United States Patent 7,504,490 (NUCLEIC ACID AND AMINO ACID SEQUENCES RELATING TO APERGILLUS FUMIGATUS FOR DIAGNOSTICS AND THERAPEUTICS) - sequence listing, part 2

SEQ ID NO: 5214 - DNA, 525 bp, A.fumigatus
  unsure (518): Identity of nucleotide sequences at the above locations are unknown.
taccatagctcggttccttcgaccccctgtggtagaagacagccggaggaacctccccgccgcccgtctgaagacaccgtcgccggatcgggagggcttcccgacttgaagtacggcacggtcttggatgaactcccgcaggactgggaagtcgtcccgggtgagagcatggggaacttctacgcgggcaatatggccattatgtccgcagatacgaacttcttcccggcttccctgccaaatgacggtctgatcgatgttgttacaattgatggaaccatcagccgcctcacatcgctcaaaatgatgacagagatccctgagggaggattttttgatatgccggatgttaggattcgtaaggcttcggcatatcgactcactccccgggagaaagatggctacatcagtgtcgatggtgaacgtataccctttgagccgtttcaagtcgaagttcatcgtggtctaggtacggtgttgtcgaagtccgggcacctttacgaagccgaaggtccgangccatga

SEQ ID NO: 5215 - DNA, 849 bp, A.fumigatus
tcaactaacaatacccccattcgcataggcttctaccactccgaccgtcccctcacacaacaagccctcgcccgcaacctctcgtacgcgctcgtcccgactctcccgcggcagacactccaccgcttcctgcgcgcgttctggatcaccatcgggagggacttccactcgctggaccgtttgcggctcgataaatatctctacctgatccgctgctacgtaggcgtggcattcgagatcttcctcaaggggaacaagggggagcagcagcaatccacacataccaacggagccagcaaaaagcgcaagcgcgaagaacaaaccgcggcggggaagaagaagcgctcgaaagcagacaaggaggacgaagcgcgtgatgaagcggatgtggaggagggacaggatggcgagggtgactgggccgagctcgagtcatacatgaccatcatcgaggaagggcctctgtgcccgctcaatttcgacccggatcagccccctgccgatgagaagaacccgaactatgtgcctatgccccatggcccggatgggcttcgctaccacttgctggatatctggattgatgagatagaaaaagtgcttgagttcgaggagggggagacacaagatggttcttcgcggaaagtcaagggtcaggttcccatggaactcctactgcgccccattgagaagctgcgcaaggagagtccctttaagcctgtgagaacaagagcggcagaaaccttaaacgacgaccgattggttcagtggggattcaagactagggaagttgaggaggaggatggcgacgatgatagtgagcaggaatggggtggtttcgccgacgattga

SEQ ID NO: 5216 - DNA, 1677 bp, A.fumigatus
  unsure (1104): Identity of nucleotide sequences at the above locations are unknown.
aaaattactagaaatgcagagtcccgaattaggaaaggcggcgacagctcagatcttagcttttccctccatcgacccatatctcctgcgcatttatacctaccttcacgacctcggcctgccatggcgtcgtttaaatcaccgtacatctgcctcaattgcagattaacgagcagactcacccgacgcaacttcgccgcgtctgctcgaaccttggaattgctgcgccccgcaaccgctccgaaacccacccccgacatcaaacatatccgccagaacgcagagctctactcgaaaaacagcgtggatcgaaattacccgacacacgctgactatccctacaaaatccaagagctctcggaagaagcaaggcgtcttgatcaagatctcaaagcgccgcggtcccgcatcaagcaattggagaagacgatagcgaatcttgcggcatccgctcgccaaaatggcgcgtcaagtgccattgaggaagaattggcatctcttcggtcagaggcacaacgattgaaggatgagtcgcatgcaatgaatacccggagaacaacttgcaccgaagaaatccaacggctcgccctatccctaccgaacctttcctcggccgatacccctgttggagacgacccaaagctcgtcacgtacatcaatttcgaccctcaatccccgccagaatgggttagccgtccagatccgtcgcggtctcatgtcgctatcggcaccgcgctagaactgatcgattttacaagctctgcgaccaccacaggctggggctggtacttcttgacaaacgaaggagcgctgctggaacaagccctggttcagtacgccctcagcgtggcccgcaaccgcggctggaaagtcgtgtctccaccgtcgatcgtctactcctacatcgctgaagcgtgcggctttcagccccgcgaccagcacaacgagcagcagatctgggccatcgagcagagcgacaaggacaagagtaagccccagcgctctctgaccggaacagcggagatccctctggcagccatgtacgccggtcgtgaccttgacgcttcctccatccccctcaaactcgtcggcgccagccgctgntaccgcgccgaggcaggctcccgcggcgtcgacaccaagggtttgtaccgcgtgcacgaattcaccaaggtcgaactattcggatgggccgacactctccccgcaaccatatcctccgacaacctcttcaccgagctcctcgacatccagaccgagatcctcaccgccctgagcctcccttgccgcgtcctggaaatgcccaccacagatctcggcgccagcgccagccgcaaacgcgacattgaggccctcttcccgtcccgactgcgcgtccccggttccagtagcggcagcggcagctcctcgcctgacctcgagtccggctggggtgaagtcacctccgcctcgatctgcacggattaccagagtcgacgacttggcactcgtgtgcgcggcggctcggcgaaggaatctcgcttcccccacaccgtcaatgggacagcgatggccgttccgcgtgtactggccgctatcctggagaatggatgggatgagaagcgaaaggtggttgtgattccggaggtgctgcggaaatggatgggcgggatggaggttattggagagaaatcgtag

SEQ ID NO: 5217 - DNA, 423 bp, A.fumigatus
tggtcgcatcagagacctgagagagtctcgatgcatctattttctcctggccgagacattgagacttccttcttctccatatctgaactacagttgcattcgatccgagttcgggcgggtgcagcccagttggaaccgaatcactgcaatttcgagtccgaatttgcaatcagaaatctaggatctatcaattgtatcagaataacttcgaagagaaataatctaggacgaaagtataatcgctacatgggtgctctatctaagaaagggcagactctattgacttgccagaattacgttaaaacagctatcccatattccctgggagattattatatatacccattaataggcccctctggtgctgttataactggccataattccaagcccaaggattatttgccaatgttcacaaacccc

SEQ ID NO: 5218 - DNA, 282 bp, A.fumigatus
tatgtaagtattgacccccctttgtcctcttgtaaaaaggaggagcaactgacttttgccagctttgatgggttcggctcctaccctgagcatatgcaatcctcgaacatgttcaagaacatcgggcgcattggtattgagatgtatctgctcttccaacaccatacgacgctggacatcttgcgaaatgtcaacaccgacatagatcttttcaccatcacggggatcgggttggcattttgtcaagtatttaggaccagctgttgtcgtcgttggcgctga

SEQ ID NO: 5219 - DNA, 1725 bp, A.fumigatus
tatgcaccttcggggatcgcgggcacctcaacactggcagggttgcatgcacaaagtgctgccgcccagcgaatagcagaaccatacgccggtcaattacctcgaacccagcagcaccagtttcccactcagcgaccttggactccaacagagcagccggggtctcaaccacatggtccacccacagtttaccagggtgccgaggccgttgaatcacgatcaccgaatccaccggccagttcctatcaacctcctccacctcaacctgtcgcaacgccgcctcatgccgctgctcagggccagcagccgccatggattccgcctaacgcactggagcaagaccttgaaaggatgcgtattatttcctcgcctcctcctgcgtactcgagtgtatccggatctgctgctccccaaggctatcccaatgaaaagcagcgtttgtcggcttccatgggccatccagctcttgcagcaagccatccaacaaccatggctactcccactgctgctgctgctgctccgacggtctcgccccaagatcatccggcgtttgccaacgaaccccggcagcagtccccggcaggtttttcaccacagaatggtacttcggccgggcgccagcctacccctgtgcagaatgcaccagccacttccgtgcccggctcatcgacgcttcctccagcctctccgccgccgctcccagaagggtggatagcccatctggatcctaattcaggacagtactattatatccacctcccaactcagtcgacgcagtgggaatttcccaagggaccgactcctttgaacctgaacgaaactccgttgtcaccggtcggcagcgtgtacagtagtcatcctcttgcctcccccggtttctcaacttttgggaagccactggcgtctcccggcatccctctaacgcctggtctagctcccggctatgagagtctgcaatcacccgtagtgactggtttcagcgggccccctccaagcagtggggttgatctgtacaaagttgctccaaccaacggtgtctacttcggaccctatctccggtacacgaacatggatctcgagcgcggtatctggctgggctctattctgctggtcaccgacgctgcccagccgccaaccatccacattcatcaaagcgtcgatctgtcgcccaatccccggcagctcaagccaatgagcattgccgtgcaccagcgctggacgttttacaagtacgaggttgacttgcggatggaggagtctggtcccgccaagtggacgtatgccattacgtcgcaccttggctgcactcgatacgaattcctcgtggctggtcggtacgagacgaactggcgcttcgtcgccacttccggcaacgacttctcgttaaacgtgaatgcaaatgagaggtcccgtctgggaggaatcggtttcatgtggaaggacatcatgcagaaacatattgagattgggggctttcatgcgcagctgtgctgtggcggccagatttacgcggatcgaatgtggaaggagattccatcactgaagcagtggcttgcgattagtgggaaagaggctcgcaaaaatgcaccgtggacagcagcgcatgaggaggacgtttctcatgcttatttccattattacaccagtcattttgaccagccttatttgagggagtcgtttgctcaggttccgtacgtctgccagctcgatgaccatgatatgtaa

SEQ ID NO: 5220 - DNA, 237 bp, A.fumigatus
gctgtgacatgggactgcgagcccatccatgcgaaatgctggtcccatgcacgttctcaaagagtacgaactcttctgttttttttttttttttccatcaccgtgggggctagaatcgctgacatgtacagttattttcatgacgccagtacctacgagaggcctgaaggctttgaattcttcgtttctccccggagtggagggaagataacctgctctgcagttttcccggggtga

SEQ ID NO: 5221 - DNA, 213 bp, A.fumigatus
agtcctctacttattaagatcaccacctataccatcctggctggcttccctttcctcgctttgaatagtagcctggagaagggccacagtattgatattgcgggttgggttaatatcctacaaaagactggcgctttgaggtctgaaacaacagttagactactgatgagattgacttacattagctacaaaagctatatatcccatcaataa

SEQ ID NO: 5222 - DNA, 771 bp, A.fumigatus
  unsure (101),(256): Identity of nucleotide sequences at the above locations are unknown.
tccgtcgccccaacaatccaacaggcgccaccgcccttggccataattggcccccacaggtatttttccttcctagttcggaccccgccgaaaagcaactntccccgtcttcgtaaacaggcatcttcgggcgccgtaaaagtactctccggtcttctcgtcgtcatcaatctctccgaccgttcggcccgccgccagctcttcttctccggcgcagcagccatgtccgcatgcatgttcgccaccgccgccgtcntcaaatcttcccccccggcacctgcctcaccaggatcctcccaaggaagcaccaccgccctcctcacgccagcagcactcgcaaccatcaccctgatctacctcgacatcaccgcctacaatctctcctgggggccattgccctggccctgcgtgtctgagctcttccctacacgcatccgcgagcccggggtcgcagtgggtgtcggcgcgcaatggatgttcaatttcgtgtggtcgtttagcacgccgtatatcttgagcaaaatcaaatgggctacgttcgtgctgtttggggggttggatctgctgattgtggggtttgtgtgggggtttgtgccggagacgcgggggaagtcgttggaggagattagtgctttgtttgaggggaattcctctcttttgtcttcttctcggggaactgagggtcattatgaggctggtcccgatggtgatggtgttaatggtaaggacgggagtatattgcctgtcgcggccggaagtgcttcttcgtga

SEQ ID NO: 5223 - DNA, 876 bp, A.fumigatus
cagttgaatatagagcttgcctctactcttgagaactcgactctcttcgagaagaaccctgaatatcgcaaggctctcgccgttgtctccgtccccgagcgtgtggttcagttccgtgtcgtctgggaggatgacaaccaccaggtccagatcaaccgtggttaccgtgtccagttcaactccgctcttggtccctacaagggtggtctccgtttccacccctccgttaacctgtccatcctaaagttccttggtttcgagcagatcttcaagaacgctctgaccggtctgaacatgggtggtggcaagggtggttccgacttcgaccccaagggcaagtccgacaacgagatccgtcgcttctgcgtggccttcatgaccgagctgtgcaagcacatcggtgccgacaccgacgtccccgccggtgacattggtgtcaccggtcgtgagatcggtttcctctttggccaataccgcaagatccgcaaccagtgggagggtgtcctcaccggcaagggcggtagctggggtggttctctgatccgtcccgaggccaccggctacggtctcgtctactacgtcgaccatatgatcaagtatgtcaccaagggtgccgagtccttcgccggcaagcgcgtcgccatctccggctctggtaatgtcgcccagttcgctgccctcaaggtcatcgagctcggcggttccgtcgtctccctgtccgacagcaatggctccctggttgtcaacggcgaaggcagcttctcccccgccgaagatcgaaatcatcgcgcaactcaatgtcgaccgcaagcagctctccgatgttgctaccaccgaagtctttggcaccaagttcaagtttcttccaaggcggcc

SEQ ID NO: 5224 - DNA, 285 bp, A.fumigatus
tcaagtatgtcaccaagggtgccgagtccttcgccggcaagcgcgtcgccatctccggctctggtaatgtcgcccagttcgctgccctcaaggtcatcgagctcggcggttccgtcgtctccctgtccgacagcaatggctccctggttgtcaacggcgaaggcagcttctcccccgccgaagatcgaaatcatcgcgcaactcaatgtcgaccgcaagcagctctccgatgttgctaccaccgaagtctttggcaccaagttcaagtttcttccaaggcggccg

SEQ ID NO: 5225 - DNA, 636 bp, A.fumigatus
ggccgccttggaagaaacttgaacttggtgccaaagacttcggtggtagcaacatcggagagctgcttgcggtcgacattgagttgcgcgatgatttcgatcttcggcgggggagaagctgccttcgccgttgacaaccagggagccattgctgtcggacagggagacgacggaaccgccgagctcgatgaccttgagggcagcgaactgggcgacattaccagagccggagatggcgacgcgcttgccggcgaaggactcggcacccttggtgacatacttgatcatatggtcgacgtagtagacgagaccgtagccggtggcctcgggacggatcagagaaccaccccagctaccgcccttgccggtgaggacaccctcccactggttgcggatcttgcggtattggccaaagaggaaaccgatctcacgaccggtgacaccaatgtcaccggcggggacgtcggtgtcggcaccgatgtgcttgcacagctcggtcatgaaggccacgcagaagcgacggatctcgttgtcggacttgcccttggggtcgaagtcggaaccacccttgccaccacccatgttcagaccggtcagagcgttcttgaagatctgctcgaaaccaaggaactttag

SEQ ID NO: 5226 - DNA, 381 bp, A.fumigatus
tggctgtcacttgacaggactggagccaacgacagggacgagacgagaggctgtcttgtagaaaagtcgtcgtccgagaaacaagctcctaggctgagggtgaaggtccgcctttatttcggagtcgagtacgccccaggcatcaacaaggcaccaacaaggctagttcccgaggcgtccactaaaactctgaccaataggactgcatcgtggtttggcggctggggtcatccatggaacatcaatgtgactgatcaactcagtgtttacaactctttacgacaaactggatttaatgttttcgatgtcttcttacggaaaaaagtatctgagtatctattaccgtttcatcccataaggagtactctgatctgtggtgcg

SEQ ID NO: 5227 - DNA, 210 bp, A.fumigatus
ccattgtgtaggatcgtgacagaacatgccaacggcatcttgctaaggacaaattatggccgggacacaaccacctatatgaaagaccatgaccctgtaattacagatcggctgacaaagattatcgtcatcaggctggtcgaggaatcattgcttctccagtgcattgcaagtttgcagcttttgggagacatttccccctcatggtga

SEQ ID NO: 5228 - DNA, 441 bp, A.fumigatus
ttgttgacccagacgcttccagccttgatggcgtttgatacacgaattgcggtattgacgttcttggtgtggacagcagaggcaagacctgtgcatgagattagcgggggtgaaccagctgggtggctggatacacttaccatagttggtgctgttagcaagcttgatggcctcctcctcggtcttgaacttctgcactgtgcaaacagggccgaagatctcctcttgaacaatcttcatatcgccgttgacatccgcaaagatagtgggtttaatgaaatatcccttgtcaccaaggcgttctccgccagtaacaactcttgcacccgcctgctttccgtcttggatgtagcccatgatgcgatcgaactgcagctgcgaaacctgaggtccttggaacgtctggggatcgaagggatcgccgactttgttctgttctga

SEQ ID NO: 5229 - DNA, 378 bp, A.fumigatus
agattgttcaagaggagatcttcggccctgtttgcacagtgcagaagttcaagaccgaggaggaggccatcaagcttgctaacagcaccaactatggtaagtgtatccagccacccagctggttcacccccgctaatctcatgcacaggtcttgcctctgctgtccacaccaagaacgtcaataccgcaattcgtgtatcaaacgccatcaaggctggaagcgtctgggtcaacaattacaatatgatctatccccaggcaccattcggtggctacaaggaatcgggtcttggccgtgaactcggctcttatgctcttgagaactatactcaggtcaagacagtacacatccggacaggcgattgcccgttcccctga

SEQ ID NO: 5230 - DNA, 207 bp, A.fumigatus
tctatccccaggcaccattcggtggctacaaggaatcgggtcttggccgtgaactcggctcttatgctcttgagaactatactcaggtcaagacagtacacatccggacaggcgattgcccgttcccctgaagcagtgacacagtgcgctttcgagggaaagtactctgatttaacgaattcctttgtttatcacgttcaggcctaa

SEQ ID NO: 5231 - DNA, 624 bp, A.fumigatus
gctttgaaatgggcgtcatttggaatttatttcaaccatggccagtgctgctgcgcgggatctcgtatccttgtccaggagtcgatctacgaggagttcctggctcgattcaaggagcggtcagaacagaacaaagtcggcgatcccttcgatccccagacgttccaaggacctcaggtttcgcagctgcagttcgatcgcatcatgggctacatccaagacggaaagcaggcgggtgcaagagttgttactggcggagaacgccttggtgacaagggatatttcattaaacccactatctttgcggatgtcaacggcgatatgaagattgttcaagaggagatcttcggccctgtttgcacagtgcagaagttcaagaccgaggaggaggccatcaagcttgctaacagcaccaactatggtaagtgtatccagccacccagctggttcacccccgctaatctcatgcacaggtcttgcctctgctgtccacaccaagaacgtcaataccgcaattcgtgtatcaaacgccatcaaggctggaagcgtctgggtcaacaattacaatatgatctatccccaggcaccattcggtggctacaaggaatcgggtcttggccgtga

SEQ ID NO: 5232 - DNA, 2082 bp, A.fumigatus
  unsure (2040): Identity of nucleotide sequences at the above locations are unknown.
gcggttccttccagccccgtggtgaagacgaagttgggcgtcatcactggtgaccaggccgtaggattcttcatgaaagctcaattgcctgaagaagtcctagctcagatttgggatctcgcggatattgacgctgacgggcaattgacgaaggacgaatttgcggtcgcaatgtatctggttcgttcacagcgtacaggaaaggagcccttgccgcagacgcttcctcccgctttggttcctcctagtatgcggcgtcctaccacggcgcaggcagtgccgccgcctcccccaagtgtccggtctgctgcggatgacctcttcggtcttgacgcattttctgctcctcccgcacctgcagcaccttcacaagtaccccagtccacaggaggttccaacacgccgttccagacgccgggttcacccacctccagagcgtcacctccagccaactcgacgacttttaagcctttcattccgacttcctcatttggtcagagtctccagcctcaaataactggcgcttcagccggtgccccgccaccagtccgttcaccaccgcctccatcggatgaccttctaggtgacaacgaccctgaggaatccagtaaactcacacaggaaacggccgagctggcaaatctatccaaccaaataggctcgcttgccaaggagatgcaaaacgttcagacgaagcgcacttctgcggagcacgagctgtctcagacatctcagcaaaagcgtgactttgagactcgcttagcgcaagccagagcgatgtatgaacaggaggtcaaaaatttcaaagctcttgaggagcgactgaacgcctctaaggcggagactaagaggttgcaacaagaatatgcgttgatcgagggcagtaggcaagatttgcagactcaatataaccaagtttctgctgctttgaccgccgaccaacaggagaatgcgaacttgaaagagaaaattcgccaagctaatgctgctgtcgcccagcttaagcctgccctcgagaaagcgcgctctgacgctcggcagcaaaaaggccttgtcgcgatcaacaagaagcaattatctacagtggaaggtgaacgcgacaaaatccaggaggagatggacacgctctcgaaggaacaacctcaaggatccgacgaaagcgctgcacccgcgctcgcaagccctgctctgtccacggccagtcaaaacaacaacccattcttcaggcggactaccacagcatcaagcgacgggcagggagcgtccccccaggtttcgagcgaacagcaacgtgcttttgacagcctctttggcactgcctttgctcctccgaccactgctacacccccacctcccacttcattccgcgccgactctcggcaggcttcgctccactctcctgttacatccggggtaccaaccccctctgtatcaccgccaccttcggttgggaccgtgcctgaacccccgcagtctcggcagttcacccctaacgttcttcccttagccgagacacaatctgtgacctcatctaccaagccatctccgccaggtagcagatttggtggtcctgagtcatcaactgtagggactccagccccagcaggtgccaccgaaattccctctgcgagtccagaacacggggaagtacggtctcccttcgaggagttcgaagagtctaagcgcttccccgaagttccagtcgtctctggggaaacagcaagagcagacacttcggctactgccaacgagaaccagacagccgcaaaggaccccagcttcgatgagctgtttggcggtccagcacatcagaggtcacggtctcagaacgcgaatgattttgaagaagcttttgctgctatgaaacagggtgctggagccaaccaagccctaatggtacagctcctgctgcgctctccgagttcccgccgatccgggagctcgccgatgatgacaatgacgacgacagctttgatagcgaggcacccttggggtttcgatgaacattttccacccgactggttcccccccaagaacagncaaacgttaaaaacgggacccgatgggacccatctcaattga

SEQ ID NO: 5233 - DNA, 723 bp, A.fumigatus
gctcctgcgcggatctttggctcttcgtggacaataccccgcaggctcatcctcggcaccggcatgaaggacatcctgccggagacgcccgggctggacgaagcctgggggaaaggcgtgtactggtgcccctggtgcgacgggtgggagcaccgcgaccagcctttcgggatcctgggctccctcgtcgacgtcgtgggcagcgtgctggaagtgtacacgctcaacacggacatcatcgccttcgtgaacggcacgcagactcccaaggctgaggccaagctggcggagaagtaccccaactggaagaagcagctcgaggcgtacaacatcgtgctgaacaatgagactgtcaagtccattgagcgcgtgcagaacggtgaggacgtctatgatgaccagggccgccagttcgatatcttcagggttaacctcgccgatggctcctccgtcacccgcaatgccttcattacaaacttcccctcggagcagcgctcatccatccccaaggagctcggtctgaagatgaaggataacaagatcgacaccaatatcgatgggatgcggacgagcctgccaggtgtgttcgctgtcggcgatgccaacagcgatgggagcaccaacgtgccgcatgccatgttcagcgggaagagagctgctgtctttgttcacggtatgtatcttttttttccctacagatgtcgaacttgggcagattactaa

SEQ ID NO: 5234 - DNA, 429 bp, A.fumigatus
aactggctcattttcgtcactcgcggggtggagacgtggccgtccatccacttcgtcactgccattctgggtgtggacgtcctggccaccattttctgcctgttcggttggttcacgaacgagacaatgccgaccaaaccggccgactcgttcgtcgaaacccgcaacggctggacggatattgtaaccgtcgtccgtgtctggggcttctcgctcggtgtggagattgtcattgcgctcgtgtactacatgctcaacaaattcaagtggctcgagaaccttggccgagccaagcgagacaaaggcgatatcaagatccagaatctgctcggtcatctggctcggttgaccgtcgagtacgatcagcccggtcagcctaagggccgcttcttccttacatccagcaaggaagaagaggaggctgagtag

SEQ ID NO: 5235 - DNA, 546 bp, A.fumigatus
cgatctgcgcaggttgagcaatctggcacttattggtaccattctcacacaaaaggccaataccctgatgggctccgacaagccttggtggtgaccgatcccaagaacccgtatattgggcagtatgatgaggagcgagttattagcctgtccgactggtatcacgaccaaatgccaacactcttgaagtcattcatcagcatcagcaatcccaccggcgcggagcccgtgcccaaagcggctctgatgaacgacacgcagaacctcactgtggcagttgagccgggcaagacgtacctcttccacttggtcaatgtgggtgcgtttgccagtcagtatttttggatcgaagaccacacgatgaagattgttgaggtggatggtgtctggacccatgcgtcggaggccaacatgatttacatcgccagcgcacagcgctacagtgtgttggtaaccatgaagaatgagacgagccagaattacgccatggtgggcagtatggatacggtatttgcttccagtctccaggatgatgcccagcgctga

SEQ ID NO: 5236 - DNA, 222 bp, A.fumigatus
gatctcttcgatacacttcccgaatcgttgaactacaacgtgacggggtggctgatgtataatgaccaggctgacaagccaactcctgcgttagtctccgcatttgagccttatgatgacttcaacctggtgccagtggatggcatggcgctgcacaaggaagcagattacaccgtcactctggacgtgacgatggataatctgggagacggggccaattag

SEQ ID NO: 5237 - DNA, 309 bp, A.fumigatus
tcccggtatgtgtctagtctagcagcctcttcattgcaacaagaagctgatcacttggatcccccactaggcgtatggctctttcactgccacatcgaatggcacatggattcagggctagcggcgacctttatcgaagcgcctctggacctgcagaagacgctcaagatccccgaagatcactaccaggtctgcgaggctagcgggaacctcaccgcggggaatgcggccggaaacaccaacgatttgtttgatctgacggggcagaatgtatctcccgcaccgctgccggcgggcttcacggccaac

SEQ ID NO: 5238 - DNA, 279 bp, A.fumigatus
ttcaccgttatcccggatggccatttcgagcgacttgtgattggaatcaacggtcaatggccacctccagtgctcagttttaccagaggtgaccgcatcattgcaaaggtgcataatgcgttgggaaatgagaccaccagtgtccactggcatgggttcttccagaatgggaccaaccatatggatggccctccgtcggtcactcagtgcgatatcgctcccggctatacctttgtctacaatttcaccgtcagtataggatgcggtagaagctcctga

SEQ ID NO: 5239 - DNA, 462 bp, A.fumigatus
cgatggataatctgggagacggggccaattagtaagagcaacacccacacggcccgattgtcaggatccaaggaactcgggctgaccttccatagtgcttttttcaatggaatcacctatgtcatgcccaaggttccgactttgtattcggtcctgaccactggctcagcggccacagaccctgccgtctacgggtacaacactcacccgattgtcctcaaaaggggggatatcgtggacattgttctcaacaacgacgatgctggaaagcatccgttccacctgcatgggcatactttccaggtgattgcgcgcagcgaagagaacgcgggacactatgaccccagcaaccacacgacattcccatccatcccaatgaggagggatactgttatagtccgcccgcagggcaactttgtcctccgtttccaggccgataatcccggtatgtgtctagtctag

SEQ ID NO: 5240 - DNA, 726 bp, A.fumigatus
tccatccggctggctaatactaaggaccgaggtttctggctcttcggcagactatactgggatgtcgacccatactcgtaccttgcccttagagtgaagtccgacggtcggcgatacaccgtcaatatccagacagactcgatcgtcgagacggatatccaccagcatagattatatactcgtcatcaccgtgtgcgaaaccagacctcccgtgatgatcttccctcatacccgtcgcaagcagtcgagtcaccagagctcgcagaaactctcttcccgcgcggaattccttcttcgctctccgacgtcccccccgaatcgacgatcatgtactcttctgcaacaacatccggtggcacgggctgggagaccatcctcctgccattccactcctttgttcgtacgaaccacggccttgtggtcgagccgcaaacatctcttctccgacagcgagtgaagagtgtcggtatcggtcttacggatcgagtcgatggtccttacgacttgcgaatccatcgtatctgggctaccaacgggatcagcgaagaagagttcgaggatgagaagcggatctgcggtgcagatgcgctgcctattgatgagggagtcagaactggctggaggggtgactctccttccgatcatcccgaggacaagggtagtcaaccgggaggaggagggaagacgaagggtttgaaagggttgcgctcggagtgggaacaatga

SEQ ID NO: 5241 - DNA, 1182 bp, A.fumigatus
gtcgctctggctattgttgtcacgttcctctatcttggcgcctcctacttcggcatgaaatatttgcgtcggatgggctgctcccccaaatatctcccgggaaaatatttgaaagacaaatggaaccgttgggaccctggaaagttctataaccaagtctcaaatgacattcggaacggatcggctactggcgctgaagcaacggagatgataacagcgagaacgaccaatcctatccatcgagacgcttccattcggtccgtggccactcttcctgcctattctgcaaatcccaagcccgaggaacgggtcatcgcacgtgaaggtgaaagagacggtatggataccgtgatcgagtttcccgagaccgctgaagaagaagaggctcgccgggaggagctcatggcatcgctttacgagatccgccagcgccggcgtgaggaactggcagaacgcgaggctaggcgacaggcacggcgtgaggctcgggagcgtggagaccgcgctcagctagagctcttacggcaacaggatcgacttcgtgctcgccaacgtgcaagaagtcggtcatcaaccaatgccagcaatagtgcatccaacctcgctacggctttagcggagcatcagagtcgtggtcgtggcaggaggattgccagtgtgaactatgcggacgtgggctacgttcgtcacgatggatcacgagtccgcgcaacttcacccgattccgaccgtcgccccctactgtcgaacggcccttccggcagtttcgatgcctctaataggtcatccatggtcgataccccgagcattcactcgcggggagagtcctactcatccgcctcgactggtaccgtcgatccaagtgccttgactagggtgcactcccagacacattctaccgcctctaccttgccatctaccccaggtgctgaggaggccgatgttggtgttctcagcattccccctccggaatacgatcatctggactggggcgaggcccctccgtatcaaagtcctgtcgaggaaaggaacgaaaatactgcacctcttcgggagctaacagttgtgcctaccattcatattgatgcagcgagccctatcagcgacaatttcccagcggctgctcctcatgagtccagagagcagcacgattcgcgtgcggttccttctgtaactcgctag

SEQ ID NO: 5242 - DNA, 240 bp, A.fumigatus
  unsure (77),(98): Identity of nucleotide sequences at the above locations are unknown.
atgcttgcagcacgctctttggttgttgttctccatatggtggacaagaactgtttaggcggtcactccaacagtanctccacccggtcgagtaaacnaatccacaactcctccagcctcctctttttccgtcccgcagaattcaaactaacttctgatcatcaaccgcattatttcgcggctgatggcaataatctggactttattaattgcatcccctcttccatggccctccgttga

SEQ ID NO: 5243 - DNA, 543 bp, A.fumigatus
tatcatcatagaattctcataatcttggatctcgaggtcctgcaggaactcggcgaagcagagaaaatcggagaaccgagaccattggaaaataagttggaagaagatgaaaagccccaaccaactacaatttccggtggtggattttatggctccaaggttcaaaatcagcgaggggaacctcgcgtacagcctgcacgttcctctttgacatcgtcccacgccaccatctatccgatcgaagctatctctccttattcacataaatggacgatcaaggcgcgttgcacgagcaaatcagccatcaaaacctggcacaacagaaactcggagggtaggctatttagtgtcaacttactcgatgatagtggtgaaatccgtgccacgggattcaatgagcagtgcgacctgctctatgacgtttttcatgaaggaggcgtgtactatatatctagcccctgccgggttcagattgcaaagaagcaatttaccaatctgaacaatgactacgaacttaccttcgagaaagatacagttgttgac

SEQ ID NO: 5244 - DNA, 267 bp, A.fumigatus
aagaacagcaaccaatacggtggttatgtcttcccctgctccaccaaacttccttctttcactaccgtcatcggaggctacaatgccgtcgttcccggtgaatacatcaactacgcccccgtcactgacggcagctctacctgctacggcggcatccagagcaactctggtttgggcttttctatcttcggagatatcttcctcaagagccagtacgtcgtcttcgactcccaaggccccagactcggcttcgcccctcaggcatag

SEQ ID NO: 5245 - DNA, 216 bp, A.fumigatus
cttcttcatctgacacgttgtgccaatctgaccagagaaatggtagaaaaagtgcttcaatacgacaaccagtcgtccacggattactcgacacccgtcgttgactcactctccgaggatgggcgcgagatcgagcccaaactgcgtcgcaagctggatatacgaatcatgcctgtcattattctgatgtatctcctcaacttcattgaccggtaa

SEQ ID NO: 5246 - DNA, 351 bp, A.fumigatus
tcgcatccgcagagctatggacgattcaagctgacactagctaggtcgaactataccgctgctcgtctccagggtctagagagtgatctccatctctccggctcggaataccaggtcgggctctcggtattcttcgtgggatatgtcctcgggccaattccatcgaaccttcttctgaattatctcggccgtccgtcggcttatatcggtctctttggtgccgcctggggattagtgacgctcttaacctcgcaggtgaaaggctatggatcccttgctgcttgcagatttattctgggtgtagttggtaagcctagagtttttctactgggagattggggcctggactga

SEQ ID NO: 5247 - DNA, 306 bp, A.fumigatus
cctacgcagaaatggtacacgcagagagaactaggtgtgcgaatgaccatattcttttcagccgcgcatattgccaatgcctttgggagcttgattgctgccggcatcctgaacggccttgacggtaaccggggcttatccgcctggcgatggctatatatcatcgagggagctagtaagtacacttgctctgatgaccgaagcacactcactaaccacggtgagtctccgtcttcctcggcttcatcgcctggtacctactgccagactttccagagaactggcgtgcactatcccccgagatga

SEQ ID NO: 5248 - DNA, 183 bp, A.fumigatus
atctccctggggaagggatttaaaatcatgcgtaagacaacacatagctgttacctcattatactaccttttattgttcaggtcactggcgctgtaaatctctatagtgctatgaataacctctctgatagtatcattaggcagccacggcttctgagcacaatatgctatctgttgtgttaa

SEQ ID NO: 5249 - DNA, 198 bp, A.fumigatus
cagggtcttacccacaccgcagtgacgccattagatttagtcaaatgccgccgacaagttgattcgcagttgtacaagagcaacatggaggcgttccgcgtgattcgcaatgcagaaggcataagaggcgtgttcactggttggagtccgacatttttcggatacagcgtaagccgatggtttatggcgcggttttga

SEQ ID NO: 5250 - DNA, 456 bp, A.fumigatus
tcgcaacatagtctctacaaaggcttgtatccactctggggtcggcaaatcccatacaccatgatgaagttcgcgtcttttgaaaccattgtggaagccatctacaagaaactgccccggaagaaggaagagtacggcaagggcgcgcagactgcagtcgcctttactggtggttacttggccggtatcctttgcgccgtcgtgtctcatcccgctgatgttatggtgagtaagctgaatgctaaccgactgcctggcgaggcatttggtgccgcaattggccgtatctacaaggacattggcttcatgggtctttggaacggtctccctgtcagaatcgttatgatcggaactcttgtaggtcctccttttgcacgtgtttgcggtcatgagctaacaaccttctgtacagactggattgcaatggatgatgtgagtttctcccttcaagtgtga

SEQ ID NO: 5251 - DNA, 348 bp, A.fumigatus
  unsure (16): Identity of nucleotide sequences at the above locations are unknown.
tcaattccaaattggncaaccatgttcccttttgacagtgtgatcctcgaggccttcaacgcccagaaccttttgaaccgtcctaaagagcccaagcaagcgggatctgcggctttgatcagacgggagcctttcccggcgtggagcgtgattgatgagtctaagaggaaagccgatgcctttgctaaagaggcggctcgagaattcgatgtcgtcagtcaaaaggctcaagccaaaacaggcaagattgagccatggacccccaagtactatgcagcttgcaccgtcggaggtctgctggcttgtgtaggtctcaggagtgatattgtctatttgatctatatttaa

SEQ ID NO: 5252 - DNA, 270 bp, A.fumigatus
cagggggcaaaggctcaaggagcattcaaatatggcggttacgaatttttcaagaagttctattctgatctcgtgggaccggagcgtgcccataaatggaagacctccgtgtatctggctgccagtgcgtcggcggaattcatcgctgatgtcgccctatgcccattcgaagctgtcaaggtgcgcacgcagacaactattcctcctgagttcaaggggactttctctggaatttcccaggtcatcggcaaggaaggagttgctgggtaa

SEQ ID NO: 5253 - DNA, 378 bp, A.fumigatus
ttattcatcgtcggcacatgcggctgcttcggctccgatgagacgttggcttgtttcgtggccgggaacgcactgaactgggacgggctgtatcacgccgagttgcaggcccggcatgacgccttcaactcgaccctggaaacactgttgaatttcgggatctgcatgtacctgggcgcggtgatgccatgggatcaatttcatatgccggacacaactggaatcaccgtctggcggctgatcgtattgggattcctcatcctgctttttcgccgtatgccagcgatcttgctcgggtaccggtttatgccgaaggtgtgccgtaactggagggaagccttgtttatgggatacttcggaccaatcggtgagtcttaa

SEQ ID NO: 5254 - DNA, 411 bp, A.fumigatus
tgttgcagtacgtttccctttttggacaaccacggaatgaagcttatcgtccgcagcatgcaataccatcagatagtcatcttcactcacagaccatgggtctcgaaaaactatatccaaccacgcagcccgcgccagggtcctggctaccaccatgcgcgccgaatgtgcatcgagtcatcgacagccatcgcgcgaatcctccacatatacgaaaagcattataccttccgccggatgaacaatcaggttgtcgcgatcatcttcagcgccgctctgatgcctccctacatgaaccttctcgaacacattcttcatcctgctaagaatcgctgcgaaaaattccctactgcaaccgctggaaatgggtggcgttccctgaaactccggcttctgcccctctgggaataa

SEQ ID NO: 5255 - DNA, 258 bp, A.fumigatus
caaaatcataggtgtgccgttggcagtgcgttcgaagcacggtaccaccctacttttatcacgtttcccaagtcgctttccgaatttttcgcggatcgagccaaggctcttctggaaatcgaactagatactccatgtgttgccacagtgcaggcgctggtcattttgagctgtcatgagggggcatcaaatcgtgatgcacgtggttggctttatagtggtatgtggggaaccaagcaaatggacggccggagctga

SEQ ID NO: 5256 - DNA, 306 bp, A.fumigatus
aacgtcaccttgaacgagatcgccaccaccacctacggcgagaatgtttacattgttgggtccatctccgagctcgggaactgggataccagcaaagcagtggccctgagtgcgtccaagtatacctccagcaataacctctggtacgtgtccgtcaccctgccggctggcacgacattcgagtacaagtatatccgcaaggaaagcgatggctcgatcgtgtgggagagtgaccccaaccgctcgtatacggtgccggcagcttgtggagtgtctactgcgaccgagaatgatacttggcggtga

SEQ ID NO: 5257 - DNA, 240 bp, A.fumigatus
agtaaggtgtggccgtcgagatgcgggggaggcatctactgggactacacgcatacatacgtcaacgcgattgcaaacgagctgtttctctcgctcgcagcacacctggcgaatcgcgcttcggacaaggagtattatgttgactgggctccaacgcgagtgggactggttccaaggcagcgggatgatcaacgcgaaccacaccatcaacgacgggctgacagaaagctgcgagaataa

SEQ ID NO: 5258 - DNA, 459 bp, A.fumigatus
  unsure (414): Identity of nucleotide sequences at the above locations are unknown.
ccagatagttggacttataatcaaggagtcatccttggcggactagccgagttataccgcgcctgtcctaacgcaacattcctggagtcagcaggggagattgctagagcggctattgcggcgctgagtgactcggatggggtgatgcacgagccctgcgagcctagcagctgtacaggcgatagtacgcagttcaagggcatcttcatccgcaacctgcgcttgctgcacagcgtggccccagacgaggagtactcgcgggtgattacagcgtcagcggatagtatctgggtgaatgatcgcgatgcgaacaatcagatgggggtcaattgggctggtcctattgagcgggtggatgcttcctctcataattcggctacggatgcgttggttgctgccattggattgtcgtancccgtctggtggagaccatgggagagacagagatgctttgaataa

SEQ ID NO: 5259 - DNA, 960 bp, A.fumigatus
ccctacgtggtttgtccattattctcgcagctttctgtcagcccgtcgttgatggtgtggttcgcgttgatcatcccgctgccttggaaccagtcccactcgcgttggagcccagtcaacataatactccttgtccgaagcgcgattcgccaggtgtgctgcgagcgagagaaacagctcgtttgcaatcgcgttgacgtatgtatgcgtgtagtcccagtagatgcctcccccgcatctcgacggccacaccttactctaaaccctgtcattaaatggcattccacagaccatcgagcaacccaccaattcgtcgaacactccctccgcaagatcaagatactccggtctgccagtgacatcgaacgccgcgatccacgccaacgcccaccaggcatcgtcgtcgtacgcgccatccagccactgcgaaacatcaacccctgcgcgccgccgactcaccggctgcgggcgatgatgcttaatcaccccgttgtacgtgtcattcccccgtcccggcgcggggttcgatctcggggccaccgaaaacgtattctcaaagaccccgaccgcaacctcgcgcaccgcgtcgtccacgtccgccaggtccgcaacaacggtcatacagctggccccgttccaccagccgcaggtattccagatgccgctggtggtgttgtaccaggtctgcagcgcttcgagggccgtttccgcgcgtgctgtcggcgttatagccgcgaccgagggcgcgaggattggaaagacgaatccggcgcgcattttgtgtgtgtgtgtgtgtgtgtgtgtgtgtgtgtcatcgtggatttgcaggggagagcttcgtcttttaagtatactactcgaaatgcagatgatgtgtcactgcgcaaaaaggggtcggaatgcaccacggatacatgccagggatggggacattcttttctggaaagatatgtgccatga

SEQ ID NO: 5260 - DNA, 231 bp, A.fumigatus
ggtgcgccccggaacgcggttccttccagtcccggcgtgaatagtgtgagccatgattctactgggctgtcggaaggagcacagcgttgtgtcccggcgggcatctgggcctcggaacgtggagtcacctaccatcttttccgaggcgctggacacagcgtgttcatcaagaagccccgggagatgttcgcctatgtgagggatgttgtcgttgcgcaggcaagtggctga

SEQ ID NO: 5261 - DNA, 189 bp, A.fumigatus
  unsure (115): Identity of nucleotide sequences at the above locations are unknown.
aatatcttctcaaaaatgcgttcctcctcaatctcgtccaagccagtcagtgggttgattcggggtactactgacgtcggtatgggggggaatgtttcccctgaacggggtgtcncaagtgatgagggtacggatgagttaattaggttggatttgctgcttgaccggctccgcgttccccagctatag

SEQ ID NO: 5262 - DNA, 249 bp, A.fumigatus
ttcctcgttcgatgggtctacctcggcggacccatcattttcatctgtcgtgacttcagcccctatgccccaggagaatcaaaatatgtacagccacattcccgtcactcctcaaaagtatatgaacttgtccgcctatgcgactcctcccgttcaacatacatcacgatcaccatctttgtctccaagaggccgcggctcgccaacacaaggatcacccttgcgcaacgaagccagcacaaagactag

SEQ ID NO: 5263 - DNA, 282 bp, A.fumigatus
cttacaaaaaggtgcttagatcaccacgggcttttggatacacacatacctaatcatcgaatgcagtatactaatgttcctcaagattctcctactttgatcttgaagattatgactagctgtccggtttacctaaggatcacttgctcagcctatgaacagcttccattcacacatgctaccggtgtgaagattcccgtcagggttctgcctgtcagatgtgcgactggccttgtccctggctctcttcaagaggatgttgccttcgatacaatcatatag

SEQ ID NO: 5264 - DNA, 708 bp, A.fumigatus
agacaagcgtggtggccatccatgccctctcgagtaccgcgacaaccttcataccagcacgtggtgtcctctccggccccacaaaggtcaattcaaagtaacaaccagcatgatctaatgcaggggggattgatgatccaatttgattcctcgttcgatgggtctacctcggcggacccatcattttcatctgtcgtgacttcagcccctatgccccaggagaatcaaaatatgtacagccacattcccgtcactcctcaaaagtatatgaacttgtccgcctatgcgactcctcccgttcaacatacatcacgatcaccatctttgtctccaagaggccgcggctcgccaacacaaggatcacccttgcgcaacgaagccagcacaaagactagccctcaccgccgcggctaccacggcaggaagttgtcttctcagtcaatgaacacacctaagcccgtcaaagggccaaactcgtcgagtcccggatcgggatccaacaagtcgctgacagtgtcgtttgtcaatttcactccaaacgacagcaagaaaattctcactggagtcgctccgagtgggagttccaagactaaagcaagacgcgagcaagaggcccgcgatcgacgccgcaagctcagcgaggctgccatcaatgcagtacggaaagctggtggagatgtggaagcactggaggctgtcctctgctaa

SEQ ID NO: 5265 - DNA, 471 bp, A.fumigatus
ggaccttccagccccgtggtgaagactctaggtaagctaacggaaagatttacagcccagtggcaccaatggcttcgatacgtccgtgccgaccctccctcgcttgaagaacagcagcaggatgtcatccggcaaatccagatcaagaaactcgcccaattagccgatatgcggtgggcaagcaagccctcctacctcgacaagccgcagacacagcagccggggcccgcgaccagaacgagcgatgcgactttgcatccaccgatgggagcggtcggcgagggtcccaagtcgcataacgcgatttctggcgctgaggctacaaaaacaacaggaacgacgacgtcagcaccaacaccaacccctgatgtgacatcgagggcgaaagaggatccgtgggctaaagcacgaacgagtgatggcgagaactggcagcccgagtcctggacaccgtcttcttcgcggagatga

SEQ ID NO: 5266 - DNA, 555 bp, A.fumigatus
agaccagaagcgcaaatcaaggagttgcaaaacctcctcgccaaaacgaaattctcatctactatgtggtcgcgcaaaggattcaaaactcggactgacagctctgtccgctcggcgctcgacctcctctgcctcgacggtgtggacatcgacaccttgatcccccacatcgaatcgccatcgggcatggcttatacaccctcctcattcgaccccataatccgaacccgggtcagcatcgaaggccgctacgccccttatgtcaagcggcaagaggcaatggcgaggaagttcctgcaggatgaaagcctcatcctacctccggatttggactactcaaaggtgcagggcatcagtaccgaggaaagacaggctctcgagcgcgtccgccccgttagtgtgggaatggcgaggcgcatcgaaggagtcacgccggcgggtgctctgcggttgctgatgcatgtccgccgggccatggacgcgagcaaagaatcatcactcgacgcagacgcgcttgagggctctgcggagagcgtgttacgtggatctgtttga

SEQ ID NO: 5267 - DNA, 1062 bp, A.fumigatus
  unsure (12),(13),(38): Identity of nucleotide sequences at the above locations are unknown.
tttttcacattnngcgacggcgctgccatgaggaaaanaccggcgaatgcccgactggccgctgaaatcagtgagaatgtgatggtggtggacgagtcccttgttcccccctgggagtctgcaccgctgaatcctggaacgcaaccggagaatgcgctgtactgcgtcttcacttccggctcgaccggcaagcccaaggggttcttgatggatcaccgagcgttctgcacctgtgcactcggcgtcggagaattactcggattgaatggagcctcccggcttattcagttctctgcgaactcgtttgatcttgcgacgttcgatcatattcttccgttcctgtgcggtgcatgcctctgcatcccatccgaggaagagaggaaaggcgaccttactcgcgcattcaacagataccgtgctacccatgccgtactcacgcccacggtgagtcgtctcctggagcccgaaaagctcaccaccttgcaggtattgctgctagcaggtgaggcgcccagcagggaagatatccggcgttgggcctccactgtcgggctgctcaacggttacagccctgcagaagctggatgcatcactattgtcaacccgtccttgcaggagagtcatccgagcaagatcggattccccgtcagcgtggtaccctgggtagtggacccagacgactgcaatcgactagtgccggctggagaggtaggagagctggtactgcagggacatacgttggcgcgaggatactttggacgcccggaccaaagtaaagcggccttcatcccgacgcctgcatgggtacgccaatttggttacgagacctatggacgtctgtacaggacgggagacctggttcgattcgatgccgaggacgagtccctggtctacatcgcccgcaaggattcccaggtgaagatccgcggtcagcgactggaactgggtgaggttgagcatgcgttgcagcaattctttccccggccccagatagtcgtggtcgagttattgacggccgagggtggccaccacgggccaaaggatccgccaagcgtacccgcc

SEQ ID NO: 5268 - DNA, 624 bp, A.fumigatus
ctcaacggctgggacattgacgttctccaagacgccatcaacacgtgccacgacggcggcggcgacatcaccaagtgcgagcccatcaccttgcagccagactgggtgacagacggctgcattcttgagcgctcgatcaacgagcgcatcgacgggtggctcgatgagctccccggatgcaaccccatccagcccgggcccgacgacgccaggcccgtgaccggctgcggcgcaccaactaccatcggcgagcccctgcactactacaccgatctcaccggcagccacgggtgggagtgggtgggctgcactcgggataacgtcggcgggcatcgggtcctagtcgggtcgacggcagagatctcggatctaacgccggcccagtgcgtggagaaatgcagtgccgaaggctaccagtatgctggcgtggagaacgcacacgagtgtttctgtggcaatagtgtggaccaggacgatatgccgagggttacgcccatgggcaattgtctgtggccgtgtgcgggcgacagcctgcagaactgcggaggatatgggtttatcggtctgtatcgcagacgccagggtggatgcaagaatctggagtatcccattgtcccgcattag

SEQ ID NO: 5269 - DNA, 411 bp, A.fumigatus
atcaacacaatgttacccacgtggttactgtcacaaacgaaggagaccgcagctagttcactcattctccagattccccagaccgaatctctcaccggacgttatttcatccagtcgcataacatccctgacgggaacgactcgcaggaatggctctgtccgtgccgcctgtccttccttcaggcaacgcccgacgcctctgacgatgtggcagagagtactggtgctcggaaggagaggattccgagccgtgagatgttcaatcttgcgctgggccgacatgtctttgcggggtttggcagaactggggcaaacatggccgccaactcccccaactccccacagcttgtcctcgtaaaccgcggagtgtcgtgcgaaatcttcaccacggggctggaaggaaacgcactc

SEQ ID NO: 5270 - DNA, 729 bp, A.fumigatus
gcacatagttgtcaccggggattacctagtcaatcactgacatctcacctcgctcattccttttccattgcacatttaatccatatggctaccaagatgggcatgggccacactgtcaaatgcgcctttcgcctgacgtccctgctcaagaaagcagagcgctcattccatcaaaaggggaaagcagtcgatcacagccatcccgctgtaccctccctcactttacccgacatcgattgctcggatcacggactcaggccgctctgcaaagagatgggaatggacgcctacaacaaggatactttctccgacagcgacagcgacagcgacacgaacaccgacaccgacaccgacacttcaagcgttttcatccctgatctggcggtgagggcgaaacccgtagacgcagacgcagacgcagacgcagtcgcaggtagcagcagtaaccatccccataacggtaaccggaaacgcctcgtccgcatcgttagcttcaagagcatcgcgcacaaccgctcgcggtggtcctcgtcgcaggagcgcgaactcgcaatcgcgcagcacgagctggcgcggtgtcagaaggcgtggagttcggagcaggagctgtggttggaatatgtgggttaccaattgacgtctgatactgtcgtaaacagccatcttcccttttttttctttttgtttacttcttggccaacaagctcaaggcatggtgcagatgactaa

SEQ ID NO: 5271 - DNA, 264 bp, A.fumigatus
tatacgcttagcgtcggactttcggcccgcgtggtgagaccagccacagttgttgaagaggatcacagaggccatgagcaggaacgtgctggtccccagcagcacccgatgccatgtatcgccaaacacataccggcacgtctccgtgcccccgtacagctcccgcgtgatctcctcgtcgcaccggaccacaacaaacgccccgtggcgcgtcgcgatcacgatatcacccggcggaaccttggcgtcggtcggccggtgtga

SEQ ID NO: 5272 - DNA, 1467 bp, A.fumigatus
  unsure (1381): Identity of nucleotide sequences at the above locations are unknown.
ggcccttccggatccctactatgccaagtgggagtggatagcttccaacctacagtctctactacacagtgggaggattcgggacgtcgtcaactgtctacctatacttcagaccagatacctacattccgaagacgagtggcgaagggcttatgtcgtattgaccttcatgcttcacggttacgtctggggcggcaagacaccagaagaggtaggctttcttctaacaagcgagtcctgcaggtgcacatgctgacactgatggttgattcccagaggattccacctcagcttactattccccttcttgaggtctgcgaccatctagagctccctccggtggccacatatgccgcagtctgtttgtggaactacaagcctatcttcccagatgaacccccatacgacctggataacctcgcctgcatcaataccctcactgggtcattagatgaacgatggttctatctcgtttcggtgggcattgaggcccgcggagcacctgccattcccttggttctacaagctatttccgcagcgcggactggaaatagcagagtggttacagagtgcctgcaaagtattgccgagattctggaccagatcggtgtgcttctggagcggatgtatgagcactgtgatccctacgtgttctaccaccgaatccggccatatcttgccggaagcaagaacatggctgatgctgggttgcccaacggtctgttgtacgatgatggaagcgaggaacctgagtatcgccaatatggaggtggcagcaacgctcagagttcacttattcaattcttcgatattgccctgggcatcgaacaccggcccaccggtgagactcgtcccgccagcactccgtccgaggatgagaaagaaggcgttacgggagcaccgcggcacgggttcattcaggagatgcgaacctacatgcccggccctcatcggcgtttcctggaacacgtcagcgctgtagctaatatccgggagtacgttgaaccgcgacgctcggacaaagccctctgcctcgcctacgatgcctgtctcgctatgctgcgggccatgcgagacaaacacatccagatggtgtcccgatacatcatcatccccgcgcgagatgcacgaaaccgtacacccgagacgtccaatgccaggaggccatcgataacaatgaatctggccaatgttcggcctggccgcaagaaactgcgtggcacgggcgggacagcactgatccccgtcctgaagcatgccctccatgaaactggggagcccgctattgacccttgggcgcgaccaatgctcgtcaatggtcctgcggagcctagcttcccggcgctgagcccttgggccagcatccggaacggccccctgnaattggtcgggctgtcccgggaactgcaccggttcatgatactgacggaaggtactgccaattggtaccccgattcagggttttga

SEQ ID NO: 5273 - DNA, 348 bp, A.fumigatus
atcctgcctacaatgcttcctcctatccccgctctcgcggactacggcgtctccccagatcatggcttccttccaccagaacccccccttgaggcccttccggatccctactatgccaagtgggagtggatagcttccaacctacagtctctactacacagtgggaggattcgggacgtcgtcaactgtctacctatacttcagaccagatacctacattccgaagacgagtggcgaagggcttatgtcgtattgaccttcatgcttcacggttacgtctggggcggcaagacaccagaagaggtaggctttcttctaacaagcgagtcctgcaggtgcacatgctga

SEQ ID NO: 5274 - DNA, 264 bp, A.fumigatus
tggcgcggctccttccagccccgtggtgaagaccccacagacgtaaggtctggttatgacggatctctctgggcagaatcctccgtggtaattggtgagcccctgctagagctcagttctgaactgactgctaattcgttctttggtactgtgcagtcggtagtcgatgcaggaagccggaaatcgtatcctcttccccacggcggcaaatgtcccccacggggagaattcctcttattcattctccagcagagtacagagtaa

SEQ ID NO: 5275 - DNA, 417 bp, A.fumigatus
ggcgaaaaggtccaagccgtaggcgtatgctgtgacaaagtgatcgtagttcaacggctacctgcgtcccccaatcccatcataccgggccgcaatggccctcaaccaccgggtcggtccagcctttccaccaggccctttcctccatcttctttgccccgcccaggctcgcatccaggcccagctcctgggccaatcccgtcgagtttcacccgcaccacatggagcaggtccaaatcgcgagcgaaatcacataagatgatctcaaacccagcctccatacgaatcaccccgtcaatccgatcctcccattcctccctcgccatccggcaaatcgtctccgcgcgccgcttttcgtcgcgcatcaggtccccgtttccgtcatccagcgcatcccgcagcaaaatgcgatcctga

SEQ ID NO: 5276 - DNA, 441 bp, A.fumigatus
agacaaaaggacaaggagcccgaacttggtggctggctgcatacgtacgtggctgccaaggacttgcgacttgtgtatatcgacggaatgtccgctgccaagtcctcgaacgggacgctggactctcaggatcgcattttgctgcgggatgcgctggatgacggaaacggggacctgatgcgcgacgaaaagcggcgcgcggagacgatttgccggatggcgagggaggaatgggaggatcggattgacggggtgattcgtatggaggctgggtttgagatcatcttatgtgatttcgctcgcgatttggacctgctccatgtggtgcgggtgaaactcgacgggattggcccaggagctgggcctggatgcgagcctgggcggggcaaagaagatggaggaaagggcctggtggaaaggctggaccgacccggtggttga

SEQ ID NO: 5277 - DNA, 963 bp, A.fumigatus
gcgctcgtcatcctgtccggggatacctcgatcgccgtatgttttctcattagtcctcttttcttttgtctagcctacttactgacggttaaagtgatgtatcaggcgtatgcagttcgccctatcggagaggaattcctcttcaacgaagggggtttctacgacagttcctttgcgcttccaaactgggctggcaagaagtacgcgacagatgcctactgggagcacgcggggcatttcaaggctacgaatttctaccaagacctgtttgaccgcggactggtggactgcacttatggaccccccttgacctcgttcccgttctatgagacagtggcccccatggtggaggctatcgaggagtttacgcgagcattcgtggaagcgtattacccagacaagacattaatggacgtagacaatgaattacaggattggatcatcgaggccactgaagctgccaaggttatcgatttcgtgccggctccgatgcgagagcccgagcaactgatctctgtgctctcacacatggcttttctcgcaggtattgctcatcatgccctcaatggcgcgacggtcggcgaggcctcaggggtcctccctctccacccttcctccttcaaccggcccctccctgaagccaagggaagtatcgattccctgctcccctggttgcataacgagaccgaggcacttaagcaggcctccctccttgtacgttttaaccgaccattgctggatgaacaggagggaagcctgccctatatgttttcaggatccagcttcctggcgcggacgggggccccgattcatgatgccgacaggaggttccgggagaaaatgtgggcgattagcgacgagatccggatgaggcagtttgacgagaggggtctgtcgcaggggatgccgttcctctggcgatcgattgatcctcgaaaaatcccatactacttgtgtgtgtag

SEQ ID NO: 5278 - DNA, 621 bp, A.fumigatus
ctgaacaaggcgggaggtatacaatctctctccagctacgcagtcatctacgagaaccaatgggccaccaccttgccggacggggttgcctccgggatgctgacaaactggacccaggacctgctgttctccatggaacggctttcaatcaatccctatgtggttcgacgtcttcacccacgcaaggaccggcttccctttgcggttgatgacagagtcgtgcagcacctggcggcgggaagtacccttgaggccctccaccgtgacgggcgactcttctttgccaatcattcgtaccaggcgccgtatcccaaaactcctggacgttggaccgcggcttgcactgcctacttcttcatccatccccgctccggcgcctttctccctctggccatcaagactaacatggggagcgacctcacatataccccgatggacgagaccaatgactggctgtttgcgaagatggcttttgagatgaacgatctgttccactcgcaattataccacctggcaaatacacatgatgtggcagaacccgtccaccaggcggccttgcggaccatgagcgctcgtcatcctgtccggggatacctcgatcgccgtatgttttctcattag

SEQ ID NO: 5279 - DNA, 1782 bp, A.fumigatus
tccggccaagggcgcgcatcgattgaatttggacgaagttgtgctcctgggtttccgattaggcagttgaatgtagccaacgttcattgtttccagaaaaggaacgggccgatggaacttgagcccggtggagggattcgagtaaaattgggggccaccccagccgagaaattggattcaggggagccgggggcgcaagccggcggagggccgttggcagttacgacagtcaaagtaccgctcaaggatgccgaagatcatgcgggacagtcaccgaaaaggcgcagaggcgacccaaggaaatcggacatacgggaacaggatgctacgcctacagcaggcagtccaggacacacacccggcccagcaggtgcaagtggacagaagagaaaacgaggtcgaccaaggaaacagtctctcaatccggatacggtaggcggcgataagcaagtggctgattcggcggattatcaagacacacggcccgttgagcctgaaatggaggccgaacaacgatggagtccgttgaaccttgctggggacgtagactcggacgacgacgctttgccggagggtttcatgcctgccgacaattttccagaagacaacaacatggggcaacccgatgcagccgcttgggatcggagctccccccgaatacataatgagcgtacgtatgacacaccagatgtgactgcagtggatcagatatacggacaaaaccatgatgaagaaccgcagtcgaccccctcaaaaatgccgtcgccctctcgggaaagccaaggattctccccagaaaatacattacatgctggtcatacacccagaccgccgcgctcatacccaagtccaacctcctcctctctgggtgacgatgacagagcggtgcaagttgcttctagggcacaccccgaaggatctggtcaggaacagaatacgactcgtcctacaaatgacccaacagacgaacatagggagtttgattctatcatggaaagcgaaggctttagcatggtttcattggatacactaccctctgtcaaacaacacgggctgagcatcaactcgcagagtggcaatggtgctctgaagcccttcctctcccgagagaagatggcgaatccggagaaatcgaagcgcaaggtgtcaagcctaaacctgaatcccaggaagcattccccagatgtagaggtgggaaaagaatcgagattccaggcaattgagcctcaagcattgcccgtgtccgccgagaaaagacagtctgcacctctattgcgtgaatcccctgttccggcttttgttcccaagcaaagaaaaccactttcaaggttggctcgaatcatccgcgcaggcgtagcccttgaaggcgcccttcggcgtccatacgagggggcacctgtgccgacgcctggtacaccggatctgagagaacagatttctagtctagaagcacctaaaaggcggttagagctcttgttcagcgacttacatccaagactgaggcgagaactgcgcgcaggattgggctttgcacaagagctcgcaaaaaggaggagaaagacggagattgaacgggcaagacaaacggcatcagtagaaacaaggttgacgggtaatgccagaggcgcaaccacaactcctcaacagatacacagcggaactgctgtgaaggacactccgagcacagaaatgaaacgacgactggaggaatggcagcgggagagggaagcccggagcccgggagatccagatggcgaatgccagtcaagtcattgtgattga

SEQ ID NO: 5280 - DNA, 639 bp, A.fumigatus
aaggacaaggccgattacctgtacctgctactccttggccgggcgatcgccatggccgccacgcaggatatgcatccgctcgatctcccagaggtgaaatacatctggggtgacttccacgacctcgacatcaacaacccttcaaactcggacgaccccaccgccaccctccccttttcctttcagctcaacatcctccagccgatgcgcatcctcgaggaaatggaactggacccgtacgccaacctcgcccgctacgatacctgggtgctcaacacgctgtatgccaaattccggggcacagcgtcaggccgcctctccacctgggacggcgggccagagctctgcgccgtgcacccgctctggtgtctagcgaaccactcgtgtgaccccaacgtgcgctgggaatggggcggcgagattacgttccgggcgcggacggaggccgagcgagcggtgtggaagggggagggagcgcctgtgcgacggagcggcgaggggatcaaggccgatgaagagatcctgaaccactactgtgatattgggcttgatgtgaaggagcggagggagtgggctaggggcgcgcttggggggttgtgtcagtgtgagaggtgtgtgtgggaggctgctacagcgtag

SEQ ID NO: 5281 - DNA, 633 bp, A.fumigatus
agccgcggccggcgtcgttctattagccgtggaaggtcttactcaagatcagtgtctggatcttctcgaggaagaagttataccccaagctacagtcgatcgagatctccagttccaaagtctcgtcggcgctcagtgtcctatagtcgctcacgctcgccagctggccgaagaaggtcgtcagtctctcgtacgccacctagacgtgtccgtggcaaatcttacgactctcgctctccttcgcgatccgtcacgccgccaagaaggcgaacctcttacagccggagagatcgatcttactccaggtcactgtcacgctctgttaccccaccactccgagctgtggatgcaagggcgcgtggtagacgctactcttcgcagtctctttctcctcctcgtcggcgtgccgaaagaagtgtgtcccctcaacgtcctcctcctggtcgccgtccccgtggtgattctttgtcgcgatcccccagtccccctccgcggtatgcacgtgaacagaggcgcagagggaattcgagctctgcttcggcatctcgctcgcctccacatcgcgactccaacaggcgccggtctttatctaggactccgcctcgtcggggccgcgcctccgactatttgtaa

SEQ ID NO: 5282 - DNA, 825 bp, A.fumigatus
attgaaactgacctccgtcggcccttccagccccgtggtgaagactacgacgagttcctgcagggcgtgccccgccgggagacggaggccatcgccgccaccatcacccggcacgcgaaccgcgtccgcccgcacgcgtcctacgacggccgcggcgtcgagtgcatcatcgtcggcggctaccgccgcggcaaggagctcagcggcgacgtggacctcgtcctctcgcaccgcgacgagtccgtcaccaagaacctggttgtggatcttgtggccagtctggaagcagagggttggatcacgcataccctcgccctgcacatgactacctcgaaccgcgaacagcagcctctacctttccagggcgatgatgactcgggcagacacttcgacaccctggataaggcacttgtcgtctggcaggatccgcatttcgaggacggcgatgatgatgatgatgatgatgatgccgagacgacagccgcggggggtggagcagacaccccggaagaaggcgcaagacagcgcagaaaacgcaaccccaatgtccaccgccgggtagacatcatcatctcgccgtggcggacggtcgggtgtgccgtgctgggctggtcgggcgatacgaccttcgagcgggatctgcggcggtacgccaagaaggcgcacgggtggaagttcgactcgagcggcgtgagggagcggacgagcggcgggcaggtgattgatttggagcgcggcggggagacctgggaggagagggaaaggttggtgcttgagggcttgggggtgggttggaggcctccgcaggagagatgcacgcgataa

SEQ ID NO: 5283 - DNA, 360 bp, A.fumigatus
tatggcacgatcccccggctgttcacctcacccattttttacctgatggccgtcgtcctgccgtgcatttgccttctccgcgactacgcctggaaatacgccaagcgcatgtactacccgcaacactaccaccacgtgcaagaaatccaaaagtataacgtacaggattatcgacctcgcatggagcagttccagaaggcgatccgcaaagtacgacaagtacagcgcatgcggaaacagcgcggctacgcgttcagtcaggccgacgagggcggacagatgagagtcgtcaatgcttatgataccacgagaggaagagggagatatggcgaaatgaccagttcgaggacactggtctga

SEQ ID NO: 5284 - DNA, 240 bp, A.fumigatus
tgtctacccggcggtggacattggggttgcgttttctgcgctgtcttgcgccttcttccggggtgtctgctccaccccccgcggctgtcgtctcggcatcatcatcatcatcatcatcatcgccgtcctcgaaatgcggatcctgccagacgacaagtgccttatccagggtgtcgaagtgtctgcccgagtcatcatcgccctggaaaggtagaggctgctgttcgcggttcgaggtag

SEQ ID NO: 5285 - DNA, 546 bp, A.fumigatus
  unsure (21),(35): Identity of nucleotide sequences at the above locations are unknown.
agaccccttctggtcttgatntgcagattcttcgntgatatgctgcgcagtttctatctcatcgcatcaagggccggccctctccttatgggcgacatcatggccgttctggcagaatgccggaatcgacaggattgcggcatagatcgctggggtggcatacgccactatacaggcgagctcgtccgatgggaggaggagaaatgggagccctatcactgggccgcccttgacagaatgccggatgatgtgtccattaatgttgcgatcgagatgccttggggatacgggggatgtcctgccttttctcttcggcgggtctacggcaccgagcgcttcctgcatgaaatgatcctgcatgagatgatcatggaccaagggcgtgaatatcagtgggccgagacttcgtcgggcccccaataccgccctgtgaacaagtccaagtacagggcaaatctgttggctgtaaaggagcatcgagggagatatctgtcgacttgcagcactgtctttcgcctactatctgaggtgaaccagccagggtag

SEQ ID NO: 5286 - DNA, 183 bp, A.fumigatus
  unsure (71),(101),(107),(108),(126),(156),(182): Identity of nucleotide sequences at the above locations are unknown.
gagggcattgatgttccggaggatcgggtgcgagagcggtggatttatagtcccagtgggttggtcttcanacgagtgggatacactggcgagataggatntgatcnnagaaattcgagactccancgtgcggatggcgttgaagcgtgtgttaanactgccaattactgcgaggccacatna

SEQ ID NO: 5287 - DNA, 471 bp, A.fumigatus
gaatgggcctactatgtgttcttggttgccggttggtttgttgctgggacatggggtgttggatatcttcttcaattgctgctaggtagtacggagtatgtatcatgcaatcaattcactgtgaatggaatgtatcaatgcttaattgtgtgtgtatgcatagtcttcacgtctaccaaccaaaagtaccactgtaaaaccatgaaaccaacctctcagacaagtttgaacagcgcggaaatatacaatagtaaaaagtctcatgcagctatcaatcctttcactctagccttgaaaaagcaacagcttggcggaacgatcccaggctactggatattttggcatgttgaaggattccataatctgccaatcaaaatcgtaattgttttttgctattgctattccccacgtgctggccgcatggacctccaggccctatacaccgaaaagggaaaacgcaaggattattga

SEQ ID NO: 5288 - DNA, 192 bp, A.fumigatus
acctttattgaccatttccttgatcttctgaacatccgccagggtttcttcgactacttgcaattcctttttaatgtcgccagggtagggctagggataaagaaatgcctatggtatactagaacagagaagttcgcgatcatccttgtgcagctctatttgagtatccctaacagtgagttgtgccgctga

SEQ ID NO: 5289 - DNA, 360 bp, A.fumigatus
caaggttgcagtacgaccacaggaaggagcccacaacctgcagaatcaagaagaacgtcaccttcatggtataatccaaattctggcggagagaatcaaaaacgctgttttggcgcgacttggtgtcacccgcaggtcaaaagcgagtggaccctgctctgcgcaacagagaatctgacttgcggtgtatcaacgatggtcagtcgtcaaggagtcgtcaatgccaagcagtatcaacttctagtatgcctccatgtcgtccgtccaaccagcatcactgccagctactctgactatctggccatgatggtcatcaatcggctcctctgggctaacactcctgatacctttggctttttt

SEQ ID NO: 5290 - DNA, 261 bp, A.fumigatus
gcggaaaaggcacgcctaaacgcagacaaggccttcaagaaagaattataccactacctgcgttgggctttgtcggccggtgcccccggccccgggatccccgagacgatggagattctgggccgggcagaatcgcttcgcagacttcaagaggccagagagctcacggctgaggcgtcgtctgtccgtgtgcccaagaggacccagtcgcagcagagcgaggatacaacctggatgggctctcttgctccgcggccctag

SEQ ID NO: 5291 - DNA, 195 bp, A.fumigatus
gcgggtaacatcagattgccgatgaagcatcaaaagcagatgagaagattcttgcagagcaggccgccaagggcaattgacattatgttaagtcacgtcaagcagagaaactctaagatcctcagggtgtttgaggcagcgggcgatgctgtgacccaggataaggatttcttgggtctgacgaaggaatggtag

SEQ ID NO: 5292 - DNA, 1344 bp, A.fumigatus
  unsure (326): Identity of nucleotide sequences at the above locations are unknown.
aaatttcatgaaagtaagcatatatggtatagtccgaaagcagtgtactctggtattctaacagatttcttcttgcagtatggcgtccttatctgcatcacatgtcatgactatcggaagcaggatgtagttcttgggtcgattctctttgcccttgttccatgccatctcttccttgcgtacatcattgaattggttgcagctcagcaatccaagaaaactgtcggtcgacagaaaaaggatctatcgacggaggagagggagcgcgaacaacaggccttccgctcaacctggcggtatacagccttcttccataccgtgaacgntaccctttgcctcgccgtgaccagcttcgttgtttatttctacatcaatcatcctggaatcggtacaatttgtgagctccacgcaatcattgtgtggctcaaaaattgctcctatgcatttacgaatcgcgatctgcggcaggcaatggtcgacccctctgcagagtctgctctcccagaaatctactccacatgcccatatccaagaaatatcacacttgggaaccttacatatttttggctagcaccgacacttgtatatcaacccgtttatcctcgatcgtcgcatattcgatggtcttttgttgccaaacggcttgctgagttttttggtttagctgtcttcatatggcttctctcggctcagtatgcagccccggtcttgcgaaattccattgacaagatagctgtgatggatattgcgtcaatcctcgagcgggtcatgaaactctccacaatttcgcttgtcatttggctcgctggattctttgcgctcttccagtcgctgctgaatgctttggcggaggtcatgcggttcggagatcgtgagttctacacagattggtggaacagcccgagtctcggcgcatactggcggtcatggaacaggccggtgtacctcttcatgaagaggcatgttttctcgccgctggtaggaagaggctggagcccttttgcggcgagcttcatggtcttttccctctctgcagtcctgcatgagatgttggtggggattcctacccacaatttgatcggtgagaacttaattcttttcgcaaatgataaatctggaatcactgacggccacataggtgttgcatttgcggggatgatgttccagctgccattgattgctgtgacagctccctttgaaaaggtgaatgacgccttgggcaagattgtagggaactcaatcttctgggtaagcttttgcctcgttggtcaaccgctgggtgcgctcttgtatttctttgcatggcaggcgaagtacggaagtgtcagcaagatacacgtttag

SEQ ID NO: 5293 - DNA, 222 bp, A.fumigatus
ctaagcctatttaagtccctagtaatgccctttaggctaacagaagcacctataacctttcagcaattcattaataataccttacaagattaccttaatgtcttctacactacctaccttaataatatccttatttacagcaagacctgtactaaatatataacatatatccactccatcctgcagaaactaagggaagctagtatatatacaaaaatctaa

SEQ ID NO: 5294 - DNA, 486 bp, A.fumigatus
aagacggaccaaatctggtaccttgacgccttgaccactcaaaagggcgccccatggggcctgggcagcatttcccacaagggacaagcaagcaccgactacatctacgacaccagcgctggcgcaggcacctatgcctacgttgtcgacagtggcatcaatgtcaaccacgtcgagttcgagagccgcgcatcgctggcatacaacgccgctggtggcagccatgttgacagcatcggccacggaacgcacgttgctggtaccattggcggcaagacctacggagtggccaagaagaccaaccttctgtccgtcaaggtcttccagggcgagtcctctagcacctccatcatccttgacggcttcaactgggctgtcaatgacattgtgagcaagggtcgtactaagaaggctgcgatcaacatgagccttggtaagatagacccctcttgctcgttcaactggactgaaagtaacggcggctga

SEQ ID NO: 5295 - DNA, 528 bp, A.fumigatus
tggataatgacaggtggtggttactcttatgccttcaacaacgctgttgagaacgctttcgatgaaggtgtcctttctgtcgtcgctgctggaaacgagaacgtatgtatcccccgttttagaaaagttacaaatgaacattgcaggtttggtcggactaacatgttgtgccagagtgatgcctcaaataccagccctgcttccgctcctaacgctttgacggttgctgcgatcaacaagagcaacgcccgcgcctccttctccaactatggttccgttgtcgacatcttcgctcccggtcaggatatcctttcggcgtggattggctccaccactgccaccaacaccatctccggtacttccatggccacccctcacattgttggcctatccgtctacttgatgggtcttgagaacctctctggccctgctgcagtgaccgctcgcatcaaggagctggccaccaatggtgttgttaccaacgttaagggcagccccaacaagcttgcctacaatggcaatgcttaa

SEQ ID NO: 5296 - DNA, 576 bp, A.fumigatus
attttgggggtcttttggagactaacacccttttgggctatatcttgccagtctttctctccatctccttcccctcccccctactatagcgcaaacatgccttctgattccgaggatgtgttcgaagagaatcacgttgacggaaccacctccgaggaggaagaagacggaccatctggccctccagttgcaaccgatctctacgaggttctcggtgtcaaagaggatgcgactcaggacgagatcaagtccgcctaccggaagctggccttgaagcaccacccaggtaacttgcttgagatttccgcccaaactacaaccggtgattattggattgtgtcactgattgaatcaacaaagacaaggctcctgccgaccagaaagatcaagcgcattccaagtttcagcagattgccttcgcttatgcgatcttgtcggacgaaaagcgccgccggcggtttgatcgcaccggcagcactgcggaagcggccgccggcgacgaagatttcgactggacggaattctacagagacctatactcgaactcggtcgatacggaggcgattgacaaactaa

SEQ ID NO: 5297 - DNA, 474 bp, A.fumigatus
atcaacaaagacaaggctcctgccgaccagaaagatcaagcgcattccaagtttcagcagattgccttcgcttatgcgatcttgtcggacgaaaagcgccgccggcggtttgatcgcaccggcagcactgcggaagcggccgccggcgacgaagatttcgactggacggaattctacagagacctatactcgaactcggtcgatacggaggcgattgacaaactaaagaaggagtatcagggctctgcagaggaagagaaggatatcctggaggccttcgaccgccacagaggtgacatggaccgcgtttacgagtcggtgatgctgagcaatgtgcttgatgacgacgagcggttccgcgctactattgacaaggctattgccgaaggcaaagtggaggcttacaagaagtacacagatgagccggcaaagaaggtcttcaccacggggctgaagggcagctgcaagccataa

SEQ ID NO: 5298 - DNA, 210 bp, A.fumigatus
tttcaccgtctggagagcctcacccacatagcgaagcagacatatcaccaacagctgttcattatacctgctgctcattgcacaatcatctacctctctacaattctacttattgtgaagccttacctcacaagctctcaaatcaattgctcccttccaaccacccgcggaatgaccgcatccccccacctcgactacctccgccaatga

SEQ ID NO: 5299 - DNA, 408 bp, A.fumigatus
tatgatttgcgtatgatcaggcatatcgaagtagatgcgcagaataacggcaaccttttcttctggcattaccagaaccgtcatatcgccaaccgccagcggactgtgatctggctgaacggcgggccaggatgtagttcgatggatggtgctctcatggaaattggcccctacagacttaaggataaccatacactggagtacaataatggctcgtgggatgaatttgcaaacttgctttttgttgaccaacccgtcgggacgggctttagctatgtcaacaccaacagttatatccacgagctcgatgagatgtcggctcaattcatcaccttcctggagaagtggtttcaactatttcctgagtacgaaggtgacgacgtaggtgccctcattttcagtgcctga

SEQ ID NO: 5300 - DNA, 207 bp, A.fumigatus
gtgccctcattttcagtgcctgatgatctcggtgccaacttattaacttgtcatcagatatacattgcaggcgagtcgtatgctggacagcatataccttacatcgccaaagctatacaggaacgcaacaataagatccagaatgaccagagcatccggtggaaccttcgcggcattgtgatcggtaatggttggatctctcccgcc

SEQ ID NO: 5301 - DNA, 1539 bp, A.fumigatus
cggcgtggctggacacggacaattaccgtgcatatcacccccggtggacacaagagcaacagagcttgttgcatggtcaaagttcgcacagcggaagatcaagattctgtcactcaaatcggaaacaaactgctggtcaatgctcaagatgcgctgattctaatctcagcgcaaaccacttaccgttgcgacgacatagacaagaaggcttcttctgacttggagacagctctactgcactctactgatgagatctgggaacgacatgtgaacgactaccgatcactctatggtcgcatggaactgcacctgagtcccagcaactgtgacatgccaactgacaaaagaatcaagaactcgcgtgaccctggtctgatagcactctaccataattactgtcgctatctgttgatatcgtgcagtcggaatggggacaaggctttaccagcgacgctacagggaatatggaatccgtctttccatccagcctgggggtgtaaatacacgataaatattaatctgcagatgaactactggccggcaaatatttgcaatctttccgattgcgagatgccgctattctctctactagagcgagtggcgaaatcaggagaggagacagcacagaagatgtacggctgccgtggctgggtggctcatcactgcaccgatatttgggctgatacttctcctggagacacgtggatgccagcaactctttggcctctaggaggtgcttggctctgtgtccatatctgggatcatttccgtttcacccgcgataaggaatttctcgagagaatgtttccgattctgcaaggatgtgtgcaatttcttctggatttcttggtcgaagatgcatctggagagtatttggtcacgaacccgtccctgtcgcccgaaaacacgttctatgaaaaaaacggagagcgtggtgttctgtgtgaaggctccaccattgatatccaaatcgtgaatgccgtcctgagcgcttatctgaaaagtgttgaagagttagagatagtggataagcttgcgcccgcagcattagacgccctgcatcgacttccaccgctccgcatcggatctttcgggcaactacaagagtgggcttcggactatgcggaagtagagcccgggcatcggcatgtttcccacctgtgggccttgtatcctggagatactatcagcccggaaacaacgcccaaaatagccgacgcctgctcggtcacactgcacagacgtgaggcccatggaagcggccatacgggctggagtcgcgcatggttaatcaatctgcatgcacgattgctggcagctgaggagtgtgcaaagcacattgatctcttactggcgcagtcaaccctgcccaacttattggacactcacccgccgttccagatcgacggtaacttcggcgccggtgcatgtatcctggagatgctccttcaatcccatgaggagggaatcattaggcttctttccgcttgcccgagagcttggagtttcgggtctcttcgaaacatctgcgctcgttga

SEQ ID NO: 5302 - DNA, 393 bp, A.fumigatus
cctcgactcgcccgctcctgtctcaagactttccttgatccgtcaaaaccattcggagcacattatggtgcgattattggcttgcatgctgtcggtggcaccgaagctgttcgcgtcttgatacttcctaatctatcaacttacgcgacccttctcgcggacggcatggcagaagacaatcctcgacgaccagaggccgaaaaggtgctgggtgcactgttggccgtcctttctaccttgcgggagggccgtaaaactctggccaatgggcacggtgccattgtgacggacgagctccgcgagcgactaaacgccaaggtgggggatatcatcgcaagcaggatcgcggatgcgggagaggtgcagatggtctatgctattctcgaagcttga

SEQ ID NO: 5303 - DNA, 216 bp, A.fumigatus
cagtctacaggtccagagaaactcttggaggtgtggttcgcgccttccgctcaggaattaggtccagcgcagcccgccggtctgaaggctgttccggaggagatctggaaggacatgttggatctcgtcaattgccaggtcctctcgattgtttcgtcagaggatgtggacgcctacctgctatcctctcttaacgccgggatggaaggtatgcgt

SEQ ID NO: 5304 - DNA, 195 bp, A.fumigatus
actaattaccagaaccggaatagcagaatgtcccagacgcctagctatgcatataagctggacactcaaggtgcgaacatcggtctcaagatgcacgcaaagaaccaaacaaggacgaggatgccgatgccggtatattcaaccagatgcccaaatacacagagcggcggcagacagcaagaaatgaaaaaataa

SEQ ID NO: 5305 - DNA, 456 bp, A.fumigatus
tctgcaagctactcatcaaccgctggggcgctgccaacgccaatcagttccacctttgctggcaatggagcaacgtcggactcgggaacggagccgtacgctgcagcttctcctcagtcagtttccgacgctgctccgtccagcagctactgtcatagcattgcaacacccgcctactctccccccactggttcctcgggtccccacatgaccggaacggttgagctgcgagcagtgctacctgctgtcacgcaaccatatcatagtatggcatcgggatacgcatatcccactgtctgccagcagcagggacaactttcactcacagctcctgtcagtcggccgtcatggaatcccaacagccttgctcatcagccttcggcaagtgcggcccccagctatagctatctagctcctttgccttattcattacccgacccttcccacgggtgttga

SEQ ID NO: 5306 - DNA, 837 bp, A.fumigatus
ataaggcgttttatgtccaccaaaaccggatggtcccgaaggcccgagggtcccccggggggtaaatatgccgccaatggcaagcaccgaaagtcaagaaagagtgccccctattcaaccgacatacagagggcgtcatctccatacagttcaattcccaaattgcgcacgccttccagcccgagatcaaattttaacaggtccccattatcaagttcaatctctacccaaggcagcctgaggtttgcgtcgggaggtcggagcccggccagtcctgaaaagtcgcttcggaggacgataagcatcgcggcctttccccagcctccaaaggtcaatggccgttcctctgtggcttccacaatctcgggatccaataatattccgcttggtagcgcgagagtcaagagtggttcgaggttaagttcagggactaccagcagttatcgaagttcaagacccccttcccttttgaacgggaatggggacagcagaaatggcgcttccttagactcacgagaacaagaagcctcccctacacagagcagaagctcgtcagcccaaggatcgtactcaacaagtgcgaccacatgtgaagatccggatgatgctacagggatcgccaagtcaaattcgagaaccaagcaagtgaaaggaaacgtgatcgtcagcgtccgtgtacgtcccaatctgaccgggacagatagttcggcttctgacagcgattgggttgttgacggtcgtcgcggcctcatttcctataaaggaaaggaaggcggagtagactatttatatggtgtgcacccagacaaagacctttctaacgattcgcatggctga

SEQ ID NO: 5307 - DNA, 639 bp, A.fumigatus
cgattcgcatggctgattgatcaatctacttctacaacagacaatgtcttcccgccgcacgagcacaatgccaaagtctacgacgccgcggccaagcgccttgtaagaagggtcatggaaggatatcacggaacagtctttgcttatggcatgaccgggactggtaaaaccttctctatgcaagggactgcgacttctcccggtgtgataccattagcaataacggatatcttctctttcatcagagagacacctcaccgggaatttctgcttcgcgtcagctatctggagatctacaacgaaaagattcatgacctcctgtcggcgtcgggctctactgggcttgggaattctcagcaggaggagatcaaactccgcgaagacagcaaacgaggtgtgtatgcaactccgttaaaggaagagattgtgcagagccctacccaactcctacgtgtaattgccagaggcgatcttgcacggagaacgggcagcacgcagtttaatgctcgtagttcaagaagtcatgccgtcgtccagattgttgtggagagcagagaacgagcaccaacgagcaaaccatcccaagaacggcgctcttgtatggccccaggtggagtcagggtgtcgacccctacttaa

SEQ ID NO: 5308 - DNA, 765 bp, A.fumigatus
ccccgaaagcaaatataccatgtcaaggcagcagccaataccgcctcggaggatctcgacctgaacagggcgcaggatgaacagtttcccccagagaagcttcgaatcacgatcgagcgtttctatacgtcggtggtggttgagttggtgggcttctgcaggcatatcgcccggctacggtcgtggaaagagcctcggcggacggcggttttctgtgcagtaagctatgatacagagttcctcatgagcgagttggatctaatgcgtgccgtgcagggttactttattgcctggctgttggatgtggttatttttacactgtcgggcctgttgattgccttgatcttgtgtccgcccctccgtcgggcgcttttccctggcgcatctccagcgtctactgacttggagaattcgacacctggagatcctcggacgcaggatagcattatctggacctcggaaaggcacaaaggagaggctgctgagcgggaggctcaaaacctagtcaacaatgttgcgaccattgccatgaagagtgctactggtaaatacggacaggctgtgcctgaagatgctgaagaggtcgccgagccggagagtctggcagatgttgtggatgcggcggaaggacttgatgaaagcgttacagcggagtcgcagaagccgatgaagagaaaggtagccaacgctaccgacgagataatgcggacgatgaatgatattacggacacttatgagaagttctgcaagtatgtttctcgatga

SEQ ID NO: 5309 - DNA, 198 bp, A.fumigatus
  unsure (118): Identity of nucleotide sequences at the above locations are unknown.
tatagatcaagtccgggggaaatgactgtccaaaacaatcaaatccccgcaatctacgcgcgggcgatcgaaaagtacaaggatatcactaaagaggatctccgatgtcgcccttgcntgtgcaagctccagactgtcgacgacctggccaaagagatcgatgagcatctcaccgacgcggctggaaggacacgagct

SEQ ID NO: 5310 - DNA, 612 bp, A.fumigatus
  unsure (25),(38),(43),(73),(129),(135),(283): Identity of nucleotide sequences at the above locations are unknown.
ccgtggccttcagtttcggattttngaacgtgctcccntgacngtggacctgatcagaccctgaccaacgaanaccccagcgttgttttcgcttcggcctaccgcttcagcgtcttttttttgtacacntccgcngactctttgtacaccttcgcgcccaccgtcggctggaccgccatcgaaatgtccgcgggcatcgtctccgcctgtttccccaccttccgccccgccttccaggccatcgtccgtctcctcggcatccaaggcgccctgccggccttgntgcgcagccgcaccacccccatgtccaagaccggccagtcaaaccccagtcagaacgagttgacgaaaggacacccgggcagcggtgtcgggcactcggcgcatagccggcgtcattccttctattatctcccggatgaggcggattcggccggtggacaacccatgacgccggagcggttggatgcgtccctgcggccggagtatgatcacggacatatggtgaccaacgtattaggcgccaaggggaggaacgtcgataacgcgagcgatgagattcctctgcatggaatccgtgtgcagaaagattttacccaagtcaaggagtga

SEQ ID NO: 5311 - DNA, 189 bp, A.fumigatus
tacggagtcgccttggactgttcgagcccctcatttaactcgcgccgaatccccgcccgcctctcttcagccgcacttcatctactaaccttcgcgcccgtcagcatgaagcgtggggtttataagttgcacgccgcgactgtcaagtcgctggttgtaacatcacattgcttggtgctgggcagatga

SEQ ID NO: 5312 - DNA, 834 bp, A.fumigatus
  unsure (104): Identity of nucleotide sequences at the above locations are unknown.
atgagcgggccacgttctctattcctgttcctgggcgtcacaagttgggcactaaaagcacagacccctctgcggattcggaagttcgaatcagtgacctcctntgaatgtctcgatgttttcactgctaatgaaatcgttgagctcagctgtccgtcctgtggaaacagcaatggattctcgaagcgttcgtcatttaggacaatgccgcaggaactagtgctaaacgcccgacgattcgaagtcgttaattgggttccgaggaaattggatatcccagtgaatgtcagcgacgaaccactggatttcagcccatatgttggctccatgaaggaggaaggcgaaaagctcctaccagaagacgatccatccgttagtggcttctcgcctgatcagaacatcttaaaccagcttcttgccatgggttttcccaaaattaggtgtgaaaaggcgctacatgcgaccggcaattcagataccgaagctgccatgaactggctgttctctcatatggatgatccagatatcgatataccgcttgtggtcagcaaggttactggccccgccaacatggccctacaggatccatcgaaagtaagtcaactgattgaaatgggtattgatgaggatcgagcccaaagagcactggctgcgacagggggcgatgtggatcgagctcttgattgggtattcagtcatcccgacgaaaggcctgaatataaaagtggtgattgtgactctggctctcggcttcccggctttaacgaaaccccggctatatatcaacttcgggccattgtttgccacaaaggtacatcagtacacgctgggtga

SEQ ID NO: 5313 - DNA, 207 bp, A.fumigatus
gtcagaaatctcaatctttcagattatcgaattgccaagcaactgagaacaaacagacattatgttgcatttgtgcgaaagacgctgccgggccaggataacccttcctgggttatgtttaatgacgagaaagtcgtgggagttgatgatattcaagatatgaaaaagtttgcctatctatactttttctctcgagtcgaggcgtga

SEQ ID NO: 5314 - DNA, 564 bp, A.fumigatus
ggtcggctgctcagcactttgaaagatgagcgcttcaaggtcgtctatcaggcgccgaccaaatccctctgttccgagcgatttcgggactggagcaggaagttcatgtcgttgggactccagtgtgcggagctaactggcgacactgatcatacccagctcagaagtgttcagaacagtcagatcatcgttactacaccagagaagtgggacagcatgactcggaagtggaaagatcatgcacgcttgatgcaattggtaaagctcttcctgattgatgaggttcacattctcaaggaggctcgtggtgcgacgctggaagcggttgtgtcgagaatgaagacattcgggtcgaatgtccgcttcgtcgctctgagtgctacggtcccaaactcggaggatattgcgtgctggctcggtaaagatgcaatgaatcaacacgtaccagcacaccgagagcactttggggaggattttcgtcccgtcaagctccagaagtttgtgtacggttatcagtcatacagcaatgattttgccttcgacaagttatgcggttcgaagtaa

SEQ ID NO: 5315 - DNA, 855 bp, A.fumigatus
ctggacggcacagccacgctgatggcaggagtcgcatttcatcacgccggcctcgaccctgctgatcgccacaccgttgagtctgggtatctgcagggacatatcgccgtcatttgctgtacctcaaccctggcagttggggtcaatcttccatgctaccttgtcataatcaaaggtacagtaggttggcaggatggtggctgcaaggaatactccgatctcgaaatgatgcagatgcttggccgagctggtcggcctcaatttgacgacagcgctattgcagtgatcatgacgagaaaggaccgagttcaacattacgagaaactcatatctggatgtaagacacttgagagctgtttgcacctcaacctgatcgaccacttgaacgccgagattgggttaggtactgtcgttgatgtcgattctgcagtcagatggctggcgggtactttcctgtttatcaggctgagaagaaatccaaagcactatcagctgaaggaaagggccacaaaggatgatgaagacgaaattcttaggcagatttgcgaaaggaacatcaaacttctgcaagagactggactagtggcttctgaccatctccagtccacacccttcggagatgccatggctcggtactatgtacagttcgataccatgaagactttactcgcgctgaaacctcacgcaactgtatctcaagtggtaggtcagccggtcctctgtttgacgataggagaaactctaatggctttattcagctatctgcaattgcggaggcagaagaattccgtgagatacggctcaaggcaggcgagaagtcactgtataaagaactcaaccgggccaatggcataa

SEQ ID NO: 5316 - DNA, 669 bp, A.fumigatus
ctgcgcaggtcgtccttggtcgcacatgtaatgtccatagacgtcaactggaggttcgccacctccggtccagacggagaagcgcttgctgaacgtatccgatccttcatccacgatagattccagcaggtcgctctgccccggttcatccgttctgtccaagtccacgcttttgattttgggaccattccgccggagctcgagattaaagatttctgtgagccctttgccgacttctacgaggaagatgatgacgaccatacgtccgatgcgtccgaggagcgtggggaggagcactcgagtcggtggaacagtacccatccagagctcaacgagccctcctatcgagaagatacagccgtgaatcattccttacgagatccttttcctgacgggtttcctacctccccgttgcgatcgcctttaggcgagcacctcaatcctcatttccttccgcgtgccagtactcctggtattcccggtggaacttcgacattaggttatcacctgatgtcgctcggcgggctctccggtacgcaaacgcctcttgctgcggtagcggggggaaacccattcgcgagcggttggtcagattccggcatggggccggggaacaggggtcgttcggagacacacgccgggatgcagcacccacgcgccgaacccgag

SEQ ID NO: 5317 - DNA, 210 bp, A.fumigatus
caaactgggccacaagcctgggagctgacaatggattccaacggcctcgcgggccatgacaaccggaggcgccggggtgcgctggcatgcaatacatgtcgggggagacggaccaaatgcgatggtcaacggcccaagtgttcattctgtgctaggcgagggaaagagtgcctctaccaggaagtgcagggtcttccaccttctccgtga

SEQ ID NO: 5318 - DNA, 222 bp, A.fumigatus
  unsure (192): Identity of nucleotide sequences at the above locations are unknown.
aaagagctcctgtcaacatctgttcgttcttctgcgaggctcacgtgctacatccaggattctcgcgtggattgtgcgagtctatttccaggaaagggccgcccaggaagcgatttgacttacacatataagggtgcttctcatttgatgtttgagcaggtgtcagccattgaagagcagtacacttctcantggtttggacggatatctaaaactcattag

SEQ ID NO: 5319 - DNA, 243 bp, A.fumigatus
caggagctctttctagtctctcagtgccaggctatacacgcccggtccatcttcccctgtcaagatacgccggatgtcaagtgtacgctggacttcaacatcacttcgcctcttccggtgattgccagtggactccccgttcggggttcatctgaggctccgaagtccgatggtaagactttatacaagttccaccaaaaggtcccaattccaagttatctttttgcgttagccagcgggtga

SEQ ID NO: 5320 - DNA, 270 bp, A.fumigatus
gcgtcctggctccgagtcactaacggctatagccacggcgagccttatcgtcatttctccgccatcattggatggaaggctctcacagactctgtagagcacttcggtcctgagcatgactttaccaaacttatcaccaacctgaagggcatggacccagatgacgctttctcaagcattccgtacgagaagggattcaattttttattccacctggagaatctggttggaaagagcaagttcgatcgtttcatccctcacgtatgttga

SEQ ID NO: 5321 - DNA, 249 bp, A.fumigatus
cagtcctgccttgatgagggcaaatccgctaatcatgttcagtacttcaataaatacaagggcaagtcacttgactcctatgaatttaagagcacgatcttggatttcttcaaggatgattcagatgcctcgacagcactgaacgagctcgattgggacagctggttatatgccctggtctccctccgaagccggatttgtcttcaccgaccggggctggaaggacacgcgctctggaaggaaccgcgc

SEQ ID NO: 5322 - DNA, 1464 bp, A.fumigatus
  unsure (877): Identity of nucleotide sequences at the above locations are unknown.
ggtaccccaatgcggagacatgtactatggattggacagttcagacgctttctcgatgaagacgaaatattcatctgcaaatacggactggattgctatttgtttctgcgactgctacacacagccctgaagcttctcttcccgatggctcttttggttctaccagtactattgcctgtgaattatacctctagaagtcagagcacttctgggctggataggtttagtatcgcaaacgtcacgaacggagagaactgcaggtattggatcacagccttggttgcaactctagcgaacgtgcacctatgctacgtcctttttcgtgaattcaaggtcatcgtgcgaatccgacaggctcaccttcatcgttcttcccgactgcaggcagtcacgagcgtgcttgtcactgaacttcccccagacctgtggaacggagagctgttggctcatctctattctcggttcaacgagggtccgactgaggttatcctccccggggaagacatgcatgcagccagaaaaactgagctggaattgctcttgaagaagcgcgatgacttagccaggaataccgcaattcaacgacggcgattgccaatctcccacctgaagagttgcatacaagtactagtatcgagcgctcatttacgatggcaagttatcagggtgcgggcagaagttagaaaactgcgaagcgttgctataattcgattctccagccttttcaccgcacacctcgtactacaggcgactacctcttccgagccattcaagatgaaggcacatatccttagtgataaagcatatgatggcaggcgacatatctttaaaagcagactggaaaggtctatacacagcataagtatcactgtgattntgaacgtcctggaaatagtgtgggcagttccaatcgcaatgactggcctgctgtcacagctctcctatctggacactataagcatcgatctagcagatctctccgaatggcaagtgagcgccatacaaggcttagctcctcaagcagcgctctcattgctgatgtactgcttcccttatatcatctgcgctctatcgaatttcttcgtccatttcgaaggctcctcggtcgaaacattgatccaaagacattatttcacgtttctttacgtacaattgtttttggtcgtttctatctcttcaggcattacgaccatgatccccgacctggtcagtggattccagtctattcccttaatccttgctcgaaacctgccaaagtcttccaactactttttttcctacctgattctgcaggccgtcgtacagactagcacaatactcttccagctgccggacggcctttggaggggcctgcgacgtggccaagcgaaacactccatgaagcgtgtccgttggagcttagtctatccggtctttgccaatttgatctgcatatgtgcgtatatcatgaaggacttcaactga

SEQ ID NO: 5323 - DNA, 279 bp, A.fumigatus
aggccgtgggcaacgattcttgccagttctctgatacgaactcagttccaacacccctttgtcactacctatccaatggtcgtcttggctattgcaatgaatctttctgctatcaatgagaccgtcacacatgccgcagggaaggcgcaaagggagaggggactctcgtctcagtcatttctcctaactctccttgtctacggcagtgtctccatactatcggtatgcttgtttagttacctaaaggataagaatctcaatctcttgtgggtcatgtaa

SEQ ID NO: 5324 - DNA, 384 bp, A.fumigatus
aggacttcaactgaacactggaaattatgcggattgagagctaaatgcgatgcaggcattatattttcccttttgtcgcctctcatcttgccaatcgggctgctgacgttcaaggtgttcctaatcctctattcctatcaagcaacatacgtgctcgaaagcgataaggaaacttctggtttgctctactgggaagctgtcaactatctttttgtaggtatatatactatggatctttgccttatcgggctttttgcgttacagaatgcagtcggacccaccataatggctgctacccttctgcttggtgttgcgatggtgcataagcatctaaggagcaatttttcccctctcatccactacatatcctgcaaatctccataa

SEQ ID NO: 5325 - DNA, 210 bp, A.fumigatus
gtattgatcatgggtcttcgagtaattatcaccggaggttccggtaaagccggccaacatgtgattgcagagctccttaaagctggacatacgatcttgaatttagatctacttccttgcccaaatgataaagtctgcacgctcagaactgacctgacacagtcaggtcaggtctttaatgccatgtctggtcagttcgccttgaattga

SEQ ID NO: 5326 - DNA, 855 bp, A.fumigatus
ggaacattgtctttgggaaaagagacaatccttcagctcgcgtaccatcgtccgtcccgcatctacatgggtgcgcgcaatgcgacgaaagctcgcgatgccatcaccgacattcagcggcagctttcgacccctgtggatatcagacatattcccctcgacctagcctctttcgcttcgattcgcagcgctgctgcgaagtttacctccgaatgcgatcgcttagacatcctgatcctaaatgctggtaccatgggcaacccgcctacaactactgaagaagggtttgaagtgcaatttgggactaaccatattggtcactttctgctcacaaaattgctgcttccggtattgcaaaagactgctgccagccctgcgtcaaccgacgtgagggtggtaactttggcgtctttggccaactgcgccgctccgtcgtacgatgtcatgacatccacgggtgcgctcttggctgctagtacttggacacgctatgccgcttctaaggctgccaatattctattcgcctctgaacttgctcgccggtacccgaacatcctctctgtctccgttcatcctggtactgtgaccagcaacttgtacgaacatgcgaaggcgtcgagtcccgtctcaaaatacagcgttgctgctctctcccttttctttcggtcagtccgttcaggcgctctgaaccagctatgggctgctggggccaagagagagctcttgacgaacggagcatactacattccgatcgggaatcatgctaaaaacaacaagtatgccacggatgcggacatggcaaagagattgtgggaatggacagaggcccagatttctgaaaaattcgtgccttga

SEQ ID NO: 5327 - DNA, 522 bp, A.fumigatus
acgggtgccgcgggacctattatcgtacggccgtctatccttcgcatcgatcgcaatcaacaccatacgctcgtcaccatgaccacagaaattgcggctggtactcctctggcggaggccttgagcaatgctatccagcctaaactcgtagaaatgggttggacctccgatggcggcgacgattcagctttgatcgaatacattatcctgatgcttgtcaacggcaaaagtcaagaacaaattgctgacgaactttccaatgatttgctcggccttggcagtgaaggagatacacaagctttggatttctcaaggtggctcttcgaacaggtcgaagtcctcaatcgacagatcaacggcggtggcgcccctgtcgcaaacgagacggcacacactataccgtcgtccaacgaccaaacagcgacttcgcaagagggtaatgatggaggagatcaggatgccactatgaacatggctgatggttcgcacatggatgattcgatgtgggttcctgctctttaa

SEQ ID NO: 5328 - DNA, 306 bp, A.fumigatus
  unsure (177): Identity of nucleotide sequences at the above locations are unknown.
ctgggaacttattcttcagtgtcaacgcctccaagcatggagtttttgacgttgccccagacaatcaaagttttggaggacgcgggatacgtcattgactcttacaacatgaagctttgttgtaccttcgagaaccctgaacgactttgggtggctctagaagagttggacaagctntcacaactttctctggccacattggccgacactaaactcgcacgtccaaagagcgacaaaaagacaagggacgagcttttggatcaagggctccaacggttgagggagaaactaaagcctaaattatga

SEQ ID NO: 5329 - DNA, 1431 bp, A.fumigatus
  unsure (1413),(1420),(1421),(1426): Identity of nucleotide sequences at the above locations are unknown.
aaaggtgctagaacaacaccctccgttgttgctttcgcccaggacggtgagcgtctggtcggtattgctgccaagcgtcaggctgttgtcaaccctgagaacactttattcgccaccaagcgtctcatcggtcgcaagttcaccgatcctgaggttcagcgtgacatcaaggaggtcccctacaagattgttcagcacaccaacggcgatgcctgggttgaggctcgcggtcagaagtactcgccgtctcagatcggtggtttcatccttcagaagatgaaggagactgccgagaactacctcagcaagcccgttaagaacgccgtcgtcactgtgcctgcttatttcaacgactcccagcgtcaggctaccaaggacgctggtcagatcgctggtctgaacgttctccgtgttgttaacgaacccaccgctgctgcccttgcttacggtctggagaaggaggccgaccgtgttgtcgccgtctacgatcttggtggtggtactttcgatatctccgtcctggagatccagaagggtgtgttcgaggtcaagtccaccaacggtgacacccaccttggtggtgaggactttgatatccacctggtccgccacattgtccagcagttcaagaaggattctggccttgatctctccaacgaccgcatggctatccagcgtatccgtgaggccgctgagaaggctaagattgaactttcttcttcacttcaaaccgagattaacctgcccttcatcaccgccgatgctagcggcgctaagcacatcaacctcaagatgactcgctctcaacttgagtccctcgtcgaacccctgatcaaccgcactgttgaacccgtccgcaaggccctcaaggacgccaacctccaggccagcgacatccaggacatcatcctggttggtggtatgacccgtatgcccaaggttgccgagtccgtcaagtccatgtttggtcgtgacccagccaagtctgtcaaccctgatgaggctgtcgccatcggtgctgctatccagggtgctgtcctggctggtgaggttactgacgttctgctgctcgatgtcactcccctttccctcggtatcgagactctcggcggtgtcttcactcgtctgatcaaccgcaataccaccatccccactaagaagtcccagacattctctaccgccgctgacttccagactgccgtcgagatcaaggtgttccagggtgagcgtgagcttgtcaaggacaacaaactgcttggaaacttccagctcgttggtattcctcctgcccaccgtggtgttccccagatcgaggtcaccttcgacattgatgccgactccattgtccacgttgccgccaaggacaagtccagtcttcaccacggggctggaagtatcgacagtgttctattnttaaatnnccatngcgcc

SEQ ID NO: 5330 - DNA, 687 bp, A.fumigatus
aacactgtcgatacttccagccccgtggtgaagactggacttgtccttggcggcaacgtggacaatggagtcggcatcaatgtcgaaggtgacctcgatctggggaacaccacggtgggcaggaggaataccaacgagctggaagtttccaagcagtttgttgtccttgacaagctcacgctcaccctggaacaccttgatctcgacggcagtctggaagtcagcggcggtagagaatgtctgggacttcttagtggggatggtggtattgcggttgatcagacgagtgaagacaccgccgagagtctcgataccgagggaaaggggagtgacatcgagcagcagaacgtcagtaacctcaccagccaggacagcaccctggatagcagcaccgatggcgacagcctcatcagggttgacagacttggctgggtcacgaccaaacatggacttgacggactcggcaaccttgggcatacgggtcataccaccaaccaggatgatgtcctggatgtcgctggcctggaggttggcgtccttgagggccttgcggacgggttcaacagtgcggttgatcaggggttcgacgagggactcaagttgagagcgagtcatcttgaggttgatgtgcttagcgccgctagcatcggcggtgatgaagggcaggttaatctcggtttgaagtga

SEQ ID NO: 5331 - DNA, 615 bp, A.fumigatus
agaagaaagttcaatcttagccttctcagcggcctcacggatacgctggatagccatgcggtcgttggagagatcaaggccagaatccttcttgaactgctggacaatgtggcggaccaggtggatatcaaagtcctcaccaccaaggtgggtgtcaccgttggtggacttgacctcgaacacacccttctggatctccaggacggagatatcgaaagtaccaccaccaagatcgtagacggcgacaacacggtcggcctccttctccagaccgtaagcaagggcagcagcggtgggttcgttaacaacacggagaacgttcagaccagcgatctgaccagcgtccttggtagcctgacgctgggagtcgttgaaataagcaggcacagtgacgacggcgttcttaacgggcttgctgaggtagttctcggcagtctccttcatcttctgaaggatgaaaccaccgatctgagacggcgagtacttctgaccgcgagcctcaacccaggcatcgccgttggtgtgctgaacaatcttgtaggggacctccttgatgtcacgctgaacctcaggatcggtgaacttgcgaccgatgagacgcttggtggcgaataa

SEQ ID NO: 5332 - DNA, 573 bp, A.fumigatus
agactggacttgtccttggcggcaacgtggacaatggagtcggcatcaatgtcgaaggtgacctcgatctggggaacaccacggtgggcaggaggaataccaacgagctggaagtttccaagcagtttgttgtccttgacaagctcacgctcaccctggaacaccttgatctcgacggcagtctggaagtcagcggcggtagagaatgtctgggacttcttagtggggatggtggtattgcggttgatcagacgagtgaagacaccgccgagagtctcgataccgagggaaaggggagtgacatcgagcagcagaacgtcagtaacctcaccagccaggacagcaccctggatagcagcaccgatggcgacagcctcatcagggttgacagacttggctgggtcacgaccaaacatggacttgacggactcggcaaccttgggcatacgggtcataccaccaaccaggatgatgtcctggatgtcgctggcctggaggttggcgtccttgagggccttgcggacgggttcaacagtgcggttgatcaggggttcgacgagggactcaagttga

SEQ ID NO: 5333 - DNA, 189 bp, A.fumigatus
gtcctacaatataataaaatgcgcactatggcctgccttagactcactcaggaaaatgtcattctcgcttctttggttcccgagtcgtctgctcaaccaggtaatttggcctttcccctcctccctgtttacttttcgggctcttcttgtggcatctcactgattgtggcatttcagcacttggtttga

SEQ ID NO: 5334 - DNA, 582 bp, A.fumigatus
gagcgcgtttccttccagccccgtcggtgtaagacgttgagcagtgctcgtcgtgatgatatggaatctctcggatatgtcatgctctacttctgccgtggcactctcccttggcaggggttgaaggcggccaccaagaagcaaaaatatgaccgcatcatggaaaagaagatgaccacgcccaccgaggtcctctgccgtggattccccaacgagttctccatctacctcaactacactcgctccctgcgttttgatgacaagcctgactactcctacctccgcaagatcttccgcgacctgttcgtccgcgagtcctaccagtacgattacgtgtttgactggaccgtctacaaataccagaagaacgctgccatgattgcggatgctaccaataacaagaaggacaaggaggctgatggccgccaaaatgcagctggagctcaggcccccatggctaccactgctactgctgccaaacctggtgctatctccagccagcgtcgcaaggtccttgatcacaacacgctcaacaacacccctgacaccaaccgtgctatgggagggagtgacaggatgtga

SEQ ID NO: 5335 - DNA, 462 bp, A.fumigatus
gcggctaaattccattgtgatcagcgataccagattctcccagcattggtcctatccagtgttttccaaggctccaccaacagttctgtttttgaaaattttattgaggaactgctttaccattgtggaagatggccagagccaaagtcttctcttattatggataatgcgtccttccatcactctacgacattagagaaaatttgtgcggaagcaggggtaagtctggtatacttgcccccgtttccgctggatctgaatccgattcaggagctcttcgccgaattaaaagcctttatgaggcagtattggcaagtctatgaagataatccctaccagggctttgattcttccttaaatggtgcgctacttgggaaatggccaggacgaatacatcatggacagcgaatgaagcttagcaggtaccgagtcgaagttaactatgtgtcccaaattctctga

SEQ ID NO: 5336 - DNA, 315 bp, A.fumigatus
agactcggattgtacctcctggaaaacattggagtggatggtcagggctacagtggaggtgctggcaaggcaattggcctctggttctacgaaacctgggtctatacagtaatcttgagcgtcgtgtacgggatcgccgttggctgggtttctagagagcttcttcattgggccgaggagaagcgttatgttgaccgcgagagttttctcgtctttgctatcgcacttgcagtacgtttggcaccgctgcacctcgaaacaccttccgttgctgatcatgtgtacagctctttgttctcggaacctgtggcatga

SEQ ID NO: 5337 - DNA, 510 bp, A.fumigatus
cctgcttcgtcgcaggaaacgtcttcactcaggagtaagttcccggcgagagacccgagtatgctttatactcacgcaaacagtgattggtttcgcctggaaacgatggatgactcgctccaacccactattgatatgcttctcaacttggccgtattcatgtggtttggtgctgtttgtccgtggtcttcgttcgtgaacaacgacatcattccaatctaccgccttatatgcttgggtattctgattttacttgttcgccggataccgattattttcgctatgcacaagtacattcatcaaatcgagcatctctttcaggctggctttgtggggttcttcggacccatcggggtcggagccatcttctacctgtcagtgacccgtgaatatctgcgtaccatcacggtggagggcacagtccgcgaggatgcgcagagagtttctgaagccgttgacgtggttgtctggtttctagttatatgcagcatcgtaagttcgcacccataa

SEQ ID NO: 5338 - DNA, 849 bp, A.fumigatus
ctgagttcgatgctgactctcctgtgccatttctcagtcattggggtggagcgccccaagagccgtcttactactgcaaaaagcgagccaaactgggctgttgtctctcacacgggccccgcggaggagttgcctctgccaagttctcgtcctgcttcacaagaaggtgagaagatcgacgctctttatgtttcatcgtcaagacaagtggacgaattgtttcgtgatatgatgccgcactttgaaggtcgggagtctgaggataactggatccgccgggaaaaagatgttctgaccctcaggcgcctcacccatggcaacgcgccagacgattattccccagcttatcttgccggtttgaaaaccttgctggacggcatattcaaagtggttaattcacttcgtacgactctctcgactatcggctgccttctcatccaagatattgctaagagatgcggtcctcggatcgactccatggtcgaaatcatgatgcagaatttgatcaaactctgcagcggtatgaaaaagattagtgcccaaaacggtaacgccacggtcgatgctctgatcgaaaatgtcactttcaccacgcgtattctgcagcacgtctccggagcttgtcaggataaaaatgtccagcttcgcctttttgcggccggttggctcaaaaccttgatccaaaagcaaagtcaccataagagttcgattgaacacggcggagggttggacatgatggagaaaagcgttaagaaatgccttgccgacgccaaccctggtgtgagagaggcgatgcgcagtactttctggacgtattaccgtgtgtggcccaacagagccaatgagtaa

SEQ ID NO: 5339 - DNA, 216 bp, A.fumigatus
cgaggggctccgcatctgaccgaatcgcttcgacttcgtgtggttggagagctctcccaccttgagattttttcggaaatctgcaatttcgtcaatgtcatcgctattctgcctttggccttgatccgctgtgctatcacaaaatacgagtattactcgactcattgcagtcctccgaccgtcctgaaaaagagccagcttgtctgtcatacctag

SEQ ID NO: 5340 - DNA, 666 bp, A.fumigatus
cttcggatgtctcagttttcaccgacataccctgcccttctaccggtgccgtcgtccatttcagacaatacgctcaactacgcagctcgttatcggtcgagagcacgagtacctgtcctgacatatcgccatcccatcaacaactgctcgattacgacaagctcacaggctctagtaggtgtacggcagaaccgaagcatccaggatgaaaagctattggcagcaatattctcaacgtcccgtacagacaggccactggcgaatttcacaccaccacatatagaaaatgactcatcgagctctacgcaaggtgacgtctcatcgggtcagatgctgactgacttgacaaacgccgaggaattggaagacgaaatgctggagtcgttccgtgggaatccagaggaaagacctcagatttatggtgctcagcagcataacctaattgttgatgcacggccgacagtcaatgcatttgctatgcaagccgttggtctagggtcagagaatatggacaattacaaatttgctacgaaggcttacctcggccttgacaacattcatgtcatgcgggaaccgctcaataaggttgttgatgctcttaaagaatctgatgttcacccgttaggacctaatagggatctactgggccccaagtgggatggctga

SEQ ID NO: 5341 - DNA, 258 bp, A.fumigatus
atgtcagaaatgaatcggtggtataaagtctggaaggcgtcgaaatgtcttattcttttactcccatacactctttttccgtccctttttgtgactttcctgctcccataccttaaaggtgtcttagcggaacaccttgttcaagaagtatgcggcatcttcgtccctctttttgcattctcttttcttatattcccctacattccgttttatctgaaggatattcccttgcgactcgacaaaatcttgtaccgaagg

SEQ ID NO: 5342 - DNA, 195 bp, A.fumigatus
ttcggttcggggcgggattggcgtttagtgatgggatatctactgttgaatgcattgcgaaggggaccttcttggagattgaaactgattaaggtaacggatgctcatatttctgaggggttcctggagggccgtcttatgtgtacgttgtatcccgatgccggcgcgcatgcctcccatggtacccgtctctag

SEQ ID NO: 5343 - DNA, 228 bp, A.fumigatus
gctgaaaaggctacgggtccacttggccggctgtctcccgggccgggtccggtcggtgaaaacagagagaccgggacgagtgcctacttaatcatcctagaagatcttcattcaggctcaaatagagagagccaagacgagggatgccgtcggtggcgtggcttgggaacggggatcctttttggtcacgtgcccaccggtctgcttttattccttcgtatacattaa

SEQ ID NO: 5344 - DNA, 258 bp, A.fumigatus
cacttcaatgcctacatcagcggcgtgcccttgactaatacccccctcccccttacccctgcccctgcccctgcccatggccctgcttccttcccccccttatctcccccttcttatcccccctctagtcttgcccagtccacatatataactatcaccagaagtcccctagctaggaacaatactgccatgaagaaaacatatagtaatactaagactgataggttagctacaaagctgccacctcctgataactaa

SEQ ID NO: 5345 - DNA, 438 bp, A.fumigatus
agcgcggacgatctcagctctcacggcgactgggtcaaggatatcaacgaggtcgcatcgaccaccgttcagttccccatcattgccgatcccgagcgcaaggtcgccttcctctacgacatgatcgatcaacgcgacctggacaacatcgccgagaagggcattcctttcaccatccgtgcggttttcatcatcgatcccgcgaagaagatccgtctgacaatgctctaccctgcttccactggtcgtaactccgccgaggtcctgcgtgtgattgacgctctgcaggcagcagacaagaaaggcattgctacccccatcgactggaccgttggcgaagatgtcattgttccgccctccgtctcgaccgaggacgctaagaagaagtttggcaatgtgcgagaggtcaagccctacctgcgctacaccaagttctag

SEQ ID NO: 5346 - DNA, 282 bp, A.fumigatus
tttagcaccttgcttccatacatacatacatacatacatacatacatacatacatacatacatacatacatacatacatacatacatacatccatacatccatggtcaaccaaggacataggtagatggaagaaatgttctgcctcaggcatgcacgccattccgagtgggtttcccaatatggttagcacctggtactgccgtgcccctccgatgttgttgcgtcagtcgagcaccgacaaaagccatcgaaggtacactctcgtttccgccctcaattga

SEQ ID NO: 5347 - DNA, 222 bp, A.fumigatus
catatcgtacgtattgtagctccgaacttcaaggctcagaccacccacggcgagattgatttccacgagttcatcggagacagctggaccattctcttctctcatcccgccgacttcaccccagtatgcacgaccgaactcggtgcctttgccaagctgaagggtgaatttgacaagaggggtgtgaagatgatcggtctggtgggtagtcctctcagttga

SEQ ID NO: 5348 - DNA, 201 bp, A.fumigatus
  unsure (27): Identity of nucleotide sequences at the above locations are unknown.
attgatgccgacgttttcagatgccgnacttcaccatggcgggagtttagctctgatacttcagacggactttcgaccaacaaggcaacgcctgcccctgaaaacaagcattttacctctcccgtcggtagtcaatctacatcaaagcggagcatcatatcccccaaacccacttttctttactgtaattgtcttatgtaa

SEQ ID NO: 5349 - DNA, 861 bp, A.fumigatus
cacaagcatactaattgtggaacgccaatggtgcgaggaattggtaacatcggtcgaatctacagttttgagctgttgctactcgatggagccgaaaagggacctatcgtcagtaccagtaaaccgagcacattgctgtgccagtatggcagagctgaggcagtgccaatgcaaggctactttgacatatcagctgcatataacggaaatcttattgttgttacagatatactggatcccatgtatcgaccggcatcggtcggagcccatctagaacttggtgtagcgcaggtagggcttgacctctcgcacattgccaaacttcttcttagcgtcctcggtcgagacggagggcggaacaatgacatcttcgccaacggtccagtcgatgggggtagcaatgcctttcttgtctgctgcctgcagagcgtcaatcacacgcaggacctcggcggagttacgaccagtggaagcagggtagagcattgtcagacggatcttcttcgcgggatcgatgatgaaaaccgcacggatggtgaaaggaatgcccttctcggcgatgttgtccaggtcgcgttgatcgatcatgtcgtagaggaaggcgaccttgcgctcgggatcggcaatgatggggaactgaacggtggtcgatgcgacctcgttgatatccttgacccagtcgccgtgagagctgagatcgtccgcgctctatacatcatcaatgagtatggtaccatgattcaactgagaggactacccaccagaccgatcatcttcacacccctcttgtcaaattcacccttcagcttggcaaaggcaccgagttcggtcgtgcatactggggtgaagtcggcgggatga

SEQ ID NO: 5350 - DNA, 276 bp, A.fumigatus
gtatggtaccatgattcaactgagaggactacccaccagaccgatcatcttcacacccctcttgtcaaattcacccttcagcttggcaaaggcaccgagttcggtcgtgcatactggggtgaagtcggcgggatgagagaagagaatggtccagctgtctccgatgaactcgtggaaatcaatctcgccgtgggtggtctgagccttgaagttcggagctacaatacgtacgatatgttagcagaatgtttacaaccaaaggaaagaagagaataa

SEQ ID NO: 5351 - DNA, 1041 bp, A.fumigatus
gtagctcatcttcccactgtgaaaggcttgggggcaccaatatcgtttactcccgctgccccggcatcaccaacaaagggatctccacgacggcgtaaagtgggtgccggaaggaagagtgtcagtttctcgccgaagaagacacaggcaaaaacaacgaagagaagtgtccgctggaaggacgacgagcaagatggtgccttgacggagtatcaaaagacacctcaaaaaccacttactgagactatccctgaagaacctcccagcgaggagccccaactgccccgagcctctccaatcccacgtggaatccctgtgcccagccgaaacatcagtccttctggctcctctcccatcccgcctccttccaatgaaccaacgctgcacgttcaaaagaacaatcgatttaaagcgggatttctgtcaaagaaggccggcagctcgcctgtggggccgcctccaacctccactctcccgctctctgacaatgagaattcacctttgcgagatattgaaaacagcagtttcctgaatcgcagctctatggaccgtccgtctcgaatcgcagttcgaacatccagcggaagctactccagtagcccactgcccgacagtagggatagctggaaggctagcaaagatgatgccataaagatcacttcagctatgaggcgaatttctggcggacaatttggctccgctgcctctaccaactccctccgcatcaaccgccggcgcagcccgacatctgcaacatatggaagctctccaagcgaaaacacaatgtttaccgcgtcgcaggccaggcggatggtcaaaagtgagaaggagcttgatcccaagcctagggttttgagtcctcgaactctcccaattatgaaaagcacaagtcatagacgaaccacattcggtggtgacattcggccccgagatatcagtcttactagcagagacgctataaggcttagtactatggccgctccaagtatcgagcgacccccggagactctctaccccagctctggagcaggctggaggtag

SEQ ID NO: 5352 - DNA, 918 bp, A.fumigatus
gggctaacattctgcgtctgccgcatcgcactatactttgtttgtcgcgcctcggttttctcttccagtgtcaccaccaggatccaaatctcgaccatgaccagaatacgtccagactatgatgccatcgtcattggcgcaggcttcagtggtgtgcgatctctctgggagctccgacgactggggttgacagcaaggtgcttcgacgccgggtcagatgtagggggcacctggtggtggaatcgctatcctggatgtcggactgatggcgaggcttgggtatacgctttgaagttcctgcccgagctgttggaagaatgggactttaccgagcgctatcccccgcaagaggagattcaatggtacctaagtcgggtccttgaccgttacgacctacgcaaggacatcgagttcaacaccgaagtcaagtcagcccactacagcgatcatgatagtatctggaagatcactacggcgagtgggaaagtggctactgcgcgatactttctccctgctacgggtatcacctcgattcccaaggagccgccctttccggggctccagtcgttcaaaggggaggtatatcaaacttcgacgtggccagcccacgagatcgaatttgagaacaagcgaattggtgtaattggcacgggctcgaccggaatccaagtcatcaccaagctggctccagttgccgaacagctgattgtttttcaacggacgccaaactacgttatccccgcgcaaaactatcctctcgacgagaaaaaaagggaagatatcaagaaaacgtttgatgctacctgggatattgccaaacgaaacttggccggccacgcggtgaagcattcagggcgcatggtcgcgagtgctggcgggcccgaagagatccaacgagtattcgaagatggctgggcg

SEQ ID NO: 5353 - DNA, 318 bp, A.fumigatus
ggactttcagttgcaacctgtgacagtcctatgatggcctcgttattcggctcgaacaatgacggctcccaactgggaacagccctgctccgcatctccccactgatcatatcgtccgcatccttgatgttcagctggtcgcaggacatctctcttggggcattcttacacccctccttacggcacgacgcagcccacccgagtggcaagctcctccctcgctacctgcccgctttcatgagtcctgggatctggggaatcggcctgacgtacccccctgccgtcttctaccacggggccggaaggacacgcgcatgg

SEQ ID NO: 5354 - DNA, 435 bp, A.fumigatus
ggaacaaatacgctccccagaccatattcgccaacatgggcagccctcatgtcacgttttccccactccctggttgataatcagccgttccacaaaatcctgtggcatgcaggactggtctcctctaaaagtgaaggccatcgcatcgtcgccaataagggcgcatatgtgggaagtcgcccaggcgacagtgggcccatgtctgatgatctagcgttcacgcccattgagacttggctcccagaaaagacgcaagagttcatcatcaacggggacctcttgctcctgaagctcggtaaatggaagttccggatggtaaggatcgtcagcgatgaagagttcaaagagcgcggacttactgctcctggttgggagctggagaagtcggaatcagaatcggctgctgaaaaggcaacggagacgaagtcagcatga

SEQ ID NO: 5355 - DNA, 555 bp, A.fumigatus
ccaaggaccctcgaaactcacagatctgatgtacacttctggcatgcaggttgcattggcccaatgatcgtcgagggcgatcacatcctgggtcacgagtcggctggtcaagtgattgcggtcgctcccgatgtcacctccctcaaacccggcgatcgtgttgctatcgagcccaatattccttgccacgcttgcgagccctgtctgactggacgctacaacggctgcttgaatgttgccttcctctccacacctcccgttgacgggctgctgcgacgctatgtcaaccaccccgccgtctggtgccacaagatcggcgacatgagcttcgaggatggcgccctgctggaacccctcagtgtatctcttgcggccattgagcgcagcggactccgtctgggcgatccctgcttgattaccggcgctggtcctattggtctgatcactctgctcagcgcgaaagctgccggtgccaccccgctcgtcattacggatattgacgaaggacgtctgcagttcgccaagtctcttgttcccgaagtgcgcacctacaag

SEQ ID NO: 5356 - DNA, 276 bp, A.fumigatus
acctcttctcattggtttgtccagtccatctaccacgagtcggatatcatggctaccgcaaccacaactgtgctcgagaagcccaacattggtgtctacaccaaccccaagcacgatctgtggatcgcagaatcaacaccaacgttggaggatgtcaagagcggcaatggactgaagcctggtgaagtcacaattgaggttcgcagcacaggtatttgcgggtatgttcttcgtattccttgtgtgcgtccgtttgtctcgtgtcgtacggagtag

SEQ ID NO: 5357 - DNA, 564 bp, A.fumigatus
tggctgaatttgagaacgctggcggtcctgggcgcaatgaccagtctgacgacgaaggggacgagaagatttacaaccccactcaagcttcccttggcatgggacggcaagcctattccttactggctgtataagctgcacggtctgggcgtcgagtatccgtgcgagatttgcggaaactttgtctacatgggtcgccgcgctttcgacaagcacttttcggaagccttacatatcttcggcttgaagtgtctgggaatcacatcgaatactaatctcttccgagaaattacccggattgaagacgcaatcaagctgtgggagaagcttgagcaggatcgaaagaaggaacgggagtctcgtgagaacgtggtgcagatggaggatgccgagggtaatgtgatgccagaaaggatctacctcgagtacgtttctcttttccttacaaagccaaacgatgctaacttgctacagtcttcaaaagcagggtattctgtgatccttctgctcagtgtgcctttccttccttgctttggtccgtttagagtaaaagcctggagttaa

SEQ ID NO: 5358 - DNA, 942 bp, A.fumigatus
cgcggtaccttccagcccgggcctgaagatccaaatgagcctgttgaaaatcttgagagagcctacaagcgccgtcaacctggtgagggcgaaccgacgggcgtggaaattgacacaatgttctccggcgaagaggcctacgggcagttcctggacctcacaacattacacgaagactatctgaaccttcctggagttaagcggcttacatacatccaatacctcgacgtgttcgactcattcgtacccccgcatctccttatcaagcgagcgaataagatatcggacaagtatttcaagtatgtcggagagcttgctggctacttggaaagctttatcaaacgcacaaagcctttgcaggatctcgacaaactcttcgcaagctttgatgaagacttcgagaagcaatgggcagcaaaccaagtgcctggatggacagaggagaacgttgagaatcgtactcaggctccaaaaacacaaggctcaggggaaggcatctggtgtaccgattgtgaaagagaattcaagaacgaaaacgtttacaagaatcacttgactggcaagaaacacattcgggccgccgaagctcgcaaagctgtaggtgactcgggcgcgggtgcaccgccgtcagttggtggcgttacctctgtggcccaccgtctgaaagaacgcgcagttgctgagcgcgagcaccgggttcgctctttagccaaggtcctcgactctgaacggcaggcaacccgtatcaacgttgagcggagacagggcatgactgagcgcgagcggcagatggagctggaggctttgatggctgaatttgagaacgctggcggtcctgggcgcaatgaccagtctgacgacgaaggggacgagaagatttacaaccccactcaagcttcccttggcatgggacggcaagcctattccttactggctgtataa

SEQ ID NO: 5359 - DNA, 384 bp, A.fumigatus
gtctacctgagtctacctgactcgacctttcaaaggtcatggcaagcgaatctaacgctatcacagaacgcagctatctctaatgcacccccgactcattcacaccctggtcctactagacccagtcatccaacgccaaaccacccagctcgagccacgacccctgtccaaggaccagttcatcattgccaaaacgacccaactctccacctaccgccgagacaaatggccgtcccgcaaagccgctgcagaagccttcaagaagaaccccttctaccaaacctgggacccccgcgtcctcgaccgctggatcaaatacggtctccgagacctcccaaccgccgtccacccgctagacgacggtgcagcttctcaaggcaatga

SEQ ID NO: 5360 - DNA, 888 bp, A.fumigatus
cgctatcacagaacgcagctatctctaatgcacccccgactcattcacaccctggtcctactagacccagtcatccaacgccaaaccacccagctcgagccacgacccctgtccaaggaccagttcatcattgccaaaacgacccaactctccacctaccgccgagacaaatggccgtcccgcaaagccgctgcagaagccttcaagaagaaccccttctaccaaacctgggacccccgcgtcctcgaccgctggatcaaatacggtctccgagacctcccaaccgccgtccacccgctagacgacggtgcagcttctcaaggcaatgaccgaccagtcacgctcacaacgactctccaccaggaggtcttcaccttttcccggcccaactacgacgggccccctggcaagaacgtcccgattaaccgggtaacgcatcccgatctgaaccccaagcacgttggctcatttcctttctatcggccggaaccatctcgtatctttgctcagcttgagcacctccgcccgagcgtgttgtatatcttcgccggcaagtcggacatgtgtctcccggagatgatggccgacaagatgaaaaatacaggcacggggctcggcggcagtggcggtgcggccgaaggacgtgtgcgcgacgtatatctcaaaaaatatggccacttgctcgcgcaggaagcgcccagtgagtgtggcgaggcggcgagccgatggctcggcaaagaattggagcggtggagggcggaggagcaagccttccgagagcagtggagcaagaagtcgaagatcgagaaagcgactattgattcacggtggaaggaacatgttcctgcacctgtgagacccaagaaggattccgaggccaagttataa

SEQ ID NO: 5361 - DNA, 312 bp, A.fumigatus
ccgattttgccatacgctccgcagatggcgtcgggcggtcgggcttccttggggtcttttcctcgagggccatggttggtggtacgtttagtgtatgaatctagtcctcggctttttgctaacttctcttgcaggcatgtcatgaccggtattggagcttacctatatatcatttggggtatctggctgcgccattgcctgaacggacggcaagaggaatacgagctgtggtggcctcatttctggaacttcccggaaattgtccctgtcagtactgactccggaagtcgaccggccaagaagtcaatctga

SEQ ID NO: 5362 - DNA, 603 bp, A.fumigatus
tcctattccactcgactctcaaatgcaagtccagtcactaagaaggaaacatgcgagattgctgactacctactagatccgatgcaattagttgatgagctctcgatgatctacacgacatgcttgatgtgctatgcctcattttcttactcacgacccctcggcttccgtattgttctcgccgttgcattgacaagtttggccgtcttcatcactctttactaccattacctccaggaccccgtattccatcaaaatgcgtatgcgcttttgacgatcgtcgtcgttttgagaagcatgtacaccatggaagtgacacttcgaccctctttgcggcactcgaccgaggaggaccggctggctcgtcagaagaaagatctgcccgtgctttccaaggaacgacagcattacgaaaatgtcagggacgtgaggactctcaaaacaatgtggttcatggttgcctacggactagcgatgtttctgggaggattcttcatctggactttggataaccgattttgccatacgctccgcagatggcgtcgggcggtcgggcttccttggggtcttttcctcgagggccatggttggtggtacgtttag

SEQ ID NO: 5363 - DNA, 198 bp, A.fumigatus
ataacttgtaggttgcttcactggaatacatcagagttcatacagataatagccagattcgattcaaggggctgtgtccaaggctcacttaccaattacgttagtggtagattatatgattataacaactatctagtgattttctataaaaacatttgtctaaatcacagtaatcccttcgggattagttggttgtag

SEQ ID NO: 5364 - DNA, 462 bp, A.fumigatus
ttatttaatgcgagcactgtcatcgaatcgcgggctgctacccagcttggtgaaaacgtcaaactgctcacatacgtgagcatattctatctcccgctaggttactgcgctgctttatggagcatcaaccgagatttcaacttagtggcattcaccattaccactgctcttctggctctgggcacgtatgctctggtgttgaacctgaatgatattgtgtttctgatcaggaagacctaccgaaagctgcggtctcctatattggaagcaatgaaaaacgactcgcatgaacaatgggccgagttgggcagcgctttcagtgaattcatgccggagaggcatggtgatcagccctccgagtgggcaattctgctgtacgctgtgttgatggctacagagaagttgaaattctggaaacgaggccactccaatccgattgatgacggactcgaacgaaagtga

SEQ ID NO: 5365 - DNA, 468 bp, A.fumigatus
  unsure (452): Identity of nucleotide sequences at the above locations are unknown.
cttgaccactccccccccatctttcctactacgggtttttggcctcaacaacacccttatatagctatttttaccatgaccgcagagcattctcccttaagcctgagcacggttctcgtgaccggtggcagtggtggtcttgccagcaagatccttgagctcttctcacagcgtggctgcaaacgtctccactcgattgatattcggcagccatcccatcttcttcacggtgttacgtaccatctaggagatcttacagatgttgatgcgatgcgacagatctttcatgaggtcaaacctgacgttgtgattcacaccgccagtcctagattcgacacgccaaatcatatcatgtataaagtcaacgtggaaggcactaaaaacttggtccagattgcccaagagtctggagcacactcgttcgtctacacgagctcggcgagcgttatcancgacgggaaagactga

SEQ ID NO: 5366 - DNA, 192 bp, A.fumigatus
gggttgacaaagtcggtggcaccgaacttgcgagcccacgcctccttgctgtcgttgacatcgacagcaatgatcttgcccgccttgttcttgacagcaccctggatgacggagagaccaacacagccagcaccgaagacagccacgttcgagccctcctcgaccttggcagtgacaacggccgcaccgtag

SEQ ID NO: 5367 - DNA, 318 bp, A.fumigatus
tcaccgggcttcaccgaagtgacaccctctcctacagactcgacaataccagcaccctcgtgtccgagaatgacggggaaggcgccctcggggtcctttccagacagtgtgtatgcatctggaggccgattagccgttgtcaccgtttctgaagcttcttcccaaccaagagataccaacctgtgtggcagacaccggtgtgcagaacctggatgcggacttcgtgcgccttggggggtgcaacctcaacatcctcaatcgagagaggctcgccagcgccccatgcaacggcagcctgcagttctcagtatgatttag

SEQ ID NO: 5368 - DNA, 264 bp, A.fumigatus
ggttgcaccccccaaggcgcacgaagtccgcatccaggttctgcacaccggtgtctgccacacaggttggtatctcttggttgggaagaagcttcagaaacggtgacaacggctaatcggcctccagatgcatacacactgtctggaaaggaccccgagggcgccttccccgtcattctcggacacgagggtgctggtattgtcgagtctgtaggagagggtgtcacttcggtgaagcccggtgactatgtcattgctctttag

SEQ ID NO: 5369 - DNA, 450 bp, A.fumigatus
agcacccccgagtgccgtgagtgcaagttctgcaagtccggcaagaccaacctctgcggcaagatccgtgccacacagggcaagggtgtgatgccggacgggacttcacggttcaaggcccgtggcaaggacctgttgcacttcatgggcacttccaccttctcccagtacaccgttgttgctgatatctccgttgtcgctgtcacacccaagatccctactgaccggtcctgcctgctcggttgtggtatcaccaccggctacggtgcggccgttgtcactgccaaggtcgaggagggctcgaacgtggctgtcttcggtgctggctgtgttggtctctccgtcatccagggtgctgtcaagaacaaggcgggcaagatcattgctgtcgatgtcaacgacagcaaggaggcgtgggctcgcaagttcggtgccaccgactttgtcaac

SEQ ID NO: 5370 - DNA, 576 bp, A.fumigatus
  unsure (534): Identity of nucleotide sequences at the above locations are unknown.
aaaatagttgtggaaacatgtgctcacattctgagtagtgttcttgtcatcggtgctcgcaactcgggcaagacctccttcttgaattttctcaggaaatctttaactatgccgccacacaagcatcccattcgatctccagaagaagtcgaagcatatgaacgccactcacctgctaacgaaggcttcacctctcactaccttgaaaccgaaatagacggtgagcgtgtgggtctgaccctgtgggactcccagggactggagaagaatatcgtggacattcaactgcgtggtgtcaccggattcctggagagcaaattcgaagagaccttgcgcgaggagacgaaagtgattcgatcccccggcttccgggatacacatatccattgcactttcttgcttcttgatcctgtgcgtctggatgagaacattgctgccgctgaacgcgctgcccaaggaacttctaaagcagcagatacgccagtgattgggggtttggatgagttcctcgatattcaagttctacggactgtnttgggggaaaaccactgttgttcctgtcatcaaccaagctga

SEQ ID NO: 5371 - DNA, 1347 bp, A.fumigatus
tcccaccccgcaggatcttatcgaattcaaatcttttggaagggcgatcccggtgttgtggacaatttcatcatccgtttccagaatgaggacgtaatgcgcaaatggtacaaggagattgacacgcagcgagcgatccaagcggagcaacgcagtgcccgaaacacaggtacctccgaaacggaattcatgtacatgaagggcattgcgaacatgccgaatccttatcagcaagagtacgacgctgaagagcagagcaccaaggaagcagcgttcttctccgagtttccaatgagccgtaatgcttccagcacgagtcttcgaacccggtccgcaacggggggaagcgggagctctggacctccactgtcgtccggccggcaaatttgcttcccgcgggaccctagtctgtccgtccacacgcagttcacgcccggtagcatgtcacctgcggagaggaatatgaactcgtacttctcccctgtcgccgagacaccgtcgaccagatcaagttcccagtccactggttactcgtatgggcgccagggcacaccgtcgaacaactggaatgaggagcctaatcgctacaccgctcctgcattgtctcgtggcgtatccagagatgggaccaacttcttcaacaacgcgcccaatggccggggtactcgaccttcccttccgcctttggcaggacaaaccaacgccaacggcatggcgcaaagaatgcgctccgctagcagcccggacattcaccatcacaaccccgaatcgcgtcggtatatgggagcccacacgatgcagaccgtagacaacgttccggtaccacccattcctgctcatatggccagtatgaaggcgccagtgaacagaagccagaacaattcgcctaccggtataaatcttccgattcgcaacggccacagccagcaagcctcgacccatttccacgagcctcaatattcagagtctcgagccactgggcccgcgtccgatcaaccgacgtctccactgagccgtgagcccgacgaagaccctctcatgccgacccagctcaaagccaaggtcaactttgatgacaattacgtgaccttggtcattgccagtaatatcatgttccgatcgctcactgatcgggtggatgccaaactggcccggttcaccaatcgatccattggcaataagtcagttagattgcgctaccgggacgaagacggagactttgttacgattgacagcgacgaggctgtccagctagccttcatggaatggcgcgagcagcaccgggatatgctggcgaagggccaagtaggggaaatacaactctactgccaagtggttgagaattag

SEQ ID NO: 5372 - DNA, 909 bp, A.fumigatus
accaattgctcttctaacagcgaagcaagagcaacaacctcaatcgcaatcatggtgcacgctcatgcgcatcgcgatcatcacgctgcgcttctggagcgaagtctcgaggaaagagatcccaagaatgaagctgtgaccattgtctacgtgacagcagctcccacctttgacggtcctatcggcggctatgtaacgggtgtagacccggcagaaacagcaacacggccaaaccagggtgttggggctccccttggacacacacggcctaccaccaccgaggaagtaacaacgacggcccagccgaagccaaaaacgacaaaagagacgaagcctacaatcaccgaagcagaacccacgaccactcaacgtaccaccaaagcgaccaaggcgatcaccaccgacaacactgaggacatcatcaccactccgaccactttctccacggccacctctagctcgacttcttcgctgaccatcccaggcttggatactaccactaccactaccacccatggatcatcgtctttggaaaagtcggcctcgccatcggcctctccagttgctgccggttcgagctcgggacttaccgggggtgctaaagcgggtatcgcaattggtgtgattcttggacttggtttgatcgcgggtttcatcttcttcgtcatgcgcaagaggaagcaagggcaacagatggcagaggccgaggcaatcaaggagaaatcccatgaagccgataatatgcttccccctggccctccgccaaaaccccaaccgatgactccagctgaacctcctcagctcaatgtccgccctgtcactcagtttgcaccagatctgacccctatgggcacactgggtgctggcggggctgggggtcttcaccagacggctggaaaatcatacgtc

SEQ ID NO: 5373 - DNA, 717 bp, A.fumigatus
gcgtccaattcgctcaacaacggccccctcaaatcaacctttggagccaacgttgctcgacgacgttggagcagtatctatatgatctcagatacctatgagaatgctaaattctcctcaaccacaggtggaaagtctccgatagcgttgggaaagccttccaccatgtcgtggaacttgtccaccgatacctctacagaggcaacctctcgtcctcccctagcctcacaacagtcgaattcccttccttccactccatatcaacatacgcgcaacctttcattccactcgaggacgccttccccccctcacggaaacacgtcgccacgctcgacccattccgagtcaatacactttcctccgtcgttacgaaagccgttcgcaggttgcaaatatgaaacggcaatggcctttttccgacggaggatgccttatacaataggtgctgatctgttaccggaggaaaaggaaggtctcaaagagcggcttgaagcagaggaggaggagagactgactaaggatatgttggaggtatatgatcgtttattaccatcagcggagagcgacgaccgacggcgtcagctggttcgaaagttggagaaactcttcaatgatcagtggccaggtcacgatattaaggttcatgtcttcgggtcgtcggggaacaagctctgctcaagcgattcagacggtgagtggtcatggtgcagagcctga

SEQ ID NO: 5374 - DNA, 384 bp, A.fumigatus
tgttgtgcgcatttcgcctccactctggtgtaccttaccgaagccccggcgcttggaaagatatctacggtcaccgcaaacacggtgtcaattcgttcatcaaggatcccgagttctataaccccagcccgaacggtgggcatatacttacagctggtgacgccgatcacgccaggcagcggcgccgattgtcgcatgcaatctccgagaaaaacgttgagagaacaggagtcgctcgtactgcattacgtcgatcttctcgtcgagaaactacgtgctgaatgcgcagctgcgcgaagcacggtcgatatgatgaagtggtacaattacaccacctttgatatttttgtcgatatcgcccacgacggagcaaagcaaacgcgt

SEQ ID NO: 5375 - DNA, 360 bp, A.fumigatus
gtgcacctaaccacaaactgcctgactggacagcgtcctgctgagcaggccacgagtagaatagctggtggcagttctgcttgggcaggttatctacaatatctagttatctacctacagccgctaaggaaatctcctggccccaagctcgtggcatgctcgaatatatgctacatctggtggacattctcaggggaaatacatgccaagctaaaggaactgcatgatcagtatggtgatgttgtgcgcatttcgcctccactctggtgtaccttaccgaagccccggcgcttggaaagatatctacggtcaccgcaaacacggtgtcaattcgttcatcaaggatcccgagttctataa

SEQ ID NO: 5376 - DNA, 192 bp, A.fumigatus
cctggccgcaagcaccgccgtcgtgaggcccgtctcgctaaggccgccgctgttgctcctcgtccggttgacaagctgcgtcccgttgtgcgctgccctaccgtcaagtacaaccgccgtgtccgtgtcggccgtggcttcacccttgctgagctgaaggtaaattcatcctcacttttcgtcccacaatag

SEQ ID NO: 5377 - DNA, 438 bp, A.fumigatus
gaagctggtatccccaagaagctcgctcgcactgtcggtatcgccgttgaccaccgccgcgtcaactactccaaggagtcgctcgttgccaatgtcgctcgtctcaaggactacaaggctcgcctgatcctcttcccccgcaagagcggtcagttcaagaagcttgactcatccgccgacgaggtcaacgccgccaaggctgctttcgccgctgagggcaagactgagggttacgccaccaagctgggcgctaccttccccgtcaagaacatctccgccgctgaggccgttactgaggtcaagcgcgatgagctgcccaagggcgaagaggccgcttaccgccgcctgcgggaggcccgcagcgaggcccgctacaagggcatccgggagaagcgtgccaaggccaaggctgaagaggagtctgctgctaaaaaataa

SEQ ID NO: 5378 - DNA, 204 bp, A.fumigatus
tgtaaacctaacttttctctccttctttcaccagatgcgggccacaccatcgtccatgagaacatcacttatgacttccacattcttccctctggattggtgtctccgtcctgtgtcaacctcattggcgctggaactgtcgtgcacgtccccagcttcttcaaggagctggcctcgttggaagagaaggggctgaaggatgcc

SEQ ID NO: 5379 - DNA, 183 bp, A.fumigatus
aaggtagggtggatttatttatataattttagtaagtataaggtatatacctacttccctataacagcaataattttaaacagcctattatatttattattaagtttcttatatagacactatattctcaagttttttaataagagtagcaccttttctctaacagaaaataagatatcctag

SEQ ID NO: 5380 - DNA, 441 bp, A.fumigatus
  unsure (346): Identity of nucleotide sequences at the above locations are unknown.
ctactacacacagccctctacctctacgcccggcacgagtcatccacccacagcaccaccgcttactgcacagactgcctgccctaccccatgagtgtggaccccaaaatccggcacccggaagaaggccgggccgaaaacatccgcaccaacaagcagtccttccgctatgccgttgacttgacatttcgggggccggttgttcgttccaataacccgggttctggactttccggagacgaattcctggggggaatgcgggaaaaaatattccggtttgcggtgggggggaccccttaccaatgccttgtttggggggattgggaccttggtttaattaggttgnccacgcccttattaaccaaacccatttggagttttgggttggctttttcggaattttcctcacctctgaaccccgacattggctccggcctttac

SEQ ID NO: 5381 - DNA, 201 bp, A.fumigatus
cgtcatatcggcagcacgagtcggcagagggtgcagcaagtgtcggaatcttggaaggaagggcaaaatgtcgcttggatggcgtctgtggctcaatttgccgatctcaaggacctgtatgttaggagtggcacctcctccaacaccttctctaacaatgatacccgcagttcggaaaccatcctattaaaatttcagtaa

SEQ ID NO: 5382 - DNA, 1680 bp, A.fumigatus
aaggcgatttacacatctcctatcaaagcactgagcaatcaaaaattcagagacttcagaactgagtttgatgacgtcgggattcttaccggagatgtccaaatcaacccggaggctagctgcctgatcatgactaccgagatcttgcggagtatgctctaccgaggcgcggatctgatcagagatgttgaatttgtgatctttgacgaggtgcactatgtgaatgatctcgagcgaggtgttgtttgggaggaggtcatcatcatgcttccggagcatgtcactctcattctgctctctgctacagtccccaatacctatgaatttgcctcctgggttggtcgtacgaagaagaaggatatctacgtcatatcgaccgccaaacggcctgtcccactggagcactatctctgggcaggtaaagacaagtacaagattgtcgactcgaacaagcgctttctcgagactggctggaaagaagcagacaacgtcatttccggcagagacaaaataaaagcacaaaaggcggccgaagctcaagctcagtctcaagcacagcgcggaggacaacaaggcagaggccgtgggcagcctactggtagaggagctcctcgtggaaacgctcagcggggcggtgctcctcgtggcagaggccagcctgctaacaggggcactggcaatatcgcccgtacgggacggggtggaggacgcacaacggctgctcaggataagacaatctgggtacagctcgtggggcacctccgaaaagagaacttgctcccaggctgcatcttcgttttctcgaaaaaaagatgtgaagagaatgcagactcactgtccaatcaggatttctgcaatgcttccgagaagagtttgattcatatgttcatcgagaagtccctgacacgactcaagccagaagacagaattctgccacaaattcttcggctgcgggagctgctaagcagaggtatcgctgttcaccatggtggtcttctgccaatcatgaaagaaattgtggaaattttgttcgcaaaatcgttggtcaagattcttttcgctaccgagacttttgcgatgggtctcaatctgcccacacggacggtcgttttctctgggttccgcaagcacgacggtaggggctttagagatctcttgccaggcgagtatactcagatggcaggacgtgcaggacggagaggtcttgacactgttggatacgtcatcatcgtgagcgctggtagagacgaggcacctcctgcgggtgctttgagaaagatgatccttggtgacccgacaaaactccggtcccagttcaggctcacttacaatatgattctgaatctcttgcgtgtggaagctctgaagatcgaagagatgatcaagcgaagtttcagtgagaatgccactcaggctctgctgccggagcatgagaaacaggtacagctttctgaagcaagtctggcgaagataaaacgagaaccttgcgatatctgcgatattgacctggtagcctgccatgatgcagctatcgagtatgagaagctaacgagcgaacttcacgttggtctgcttgcctctcctgtagggaagcgtcttttcatgccaaagcggcttgttgtgtatcgaaaggttagtcggacggtggatgttattgccttctgttctcaaatttactga

SEQ ID NO: 5383 - DNA, 189 bp, A.fumigatus
gttccgggttctcatactccgctgcgaaaagggccatttacaggaagccatctcctaacccagtcgacgagttccgctaactaccttacctcttgcaagtcaattcaccagagatcacgacatgttagctcattcatcaagctggatgtcacaagcttattccagctttgcagtgtgaccaagcaatga

SEQ ID NO: 5384 - DNA, 243 bp, A.fumigatus
  unsure (137): Identity of nucleotide sequences at the above locations are unknown.
gttagcttctcatttacggctgcgcttgtccaggaggaagctgcgcaaattcgtgaacttgtgtttaagtgcatcatttcatatctctataacaatagttcaaagcaagacgaatgcaccgagggaagttgggatancattgggtggtttgaactgaagatccgattactctttattgaccctaaccacgctatccatttcaggactaccgccgcatctccgaatccttccatctgcaactcc

SEQ ID NO: 5385 - DNA, 756 bp, A.fumigatus
tcgatcgcgacgtcgaggaacgacgatctggtttttttgggcaattttctctccactttttccgattggtctatgacaggttatttctccgcgattcaaaagcagctggcccctgtactcatccgcaaggatgctcaaatcgaagttgcccagctgctggtcgaacaggtcacgcagtcctgccttgatcataaagtcgatggcatcttgaacgtctcagaatttgagagtaaagcatactctctacgaacatttctcgaggatacagccttcatgggtgagattgagagacttgacttgaatggcttcgtgtcactgcaggagaacagtggcctatcccctccgttaacagctactatgtcgcgtcagtcatctcaacgcaaggaaaatggaaaaagctcgatattgaagctcgccccgccacatttgcgtattcgtcgcggtaaagattacctagaagttctgccgcccgccatttcattctgggagacattcggcttggaacctgcctacgggtcgaaggacatctacgcttattgtatccaccctcagactgcagctgaagcggcaaatgattttctcgagcggctaggcctgctatattcgagctgcaaccttggtcagcatacacgagctagcaggtcgactggcttcgaccgtggaatgtgttcttggaacatcggcgcacctggcgaatttaattatcactatataatgcaatcactgaaatcaatatgcgacaagctaggtatgtga

SEQ ID NO: 5386 - DNA, 189 bp, A.fumigatus
ttcgcgactaaccctcctttagtgacggctcttttgaaaagcccaccgacgagagatagcgttgtcgtctacataattaatccattcagtcacgccgcggctctagctgacatttgctccgcattctatgacctctttcagaaatatatcgatgaagttggaaatcagcacgccggtcaagcaaagtga

SEQ ID NO: 5387 - DNA, 711 bp, A.fumigatus
  unsure (677): Identity of nucleotide sequences at the above locations are unknown.
ccaattattcctccagcacaccagcacacaccacttagagcatcttctctaataatggcatcagtcgaatcccgaataatcgcaatcactggcggcgcctccggcattggtgcggcgacctgccgcctgctcgctgaacgtggcgctgcggttctgtgcgtctgcgatatctcgcccaagaattttgatgatctcaagatttcaatcaagaaaattaatccatcgacaaaagtccactgcgctacagtcgatgtaacctcctctgtggaagttcggcaatggatcgagggcatcatatctgatttcggagacctccatggagccgtcaatgcagccggtatagctcaaggtgctggcatgcgaaatacccccacgattgcagaggaggtggacgaagagtggacaaggattatgaacactaacctgaatggcgtgttctattgcacgcgcgaggaggtgcgtgccatgaaaggtctgcctgctacagatagaagtattgtcaacgttggcagtattgcgagcgtttctcacatgccagacgtgtatgcgtacggcacctcaaaaggaacctgcgcctatttcactacttgtgtagctgcggatgcatgtcccttgggtatccggatcaataatgtctctccaggtgggtcatctccttccccttcttcggcatgganagctgtcatatggatcacaatactctcttgttag

SEQ ID NO: 5388 - DNA, 600 bp, A.fumigatus
cttaggcttgcaaagtacagtgtgggatctcagtaccagcatctgttgatgttctactccgtctacgcgcccaatttgggaccttggcccaacgacaagcgagataatgttcactgggtctgcggtatctgccctggaggcgagaacctggagattagcatgaactaccaacaaggagcgaaatgcacagttcgcatcgctgctgaaaccattacacccgcggccggtaccgataaggaccctttcaacctaaccgctgagaagaagatgatcgaggatcttaaggccctccagccaaacctgaacttcacttggtttaatcattttcagcgggaggttctggtgccggaagaggtggctctaaacaatgacgaaattatctccaaagtcccattcaagaatcagagactccatgggctcgatctgagtgaaggagcattcatgttgaagtcctacttcatgcctgcgattcgctccgccatcactggggttgagaacacacagatcatgttcgaatctatccgaaagctgaatctcaagaatgccaactttatctccgctctgaggtcttcaccacggggctgggagaagaagctccat

SEQ ID NO: 5389 - DNA, 750 bp, A.fumigatus
gcccgtttcgaccaatgggccgaggccagcatggagaaagatgatgatttgatcgcagagctcaaagcccccgaagaccttgtctttgccgacggattacaagaccaaaccgcgacattcaacctgtcccttcgtgccgttgacccagtcgatgtgtgtgttgagaatctatccctccaggttgatacgacgcgtccaatatggaagacctcgccgtcgcagttatggaatcggctctgcgggaagacgatggacacccacacacataaaactgtcctcgacagcgtcaacgcattcatgcctagtgggagtcttacggcgattatcggtagcagtgggtctggaaagacatcgctgctcaacatcatggctggtcggatgagcttgaccaaggcgaaagtctccggggcgaccaccttcaacggagttgcgggcattgaggggattcgcagcgcatatgtaatgcaggaggatgtgctaattcccaccctgacggttcgagagactctgcggtatgcggcggatctgcgattgccatcgccagcgacgcaagaggagcgccatcaggttgtcgagcaggtggtattggagctggggctgaaagagtgtgctgacacgcggattgggacaaatacacacaacggctgcagtggaagggagaaaatgcggacgagtattggcgttcagatgctggcgaacccgtcggtgagcatccttcggatccctgaggggaaagaacaagaaccctga

SEQ ID NO: 5390 - DNA, 231 bp, A.fumigatus
agacaaggcgagggcgaaaccgatgacgagcgcgtcaaggccctcctggcgcagctggaccagactctccagggctacgagcgggtgctttccaagcagaagtaccttgccggcgacgaggtcacgttcgcggatctgtcgcatctgccgtatggggtgtttgtggagcagtttgggttcgcagacttgattgcaaagtacccccgttccaaaagtactgggaggacttga

SEQ ID NO: 5391 - DNA, 498 bp, A.fumigatus
cgcgcggtccttccagcccgtggtgaagacctgggagcgagctacgcgcagcgtgatctgattgcgcgaaacgagtaccacaacctctccgccgcccggacaatcctcttcatcggcgacggcagcttccaaatgaccgtccaagagctgagcacgatcatccaccacaaactcgacgtcattgtcttcttgatcaataatgacggctatacaatcgagcggtgcatccatggccggaaccaggcgtacaacgacgtcgcccggtggcggtatctcaaggcccccgagctattcggcgcggatcaagagggcgagtacgcatcgcggacatgggagattcgcacgtgggcggactgtgacgccgtgctgaaggatgaacagctggtgaatggcaagggactgcgcatggtggaggtgttcatggacaagtttgacgcgccggatgtgttgatgaatctgctgaatgcgcagattgcgagggacaatgcgaagaaataa

SEQ ID NO: 5392 - DNA, 288 bp, A.fumigatus
tctggtccttcgccgccgttgagaaaaccttgcgtcttagtcgaccctgagtgtgatattgctgtgggtaccatggcccaactccttcttcaacagggtaaggtctcgcaggcactcaagtacttcgaacgggccgcagagctagctcgcacggaggcggagatcgtcaatgccatctcgtatgccgaggccactcggacacagttggaagttcaggagagatacccccagctggcagcgcgcctgcaatccatgggtgccgggttgggcggacctcctggtctgtaa

SEQ ID NO: 5393 - DNA, 432 bp, A.fumigatus
actctcgccatggatacgcttcaaagggtcgttattgaccctcttcaacccgttctccgtcctatctcgtccgctctcccacaacctgtccacgatgtcatcatctccctgatcggatcgccatgccacagcgccctcctcctcgatctggatgtcaccaaggatgctgcctgcacgtctcttgctatctccaaggctctgggtattgctattgtgggtgcaagtgccatcgtgaaggttccgcaaatcctcaagcttatccgctcgcgatcctccgctggcgtatcttttgtctcctacgccctcgaaaccgctagcctgttgatcactctttcctacggggtgcgcaaccagttcccgttcagcacatacggagagtctgcgttgattgcgtcttacaccgacggggctggcagaataacgcgctgcaag

SEQ ID NO: 5394 - DNA, 999 bp, A.fumigatus
  unsure (628),(637): Identity of nucleotide sequences at the above locations are unknown.
tttcaatatccctccgtccatgttccttccgccatgatttatctccggtcctcgttgctgaggtctggattggctcaagattctgctcgcctgtgttcacaatgcttctcacgactctcaccatcacgacgacctgtcgcagttcgcagcttcttctcctcatctcggctgcgggctggcattgccgatcatgaatcaactccctcgactgtccaaaagacctatttttctgccaatcggaccgcagatggcttactcgcatccttatccgccgtcaatagctcccctcgaagtattgccgacaatgcgttatcacagggtgcagccagttcggagtcgattacttcacagtctacttcacaagagttacctcatcgccggaggaagcggttaaaggaagaggcggccaagaataatgctgcagaaaccgaactccctcctgatgcctcgtctcaattgtccaccctctcatcagccctccctgcgacttccctgcgccgcaagctggctgcgtttctcgccctcacaaagcctcgtctctcgttcctgatcgtgttgacgactacctccgcttatgggatgtacccgatctcctctcttctcacacttgacccttcaatgactcccntaccgaccnttttgacctcaaccttgacctttctctacctgaccacaggaaccttcttgtcttcatgcagcgccaataccttgaatatgctccttgaacctaaatacgatgccctcatgtcacggacacggaaccggccgttagtgcgggggctactctcacgccgtgctgcggtattgtttgcgattgcgactgctgctgcaggtctcggtttgttatacattggaacgaaccctacgactactgcgctctccgccagtaatatctgtctctatgcctttgtgtatacgccgctgaagcgtatatcagtgatcaacacctgggtaggcgccgtggtagttgtcaccacggggctggatggtaccgcgctg

SEQ ID NO: 5395 - DNA, 618 bp, A.fumigatus
aaactaatacaactagtcttctctcgcctcaatcaatccattgccaacaacgagcacccgctgaacgtcgacgcctgggatggatatctggccaacaagaaccgcacactccaaaccctctacgacaaccagatcgacaacaacatcatgattgcgggtgattctcatgccaactgggtgagcgatgtggcttggatcgacaacaagccgtacgatcccaagaccggcgctggtgccattggtgttgaatttgccgggactgcactcacttccccctcgccctatggacagaacattacgattgccgatgccaacgaggcctcgaaggctctcgtcactgacaatgaagagcttcaatggtcggagctctactaccgcggatactttgagcttcatatcacacctcaggaagtcgaggcccgcttcttcggtctacccaacatcaaggagcgtaatggcgaggaaatttcccttgccaacttcaccgtcaagagcggtgccaatcatctggagcgcaactcccatggcgttgtgggtggaggcgctgtggccaacggatggctcaagaacgggcaggtggtgcctaccaaccagacgaataacacttatgggcagtaa

SEQ ID NO: 5396 - DNA, 795 bp, A.fumigatus
tgccccagcctggccgacgctctggcactagcaaggtccccagccacagccggccttgtggtcacaatgccgtacaaaaacagcatcataccacacctcgacgagccggatgatctggtgaccatgatcggcgcctgcaataacgtctactaccgcacgaacgcggctgaccggcgcctctgcggcacgaacactgattggcggggtatcaagggctgtctcctggagaaagaagggcagggccagcggccgtctgcgacctctccagggtgcgccctggttgtcggagcagggggcgcgagccgtgcggctgtctatgcgcttgccgtgcatctgcattgcccgaccatctacattctgaaccgggatgagggggaggtggatgctctgctcgcggatacgcagagattgcctgtgaccctttccataacccatgtcaagagtattgagcaggcgcgtgcgctggctagtccgtactatgtagtcgggacagtgccggatgatgagccgaagactgagtctgagcgtgctgtggctggcatactcgaatcgttcctggctcgagaagaaaagggggtgctattggagatgtgtttcaagccgcgccggactaggatgatccggctggctgagcggctgggatggccgtgtgtggagggcacacatgtaatcatgtatcagatcgaggagcagtggcgtttgtgggcgggagaggagagtgtagtcaatctagatctaaagggggcttgggacgtgctgctgaaagctgccgaggagagtacggcgatcaattag

SEQ ID NO: 5397 - DNA, 204 bp, A.fumigatus
  unsure (194): Identity of nucleotide sequences at the above locations are unknown.
agcgcgcaaggctccgcgaactcgctgaaggctggccttgttaccggtaagccccttggccttctcccaaacttcatccgtactaacatgcttagcgatgcctgcgagtgggagaactttgcctccatattccacgccgacgcaaacgtatacacaacctgggtcttcaccacgaggcggcaaggagccgcgantagcgtgtga

SEQ ID NO: 5398 - DNA, 195 bp, A.fumigatus
gaccagattgtctgggccgttgttgcgaatggcgcgcgagggcctattgccttcgggaagagagtgtatatcgggcattttgggttcttcgtttactggcactgttactggtgtgagggtagtttggagaatatatattatgagggtcatccggctaaggacattgccgagtcagccagacttccactgcagtaa

SEQ ID NO: 5399 - DNA, 627 bp, A.fumigatus
  unsure (472): Identity of nucleotide sequences at the above locations are unknown.
ctggagcaactgaacacacatcgtctcatccaacccctgagatatcccctctcgccagagtcctacatcccagtgatggcaccggcaccgaaaaacttctacatcttcggcagcggcatctccttcagtatctcgcccgctatctaccaggccggattctctcactatcatctcccgcacacataccagatccgcgagtccgagtccatcgacgatgtcgcccatttgatcgccgacaataccttcggcggcgccagcgtgacgatgccacacaaactccacgcgcaccgattctgcgacatccagaccgagacggcgcggctcatcggcgcgatcaacacgctgatcgtcacggagactggcgaccagcgactcattaccggcgacaacacggattggtcggggctgtatgcgctgatcaccgagtacacttcgcgaacacagcacccgctgcaaaccggtctggtcatcngggccgggggcgcatctcgcgcggggctcttcgcgctccacaaagcccgcgtgcgggggatctacctcgtcaaccggaagcttgcggcggcggaaaaggtccgagatcatttctccgcgctgttccaagcgattgccgtgcctccgctggacaac

SEQ ID NO: 5400 - DNA, 1239 bp, A.fumigatus
aggcttggcccttgggagcggggccaagggagcctccaaggcgcgaaaaccggaccaaaaaccataatggaattgcatgtcgaaattctgctcaagattttcgttaaattccaggacccaagggtcagaagacgggcccaaattgactgcagttcaccgcacaggggctgtgaagaggatattgcctgtcagacggcccgcgagacgatccggcaaattcgcatggtctgccgcctgttcaacgacctggcgtctccactgttgtgtccgatcctccgcgtagatctggaccaggaatctctgaatggggcggtcgagttgtgcaaacgtccccggatagctggaggagtgcatgccatccaagtggggctgcaatatcgtccagaagagctcgtctcagactgcccccgattcaaggactattgcaagcagcaattggatagagtggccgatcgctgtgactggctcggggggtatgaattggacgatgaaacagactgcctggaggacaagagggaatttcgagaagcgaaacgcaattaccagaagatctgtcgttcgtgggacgcctatttctccaccgacgagagtgacgagaatgacgatgtcgccgaagcagaggcagatgagcacatggagattctcatccgagcctacaatgaatattgcaaaaagcatgaagagcaactgcagctcatcaccagtggagccttcgtcaccgcgcttgccgcttgtatctcccaactgcccaacacagtgaccctgggcttcacagacgaaatggaaccactgtatgattgggataacccgacaattgtactgggagacacgagtctgcttcccggaatgatgagcgcagcgctacggtgggaaaagatcgacaatttgcgccatggcaatgatcccgtccttacgcgcgatgccagatttacgcccgccaggatcttgttcgacctgccggttgccatacacaaagccggaatcaagttgaggaatcttgatctcggaccgttcccatgccgaggcagtttttctctgctctgtcccgatactgtgagcaatcccaccgatccagcagtatggtcagcgcttcgagcggcgtgtagcagcctctggcgagtcaatttcggaatgaaccagaaccaccaccgccctcacatccgccacgagcacctccgaccggatgaaaagttctatgtcgaccagacctcagcacagtacttttcagtagagatctaa

SEQ ID NO: 5401 - DNA, 240 bp, A.fumigatus
  unsure (3),(5),(6),(12),(13),(14),(16),(17),(19),(20),(21),(22),(23),(25),(27),(28),(29),(30),(31),(32),(33),(34),(35),(36),(37),(38),(40),(41),(42),(43),(44),(45),(46),(47),(48),(49),(50),(51),(52),(: Identity of nucleotide sequences at the above locations are unknown.
tgntnngcatannntnngnnnnngnannnnnnnnnnnncnnnnnnnnnnnnnnnnnnnnnnnnnngnnnnnnnnnnnnnnnngccgattaaataaagataaaatcctccccccntnnaaaaaaaacacgagagcggcgttgaagcaccaagagaagacgagaaggttctgtgatattaagaaggagaaaaaacaaacaattattttttttttttatatttccacgaacaaanaaaaatag

SEQ ID NO: 5402 - DNA, 222 bp, A.fumigatus
gtggagctgagctctaatttctcttccgtccatactaacaattacggtttttcttcacggaaggcttgcggacgctatggtaggtcaggatcaaaaaggtggctgaggctgtgcaagttgaataaggttcccttgtcaactatcacttttagagctaccctccaggctacagcattatatacctcttcccgatgtggcgaagctgagacaataatgctttga

SEQ ID NO: 5403 - DNA, 222 bp, A.fumigatus
gatattcgagatgaacccgcgataacaagaggaactgatcggcctgatcctatttacttcaacgtgagcaaggttagtgctcaatacccaacatcttggcgaagcgtccatatgacgaaggatcgtggcactcatcagcgtggctatgctaacggtgatcagttactgattcagggtcttaatacagtgggattagctctggtgacttatattgcctattaa

SEQ ID NO: 5404 - DNA, 372 bp, A.fumigatus
  unsure (250),(314): Identity of nucleotide sequences at the above locations are unknown.
tgcattggaacagactcctgcatctggcacttggtacgtatctcctacctgtgtctccggataggtgctgacgtgatagcgccccttgccgccgcccaaatctactctttctctcccgcaagcgatatcgtctatagggtggtagcaccggaaagcacagcttcgtccaactccgggccaatctacttccaaatccgtgcgcccacttcgtaccaatgggtgactcttggccaaggctgccaattgcggncttttaacagttcgtatgtacgccggctttttcaacaacgtaaccctttttcctggtttggganggggcgttctgtcaagattaaaccccggggcgcaaaaagattctataaggatgggtaa

SEQ ID NO: 5405 - DNA, 1143 bp, A.fumigatus
agtctggaaagtctggacggatttatcggaaggtctacagggaaatccgcgatgctttgcgcctgccccacatatttccgggaatccgaatccaattcaactttctgcaaacatgtaaggaggtattcgacagagataaagaggcagttgccgcaagaatgcaatgcccaaaaataccatacatcttctcaacattcacttgaagttcgcacgtttctcgtcaacatggtcggatttgatatgtgtggattgacccccgctccggtcactcctttcactcaagatggtgctgtggactacgaagccatccagcgtcttggctcctggctcggcagtatcgatggagtgaaaggtctcgtggttcttggacacgctggcgagggcacatttcttaccgccgaggagcaagtctcagtcatcaaagcgttcgtcaaatcggttgatggcaaagtcccaattattgctggcatcacgggtgaaggcaccgaagttgccgccctcgaggccaagcgagcaaaagaagctggagctgctgctgggctgctctacccgtctcacggctggttgcgcttcggataccaacgtggtgcccctcaacatcggtaccgtcgtgtgtatgaagtctctggcctgcctttgatccttttccagtaccctgacaacacaaaggccacctatgatttgcagaccatgctggacattgctgcccagcccggatgctttgccatgaagaacggcgtgcgcaacatgcgccgatgggacacagaaattcccatcattcgggctcaacgacctgatctgcaaattctctcatgccacgacgaataccttctccacactgcattcgatgtcgacggtttcttggttggttatggaaacatcgcccccgagcctcttatcgagctcatcaaggccggaaaggccaaggactataagaaggcacgggagatccatgatcggctcttgcctgtcactaagagcgtatatcaccgtggatctcacatggaaggcactgttgcactcaaacatggtcttgttgctcgcggaattctggaacacgccactgttcgctcgcctcttttgccccttgagcctggtgcggagcaagaaaatatgctgctatcaatgctgtttactcaataa

SEQ ID NO: 5406 - DNA, 291 bp, A.fumigatus
aaggtctcgtggttcttggacacgctggcgagggcacatttcttaccgccgaggagcaagtctcagtcatcaaagcgttcgtcaaatcggttgatggcaaagtcccaattattgctggcatcacgggtgaaggcaccgaagttgccgccctcgaggccaagcgagcaaaagaagctggagctgctgctgggctgctctacccgtctcacggctggttgcgcttcggataccaacgtggtgcccctcaacatcggtaccgtcgtgtgtatgaagtctctggcctgcctttga

SEQ ID NO: 5407 - DNA, 411 bp, A.fumigatus
atccgtccagactttccagactttacggtaccgagccgccgaaaaaggttgtccacccccagaaagtggactgtatcctggcccaggctagaccacccccataaactgtggaagcatactgtatcaagcctcggacgtgttactcagctaacggggctagggccgatccaacaaggctacttgaccgcttacacgacccgcttggtcactttagtcgtctgcagaggattcatccccgcgcgaggtgacattgcaatccgccagccggcccccggggagaaactgacatctcatcaacaaccaacaatttcgaatcactgccttcggcaccgtttatttcctagagcaaacggccccggactactccagggttgtcgtcgcacatggtctgtggttagctacattaaataa

SEQ ID NO: 5408 - DNA, 411 bp, A.fumigatus
atccatagaagcgtcatgtctttgccccagaggccgggaaaggtctccccgcggcgagaggaaacacaggcgttccgagacacttcgcgcagacgacgtcgggatatcgagtcgggcgacaacgagacactgtccagcccacatcgacatcaccaccgccgccattcacaaagctccagaaaaactagggatatggacgaagagagactcgaaccaggtgggcacaggaagagccaagtgcggccggaacgcagtcgcattgacgagaaccatcctaactaccactatcgtcaaaagtctcaaaatatgccagtatacccgtcaacaaccggaaatgaaccgctgattgaaagcgatgagctcaacagagacagttcgccagagtacagagcacacaagcagggaaggtga

SEQ ID NO: 5409 - DNA, 978 bp, A.fumigatus
tcccttcttctggaacgaggaaaaactccgcttccccacgggagcgccagccagggaagaaaggtcgatgtagcctcgagcagaccagcgaaaacttttcgagcgaaagattgggaatgcccccgatgccagttccattgtgtcgggagaaacttcacctgcccacgctgtaatacccccaagccgaatttggacgcgccagcccccgagtcgcctcgtcagatcaagcaaggccagaacgccttaaagattctgaggctcgcccagtcgttgcggtcggaatatacaaacgcgggacgacgccctctcggagatttgatcccagaggccggaggttcgagaaacaccgcgcttgataactaccttgtggagataggacgcaaggccgaatctctacctgcatcaacagaattagagacgcagtcactggcagaacagccactgtcgaatgctagggatgaggttacagaaagcggcggtgccgaccgccaagcttctgaagcagagcgcacatcatcgaaaccggaggcagacccatggacatgggaccagtcagctctggagaaacttcaacagacatacgaggcagaagctcagagtgggcaaaagcccaagcggtgggacggtcgcaaggaacgaggagatgatgttgactacgaagaatttgacccagaagacgaccgccgccgtcgccgccaggaacgtaagcgccagaagaaagagaagacccggcagaaggagctcgaggcggcggctcccagtcccctctaccttccggaattcatcagcgtcagcaacctcgctgatgtcattggtgtgcggccggctcaattcgttcggagaatggaggaaatgggatttgaagatgtctcatacagtcatattcttgatgctgaaacagccggcttgatcgcgagcgagtacaacttcgagcctatcgtcttcaccacggggctggaaggatcagcggtagtctaa

SEQ ID NO: 5410 - DNA, 891 bp, A.fumigatus
  unsure (882): Identity of nucleotide sequences at the above locations are unknown.
tacggtcaataccaccggggctcagcaacattacaactccaccattcagggtatgccactgcatccactgttgaagtattcgagtggctgatgatcagaggaaccgttgtggcccttttcaccgtggggggaatctttggctccctgtcgtgcatttaccttggtgaccgcctgggccgccgtaaggtggtctttcttgcatccggcgtgacaatcgtcggcgcggttctgatggccacagcattcgactttgctcagttcattgtggcgcgactggttctgggtttagggaccggtgcatatctggcgacggtgcctgtgtggcagtcggagatttccaaagccagcaaacggggtgcgcatgtggtgaccgacggcatcttcatcggcattggggtctccctatccctctggattgactttggcttctacttcatcaccggcaaatcggtgtcgtggcgcttccccctcgcgttccagattgtcttgctgttgactgtgatggtgttcatcgtgatctttcctgaatcgccccgatggctggtcaaaaaggggagagttcaggaggcccgagagattcttgccgcgctggccgatgtcgagccggactcggagtcggtcagcgcagacattcgcgacattgagctctcgctgtccatctgtggcaatggctcgttcaagagcatgctcacgatgggcgagcagcggctgttcaatcgcactcttctcgcggccggcgggcagatgttccagcagatgtgcgggatcaacctgatcagcatgtacgcgacgaccatcttcgagcagtacctgggcatgagcgcgatcaatgcgcgcatcctcggggcgttcttaaccgccgtgatagaaggtagtgcgctnccccccacc

SEQ ID NO: 5411 - DNA, 282 bp, A.fumigatus
gatacctgcagtgcttgcatatacttcactactgagatggcgccttattttggcctccgtggctctaccttgagccaggccatcatctgtctggtcgtgtgtccggcctttgttacctatggatacaacctgagcgtggccgggggtctgttgacgctcgaatcgttcgtcaagacctttccccagattgatacggtcaataccaccggggctcagcaacattacaactccaccattcagggtatgccactgcatccactgttgaagtattcgagtggctga

SEQ ID NO: 5412 - DNA, 501 bp, A.fumigatus
ataatcaggcgtctcattctagatatcatagggacgaatacatatctaatcggtcggggccaccagcggatactcattgacaccggcgagggcaaaccgtcctgggcaaatcatctcaaaagtgtgctagcaaaggagaatgcgacagtccataaagcactcttgacacactggcaccacgaccatgttaatggtgttcccgatctcctcaagatttgtccgcaagcgacggtttacaagcaccgaccagacgaaggacagcttgatattgaagatggccaagtcttcagcgttgaaggcgctactttgaaagcgtatcatactccagggcataccgtggaccatatgatgttcgttcttgaagaggaggacgccattatcactggtgatagtgagtcttactctccactatgtggttgttctacgtggtcacctttgcggctgacctttttctttactctttcctttagacgtgctaggtcacgggacagcagtatttga

SEQ ID NO: 5413 - DNA, 321 bp, A.fumigatus
cacgcttgtccttccagccccgtggtgaagatttcgttaggtcttagctgcacgtcgcaagtattgaatgcactcttggtggatctgtggccgaaacggtctgctgctgcgacggcggcgaataatctgtttcggtgtgagttgggtgctggggcgtcggctgccattgcacccatgacgaacgccatggggcatgggtgggcgtatacaactttggcactgatatgtgtgttgtctaccgggtgtttgtggtggacaatgttctttgggattcaatgtcggcagaagagggcacaacgggagcaggcaaggcggagttga

SEQ ID NO: 5414 - DNA, 282 bp, A.fumigatus
aagcattcgccgcagctgatggtgaagggagtgacaacgcgatcgccctttctaaaattccgaactgcggggccggtttcgacgacctcgccggtgaattcatggcccattatgaagcctgtgcttgagggttggtggccgcggaagacgtggagttcactgcgtctctctcgttatgacggaatctttcaagcggagaagaggggcctgacctgccgcatagtgccgtgttaccggactttgatgaatgcgtctgttgggatctggatctgcgggtattag

SEQ ID NO: 5415 - DNA, 939 bp, A.fumigatus
cgagagagacgcagtgaactccacgtcttccgcggccaccaaccctcaagcacaggcttcataatgggccatgaattcaccggcgaggtcgtcgaaaccggccccgcagttcggaattttagaaagggcgatcgcgttgtcactcccttcaccatcagctgcggcgaatgcttctactgcgcacggggatgttcctcgcgctgcgccaaggggaagctattcggctctgcggtgctggacggaggacaggcggagtacgtgcgcgtcccgttagcggatggcacgctggtcgcggcgccagccgccgtcgatgagaagaagttggttctcatggctgatattttcccgacggggtactttgcggcgaggaatgcgtttcgggggtgggatgaggaggatgtgcgggggagtacggttgtgctgtttgggtgtgggccggtgggattgtgtgcgctgatcagtgcattggagtatcagcctgcggctttgattgcggtggatagtgtgccggataggctagagcgagcgaggagtctgggggcggaggcgtggaatttccagacggatgcgcaggggctgcgggagagggtgctggagttgacggaggggcggggggcggatgtggctattgaggttgtcgggcatagcagtgcgctgcgaatggcgtttgagctgctgaggccgtgggggcgtatctcgagtgtgggtgtgcataatggcgagattccctggacggggaacgaggcgtatgggaagaatctgcagattcagatggggaggtgtcctgttcggagcatctttcgggatgcgttggagctgctactgaaaaaacaggattcacttgagtgtgtatgcaatttccttttgatggcacggctgaccatgtctaggtttatggctgctgatattcgaccgctgtcgcaagctatcgcagcgtaa

SEQ ID NO: 5416 - DNA, 660 bp, A.fumigatus
actcaggaaatgggagtagaactcggaggaccaggggtagaccactcccaccctggctaccctcatcgtcctatgaacccggtattggcgacacctctctttgtcctcagcggggtctttaccgttctattcctgtgtcgggtggtcataaggtttcagcatcgccgtcgtttacgtgagattcttcagacagaggaccagtgcaagttttcgcggaccagcgtcatctttgcctggattaagaaacatgtactttatgcaccattggtttcaaaacggcacagtcgcgaatttcaactgctaaacaggcttcatatgggaagcatacccttacgactggaagctacgttagttctgggatatatcacgaccaatttgcttttcttgttcgtcctagtcgactggtggacggactatcaagaaaagatgtaccaactaaaatatgccgctggacatctggcagtgatgaattcacctgtgctcgtcttgagcgcgggtcggaacaatcccctcatcccacttctgggcattcctttcgacacattcaatttcctgcaccgctgggtcggacgagtcatgatagctggggccctgattcatatgggctgtgtcattggggcccaggcaatgcagggtgggtggttcagccgtctcaaatga

SEQ ID NO: 5417 - DNA, 339 bp, A.fumigatus
gcccttattgcatttgtagttattttctttcaatcagtatcaccaattcggcatgcattctacgaagcctttcttcattttcatatattcctcgcaatcatggcatttgttgggctgtggtatcatctgcgtggcttggcccagcagcgggttcttttggccacgttgatcctttggggtcttgatgtgagttatctgcccttgatcagctcttggtcatcaattaaagtccgcactgctcatgcttctctccaaaggatgcacttctcgtcagcattctctggccgaattgcgggaaacaccgtacttccggctaccggtgaatggtggcctggaaac

SEQ ID NO: 5418 - DNA, 516 bp, A.fumigatus
cgccagaaattgatcgcggcacggtacagcaccaacgggtacgtgatccgaaagggaagcatccgtctcttcaagcttccaagttccgccggagtcgcaatctgtgacgggcgccggccttcgtcctgctgttggccatcccaactagtgatcaacttctgtacgcgctcgcgggtcagcgcttctcggtcttcctgctgtaggtcgaccgtgatcaggtccagaacaaagtcggcagggttcgtggtcttgggacactcgtatcccaaggaccggaagtacgggagcatcttctcgccctcccccgcatacacggtgtatcctcctcgggccagtagcaggaccctcgagaagtgctggaacaggtccgatcgtgactggtggatggtcatgatcagggtccggccctcggctgccagcgcttcgaggacttcaataatcgacgtggctgtaaacgcatctaggccggaagtaggttcatccaacagtaaaaccttggggtctgttagaatctga

SEQ ID NO: 5419 - DNA, 258 bp, A.fumigatus
atccaagatgctaatgagatagggatgctgcaaaatatcgccatctacccgaacgaacgggacgtcttctaccgggaagaagcggaccactgctactctgccgagactttcattctacagtacacgacgctcgaagtaccctttgaggcgatctcctcaatcatcttcggggtgctcgcagcctacgcggataatctagaacgcagtccaaaaatgttcctcatcagcgcattcaactggttctgcatcatcagcttc

SEQ ID NO: 5420 - DNA, 1764 bp, A.fumigatus
  unsure (1),(4),(21): Identity of nucleotide sequences at the above locations are unknown.
nttntgaccatcctcactcantacattgccgtcacatttgcggctgtctccattggcgtcgctagcagcttccccggtgcgagtattgtgggcaacctttctttcacactacagtctttcgcgtgcgggtactttgtacagtcgaaccagatcccggtgtacgtgcggtggctaaaatgggtggcatatacattctacatcttcggtgccctgtgtgccaacgagttcattggtcctgacgggcccccagagggccagttctatgattgtccatactccacagacccgtccaatcccgcatgtacgcaatacacgggccggtacattatggagaacctggggtttccgtcaaactggatctggcggccaatcgtgattcttgtggcctttgtgattggtcattatctcctcgctggcttgctgctccagtacaaccgtttcgccattgacatcgcgcaagcccggaagaccgatgtagatttgtctgcgggtaaagagaagtttgccgaacggcgcagcgaggaagctcgtcctgtcgccatctccctggacaagtatgccttggagatccggaaacgccaggtctctcgccggggatcgcggacgctatccatcctcaaacccatcaccgctgaattccagccagggaaattgaacgtcatcatgggcccgtcgggtagtgggaagacatcgctgctcaactctattgcacgaaggttaagaggttcattggggacacagtatcgactgcagggaaacatgctctacaacggtgctgtgccttcagagagcgtgatccggtcagtaacatcgtttgtcacccaggatgacgacgcgttgatgccgtcgctgacggtgcgcgagagtctccgtttcgcagctggcctgaggctaccacagtggatgtcgcgcgaggagaagaaccatcgagcagaggagattctcctgaagatgggattgaaagagtgcgcggacaatctgataggcagcgaactcatcaagggcatcagcggcggagataaaagacgaatcaccatcgccattcagattctaacagaccccaaggttttactgttggatgaacctacttccggcctagatgcgtttacagccacgtcgattattgaagtcctcgaagcgctggcagccgagggccggaccctgatcatgaccatccaccagtcacgatcggacctgttccagcacttctcgagggtcctgctactggcccgaggaggatacaccgtgtatgcgggggagggcgagaagatgctcccgtacttccggtccttgggatacgagtgtcccaagaccacgaaccctgccgactttgttctggacctgatcacggtcgacctacagcaggaagaccgagaagcgctgacccgcgagcgcgtacagaagttgatcactagttgggatggccaacagcaggacgaaggccggcgcccgtcacagattgcgactccggcggaacttggaagcttgaagagacggatgcttccctttcggatcacgtacccgttggtgctgtaccgtgccgcgatcaatttctggcgtcagccgccattggtgatggctcggtcattgcaggtggtagggattgcgatcatcatggctctgttctttgctcctttgaagaacgactatgctgctgtgcaatcgcggatggggtttatccaggagtttgctgcgctctatttcgtgggtgagttttcgtccattataatccaacgcgttagatccaagatgctaatgagatag

SEQ ID NO: 5421 - DNA, 183 bp, A.fumigatus
aaggaccacgcatatcaaatcattgagaaacaatatatcttgcctgtgctacattcgtggatgactttctattatgtcaatgactacattgtgatcatgtgctgcaacaagtcaagtgccgaggagaggatggagcttgtttgcatcccagccaaacatacctctttgggctaccttacgtag

SEQ ID NO: 5422 - DNA, 321 bp, A.fumigatus
atggcactccccgcggatccttccagccccgtggtgaagacggcatctcaactcgccaagttgaaccttgacgatgttgtcgatgacatgaatgaggtgagtctacaaggctgggcagagctgctggagaaaaagggcatcacacgtcccgggccaatcagcccgttcctcgagaaagatgtcatcaaggatcaggatatgtcgattgatggcaccttgttcgaaaaaaccaccggatggaaacctacacgcgaacgctttgatgcagagggagtccgcgccatggttgatagctacaaacgtatgggctggtggccataa

SEQ ID NO: 5423 - DNA, 204 bp, A.fumigatus
tctaactttcgtcttctactcttcttatcctcaacctcgggctccaccactgtcagcaccggtatgttcctgatatcctctgcgtatccatctgcatacttcatcactttccttacttcagagagtgctgcgtcgtcttcttctgctcatgaccctgatgaacatgtagacttgggtgtacataacataacatatgcactttga

SEQ ID NO: 5424 - DNA, 351 bp, A.fumigatus
  unsure (30),(129),(134),(180),(289): Identity of nucleotide sequences at the above locations are unknown.
gcttggagctccatggtctcaatgcgctgntccagcttcgtgattgctgcttcaagcttttcgacactgggggctcttgccctcaacttcgactttgcctgtcttattttctctcatgaaattattctncattntcttggaccgctcgaggcggtgttcgagctcgctggccttattttncttctccccttcggcggccaagcttctcattcttcttctcaaaacttcttcttaaatcttctggcgctggtccttcaagtaggaaggcttgatggttcttcaccccatnccatactaatggcttcggccaatctcgaagaactttgcggcccttcttcttttttcgaatag

SEQ ID NO: 5425 - DNA, 189 bp, A.fumigatus
  unsure (84),(158): Identity of nucleotide sequences at the above locations are unknown.
gagaaaataagacaggcaaagtcgaagttgagggcaagagcccccagtgtcgaaaagcttgaagcagcaatcacgaagctggancagcgcattgagaccatggagctccaagctcaggacaaggaagataccaaggaagtcgctttgggaactcccanaatcgtgagtcacccaccctctaccccatga

SEQ ID NO: 5426 - DNA, 1302 bp, A.fumigatus
ttgatgcgtctcctgcagccccggcgtgaagatcgcatacctggcatgcctgcacggagaacgacaattctttgttctgctacgctaaaaatgagcgtacagaagcttggtgaaatcagcttgaaagatgcagtccacatcaaagcggacccagaggacgaggatgagaaagccaggaggagcaaagcggaagaatccgcctatcgggtgccagcccagctcaaacaatcatacgctgtcgttgcggcaaagctgcgcctagtcacactcactgctttcttcaaacgcacttttatgaggaagggatcggtcatgaaggctatcatttttgtctcctgtgctgactcagtcgacttccactttgaagtatttacgcggaaacaagtaaaggaggatggcggcgagcctagcgatacagataaatcagaagagaaacccccatcgtcgcctcatggtaccatagcacctgccacagctttttcgaatccgtcaaatccggtgactttgttccgactccacggctccctacctcaaaatgtccgaacttctactcttggagcatttgcgaagaacaaggaagcatctgtcctgatctgtaccgacgtggcctctcgtggattggatctgccaaatgtcgatctggtcgtggagtacgatccagcattcagcgcggaagaccacttgcaccgcattggacgtacagctcgtgtgggccgtgacggtcgggcattgatcttccttcagcctggatgcgaggagaattatgtagaagttctcaagaggggctatcgcgacggcggaaaggcgcttactcgtgcagacgccaacgagattctcaagcgcggatttggcggcaacgtggagagcggaaacaaggactgggagacaaaagcgacggattggcagtgcgaggtagaacggtgggcactggagaacccggaatacctcgagatggctcggagagccttccaatcgcacatccgtgcatacgccacacacatcgcagctgagcggagcatgttcaacatcaaagagctccatctgggacatctcgccaaggcatttgcattgcgtgaccgccccagtaaaatcaatgtacccggtttacgacaaggaaaggaagagacgaagaaagacttcaaggctgagaggaactcggccgcaggaaagaagaggaaggctggtggtgcagatcttgcggacgatataccgtctgccaataacacggcaacggcggcccaaaagatgagggctaagatgaaagaacatatggctggtgcaaacgagttcaaccttgcctag

SEQ ID NO: 5427 - DNA, 726 bp, A.fumigatus
agagcgcgtgtccgccatccccgtggtgaaggacgggatatccagctcaatgtcaggggcaacaagacacttgacgacagtttcaaggactacattcaggtggaaacccttgagggcgagaacaagtacgatgcaggctctccctacggcttgcaagacgccaagaaaggtgtcatcttcgagagctttcctcctgtgcttcatctgcacctgaaacgtttcgaatatgacattaatcgcgatgcaatgatgaagattaatgaccgtcacgcgttccccatggaattcgacgcgactccatatctatccgatgcggccgacaaatcggaaccgtggatctatcagctgcacggggttctagttcacagcggtgatctaaacgcaggccattactacgcattcttgaagcctaccaaggacggccattggttcaaatttgatgacgaccgtgtgacccgggccactgacaaggaggtacttgaggagaactatggtggtgaatatgaactatccaatggtgcggccggcgtccggcaaccacatacacggggtctgtcgaccaaacggtcaatgaatgcctacatgttggtctatattcggaaaacacgcctggatgatgtccttcttccgattacaaaggatgatattccctctcacattggtaagccttatgcattctcttcctccgcgagcagatgtctgacattgaatcagagaagcgtttag

SEQ ID NO: 5428 - DNA, 351 bp, A.fumigatus
ggtcattcatgctcatttttacgtcagcaactgtttgaagtcctagtgcctcgggacggcacctttgcggaccttctggcgggtctgcagaaaaaggcaaaccttgaggatgatgtggttcgagaaatgcggatctttgaggctcacagcggcaaaatttacaaggagtaccaagaagatgctaagatcgctggcatcaatgagtacgtgactttatacgctgagaggatacccgaggaagagcttcagatgcaggccggcgaacggacaatcaatgcattcaactttgaccgagagccaagcaggccgcatggtatccctttcaagtttgtcatgaaacctgtatgcata

SEQ ID NO: 5429 - DNA, 1251 bp, A.fumigatus
  unsure (295),(305),(609): Identity of nucleotide sequences at the above locations are unknown.
gccttatgcattctcttcctccgcgagcagatgtctgacattgaatcagagaagcgtttagtagaggagcgggcagagcttctccgcagaaagaaggagagagaagaggctcacctgtatatcaatgtgggagttctatcggacgagtcgtatacgtcacatcatggattcgatctgacgagcgcggacctaccggccggcgatcctgctctgccgaaacagtataggattcttcgggctaagaaagttggcgagttcgtagagcagcttgcggaagaacgaggtctaaacgcanaccaaatcangctgtgggtgatggtgaaccgtcaaaacaagacgactcgcccggaccaagccatcaaagacccagaaatgacggtggaagaggcctacagcagatttggtaccaaagggaaccgtttcaaagtctggatggaagttgggcaaccatctgcggacggaaccatctcgtgggctgacagcagcacttctgttctcgtctttttaaagaattttgacgtcccttctcagattctttctggagtcggtaccgtatacgtccgcaagaaccagaaagtcgcagaactcgccccaacaattctcgagaanatgaactggcctgccgggacagagtttatgctttttgaggaaatcaagcacaacatgatcgatgtgatgaagccgaagcagactttccagcagtctgagattcaagacggcgacataatcacgttccaacgcacagtcaaagaatccgacttaccatccactgcactgtacacggaagcgaggcaatactatgactacctgttgaacaggataaatatcacattcgctcccatcaaagcgactgatggcgacgagttcactctcactctgagccgaaagatgacatacgatcagttctcgaagaaggtcggcgagcacctcaacgtggaatcaactcacctgcgtttcgcccccgttcttgctagtaccggaaagcccaagcagttcattaaacgcaatcctaaccaggccaaccaaacgctgtaccacatccttagtgggcaggtcagtggctacggttatagtatgcatcgccaagatgcactatactacgaagtccttgagactagtctcagtgattacgagtcgaaaactacactgaaagtaacgttactcaccgagggcattgtgaaagaggtaagttcaccctatcatcgagcgctagggtcattcatgctcatttttacgtcagcaactgtttga

SEQ ID NO: 5430 - DNA, 228 bp, A.fumigatus
tttcagtcatacagtacccgcaatctccttatccattctctccccatccctatcgccttcgtcttccctactccataccccccagtctggtcctgttccttctcttcttctcccatctcttatcttccatccgacgtctccttcctcctactcttcctcttcatcatcgattcgaattcacctgaacatttaaatcgtccgtccgccattacctacatacctacctaa

SEQ ID NO: 5431 - DNA, 288 bp, A.fumigatus
tgccctgcagcggctgccaaaacgctcgacaaaccactcaaagacatccgggccagcatcaccgagaagacggtggatattttcagcggataccgcaaggtcttttcagggtcgcaccctccaggacagctcgtgttgccggagaatctcaaggagttttccatgtacatgctcagcatgatcaagtcgagggcgttcaaaggtgaggtatactacggttgcaacaatggattcaccgctaacagggcaagtaggtggtcaggaatcgtccgaccggcggattcatga

SEQ ID NO: 5432 - DNA, 708 bp, A.fumigatus
  unsure (632): Identity of nucleotide sequences at the above locations are unknown.
tcaagtcgagggcgttcaaaggtgaggtatactacggttgcaacaatggattcaccgctaacagggcaagtaggtggtcaggaatcgtccgaccggcggattcatgatatccggatgctacgatcgataggatgcacagagctgtcactgtacctgtatccccggatcatccccatccacaacatgcaaccggaggatgggttcccgaatgaacagggacaattacaggtaccacccgcgctccgtgccagctactccaagatcgaggagggcggggcgtacctggtagacaacggccaaatgattttactatggcttcattcacaagtttccccgaacctgcttgaggatctatttggacccgggcaaacgtctctacaagctctgaacccacagctgtcgtcgttacctgtgctggagacacacttgaatgcgcaagtgcgcaatctcctgcagtacttgtcgacaattcgaggatcgaaggcggtggctatccagctagcacggcagggattggacggggccgagtacgaatttgcgcgactgttgctggaggatcgcaacaatgaggcgcagagctatgtggactggctggtgcacatccaccgacaaatcaacttggaactggcggngcaccggaagcgtgaggatacagcgggggagggaacgctgtccagtctggccggactgcgggccccatactggtga

SEQ ID NO: 5433 - DNA, 246 bp, A.fumigatus
aacgggggatcctcgcgaaagaggtgtcgggaggggtcggagggttcggaaggttcggagggttcggaagggcaaaaaaacaagggatcctttacgagtcttccattcttcgatttacaggaactggagacttggatcctttctttagtctctgggaacaaggttattggcagttgtgactctgactggggcagtggagttggcttcgcacgtcagtggatacaagatagaggggtgtctatctga

SEQ ID NO: 5434 - DNA, 267 bp, A.fumigatus
ggtgcgaaactaaaagatcaagcgggttttcgagtgacattggccctatttgcatatatgtacattgtggtggttgtttacattgccattcggctgtcagacttcagtgcacgcagcgtccttgtcggccctcaacgtcctgaatctgtaaaggcagctcgagtcaaggagaatgatctaaattttcgtgaaagacgaataactatagacatggaccgacacagggctagcagacacaagtttcaagtaattaaaatccgttgttga

SEQ ID NO: 5435 - DNA, 933 bp, A.fumigatus
gtcggggttgatttccaattgcaccgcgctgatccttccagccccgtggtgaagaccgaaaacaccgcagagatcatgttcgagtcgttcaactgtgctggtctttacattgccgttcaagcggtgcttgccctcgctgcttcatggacgtcctctaaagtgaccgatcgatcccttactggaacggtcattgactctggtgatggtgtgacccatgtcattcctgttgcggaaggctacgtcatcgggtcatccatcaagagtatcccaatcgctggacgagacattacctacttcgtacagagcttactgcgcgaccgaggcgagccggatagcagcttaaagacggcagagcgggtcaaggaggagtactgttatgtgtgccctgacatcgtcaaggagtttgcccgctatgaccgcgagcccgatcggttcctcaagcataccgtgacctcccctaatggccggagcgtgacaattgacgtcggctacgaacgcttccttgcccccgagatcttcttcaaccctgaaatttactcttctgacttcctgactcccttgccgcaagtcgttgacggcgttattcagtcctcgcccatcgatgtccggagaggtctctacaagaatatcgtcctgtccggtggatcgaccttgtacaaggactttggccgtcgtttacagcgcgacatccgacacctggtagatgcgcgtattcgcgcctcggaagctcgcagcggtggtgctaagagcggtggtttggacgtggctgttgtgacacacaagagacagagacacggcccttggtttggtggtagtctgctgggacagactcctgagttccggagctactgccacaccaaggcagagtatgatgagattggtcccagcattgtccgccgatttgccctcctgggtggtcccggaagcacctaa

SEQ ID NO: 5436 - DNA, 960 bp, A.fumigatus
gattattttggtcatgcaaggttgtgtccagaatatcttcttcctgactttacacactatatccttcatctttttcccgagacgtttcccttgtgttcgtgtctggcaatggactcccccagtgataccccctcgaaatccaaacagaaactgtgcaagcaagcctgcgacaactgtaggcgccgaaagatcaagtgctcaagagagctcccatgcgacaagtgctctcggcttctcctttcctgctcctacagcgatgttctgcgccgtaaaggccccaagttccggactctctatcctctggctccgatccatccgctcatttcacgatctcgagataccttgcattatggccctcgacagcatactctggacaaagatttccttccagaggccgggggttacccattaggggcctctcccacgtctcctccgttttctctgggggatgtccagttcaactcccaagacttcctggactcattgacacggctggcgcctccggaactggtctcatcccccgactcgacgaattccatttctgaccctggcactggtcagtgttctcctttttcaagacgtctcacgtcacctgttctcctggcacatgtgaacgtctacttcaaatacatctttcccatcatgccagtggtgcggaaggagggaatccaggcggactgccaccagctggaaagactctcgtcgcggaggtatgcttttctggcttcgttgtgtgccgcgactcatatacagctcaagtttgatggtgctatggggccccctgccttcaacacggaggcacagtccatgatgtcaggggaagaattgctcgccgaggcggtacgggcaaggaaggagtgcgatccggtggatgaaatcagcatcgagagtcttttgacttcattctttctgtttgcttgctatggcaatctcgacaaacaggagcaggcgtggtcttaa

SEQ ID NO: 5437 - DNA, 237 bp, A.fumigatus
atccaccgtcgttgcagagtcctcctcagccttatcaatggcagacgtgcgttcttcagcatccttcaaacccagtacttcattctgagctttgttgataccatcatcaccagcgtcatccaattctccctcgtttgtctcatcgtctgcagccagcgcagtgagcttcacattaggtgcaacaacttcttcagtccctccatcgccatcctcgaaccttccaatcaccacctttaa

SEQ ID NO: 5438 - DNA, 1473 bp, A.fumigatus
ggaaatgggcaagcagcgccagggtcacaaatggaatcatggcgggaacgagggtttgtaccggactcggactcagaggttgactttgacagtcaggaattaaaggtggtgattggaaggttcgaggatggcgatggagggactgaagaagttgttgcacctaatgtgaagctcactgcgctggctgcagacgatgagacaaacgagggagaattggatgacgctggtgatgatggtatcaacaaagctcagaatgaagtactgggtttgaaggatgctgaagaacgcacgtctgccattgataaggctgaggaggactctgcaacgacggtggattcaaggaagaagacgtctcaaagtgattctggctctgtccaaggaaaccaaaaagatccagccagccagagtgcgcgtgctacggcaaaggtgccaaactcttcgcccagttcaggtggtgtgaccgccatgaaccccagcgctccgtcaactcctcgcacccaaccgcacgccgccatatgggacattcccagctccccagacgagttacagttcgatttgcagccatcacggagactggttacttacttttcaaagaagaaggaccccgaaacccagaagaactcgccgactatcgatgaagctgagacacagctagtgaacgagaatgacaatatctctcctctttcttcccctctctcatcccttcattcgatatctttgggggaagatgatgaaagtttacgagatagaccagagggacacaaggagacagcgaccacagaaacgcaagctccccagaatcgagaggaaccgttgccaccttttgagagttcggaccgaatactacaggagatgtcacagcccatgcgcaggtcattaagacagcggaatcctatccaattacacccatacctgctcgaagatgcgaagtaccggagtctcatgaaagccagaggcctcaagcccgtacgggtacctctgcatcaagctgtacatgagacagccgacgagagtcaaatcaaggacttcgagcctccttcaagcagcccggtcgaagactttcaatttccgccatcatctccaataatagaccacccgctgcctgatagacacattcacaaggagtcttcacatcggcgtggtcgtgtagacccacaattccaagaccatttagcgaacagaccagatgctcgtccttcaaaacggcgaagggtatcccgacctagaaatactgacagacgctctctgatacatgcgccccagccaaaggtggtcatcggccaatctcctgcacgtcctgaacatgaatctattttcaacataccgagtccaccgcgctcaggcagcatctcgtccacgcaaaccagccagcacgccgagggattccgttttccacttggattcacgccaccgaccttaactacgccggttacggagcctagagttaatgcacgccaatgctataaactctga

SEQ ID NO: 5439 - DNA, 966 bp, A.fumigatus
  unsure (698): Identity of nucleotide sequences at the above locations are unknown.
agtcatcaggatactgctcaccgaactgtcctctgcactaatgcacaattatccatctaccaccacccaataaagaatcctgcttccatcctcgttcatggattccatcttttaatcatgtctaatatgaatccgctgtgtactctcggcatgactaggcgtgtcacacgttccgcagcagcccgagaggcagctttgttcgcggcaaaggcacaggacgtcaagccgcagctaaccgactcgaacggtccagacgtctcgccaaagactggaaagtctacacctggtcggaagaggaaactgcccatagagcatccagaaaaattatcaaagtcatccaaaacgagcaagccaaaaggcagtttgccaagtctcaatgtgaatgacgaccttccacacaatctgggctcagtctctcaaccacttgagagtatcaatgtagaacctaaactcaacaagcaggatcccggcatcggagaagaagaagatttagacaaccttgcaagtgatctccaaaagaccgtcgacaaagctacagagggactaccgcaacaaatcaaaattagcaagaagaagaatccttatggtcttacgcccggagctaccccatttcctgaatgggctcggcccacacctgaagaatgtgaggaagtgaataggctcctttccagtgctcatggagaagtcatccctccttntaagatcccggagccgtctctcacggtcacagggtgtggtgaggttccttcagtgctagacgcactcattcgcaccctgctcagcggtgccacgacagggaggaattccgctttggctttcggtggcctggtacagaggttcggtattcttgaagaaggtatcggcaagggaagtgtcaactgggatgccgtccgtcaagcaccgctgaaagatgtcttcgaggcgatcaagaggggcggtctgtcggagatgcacgagccagaaaga

SEQ ID NO: 5440 - DNA, 336 bp, A.fumigatus
acgcattgcgttggattttccggcccggtggtcgaagaccggctatttggaccatctggagaagatcgcggcgaaggacgcaagatcaaggctgttgaccgtgccaaagaggctgtcacccatggtttcgccaacgaggaggactaccagattgctgctaatggagtcaagctcgatcaacatggcaagatcgtgcctgccaagtaccctggagaatccgaagtgcttcaggcgggcttcaaccggtgcaacaaacccatgacgcacgaagatgaacctcccaaggtcaaggatcgtatggatatcagcatccacaacattgctgatcacgaatga

SEQ ID NO: 5441 - DNA, 486 bp, A.fumigatus
gttgcaacaccgcaggttgaggaaccacgggatgagaaagcgcgcctgcggcacgttgagcagacctttatacccagtcggccgccggatgattctgagccaggaccttcagccggtcacttggccatgccaaccgcgcccgtgcttcctgaagatgaccacatcaacggttatcatcatttaccgtcgccggtggagaactgtctgcctcacacgttgggatccgcggagtcggtgcagactgtagttgccagcagcagtgtagccgaaccaaatggaagcacagcaccccccggcgaggacaagcaggaattggagcgccggcgactgatgatggaagcaagtgccccagaagacatggatgcccataccgacaactccgccatggatggacccagtgctccggtcttccatgatgaccacgacgagcaactggtgggaggagcagcgcacggggacgagtcattaccgcgttaccagcgataa

SEQ ID NO: 5442 - DNA, 321 bp, A.fumigatus
ctttttaccagcgacaatcccaacaagccgataggcagacagatagataactactgtcaccttaacctaggttacctccatccaaccgcaataggtgtgcgttccaagcgggctggcttggcaccgtctctaagcggccacgcgacgacacttatcttcatcgcctctcaccagccattcgccctcgtcttctccttttcctacctcatcttttctgccgtgtcctcttccgtcaataatccttttcagtgcttctccatcgcaagcaaccatggccttcaggaacgggtcctttgcgaccttcctgatcgtttgtcgtaa

SEQ ID NO: 5443 - DNA, 453 bp, A.fumigatus
gcggccacgcgacgacacttatcttcatcgcctctcaccagccattcgccctcgtcttctccttttcctacctcatcttttctgccgtgtcctcttccgtcaataatccttttcagtgcttctccatcgcaagcaaccatggccttcaggaacgggtcctttgcgaccttcctgatcgtttgtcgtaagccaccccccatccacctcctggaacacttcctcttcagaacaaccattctaacaggactccccaaaacagccgtcagcttcttcctgggcatcatcttctccctcttcccctatgactaccccatcctgtggtccacgggccctacccccccagcccactacgactacctcgaagcgcacctgcgcttcctgcacgcctcgccgcccctaatccctcgcatcctccacatcgtcatctttttgggtctggccggcctcgtctcg

SEQ ID NO: 5444 - DNA, 987 bp, A.fumigatus
ccgacctcgcatagatacaaggcagcctctctgccggcctccttctcaggtttgaaggccgccaagaccaagtctggcgacattcgtttcgtggcctatggccaatcgtatcccaatggaactgcatacaatgaagagcttgctaccgctcctctgagctccgcgcgcatctacgatagcatctacgtgcgccactgggactactggctcagcaccaccttcaacgcagtcttctccggcactctgaagaagggacatggaaagaatggctacagcttggacggggaactcaagaacctggtttctcccgtcaagaatgccgagagcccctacccaccgttcggtggtgcgtccgactatgacctctctcccgatggcaagtgggtcgctttcaagagcaaggctcctgagcttcccaaggccaatttcaccacatcctacatctacctcgttccccacgatgcctcagaaacagcccgtcccatcaatggccccgatagccccggcacccctaagggtatcaagggtgattcaagcagccccgtgttctcccccaatggcgacaaactcgcctacttccagatgagagacgagacgtacgaatccgatcgtcgcgtcctgtacgtctactccctcggctcgaagaagaccattcccagtgtcgcaggagactgggatcgctcccccgacagcgtcaagtggacacccgacggcaagacgttgatcgtcggaagtgaagacctgggccgcacgagactcttctctctccctgccaacgcaaaggatgactacaagcccaagaattttaccgatggtggctcggtgtccgcgtactacttcctacccgactcgagtctgctggtaactggcagcgccctctggacgaactggaacgtctacactgctaaaccggagaagggcgtgatcatagaagattgcgtctgccaacgagatcgatcccgagctcaagggacttggtccttctga

SEQ ID NO: 5445 - DNA, 216 bp, A.fumigatus
  unsure (49),(73): Identity of nucleotide sequences at the above locations are unknown.
cgcacaatatcaggacctttgtcaacaaatggcgccatctcgcgtccanatgcttcgacgatgcttgcattgntaacccaagactgtggagaccaagacagcgtccaagacagccctgtgttcctgtgcttctctgcccacactgaccaggctaagctgtccgaggcccattcatggcgtggcgaatgggctccatacgagcgtccatggatgtaa

SEQ ID NO: 5446 - DNA, 330 bp, A.fumigatus
aaagttgcggtcttttcgacgtcgcagtactcatttgagacgcacaaacggacctcgtggtggagtctgttggacctgaagactggtcagaccaaggtcctcaccaatgacagcagtgtgtccgagattgtctggttgtccgacgattcgattctctatgtcaacagcaccaatgcagacatccccggtggtgttgagctgtgggtgactcaggcttcgagctttgccaaggggtatatacgccttcctgtcacgtcattccgaaggctatctaaccgacctcgcatagatacaaggcagcctctctgccggcctccttctcaggtttga

SEQ ID NO: 5447 - DNA, 1005 bp, A.fumigatus
ggacactgcctgagcataaggactcaacatcaaatcttactcaagtcaaggcaccacatagacgagacagtatccacgatgcttgacaaacgaggagggccatatccgcctcataacgctgcactggggggtttacccagtgtcatccccgacatccccatctgtgccgtcttcctcgccctctacatcggatttgctgctacaaacatggccaccctgcaaataaatcgtcgcagaagccacaagttccttatgtcgggaatgctatttggcttttgtatggcacggatcactacactagtcttgcgcatcgcctgggccaatcgacagcacaacgtccgactcgccgttgccgccaatatctttgtcaatgccggtgtgctcctggtatacatcatcaacttgcttcttgcacagcgcatcctccgagcgaagcagccccgaatcggttggaatcccgtgttgcgagttgcatataaggtcctttacgccctcgtcgctgcagccttgatcatggtcatcacggctactgttgtcagcgtttataccctcgacaggcatacgcaggcgcaatgccgcgatgtccagctggcagccataacccttctgctcgtcatcacctgtcttcctatcctgcatctcctcgttgcattcctgttcccacgatccgagcaggaggaaacattcggggaaggaagcatggccagcaaagctatcaccgtgatcctatcgtctgcgctgtgcattctcatcgggggtttcaaggctggcgcaaactggagtactcctcgaccagtcaccaaccccgcctggttccattccaagaccgccttttacgtgttcaactttgtcctcgagatccttatcctttgtgtcctggccctcggtcggatcgacaagcgattccatatccccaatggatctacaaagcctggtgactacactcgtctcggactgcagttggataaaggaaaaggaatggaaagggctcccgcttctcgttga

SEQ ID NO: 5448 - DNA, 243 bp, A.fumigatus
gcccgagcaaaccggcgggcgacggcgctgcctgttccatggcctgccccggcaatgatcgcaattggtttcaccattgtgaacatcggggtgtgcgtaccatggggattgggactgcagccccagacgactacttatcagctcagctccttgaccactgttgacatcatcgccggtatgcggtgccccgaggacgcggccttggcatgggacacatccatggaaatacctcgtgaacgataa

SEQ ID NO: 5449 - DNA, 201 bp, A.fumigatus
cagattccccagctctactttgagcaggctgaagagctagctccgttactgaacttgaagctcgccgttaagaggaccagcgcaggacctgttcccatggcaggatttcccttttttcagctagatcggttcttgaagatactcgtccaagacttgaataagtacgtggctatcagcgaaaagtttgccaatgcccgctga

SEQ ID NO: 5450 - DNA, 582 bp, A.fumigatus
ataagtacgtggctatcagcgaaaagtttgccaatgcccgctgaggataaaagccggggcggtctgctcttcgatcgcagggtagccagaattatcacgccaggtacgctaatcgatgagaagttcatggacccttcggagaacaatttcttgctggcggtttatatcgacgtggcagccttgaaagcgcaattagaacaacaggagggcaacctgtctgcgcagcagcacatattgtcttccgcatcccagcacgttggcttgtcctggctcgacttatccacaggagatttcttcacacaatcgactaccactcagatgcttccgtcggcgattgctcggatcggagcgcgggagatactcgtggaccataaacttcaggacctgatcgggcaggagttgcaacttctggttgggcatgaccatcgcttgatgacctttttcgcttatcccagcaagattctgcctatagcacagtggagctctgtgcttgaggcgcaagtagctgaccaagattccgatgcttttacgccggaagaggtcgcagccggttatagcttgctggagtatatcagagttcag

SEQ ID NO: 5451 - DNA, 558 bp, A.fumigatus
tgccccaaaaccaagaaaaaacccggtcgacctacagatatcgagcgaggtgcgatccgagaaagcgaggatgtgctcgctagagaacagagaaaacgtcgcgggcaacagcaattacgcggccagggtattctctctgctgccgatgctctcatcgaagggttgaaataccgccctcgaacgcccgccacccgcgcgacgtacgatcttatccttacaatgactgcaagccatctgggtgatgtccctcacgaagtcgttaggagtgctgccgatgctgtgttggagttattgaaggatgaagatatgaaagattttgacaagaaaaaggagattgacgacttgctcggcagctccatgagcccaaaagagttcaatgaacttgtaaatttgggaaagaagattacggactacgatgcgcaggacgaggacgaagagatggagggcggaatggatggccaagaagaggcagagctcgacgaacgtcagggtgttgccgtcgtcttcgacgaggaagacgaggatgatgagcgcatgggcactgtcactgaagtccga

SEQ ID NO: 5452 - DNA, 531 bp, A.fumigatus
ccaaatatcatcatggaatatcgtacacaagctggagaaaaagaagctcctgatcgcgatcaattgtgttgctgctctgtcaatcctcttctttggttagtctgtcgtatagcatcactaatgcttctactgatcagatattcaggttacgaccagggaatgatgggcggagtaaacaacgccaaagactacattgatctgatgggctttggttacaccgagatgaaagatggccagcctactccagttgtcacaaatagcttgttacaaggaggaattgtctccgtctactatctcggaacgctttgcgggtgcctccttggtggatggatcggagactctatcggtagaatcaagaccattgcttcgggcgctgtgtgggctatatttggcgccgctttgcaatgctcagcgcaaaaccacaactggatgatctgcggtaaggcttcattcttaccatcaaccgataggttcgctgtgactgaccaaactcagcccgctttatcaacgggattggcaccggtattctga

SEQ ID NO: 5453 - DNA, 195 bp, A.fumigatus
ccaaactcagcccgctttatcaacgggattggcaccggtattctgaacgcaatcgtgccggtctgggctacagagactgctgaacacacgtctcgtggacagttcattgccatcgagtttaccctcaacattttcggtgtcgttttggcgtactggctgtctacacggcccggggctggaaggctaccgcgctgc

SEQ ID NO: 5454 - DNA, 1311 bp, A.fumigatus
  unsure (541),(605),(1300),(1301),(1302),(1305): Identity of nucleotide sequences at the above locations are unknown.
aacaatatcaccgaggttgggctgttttgcgttttcggggtcaagatgggttccaaaaagtcgcagtcgaagcctccccctagcgctgctctggattataaacctgcgaacaaattgaggcgtcaaatgcttcatgtcaagcgcaagcgggctaaggactcggagcgacgagcagaacgatttggaagaaaaaaggaagaagccaaaaacccgaaattgaaggaggagcgtctcaagcgaaatattccgctgactctggatcggaaacgtgtctgggacgaggccgatagtgacgttgaagatgccctcggcctcagcgttgacgtcgagcgcatcaagcgacagaagaaagaagaggaggacgaactcaacaggcctttggacgataaagactcgggttcggacgaatctgaagatgatgtcgacagcatgctagccaccagcgacgaggaagaggacggagatgagaaggctaagaaggatgatacccggggtcgcaaaaagtcctcccttccatctgctacagaacgagcaacctctncgagccagtcgactcggagtacgaacctcaacctagcgccagaggcactcgctgccaaatttcntacgttgttcccttcagagcctcatccgacacccaagatcctcatcaccacctcgctcaactctaccctccataacgaggccagatcccttaccgatctgtttcctaacagcgtttatatccgtcgtacggcccatcgctattcccacaagttctccatccgcgagattgctgccttcgcgtcgaatcggaactataccagcgtcgtggttctccaggaggatcagaaacgaccttccggtctgacgatcgtccacctacctcagggtcccaccttccattttactattagcagatggatagaaggcaagaagcttccgggacatggaaatgccaccgagcaccggccggaattaatcctcaacaacttccggactcctcttggtctacttacggcccatctcttccggagcatgttcccaccacaaccggacctagaaggacgtcaagttgtcacaattcacaaccaaagagactacctatttctccggcgtcatcgttatgtgttccgtgagaagcgcgagactgaaaagagtgtcgttggtacagacggcaaagagatcaagggtgtggaaggcattcgcgccggccttcaagagcttggtcccgcaataaacttcaagctgcggcgagttgacaaaggaattcgtcttcaccacggggctggaaggagcgctgccaaagtccaatctattnnnaangaaggc

SEQ ID NO: 5455 - DNA, 495 bp, A.fumigatus
  unsure (22),(86): Identity of nucleotide sequences at the above locations are unknown.
ggctctgaagggaacaacgtangaaatttggcagcgagtgcctctggcgctaggttgaggttcgtactccgagtcgactggctcgnagaggttgctcgttctgtagcagatggaagggaggactttttgcgaccccgggtatcatccttcttagccttctcatctccgtcctcttcctcgtcgctggtggctagcatgctgtcgacatcatcttcagattcgtccgaacccgagtctttatcgtccaaaggcctgttgagttcgtcctcctcttctttcttctgtcgcttgatgcgctcgacgtcaacgctgaggccgagggcatcttcaacgtcactatcggcctcgtcccagacacgtttccgatccagagtcagcggaatatttcgcttgagacgctcctccttcaatttcgggtttttggcttcttccttttttcttccaaatcgttctgctcgtcgctccgagtccttagcccgcttgcgcttgacatga

SEQ ID NO: 5456 - DNA, 612 bp, A.fumigatus
gaagaaaatcaagggaaaggggagatttttgatttttctaactcacgttcgtttcatctcttacgtaccagctccccttgtctttcattaccgtcgttcctcaggttcgttggttctgggggtcgactcacgtggtggatgactcaattgccatttcttcgactctctcttccccgccaaattcctctctgtagccccgccagaagctttttccacaccactgccgcactccaggctgtccaggcttccaagaagaatcagctcacgatggcgaccgtaaacacaaagaccgggaaggtcgttgaccgcacggtcttggactcaatgctccggcgccggcttttctacaccccgtctttcgacatctacggaggtgtttccggcctgtacgactacggcccccccggtaccgccctgctgaacaacattgttgacctgtggcgcaagcatttcgtgctggaggaagacatgctggaagtggactgcaccatgctcaccccgcatgaggttttgaagaccagcggacacgtcgacaagttcgccgattggatgtgcaaggaccccaagactggagaaagtcttcaccacgcgggtggaaggatccacgcgaag

SEQ ID NO: 5457 - DNA, 384 bp, A.fumigatus
  unsure (223): Identity of nucleotide sequences at the above locations are unknown.
cctggaagatccgcaagaagcgcgacctccccgcgctcagggacaagaacgatctccccgagcgccgcgaagcagacgtcgacgtcgaactcggcgactcccccaaggatggagagcacgagttctccgtgctcaaccccacccaacagcgcaaactcatgcaccatcaagagaaattcgccaagtcccataccttctacaagcctcatgaaacatacacccnaccacgccttcccactacgcctcctcatcgccatcgttgtcctcctcgactgccactccctctttcagatcgccctcggcgcttgcacgtggggcatcaactaccacgtgcgccccttcgccctcacaactgtcatcctctgctgctccatcacctgttaa

SEQ ID NO: 5458 - DNA, 819 bp, A.fumigatus
  unsure (653): Identity of nucleotide sequences at the above locations are unknown.
acgatcgggtcagacatatgttacattcgcgacgctctgccttcaagcggtccatggttgggtttggtaaatatgtatcgaaacgtaagtcgttggacggcatgtttcggctgctcttatgatccgtggctaatagcagtttgtcgacagcgctggggtttttggttactctatacgcaactctcatcaccctttttgggcttgcatgggtgcttttccttattggtatgctctcctcctcagatattaccaactcctgccgctgacatacaaaaaggctggatcaatgtgggaggaaggcaactatacgtcatcaatgtcatcgataacgtacttgtggctttattcgcgatcatgggcgacgggctggcccccttccgagccattgacacctaccacatgatctttattgcgcactacacctttttaacctggaagatccgcaagaagcgcgacctccccgcgctcagggacaagaacgatctccccgagcgccgcgaagcagacgtcgacgtcgaactcggcgactcccccaaggatggagagcacgagttctccgtgctcaaccccacccaacagcgcaaactcatgcaccatcaagagaaattcgccaagtcccataccttctacaagcctcatgaaacatacacccnaccacgccttcccactacgcctcctcatcgccatcgttgtcctcctcgactgccactccctctttcagatcgccctcggcgcttgcacgtggggcatcaactaccacgtgcgccccttcgccctcacaactgtcatcctctgctgctccatcacctgttaaaatca

SEQ ID NO: 5459 - DNA, 1047 bp, A.fumigatus
cggatgtacagaacggaaacgggccagttgatgacctcttttcgaccaccagaagacaaaggatgggactgggtgcggccctcggagcaggtcaagaagtatctggtgttcgaggagcgttctccggggatttatgagctgatcgtcctcgacggctggccttcaaaggttctgtctaaccgaccagatggttcttatgctacaaaggatctcttcctcaagcatcccactatggaagcatacaagtactacgctcgactggacgacacgattgtcctcgtcaatggcgaaaaagtcaatccgctggacatggagggtcgagtcaggcagcatgatgccgtctccgaagccgttgtctttggagctggaaaggcttgtatcggactgttggttattcgtgcgcctggcaccgaggttatatcggacgaggaactcaatgaagccatctggcccgccgttacacgggcgaaccagacaatgcctgcatttggccagctttcaaagagcatggttcgaatactcccggccgacacgcaataccctcggacggacaagggaacggtcatcaggcaggctttctatcggacctttagcaagttgattgaggaggcctacgaggcagagaatgcgtcgacgggggcattgaccctttcagaagccgagctgaaagactttctcagagagcaactccatcgcttgttaccactgaagaatggccatgtagtgactgacgacgcagacttctttaccctcgggatggactccctgcaggctacacagttgcgatctgttcttctgaagactctagacacaaaagggcagaagttgggattgaacgtcgcgtttgagcaccctacaatcaatgcattggcgcgctatctgaatggccttggttctggggtctcggacggccccgtgcctgtcgaggagcagatgagcgccctcatctcaaaatacagtcagttcgaaccgcacaggcctatccctaatgggctgaagggcagatatgttgtaagtttgtcattctcgtccatatctgtcatataa

SEQ ID NO: 5460 - DNA, 486 bp, A.fumigatus
acagaagatgtcgatacgaacctcgtgccgcacttggattctgaggccgagtcgaagcatgtcgcgtggatcatccactcgagcggctcgacggggctccccaagccgattttccagacccagagcgcggtcatcaagaactacgcgggcaacatgaacatgaccgggttcatcacgctgcctttgtaccataatcatggactaagctgtctattccgcgcagtgcactcatgcaagtcgttgcgtctgtacaatgcggagttgccgctcacaaagcagtacctgttggacatcatgcggtcccacgagtttgagatcttctatggagttccgtatgccctgaaactgctcgccgagtcgagcgaaggtattgctgttctggccaagttgaaagcagtcatgtttgggggttctgcttgtcccgattcgctgggagatctccttgttgagaatggagtcaacctgatcagtcactatggaacgtag

SEQ ID NO: 5461 - DNA, 201 bp, A.fumigatus
actggcgcgcacaaggcagtacaccttttggacgtcgtcgagggtggagactttcgcggcgacatggcttccaagggatccagtggcgcccgtgacaacctggaaagtgtcaattatatgacagatatggacgagaatgacaaacttacaacatatctgcccttcagcccattagggataggcctgtgcggttcgaactga

SEQ ID NO: 5462 - DNA, 336 bp, A.fumigatus
aagctggccaaatgcaggcattgtctggttcgcccgtgtaacggcgggccagatggcttcattgagttcctcgtccgatataacctcggtgccaggcgcacgaataaccaacagtccgatacaagcctttccagctccaaagacaacggcttcggagacggcatcatgctgcctgactcgaccctccatgtccagcggattgactttttcgccattgacgaggacaatcgtgtcgtccagtcgagcgtagtacttgtatgcttccatagtgggatgcttgaggaagagatcctttgtagcataagaaccatctggtcggttagacagaacctttga

SEQ ID NO: 5463 - DNA, 282 bp, A.fumigatus
caaacgtctttcatcgtttttcgatctgactacggatcgccattctttgttttgagacatgttcatccaatgaggaggacgcggatctgggcaagcgacttacagcgcgtgattgacacagcagcatgtttcgcctctggtcttttcagtctgaaccaggaaaagaacgacaaagctaccctgtttactcaaaaggagtggggacatttcacgtacgcccgcgacgcgattcattactatcgcgccggtcctggcaatccatatgctggtgcgatgggttag

SEQ ID NO: 5464 - DNA, 639 bp, A.fumigatus
agttcgtggcgtccagttgagccagttgacgaaagaaggaaaggaccaactggccctctacgtcgctcaaagaaaagtcgtcggtacgttatagactccagcctcgtcgatcatctgctgacggtgtccccagccttccgtgaccaggattttgcccatctccccattgaaaaagccctggagtttggtggctacttcggccgacaccatatccatcaaacctccggagctcccagaggctatccggagatccacctcgtgcatcgcggtgcggacgaccggagtggtgccgagtttctggctacgcggacaaataccgtgacctggcactctgacgtaaccttcgagaagcagccgcccgggacgaccttcctgtatcttctggatggcccgaccagtggaggtgacactctctttgcagacatggtgcaggcatacaaacggttgtcgcctgagttccgcaaacggctgcatggtctgaaggcagtgcactctggtatcgagcagatcaatgctagtttgaaccgagggggaattgcacgccgggaggggatcacatcggagcatccgattgttaggacgcatcctgtaagttggccaaacttcagcaggctggtgatagtgattgatatcgtttag

SEQ ID NO: 5465 - DNA, 234 bp, A.fumigatus
acaactgataccattagagatcccccactgacgccgtttgagcactatgaccatggcaaagacgccgatccctcctttcctgaccttctgcctccgggtaaagtccaggtggacaacctcacgccaaccattggcagtgaagttcgtggcgtccagttgagccagttgacgaaagaaggaaaggaccaactggccctctacgtcgctcaaagaaaagtcgtcggtacgttatag

SEQ ID NO: 5466 - DNA, 267 bp, A.fumigatus
ttgatatcgtttaggttactggagagaaagccctgtttgtcaatccacaatgtgagtattctcttcaccaaagacagggtctcttctaactgggcagttactcgttacattgtgggatacaagaaagaagagtcggacatgcttctcaagttcttgtatgatcatatcgcgctctcgcaggatctgcagactcgtgtccgatggcttcctggaacagtagtcgtttgggatgtgagtatactgatcttgcggtctggaaagtactaa

SEQ ID NO: 5467 - DNA, 411 bp, A.fumigatus
aatcttgacatccaaaggtccctggaaacaaaccgacgtaccaacctcatcatgccctgtaggaataacaataacaacactcccggaccctggggaagccaatgtgcctgtctttgtctcgacagcaccggtcagagagacttcatcgaaggcggcgcgttcatggaaagtgacgacgaggagggtctcgcttggcagcatgtcgaggatatatctatcctgacgcctgaggaacaggacttttccctcggtgcgacgggccggaatcgtgagaatgggtttaagaaccgttgtatctccgagtctgcctctgcaaaagagtgtggctctaaaaaggggatctttggcttttgtgcgaagagtaagtgtaagggtaagggtaagactaagggtcttgctgggaagaattga

SEQ ID NO: 5468 - DNA, 207 bp, A.fumigatus
ttcgagaaaagcgcctactcctccctggacgcttccaactgccgtgttgatgccgagaaggacccgaggcttgaagccgatactggctataagggaaaccagagcggcttttgcttgaaatggcaaggcatggacggttgttttgtcactgagcaggggttagtcgaacagagtcgtgaaatggcgggttttcttacaagcctgtaa

SEQ ID NO: 5469 - DNA, 597 bp, A.fumigatus
cccctgctcagtgacaaaacaaccgtccatgccttgccatttcaagcaaaagccgctctggtttcccttatagccagtatcggcttcaagcctcgggtccttctcggcatcaacacggcagttggaagcgtccagggaggagtaggcgcttttctcgaactacccaaagtttccgtcaatgtgacacagctccgtaacgtcaacgaaaagtgcgagtccgtctcaaacggcgagggtaagcttacatcaatgctggacaatatcgttggggactttacgaatattgttcccaccgtggacatcaatctgggagcgctggcgaatttcgaggttgatgtcccacgcgtcttcaccgaaacagccgctgtgcaaaccgtattggcttcaacttcataccctctgcccacggcgtgcttgcagtttgattcggagagcggcgaatacagttctcctactccaactccgactcctacttcagtatcgtctgctgtaggtaaggctgccacggctgaggcgaagaaaagccgggctggttctgtgggaatcaatcgtaggtttgtgtttttgtcagtgattgtgagtttgtgtgtcttttag

SEQ ID NO: 5470 - DNA, 477 bp, A.fumigatus
aaagaagagaacgccgctttctgtatcttccagcctttttccctacctcttttccggttgattaacacatcttggaccatggcgacggctaatgcttcaattacggactcaccacggaagtcgcttatcctcaatgcgttcgttgagatgtgtacgcattcaatctctccgtgcctgactattctgacataccacaggcagcggccaccagtctcccgggctgtggcgacacccagaagacgaatcgtaccggttcaacgacgtagaccactggatcgagctggcacagttgttggaatccgccaagttccatggcatcttcatcgccgacgtcctaggtggctacgacgtgtacaaaggggctcgaaaacttgctccggcgattgtttccggaaccgcaatggccccgtcaatgagcccgctagcttgtggtttccggcgaaatgcaccttgcaacaaaaaattattctgctttgg

SEQ ID NO: 5471 - DNA, 291 bp, A.fumigatus
cataccacaggcagcggccaccagtctcccgggctgtggcgacacccagaagacgaatcgtaccggttcaacgacgtagaccactggatcgagctggcacagttgttggaatccgccaagttccatggcatcttcatcgccgacgtcctaggtggctacgacgtgtacaaaggggctcgaaaacttgctccggcgattgtttccggaaccgcaatggccccgtcaatgagcccgctagcttgtggtttccggcgaaatgcaccttgcaacaaaaaattattctgctttggg

SEQ ID NO: 5472 - DNA, 333 bp, A.fumigatus
tcacctatcactcgaggctcaactcaaatgctgatacctaatcctgcagccggtgagctcgagaatctcattgacgagttttcggagggaaagattcagttcgctttcgtcaaagtcaccgatccaaacagtggtctcccgaagaatgtcctcatcggatggtgtggagaaggcgtctcaaaacgaacgaaaggatacttcacaagccacttgtctgctgtcacaaagtttttatccgtcggtgcccccttgtccagcttagatgaacgtaatattctgatattaggctactccagaactaccatgttcagatcactgcacgctctgaggtag

SEQ ID NO: 5473 - DNA, 855 bp, A.fumigatus
tattctgatattaggctactccagaactaccatgttcagatcactgcacgctctgaggtagatctgacacccgaaggaataatacagaaagtcggagatgcctctggtgcgaaatacacacctgaacgagcttcgccagtcactgctttgcccaaaacgtttccggttacaagcaagccagcattcacacccaccagaactgttgcggtaggctcaaagacgtgttcaaatgtttccactagggtggttccaagaacgagcggcgatgaagatgattggggtccagatgcgcccccggttaccaggacagaacttgaaaaagttcagtccgcgtacaagccaactaaggttgacatcgaggcaatcaagtctcagaaccttcccagaacatcctattatcgtgagcttcccgttacagagaacaatgatgttgttaagggtggctatcaaccgataggcaaagtggatattgctgcaatcaggaaacaagcgcgggaagcaggagaattgaaagaagaccgacccgagcctgtgagaggcgcatatgagcccgttggtaaggtcgacattgctgctatccgttctaaggcgcagaagcagcctgaatcgtctgttgaccagtccatctcaagcaaccctgttggatcccgtaatgaaagggttgaaccttcggatttttcaaaactagccgatcagcctgagcgtttgacgactttacccaagccgaaggttgcgaaaaaaatcggtataagttcaactttcacaggcacaaaggcacccttgcctggtggcttcgtttcaagcccggtccctcctaccacacaggttggcattgccaaaccaaccttttggtga

SEQ ID NO: 5474 - DNA, 204 bp, A.fumigatus
tgtcccaagagtgcttgtctcggtccaggaaccacgacgtacattcatggatttgttggtgtcattcattccagcacccactattttatcatgatgtaccaacacgcatccaactggtgtttcgccatgttcgagcgctctctctccctacacagcgtatttgtaagcgctgatccagccttaggcaaagtatcgtaccattag

SEQ ID NO: 5475 - DNA, 201 bp, A.fumigatus
tggtcagcctcaaccattccatacctacatcacccacaggcgatccgagtagacgactggatgcgcacagaaatggagactccacgggcaggaaatgaacaaggtctggtcatacagcggatatggtccacagatggagtcctcgttgctacctgcattcaagaggtgagtcaaagctccctctcctacctctcgaattag

SEQ ID NO: 5476 - DNA, 324 bp, A.fumigatus
ttgcaaacaactttggctgactgccctctagaactccctcagaatgtccaccaccatactctgcagcacaaacaagtacgggatctcatcggagacccagagccgcccaccagcagcactccgtacagccgcacgcccgagctgcgagtaactcacaagttagcagaacgcaaacgtcgcagtgagatgaaggactgtttcgaggcattgcgcatgcggctaccacagagccaaaacaacaaatccagcaaatgggaaaccctgacaagaggtaccgattttatcaccgcttcttcgatcgctttcacactgactttcctctag

SEQ ID NO: 5477 - DNA, 321 bp, A.fumigatus
catctcttgttcagtgctcccgtcgattcccgcaagcctgacgatgatgaagaaggtgccgttaaccccggctcgaaccttttcgtcaccggtatccaccctcgtctgaccgagtccgatatctcccgtctgttcgagaagtacggcgatgtcgagagctgctcgatcatggtggaccctcacactaaggaatctcgtggctttggcttcgtcaagatggtcactgccgagcaggctgatgctgccaaggagggcctgcagggtgaggttatcgagggccgtactctcagcattgagaaggcccgacggagccgccccagt

SEQ ID NO: 5478 - DNA, 576 bp, A.fumigatus
ttatgcagttgctgggggtatggccgctgcctcccctctcgcattctgggctatggagagggtcagcccttcccatgtgggccgaggaggctttgctcctgtgatgcgactggcgacagcaatcggtttgattggaggtctgcacatactttaccagagatcttgcagtacgtcaacgcactgaaacctctggtagcatgcattaacccgagcatagaccgattctacggattcacggaaaatgccagagaggtcgaaatggacatgagggaaatggtcgacaaagtcaaaaagggcgagccgctatacggtacatcacaagtatcctcttacctacaaggcgttgctgccagaaattcgcggtactctcagctttttatccatgtccttccttggtttaacattgtcaatcacgaccaggtaagcctttttgtttttcattgctgtcctcagaattttgaacacagttcgcagttcgctaacgtacggcagcatggtgttgacacagcaaaatattatcagcaagctgagcgtgaactcgaagccgagcgcttgacgacagccggttctcactga

SEQ ID NO: 5479 - DNA, 321 bp, A.fumigatus
tcgctaaccttgcattgcagctcattgactctgatccgtatgtcactacccttcgctcaagcgctcaactgtggaagcagatattcacatcaacataggcaccttagaagagttttcggatatgctagaccttctgattatgcagttgctgggggtatggccgctgcctcccctctcgcattctgggctatggagagggtcagcccttcccatgtgggccgaggaggctttgctcctgtgatgcgactggcgacagcaatcggtttgattggaggtctgcacatactttaccagagatcttgcagtacgtcaacgcactga

SEQ ID NO: 5480 - DNA, 1509 bp, A.fumigatus
  unsure (82): Identity of nucleotide sequences at the above locations are unknown.
acagaacaagcagctttgagttcttcacctcttcaaattgcttcgtggaatccctcgctttgcccaagcatctcccttgagntatacctctcaattcttaaacaagtgtctcacctgcttggcaccaaccctgtgtcaacagtacagcacaagaagcattgttttttacgttctacgtcctcatctcttgctgttgtctctgagacgtacctatcaagcaaggttgcgcacgtacccgccatacatacacatacagaataccggtctggaggtcgtctatcgctgtgtctacacggtgagacacacagacataaccattccgctgtccgccacccgcaaaacacacagcacagacggaaacatgatgttcgaagacatggcgtcgacttgcgacgagacctcccagcgccgcgctttgccgtgagtgatcaatgtctttcatcgtttcgaagcgttgtccgactgacatacctttccacaaatagcagcatacgctccatctcaaacagctcatccgggcctgtagatctgggcgatgaccgcatattacccccccttcctcgcgcggagccattgcctcggggaccctttaaccctttcacttctaacatctttgctcccagcccacccagcccacatgacactatccccgccaagtcgtcgtggccggtttcagagcacattgtcactcctccctctcccgccaactccgccgacagctcctggcccgacagtttgacgcctcgcaaggcctttgactggtcccaggaactctctcctgccgacctgctgagcttgattgccccgaagaacatcagtcggaagccaccactgcaacagttgtgcggaagaaagcgcaagggaagcatgatctccgccgatgttgatgaccagcgagagaagcaccgcattgccgagggaaatcgtcgcaagaatctcagccaattgcatcgggagctggatagtaggattcatgacttctttcttgaacgggccggctggaacccggccaagagcttgcctgaatccaaggaacacatcgttcagggtgctattttcctcatcgacttcatgctgctgatcatcgtgcacctgattcgccaggagaatgaaatgcctcgacagctgtcagagaagctgcagccccagatccgctgcatgcaactccagcaattggtgtcgaacctgcaacagcagcagcagacagctcaacagcagatcaaggttctgaagcaggagaaccagctgctggaagagcgaaaccaagcacttgagttccaacttaagtcatacgagcacatgttccggtcccccaagagcgagcaaacgagccctcgtcccctggcgctggtccctgaagccaagactcaaaatgtgcttcctggcttgcgagttctctgtgatggcatcgctgccccaagcgccgcccccgagcccttacatccaggctcctcccacggacagtccttcggacgtcttcaccacgggggtcgaaggatccgcgctaag

SEQ ID NO: 5481 - DNA, 933 bp, A.fumigatus
cgcggatccgggccgcttcgtggtgaagatattggtgacgaagaagatgatgacgatagcgacgacgacgatgacgatgacgatgacgataacagtttgtctcgattcatcgttgatgacgaggatgactcatcatcagtcagaaagtccaagacaaagaaaggaaagaaagccaagaagaccaagaagagccttgcggaactcaagaaggaagcctcgaagaatatcaagtcgaaacagaaataccttcgccgattggagaaaacctgggtcaccagcgcaaagattgagaaaacccttgaaatccttcaggagatccaggatcgggaggatagcgagaagaccatcatctttagccagtttacggcgctgctggatctcctcgaggtcccaatcgtgcgtcgaggctggggctatcgccgctatgacggcagcatgagacccggtgatcgaaatgccgccgtcctggagttcactgacaatccagactgcaagattatgctggtttccctgaaagccggcaacgcagggctgaacctcgtcgctgcatctcaggttatcatctttgaccccttctggaacccctacgtcgaggaccaggccatcgaccgtgctcatcgcatcggacagatgcgccaggttcatatccatcggatccttgtacaaaagacagtcgaggaccgtatcctcgaacttcaggagaaaaagcgcgagattattgatggtgctctggacgagaaggcgcagaagaaggtttctcgcctgggaactcaggaactggcctatttattcgtacgcgagtccatccccagttctttgaacaagagactaactgaattttcccacagggcgttcggtaacggctccttatctttcgatatgcgtggtatgggtcttcaccacggggctggaaggatccgacagggtcagtga

SEQ ID NO: 5482 - DNA, 1239 bp, A.fumigatus
  unsure (772): Identity of nucleotide sequences at the above locations are unknown.
cagttacttcgtctgtcttccatatcaacgggagttcaccaaactaaccaccacaatggtggcaccggtgctactaatatacgtccagcgcccacgtctgttaatgttgagactggttgtacggccttggggcacttgcgtcagccaacacagctacctcagcctcttagcctgttctccaacatatcatcactagcttttgaagatgtcataccaaataccaacacatactccgtctcgcaatccacggacggttcagactcttcgtcttggcgggacaccaaatttagagcgtacgaggtgcatcaacagacaagcaagtccaatgctgatcaagtagagctgagtcaaggcgttccctacggctcttccagaggagtgacaacgacaggaggaacgcgcgcccaaggacacaatatacccatcactcgctccaaaggaattccggacagcagtttaccgagtgatcgcagatttgtacttcaaattccggcgacaagtacaatgcaggggacggaacatatgaatgttgagttaggagctcattcgccctctgccgcggggttaggccaggcatctatattgccaagtcccagcagtaggaaacaaccctcttccactcaacgtgtgggcctcaccgcgggggtactgggagggctttcaatgacatttacgccagatccctcactcgtaggccaatctggagtgaaatcaatcattaatctctctctcgtaaagactgggtcaggctccctccaaattactacaccancggacaacgcctattttttcctcaaagaccgggtggtagcctcagagtcgacggcgattgtcggtacattgtcagcggaatattctgtcaacatagcaacagatgcggacaaaccggtgcagacggatttcttggtgccgcaaggccacattacgacaccattacttcagagcttacagagactgactactgctcacagccagcaactccatatcactgtcactacttcaacacacaggtcatattcaggcagcataagttcatcagcatccgatcagcttgacaaaggaatgtccgggagggccatcggtgtgatggtaggggcggttgctggagggacttgtggtttccttggtatatttctcatcgcagtgcggcaccggaagagaaagcgccgaaggatttggataagcaaccagttctgggaggatccaaaccgttcatacatttcgtttgggtccacgtaa

SEQ ID NO: 5483 - DNA, 477 bp, A.fumigatus
  unsure (14): Identity of nucleotide sequences at the above locations are unknown.
gtatttgatttacntggcctgcgtgcatcattgactgcctttattgaccaaattgatataggccatgggcagtcgggcaagaatttctattacaaaacgaagcattttgtcggtcctcttcaacaacttgccctgcaggagaaagtttcaggtgatgtggagctgttctacccagatggtccttggcctgctcccggaggtgaggaattggatgtccgggcatggggtttcggtgattttgaacacggtttgattaaaggcttggatatatccatcctgaagattttagacatactagatctgtacgggcctttcagcggggtaatgggattctcaaccggggcggctgttgccgcaattattgcttctatattggagcggcacgaacggatccagatgttcattcggggacacatccacgaaggcaagctagtgcaagtcttcagggatttcggcaaactcactgacgcgatatag

SEQ ID NO: 5484 - DNA, 321 bp, A.fumigatus
attgctcatcctccactccagtttgttgtctgtttcagtggcttcagacttggaaatcttcaatacggttccctttattcccccaagctagaaacaccgtcgctgcacctcattggtgtactggatgcaatgatagcagggcatttaacggaagacttcagcgcacagttcatgagtccaaaaatacagcgattttttggtgctcattatgttccgaagacggacaggacaaatcaagctgtcggcaagttcattctttattggtgccggcagtcgctatcaaggtcccgtacatacctgttgccgtggaactccatttga

SEQ ID NO: 5485 - DNA, 597 bp, A.fumigatus
agatcaggcgctgctccatctggagctattccctctggtgccatacccaccggcgctgttccctcgggcgctcccaatggctttggcggtttcggacagggcggtcacggcggcccaggaggcccaggcgaggaaggctctggtccttctcctaccggcgctgtcccttccggagccatcccctctggagccgctccttccggcgcagttggaggctttgacggcttcggacaggcatctgagaactctggcaacgcccagttccaatcttctggcacctcgccatttggtgcttcccattctggatcggctagcggtcatcagggcggccgtcacggtggtgaccaccgtggtcaccacggcaacggctctggcgcgattccttccgatgctgctccttctggtgccgctccctctggcgccgcgggaggtttccctggttttggacagggcggcgagggctctggcccctctcctactggcgctgtcccctctggtgctgccggatttggtggtcagggtcacggccagggccagggttcattccccaccggcgtcgctccatctggcgtcccctctgctcagcctactgcttga

SEQ ID NO: 5486 - DNA, 390 bp, A.fumigatus
gaagaccttttcacggctttcggtgcattccagagctactaccaatccgatctgctgcacaccagctctccgtctcgcattgcttgggtgggcactgtcaatgccttttttctcatctccactggcgtcatcgccggtccccttttcgatcggggataccttcaccatctgatgatcgccggctgtttcctgaccaccttcgggctcatgatgctgagtctgtccacgcagtactaccaagtgtttctctcccaaggagtctgttgtggcctgggtagtggcttgatctacgttcccgccttgtcattagtctcaacgcgctttaccacgcggcgtggcattgcagttggcctggtcacctcaggcgcgagcgtgggtatgcttcactga

SEQ ID NO: 5487 - DNA, 801 bp, A.fumigatus
gctgatgaaaatcactctaccccaggcggagtcctctttcctatcatcttcattcgtcttcaaccacgtatagggtttccctggacggtacggagcttgggcttcattcagctggcctgctcgtgcatcgcagtcccgctgctgatggtgaccaccaagacccgacgcagtcctccccggaagctcatccactggcatgcgatgaaggaatggagcttcaacgcctatgggatcgccaacttcctcatgttcatggcctacttcattccgctcttctatgtccctgcctttgcctctaccgccctccgctcttccaccgaccttagtttctacatggtctccatcctcaacgcaggctccgcattcggccgcatcgggtcatcccttctgacctaccgactcggcgccagtagcatcctacttgccagcgtggttgcctcggcggtgctcctttttggctggattggcatccactccgtcgcctcgtttgtcgtcttctgcgtgctctttggtattttttctggcgtgctcatctccgctaatccgctagtcattgcccacccggtagtctcgcccaccccttcagtgattgggacgcgcatgggcatgcagtggtttgctaccagtctcggcgtgttaattggagcgcctattgcgggcgttattgagggtcatgggggagataatggctttctgggattgcaaatcttcagtggagcggggatggctgcgggagcagcgtttctgctggtaccccttatggcagtttggcgacatgacaatatacaaaacaaggcgtag

SEQ ID NO: 5488 - DNA, 402 bp, A.fumigatus
catggaatctgggatgcggattcgccaagaccaaggctcagctctttgcttttcgctttcttgccggcattggcggcagcgcaccgttggcgattggaggaggcgccatcaggtaagaagtggatgcaaccaccaagagattcatcctttgctaacccgtcttgtagcgacatgtggagcgccgaagagcgcggcaaggctatgggtgtatacactcttgggccgctcctcgggcccgtcattggacccattgccggcggcttcattgcccaatactcgacatggcgttgggtcttatgggcaacctccgccgccgccgtcggaatccaggtcgtcggattgatctggctgcgtgaatgtcacccggccacgtcttcaccgcggggacgaaggtatgcgtac

SEQ ID NO: 5489 - DNA, 561 bp, A.fumigatus
gaatcagttgatgtttccccacccaagatggacgataagactccatttgcctcctgcgagggcatcacgccttcccctcagaaggaagaccttgaagcagccaaagagacaatcccaaccaagccatccaacacaggcccagatctcgttacatggagcgggccaaatgacacggagaacccccaaaactggcccaacagcttgaagtggaagaacacctgggcgatttccctcttcgtcttcatctcacctgtctcatcgtccatgattgccccggcgatgcaggatctcggcaagagcctagggatgaacaccgaaattgaggtgtacctctccatggccatctttattctcgcttatgccatcggtcccatcttcttcggtcctgcttcggagctgtacggtcgagtgcgtctgcttcaggttagcaatgcgtggtatctagcatggaatctgggatgcggattcgccaagaccaaggctcagctctttgcttttcgctttcttgccggcattggcggcagcgcaccgttggcgattggaggaggcgccatcaggtaa

SEQ ID NO: 5490 - DNA, 252 bp, A.fumigatus
  unsure (109): Identity of nucleotide sequences at the above locations are unknown.
atttgtcaggcatcaagaatcagtctaactattctaaatctcattaagagcagccattgtttgtggagaacaaaggcgctttgtcatcatggggagagctttagggtanaaaagggcgcttttaccttcatagacatcgccttctgttcatttttaactaagccttatgtgagccgaatcccctgcaacaccaccgtgcaaatggcctcgcaagtggatggaaagtacgcctggatcgttgtcgcaactgtc

SEQ ID NO: 5491 - DNA, 912 bp, A.fumigatus
atatctctttcctcaatcactcctcaacctttctgcgtctcgggctctcttcaaaaattagctgtcatggctcccttccaaggttctgtctccgtgacttacatcaccaccgccacggcgatcatcaacattgatggggtgcggttcctcacagaccccgttttctgtcctgctggctcggaatatgtctacgatggttgggccaaggccaactggaaggaatggggcttccaaaaccgtccaccgacctctgtcctgcgcagcttcgatggtcctgccctccagctgcacgacatccccccgatcgatgccatccttctcagccacgaagaccatgttgacaatctcgacccctttggtcgccagctcctcgatggtcgccgtgtctacaccacccccgatggtgcgcacaatctccagccacgccctggtgtcgtcggcctcaagccctggcagactgtctcagcccagatcggtggcaaggacttccggattactggtacgccctgcaagcacttccccggcggcgaggtcacaggcttcattgtggaatgtgagtccttcggcgtcgatgagaccggccttcccaacgtcgtctatttctccggcgacacggtgtggatcgatgagctggtggaaatcaagaacaagtggcatgtatctgtggcggttttgaatctgggcaatgccctcttcgagtatcccaggggtatgctgcagattacctttgacggcaagcaggcggcacactttatgcgagcgacaggtgctgatatcatggtgccgatccatttcgaatcctgggagcactttaccgagcatcgggaggatttgcagaaagttttcgataaggagggcattgcagaaaatgtttgctggctggtgcctggtgtggagaagagagttatttga

SEQ ID NO: 5492 - DNA, 183 bp, A.fumigatus
tcgcatcagatcaaaccctgccccagaactacaactgccattggcaagaatctccatgcccctttgtcagagcatcacatccaccacatttcacagctactgtccagtaacctcccactagctgagatccagttccgctcgtcacggctatccaatccagcgcctctatccctctccagctga

SEQ ID NO: 5493 - DNA, 579 bp, A.fumigatus
cttacatcaccaccgccacggcgatcatcaacattgatggggtgcggttcctcacagaccccgttttctgtcctgctggctcggaatatgtctacgatggttgggccaaggccaactggaaggaatggggcttccaaaaccgtccaccgacctctgtcctgcgcagcttcgatggtcctgccctccagctgcacgacatccccccgatcgatgccatccttctcagccacgaagaccatgttgacaatctcgacccctttggtcgccagctcctcgatggtcgccgtgtctacaccacccccgatggtgcgcacaatctccagccacgccctggtgtcgtcggcctcaagccctggcagactgtctcagcccagatcggtggcaaggacttccggattactggtacgccctgcaagcacttccccggcggcgaggtcacaggcttcattgtggaatgtgagtccttcggcgtcgatgagaccggccttcccaacgtcgtctatttctccggcgacacggtgtggatcgatgagctggtggaaatcaagaacaagtggcatgtatctgtggcggttttga

SEQ ID NO: 5494 - DNA, 369 bp, A.fumigatus
acccaggcctgggtcgacatgtaccacaagcttgatcccaaagagcacccctccagcatcatgactgcgttcgactcgcatgggaaacaagtaggttggacgctgatgctgtcaccgtcgtcgccagtcctacagcagaactgggccttcccacccctctgtggccccaagaccgggctgatcggctgcgttggagtcgatgaagaatatcgtaaggcaggagtcggacttgctctcctctgccacgcgatcgaggacatgaagcaacgtggagtcgaaggagtctttgtggattgggtcagtcttgagggatggtacgagcagctcgggttcaagatctggcgcagctatagaaccggccagatgtag

SEQ ID NO: 5495 - DNA, 555 bp, A.fumigatus
tcatcgacggttgtcgctcaagcgggtgccagcaataccgaagccctttttgcctcttggggcttcggtctggtcaacttccttttcgctttccccgcagtgttcaccatcgacacttttggacgtcgcacccttcttcttttcactttccctcagatggcttggactctgctcgcagctgccttctgcttttatattccggaggaatccaaagctcatctggcatgtatcgcactcttcgtgttcctgtttgcggcattctactctccgggcgaaggacccgttccattcacttattctgcagaggttttccctctctcccatcgtggtaagtgtgcattttgcattttgcatcttctgtgggactcgtcagctaattactgtcacagaggttggaatgtcttgggcggtcgctacttgccttggctgggctgcagttttgtccatcacgttcccacgcatgctagctgtgatgacccccactggcgccttttgtttctatgcgtaagtgcatgtcctatctcaagtctttgcttctcagatgtctgggcataa

SEQ ID NO: 5496 - DNA, 525 bp, A.fumigatus
  unsure (14): Identity of nucleotide sequences at the above locations are unknown.
acattgtcgcgttntaatcatcgacggttgtcgctcaagcgggtgccagcaataccgaagccctttttgcctcttggggcttcggtctggtcaacttccttttcgctttccccgcagtgttcaccatcgacacttttggacgtcgcacccttcttcttttcactttccctcagatggcttggactctgctcgcagctgccttctgcttttatattccggaggaatccaaagctcatctggcatgtatcgcactcttcgtgttcctgtttgcggcattctactctccgggcgaaggacccgttccattcacttattctgcagaggttttccctctctcccatcgtggtaagtgtgcattttgcattttgcatcttctgtgggactcgtcagctaattactgtcacagaggttggaatgtcttgggcggtcgctacttgccttggctgggctgcagttttgtccatcacgttcccacgcatgctagctgtgatgacccccactggcgccttttgtttctatgcgtaa

SEQ ID NO: 5497 - DNA, 288 bp, A.fumigatus
ccaatgtgcagcgggctcaatgtcacagctctggtcatgatttttctctgggtgcctgagacgaagcagcgcaccctggaggaacttgattatatctttgcggtccccaccacaaagcacatgcattaccagtgcttcaaggtcctcccttggtggatccagcgttacatcttccgtcgtgatgttaagcttgagcctttgtacaagctagatctgaccgctcacgacgagaaggtagcgagcagagagggcggtggacaggtcatctcacccaacactgagatgtaa

SEQ ID NO: 5498 - DNA, 258 bp, A.fumigatus
ttcagactgcaggctggactacatctggccggttctatagctgcgccagatcttgaacccgagctgctcgtaccatccctcaagactgacccaatccacaaagactccttcgactccacgttgcttcatgtcctcgatcgcgtggcagaggagagcaagtccgactcctgccttacgatattcttcatcgactccaacgcagccgatcagcccggtcttggggccacagaggggtgggaaggcccagttctgctgtag

SEQ ID NO: 5499 - DNA, 249 bp, A.fumigatus
aagactatggtatctgttatactctgtgtattcctcctgtcctacgtgtatggcgaagggaagagcaattatttcaagggttcgatcctcgtactcacctacctggtcgtggttatcgggttctacttggccggctacagtaatgttgacacgatgggtgtcgatcgcttcgacacgctggcccttggaccaatcaggtccgagaacttccacacgattggtcagccgacacgcggcatggctttctaa

SEQ ID NO: 5500 - DNA, 693 bp, A.fumigatus
gcctttccaaccagggcgatcttcaaatgccggagtcggaacaaaaccaaatattttacggataattttgaacggaacattgggaaagagattggttcaggaacaggaagcccccaaggttttcatacctgggttccccatgtaatctttatggggaatttttggggcaaccgttcgcccatcgcagaccccaacatgaagggttctattatcggcatggccaatgacaaaactgtcgatggccttgcgatctattactatgcaaccctggagttcattgcacttcaaacgaggcagatcgtcgagacgatgaataaagccggtcatagcatcacatccatcttcatgtccggatctcagtgtcaaaatgatgtattagtacggctcattgcatcagcctgcgacatgccagtccttatccctcgttatattcatgctgcagtttgccacggtgccgcaatgctgggagccaaggccgcaagtgccgacgccgaaggcaaaacagaagacctgtgggagatcatggatcgtatgagtaaaccgggaaagaaggtcgtgccgacagaagacaagaatgagaaagctttgctcaacgtcaagtacaaggtcttcctggaacagtgctacaagcagctcgaatatcgaaagttggttgatgagaccgtgagctcgtggaagactggtgacacatga

SEQ ID NO: 5501 - DNA, 213 bp, A.fumigatus
gcaataggtgcttcaaaatcttttaaactgctccgcgcatatcatcgtaagccattcatatatatatatgacagcaatggcgtcgaggaataccctccgtcgcgctcttctatacagtacgttaatccacagaacaagctctccccgcagttgaccatcccccctcttggcacatacgaaacgaccacgatgctgagtaacactcctggctga

SEQ ID NO: 5502 - DNA, 198 bp, A.fumigatus
ttgccagttcccggctcttctcagcgcttcatagacaaatctcgctcattgacggcggattgcgtcgcctatgacctggaagacagcgtgactccacacaagaaagcggaagcccgctcgctggtgcggagagcgcttgacctgcctggctccatctggcatccgcgaacgcgccgttcgcatcaactcggtagatag

SEQ ID NO: 5503 - DNA, 681 bp, A.fumigatus
ctccacacaagaaagcggaagcccgctcgctggtgcggagagcgcttgacctgcctggctccatctggcatccgcgaacgcgccgttcgcatcaactcggtagatagcggtctcgcattggcagatctgaccgaagtagtaagtgaaacctcaccttctccgaaagtcaataatccagctaacgaaacgaaacagctccaatcccccaacctcagcaccatcgtcatccccaaagtcgattccgcttcggatctcacgtttgtcactgatgtcgtctcccacacgctctcgcaacaagcacgatcgcaagacgcagcctcacgcccccgtctctcacttctggccctggtggagtcggcgaaatccctgacgtatctgacccagatctgtgcagcgaccccacttctccaaggtctgattttcgcggcggaggatttcgctctcgacctcagtcttacccgcactccatctctaacagaattcttgtttgcacggtccgccatcgtgagtgcagctcgcgctgcgaatctgccgtctacaattgatctggtctgtacagcgtacaagtctaccaagagcgatgggtcgccaccggcggctctggaggaagaatgccgcggaggaaagcagctgggattccatgggagtctacagccagggggccaggaaccgcgtagcgcc

SEQ ID NO: 5504 - DNA, 417 bp, A.fumigatus
gtttcccagctacttgagaggctgtcagtcaccccgtctcatagcttctcttccgctaacacagttcacagcgtccttgtcttcatcctgactctcctcctcctctccgcggacttttactacctgaagaacatcgctggacgtcgattagtcggcctacggtggtggaacgaagtcaacactgctactggggattctcactgggtctttgaatcttccgaccctgccacgcgaaccatctcggccacagataagaggttcttctggctgagtctgtacgtgacacttgcgctgtggatcgggctcgccgttttggcgattgtgaggttgagcagtgttatttggttgagtctagtgggtgagtcgtcctatgcggatattgatatcgattgttgtattgccaaagttgaaaggtaa

SEQ ID NO: 5505 - DNA, 1545 bp, A.fumigatus
gatgaggaccccagggaacgaatgttttacaatgctctgatcaagttcagaaatgagcagctagagaattaccagggacagcctctcgagtattcagccagtgattaccaccatatctctcgactaccagcttcctctgcaaataggcgcaagcatgcccgggtacaaggtggttctcggagacaaggccaaaattcaacgacgacgacgacagcaaccacaacaagcaacagcagcagcaaacagcctcaaagtaaatccagagccctaaaatcctcaacaaccgagaaaagctatgatccattcagatctccacgccacataatcgccactcccgaagtacagtgcgctcaagttaccattcaccggaacggccctgaagcaaataccaaagaaatgtcggaagctgttccggatttagacgacgatatgaaggaagaagaagttgaggatatagactgtctcccaagctctcctttctccatagtgcccaacaagaagtccaaagccagcttcactaggtcttttcagtcaagagcttcccactcatctgctcgccgggtgatgaatacaacacctacacctcgctctgccagctataagcggaacgttctatttcttcatcaccagaatcgttcacaagcatcaatgtctgcaagaccgaggaaggcacgagcaaatgcttccagcattagcaggcaagaaagcgactgcagcataaagtctgacgaggacggcgttctctcctcagaccgttgtggaagtcctttgctaccggtccaacctttagtagttagaggagctggtattactattaaaaactgccctcaagtcaagagagtttgcgacgcggacattatctggagagacgaagcgcgcaaggtctcccatgaactcagccaaatatgtgaagaggctttcaatggcggatccttgtcaacagggtgcacgacaagcattggatcagagacaccagcgacttctctttcaatggtcagtgctggagactcgcagaatcaaatcacaggaagcaacatcaaatcgaaccagccatcgaacagagcacgagattcacccaacacttatactgcgacagagctgaccgagactcgtcgcaagctaatacagcactcaacccaggacggcactgagagtgttccaggctatctatccgctgttatcaatcacctcgatcgtctcattgcgcaggacagaataaaggagcgcggaaaacgagacaagtctaaggaaaacggcaactctacatacgattctcttcagaggtcttcaatcgatactggtaaccttccgatcatttcggaagaacgcagcaactccttggctgagagtgagatgagaaacggccaagacgtaacaaggcataattcagattccgccagttctatccagaccaaacgccaaagcggtgatggaaaagccacaatcagaatggttccccagagttctcaacagtgcttggaggagattaagccattgaatatccggaagaagagacaagcctcgaacgagtctcctcaaccacgc

SEQ ID NO: 5506 - DNA, 1176 bp, A.fumigatus
ggccgtggtctcattgttaatgtcgatgtgtccaactcctgcttctgggcgcggacctcattcatgggcgccgctatggcgattctcgattgccgggaccaccagcacctgatgcaccttcttaagcctgttgccgacggtcatggtggtgtcactgagtcaactggcttttatgaagttcatcgtcgccttcgcaagctcggggtccagccgcattacaaaggctgtccttgccttggtgttgatttcattgtcaagggcctgctaaatgccaacgcacgccagtacactattgaaatcaaggacaaagccaccgggaagacccaaaagatgagcgtggaggcttacttcaagaggaagtataatctcaccttgaactactgggagcttcctatggttgagatgaccaagaaaggcgtcgtctatcctatggaagtcttgaccatccatggactccaccgctacccatggaagctgaatgagtatcagacctcagctatgatcaagtatgctgcatcccgtcccgcagaccgtcttaattccatccataagtcaaaggctatgcttgaccatgcaaaagacccagttctcaacactttcggccttgcaattgacaacaacatgattcgcaccaaggctcgtctcttgcccagccccgacattcagtttggcggaaaccagcgcctgtctcctggcaccaatggtcgttgggatctccgtggcaagagattctaccagccaaacaagaggcctctggaagcatggggtgtgggcttcttccctggaaagcgcaacgctatcaaccaaacccaggttcagcagttctgtgacttgctcgtgaagacatacgccggtcatggtggtatgatcaaaaacaggccccacatccttgagcttcgtgaggacattggcgaagctattaagcgtctctacaacacgactggtcaacgttttcagaaagatccccagcttcttttgatcattgttccggacaagaactcctttacctacacgcggatcaagaagtcttgcgactgccgctggggtgtgccgtctcaagtcttacagtccggtcactgcgtcaagcttaaccctcagtacgcttctaatgtcctaatgaaggtcaatgcccaacttgggtggcaccaattgttgggctgtacccaaagttactga

SEQ ID NO: 5507 - DNA, 429 bp, A.fumigatus
atcgcgtgtccttccagcccggtggtgaagaccaaacttgaaggcggccttcgccatcttcgtatccagaatgctgacgaggttgccaagtactctgttccggtcgagaccgttgcccgtcccaaccacaatcagactggaaaggagatcgaagttcttatgaacgcttatcccatcaccaaattccctactcgtaacgtctaccagtatgatgtaagtatttcctggtatcgaacgaaggcaatcactggagcagcaccttttaacaagccaaaggttcaaatcggaaacggcgttgagaagaatgctgtcatcaagaaggtttggaattgcaatgcccgcaaggccgccctgaagcagatcgtctttgatggtcagaagcttgcctggtatgtgctaacaccaacctgtcccttgagcaatcactga

SEQ ID NO: 5508 - DNA, 255 bp, A.fumigatus
ctcagatctcgcactaggccgtcgtcctacccaatcgaattatccatatcgctatcgttcaatgagagtgggtacgcccacccaacgaacgacatcctggggtttgttcacaaggtcgcggatgcctcaaagcactctgaactctggatgaagttcagctgggtgttctacaaggccgatgtcaccgcgttagtcgggaagctcgagggccgcgagaaggacctcaaccttgtccttactttcattgcagcgtag

SEQ ID NO: 5509 - DNA, 426 bp, A.fumigatus
ttcatttctgcaaacatgaaaaaacagctttttcacctggctggggatgtgcgacccgtcgtgcttgctgccaaggtcctcaaggttcttcttgaggagagcacgcatctcaatgatacggtcggccatgcccttgacctcgcccagccactgctggttgagctcagggtcattcatgatggtagaggcgatgcgagcaccgtgaacgggagggttggagtagaagggacggatgaggatcttgatctgcgaatcgactcgcttcttctcctcagcggattcgcagacgagagagaaagcaccaacacgttcgccgtagagaccctggtggttcagcatggtcagtccctgaaatgtttccatgaggttgagcagcccgagcttaccatgttcttggcgaaactctggcacagggcaatgttgtga

SEQ ID NO: 5510 - DNA, 492 bp, A.fumigatus
acacttcgtcaaggagggtcacaacattgccctgtgccagagtttcgccaagaacatggtaagctcgggctgctcaacctcatggaaacatttcagggactgaccatgctgaaccaccagggtctctacggcgaacgtgttggtgctttctctctcgtctgcgaatccgctgaggagaagaagcgagtcgattcgcagatcaagatcctcatccgtcccttctactccaaccctcccgttcacggtgctcgcatcgcctctaccatcatgaatgaccctgagctcaaccagcagtggctgggcgaggtcaagggcatggccgaccgtatcattgagatgcgtgctctcctcaagaagaaccttgaggaccttggcagcaagcacgacgggtcgcacatccccagccaggtgaaaaagctgttttttcatgtttgcagaaatgaatcaatgcttatttatgatagattggcatgtttgcctacactggcctga

SEQ ID NO: 5511 - DNA, 699 bp, A.fumigatus
tcggaacgagtaggtgatgacaagggcaagccatatgttctgccctcggttcgtgctgccgaagacaaggtcgttgcgtcgcgtctcgacaaagaatacgctggtatcactggtattccttccttcaccaaggctgctgcggaattggcctatggcagcgactccgccgtcatcaaggaggaccgtcttgtcatcactcagaccatttccggtaccggtgccctgagaatcggaggtgctttcctgcagcgcttctaccctcacgctaagaagatctaccttcccactcccagctgggccaaccatgccgccgttttcaaggactccggattggacgtcgcgtcctaccgttactacaacaaggacactattggccttgacttcgagggcctcatcgctgacatcaaggccgctcccaacaacagcatcatcctattgcacgcctgtgctcacaaccccaccggtgttgatcccacccaggatcagtggcgccagattagcgatgtcatgaaggagaagggccacttcgctttcttcgatatggcctaccagggctttgccagtggtaacgcggaccgtgatgcttttgcccctagacacttcgtcaaggagggtcacaacattgccctgtgccagagtttcgccaagaacatggtaagctcgggctgctcaacctcatggaaacatttcagggactga

SEQ ID NO: 5512 - DNA, 1608 bp, A.fumigatus
  unsure (397),(451): Identity of nucleotide sequences at the above locations are unknown.
tatcaaccacctaatctctgcagcagttgcaaaccatcctgctccgtcatgtcggagtctcaatcacgaccagtttccctgacacggtatcgtcctgctctttacttgctgacgggtgttgccgcagcctacgctctggtatacatccacaataatatccttttcccctcatcgccccaaacacctctccgtcgccgaagagctgtccgccgaagacgaacgggacccgacgaaagcgatgtcagcaatacaccatcgtaccgcgcgattgctcatctcgagcaactagaacggcagaatggcgtgtacggtacctttcgtattgagactgaggacggaccccgcgtggagagcggcctcctcccatcctttttggctacgcgcgatcagctgatgnaggaagtcggcgtcccgcaggctcatgcgaagcggatgcgcgagatgatggagnagacattcctggagtcattccttgctctggatttcccgtcggcacatacaatcgaggaagggagtgcggagaggaactacctcattgagcagctgcagcggcgggggatttcgcgtacaggaatcgagagggcgctggcacggttcaatgaggacgacaactacggcgaggagttgcgacggcggcgccagaatggagagagggttacgctgtctacatctacatttccagaggagtcggtgcccttgcagaacttggatggtggggagacagtggtcgacgatcagagcgtcttctcctggagggaaggcaataatgagtcgtctccggcgccggaaggccaaaatctcctgaacctgctatatcacattgcggaggaccagtctagacgagatggctatatccaccgacaggtgacatgtaatagctgtggtgctatgcccattcaaggcatacggtatcggtgcgcaaattgcattgactatgacctgtgcgagacatgtgaggcgatgcaagtgcacatcaaaacccatctcttctacaaggttcggatcccggcgcccttcctaggaaatcccagacagtcgcagccagtgtggtacccgggaaagccagccatgatgcctcgtagtctgccacgtgcgctggcgaagcgtttgatgatggagaccaatttcgagaacaccgaattggacgctctctgggaccagttccggtgcttagcgagctatgagtggccagacgacccgaacaagttgtgcatggctatcgatcgcaaaacgtttgatcgatgttttgtgccgcatacttccatccgccctccgcccccatgcctcatctacgaccgcatgtttgcgttctatgacacaaacaatgatggattaattgggtttgaagaattcctgaagggtttggccagcttaaacaacaagagcaatgacgaaaggttgcggcgagtgttccgtggctacgaccttgatggagatggctacgtggagcgcaaggatttcttgcgggttttccgtgcatactacgctctcagcagggagctaactcgcgatatgattgctggcatggaagatgactttctcgagggaggcgcaagagatgtcgtgcttgtcttcaccacggggctggaaggagccgcgcaacgacga

SEQ ID NO: 5513 - DNA, 354 bp, A.fumigatus
gctccttacaaaacatggcagcggatctacgactacgacttcacgacaaatctgacggatgctcaagccaagcatatcatcggtgcgaccgcgcctctctggagcgagcaggtggatgatgtaactgtgtcgagcaagttctggccccgcgccgcagccctggccgagctggtctggtctggcaaccgcgatgccaatggaaagaagcggactacgctcatgacgcagcgtatcctcaacttccgagagtacttgctcgcgaacggcatccaggccggcaacctggtgccgaagtactgtcttcagcacccgcacgcgtgcgatctatactatgaccaaagtgccgtcgcgtag

SEQ ID NO: 5514 - DNA, 189 bp, A.fumigatus
tatgcggggcatagacaggctcttgctcaatggtcttccaggctatgtaaacaggttggtgctggagctacactgtctactctaaaactacctaaaatcattatcaagatgctcaaaacctgcttagagaatagtatggaagcccaacaggatcttcatgagagctgtcagttaatctctactttctga

SEQ ID NO: 5515 - DNA, 348 bp, A.fumigatus
gatttcactggcggccgcatgtgcgccgttcaaggcctcgagggtgccgccgggtccgctggtgaagccggtgcctctcccgccgccggcggccatggcggctgcattgaagacggcggcggcgttacgaccatcgaggatttggtggagtcgctcgacggtcgcctcgaggaggccgtctacctggtaggggcgggcaagttgaaggagggagcaaagaatttggggcgtgcaaagggaagatccgacgggtgggagcgacgaggtgtacaggtagtagacgaggactcggatagtgagaaatgtgtgggggaggtacaaaacacgcggtcgagaggtagggggtaa

SEQ ID NO: 5516 - DNA, 1227 bp, A.fumigatus
aatattccaaagccaaacttcctgggatgtcaagggtggagctccaggtgcggtttcccggatggtcgcttgattgagaagccaatgcacagtgcagcgtcgccgccgggcttgagattccccaacggcggtgtgatcaacgggcatttcgttgtgagcggcacctacttgacctcgtccaaacaggagtatgcgctctgggcgctcgatctgaagactctcacatggggtcggatcgatgccggagggtctgtattcggtcatggcagctggaaccgcggagtgctatgggcaagacggaatacctttgtggttctgggacaccgaaagcgtagtctggtcgaggattacaaccatcgtcgaatcaacttctctcacgtctgcatggtcgagttggaggccttcgggttgtacaacaatccatgtagaaccgcgccaacttccgggtacatctcgcacagtgcaccttcagttcctgcgtctctacaacacaagttgactcagttgacgtcgggtggaaggccgttctcacccgcgtctgacgaactgggcaaacttgcccagtctcttcctgaaatagcggacatggagcttcaggccgctggtggagaacggatccccgtcaactcgcggattctttcccggcgatggggcccttatttcatccagctccttcgcgagtcatccgacactggtgtttccgatacggcgaccctgcgtggagcgatcccgatgtaccccagtcgaaactcaagcatcaccattaccccctcgataggacaaaatagttcctactccagtgccagcacccttgtcagcaaccactcgaacccttccaagtctttgttatcgaatcttgagataccatttgctcataccttaccccctacctctcgaccgcgtgttttgtacctcccccacacatttctcactatccgagtcctcgtctactacctgtacacctcgtcgctcccacccgtcggatcttccctttgcacgccccaaattctttgctccctccttcaacttgcccgcccctaccaggtagacggcctcctcgaggcgaccgtcgagcgactccaccaaatcctcgatggtcgtaacgccgccgccgtcttcaatgcagccgccatggccgccggcggcgggagaggcaccggcttcaccagcggacccggcggcaccctcgaggccttgaacggcgcacatgcggccgccagtgaaatc

SEQ ID NO: 5517 - DNA, 204 bp, A.fumigatus
ggcagcaacaggccatacgtatccagttttcgatacagtccatgccacaattgtccaagtggagaatatgcccatgcagtgtctcactttacagattacacattcatgctatggacgggccacatgaaacgagatgctgcttggtccttgaaaatctatattgctccccagttgattgcttatccacttctcttgctagactga

SEQ ID NO: 5518 - DNA, 621 bp, A.fumigatus
cttcctgcttttcttccctcgtacccttctctccctactgtcaagactcatatttttgaaatattttcctatttgttccattctctatatactcagccagaatgcctcgccaattcttcgtcggtggtaacttcaagatgtatgagctctgactcgatgccccgcaatccccctcgcagcttcaccatcccagcctgcaactgcacagctactgacattgtcgacgcaatgataggaacggtgtcactgacaccatcatctccatcgttaagaacctcaacgaaggccagctcgacccctccgtcgaggtcgtcatctccccctccgctctctacctcctcctcgcccgccaagctgccgaccccaagattggcgttgctgcccagaatgtcttcgacaagcccaacggtgctttcaccggtgaaattagcgttgagcagctcaaggatgctaagattgactgggtcattatcggacacagcgagcgtcgtgtcatccttaaggagactgacgaggtacgttacctcccgggatctgctttgccagattgagaatgtaaggctgacatgcctgtttagttcattgctcgcaagaccaaggctgccattgatggtggcctga

SEQ ID NO: 5519 - DNA, 222 bp, A.fumigatus
  unsure (56),(57),(67),(181),(218): Identity of nucleotide sequences at the above locations are unknown.
caacacaatgcagggccatcggcaccggcaaggtcgctaccaccgagcaggcccanngaggtccacnccgctatccgcaagtggctcagcgacgacgtctccgctgaggcctctgaaaacgtccgcatcatctacggtggctccgtccgcgaaaaaaactggcgcgaactccgcaaaccancccgatgtggacggttttcctggttggccgtggcccncttg

SEQ ID NO: 5520 - DNA, 336 bp, A.fumigatus
cattgtcgacgcaatgataggaacggtgtcactgacaccatcatctccatcgttaagaacctcaacgaaggccagctcgacccctccgtcgaggtcgtcatctccccctccgctctctacctcctcctcgcccgccaagctgccgaccccaagattggcgttgctgcccagaatgtcttcgacaagcccaacggtgctttcaccggtgaaattagcgttgagcagctcaaggatgctaagattgactgggtcattatcggacacagcgagcgtcgtgtcatccttaaggagactgacgaggtacgttacctcccgggatctgctttgccagattga

SEQ ID NO: 5521 - DNA, 711 bp, A.fumigatus
tgtgagtggtacgttgggatagaaaatgaggatcttgctcactgggggagtgtgagcttacctggcggcgttttcccaagcacccaatgccagaccggtcatctgagcggcaataccgatacgaccttcgttcagcaagccaatagcgtacttatagccctggccctcctctccgagcagattacccttgggaatgaccacatcatcgaagttgagcacgcaggtgctgctagcccggatacccagcttcttctccttcttggcaatggagaatcccggggtatccttctcgaccacaaaggctgtgattcccttgtagcccttgctgggatccaggttcgcaaagacgatgaacaccccagcctccatggagttggtaatccacatcttggatccattcagcttgtacccatccgccgtcttttccgccttggtctgcagggcgaacgcatcggatccggacgccggctcagagagacaaaacgaaccgacggtgtccgtagcgagcttaggcaaccacgtcttcttgagcgcggcgtcggcccacttgttgaaggccgtattgacgagcgtgttgtgcacatccaccaggacactaacgctggggtcgacgcgggccagttcctcgatggcaacaatagcggaggtgaagttcataccggctccgccgtattcctcggggatctcgatacccatcaacccttggtcttc

SEQ ID NO: 5522 - DNA, 654 bp, A.fumigatus
gaagaccaagggttgatgggtatcgagatccccgaggaatacggcggagccggtatgaacttcacctccgctattgttgccatcgaggaactggcccgcgtcgaccccagcgttagtgtcctggtggatgtgcacaacacgctcgtcaatacggccttcaacaagtgggccgacgccgcgctcaagaagacgtggttgcctaagctcgctacggacaccgtcggttcgttttgtctctctgagccggcgtccggatccgatgcgttcgccctgcagaccaaggcggaaaagacggcggatgggtacaagctgaatggatccaagatgtggattaccaactccatggaggctggggtgttcatcgtctttgcgaacctggatcccagcaagggctacaagggaatcacagcctttgtggtcgagaaggataccccgggattctccattgccaagaaggagaagaagctgggtatccgggctagcagcacctgcgtgctcaacttcgatgatgtggtcattcccaagggtaatctgctcggagaggagggccagggctataagtacgctattggcttgctgaacgaaggtcgtatcggtattgccgctcagatgaccggtctggcattgggtgcttgggaaaacgccgccaggtaa

SEQ ID NO: 5523 - DNA, 528 bp, A.fumigatus
gtacgctattggcttgctgaacgaaggtcgtatcggtattgccgctcagatgaccggtctggcattgggtgcttgggaaaacgccgccaggtaagctcacactcccccagtgagcaagatcctcattttctatcccaacgtaccactcacatcaatggcagttacgtctggaacgaccgtcgtcaattcgggcagcttatcggaactttccagggtatgcagcaccagctcgcccaggcctacgtcgaaatcgctgccgcacgggctctcgtctacaatgccgcacgcaagaaggaagctggtcaagactttgtccaggacgccgccatggccaagttgtacgcctcgcaggttgcaggccgtgtggccagctccgccgtcgaatggatgggcggcatgggctttgtccgtgaaggcatcgccgagaaaatgttccgtgacagcaagattggtgccatctacgaaggcacaagtaacattcagctgcagacaattgctaagctcctgcaaaagcagtacactaaatag

SEQ ID NO: 5524 - DNA, 276 bp, A.fumigatus
cttacacttatagcaggcacagttaccgacgagtctctccaggacgctgtaccaaccgactaccatggtatcagcttcgacgagtggctggacttattcctgcaatacgcccttgtcgtctcagggcaaggggagcctgacgaagcgtacgatagtcttgcagctgctgcagatgccagtatttggtatcactcgaaaccttgcactcgacttatccacgtctgctggtttagtaagttgccccttgcacctttgtctcgctcgatggtatactaa

SEQ ID NO: 5525 - DNA, 555 bp, A.fumigatus
aattcatgctgcggcagatcaaggccatggacttttccattccggatggccccaatgactccagacccagcaaagcagtccgcgagtcaatctacagagagcgcgcgacgctcaccacccgcgacgagtcaggcgaagccattcccgctgatcaattggacgtcgccctgcttgtgctatatggccacatcctatattccggcaacagtttctacccagctctcaactactttttccgtgcatacgatctcgacgaccagaaccctgctgtcctactctccattgccctctgctacatccaccactcgctcaaacgccagtccgacaaccgtcactacctcatcatgcagggcctctcattcatgcacgaataccgtcgcgttcgcgagcgaaagggaagcctcctccaggaacggcaggagatggagtttaactttgctcgcgtatggcatctactcggcctcgcgcatctcgctatcgaaggataccagcgtgtcctggcgcttggggagcagatccagaccgaatctcagaataagatccctcagccgttga

SEQ ID NO: 5526 - DNA, 738 bp, A.fumigatus
ccttcgcccccctgtggtagaagacattatacgccgatccagcagactactgagtatgccgacatcagctatttcatggccatgggagactgctttatgcagttgggcaacattgaagaagctgagaattgctaccttacggtggcagactatgatacaagaaacatagaatcgcgtgcacagctcgcaaagctgtacgagagcatcggaatgactgaacaagcgctgaagtacgtcaacgaagccgtgctgcttgggcgacaggagaccagaactcatcgccgaagaaaggatactcggttggaacaactcgcgctcgagttcagaaccgagaccgatccggaactaccaggtctgagaattgctgtaccgcctgaacgtgctgaaggactggctccgacgcttaccactacttctgtaaacgctacgaggagaaaggtccaagaagcggaggaggaaaggacagaacttgtccagtttttgtatgggaagctgttagatattcacccaagggtcaaagagggcaatgccgaagcgattgaggactggctcgatatcgcggatgctttgctacgtgagtttcgctccaataaggtgttttatcctttccaacgcaacatcgtgttcctcggttattcaagggaagcacaaaggaaggcgggaaagtacaaaaatcgtactctcatggatgagatgcaggaaatggcgagtcgtctccaggagtctttaggtatgtaa

SEQ ID NO: 5527 - DNA, 804 bp, A.fumigatus
gttgccccttgcacctttgtctcgctcgatggtatactaacccgcacagcatgtgccctgaaggcgcaagacgaggagactcttgcaaatgaagcacgctggttcatcaaagagtatcaattcgtcacagacacatatcgcttattctccatgctgagccggctctgcggcgaccctcaccggtctctcttccattcctcaccaaacatgaaattcatgctgcggcagatcaaggccatggacttttccattccggatggccccaatgactccagacccagcaaagcagtccgcgagtcaatctacagagagcgcgcgacgctcaccacccgcgacgagtcaggcgaagccattcccgctgatcaattggacgtcgccctgcttgtgctatatggccacatcctatattccggcaacagtttctacccagctctcaactactttttccgtgcatacgatctcgacgaccagaaccctgctgtcctactctccattgccctctgctacatccaccactcgctcaaacgccagtccgacaaccgtcactacctcatcatgcagggcctctcattcatgcacgaataccgtcgcgttcgcgagcgaaagggaagcctcctccaggaacggcaggagatggagtttaactttgctcgcgtatggcatctactcggcctcgcgcatctcgctatcgaaggataccagcgtgtcctggcgcttggggagcagatccagaccgaatctcagaataagatccctcagccgttgaccacgaacgcggatccagcagacagtagcgacggtctt

SEQ ID NO: 5528 - DNA, 264 bp, A.fumigatus
  unsure (67): Identity of nucleotide sequences at the above locations are unknown.
aaatcattcaatgagtatagcaagtctctaactgggttcatagcgtctattcagaagatcctcaatntgaaccacgagccccagtcgacgaataattcccctcacgatatatcagctcaaggtctcatctccacgcctattctcaatgaagacggcgatcccatttggaaggtcttagtgtttgacaacatgggccgggatgtcatcagtagtgtacttcgtgtaaacgaccttcgagcttggggtgtcactattcatctgtag

SEQ ID NO: 5529 - DNA, 528 bp, A.fumigatus
tgtacttcgtgtaaacgaccttcgagcttggggtgtcactattcatctgtagggtcctcgtggtgcaaggagcatagaattgcagctaaccatttgtcgtcaaggaatctcaactttaccagatatcccatccctgatgtccctgttgtatacctcgtcgaaccgactcctgcaaacatccaagcaattacaaatgatctgtcccgtggactttactctcctgcctacgtgaactttctctcatcgatacctcggccacttcttgaagacttcgcgtctcaaatcgcttccaccggtaccgcggagcatgttgctcaagtttatgaccagtacttgaattttatcgtagccgaaccagatctcttcagcttgggactaggcaacgacgcatattggaagattaacagcgccaaaacgagtgatgaagagttggacggcattgttgacaagattgttagcgggctgttcagtgtcagtgtcactatgggtatgtttcaaacctctccacgctcgagaatcagccgttga

SEQ ID NO: 5530 - DNA, 1491 bp, A.fumigatus
acaggtgcgattccaatcattcgttgtccgaaaggcggagcggcagaactgatcgccacaaagctcgaccgtaaactacgtgatcatattctgaattcgaaagacaacctgttctccggcaacaagaaaaccgccgctggagtaccttcttcacgacccgtcttgattatcgtcaaccgtaatgtggatttggtacccatgctgtcacattcatggacataccaatcattagtacaagacgtgcttcaaatgcggctcaaccggataaccgtcgaaactccgattgacgagacaaaccctgctaagggcgtgacaaagaaagtatacgatttaaacagcaatgatttcttctggaagcgtaacgctggagcaccgtttcctcaggtggcggaagatatcgatgctgaattgacacgttataaagaagacgcaaatgaaatcacgaagaagaccggggcttcttctattgaggacttgcagaatgacaccagcgcttccgcgcagcacctcaaagctgcgattaccctgcttcctgagttgcgggaacgcaaagccattctggatatgcacatgaatatagcaactgcactgctgaaggggatcaaagaccgtcagctggataatttcttcgagctcgaggaaaacattacgaaacagtcaaaaacccagatcatggaattgattaatgaccctgcaaaaggcagcaacccgaccgacaagctccggttgttccttatttggttcctaagcacagaatcagacctatcccgcgcagacttgagccaatttgaagaggctctcaggcgcgcaggagttgaggatatcagcccactgacctacgtgcgccaggttcgagagctcacccgaatgaccatgatgacgactgccgcaccgcagcagcagtcctcggatttgttccgtggattctcatcgctttccaaccgcctcactgaccgcataacttccggagcattaggtgctaatttcgattcgctcatttccggcgttaagaatttcctgcccgccaacaaagacctcacgctgaccaagatcactgagtccatcatggatccgtcatcagcctccagttctgcaattgcaaaaacagagaattatctctattttgacccgaggagcgcaaacgcccgtggagctatacccccggcatctgcggctcgcaatccacaagccccaggagcccttggaggagtggagcgagggaccagcgcgacttttggccaacgtcgccaggcattcaacgaagcgatcgtattcaccgtcggcggaggtagcatggacgaatatggcaatttgcaggactgggtgcgccaaactagcggacagccgggcgacggttcaggggccggcattcgtgcaggagtaggagctatgggtggagctagacgaagagtcgtctatggcagtaccgaattgatgaatgctaatgaattcctaacggaatcgttgtccaaacttgggcgggaaagttga

SEQ ID NO: 5531 - DNA, 183 bp, A.fumigatus
aaccaacccgacaagagtctcgcgcctacttcgagtgtctttctagtagaattctccaacgccgaactcgaggacctgtctccgtcgactaagtcttcgtatgttttgggctggtctgcaaagagctgcttgaccgagaggtggggttgccggcgaataatctcagtgtttgcccgacggtga

SEQ ID NO: 5532 - DNA, 1542 bp, A.fumigatus
ccagtggccagtcaaaacttgacttccccaatgctccagaactgtgatcactcatcgatgccaggctcgactgctgtcgccactgacaacctcgaacctacctcaattccaacttcttctgttgctcaggataaccgccgccagcccgacaaagatataccgccctcccacgacaacgcggtggacactctgccaaacctgtcatcacagatcaccgatacattaaccccactgccggagagaaaccgtcttacctctgcacatacgccttctcaccgtcgggcaaacactgagattattcgccggcaaccccacctctcggtcaagcagctctttgcagaccagcccaaaacatacgaagacttagtcgacggagacaggtcctcgagttcggcgttggagaattctactagaaagacactcgaagtaggcgcgagactcttgtcgggttggtttcagggcaagtcggagccggtgaatttgaccatggtgccccagtcggcgcaccaggatgccctgggattggcaccctctggagcatttttgaatcgtgcatcaaagcgggcctcttcgccactcaaacaagttacatcgacgaatccgttcaacttctttgcattcaagcgccagggagagggccgaccgcagctccccgaacccgcagatgatgagattcttaatatggacataactgctgccttgttcccaccagagtcactggacctcgacggacaagaagcgttcagtgccttacgaaccaacgccgataacctccttagacggctgcaggcagcctacaaggaaaggacttttgccctgcacgaagccctggcggacaagaacgaaaagcaggaagaactggaggagactcgaacacgggttggacacctgaaggtccagctcgatggtatggcggagaaagtcctccagcaggagaaggccatgaaggcaatggctgaggagctcgagcaggaaagacaactgcgccggcgagaagacgacgcgcgtcgtcgcagcgtgatgctggttcggtcgagcgatgaagagagcctttccgacgtcggggctgaattgcagacaccaaaacgcagtttgaagcgagccagcaatggcacttatacgagcgattcaggcttcgactctggcgacgaaagtctcgcagaaagtatcttctctcgccgggatggcctcgaatccccgacgtcaacgatcccaccgtcgccgaacatatctcaaattgctctatctgtccctacgtcgacccctatacagccgagcgcaaaagagttgaaaccggctcaggcgccaccggtgcgtcagtctacgtacgatcgcgtgctgaagggacttgcctctacgggtatcactagttcgtggatgggtcacacgtccacgtctaaatgtaatatctgccatgggattcccgcctccgaggcatggggcgtcctcggcgtcattaaggaggagaataggggcttaaagctacggctgagcgagctcgaactggttgttgatgattgtctgagtcttgttggatcttga

SEQ ID NO: 5533 - DNA, 300 bp, A.fumigatus
attgcagacaccaaaacgcagtttgaagcgagccagcaatggcacttatacgagcgattcaggcttcgactctggcgacgaaagtctcgcagaaagtatcttctctcgccgggatggcctcgaatccccgacgtcaacgatcccaccgtcgccgaacatatctcaaattgctctatctgtccctacgtcgacccctatacagccgagcgcaaaagagttgaaaccggctcaggcgccaccggtgcgtcagtctacgtacgatcgcgtgctgaagggacttgcctctacgggtatcactag

SEQ ID NO: 5534 - DNA, 198 bp, A.fumigatus
gctctctatagcttatacagggcgctatgtctctggcagagagatattttaaaagcacttaaagagataggtttgcagagaattaacactgacttatatctttatatagataataagactatcatcctagtgtttgtggataacatactattcctttactattataaaagcaagaagtatgctgataatctgatttag

SEQ ID NO: 5535 - DNA, 1002 bp, A.fumigatus
gcgcggtatcttccgcattgcgcggatccttcgagccccgtgggtgaagatatcgacccggctgccctaaacatgtcaacaaagcgaaagcgcggctgcgatgaagaagaccacgatcccagcaaatgttctccccagccattgaagacctcgcgtatggctgtgaccgtcgtgacatcgaatatggcttcccccatgccttcctctaccttgaaggcacctctccagaaacctaaatccacgccagctctgaagcctgctggccgttcgcctcggggcaaatcctgcaaagcattcgctcgccgctctgccattggcaagagccggccagaacctacgggcagaaagagcatatcccggcctttctccatcgcgacagtactgggcaatgcgcagcccaagagtcaaaccgctcccaagactccagcgtcctggtcttttgagatccacgtggactcggagcaggaagaaatgaccaacatgatgcagcactccacctgcgtgctggatatcagcgatgacgagggcaaggcagaattctcaagtcgcggcaaggagaacattcccccgtctgagttggaaattgacctgtctcggacacgagagcgagagacttctgtcttaagaaaaactgagatggcggatgagcctcgctctccgctcggtgaactcaatgccgcagactattatggcgaagattgccatgccttttcatatgccgtgatttacgacgaggatgagaccgcctcggaaataaagacccccctgcctcccctgccacgcaaccctacgcatcccagtcggacaaagttgtcaagtgtatcatccatatcctcgatccttgcagctactcaacctgtcaaggctaccgcgtctactaaatctgaggcagaaattgaaatttgggagagcgagagcactgcagatgattcagagaaagcgatagagagcaaccccagcgatgagctctcctcatcaacggccaaatcaattaatgtttga

SEQ ID NO: 5536 - DNA, 447 bp, A.fumigatus
  unsure (244),(414): Identity of nucleotide sequences at the above locations are unknown.
gcctccagcctctccgcctgctccagcgcctcctcctcgccttcgccctcgctctcctcttcttcgcctacgtcttcgctccactgcacgcgtttcccgcgcgcaacatcagcagcaacccctcccgccgagggagtagcattcgaacgcacactcgcacccgctgcatcaagttgccccttccaggacgccttgatcgacgcccggatatcagtcgccagctgcatctcccgcgaggacgtcncctcggggtcgagcgtgaagtcggccagcgagccatccggcgcaacatggtccgggaagcggagaacgcgggcaaactctcgctcgtcggcgacgcggccgtcgagcatgctctgcactttggcgcgcatgaacgtcctggctttgccgaatgtgccgctgccgaaacancccgtcgacggcgaattcgcaggtgttctctga

SEQ ID NO: 5537 - DNA, 633 bp, A.fumigatus
  unsure (13),(23),(87),(257): Identity of nucleotide sequences at the above locations are unknown.
ccggttcctgggnttccatcttnttccccggatccgccaacccccagggttcttcagagaacacctgcgaattcgccgtcgacgggntgtttcggcagcggcacattcggcaaagccaggacgttcatgcgcgccaaagtgcagagcatgctcgacggccgcgtcgccgacgagcgagagtttgcccgcgttctccgcttcccggaccatgttgcgccggatggctcgctggccgacttcacgctcgaccccgaggngacgtcctcgcgggagatgcagctggcgactgatatccgggcgtcgatcaaggcgtcctggaaggggcaacttgatgcagcgggtgcgagtgtgcgttcgaatgctactccctcggcgggaggggttgctgctgatgttgcgcgcgggaaacgcgtgcagtggagcgaagacgtaggcgaagaagaggagagcgagggcgaaggcgaggaggaggcgctggagcaggcggagaggctggaggctcaggtggcggctgcggcggaagcggtggaggctgctgctatggcggcggacgaggatgaggcgaatgatctggaccaggaagagtcggatgtgggggatgatatggatgtagacgaaccggcaaagccatga

SEQ ID NO: 5538 - DNA, 1014 bp, A.fumigatus
atgcgaatcgaatggccccttccagccccgcgtgaagacactatcattggtgctaaagatggcctgggtgttgagtgtctgaagggctctggcctcatcgccggagctacctcgcgcgcttacgaggacatcttcaccatcaccctggtcacctgccgctccgttggtattggtgcctaccttgtccgcctgggccagagagccatccaagtagaaggccagccgattattctgactggtgccccggccatcaacaagctgttgggtcgcgaggtttacacatctaaccttcagctcggtggtactcagatcatgtacaagaacggtgtctctcacatgactgccaccgatgactttgagggtgtccagaagattgttgagtggatgtccttcgttcccgacaagaagggtgcacccattcccatcctgccctggtccgatgactgggaccgcgatgtcgcctactaccctccttctaagcaggcttacgatgtccgctggctcatcgctggtaaaaaggatgaggaaggcttcctccctggtctgttcgatgccggatcctttgaggaggctcttggtggatgggctcgtaccgttgtcgttggtcgtgctcgccttggtggcatccctatgggtgtaattgctgtcgagactcgttcggttgagaacgttacccctgccgaccctgccaaccctgactccatggaggtgatcagccaggaagccggtggtgtgtggtacccaaactcggccttcaagaccgctcaggccctccgcgacttcaataatggcgagcagctgcccgtcatgattctggccaactggagaggcttctccggtggccagcgtgacatgtacaacgaggttctcaagtacggttcctacatcgtcgatgctctggtcaagtacgagcagcccatcttcgtttatatcccacctttcggtgaacttcgtggtggttcatgggtaagtcatttattattcttatgtcatgttcaagttttcaaatactaa

SEQ ID NO: 5539 - DNA, 354 bp, A.fumigatus
gtcgtcattgatcccacgatcaaccctgaccagatggagatgtacgctgatgaggaggctcgcggtggtgtcctcgaaccagaaggtatcgtgaacatcaagtaccgccgtgagaagcagctcgacactatggctcgtctcgacgccacgtacggcgagctccgtcgtgctcttgaggacccatccctcagcaaggagcagctctcagagatcaaggccaagatggccgctcgcgaagagcagctccttcctgtctacctgcagatcgctctgcaatttgctgatcttcacgaccgcgctggccgcctggtgcccaaggctaccagtttgcaaagcgccgcagagatcaacgtc

SEQ ID NO: 5540 - DNA, 192 bp, A.fumigatus
gctatgtcgaccactccaaggccaaagcagctggatatctccgtgacaggcgaatttgaaacttggttttcagataaggatcaactattttatcagttccaacaaagctattctactttcaacgggagcactgattaccataacacacccgactttacttgctatcggttatggatcaatcctggcctctga

SEQ ID NO: 5541 - DNA, 621 bp, A.fumigatus
gatgcattgcccgagggcaaaatggaggatgcggtcatgcacctcaagatgctcgtcagttcgaaggtcttggggaaagatacgctagatacaaccgacagtatcgcagtggatggaagcaaggagctgacctgcgacatattcgatcagcttcgtcccactgaatggctagatgagtggactctctacttggctatgaagatttcggacagaccaccatatgttcgttttgacaccagcatcttattggagtaccaaccggacaaaatcaagaaaaacagaaagatcgaaaaggttaccaatgagtcatcggactgcgaactggtagaagtcagaaaaacaaccccgctggcggaatgggccaagaagattgcggaggaccagcaaagcgtccaagaaaaattggtatacttccgccctattaactatagaaaccactttaccctactcgaaattaacacgcgagagggagtgatacgccattatgattccctggcggtcggtggtatcaagaagacggtgatatcaaggttggtcaagaaagaattcggtagctttggatttcgctacgaggaggccgtaagtattcggaaaacgtcggtttcagttgcaacgaactga

SEQ ID NO: 5542 - DNA, 225 bp, A.fumigatus
tatcctaatcgcggatccgtccagccccgtggtgaagacctccttcaggagctaacaaacctgaggaggtcatccgacattgactgcaccatcacccgtgttcgatttaaccccaaatttgggaccaactcgttcacagccgttgtcgacggggtggtgcagtcaaaaagaacaaaaaggggttttatccattttgaaagtgaagccaatggttcgctacgctaa

SEQ ID NO: 5543 - DNA, 612 bp, A.fumigatus
  unsure (607): Identity of nucleotide sequences at the above locations are unknown.
tcaattgatcacccaaatccaatcagcatggctctcccacaactcctctcccccaaacccttcctcacagaatgcggcatggaaacatccctcgtctacaaagacaaagtccacctcccatgcttctcctccctgcctctagtcgactccgactccagccgcaaactcatctcccattactacgactcatacatctccatcgctgccgccaacggcactggtatcgtcttagacacccgcacctggcgcggagctacaccctgggcgcaacccatgggtctctccgccgataagctcctcgagcttaatcgtgctgcggtacgactagccaaggaagccaggaatagagccgtgggtggggagaacaatatccccgtggtgattagcgggacgatgggtcctctgcgggacgcgtacgtggatacgagtgagttgatcacgctggaggatgcgcgggagggatacagggagcaggtggaggtgcttgcggatgcgggggtggacatgttggcgatcatgactgtgacgaatctaaacgaggcgattgcggtggtggagttggcgaaagaggtgcggttgccggttgtggtgtcgtttagtattgaancttga

SEQ ID NO: 5544 - DNA, 240 bp, A.fumigatus
cagatcagccggctcataatatatgaggggtacagagaggtgtatcttacactcatgtctccaggtactggttacgttgagtacctggagaggacagagccggccaccactgccaaccctgaggaatttgtgtacatggacacgtttggaccctggcatattgacaaccaagtccagctccgcagcctatgcctggcactgcttgcatttttatcagccgcagaggaggtggcgagctaa

SEQ ID NO: 5545 - DNA, 468 bp, A.fumigatus
  unsure (41): Identity of nucleotide sequences at the above locations are unknown.
ccctccccaaatccttcccaacaaagcaacggccatcaagnttcaatactaaacgacaccacaaccggcaaccgcacctctttcgccaactccaccaccgcaatcgcctcgtttagattcgtcacagtcatgatcgccaacatgtccacccccgcatccgcaagcacctccacctgctccctgtatccctcccgcgcatcctccagcgtgatcaactcactcgtatccacgtacgcgtcccgcagaggacccatcgtcccgctaatcaccacggggatattgttctccccacccacggctctattcctggcttccttggctagtcgtaccgcagcacgattaagctcgaggagcttatcggcggagagacccatgggttgcgcccagggtgtagctccgcgccaggtgcgggtgtctaagacgataccagtgccgttggcggcagcgatggagatgtatgagtcgtag

SEQ ID NO: 5546 - DNA, 303 bp, A.fumigatus
gtgcggttatacatgaccgcggatccgtccagtcccgatggtgaagacagcggtcctcttttctcgccggtatctcgagcgtcttggggtgaagaactatcttcttggggtaagcaactgacagaccgttgtgtatacgttattgactttactgcacagatgaagaatctgatcgacaacggcattgttgaatgctattcgccgcttgttgacgtgaagggttcctacacggcccagttcgagcatacgattctcctccacagcggtgggaaagaattcatcagtcgtggcgatgactactaa

SEQ ID NO: 5547 - DNA, 555 bp, A.fumigatus
  unsure (5),(6),(13): Identity of nucleotide sequences at the above locations are unknown.
tggannactgaancccgcgtcgtatccttccagccccgtggtgaagaccgcaccgcgcaccaagacctcggccagccggccgtcgtcgaggagcgccgctacgaccgcaccggccaggagcagctgatgctggcgtcggggacggagacgctcccggggggcgtccggcgcattaccgacctggacgacgagacgggggcgaccacctacgacgcggggacgcagtatgggattccgaccggctcagcaaatgagcgcgaggagagcagccacggcgatgagtggtggagttcgtcggtggggagatcgtcgtacgatatcgggcccccattacctggtgctaggacttacaatgcgtacacaggggcgtatgaggagcagcgtgccgattacgatgccgatggggtgccgcgataccgggaccgaggccggggacgtgggcagggccagagcgggtattcggcggagcagagggcgagtcgggagtttgagaccgatcaggggacgaggttgaagagggagacggatgtggatatgtcggatgtgctgatgtag

SEQ ID NO: 5548 - DNA, 951 bp, A.fumigatus
tgtctttgccatcctgtctgtcgagttcccgctgacgatcagtcgataggaatcatgcggccgggaacctacgttctcctgataacctcccccttcaacgccctcttgaactatctcttctgctacaccttcaagatgggcctgctaggcgcccccttagcaacagggatatcctactggctctcctttgccctcctcgtcctgtacgcacggttcatcgccggctcagaatgctggggcggctggtcgcgcgaagccttcaacaacctcggcacattcgcccgtctcgccttcctgggcgtcatccacgtcggcacggagtggtgggcgtttgagatcgtcgccctcgccgccggccgcttggggaccatcccgctagccgcgcaaagcgtgatcatgaccgccgaccaggtcctcaataccatcccgtttggggtgggcgtagccgcatcggcgcgtgtcggcaatcttctcggggccagggatgcgggtggtgctgctcgtgctgcgaatacggcggcgtggctgagtatggtacttggcggggtggtgttggctgtacttatgggaacgcgggacgactttgcgcggatcttcaacgatgacgaaggggtcgtgcggctgacggccgaggtgttgccgtatgttgctctgttccagattgcggatgggctgaatgggagctgtggagggagtctgcgcgggatgggccggcagcatgtgggtgccatggtgaacctggtcagctattactgtggcgcgctgcctctgggaatctggcttgcgtttcatgggtggggtctgaaggggctatgggtggggcagtgcattgcgctttatattgtgggagcgttggagtggttgatcgtggcttttagcaattgggagatggaggtggaaaaggcctttcggcggatggatgtgcatgagcgtctcgagacggggttgtag

SEQ ID NO: 5549 - DNA, 426 bp, A.fumigatus
ggggtgggccacacgctttgcgttgatttttcgtcccttctggtcaataccttctccctcatgtttgcgatgatcacggcgtggatgattgcgctgggaggcacaaccgccctggatacgctggcctcgtcttcgttcacagggagctcgaacaatcatgacctgggaatcctgctgcagcggggcttctttgtccttggtcttttctatatccccgtggctattctgtgggcttgttctgagcatgtgtttgttttcttaggccaggatcaggttctctcccgagagagtgcccgatttctcacgtgtctgattcccggaggtctgggatacatctatttcgaggtcatgaataagtatctccaggctcaaggtaatgtctttgccatcctgtctgtcgagttcccgctgacgatcagtcgatag

SEQ ID NO: 5550 - DNA, 243 bp, A.fumigatus
ccgaggccctttaacagacgcaaggtggggaaaggggacacaagaacaatgggcacgacgaacaatgcaaccattttcttcacagtgattcttatgctatgtatgcttgacaagatcttggatgaggtcactgcgcatgggattctggtcactcgtgtttcgtttggctcttgcctcactgttcctgtaccacctgtagccaccatgctgtgccatcggacatatgcgaaggacgaatcatga

SEQ ID NO: 5551 - DNA, 231 bp, A.fumigatus
actaacagtaatcaggaattcctccgtcgtccaacatcacctgccgactggtggccggaacctagcaccaacgttcttggaggcagagatctggctcgagccacacatgggacatggatgggggtcacaaaggaagggaaaatagctgtgctgaccaactatcgggagaatacagcggatgagcctagtggggtacacagtcgaggcctgattgtcaacagctggcttaca

SEQ ID NO: 5552 - DNA, 246 bp, A.fumigatus
cctcaagctgccaacccaactcctatggctctctgcccatgctttgagattgtgatcaatctgaacattgagtggcgaaacttcgagtctttttgcttctcttggccaggtatcgcttattgcgtagcagtggattacccctcacgagtgttggtccttcctacttcgtattcttgtgcccaacaacaactacacttggcgttgacgcttcatagctccccgtcataccacccatcagctggctaa

SEQ ID NO: 5553 - DNA, 195 bp, A.fumigatus
  unsure (148): Identity of nucleotide sequences at the above locations are unknown.
tccgctttgataatctactaccctatggggggaaacgcgactacgatcttcataccttgctggctgggtctcagatctcaatgcgcgtctttcgaaccttgcattacaatcattaacattgatttaaggttttgggaaagatgcccanatcattatctttcttatgaagacctttttctgaaaatctattatgcg

SEQ ID NO: 5554 - DNA, 336 bp, A.fumigatus
cccctccagaaaacaaagccggaagccgaaggcacccctcttcacggcctccttagcctaggcctaccgaggattcctcagcgaccatcagaatgccacaaccacaaaaagcaaagcaactggtcccacatctccctatcagtagtattcacggtcttgttcctttcatttccaccaagattccttccaaacaagctaaagttctcacaatattactggttgttgctgcacactcaaattaattatttctatattattactattattaccgttcttattattaccaacattattattttctggactaccacttcattgtttgcaactgcggattga

SEQ ID NO: 5555 - DNA, 231 bp, A.fumigatus
atggttggctgcgtgactggtccgcttgcgggtcttggccccctcactattcctaattcagcagcggaagccggtaccggctggaactggaaattcagatgtctttcagagttcacacttaccgacattcttccacatcctaacaacaatgatcctgctctggtgtcaggtctcagtcctttttctcctccactttctcccccaggtggttgcccatggggtagacaatga

SEQ ID NO: 5556 - DNA, 294 bp, A.fumigatus
tgggccaacattgacacccgcaagactctctgggccgttgcggagaacttccggtacatgaccaagttcctacgcacggccgaggaggtgcagaagctggggcgggtcaagaatttccgcgtgaactttcacgctctggtctcgacggactcgaagtattttagtaagttataccgactgcgctctacgtctcatgattatctggtgcgtgatctaacgagggagaaaccgcgtggcgccaaacacccggataccagggtggattcatcctggacggcggagtccatgtcgtag

SEQ ID NO: 5557 - DNA, 519 bp, A.fumigatus
tctaacgagggagaaaccgcgtggcgccaaacacccggataccagggtggattcatcctggacggcggagtccatgtcgtagcagctctacgattgattctcgggtcgaacgatccagtcgctacgatatccgcgcagtcctgcctccagcagcagcatcttcctcccttggacacggtgaacgcggtgatgaagaccaaatctggcgctacgggtgtgctatccttgtcgttcggatcagcgtttgatgactctgttttcgagtttgactgcgaggggggcgtggtcgccttgaactctgatacgctcacaattaagggcgagagcaatgagctcgcctttgacggacgaggcgttagccgtgaggtcgctgtatttgctacgacgattgccagcggtggttctgtcgacaagcgacagagcccggaagaggcattggcggatttggagattatggagaagatgctgaccagtggtgagagagacggcgagagacagaccgtggaattacaagtgtag

SEQ ID NO: 5558 - DNA, 192 bp, A.fumigatus
acaggcaccaagcgcttcttccgccaccagtccgaccgcttcaagtgcgtgccggagtcatggcgcaagcccaagggtatcgacaaccgtgtccgcagacgcttcaagggcaacatccccatgccttccgtacgttcaaattcctccgaccctgccgcatcagattcgatcatctcgacgagacaaatttag

SEQ ID NO: 5559 - DNA, 423 bp, A.fumigatus
ctctactcggatccttcgccccgtggtgaacactggaaccgacggtcgacacccttttccgcacccgccagaggaaacggacacagccacggccacggacactctgccacaatgacgaggatgaggaaagacgaggaaaataaaaaggacgtccaccatccggccccccttcatggtatatttgtaagcggtaagaagctagggtcaaattttttcgttctattatttcatcattcctattccaccatttacgcctcaacggtgacacggcccttggggttggtgaccttgacgccgagcgccttggccttggcaatgatctcgacgcgcttgcgggaggagacagcggaggcgatcctatccatcaatcagtatcttctcttcgtagatggaactgtgaatgcaacgtactcagcggcgtag

SEQ ID NO: 5560 - DNA, 747 bp, A.fumigatus
accaccggaaggagggacgaacgagggcctgatgtgagtgtttttgttggcccggttattgatatagcgtacacaattggactgcatcgcgacggagctgatgataaactccctccgtttgatgtggagatgcgccgtcgcctttggtggcatatcgttacacttgacgttcgcatagccgaggactcctccactgagccgcgtaccagcttgctgagcttcagcacaaagatgccatccaacacacatgatatatgtctggacccggatatgggtagtactccggtgtgccagttcgggaaaaccgaaatgaccttcagtttgatcaggttcacagtgaccgaatttgcgcttcgctccctgtttggtaaacaatcttggaaggtcgctgactgtgcacccctggatcgccagcgaaggatcaatgagctagaccaactcaaggaacgattagaagtccgttacttgtcatgttgtgacgagaccattccgtttgattttgttgttgcagaatcgacacgcttggtgttggccaagattgggatgtacttacgcaggccgcctctaaccgaacacaacaccgcgcagccattcgagccgacttattggaaggagtgcgttgatattcgttgggcatgcatattcccttcgccggtacgagaaaggggcaaagggggttttggctatttcaaacctaacttcgaatggggaggactggcggaatttctctggctggctctgctttga

SEQ ID NO: 5561 - DNA, 261 bp, A.fumigatus
gaccgatgcgacatggcagacttggttgagatagttgattgtctgcgactgagcttagcagggtccaaggaaaccctgtctacctctgattccgcacaggggggctccaaggttacctggctcgtggccgccatgacgccctggttttccttctcctcttcctgtggttctttgacggttcgttccatcaacttccgcatgaattcgtccgactccgcggagaacttgcatttttttcggatgtcaggcccgtacttgtag

SEQ ID NO: 5562 - DNA, 1602 bp, A.fumigatus
  unsure (1036),(1037),(1038),(1039),(1040),(1041): Identity of nucleotide sequences at the above locations are unknown.
cgactcatcggccctgcacaatcccatcctttagcacggatgggcgccagcagccagtcagcttcggctgatactatcgagcatgttcatcccactcggatatcgcactggcgtatggtctatgaccaaggtgcgctgacccaagagatcatcgattatcgcttcgctggttcaggcacagaagaagacccctacctagtcacctggattctcaatgacccccggaaccctctggaattttccgcgacgaagaaatggacctacaccatggttatggcgtgggcgacgttagccgtgtcattggtctcgtcagcgtacactggcggcatgcaacagatcatggaacagtttgaagtcggcacagaggtagcaactctgggcgtttccacattcgtgctggggttcgcgatcggtcccctcctttttgcgcccatgagtgagctttggggaagacagtatctctttctggtcagctactgtggattgaccatcttcaacgccgcgtccgccggatcaccgaacattcaagctctcattgtcttccgattcctcgccggagctttcgggtcgtccccattgaccaacgcaggcggtgtcatcgcggatctgttctcggcgaaccaacgtggtctggcgatgagtttgtttgcgtcggccccgtttctgggcccagtcttagggcccatcatcggtggcttcctaggtatgacggagggatggaagtgggtgatggggttcttggccatcttttctggcgcactctggatcatcgcgggcctcatcgtcccagaaacgtatgcgcccgttctccttcgtcggcgagccatgaagctttctgagcttactggcaaagtctacaagagcaggattgaagccgagcaaggcaagaaaacgcttggccactctttgaagatatcactgtcccgcccatggatcctgcttttccgagaacctattgttcttttgctgtcagaatacatggcaattgagaacggaaattataaaaagaagaaaggagctatcccaatagagggtnnnnnncagcgaggctggaaccaaggtgtgtcagggctggctttcctggggatcatgattggtatgatgtgtgctgtagctttcagcatctatgacaacaagcggtatatcagagcccaagaggcacataaggggtttgcgcctcccgaggctcgcttgcctccctgtttggtcgcttcggtagccattcccattggcctcttctggtttgcctggacaaactacccttcgatccattatctggccagtatttccgctggtgtgccgtttggctttggcatggttcttgccttcctcagcctcatgaactacctgatcgatgcatacaccatctacgccgcctccgtgctcgctgcgagcgccgtgctgcgctcgattttcggcgccgcctttcccttgttcgtcaagtatatgtatagctcgttaggtaggtcctttttctttttggtgttgttgtttaggcgaaaattaatcgggtccaggtattcattgggcctcgtccattcctgccttcctggcactggcctgtgtcccctttccattcctcttctacaagtacgggcctga

SEQ ID NO: 5563 - DNA, 426 bp, A.fumigatus
tcgggtccaggtattcattgggcctcgtccattcctgccttcctggcactggcctgtgtcccctttccattcctcttctacaagtacgggcctgacatccgaaaaaaatgcaagttctccgcggagtcggacgaattcatgcggaagttgatggaacgaaccgtcaaagaaccacaggaagaggagaaggaaaaccagggcgtcatggcggccacgagccaggtaaccttggagcccccctgtgcggaatcagaggtagacagggtttccttggaccctgctaagctcagtcgcagacaatcaactatctcaaccaagtctgccatgtcgcatcggtctcagaagttggtgacctcgcaggacgtctatgatgccaatccctttgacattgaccgtgtcaacacgcgcgactcgttcaaggactga

SEQ ID NO: 5564 - DNA, 558 bp, A.fumigatus
atcggtaaacgcaccgccaatgatagggcccaggaccgtgccgacaccccagatgaagcctcctccccccacgtacagcggccgctcctgtatggtagtggtggccgccaggagagtcatgagtccgacatacatgcccgagcccgacacgccacagatggcacggccaatgatcagggcgttcatgttgggcgcagcgccgcagacggcggatcccacttcaaagacaaagaccgacaggatgtaggtccattttgcgttgaactgaccaaagactttgccccagatcagattcgtccccgccgcgccgatcaggaaagcgacactgatccatgggagcttttcgaccgagttgaaatggcccacaatgacgggttgcacgttggccacaatggtgttgtcgagggcgaagaggaattgcgagctgtaaatggacaacacgacaaggaaccatttccacccggtgatctctcgcggaggggacttgggatcctctggcaccgagtcccctcctcgctgtgcttcaggatccgagtccgtcgagatcgccttttctga

SEQ ID NO: 5565 - DNA, 687 bp, A.fumigatus
atcctgtctcctatgtcggatacaatggcggccgacaaccaacctgcagcaggccttgcgagcaaggacagcaaccgctctcccacagaacgtgagctttcagaaaaggcgatctcgacggactcggatcctgaagcacagcgaggaggggactcggtgccagaggatcccaagtcccctccgcgagagatcaccgggtggaaatggttccttgtcgtgttgtccatttacagctcgcaattcctcttcgccctcgacaacaccattgtggccaacgtgcaacccgtcattgtgggccatttcaactcggtcgaaaagctcccatggatcagtgtcgctttcctgatcggcgcggcggggacgaatctgatctggggcaaagtctttggtcagttcaacgcaaaatggacctacatcctgtcggtctttgtctttgaagtgggatccgccgtctgcggcgctgcgcccaacatgaacgccctgatcattggccgtgccatctgtggcgtgtcgggctcgggcatgtatgtcggactcatgactctcctggcggccaccactaccatacaggagcggccgctgtacgtggggggaggaggcttcatctggggtgtcggcacggtcctgggccctatcattggcggtgcgtttaccgattcatcagccggccggcgctgggctttttta

SEQ ID NO: 5566 - DNA, 570 bp, A.fumigatus
aaccgactgctgcagatgatccggagccaacaagcccaattacaacaactccagcagcagcagcagcagcaacaatcaggcgccgctgttgaagattccacaccaccgtccgaacggtccgctggtgtccctataataccaccactccctgcagctggtagcggtcggacatccactcagtttccttcatctctgtctagtcaccgggcgtcgcgcccttccagccagacagcctctcccagtcttcggccgctaccttctgcttctctgcatggaacgtcggtcgactcgtcccgtggccctgaagggttagacctagtagcaagcaccagtgagacttcgtcccgacgtggtagcagggatgaggtggctttttaccaagccgaagcatccatgctcaaccgcgaaaaccagatgcttcggcagcgtatacgcgaattaggtttgtctgccgttttccctccgtctgtcatctgtgccaagtctcggcatctgttcgtctcctatgtctgctcggagctgaagatccaaacgctaacaaagcaaaagaacgacaaattagtgggttga

SEQ ID NO: 5567 - DNA, 981 bp, A.fumigatus
  unsure (704),(754): Identity of nucleotide sequences at the above locations are unknown.
ctacaacataaaatccagtcccagtccacaaccgaggacaagcacttcgatccactggcaggcatcctcctctccgaactcctcaaactgaccgtctgcctcctctgcatcgcccacacagcagaagagccccaacccctcctcgcaaccctcaagacaaaccacgaagaagccaccctcccagccctcctctacaccgccgcatccttcgcccaaagcatcggcgcctcctccctccccctcctccaatacctcgccctctcccagaccaaactcatcctcaccccactcctcgcaaccttcctcctcaaccaacgattcaccctccagcactggacgtccaccctggctatgacagcggggatcattctcgcccagacaggcgccaacgccgcagcagaaacgcagccccgcaccgcagccaaccccaacatccacgcgcatcccctcctcccaggcatcctcgccatgctgctctctgggtcctgcgtcgcactgggaagcctctccatcgaacgatcgctcaagcgcgccgcgaacaacaacaccactacgaccgcgaaggggagcgcgttcttcatccgcaacgcacaattcgccgcgcacagtctcctctttgcactcctctcgttcctctggaaagaaaagtgccgaatagacggatcacgcttcttggaaggcctcaatcgcctggtctgggtgtntgtggtgctccaggcgtccggtgggttcctggtggcgtggtgtgtgaggncgacgagttctgtgacgaagaactatgcgcaggggatggggtttgcgattgcggctgcggggccgttggttgtcgagtcgaaggatgttgatgggaaggtgagtgatttgcttcagcgcggtgttttcggagaatgcatcgctgatgcggaggttggtagcttcttgtcggggttgtgcttgtattgggggcggtcgttgggtcggccttcgcagggcagagtatga

SEQ ID NO: 5568 - DNA, 834 bp, A.fumigatus
  unsure (693),(743): Identity of nucleotide sequences at the above locations are unknown.
aatccagtcccagtccacaaccgaggacaagcacttcgatccactggcaggcatcctcctctccgaactcctcaaactgaccgtctgcctcctctgcatcgcccacacagcagaagagccccaacccctcctcgcaaccctcaagacaaaccacgaagaagccaccctcccagccctcctctacaccgccgcatccttcgcccaaagcatcggcgcctcctccctccccctcctccaatacctcgccctctcccagaccaaactcatcctcaccccactcctcgcaaccttcctcctcaaccaacgattcaccctccagcactggacgtccaccctggctatgacagcggggatcattctcgcccagacaggcgccaacgccgcagcagaaacgcagccccgcaccgcagccaaccccaacatccacgcgcatcccctcctcccaggcatcctcgccatgctgctctctgggtcctgcgtcgcactgggaagcctctccatcgaacgatcgctcaagcgcgccgcgaacaacaacaccactacgaccgcgaaggggagcgcgttcttcatccgcaacgcacaattcgccgcgcacagtctcctctttgcactcctctcgttcctctggaaagaaaagtgccgaatagacggatcacgcttcttggaaggcctcaatcgcctggtctgggtgtntgtggtgctccaggcgtccggtgggttcctggtggcgtggtgtgtgaggncgacgagttctgtgacgaagaactatgcgcaggggatggggtttgcgattgcggctgcggggccgttggttgtcgagtcgaaggatgttga

SEQ ID NO: 5569 - DNA, 510 bp, A.fumigatus
ctctggtacccgcaggacaacttcaccgagggcgtgtacatcgactaccgcgcgttcgaggcgaacaacatcactccgcggtatgagtttggctttggtctcacgtacagcaacttctcatactccgcgctggaagttgagctcgtccccggcgcaaacatcgactatttgccccccggctcggccattgccgagggcggtctcccctctctatgggacgtcgtggcaaccgtcaactgcaccgtggccaatactggcgcggtggaggcggccgaggtcgcccagctgtatgttggtattcctggcgcccccgccaagcaactccgagggttcaacaagcagtccatcaagccgcacaagaagaagcactttacctttgacctgacccgccgggatctgagcacctgggacgtcgagaagcagacatggggactgcagtcgggcagctatcctatttatgtgggtaagagtgtgcgagatattcagctcacaggtactttgcagatatga

SEQ ID NO: 5570 - DNA, 384 bp, A.fumigatus
tctggtacccgcaggacaacttcaccgagggcgtgtacatcgactaccgcgcgttcgaggcgaacaacatcactccgcggtatgagtttggctttggtctcacgtacagcaacttctcatactccgcgctggaagttgagctcgtccccggcgcaaacatcgactatttgccccccggctcggccattgccgagggcggtctcccctctctatgggacgtcgtggcaaccgtcaactgcaccgtggccaatactggcgcggtggaggcggccgaggtcgcccagctgtatgttggtattcctggcgcccccgccaagcaactccgagggttcaacaagcagtccatcaagccgcacaagaagaagcactttacctttgacctga

SEQ ID NO: 5571 - DNA, 876 bp, A.fumigatus
gatagtagcatctgtaaaacaatagagaaacgaacactgacaacctgctcagactcaatatcaaccatcgccaaaccgtcaacatcgcaggtccccgccccgcgcgtgggatccgcgtccaccaccctcgacaagaagatctacctcttctccggccgcggcgggctcgccatgtcccccatcgacgaagccggggcagtctgggaatttaccccccagacctcatcctggagactcatcacgcccacctcggaaatccaccctccaccacgcagctaccactgcatgacgagcgacggcatcgacacgctctacctgcacgcaggctgcccggaaaccggccgtctctccgacctctgggccttccgtctctctaccagggaatggactccgctggcggctgccccagaccctccgcgcgggggtacctcgattgcgtttgcggacggggcactgtaccggatgaatggattcgatgggaagatggagcaaggcgggagtgtggacgtgtattctcccggtgagaacgtgtggtcgtcttatgggtttgtggcggatggggttagtgggcctgaggcgcggagtgtcagcgcgctgcttcctgttcggactggggagaaggtcgcgctggtgacgcttttcggggagagggatcccagcgcgttgggccaccagggggcagggaagatgctggatgatgtgtgggtgtttgatgtgcaggagcggtcttggaggagggtagatgcgcaaggcgaggcgccatgtgctcgtgggtggtttgctgctgatgtgctcggtgagaatgcgattgttgtgcagggagggttggatgagtcgaataggaggttaggagatgtttggattctctcgttctag

SEQ ID NO: 5572 - DNA, 249 bp, A.fumigatus
caacctgctcagactcaatatcaaccatcgccaaaccgtcaacatcgcaggtccccgccccgcgcgtgggatccgcgtccaccaccctcgacaagaagatctacctcttctccggccgcggcgggctcgccatgtcccccatcgacgaagccggggcagtctgggaatttaccccccagacctcatcctggagactcatcacgcccacctcggaaatccaccctccaccacgcagctaccactgcatga

SEQ ID NO: 5573 - DNA, 846 bp, A.fumigatus
tctaaggcgccgatcaaggtcttcttcactggtcctggcgttattacatccgccacacccactggggacatgtccgtggacagcgtccgcactgcaatccttccgctttacaaccagttcggtatcttcaacaacatcgaacttcgtgttctccgccggtctaaccccggaccgaacggcaggggaggcggtggagaggttcagttagttttcggtcaccaagtacgccttccgaaaacactgcacttgatgaacccgggcagagtcaagaaggttcgtggcgtggcgtactcggtgggtgtttcagcctccaacaatgccaggatgattgatgtagctcgtggcattctcaatcctctcgttcccgacacctacattttctccgatgtgtcgtctgcgccgctggtccctgacaggaacaacccatccgcaaagaagaagatcggtcttggattcggtttgtccctggtcgcggagtcttcgactggctgcttgtactccgctgacgtcgcctcgccacctgcgggtgggcaggcaccggaggatattggaaagcaatgtgcctaccagcttctggaaactatctcaaaaggcggatgcgttgccccggctgcagcttccaccatgctgggcttgatgactatggggtcggaggacgttggtcgacttcaatttggacgggaagtgattgccgatgagagcatcatccagctggctagagatttggccaagtttggtgcccccggttggggtctacgagatgccactggtgagaacgagcaaggggacgttatcgtgagcgtggttggacgaggtatcggtaacgttggtcggaaggttgcttga

SEQ ID NO: 5574 - DNA, 273 bp, A.fumigatus
gagagcaccctaattcttgtgagagtttgccgtccgtctaactcacgtctaacaacttccttcaccattactgtcgatctttacggtacaaatccaattatctacgggaaacgcttgaactatctattttctgccgatccagctgtctttcggctgctagttgcttccagtttatttccagcctgctcgctcgatacatcgcagcttcccacggtcttttttgcgcaaatttacgaagtcctctgtgcactctctcgcttccatctgcagtga

SEQ ID NO: 5575 - DNA, 201 bp, A.fumigatus
gtttggatctttattctgtcatatgcatgcagattgttaacaagcgtgtcgacagagtcgcctaacggtggagagcaaaacaaacgtggcagctactatggaggtaaatacgcgctacaaacctcacccttgaagacaatatgcaatcggtcggactgtcattttgtgatgcagtatgctaacaaccgttgctgcatgtag

SEQ ID NO: 5576 - DNA, 315 bp, A.fumigatus
gcaattagtggctgtggccctcgaacagtcgactctgggctctctaagagctatgcagcacaaagaccgatttgggcagattatcagtacgtactgacagcttgtgcaatcggctgcaactttccactgacagtttttgtgatcaaagccgatcccgatctttccaatcccactcgtcctcgattcgaacgtccattggagaccattcgatctttcgaagctgctattgaagggacgtacagtagtagacccgtttcctgggcgagaacaggtgagtttggatctttattctgtcatatgcatgcagattgttaa

SEQ ID NO: 5577 - DNA, 1212 bp, A.fumigatus
attgccagaaggtcagaagaccgtagtcaggccgcatggacactgacagcggtggctgtgcgactggcaaaagcactcggtctccaccgcgagcgagatgagacattcttcaaccaacagatgcgcaggcggttgtggctcaccatctcactgatggacctgcaggcctccttcagccaggcctccgagcccctcatcagcactgaagaggccacctccacattctttctgcccaagcacatcaacgactcggatctggatccaacaatgacccatgaaattccggacagggagggtctgtgcgataccacattcgcgcttgtcacataccacatccagctggcagggagagccctgaattttggcaccacggcgtcgccccagcacaaggcgtctcaacagcaacatgcgcagcgctttgaggagaatgcgctgcgcttgttgcacttttgcgaccccgaatcctcgccgtacgcgtggttcacatggcacggcacgcaatgcctcgtctctggagctcggctgtccgctctacggccgctccagctcccgcaacccagtaacggcagtagccagccaccctcctcgccgtctccgaggccgcaggagcacaaccacgagctcctccgcctggccctcaacgtcttggaaaaggcacacctgatgcacacagatccccgcggcgaggggttccgctggtacgtgacgatgccgtggcacgcgctagcggtcgccatcaacgagtgctccctcagcccggatgtggtccgaatccagagcgcgtggccaaccattgaggcgtgctaccagctgctgcgccgcaaaggggttgcgggccaggaggaagcaattcagcgtccactggagaaattgatatgtcaggcccgggacaaggcgagccctcttttgcagctcgcaaggtcgagcccgacattcagcctcggtagcagtactgggacatctgctgcccccacgccgcgttctcgggccagcagtaccccaagtgacaccctcagcgacctgtcctggccgacagctttctcccatgctccttcccagctcggcatggaattggctccagttggtcccgtacagccgttcgccaaactcgatctggattcgttgctgtcacagttcgatattcagggccagccgctgcttgccggccagatccctcgtcttcaccacggggctggacggatccacgctaag

SEQ ID NO: 5578 - DNA, 222 bp, A.fumigatus
ccatttgtgatgccacgacaggctatgacgctcgcttcccccagcagaaccagtacgtcttgttcttctatgaacaccggctttgacacaattgctaataccagcctcaggaccaagcactgctggcagaactacgttgactaccacaagtgtatcaacgccaagggcgaggatttccgtccatgccgccaggtaattatttcaattgctggagtaaaataa

SEQ ID NO: 5579 - DNA, 669 bp, A.fumigatus
agcacctttcagccccgcgctgaagacaaatcccgcttcacctcgtcctcgtcaccacccggacttcccaccctcgttggaatcgcctgcgcctcaggcttcattggcggctttgcaggagacccggccgacgtcctaaacgtgcgcatgcagcacgatgcggcactccccccggcccaacggcgcaactacaagcatgcactccacgggttgatacagatgactcgcaccgagggcgcggcaagtctcttccgcggcgtgtggcctaattcaacccgtgccgtcttgatgacagcctcgcaacttgcctcgtacgataccttcaagcgtctctgtctcgagaagctgggaatgtcggacaacctcgtcacgcatttcaccgcgtccctgatggccggattcgtggccacaaccgtctgcagtcccgtcgatgtcatcaaaacccgcgtgatgaccgcatcaccggcgcagacccagggccacactctcctgggcttgttgcgtgatatctaccgcaaggagggtttcgcgtgggccttccgcggctgggtgcctagttttatccggctgggtcctcataccattgctacctttatcttcttggaagaacataagaagctctaccgagtgttgaaaggaatttcgggggataacaccatcaacgtatag

SEQ ID NO: 5580 - DNA, 810 bp, A.fumigatus
  unsure (760): Identity of nucleotide sequences at the above locations are unknown.
gtcatcatttctcgtcaccctagcccctgtctaactctgcaggtcctcctggctcaaggcttctgcatcggtatcggcgggggtatcgcctacatccccgcgatggtagtcatctcaagcaacttcacgacgaaacggcccatcgcaatcggctgcgccgccatcggctccagcgtcggcagcgtcgtcttccccatcatgttccggcaactgcaaccgcgcatcggcttcccctggaccgtccgcagcattggcttcatcaatctgattttagggctcctgtcaatcctcatcctctgccgcaaaccaggcaagaagtcgcgcgcccgcagtatgatcgaatggcgcgccttcagcgacctccccttcatgctcttctcgatctccctcacctgcgtcatgctggcatactacatcccgctcttctacgtcccctcgtacgcgcgcacccggctccacaccacccgcagcctctccttctacctggtcgccatcatcaacggcgcctccgccttcggccgcgtcgtcccctacctcctcagcgcgtacatcgcgccgatcgccatcctctgtctggccatcgccgggtgcgcactcgcccatgttcacctggaatcccgggaacgaatctttccggcttcatcgtctggggccggtaactgggggttccttaccgggtggctgttaccggccccaccggaacatcggccttcaaccctgtgttcggacccaaataacctgggacccccttgggattatntggggaatcagttccttggaatcctggtgggggacgccattccaggggcg

SEQ ID NO: 5581 - DNA, 474 bp, A.fumigatus
  unsure (423): Identity of nucleotide sequences at the above locations are unknown.
tcgaatggcgcgccttcagcgacctccccttcatgctcttctcgatctccctcacctgcgtcatgctggcatactacatcccgctcttctacgtcccctcgtacgcgcgcacccggctccacaccacccgcagcctctccttctacctggtcgccatcatcaacggcgcctccgccttcggccgcgtcgtcccctacctcctcagcgcgtacatcgcgccgatcgccatcctctgtctggccatcgccgggtgcgcactcgcccatgttcacctggaatcccgggaacgaatctttccggcttcatcgtctggggccggtaactgggggttccttaccgggtggctgttaccggccccaccggaacatcggccttcaaccctgtgttcggacccaaataacctgggacccccttgggattatntggggaatcagttccttggaatcctggtgggggacgccattccaggggcgc

SEQ ID NO: 5582 - DNA, 195 bp, A.fumigatus
ccagctcacaaggccattattggtgcgaataacaatagcttcaactgttcatgtcagctccctcgatatcaggagcctgacattcacgttacaggggtcgcggtgcttgacttaaataaccttattttcacctggtcgcttagtccgccatgttatgatggtggtaccttccactggtttactttgtgtgcttga

SEQ ID NO: 5583 - DNA, 450 bp, A.fumigatus
gtcgtcgatttacatttctgtaagacaactttatcctatacaccacgttttccctgtcattcgcttcgcactttgtcgtgtctcaaaaaagtcaataatgctatgctaagatttctccgatccgcaatgacttcgctcacgacaccccgcgttcctattcccgtcaatggtgtcgactaccgtggcaaagtagtcctggcaccgatggtgcgttcgggagagctgccttcacgccttctcgctctcaaatacggagcggatcttgtctggggtcctgaaacggtagaccgatcgcttatcggagccacgcgccgagtgaaccctcgcaacggatgcatcgaatatatcagattcccctcgaacggtggccgcccagacaaacctgctcaggagtccattctgtaccggattgatcccgttcgggagaagggaaaattgtgttcgtcttag

SEQ ID NO: 5584 - DNA, 240 bp, A.fumigatus
ggcaagcacgcgattcatcatccactgcagttcaaggatccgagtatctggcaggggatgagtttgcggattatgtgtctcaagcatgatctcttcaccagagataagtggatgagcattgtcgaacctatgaagagcaactccatattccttcgggcacagatcttttgggagttgtgggcgaagaccaatattaaccccccccttgatggccatgtcttttcagccaccagaacctaa

SEQ ID NO: 5585 - DNA, 306 bp, A.fumigatus
gatcttccttataagagacatttggtacctaagtctcgccaagtagtgctacaagtcgggtccaccgtgggactcggtctttcctgttttggactttccaagctctcctcccttgtgtactctaccaacgaagggccaggcgagaggacaggaatctactgcgtactttttgagagtctctgtgtgcctggcatggtctccctgtcagaaggtggtctaagccatgactgtgagtatgatatagcacagccgtgtgcaacccagaagatgcttataactcacgtggacctggtatttcttacctaa

SEQ ID NO: 5586 - DNA, 432 bp, A.fumigatus
cagtgttctctgagtgaagaaggccagcgctctcctccgcgtggccccgctgcagatcggcgacgcgaaccatccagggaccgacttggttctcgacctcgctatcgaagccgcgaccgcgatgactatcgtcggcgaccttctagatcaccgccaccgcggcgtggcagaccagcctacagagatcgggatcgtgagggctatcgttcacccggatgcagtcggagcagaagctacagtcgcagtcgcagccctcgtcggagtcgacagccttaccacgagaaggaaagcagagaagtcatgatggatgggttgccggtggatatggcggaagaagacgttggaaaactccttccccccttgaagttccatttctggagttttagaactacgctccatgtcacaaacacgtccttaatggcaagaggctga

SEQ ID NO: 5587 - DNA, 192 bp, A.fumigatus
  unsure (156): Identity of nucleotide sequences at the above locations are unknown.
tgcagtagtagtatctcgtcgttctgctgctgctcctacacgatcctctctcctactattatgatgcagatcctcccagaggttacgactttgtctttcccggcggactggatctttagagccgttatcaggatggacggcgcatgtacagtcttncgccgagccagccgaaagtcagtgaaccggaaaagg

SEQ ID NO: 5588 - DNA, 189 bp, A.fumigatus
ctccgacagggcatttatctggccggaacgatccttatgaaccagccctggggcgcagacggttactcgacattggatacaacgcttttggatcagcattttggtaacatcgacacctggcgcaacgcgatcacggagatccacaagcgcgggatgtatgtgatattcgacaatactattgccacgtaa

SEQ ID NO: 5589 - DNA, 675 bp, A.fumigatus
gtctccccaaaccccattctctgcgtgcggactgacgcaaatacaagcttgggtgatctcattggcttcgaaggctatctcaacaccaccacccccttctcggtcaaggagcacaaggccctctggaagaccgatcgtcgctacgtggattttgacattggcaacgactataactcaacctgcgattacccccgtttttggtatgaggacggtcttccgcttccctccgagcaggccgatcagctggtgggctgctacaacagcgatttcgaccagtacggtgacattgaagcgttcggtgtgttccccgattggcagcgtcagttggccaagttcgcgtccgtgcaggatcgtctgcgagaatggatcccgagcgtgcgagagcgactgatccgtcactcttgcataatcatcgcctccctggatattgatggtttccggtacgataaagccacccaggcgacggttgatgctctcggcgaaatgtccatggcataccgggagtgtgcccgtgccgtgggcaagaacaacttcttcatctcgggagaaattaccggtggtgattacttcggttccatctacctcggacggggcagacagcagaaccagtggcttccggacccttcccagggtcccaagatgacgaatgagtccagcgcccagtatttcgtataa

SEQ ID NO: 5590 - DNA, 486 bp, A.fumigatus
tacccccttccttcagtgcatgggtcgactcccacatattcttatccaccgcattgctcagaagcagcgaacagaaatccactacccacgatgaagtggggatggaccggggcgttgctggcctggtttgcgacaaccacatcatgctggccgtatgacgagagcctggtcgggtacaacctcaacgagaataaagaggccaaaagccccgtggagtactggggagaatggccggaccataagggcaaatactttccctccccggaaaactggcggtttccattttacaccctgtttttggatcgattcgtgaacggtgacccggagaatgataatatcaacgggacgcagttcgagcatgatatcagctccaaccagatgcgtcacggtggtgatgtcgccgggttggtcgctactttggactacttacagggcatggggatcaaagtaggttttcctgacctgactgatctgtggccgcaatga

SEQ ID NO: 5591 - DNA, 624 bp, A.fumigatus
gccatctgctatctccccatgtcttttcctcatacaaattttatccaaaccacggatacgttgtttgcagaccaagaggcctggttttcatctctacggtggtggacgagaaccacgatggactcacgatccgatatcaaccccgattgggttcggaggactctcaggttattggtagaagcaaatccgcgaaacgatgatctggctgagtatgcacttgccgtggaattggcgtgcaatagcaaggaagccaggaagtacgccaagtcacttctaaagaagaggagctcgaatctacgcctttacaatgcgtacgctctcatagaatgtcgctctggcaatcccacaggtgccgaacatgtctgggcaaccactctctccatgagcaagacattttccgatcacgacagggtcgattgtgccttgttatggcagagctggacctgggaatcgcttaatgctcagaatttagcccaagcctcccacctgctgctctcaataccacagaacagtgttgacctcaaggctgtcccaggtgcttttagcgaaaccatgtttagcgcaacaagtctcctgaaagcacagaatgtgagctctatccacctgttttattgcactactagc

SEQ ID NO: 5592 - DNA, 1326 bp, A.fumigatus
  unsure (25): Identity of nucleotide sequences at the above locations are unknown.
ttcatttcccaagcgacttggaggnccgtgtcggacacggactcaagtgacggcggccttcgagtggatcccgacgaggaaatcagatctcgcaacgcagaactcttgaggaccgttgatcgaaatcccagagatattgaagcatggattctcctgatagaacatcaggaattgcttcttagaggttcagaaagggattcccgcgccttgaccgccgcggaaagaaagagcttggccgacatcaaactgtcgttgtacgagaaagcgctgaaaaaggtcggggacagtccgttcaaagacgtcctgctgctgggtttattagaggaaggtgcaaagctatgggacacgaaagagctctcgtcgcaatggcaggcagtgctgaaagcgaattcacaatttattagcctttgggtcaaataccttgatttccgtcagacggaatttctcgactttacctacgaaaaatgcttcaacacctatctcgaatgcttgaaattgaacaaactcggccctggagagccaggaaatgggcatgtgcaggtctacttgtttttgcggttgacttgcttcatcagggaagctggattcacagagcatgcggcgggtctttggcagggcattcttgaaacagtgttctttcgtcctgaggacctcagtctcgcaaaagatgaagaaacactctcagcattcattgaattttgggaatcagaagttgctcggatcggagagttgggcgcaaagggttggagatcgggagaaaatgctctcatggaacccaaggccttcgcgcctcagtttaaagtcaacacacgagcaatttttgcatcctggaccgcctgcgaaagagaacggatatccaatgctcaaattcccgggcgaagtctggatgaggccgacgaagatgatccgtaccgtgtagtaattgcatctgatttccgagaggttttaccccttgtctgggacatggacttggccgacgcgttgatcgatagcttcatgtattactgccagttgcctccactcaagtcacccgagaacctggaatcgaccagtcgttgggcgggagacaatttccttcgaaatgagtttataagcaacacagggaccacaatggacgattttcttcagaatcaaaccaacagtgctgagccatctgctatctccccatgtcttttcctcatacaaattttatccaaaccacggatacgttgtttgcagaccaagaggcctggttttcatctctacggtggtggacgagaaccacgatggactcacgatccgatatcaaccccgattgggttcggaggactctcaggttattggtag

SEQ ID NO: 5593 - DNA, 426 bp, A.fumigatus
  unsure (111),(147),(201),(255): Identity of nucleotide sequences at the above locations are unknown.
atcagtcgaaggagccccagatcgggatggtcaaccccatggcccactatggtaagtccccaggttttatacccatggagcaggggagatcggttaactgtcccaggtgtngacgtcaacatctatgcatcctcttctaaagatgcntggcccctggttgggaaccacgaaaataccgagatcggccagttcatttcagantaccttgacctggacgtggagaacatcaccaagcacctacaatcatccagcgcntggtcgttcgccggcggtgacgtagagcggccttacgcctggctaggagatcctttgggcgcggatgtccgcaccgagggctttgatacctaccacggagagttcaggaaacgctctatggacgtggacggcatggagaagagggagtgcgggtgcggagggatgcattga

SEQ ID NO: 5594 - DNA, 1350 bp, A.fumigatus
tttgaagggaaaaagaatttttgttgggaaagccaaaagaaactcgagaaatccatgcaggctgctcgtcttgccgcgtccgagtgcgaaagcttggtgcagaaacataccgatgatatcaacaagaagacagctgagactgccaagcttgaagaggagatgaaggcagaggaggaagagctgtccacaattcgagagggcttgaagggaaagacccagggtctttctgagcagatagctgctaagcagaaatccttggagccatgggatgagagaatcaacaagaagctttcagctatcgctgtggcccaaagcgagctcgacatcctccgcgaacgaagcaatgcaggggctgtacaactagaagaagcgcagtccaaagtcacatctatcgaggagacgctggcgaccaagcaaacagatctcgaggagcgcaaggctcaaaaagctactcttgaagaagaggtcgccagtctgaaacgggatctcaagaaatttaccagcagagagaccgaggttcgtgctcatgtttctagcgcccgacagaaggccgaggaggccagagctagccttgcgagcacccagaaccgcggcagtgtgctggctggtcttatgcgtctcaaggagtcgggtcgtattgatggtttccatggccgccttggtaaccttggcaccatcgacgaaaaatacgacgttgctatatcgaccgcttgccctgcattggacaacatggtggttgacaccgttgaggtcggtcagcaatgtatagattatcttcgcaaaaacaacctcggccgcgccaatttcattctgctcgatcgtcttccccgccgcgacatgtctccaatctttactcctgagagtgtaccaaggttattcgacttagtgaagcccaaggatcccaagttcgcgcctgcgttctacagtgttatgcagaacacattggtcgccaaagacctggaacaggccaaccgcattgcttacggtgctagacggtggagagtagtcactcttgatggccagttgatcgacgtgtcaggaaccatgagtggaggtggcactcgagttgcacgaggtggcatgtcctcgaagcaggtggctgaggtgagccgggagcaggtttcaaagctagaatctgatctcgaagagatggagaggaaattccaaaacttccagaataaacagaaacacgtggaggctgccatcagagagaagtcggaagagatccctcgtgtggagacgaagattcagaagatcatgatagagattgagagcgcaaatcgcagatctagcagatgctcagcggagagtcaaggatatcttcacgccggggctggaaaataccgctcc

SEQ ID NO: 5595 - DNA, 1449 bp, A.fumigatus
ttccctttgcagcgccccttgcagccccgtggtgaagacatgctacatcgtgcaataccccagaagatagcagggataatgaatctctgtgcatcaaaccataaacaccttgagcccgatgatcctgcgctcgttgaagagcacaaattactgctttccaagtttatggaaccctcttctaggggtaccaaggaaatcgagcgagtgtcctgcaacaactttgagacagtttttcattctcagacatctatgagtagcgcctctaacactataaatgatgaattcagcgcagttaccaatccaggagtcacgtcgggaggcaggaaggattgcaatgccaaagtagctcttggtttaccaacttctgcgaggaaaaggtcaacatccaatttgtccagtatggacaagcagacatttagctcttctgcatcatctgttgaacgggactcatcatctccaggtccatcttcgaccaggtctctcgcgccaaggacacgacgttctactcgctcgagaaacaagcaaatcaattattatcccgtgatcagcctctctgagtctgactcaggagagggtccttcgggcagtagagacacaaaaacagtcaataccagttcacaggcacgcaatcggcagagccacaaaccttccaatcaatcatccaagcgccttcatcacctgaattcgaatactgatcctctttctgatgctgaaatccgtatcatctattcttcgcgaggggtgcagattcggaaattgagcttcacatcgcttgatcatctcaaagatcttaaacacgcaccattctgcccagagcataatcctgccaaatatgctaggagatacagagagtccatgatagtatcaagtgagatcttgcatgttgattttgactcgcacgagatgacagctatgctcggtttattatcattacatgggtgtcagtattcaccaaccacagaaatctcaatcagtgatcaagttatcgcagttttgtcgagtcatgatgtccatcgggattttgcgaagaaaatctctctcctgcgcgaacttgccaaatacatttcaaatgaggcagtcattgatacgagcacctggctctgggaagtattgacctcaaaagtcagaaataagaatcagcaatctgtgagacattgccttacccaactccttactctcaagggcatggcaggcgatggggccttgtccagttcacccgcagtcatcaaacaacaactccagatattcctaagctgcttacctcatgcctctatactttatcgacgtcagcctgccgatattggtgcattcatccaggctgcaagaaatggacatctttcatcatcgccttcgattattcaagctgctcgagtgactgatagtaacagcggctcctcagtctttggtcccattcgagcccttattacaccgccaggatggccgaaatag

SEQ ID NO: 5596 - DNA, 819 bp, A.fumigatus
tcgctggatcgatcacagtcaaaaatgaactcgacatttgatccttggacgcagaatatcactctgactcagtccgatgggacgacggtcgtctcatctctagcactagcagacgactatctgcactacatgattcgtctcggcatcaactatggcgctcagctcggcgcatgcgccgtactcttcctagtcctcttgctgctgacaagaccagagaaacgcgtctcatcggtctttgtcctgaacgtctctgcgttacttgccaacattatacgtctgggatgccagctcagctatttctctaccggattcgctaggatgtatgcgttgctggctggcgacttctccagagtgtcacgcggtgcttatgccggccaagtcatggcatctgtgttcttcactatagtccttatctgtgtggaggcctccttggtgcttcaggtgcaggttgtctgttccaatctccttcgtcagtatcggatcctgctacttggtgcctcgacgctcgctgcccttgttccgatcggggttcgcttgacttactcggtgatgaactgcatggtgatcatgcacgcaggaaccatggaccatctggattggctagagagtgccacgaatatcgtgacaaccgtcagcatttgctttttctgcgccgtcttcgtcgtcaagcttggactcgccatcaaaatgcgaaagagattgggtgtgaaaaaattcggtccgatgagggtcatctttatcatgggttgccaaactatgaccatcccaggtaaggcccggagaagaccgcatcatccaatgaaagaagaatcatactga

SEQ ID NO: 5597 - DNA, 417 bp, A.fumigatus
  unsure (287),(327),(328),(333),(334),(374): Identity of nucleotide sequences at the above locations are unknown.
ctgcctgtcttgcgaatatggatccatccgaccaacaggcctccaaggccgaaccctacgttcgttggaacgaggatcaaccctgccgaggcgggcgaccattgtcggaccgccattgcatacactggcgtgaaaaaaagaacagaccagcgcgccatcatcgagatcagagctgctaagcaggtcgccagtacgcttctcgctttgagtacttcaagtgggattataggctctgatgtgaacttcgattccaaaagaaagaaaacggcgaacgagaacaaactccnaattaaaggtgtgatcgtaacaattgagtctggcgacgcnngactnnagagcagcccaaatacgaaaattgtctggaaaaaatggtntatccccaacccttggtggttaaaacctaattattcctacaaa

SEQ ID NO: 5598 - DNA, 831 bp, A.fumigatus
agtactcaaagcgagaagcgtactggcgacctgcttagcagctctgatctcgatgatggcgcgctggtctgttctttttttcacgccagtgtatgcaatggcggtccgacaatggtcgcccgcctcggcagggttgatcctcgttccaacgaacgtagggttcggccttggaggcctgttggtcggatggatccatattcgcaagacaggcagttactacgtgtgggtgtcgttgcaattgatctgaaaagccccaaaactaaccttacatgctatagctcgacgctgatagtgtttctgctctttgcgttgacgcactttatactggccatactatcaactccttcttccgctaccgtcgcctacgtcgtctcgaccttttttaatggtcttttcattggcgcttcgatgaactatgcgttgtctcatatgctacaccttaccaatatgaacgtacactacattgtgacctccctactaggcatgttccgtggctctgctggaagctttggatcggccattggcggaggcttctttcagcgggagctgaagaaggctcttgagaagggatttagcaagcacggactttccgggacagatgagcttgttcgtaagcttttgggaagccccgctttagtgacgaatctgagtggactggagaaagaggtggccattcaaagctatgagcaggcagtcaaggtactgatcttgggcggctgtgttctggctctagtagcgaccatgcttcaagcatgtacaggctggagagcacctcatgaggtcgagaaagatgtccatggtgatctggaggacagactcgatcgggaataa

SEQ ID NO: 5599 - DNA, 366 bp, A.fumigatus
  unsure (5),(6),(46): Identity of nucleotide sequences at the above locations are unknown.
agtcnngcgtcgccagactcaattgttacgatcacacctttaattnggagtttgttctcgttcgccgttttctttcttttggaatcgaagttcacatcagagcctataatcccacttgaagtactcaaagcgagaagcgtactggcgacctgcttagcagctctgatctcgatgatggcgcgctggtctgttctttttttcacgccagtgtatgcaatggcggtccgacaatggtcgcccgcctcggcagggttgatcctcgttccaacgaacgtagggttcggccttggaggcctgttggtcggatggatccatattcgcaagacaggcagttactacgtgtgggtgtcgttgcaattgatctga

SEQ ID NO: 5600 - DNA, 1749 bp, A.fumigatus
  unsure (1741): Identity of nucleotide sequences at the above locations are unknown.
aaattgacttgttcacccagggggaaggtgggtatctggagggagttatggcgcaacaaggcagtagccccagaggtggcagatgtgttaatatggcgtctggctgcgctggacagctgccattggcctgagggggggataccagttgagatgcgtcgtcagctcaacggcaagtaccgagtattcatggacgaggatctactggatagtcttctcttccaatacctggggctcaaatggtccgtgacgttcaagaatgccttcaaggcttttttcaggactcgcgcttggcaatctccgcgccagcagatctccaaagaagagcgggaacggcgcaggtattttctgggctcgactggtcgtggcggctgcgtgaatgactacagacggcagatgtacgagacacaatactttatgacccagctgccgtcgtccgtggaagcaggtgttccagagtacggtgatgaagcgaacagtgacaatatcactgacggggaaaagcgcaagaaccacctggaaaccaagcacgcgctgcttcaccttctgatcacagagtcgatcatccacaccacactatacggccaatttacggccatctgttccgatttcaagtggtttggctcgtcactgtcacacgcgaccgttctggcggtactggagtactttggagtgccccagaactggctccattttttcacggttttcctcgaagcgccactcaaattcacgcaggacggagagaacgccgcggtgcaggttcgcaggcggggagctcccataagtcacacgctatcggactgctttagcgaaacggtcctcttctgcatggactatgcggtgaaccaaagcacggagggcgcctacttgtaccgtctgcatgacgacttttggttctggggtcgcgagcagacctgcgtcaaagcttggggcgccatgaccaaattcgccaaggtcatgggtcttgagttcaacgaggaaaagacaggaacagtccgactgacaaagccaaacccccgtcagggcagcccagttccagccgaatcagagcattcatcctcgctaccgaccggggacatccgctggggctttctgaagctcgacccgcaggaaggccgcttcattatcgaccagtcgcgggtggacggccacattgccgaactcggccaccagctcgccgcgtgcaagagcatcttcgcctgggtacaggcctggaacagctactttgcgcgattcttcaccaacaacttcggcaaacccgccatgtgctttggccggggccacatcgacatggccatctcgaccctcagccgcatcgagcggaccctattccccgacggtgtcacctcacacctgcgacagatgatcgcggaccggttcggcgtccgcgatcttcccgacggcttcttctacttccccgtcgaccttggtggcctgcagctgctgaatccgtacattccgcttctgggaatgcgcgaggacatcaagcagacgccgcagcgccggctccagaaagcgttcctggaggacgaggatgcctgggatgcggccaaggagcgattcgagaaggacgggccctgcagcgcggcgcagattgacttcggcgatgatgacagcccggccacgttcatgtcattggacgagtttatgcgatatccagagtcttccagccaggctttgctgcaggcgtataaggagtcttcaccacggggctggaaggatccgcggcagcgcaattcaatanaaaatcgc

SEQ ID NO: 5601 - DNA, 192 bp, A.fumigatus
cgacgcatctcaactggtatccccccctcaggccaatggcagctgtccagcgcagccagacgccatattaacacatctgccacctctggggctactgccttgttgcgccataactccctccagatacccaccttccccctgggtgaacaagtcaattttcaattaacgaacttggagacccactccaaggtc

SEQ ID NO: 5602 - DNA, 201 bp, A.fumigatus
agcccacaatctctgcacactgttggcggttcagcactttacattcattcctggttctctaatggatccccaaagggcaagtcgaaggcggcgaaagtctggaagaagatactttggaagaagctccttagcatccaactcctgctcgcccctgcctacggccgcctcggagcaaagtactgctggcgacgtcgtatgtag

SEQ ID NO: 5603 - DNA, 273 bp, A.fumigatus
ttctccatgaaatgtttcatagccgtgaaggaattcaggagcatggtgaggataagtctatacctgcctacggctaagtcttccatctggttaaacgtcagagaaccttgttcttatcgaattgacagggcaaatttgactcacaacgctcctggaatcggagtcttcccgggtgtcctggagccttacctgacatttactacatacgacgtcgccagcagtactttgctccgaggcggccgtaggcaggggcgagcaggagttggatgctaa

SEQ ID NO: 5604 - DNA, 465 bp, A.fumigatus
caatggacgggctgggatctgaaaaagatgatgactacggcaaggtttgcagacatcgacgtgagcagttataccactggttatgattacagattcgagccttatcccgaagattactacgagccacatccacacgactgctctgttgtcacgttccgaggtcatcgggtactcaagacactcatccgttgtcatttctcgccatcaagtagcacgaactcgcgctatgtttacaccggaagtgaagacggcaaagtgtacgtttacaacctggacgcaacgcttgcgggcactattgatgtcgggcgtgcaactctgaattcgagaccgcgcgatcctgatatgttcaccaccgcgtatgagatcaggagcaggagcggggagatgctgtggcggacctgcgttcgagatgcgagttggcatcccagcgcgccagtcctctctggtaagatcattcttttctaa

SEQ ID NO: 5605 - DNA, 354 bp, A.fumigatus
tcaattgctcatggaaacatggcttctatcattgttctcccaactgagctcctcggtcgcatcatctcattcctggaccggtcgtccctgaaggctatccggcaaacgagtcgtcgtctctcacagattgctactccacagctattcgccactctgcgtctgtttccggacgaaaagagttatgaggctgtcgatcgcattacggaccatgcaacactgaagaaaatggtcaagaaggtgtatgtcaatacgtgcgaagatgactatgtcagtccatatctattcctcgcgaatcgaggcgctccgcacactaacaggcttaggacgactatgacgaggaggaagtcgaattga

SEQ ID NO: 5606 - DNA, 438 bp, A.fumigatus
ccaaatgcagatcagagtagaaagcgaggtattctcgagtcggatctgctgctatccaccttcgccgatgtctatctgaaagatatgacgccagaacagctccaggagtacgaccgtttcctggacgagaatgactgggacatctactactgggctacgcaggaccctccgtctgctacggacagcccagccgaggataccgtcaccgagacgtggaaacgcaccggagccaagagtggtgagtggaagcagaccgttggtgcttacaaggctgcgtataggccagtcccctcgcggtgggccgattccgaggtcctcaggcttctgagacaacatgtacgcgataagagcgctgttggattccatgctgcgaagaacaagaagactggcggctgtgggctgggaagaatgcccgacatccaagtctttgataaatag

SEQ ID NO: 5607 - DNA, 918 bp, A.fumigatus
ggggatcggccgcaagtcggtgttacaaaaaggaacggcgtgcgacttgctaatgaattacgcagagggtgtcggttgcaaccatatcgtccttgggcaattcatatatcccattactatcgatcttttcatcaatctgctacgatgttcaaggtcggcgacgatttcgacaagattcaggcttcccgacctgacttcaagcgtgatgcgccagtcactttctctaagcctccgaatccaaactggaaacaaggcgacggtgccaatgatggtggggagagtctgaagaagagtcacgtcgaaatcgatccatacgaagaaggacgaccggtatcatcaaactataagctgttaatctcgggaattgtcccaagacccattgcgcttatcagcactaggtccaaggatggaaagacgacgaacttggcaccgttcagttatgctcaagttatcaatcacgaccctcctcttttcactgttggattcgttggctcgcttgagaaggcgaaggactcgctgaggaatatggtcgagtcgggtgaatgtgtgattaatataatctctgagcattttgtcgaggccgctaacgcgaccgctatcaatgcaccgtacggagtttccgagtgggaggtttccggcctgcaccaagcgccttgctctgtcgtccaagctgcccgtgtcaaggagtcaatgttctcgattgaaggcaagctcgtcgagactaaggagttccagagcagaacgacgggtaagaaaacaggtactctggctattatcgagggggtccggttctgggtgagggatgacgctatcaacgaggacaagagcattatcgacctcaaagtcctgaagcccatcagtcggctcggaggtatctcatatgggcgtaccgtcatcacgacgccgctgaagatcacg

SEQ ID NO: 5608 - DNA, 192 bp, A.fumigatus
  unsure (144): Identity of nucleotide sequences at the above locations are unknown.
gtatcccatgttgcgatttataatagaaccagagccccattgtcgagaggaaagtatgcctatctaatcaatgcacactattacgtagcggatacgacaaccaacaagaaagttctattggctgaccaagtggtctactgtttntgcgtcgctatctctttcaatggtctagagtctcccttatcgggttga

SEQ ID NO: 5609 - DNA, 639 bp, A.fumigatus
  unsure (111),(227): Identity of nucleotide sequences at the above locations are unknown.
cctccgcggcagggggtcccagcatcagcccctttccccatccccagtccattacggaacaactttccactgccttttgttcagagtaggccttttacatatacttcaccntatgcttccgatcccccaccgcagttagctcagtttcagcaggctcagcagtcgcagcaacaaccagggttgcactcgcagtcgcaacatcactcaccgtaccttccacacaacgntaccgcaccgccacaacttcaacaacagcagcatgtgccacctccacttccgggcaaccctcagcaaccacagcagtatctcccaccgaacccaggaccaccgatgcagcctccgcagcagcaacagcagctcaattacaatgttgcgcccatgaacgctggttccacgtcgatggaggatcccgaatctgtgtcgtttgaggagcgtgcaagcaaagcaattgatgactttgaggctgttctcctggaagactacgaggacaagaatcacatcaaggaagtgctcaagagcgcacgggctcgtgctctgggccacgcgacggagagctcattccctggcggggagcccaaggacgaagctgtcattctggatgcgcttcgcaccttgattggaggcttgagagaccagtaa

SEQ ID NO: 5610 - DNA, 243 bp, A.fumigatus
  unsure (88): Identity of nucleotide sequences at the above locations are unknown.
ctcagtttcagcaggctcagcagtcgcagcaacaaccagggttgcactcgcagtcgcaacatcactcaccgtaccttccacacaacgntaccgcaccgccacaacttcaacaacagcagcatgtgccacctccacttccgggcaaccctcagcaaccacagcagtatctcccaccgaacccaggaccaccgatgcagcctccgcagcagcaacagcagctcaattacaatgttgcgcccatga

SEQ ID NO: 5611 - DNA, 570 bp, A.fumigatus
tatacgcatagcgcggatccttccggccccgtggtgaagacaacatcggcaatgaataccgtcctcgaccccgtaacaacatacggcttaaccgccgtcccctcctcctgtaccaccctcttcaacggcaacatccccagctcaccaccccctttcgtcccaaccactcaaactcccatcccatcgacccccctcgcaactcgcatagacaactacgcccgcgaaaatctctccgagcaaacctaccaccactccctccgcgtctaccacttcggcctcgccatcaaacgccacgcctttcccacctggtccttcacagacgagacctacttcctcgcctgcctgctccatgacctcggcacaacagacaagaacacgcgcaagacccggctgagcttcgagttctacggtggccttctcgccctcgaggtcctgcagtcgagcgcggagcatcccgccaaccatttcggggtacggtgcagtcaccgggaccgtcgcgccgagggagcaggccggagagtgtcttcgaggctatcgtccggcaccaggatttgtgcgagaaaggaatga

SEQ ID NO: 5612 - DNA, 240 bp, A.fumigatus
acctccccttcagtggttttgataacgtgggtagataataccggcgccaatgagcacctcgtcaatccgcagacgatcaaggatgtctgcgagaattatccccggaagcagtggagcagttgctttgcgggggtcattcgcaaggagaacgggctgaagccgtgggcgcattccaccacgctgggggaggagtttccagcgaagatcatggggaataagctgatggcgccgtatgagtga

SEQ ID NO: 5613 - DNA, 399 bp, A.fumigatus
gggttgttagaatatgcgcacaaactgaatcggcctattcccaacggggtcccctcagatgagcaaacaaatattcttgtgatgcagtcgcaaacgatgcgagacttggaagagctaacgctggcgtttgacgggttggagcgattcggcctgtgctggaagaaaattgacaagtgcgtatcgatctatgtcttgaaccgaaatggtctgctgactgatgtcgcatttaggagcaaacgtagacgggattctggcgcggttaaggatcttagggatgagttgcaagatactctggatgagattagtatgcatgtggacgcggtgctggacgaatggctgactgcgcccgcagacggtaagctttgtctcgctagacatgggagatggaagacctactaa

SEQ ID NO: 5614 - DNA, 363 bp, A.fumigatus
acttttttcggtatagaagcggaagaggccgagctggaagaaatccgggtcacctacatccccgaactgttcctggactatcacaatgcgctgtacttttccgcccacgtcctcaccagcgagatcttggtgcagtgcatgaacctggcgatgcaagtatccgagaacgaatatctgacgcgcagttttgtgtcatcgcgccggatggcagaattggttgacgcgttggcgctgtcgagcaaggcgatggttcagacccgggccaagcctggcaagagactactgggaggcgagtcgcttggcatttggacagtggaggttcccgaggatgaggagcaggagtttctccgtcaggccaaatga

SEQ ID NO: 5615 - DNA, 201 bp, A.fumigatus
tcgattgggaagacacgcacggaagcctttcacatgccaagtcacgtggatctccgtaccgtttatatgtacggagtagatgtgagagacaactcgaattggtgtcttgactacaagtttgcacatgggaaatcgtggattgcagagagtaagtcacttaaaagtatgggtacatctattctaccgaatgtgctattgtga

SEQ ID NO: 5616 - DNA, 462 bp, A.fumigatus
taccacagcaagatttttaacctccatgcaatccatctgcgttttgtgctactttatgatgatatgatgcagttgatgacaatgcacacacgtgcattattattatgccctgtactttttgcaacactatcctgcatattggcctctgctactgcaatcttgcgtcacatgcatacggcatcttttacgaactccacctgtgcttttagctctttccattccagatctgtctttttttggcattttttcttcgtttcgcttgtgatatggaccatcaatcgagatttggtagtgctgctggttaaggagcctggctactccgaccacgcgggcaaggcagtcattggatttgacttgagactggtccctgagctggcttcgttttctcagcaaggaaataaggcccaagcaccttcctgtatgtgttctgccagttcaggttttttgttgtcttatctctga

SEQ ID NO: 5617 - DNA, 552 bp, A.fumigatus
  unsure (68),(70),(184),(230): Identity of nucleotide sequences at the above locations are unknown.
tcaagaagtgccctgcgtaccgccgagttccaaatgagacgccaaatgatcgatgaaatgctggcagnanctgagctgaagaagatgcttcgcgactctttcgccaattacgttgtccagactgctatggacttcgcagacccagaaaccagagctcgtatcgtcgacgctattcgcccaatcntgccttccatccggcagactcctcatggccgccgcatcgccggcanaatgatggcatccgaaggctccggtaggggaagtgccgcgacaagcggacaggtcacgccgaacgagatgaattctgcccagcttccgggtcctttgcaaggaccacagaagccattcttgtatcaacacaactcatttcctgctcccactgtcggaccccaatttggaagtcagaacttcatgcccgcttctggctccggctctgtttccaacaccacatctggcggtgctagcgataactcttccggcatttatgcccctgctgctcagcaaccgaacggcaatatcggagctcagagccagctgtacgcttacttctaa

SEQ ID NO: 5618 - DNA, 279 bp, A.fumigatus
ctaatatcttgcacctccggtaaagtcgccgccatggcgcccaaagtcgagatctccatcccaaccactaccacctcacacacctcacccccctacacaatctacaacatcactctgcgcctccccctgcgctccttcaccatctccaagcgctactccgacttcgttgccttccacacctccctcctgaaccaaaccaacgccccgccaccagccccccttccgttttcacaaacagccgtggaaggaccgcatatggttatccccaagcaacccggt

SEQ ID NO: 5619 - DNA, 843 bp, A.fumigatus
  unsure (706): Identity of nucleotide sequences at the above locations are unknown.
cagacatcaaccgagaaattatatctttcgggattttcgtccgatggagacgtggacaaaattggatgcgacgacctcagacagactggctatctggatatcgaacgaagcattctgctgcacgacaacatcagccaaatcgcccttagcgtttcgtcccatccaatgatccaggagatactggatcaaactgcgcatggtgtgaagattttcgagcctcatgatctaatagagagccgtttgtctcaattcgcaggatcaggagtctggctatcccagctgaatgtgtatattgtggcctcgcgcgtggtgtacacagctcctggaacctcctggccgacaatcagtttcttaagagggagagtctttgataaaaattggagacacttggaaaattacaccattgactggtatggaaaaacgacgacctttccgctgctattcgagataccgacagtatggtggaaggatggaagcttctttggccctgaggatccacgcatcgtcttagaagaaggggttcaaggtgccgagccgatcattgttttcaatatgatcttgaacgctacgggctatccccgcgtcatgtggatcttcaagcctttctcccgtatcatctcctacttaaggattcgaggtgaggagagaaaaccaaccgagaagaactgggctccattcttctatagctaccgcgctgattccgaangaaaaccaagcgagcacttgtatttcgtttacagttttaatcctcttcaagtgctcaaatgcaaaagtgacactgggagttgcgactggttctacagggcaacatcaagcccggacttttcgtcactgccacattag

SEQ ID NO: 5620 - DNA, 204 bp, A.fumigatus
  unsure (79),(87),(88),(126): Identity of nucleotide sequences at the above locations are unknown.
cactgggagttgcgactggttctacagggcaacatcaagcccggacttttcgtcactgccacattaggaccctcatggngaaatgcnntgggggacgaatttcgtgcggttgcccttgctgcccantcaggacttccaattctttctgggaattccccgaacacacgtccagttttgccaatccgggtctttctatcgccctga

SEQ ID NO: 5621 - DNA, 270 bp, A.fumigatus
tccttgcgtcggagcccggcccgtgtggagaagatgtgtgacgaggcctgcttacaagatttaagcaataatccgtattttctggtctatcctgccagtaagcctcaaatgaaaaggcttcagttccgcagctcctcggacagcatatcggttttgatcgcatctttacggcttgagttcgccgcgctgtccacagcacatgatatgatctctttctctatcacggaccatcgcgatttctgcaacggtgtattgtggtcccccccgtag

SEQ ID NO: 5622 - DNA, 582 bp, A.fumigatus
ctcctattgcgcaattccgacctgactatcaacatggtcactcctacatctaaaccgaattcgagcttctcgaaggtatatctgaccaagaataattacgcagggcgatctcttcacccaaatgctaagcgccctggaaagggagttgaggaatcagcgaaggaagaaagcacccaggttgttgagagtttcgaggtggatggggataagcagatagtggacaatgaggacataaccgctgaacccgccagttctccggtcagttctcttgaggaccacgagaatgagattttgcctggttttgagtactttgacagcgcagtaggtgaaaggaggaggccacagcgcgggaggaaagacttacgcggctcagagtctcctacgttgagacgcaagaggaatgccgatgaaatggcccacacagctcaggccgatgccgagaaggaagactacgtatttggctggtcacaaagccagaagaagcgcaaacagggttacgctggaaagacaagcgatggctctttgtggaaggcgcaaggctctacgaccgctccctcccagtcgaaatcatcgccttcctcc

SEQ ID NO: 5623 - DNA, 1053 bp, A.fumigatus
acgcttgaaatattcagccagatcttatctctggtgaaccacggcaacagcttgctgaaggcggactttgtcaagggggtcaacggggtgattggcaacgccaacactttgttgacagccgattttgtcaaggagactcgcggcctcattgaagctgttgctcccattttgacacccgaactgttcaagcagattggcactctcctaatcaacgccaacactctgctgacttccgactttgtcaaggaggtcaagcagctcatcaacgctgtcgggcctctgctgtcgccggatctgttcaagcagatcagcggtctgctgaacaacgccaacgacctgttgactccggacttcgtcaaggaaaccagaagcctggtcggcggtattgctcctgtgctgacacccggcgtgctcgctgaggttggcgctttgttgagcaacgccaacgacctcctcacgccgaccttcgtcaacgaaacccagggtctgattggtgctgtggcgcctaacatcactcctcaactcttcaaggagatcggcagcttgctaaataatgccaactccttgctgtccaccgacggcttgcacgagatccagagcctgctgaacaacgccaacgatctgttgactcccgacttcgtcaaggagaccaaggacctgattggcgatgtctcgcccgtcatcacgcccgagctgctgggacaagttggaggccttctgaataacgccaacaagctcctcaccactaagttcgtcgaggaaactcagcacctgattgacagcgtgggaccggccctgaccccggcgctattcaccaatgtcacctacgttctgggcaacgccacccaactgctgacgcccaagttcgtcaacgagacgagagacctgattgacggtgtctcccctgtcatcacacccgacctgcttgtagaggtcggcggtctcctcaacaatgccaatgatctgctcaccaggaagttcgttaatgagacacaggtcctggtcgaggatgcatctgaggtatgttccctaacccttaaatccacaaattaa

SEQ ID NO: 5624 - DNA, 222 bp, A.fumigatus
ggaacatacctcagatgcatcctcgaccaggacctgtgtctcattaacgaacttcctggtgagcagatcattggcattgttgaggagaccgccgacctctacaagcaggtcgggtgtgatgacaggggagacaccgtcaatcaggtctctcgtctcgttgacgaacttgggcgtcagcagttgggtggcgttgcccagaacgtaggtgacattggtgaatag

SEQ ID NO: 5625 - DNA, 315 bp, A.fumigatus
agagagagcgtctcacgtcgcatgatacacggcgctgagtctacgagaagtcgttgcctcttacaagatgaggctgcaatctcgactcggatctccagcgagctcgcatactattacttcgatattatcatgacacaatcaatatctagtcttggcatgaaccttggatttcctttgggctatggactaattataaagacatcaacccactcgacctgtatggcatggtacataacagtcctcaacatgaagatcattaaacatgaagcgcgtgattacctcccatatatgtcaaaaaagagaaaacttcaataa

SEQ ID NO: 5626 - DNA, 285 bp, A.fumigatus
gaagacctatcgtccaactggtgttcgacagcccaactgtttgatccagaaaccatgtcacctcctaccagcgagaaaccgggcagcgtgcaaaatatcgaggatgtcggccagcgcgccctcgacaacatcgactatgacgaggaatactcgtacgaagagcagcgcaagatcatccaccgcattgaccggcggctggtcaccatgacaggtcttgcatactgcatctcgctgatggacaggacgaatctcagtatggctgctgtggccgggtatggaccgtga

SEQ ID NO: 5627 - DNA, 654 bp, A.fumigatus
gcccttcagtctaattcgcttcctcaccccggccctcgacccgaagatttggggcttcgcaatgattttcctgtaagtccgcgcgcgtcaacaacgaccaccaccactgaccgtcgcagctgcaccaccaccgtcacctacgccatcgcatacttcctgcccattatcctccagcaaggcatgggctacagcgtcggcgcctcgcaatgccttgtcgcacctcccttcgtcttcgccggcatcgtcatgttctcctctgcctgggtcggcgacaagtaccgcgtgcggggcgttctcgtcgccgtcaactccatcctgtgcctgatcggcctgcccatcctgggcttccactcgaacaacgctgtccgctactttggcgtcttcctcgccacggccggcgccaacgccaacatccccgcgatcatggcctaccaggccaacaatgtccgcggtcagtggactagagcgctctccagcgcgacgctggtgggattcggggggattggcggtatcctcagcagtctggtgttccggtctcaggatgcgccgggctatcggcctggcatgtggacgaccatcgggtgcgtgtctctttccttccttctttttttcacttctgcagcagtactgactgaggtagatgcaatattctga

SEQ ID NO: 5628 - DNA, 222 bp, A.fumigatus
atcaccggcgttattggagtcttgacccttctcctactcgtcgactttcccgatcgcgcacacaagtcctggcgattcctcagtgaaaaggaatgcgcctttgtcgtccggcgcatcaaccgggaccgatccgatgctgatgatgagcccttcagtctaattcgcttcctcaccccggccctcgacccgaagatttggggcttcgcaatgattttcctgtaa

SEQ ID NO: 5629 - DNA, 219 bp, A.fumigatus
tcgtatgtttccctgttcaggtcgagggacatcagcctaaccataagacagggaatgggcttcacgaaagattggaagcaaatgactgtatgtcgtgcgttgctgggtcttctggaagcagggtactttcccggttgtgtatacctgctttccagctggtatgtcagatgtcagtgtcccttcctcgctccggatggccggttctgtgtactgacttga

SEQ ID NO: 5630 - DNA, 426 bp, A.fumigatus
ccgccatgcgcggatccttccggccccgtggtgacgactcgtatgacagatgctcttcgcgcagtcacacggttggccatccaggaagcacgtgcgcgcgaaatccgccaggaactggtcaagagcgagaagctcaagcggcactttgaagagaaccccgaagaactcaagcagctgcgccatgacggcgagcttcgcgcagcgcggattcaaccacatctgaaacacattcccgattatttgatgccgagcaagggaaggaagggcatctccagcgaggacgttgggtttgttggtttcaggaaatcgggagacaatcggattcgcaaagctagagagaagaatcggggtaagggtaaggggcggaaaccctccggcgtgaggaaggtggacccgctcaagacctttaatcggggtcgcaagtga

SEQ ID NO: 5631 - DNA, 957 bp, A.fumigatus
ctccatcctcgcagtgtgctgtgcgaccttcacatcaccatggcacctctctcatcgaggatatttcccgtcgcgatcggtgctctcgccctcacaccactgacctccgcgtggaccctgacatggcgcaactcgaccgccggcgccaccatcatcaatgagaacaaggccgaaaactgcacgcgcatctggcaccagaaaggcctgccgtttgcctgggatccagaggggaaatggtgcatgcacttctacaaggacgcggcatgcacccaaatcgccggctacgcctgtgacggcaaggtctggcgccaggacgcctcgcgcgatctccccgcctttgacgtcttccccatgccccccgagtccgtcagcgtcattttcccgtcgacctcctcgacagcaaccactcccacctccaccgccgtaaccaccacagcatcccagtccccgtcagccgcctccgcagccgcatcgaccgcgcccaccacatccccaaccccgtccccctcccccgcctcgtcctcctccaccctctccgggggcgccatcgctggaatcgtcatcggcgccatcgccgccgtcggtctcatcgccgccctcttcttcttcttcggaagacgcaaccgcaagccagcccagcccgcggagcccgacccgcggtcgaccaccccgccaaccccgcaattcccgccgggttcgccactcggcctcgtctcgacgaacgataccgcggcggcccccgcgccagcttacatcgtcccgaacaagcgggaactcgccgaggcggagatgtcccaggcgtatgcgcatgggtacgggcatccacgggcgtacgccggcgccaagttcgtcgagttacccggcaacggggcggaggcggaactgagcaatagccgacaggtgcacgagatggatggaacgagtgatatcaagcggccgatttatgaggcggcttga

SEQ ID NO: 5632 - DNA, 459 bp, A.fumigatus
ccaccacagcatcccagtccccgtcagccgcctccgcagccgcatcgaccgcgcccaccacatccccaaccccgtccccctcccccgcctcgtcctcctccaccctctccgggggcgccatcgctggaatcgtcatcggcgccatcgccgccgtcggtctcatcgccgccctcttcttcttcttcggaagacgcaaccgcaagccagcccagcccgcggagcccgacccgcggtcgaccaccccgccaaccccgcaattcccgccgggttcgccactcggcctcgtctcgacgaacgataccgcggcggcccccgcgccagcttacatcgtcccgaacaagcgggaactcgccgaggcggagatgtcccaggcgtatgcgcatgggtacgggcatccacgggcgtacgccggcgccaagttcgtcgagttacccggcaacggggcggaggcggaactga

SEQ ID NO: 5633 - DNA, 405 bp, A.fumigatus
ctcgacgaacttggcgccggcgtacgcccgtggatgcccgtacccatgcgcatacgcctgggacatctccgcctcggcgagttcccgcttgttcgggacgatgtaagctggcgcgggggccgccgcggtatcgttcgtcgagacgaggccgagtggcgaacccggcgggaattgcggggttggcggggtggtcgaccgcgggtcgggctccgcgggctgggctggcttgcggttgcgtcttccgaagaagaagaagagggcggcgatgagaccgacggcggcgatggcgccgatgacgattccagcgatggcgcccccggagagggtggaggaggacgaggcgggggagggggacggggttggggatgtggtgggcgcggtcgatgcggctgcggaggcggctga

SEQ ID NO: 5634 - DNA, 321 bp, A.fumigatus
agacttccgattgcgatgaccatccgtgcttcgaatacatatgaggaacgtgctcttgggctatatccctctaatgaggatgagctggatgagaataatggaattaactacgtgacgacgcatatgcgcaatcaactcagctttgatctttggtatatatttattgggattttctgtatctgtgccaccgaggcacggaggatcatggacccttcggaacctgtcggtttccagccttgtttcggttttagggctcgcaccactgacttcttgcagggcttcagcgtgtttgcaatattctttgaggttgtctctgcatag

SEQ ID NO: 5635 - DNA, 297 bp, A.fumigatus
gtacagtatctagtcctttccttccgaggatgtctgacgcgttgcagtggaaatgttggtctcagtctaggataccccaatgtgaccacctcattttgtggacaatttagcgtctttagcaaaatcgtcatctgtgccatgatgatacgaggacgccatcgtggactgcctgttcaactcgaccgcgcgatactgcttcctggtgaacgcattgcgggagatgacggacttgatgagtcttttgctgcacgtcaatctcaaacactgaacagttttagacgctaccatacaaaatag

SEQ ID NO: 5636 - DNA, 210 bp, A.fumigatus
gagggaaatgcgtcgaaatcggttggtttcgaacacgaacggttgtatataactctaccagtgtcgaccgccggtgcatatgatagatcgaaggcctataccagagatatcaccaacatcaatccaatattaattcagactactcgcttggagatgccattcctcgattatacttccataacgctcactattttgtatggtagcgtctaa

SEQ ID NO: 5637 - DNA, 222 bp, A.fumigatus
aagaaaggactagaccgaccccctgcgcaggggaatcagggtgatcctatcctggccaaccaatggagagtgaaagacatactactcggccatcgccggcatcgacttgccggttactgttgccaccctcgcgcctcagctagtctaggtacgggtgcggctaccttagggacggacaccaccaactggcagtggcctagttgggcaagagcacggagttga

SEQ ID NO: 5638 - DNA, 2184 bp, A.fumigatus
  unsure (2032),(2070),(2115): Identity of nucleotide sequences at the above locations are unknown.
ccatgggctaccccgcgagcagcagaactcccattctatacgaaagagaaaaaaagttggcaagtggagaacctgccgaagatggttgatgcaggcatcatcatcgagtgcatgtctccatggagtgcacgtaccaagttcccaaggaagacctcaggaaaactgcggatggtacacaatttcatgccgataaacgcagccaccataaagatgaattatccactacggagaatagagccagtcattgcaaatctctcgaaaaagcgatggaaggtgttcttcaaagtagatgcggctaatggatattgggcagtaccgctggccattgagcattcattcaaaacagggttcaactcaatcctgggccaattctgttatttgcgtatgggacaggggcttacgggagctccagggacttactctaaactaaaggatctagcaatgggagcaatacctgaaccatcgtccgaagccgcactcacatcgcttccaggagtgggtttcgaatactttatggacgatgacgctgccgcaaccgagaatatgaacaatatggtttccttcctacaccagcattacttcccccgactagcttgggcaggattgacccttaatcctgctaagagcgtcttcttcactgacgagatcgaaattcttggtcaccaatgtacccataatggacttcggccgtccataacgaaactcgaagcgctccgggcgtggccggaaccaacaaatgaggaagaattgatgaggtttatttatctgctgccgttcttgaaggtatacatcccagggagggcggattacacggccatccttaagaaggctctcaaatatacggggaagggcaagactaagcgacttgagtcattcaaatggggtgaggaacaacggaaagtgttccagatattgaagagatatcttctagaggtgaagctctctggaggagatcccaagttgcaatatcaccttagcaccgatgcttctaatgggggcctaggcggagtactcttccagatgacagaacatccagttggaaccaaatcatcgcgaaaaactcatccatacgaagtcccagtgatgtatctgtcctttgcgctttcagaccctgaaacccattacaccacgacagaaaaggaagtactggcagtccttaggggtttggaggaaacaaggtggcttatattaggatcaccctatccagttattgtctacaccgatcatactgcagttaagtctgttacgggggagcattcggaagcaacaggtcgattagctcggtggcattaccgactgcaggaataccaagtcgactacgttcatgtgccaggaaagcttcaagtggtggccgatggactatcccggattccttactggaaatcgaccaccccaggaactgaagaggacggcttcccattgctttcgttcgcgaacatggaagattgtcaaccacagcccagtataactcccaaggaaacccatgaagaattgtacctgccatacctacaggatacctggtataagcagacagttgaagaactcctaaaaggaaggattgacaagcgattcagcctgattaatgtcgagggagaatatctcttggcatatcacgaagctaacgggaaatggtcgcaatgcgtactgcaatctcagctccaaggagtcttatgtctgctccacgacgtgcatggacattttgcggcgaggatttccctagggcgagcaattggtcgatactactggccgtgccgttaccagaccttggtggagtactgcaggagttgtccacaatgtcaagtagtcggtctcaaacctccgaagggggaccccagggcggtgatctccctggagccgttacaattgtttgctatggactatattggaccaatcacgccaacatcccggatgggagctaggtacattttggtgggagcggattacttttcaaaatatgtgttcgcacacactgcaaccgcagccactacgcaagtgtcagtccatttccttaaacatgatgtgggaaaacacntttcgattaccgcaataccctgtacaccgaacaacggnaaggcactttaccggagaagggatcacccactacttgagaaattntggggggtcaggcacgtaaccggcccttgtacaagccccgtggtctggcggttttatagaacggaatag

SEQ ID NO: 5639 - DNA, 1452 bp, A.fumigatus
tcaggcaatccctacgccgcaaattacattacattaccatacagccgaggcctggggaaatcgaccccaaagaaacggccgagattcccatcgctcacatggggttctatagccgtccatccttatttcctctgttacttcactctctccttgaagtcactattttctttccctctcgtggagcgcaacatgtccgacatcaagcccaaatctccttcaatccctcaatggcagcaacctgccgctgccaccacaaacaccgggaactccacctccacaccatcgccctcctccgatgagactccccgttcagagctcatagagcaagccaaaaagttcttacaggatgactccatacgcgatgcgccgattgatcgcaagatagctttcctagagtccaaaggccttcgaagcgaggaaatagacagtctcctggccatctcgagagagacggactcgagcaccaacctcgcagaggggagcaagtctaccccggattctaccacatcatccaccagcaacgagtcgcaaagtcccaaagaaccatctgcgttatctccaatatcctccgcatcttcgcctaccacccccgctgctccaaccgccaccaagaactccacgccacgagatgtcccacccatcatcacctatcccgaatttctcatgcagcaatccaaacctccaccactggtaactctccgcagcattctctacacactctacggtgctgccggtctaggagcaagcctctacggcgcaagcgaatactttgtcaaaccaatgctcgccaccctcaccagcgcccgtgtcgaactcgcccaaaccgccaacgccaacctgcagaagctcaacgagaaactcgaacagaacgtctctcggatcccgccccatctctccgcaaaggacacaaaacaaaccgagcccgccgactccgaagatgatgagcaggactccgtcacctcggacccaactgagctcttccaccgggatgtcgcaacccagacctcccaggatctggatgtaagcaccctcccgcacaaggcgggctatcaccccgccgacgaggcaacccccgaccccaccgcaacagtgaacacgcatatcaagcggctcgagaacatcacctcgcatctccgcgaagtggcgtcctcggagaaagaatcaggtgcgctggacgactccatgcgtaccaggctgaacgaactacaccattacctcgatggcctgctctacggcagatccagctatagttctgtcactgcgtatggggtatacagcacgcctggcctggagaccacatccggcccttcggtgggcatcagcaaaggccgagaagacgcgatggccagtttccgcgctgacattagaggtgtcaagggcgccttgctgagtgcgaggaacttccccgccagccggggaagaatcggctcaggaattctgtctggaaggtga

SEQ ID NO: 5640 - DNA, 285 bp, A.fumigatus
gagcaagcctctacggcgcaagcgaatactttgtcaaaccaatgctcgccaccctcaccagcgcccgtgtcgaactcgcccaaaccgccaacgccaacctgcagaagctcaacgagaaactcgaacagaacgtctctcggatcccgccccatctctccgcaaaggacacaaaacaaaccgagcccgccgactccgaagatgatgagcaggactccgtcacctcggacccaactgagctcttccaccgggatgtcgcaacccagacctcccaggatctggatgtaa

SEQ ID NO: 5641 - DNA, 354 bp, A.fumigatus
tattgtctcttctcattcaaccggtctggcttacagatgctccccagcacagtccttcatgattattacgcgattctcgggattccccagtccgcggacccggcttccatcaagtcggcatacaaaagattggctctggtcaagcatccagatcgacgaagaaatgagcccaaagcaacagctgaatttcaactagtaagcctgactccgagcttttcctctcttttagaagcctgcgtcgtcactgacgcggttatactcagctcaacgctgcgtatgagcagctccgagatgtcgatagacgtcgagaatatgaccgaatatatgaatcaacaatacgtcaccaaaaaataa

SEQ ID NO: 5642 - DNA, 204 bp, A.fumigatus
ctcaagttcggatccttccagccgctcgtggtgaagacgcagtgccgcagtgtgcaggggattaaaggaggcaaaaggcgtgtagagctccattatcaagtagcgccgcgctttaaggaacaagaagggttgattgtaacctatcatttcactgccccccttcctctattttatttgaaattctacaccaaggcagataattga

SEQ ID NO: 5643 - DNA, 261 bp, A.fumigatus
ggtgcagcgttggggcgcgttgctccttttagcgccttccagccgggcaatttctgcctccttgtgctttcaaaaaacccctcgctgttaaacgtcgcaaaagggcgggtgtttaattcaaccatttctccttccggaaaattaaaacccctcccaaaatcctttcaacccgggagcccccttcccctaacaaaaaaggtgcaaatccctttccttttaaacccctttaaaaatttcccgttccccccttccaatttctct

SEQ ID NO: 5644 - DNA, 1050 bp, A.fumigatus
aaggagcaacgcgccccaacgctgcacctcatcgagaggcataagaatcttctttcggagcgagaggccctggccgcatcgagtcaagatgcctcacgtctcatggcgcgaggcaacaaaggagagaggcgcgatcctggtaagctcttgagggaggagaagatgaggaagaggatcgcaaaagagttgcccaaagtcgaagcagaccttagaaaagaattggaaagatgggaggaggagtatggcaggccattccttgtccacggcgagagatatcttgatgaactcaccccagtcattgccaaacctcctccacgctccaagacaccctccgctccaccgtccgcgaattcgaaagcaggctttggaaggccacaaccgccttctcgtccggcaagtgtcatgagagggccacctcctcctcgctccgccaccagaacgcccactggaaacggccagacgaaatacaacactatcggcccatctagggctggcgcgaagtcaccctcgaagatcccagcccgggtgcccctgagtaacatgccttacgggaacaattccgctggccatcgcgcagcaccgggttcttattcttccagtaccatgggaaaagttccagcaccacgtgctcccccacctaggatgcgtgctttaacgatagactccaaagaggacagagggccctattcaatggatcccccgagatgtgctagcgcgatgtctaatgccttcgttcggcctgtcagccctgaggacgtttatgacgatcgcaatcagcgatcgttcatgagctcctctgttttctcacagcgatctaccggcttctctcagtgctctcagtcctcagcctcgtcaatatcatccgttccgaatttcccacgaccaaatccttacctgcaacatgcacctcctccaccggcacctagacaggtttcaaactcctcaaccgtggacacagcaaacacagggtctgaaaactgggaaacatttgatgatgggtccgagtccgaagccgatgttttcacgccggggctggaaggcaacgcgtgc

SEQ ID NO: 5645 - DNA, 531 bp, A.fumigatus
ttgaaggaagtccaaacccgcctccgcgccgaaatcctctcgacaaacaccacaacgccaacctccgaagttgtcaacgccctcccctatctcacagccgtcgtctacgagcttctgcgtctctaccctcccgtctcgcagctcatcaaccgcgtcacggtccgccccgccatgctcggtaacgagatccccattcctgcaggcacgtttgtcggctggaatgcatacggagtgcacgtcaacccggcgatctggggtcccgacgcaaacgaattcaagccggagcgatggggccggacggtgggtgagatgcatgcgcggtttcgccgggagacggtgcgcggcacgtatatccctttcaatgcgcattcgaggaagtgtctcgggcaggggtttgtgttgctgcaaatgaagattctgctgtttgaggtactgagacggatcgaatggacggtggacccgggctatcggttgaagatgacgccagtaagttattttctggaatccgggaggaagagtactgatgcatga

SEQ ID NO: 5646 - DNA, 825 bp, A.fumigatus
ggtgtgaaaatgcttcatttaccaagcttcgtttcgaacagatacatcaagacgatgcgcgactatgccgccgagattgtcgctaaacgtcgcgctgctccgaccgagaagaaggacatgcttcatgctattatgcacggcacggacccccagaccggcaaagccctcacggagagccagtacctggacgagatcatcaacctcttcattggaagcgccacggctgccaatctcgtctcctttgcgttgtactatctcatgaagaacccgcacgaaatcgcccgcgctcgcgaggagatcgatgccgtggttggcggcccgaccgcccagctcgagcatgagcatctcgcccgcctgccttactgcgaagccatcctgcgtgagtcgctgcgtctgtcggctaccgcgccaggcttcaacatcgagcccattccagatctggagcagcccgtcctcctcgcaggtggcgagtaccaggtccccaataagcagccgctcattgcactgctggcggccgtcaaccgagacccggaggtctttgaggaccccgatgcgttcaagcccgagcgtatggtcggcgagaagtacgacaggcttccatccggcgtgaagaagggtttcggcaacggcaagcgtgagtgcttcggaaagcgctacgcctgggaatggtcgtttatgatttttgtcacaatcatgaaggacgtagactttgtgctcgccgataaaaattacaagacggaagttggaggagtcaattacaacggagcgttcagcaccaagccgttggggttgtttgcgttgacgggacctcgacagagtgtgtga

SEQ ID NO: 5647 - DNA, 1275 bp, A.fumigatus
ggactgcactctcgtgtccctgtagtcgtggatctcggattctcacctagaaaaatagacacctatcgttcggtgctggagatgtttctccgacttgttccggacgctgtgacctgctctctctcctgcccggatgaaatcatccaatggttgaatactacaaagggaagcatcaaaacgattgcaacatggcatcaatcgactccattgggaatagatgtgtctcaaaccgcacacatccccgtcgagaaagcaatccaatctgggtttgactgcattcgcataactggcgagtcgttctcaattgaagacaacctggcctgcgttgcccttcgtcaaagactgatacagaactcaaccatcccagttattgcttacaacactggactgtccggtcgagcatccatatgcctgaaccctactctgtcaccggtggtcccctcttccatgaacgccacaggcgtcaccctctcagacgcacaaaaagccctcacatcctgctttctgaccaccaagatgcggttcacactggtcggccaagcactagaacatactctctcccccgcaatgcacgtcgcagcgtacgcggcctgcgggctgccacatagctacgaagctgtgcaagcagcgacgctctccgaaatacgcacgctcctcgaggacggtagccgcagcggcgtagcgatctccatcccttacaaaaccgccgtcctaccactgttggacgagatcagtccggatgcccggaacatcaatgccgtcaacaccgtagttctcaagcggcaccgtcacgatggacaagtggtcaccacgcgaaaagggtataatactgactacatcggagtgaggaattgcatccaccagcatctttctccagcaaacgccatccgggatggaacaaccgttttgattattggggcgggcggcatggcacgcgcggctatctatgcctgctacaagatgggtgtccggcaattttgcatttataaccgtacacttgagaacgctaggaagctagcagagtatttccatcgttggattcatcagtctggcaccaatcttgagtttgaagtcattgaatcgatagaaacgcagtggcatacacgcttccgcctaccgactatagtcatttcttgcctccctggtcagcaggtgggatgtggggagatggttgatgtccgaatatccgaacggtggctgcagagtaccactggaggggtattcctcgaggtatggctttttcttgtcttttgggcgtttgtcggatttggctga

SEQ ID NO: 5648 - DNA, 195 bp, A.fumigatus
agagtgtatacgagactaaagtcaagcaagacattcccctcgaccctgaccactacatacctctttgtaggtacccattccttgcagacgtgggtattcgttctaactgtctgcagcggcggaccaaagcatgaacgaaacggccacacaagaggacattgctcgtttgatacaatcgatccggttacgagatga

SEQ ID NO: 5649 - DNA, 300 bp, A.fumigatus
cccccttccatagacatgtctctgcatacatcctaccatgcggactccgacgcggatgatgagtacgaacggagtgtgattacctcccctcatctagcgaccgattctgaggcttctccctccgactccgaattcccttcagccgaacacactcctaggacatttgcaaatcccgaggaagatcctcgatcgccgaagactatcattacagagtggaccgctgaggagtgcgcaaactggcttgctgcccttggtctccgtcagtactgcgcaacttttcttggtacgttggccgcctaa

SEQ ID NO: 5650 - DNA, 342 bp, A.fumigatus
agttcacttctattaactgtcaaagaacccaagtctcgatgtcggatcggcgtaaaccgctcactcgcgctcacttacatccagcgaaaagaattgcgcagagcgctgactccatttccttttcaccgttcattaggctgcattacctgcaaggcaaagagactaaaatgtgacgagtcgaagccgacctgtctccaatgcaggaagcgcaacgtggagtgtggaggctacaaaaaagactttaaatggcgtccattcgaagaaaccaacgtgatcagcaggatttcttctattcaagccaggaagagtaagtgtacaggtcttcaaggcctgcatttgtag

SEQ ID NO: 5651 - DNA, 1179 bp, A.fumigatus
aatctctcaggtgatccagccagatcaggcaaagaaaggagggccagtcattcagtgcaggcgggcaaggatcgtcagccttggccggttagccctcgatcgcccacaccgacagcatcctctctggattcgaatgatgctgcactcattcatacactccagtcaggcatttcgccttccactgactcaccacttgcattgacccaggaaaacctcacatcctggaacagtggcatagctcggtttctggatttcagtaatgcagaggatgaactcctcacgccattattcacaaatagttcgccgccggaacaatctccacagctctccgatattgtaccctccgctctggatatccatacgagcccaatgcggaggccactggggatggcatcacagaacactcttcgaccgggcaacttgagctttgcagcactccttgaagaggacaatgataaaatcgaagaaattgcccgccagtctgacaagcctattgatccgtggctggtaggagtttcagatggcggggcgccgtccgagacatcgaatacccctgctatgctaaccaaggagcccaatttcgatattgccagtcccgaaatgttagcactgcagtttgacaggttcacttgcgggatcttgtctgtcaaggatgggttaaacgaaaacccttggaggactctgatatggcctctcgccggagagactccagccttgtaccatgcgatattctctatgacggctttccattcaagcaaggacaatccgggtctgagaatgcacggcgttgatcatatgagaagaagcattacttacatggtccaagatatacagaacatgcggacagatgctgccttagctacgagcttggcgctggcattcgcagacacatgggaccagaacaccaggaactgtatccagcatgtacgtggggccaaggcactcgtattgcaggtcctgaagtccaaggctcgggatgcaaacgacatcgagcgaatccggtttctatacaacacctggttgtatatggacgcaatcgcacgcttaacctctcgagacgacgatggagatcaggatatgaacttctccatcttccagctgccccgggatgcagttcatgagattgaccctttgatgggctgcgccactacactctttccactcatcaaccaggtcgcc

SEQ ID NO: 5652 - DNA, 249 bp, A.fumigatus
attatcaagatgaagtacagcggtacctggcatggactacctgcaagtaagctatatggagaggtgaaggatgttggactccttaccttacctataggtattgtagttactgaggcattggcgcctggttcacacacaatcatgcctggaattgtttgtgctattccctgcgaccataaggtatgcgttaagctatatggcagtctatgtactccatacagcaaggtagcaaggcacctacctacctag

SEQ ID NO: 5653 - DNA, 351 bp, A.fumigatus
cactcttctcatgacaaagcacaccggacattgatcacacggaaactcaagggtctcgaggatatcatctcgtttacatcagttcactggcatttgggcgaaaatggtatggtttcagaattgagggctctagagaacgaagctaatgtcttctgctggaaaggctggcgatttgcaacagccgacgaagaggttgcaggagagaatgtcaccccagacccgttgcatcctgatttcacgcatctgcgcgctatatacttctccaatgatccggattatactgggagatttaccgtcccagtgctgttcgataaaaagacgcaacggatcgtgagtaatgaagtatgttga

SEQ ID NO: 5654 - DNA, 588 bp, A.fumigatus
acatttaaacagagctctgagatcattcgcatgttctactacgaattcgatgatcttcttccggaaaaatacaggaacgtcgacctgtaccctcccgctctccgaagcgagatcgacgccaccaacgactggacctacaacgacgtcaacaatggggtctacaagtccggtttcgcgacgacccaagaagcatacgagaaggctgtgacaaccctcttcgcctccctcgacaggatcgaagcccatctctcaaaggacgccaactccccgtacttcttcggctcatctatcaccgaggtcgatatccgacttttcacgactattatccgctttgaccccgtctacgtgcagcacttcaagtgcaacatccgtgatattcgctccggatacccggccattcatcgctgggtgcgtcgcctttactgggatgttcctgcgttccgggagacgacgaattttgagcacattaagaaacactataccaagagtcataagcagatcaatcagtttgctattactcctgtcgggccggtcccagatattcttcctaaagacgaacaagtgagagccgttgctgcacaacagtaa

SEQ ID NO: 5655 - DNA, 267 bp, A.fumigatus
  unsure (5),(6),(7),(8),(9),(10),(11),(12),(13),(14),(15),(19),(20),(35): Identity of nucleotide sequences at the above locations are unknown.
ctgannnnnnnnnnnttgnnatcctacaccaccantgcaggcaaaattaccgattgggtagaccccaaagacaagtctggtgaattcaagcggcagcaatcggttttccgcaacttcatctccagggagcctggcgctcaattccctccggagaaagatcgctatcatctttatgtctcatatgcctgtccttggggtgcgcgttctcttgaagactcctttgattgctcaaactcaagacacatacggctaacactcttctcatga

SEQ ID NO: 5656 - DNA, 750 bp, A.fumigatus
  unsure (26): Identity of nucleotide sequences at the above locations are unknown.
actattttatacaaccaattcttttnttcgtccgacagacacacaaaggacccctcggtaggttgccggttattgaccccgcaaaccacctctcggcgacaagcccgccgcaagatgccgctgcgcaatatccttcacaagaaggacaagatcaacgactcaggcagtcagtatccgccggatggaccctcaaatgctgttcccgagattaaattcattcggtccgatacaatttcgcatgaggttattgacccatcgagctttggcggtgacgtcagtgagcacaaaggcgatcatggtcaatcagatctcctagaaccgtcgcgaccatcttcctcgacacatcgaagatcattgaacatattcagtcgctcgaggtccccgtctgagtcttcagaaccagcttcgccgagtcgaccgcgcggggaacaccggctatcgcaattgctgcatcgcgatcggggctcacggagtgctagctcgagctcagtcaatatcccgtccgatcttccacagatctcggacgataaagtcgacgagcaagaaagggaagcacaatgggagaagcgcgcgacgattctggcgcaacaaagcccgctttttggatcgccggcagcatcgcttcgttcttcgccgaataggcttgagacgaatagtgccggaggagcgcggtcaaggagttccagtcatagtcagatcaatgatccagaaggcgacgtaagtctctgtgcttggttgaaagccatttag

SEQ ID NO: 5657 - DNA, 426 bp, A.fumigatus
tatggagggtttacaaaggtctacttgttttctctgtttttgaagtgtctgactttgaatcgctctcctagacatggttggggctgccctcaagatcccgacaaggccgtgacatatctctcgtacgcagcggcgaattccgcatcaatagagtctcaagcactccaggcaggtatgaaaaagggaggcgctgccaaaggagagcttgtactagccattttcgaactgggaaattgctatcggaatggctggggcgtcaaaaaagacccggtagctgcccgacagtactttgagacagcggccaacctaggcgatacagatgcgatgaacgaagtcgcatggtgctatcttgaaggctttgggggcaaaaaggacaaggtacgctattatttgactcccaactgcccgtccgggagagctcggtga

SEQ ID NO: 5658 - DNA, 585 bp, A.fumigatus
  unsure (501),(562): Identity of nucleotide sequences at the above locations are unknown.
actttagtatgggaggaacatggtacgtccagttcgacatcctctcttcgcgttcgtcgaaaaccatatctgttgatgaggtgctcctcggcttcgtcctcatcttcctcctcgtccgaagaatcaagttccatgtcgaagcctccttcatcctcgtcctcctcttcgttctcgtcctcttcttcatcttcgccttcgtcttctgttgccacatcggagccatcctcactcacaaccgctgcatcaccgtgctcaatggagtccccatcttcaacgcccgacctgccgttagtggggctcgtccgccgttctctcgcgttggaggttcgtgagtctccattcaaagaggtacccaaagtcacaaggtgcacgtcttggattggctcctcctcaacgctgccgtcaatatcctcttgtaatctctcttgcggaaacgcactgtccgagttatcttcgatttccgtgcgtagcccaccaaaagcccggtttacaaaggcatanttgactcccgtaaccgtctccatcaagatgcctcgacctaccctgaagaaccagaacctanttgccgaaagcccggtcaagaga

SEQ ID NO: 5659 - DNA, 930 bp, A.fumigatus
  unsure (23),(84): Identity of nucleotide sequences at the above locations are unknown.
ctcttgaccgggctttcggcaantaggttctggttcttcagggtaggtcgaggcatcttgatggagacggttacgggagtcaantatgcctttgtaaaccgggcttttggtgggctacgcacggaaatcgaagataactcggacagtgcgtttccgcaagagagattacaagaggatattgacggcagcgttgaggaggagccaatccaagacgtgcaccttgtgactttgggtacctctttgaatggagactcacgaacctccaacgcgagagaacggcggacgagccccactaacggcaggtcgggcgttgaagatggggactccattgagcacggtgatgcagcggttgtgagtgaggatggctccgatgtggcaacagaagacgaaggcgaagatgaagaagaggacgagaacgaagaggaggacgaggatgaaggaggcttcgacatggaacttgattcttcggacgaggaggaagatgaggacgaagccgaggagcacctcatcaacagatatggttttcgacgaacgcgaagagaggatgtcgaactggacgtaccatgttcctcccatactaaagtctatcgggggcattgcaatatcaaaacggtcaaagacgtcaattactttgggctgaatgatgagtacgtcgtaagcggcagtgactcgggccatatattcatctgggatcggaaaacaacgaacctggtcaacatactcgaggcagatagcgaggttgtcaacgttgtgcaaggtatgtccattctgaccacatatacgacattagctcatacttgtttcttaaggacacccgtacgaaccgaccatcgccgcttctgggatcgacaacaccatcaagatcttctcacccgatcgccatgcacaggacaatgcacgccgtggtatcaacatcctagaccccgataa

SEQ ID NO: 5660 - DNA, 348 bp, A.fumigatus
ggacacccgtacgaaccgaccatcgccgcttctgggatcgacaacaccatcaagatcttctcacccgatcgccatgcacaggacaatgcacgccgtggtatcaacatcctagaccccgataacccagctaatacgcttggttcaaatgttgccagtattggcggcctcaaaagttgcaaacgcatccatgatagctaccggatcatgagccagaacgacgtcgatcgtcaaggaggcatgagtgaggcgtacatcacggtaagtcatgggctccttcgttcttgggattttatccttccttcatattctgactccggaatcttcagaggagtatgctggctcggttag

SEQ ID NO: 5661 - DNA, 222 bp, A.fumigatus
ccaacatctctgtctagtttcaattctacgtactacggcaaggactaccgcgccggtgcggctctccttcgcgctcgtcgtccgtatcttttcaagaatgctcttactggactcggtctcgtcgctttcacaatcagtgtctgtatgtgctccacagggacccctccttcttcatgtttcagagatgaaagcacggcgagaagcatggttcgctcatactga

SEQ ID NO: 5662 - DNA, 279 bp, A.fumigatus
agacctaggtataaaatgtcttattacaatttcaactctctcttcccgtcgggccaagctgtcgaccgcgtccgtgggtcaaaacttcccacagaaggccctcagctctctacactcgaagaagctttcacgagcgagaactggatcattcgtatctacaaggtcaaggatcttgacaaccttggccgagaccacaaccaggctgttgccttcgacaaaggtctcaagaaaaagcggagtacaaagaggaagggacctcgggttctcaggaccgaatag

SEQ ID NO: 5663 - DNA, 204 bp, A.fumigatus
actagcagtgggagaggttcctcgcagcacccatacaaagagctctcgggtcggccaaactcggcatccgctgacggacatccaagaaaagcgccaatcctcgtcatctctgttatctactactacttctattctattagcgtcatcaccatcgtcttcgtcttcttcaagacatcatatccgattcaattaaacgccaaatag

SEQ ID NO: 5664 - DNA, 1176 bp, A.fumigatus
cactatctccctgtagtttatccctgcgagtatgacacaggtcgtcccaagcctgcgccttcggggcgatacgttcttcgattttatttcaatggatgcttcaggaaggtggtcatcgatgaccgcttgccatcgtcgaaaacctcaaggtcactttacgttgttgatagaaataaccccaattttctgtggccggcgcttgtggaaaaggcgtacctaaagctaagaggaggctatgactttcccgggagcaattcgggaacagacctgtgggtactgacaggttggatacctgaacaagtcttcctacatcatgaggatgtgaccagcgatcaaatttggcggcgtctctttagatcctttcaatatggcgatgtcttattgactatcggcactgggaaattaaccgagaaagaagaggaagaactgggcttggtcagtgagcatgactatgcggtccttgatatgaaagagttcaatggccgtcggcaaatgttagtgaagaacccatgggctggagtccacacggctagtggaaggacggagaattccctcgagtcacacgcgccacatgatcgatcgtcactttctcctgggacgttttggatggactgcgaaatggtcttccagaactttgaaaacctctacctgaattggaaccccagcctcttcaaataccgccaagatatacattttacatgggacctcacggcgggaaagggggttccgggctgctttgtgaagaatccccagtttgcagtaacctctgaaacgggaggtactgtctggctgctcctcggcaagcatttcaaaacgcgtgatcgactcgactattcttcatctgaggactcccaggctgggtttattagcatttacgtattcaatgcggatggtaagcgggtttgtcttagtgatggtgcgcttcatcgaggtccctacgtcgactcacccaacaccctgatgagactggaaatgcttccgagaacaacttatacggcagttgtctctgaagagtcgctgcctgctttgagtcagaatttcacactatccgctctctcaatctcccctgtgcatatcgcgccgtcacagaatcaatatacctgtgggaataaagtccagggtttctggatgccctcgacggctggcggcaatgcagaatcagctcgatacccctaa

SEQ ID NO: 5665 - DNA, 306 bp, A.fumigatus
aataaaatcgaagaacgtatcgccccgaaggcgcaggcttgggacgacctgtgtcatactcgcagggataaactacagggagatagtgctactttcatgtcagagtttgacacgattcatcaacagtcggagtggtttaccttgtcaaggccacgttccgatcgcgaggttgtagcgcagaggctggcgacaacggagcagtctgtcaagacatcttgcacaagatcggttttctctggtacggacatcatcaatgtgtccccgccggcgtgcgccaacagctctgaaggccgcttccaaccatca

SEQ ID NO: 5666 - DNA, 267 bp, A.fumigatus
  unsure (3),(120): Identity of nucleotide sequences at the above locations are unknown.
gangacataatggtgttgtttgtcgattatgaccatgatgcgttccccagagcccatgagggcacctatcaggcgtatcttcagccggataagcctgcgttgtcgaagttgaaggctgtngactctgatctgccaactcatcatgaaaatgatcattcgatgcacgatcatgcaaagaatgacggctctcataagatagtgaatcgtaatggattttcagctgctttgaattgctatccgtatgccttgctgattgacagtttctga

SEQ ID NO: 5667 - DNA, 942 bp, A.fumigatus
ccccgcgggatggttgacgcccaaagaaagcaatctcacattcaacgcgttgaaggcattcctttcgctcgtctggctaaggccgattttggacagttcatacagacatcgctgagctccacacaatcggaccaggaaagactcatctggcagctggccaacatcttgttcaacgatgagatcgaagatgatatctctgctggggtgccgcctcaactccgctccaagtgcctccaacgcatcaagaaagaccgactcagccgcctatgggagagcattgtgcgcgagagacacgctcatgacctggataagattgaatcttctgaggaacgagctgtccacctattgtgttctcaccgagtcgaagaggcgtgcaaagtcctgattgcgggccaaaatcttcatctggctacattggtctcgcaaatcggtcgagatgctacaaccagatcagacatggcgagacagattgagatgtggcgccagcacaacgtctattccgagatgaccgaaccgatccgagctctgtacgagcttctcgctggcaactccctccgcagtgagggcaagtccggtggcgccttggaggatcgtgcatctacattttccttcactgagcgattcgagctggactggttccaagcatttggtcttcgtttgtggtatggtattgccgatgacgagcctatcgaaaaggccgttctgaaattcgccaaagaattgagcagcggggacgaatctgcgtttccttaccctgcatctcacctggagggagatgttatgtcgcgtgccgcatcggacactctgggtcgggaatctcctctctgggtcctattaaaggtctactcgggtactactgctgctgccaagagttctgatttgccagcaattgaactcccggctgccctgcttcctgagtctgtcacgggtgacaaactctct

SEQ ID NO: 5668 - DNA, 675 bp, A.fumigatus
agaaacactgtgggctcggagccaacctccacctacacaactgacgactcctttgttggatctgtggccggggtcgaggacgacactttcgatttcaagaagcgcaagatggttccgggggcgtttggtaatcaagtaatggaaacaatcggagacaaggacgaggatgagtcttttttaggggacggctccacgggttcaactactgagcaggatggcgacgatgtcaccgagagccagcagtctggcgattcagatgttgaattcgatgaaggtgaggaaatggatatggcgggcacctttcccaaccttgatcataccgtggagcacgacgatgccaacagtctggacagctaccttgacaatacccacccctcgttgaggccttgggaaactccctcaaaggcgcgtctgaaccttagtggcgactgggccgaacagctgcagcggacaattagtccaaggaagcaaaaccgggatgcactacgcgaaatacaagcaaatgcctttacagaccgacctcttcacgacgacacgccgaagaaatctgttaccgactaccgacagaaaggatttgccaccagcatcgatctgatgaactctttgttccatcagccgcgtaagccgcaggggcaatctcctctcaaggcgcagccgaaatgttttgaggtttga

SEQ ID NO: 5669 - DNA, 186 bp, A.fumigatus
atatatgcactagacaatagacttttattttcgcctgctggtattacttatcgccacaatttctacaaggactataaaccccttgtatactgtatagtagagttaccgagtatccctggtagggatatctatattagtactatagtgttagttgatattattactctgtacttattcaatatgtag

SEQ ID NO: 5670 - DNA, 330 bp, A.fumigatus
tatcagactactgacgccaactccagcgccaaggtcttcaaggagaaggtccaagagggctcgggcccagtcattgttgactgctccgcgacatggtgtggcccttgcaagggtatctctccggtcttccagcgcctcagcacctctgaagagttcaagaacgctaagttttacgagatcgacgttgacgaactctctgaggttgctgctgagctgggtgtccgtgctatgcccactttcatgttcttcaaggacggccagaaggttaacgaagttgttggtgccaaccctccggcccttgaggctgctatcaaagcgcacgttgcttag

SEQ ID NO: 5671 - DNA, 417 bp, A.fumigatus
  unsure (399): Identity of nucleotide sequences at the above locations are unknown.
gactatgagctagctgcggccggcgcagcagatacactatcgtgggcagcaggagcaggagcagcggcagagggtgcctcgacggcaggttgcgtggagccctccttctcaaagctccgcatgggatataatccccagcgctctttcatctcgcggtcctcgtccctgccgttgctatccgtcgtctacttcttctccccggtgaagacggcattggcaccggccatgaatcatgcgacctgttgttcatccgatagcgagatgcggccggcggcgatgcggacgatggtggccggcatgaagataccagcggtggcaatggtgcgcacacatatgttcaaagggaatatcttgcgggtcgcgaacggggtggccctgatgggaacgaaggctttgacngggaactcaatccgggtg

SEQ ID NO: 5672 - DNA, 189 bp, A.fumigatus
  unsure (21): Identity of nucleotide sequences at the above locations are unknown.
ttcacccggattgagttcccngtcaaagccttcgttcccatcagggccaccccgttcgcgacccgcaagatattccctttgaacatatgtgtgcgcaccattgccaccgctggtatcttcatgccggccaccatcgtccgcatcgccgccggccgcatctcgctatcggatgaacaacaggtcgcatga

SEQ ID NO: 5673 - DNA, 183 bp, A.fumigatus
acgacggatagcaacggcagggacgaggaccgcgagatgaaagagcgctggggattatatcccatgcggagctttgagaaggagggctccacgcaacctgccgtcgaggcaccctctgccgctgctcctgctcctgctgcccacgatagtgtatctgctgcgccggccgcagctagctcatag

SEQ ID NO: 5674 - DNA, 399 bp, A.fumigatus
  unsure (291): Identity of nucleotide sequences at the above locations are unknown.
gtaccaatgtttctaggaactgaaacgggaattctcaaaatggtctacagtcagctatgccatctccatcttggggattttgggctcggttccagcaacctttggagctcctctggctgcaggaggaccagctactgcggtctggtgttggtttctgggctcatgcatggccatgtgcataggcagttcggtagcggagctggtctctgcgtatcctaccgcaggaggaatgtacttcgttacaaagcacgttgttccaatgaccaggtgcccatcttttcctgggtgcanggctggtgcaatctcttggggcagactgcgggcgtttccagcgtggcttacacagtcagccagatgctgcttgcgtgcgccagtatgaactctgagtacttctactaa

SEQ ID NO: 5675 - DNA, 363 bp, A.fumigatus
  unsure (275): Identity of nucleotide sequences at the above locations are unknown.
gaactgaaacgggaattctcaaaatggtctacagtcagctatgccatctccatcttggggattttgggctcggttccagcaacctttggagctcctctggctgcaggaggaccagctactgcggtctggtgttggtttctgggctcatgcatggccatgtgcataggcagttcggtagcggagctggtctctgcgtatcctaccgcaggaggaatgtacttcgttacaaagcacgttgttccaatgaccaggtgcccatcttttcctgggtgcanggctggtgcaatctcttggggcagactgcgggcgtttccagcgtggcttacacagtcagccagatgctgcttgcgtgcgccagtatga

SEQ ID NO: 5676 - DNA, 1161 bp, A.fumigatus
agcagcatggcagatccatcaacgtattactctgtcgcccagggacctgcgcctcctgaagacccctccgatcccaatcggatggcccaccaagttacccctccgtctcatcctcctgccggctatggccctggagcggttcctcctcaaccaggagctccctacggggcagcagctccgaatcaatggcccccttacggctcgccatttcctttacagcaacaaccgcagcaacccccgcaactggcctcccctcctccgttcggctacaatgcaggcccgcaggccgggatggtagctcccacagaaccaggtttgggagggctgacacatcaaatgggtggattgggaatctcaggagaaggaggggctcggacacacaagaagaagcatcgacatgcacaccatgatattggcggagcttctgccactgctccggcacaacagccgtttgctggaatggctcagggaggtgtacagccaacatcgcagttcctgaatacgggacttaccgactcttcgcgtcctatttcgccaggtgctggtgttgctcagcccgccggcgtagggtttggagctggagcgagttctggagctggctcagttgcaactcagggcaagattgacccggaacagattccaagcatccctcggtcgcgcgacctgcctgcacagtactatttcaaccacgtctatccgactatggaacggcatcttcctcccccggctgccattccctttgtggcccacgaccaaggcaattcgtcgccgaagtatgctcgacttacgctaaataatattccatctacagctgactttctgtcctctaccggcttgcctctcgggatgatcctgcagccgctggcccgactggatccgggtgagcagccgattcccgttttggattttggagacgctgggcctccgcgatgccgaagatgcagggcatacatcaatccgttcatgacgttcaggtccggagggaacaagttcgtctgcaatatgtgcacgttccccaacgacgtccctccagagtactttgccccgctcgatccgtccggagcgcgtgtggaccgcatgcaacgtccggaactgatgatgggtacagtcgagttcttggttccgtcttcaccacggggctggaaggagccgcgccatgtc

SEQ ID NO: 5677 - DNA, 348 bp, A.fumigatus
tcagtcattgtcccttctctcctctcagtcccacggtatccgcgttatgaagcagcatggcagatccatcaacgtattactctgtcgcccagggacctgcgcctcctgaagacccctccgatcccaatcggatggcccaccaagttacccctccgtctcatcctcctgccggctatggccctggagcggttcctcctcaaccaggagctccctacggggcagcagctccgaatcaatggcccccttacggctcgccatttcctttacagcaacaaccgcagcaacccccgcaactggcctcccctcctccgttcggctacaatgcaggcccgcaggccgggatggtag

SEQ ID NO: 5678 - DNA, 396 bp, A.fumigatus
tgggtacaccttcctgcagcgctggttgcggtcgttcccaaagacaagctgaagatcaatggccctatcaagagcttcgctaagaacggaagctctggaaaggctgttcatcgtatgttctgctcggaatgtggttcgccaattgcccacgacccggacgctgccccagagatcatcgccatcaaggctgggaccctggacatagagatcaagaagaacctaaagccggtgcgtgcattaagaaggcgggctatcggattaaatatgctaactacatacgtccctggtaggatacggaaatctggaccgttagcaagcttcctttctgccaggagcatctggccaagcctttcgagcacatgccccagtagatgggacgaaaaaacgaatctttga

SEQ ID NO: 5679 - DNA, 519 bp, A.fumigatus
caaagtgaaccatacagaaggaccacatcacccctgcctcttatgttagtcggactttcggcgtgtctagcatacgttccagagagtattcctgcatcaaccaaacccgatctttaccaaagcaacagcaatgtgctcgaccgcgcaatcattcgaaccgttgcagcctacgcggttgttttcgggctggtaaactgccatcgaagagggatcccgtttgcacaaccctctcgccacacgtcttacctagagaacttgttccatctggcgggcctggtagatcaaactactggacgcccagatccaacaaagctgtcatgtttccagcgctttgccatgctcaacgcggaccatggcatggctctttctgttttttcagcactagtcacagcatcatctctcaccgaccctatatcgtgtctgataacagcaacaggggcagcatttggcccactgcatttcggtgctaccgagtcagccaaccttgtcttcaccacggggctgcaaggagtgcatctg

SEQ ID NO: 5680 - DNA, 576 bp, A.fumigatus
gccggtatggccgccggagctcccgtacaaggtcatgcaggtggtaagaagaagcgagcatatgctggggaagcctttgaaattggatctggtgccaatgctgctcttgggggacaactccctgctggtggcagttacggtgcatatccccctcagccgcaggctgcgggatatcaacaacctgtatatggggcggatccaagccagatgaatgcagcagctccggggtatactgcccctgttactcctggaatcgcacagatgacccagcaattcggcgcgatgggcgtgaccgacccccacctaatgccaccgcagcctccgcaggccgctgtggccccccaggctccacgtcccgttcccctcaaccagctctatcctacagaccttctcactcaacctttcaatgtcgcggagcttgactaccctccaccgccgatcgttcttccgccaggtgtatgtcactcgcatggtccggtccaagaagtgaaattgctgaccgcttcgttttctagacaagcgtttacccatcccctacagcgaattgccctccgaaatatgttcggtcgaccttga

SEQ ID NO: 5681 - DNA, 1023 bp, A.fumigatus
  unsure (1013),(1019): Identity of nucleotide sequences at the above locations are unknown.
acaagcgtttacccatcccctacagcgaattgccctccgaaatatgttcggtcgaccttgaatgccgtgccgacaacgcattctctcctcaagaaatctaagctgccgtttgcccttgtcattcagccatacgcctccctgcgtgatgcggaagaaccgattccagttattccagaccaggtgatctcgcggtgtcgacgctgccggtcttacatcaatccatttgtgacatttctggaccatggccatcgctggcgctgcaatatgtgcaacctgacaaatgatgtgccacaggcgtttgattgggatgctgctttgcagaagcctgcggaccgctccctgcgacctgatctcaaccacgcggtagtcgaattcgttgctccccaagagtacatggttcgccctcctcagccgctcgtgtatcttttcctgatcgacgtgagttatgcgtccgttacaaatggtcttctggcaactagcgcaaggtgcatcaaagaaagccttgacaggatccccaacgcagaccgtcggactcgattgggtttcattgcagtcgactctagccttcattacttcagtattcccagggacggctcggagaattctgatccaagaatgcttgttatcagcgatctggatgagcctttcctccctattccgggcgaccttctggtgactctgagtgaatgccgcgagaacattgagaccttccttgacaaattacaggaaatgttccaaaacactcagaataatggttgcgccatgggatcggctctgcgggctggctacaagttgattgcaccggtgggagggaagatgaccgtgttgagctcgtctttgcccaatgtcggacatggctccctgaccatgagagaggataagaaagtcctcgggacgagtaaagagagcattcttctacagacggcgaacagcttctacaagagcttcgctgtcgagtgctccaaggcacagatcgtcttcaccacagggggtctaaggaaccggccaagatntacccncact

SEQ ID NO: 5682 - DNA, 567 bp, A.fumigatus
agcatcgacagcatcatagccaacctgggcaaactctccggcggaggcaacgtcaacctgggctggattatcggccgacccatcgtcgcctccgtcgccatggccgtcctcaccccattactcacaaagtacgtttttgcgaggatcttccgacggtatatcgagcacgcctttgcgcagttcgatcatgtctcaaacatcattctgatggtgttggtcctctgcgcgtttattgccatcgcggcgtacgcgggtacctctgtcctttttggggcatttctcgccggcaccttcttgacttacatccccagcaagcatccctctggtccgtttgtggttatgagtcgtgaggagggggaacgcgaagcgcataagagtcccacatttgtccatacctttgaggtgtacctgctggacgtgcagtcctatctgatggagccactattctttgctagcatcgggttcgccattccatttgtgcagctctggacggggacaaggatttggaggggagtggtcttttccctcctgatggtcgctgccaaggtgtgtacttcccagccgtag

SEQ ID NO: 5683 - DNA, 1002 bp, A.fumigatus
ctctccaatattgctgaccacgccattgaccccaggttctactgctgtctcagtagaatgttccttgacggcctcaggcttcgctttgctggtagtctcttcaacctcgtgagcctcgctttgcttttcagtcgcgggtgcgatggtcggctctgcaacatgctcagcaacaggttcagcaataggctcatcaacgggctcaggctcagcagcgggctcagcggcaggctcagtgacaggctcagtgacaggttcagtgacaggctcagtgacaggctcagtgacgggctcagtgacaggctcggcaacaggctcatcaacgggctcgggctcagcggcgggctcagcagcagcaggctcagcggcgggctcatcggcgggctcagcggcaggctcagcgacagactcagcaacaggctcagtaacaggctcagcaacaggctcagcaacaggctcagcaacaggctcggcaacaggctcagcaacaggctcagcaacatgctcatcaacaggctcagcaacaggctcagcaacaggctcggcaacaggctcagcggcaggcttagtgacgggctcagcaacaggctcagcaacaggctcagcaacaggctcagcaacaggctcagcaacaggctcagcaacaggctcagcagcaggcttagtgacgggctcagcaacaggctcagcaacaggctcagcaacaggctcagcaacaggctcagcaacaggctcagcaacaggctcagcaacaggctcggcaacaggctcatcaacgggctcatcaacgggctcatcaacgggctcatcaacgggctcatcaacgggctcatcaacgggctcgggctcagcggcgggctcagcggcaggcttagtgacgggctcagcaacggcttcctgctgttcttcaatcgctgccacatcggcaacttcatcttgagcaggtacctgaatgctggcttccggctcagcacgtacagtcgcctcactggtctgcggctctga

SEQ ID NO: 5684 - DNA, 825 bp, A.fumigatus
gcctcgctttgcttttcagtcgcgggtgcgatggtcggctctgcaacatgctcagcaacaggttcagcaataggctcatcaacgggctcaggctcagcagcgggctcagcggcaggctcagtgacaggctcagtgacaggttcagtgacaggctcagtgacaggctcagtgacgggctcagtgacaggctcggcaacaggctcatcaacgggctcgggctcagcggcgggctcagcagcagcaggctcagcggcgggctcatcggcgggctcagcggcaggctcagcgacagactcagcaacaggctcagtaacaggctcagcaacaggctcagcaacaggctcagcaacaggctcggcaacaggctcagcaacaggctcagcaacatgctcatcaacaggctcagcaacaggctcagcaacaggctcggcaacaggctcagcggcaggcttagtgacgggctcagcaacaggctcagcaacaggctcagcaacaggctcagcaacaggctcagcaacaggctcagcaacaggctcagcagcaggcttagtgacgggctcagcaacaggctcagcaacaggctcagcaacaggctcagcaacaggctcagcaacaggctcagcaacaggctcagcaacaggctcggcaacaggctcatcaacgggctcatcaacgggctcatcaacgggctcatcaacgggctcatcaacgggctcatcaacgggctcgggctcagcggcgggctcagcggcaggcttagtgacgggctcagcaacggcttcctgctgttcttcaatcgctgccacatcggcaacttcatcttga

SEQ ID NO: 5685 - DNA, 207 bp, A.fumigatus
cgggctcagcaacaggctcagcaacaggctcagcaacaggctcagcaacaggctcagcaacaggctcagcaacaggctcagcaacaggctcggcaacaggctcatcaacgggctcatcaacgggctcatcaacgggctcatcaacgggctcatcaacgggctcatcaacgggctcgggctcagcggcgggctcagcggcaggcttag

SEQ ID NO: 5686 - DNA, 1755 bp, A.fumigatus
gaggcaacagagacggtgatggaacccgaagcggtggcaccggttgctgaagaacctgttaaaactgcgatcgctcaagaggacaatattgagaagaagttcgctgaagagacagtctctaaggacgtgacagtagaggaaccctctgtcgctgagaaagtagttccttcggagcccgcgacggaggagcctgtttcagagccgcagaccagtgaggcgactgtacgtgctgagccggaagccagcattcaggtacctgctcaagatgaagttgccgatgtggcagcgattgaagaacagcaggaagccgttgctgagcccgtcactaagcctgccgctgagcccgccgctgagcccgagcccgttgatgagcccgttgatgagcccgttgatgagcccgttgatgagcccgttgatgagcccgttgatgagcctgttgccgagcctgttgctgagcctgttgctgagcctgttgctgagcctgttgctgagcctgttgctgagcctgttgctgagcctgttgctgagcccgtcactaagcctgctgctgagcctgttgctgagcctgttgctgagcctgttgctgagcctgttgctgagcctgttgctgagcctgttgctgagcccgtcactaagcctgccgctgagcctgttgccgagcctgttgctgagcctgttgctgagcctgttgatgagcatgttgctgagcctgttgctgagcctgttgccgagcctgttgctgagcctgttgctgagcctgttgctgagcctgttactgagcctgttgctgagtctgtcgctgagcctgccgctgagcccgccgatgagcccgccgctgagcctgctgctgctgagcccgccgctgagcccgagcccgttgatgagcctgttgccgagcctgtcactgagcccgtcactgagcctgtcactgagcctgtcactgaacctgtcactgagcctgtcactgagcctgccgctgagcccgctgctgagcctgagcccgttgatgagcctattgctgaacctgttgctgagcatgttgcagagccgaccatcgcacccgcgactgaaaagcaaagcgaggctcacgaggttgaagagactaccagcaaagcgaagcctgaggccgtcaaggaacattctactgagacagcagtagaacctggggtcaatggcgtggtcagcaatattggagagctagaccaacctccaattggtggaaaggaggccgctaaggttgaatccgaaccagtagcctccaaggaacccaaggccgaagagccggcccctacttctaatggtgactcttcggttgagaaagacgtcgattcttcctctcagcctgcccctccagttcaggatgccatccccgagcccaccgtggagcccaccaaggacacagaagagaaagactcgattgtgcctcctgagctcgttggagctggtgctgcagctgccatcgctgccggtgctgttgttgctggagtcgtctccaagtctcacaaagagcctgaagtcgttgctacacttaaggacgatgtgaacattaaggaacaatctcggcctaatgacgacaagcaggaaatttcccgcctcgtacctgcaccccagatcgccgaatcctccacttcgaaggagatgcccacgcccgaacctgaaagtgatcctgctctcgtagcacttgctggcgaccgcgaagctttggtcttcaccacaggggcggcaaaatcacgcgccaagcgtctcgcggccatc

SEQ ID NO: 5687 - DNA, 996 bp, A.fumigatus
ttccttcggagcccgcgacggaggagcctgtttcagagccgcagaccagtgaggcgactgtacgtgctgagccggaagccagcattcaggtacctgctcaagatgaagttgccgatgtggcagcgattgaagaacagcaggaagccgttgctgagcccgtcactaagcctgccgctgagcccgccgctgagcccgagcccgttgatgagcccgttgatgagcccgttgatgagcccgttgatgagcccgttgatgagcccgttgatgagcctgttgccgagcctgttgctgagcctgttgctgagcctgttgctgagcctgttgctgagcctgttgctgagcctgttgctgagcctgttgctgagcccgtcactaagcctgctgctgagcctgttgctgagcctgttgctgagcctgttgctgagcctgttgctgagcctgttgctgagcctgttgctgagcccgtcactaagcctgccgctgagcctgttgccgagcctgttgctgagcctgttgctgagcctgttgatgagcatgttgctgagcctgttgctgagcctgttgccgagcctgttgctgagcctgttgctgagcctgttgctgagcctgttactgagcctgttgctgagtctgtcgctgagcctgccgctgagcccgccgatgagcccgccgctgagcctgctgctgctgagcccgccgctgagcccgagcccgttgatgagcctgttgccgagcctgtcactgagcccgtcactgagcctgtcactgagcctgtcactgaacctgtcactgagcctgtcactgagcctgccgctgagcccgctgctgagcctgagcccgttgatgagcctattgctgaacctgttgctgagcatgttgcagagccgaccatcgcacccgcgactgaaaagcaaagcgaggctcacgaggttgaagagactaccagcaaagcgaagcctgaggccgtcaaggaacattctactgagacagcagtag

SEQ ID NO: 5688 - DNA, 786 bp, A.fumigatus
gtattagcaagttacaacaggcgctattgtgctccacgatgcttatgcttagatgagcgtgctctcgacagcagccagagtgccgttctcaagagccccagcgtggtgacgagccaccaatccgcaagcgtattggtacctagttacagtgagtcccatttgaaaaatgtcgaatggagcaacttacttgtccaggtagggcagaacctggtccaggccaggggtgtttctccagtcgcgcatcaggtcggtgacgacgccaaatgtgcccatgagggtgacgccagccttctccatgcgacggttggcatcggccgccagtttgtcgtcaaaggtaccactagcctcggtgttggcgagacctcgtatccttcgtcgatgagcgagagggccaagaaggcggtgcctatctcgttagtctcgttctacctcgacgctggacgtaagacgaagcttacaaacttcagtgacaataccgctgacaatcaattgtttcttgccagtggcctggatggccgcgcggaactcggcattgtcccaggcgttgacctcgccctggcgatgaacaatggtcacattggggttcaaatccacgacttccttgatcgtcagtccattgggacccgcgtcggaggaagtggtcatgacgacagacaggtcaaacaggttgcccaaggcggcgtgggcaagcatgttgttgcggaagtcgttggtgttgaaatcgcggtccagctgggcgagaccgacatggtagtcgatgatgagaacagcctggttgggaattag

SEQ ID NO: 5689 - DNA, 444 bp, A.fumigatus
ctgtcaaagcctggaaccaactggacaaagagaatgcggtattcctttatccctatcctggttgttcagccactaattcccaaccaggctgttctcatcatcgactaccatgtcggtctcgcccagctggaccgcgatttcaacaccaacgacttccgcaacaacatgcttgcccacgccgccttgggcaacctgtttgacctgtctgtcgtcatgaccacttcctccgacgcgggtcccaatggactgacgatcaaggaagtcgtggatttgaaccccaatgtgaccattgttcatcgccagggcgaggtcaacgcctgggacaatgccgagttccgcgcggccatccaggccactggcaagaaacaattgattgtcagcggtattgtcactgaagtttgtaagcttcgtcttacgtccagcgtcgaggtagaacgagactaa

SEQ ID NO: 5690 - DNA, 231 bp, A.fumigatus
cgagataggcaccgccttcttggccctctcgctcatcgacgaaggatacgaggtctcgccaacaccgaggctagtggtacctttgacgacaaactggcggccgatgccaaccgtcgcatggagaaggctggcgtcaccctcatgggcacatttggcgtcgtcaccgacctgatgcgcgactggagaaacacccctggcctggaccaggttctgccctacctggacaagtaa

SEQ ID NO: 5691 - DNA, 189 bp, A.fumigatus
cgacaaactggcggccgatgccaaccgtcgcatggagaaggctggcgtcaccctcatgggcacatttggcgtcgtcaccgacctgatgcgcgactggagaaacacccctggcctggaccaggttctgccctacctggacaagtaagttgctccattcgacatttttcaaatgggactcactgtaactag

SEQ ID NO: 5692 - DNA, 441 bp, A.fumigatus
cagcttgagcacaggactcccatccacaggcttgaagctgacgctcgtacgctcagggacgactgttcccggggccacgccctgcgtgtacccgattgcgcagaggatacggccccagtttgcgtcgcggccgtagagggcggtcttgacgagcggggaccgagcgatggtggacgcgatgagacgggcggactcgtagtccggggagttctggacgcggacggtgacgaacttggtggcgccttcgccgtcgcggacgacgagctgcgagagcgactgcgcgaacgaggtgaggatttcctgcatggcggtgtagtcgtccgaggcgggggaactgatgggggcaccgccggcggcgccgttggcaaggatggcgaccgtgtcgtttgtgcttgtgtcgccgtcgtcttcaccacgggggtggaaggacagcggtggtct

SEQ ID NO: 5693 - DNA, 636 bp, A.fumigatus
agaccaccgctgtccttccacccccgtggtgaagacgacggcgacacaagcacaaacgacacggtcgccatccttgccaacggcgccgccggcggtgcccccatcagttcccccgcctcggacgactacaccgccatgcaggaaatcctcacctcgttcgcgcagtcgctctcgcagctcgtcgtccgcgacggcgaaggcgccaccaagttcgtcaccgtccgcgtccagaactccccggactacgagtccgcccgtctcatcgcgtccaccatcgctcggtccccgctcgtcaagaccgccctctacggccgcgacgcaaactggggccgtatcctctgcgcaatcgggtacacgcagggcgtggccccgggaacagtcgtccctgagcgtacgagcgtcagcttcaagcctgtggatgggagtcctgtgctcaagctgctagttaacggtgagccggaacaagtcgatgaggaacgcgccagtgtcattcttcaggaggaggatctggagattgtcgttgacttgggtggtggtgagaagggtgagcagggtctaggtggtgaagaggctgtctactggttctgcgatttcagccacgagtacgtgactatcaatggggattataggacttga

SEQ ID NO: 5694 - DNA, 315 bp, A.fumigatus
  unsure (259),(279),(280): Identity of nucleotide sequences at the above locations are unknown.
cagaattacaacaatgattggcaatggatctactcacgtcacggcaaggaggataccagtaccgctgccaagggcgccgagcaggtcggaggtgacggagagggcaccaatgcaggcaccaccaaaggcggcagcagtaggaatgattctcttaagctccttatacatgctctgttcgcggtggccggccatttacaagaccctgtccttcagctgcttggcgacatcgcgaggggcagagccagagacctcaatccangtcttggagagaaggcgcanngcaccagcatgaaagtgatgtatacagccgtgtga

SEQ ID NO: 5695 - DNA, 447 bp, A.fumigatus
ttagaccaccgctgtccttccacccccgtggtgaagacgacggcgacacaagcacaaacgacacggtcgccatccttgccaacggcgccgccggcggtgcccccatcagttcccccgcctcggacgactacaccgccatgcaggaaatcctcacctcgttcgcgcagtcgctctcgcagctcgtcgtccgcgacggcgaaggcgccaccaagttcgtcaccgtccgcgtccagaactccccggactacgagtccgcccgtctcatcgcgtccaccatcgctcggtccccgctcgtcaagaccgccctctacggccgcgacgcaaactggggccgtatcctctgcgcaatcgggtacacgcagggcgtggccccgggaacagtcgtccctgagcgtacgagcgtcagcttcaagcctgtggatgggagtcctgtgctcaagctgctag

SEQ ID NO: 5696 - DNA, 225 bp, A.fumigatus
atacaccaatatataaatgcacctagagccattctgtccagatgcacttgtccactgttaggactctcttgtaagtattttaatttggtctactttttgtcgaacgtgcacctagccattatagatttgttttgcttctacaagactttccaggtcacgtgtatacagtgcatactgcatagtgcataccgtcttgataatttactgctcaccaacttcgggtga

SEQ ID NO: 5697 - DNA, 201 bp, A.fumigatus
gtttgcgttcagtgtctgttcacacgagctgactatagctgggtcggcaactggacttcagtttttcttgcctcggcgacctcaggtatggaaatatcgaatatttatgttaggaaatttgattcaaatttcatgatatgtacgtggcggatacaactaggccctcagttctgttcgcggactgaaacgctgaagcactga

SEQ ID NO: 5698 - DNA, 513 bp, A.fumigatus
tccagtccagtctctgcaagttacaaagaggccaaaattatgtcagttgacgcagatgaggagactcctctggctggtactagtcccccaaacccaagccaaattccctccattgctctcaacgcaatatcgaatccagatgaaccttatgtcgtcgacccgtcgagcctgactacctatgagaagaggctttatgacttcttatgctcccaagaatggactgatacacagttttcttgttttatcactcagatcaagccaatgaaagaagccctctcacgctatttctactcgcacggttggaacactgttcaagtgcagtgtctccatgagcgttgtgagatggaatttccagagcattttccagctccaagaggcaatgccgagcagcaagatacgcagatgcagctgagactagtcgaagaaatgaatcgtcggagggcgatgggcgagcgcatgtacccttcaataggcactatggacggaggaattgtcgaggagggaagggcttga

SEQ ID NO: 5699 - DNA, 270 bp, A.fumigatus
tatagaatatccatgtccttatcaaaccccacaatagatgactatcccggcccagatctaggaacaaacagtgatgctagtgaggagagtagttgcaagcattattcatatgtgtgcactaaggagagcaagtcaatttccatcgaggaatcactgaagaacagtatacctaatggaatccttagtatctcttctgtagttccagggcacatcacgtacgtaaaaggtggtctggcgaagtatccctacgtagctgaaacgccgaactaa

SEQ ID NO: 5700 - DNA, 684 bp, A.fumigatus
cccgatgatgaggacccaggatatcaagcattcctcgatcatccggcgttcgaacgcggagatttccctgaatctaaggatgaaccatgcgcatttgcagtcgatgttggacctgtggtcacgacctgcaatggatgtggggctacattcccgttacggaatcgtctgcatacccatctttcggaatgtccacgcacacaggaaccaatccctgttacccctactactaatgacccaactgctgtctgtatcattgaatctactcacaagccaaccgggctcgttggaatctgttcctggcattgcgctactgcaaagatcagaattaacagcacatcagaataccatgagatatgccttaatataggctgctcctctaccattggaaatacagagttcattgaagcattacctagcgtaaccatcactgagctgacggacggcatcacagtttcaggcatcggatcctgtcatcgatcaaactgttctgctatgctaacactatggttccctggattgatgaatgatggtggttctgtgaatgcattcgctaagattaccatccgttgccatttggtcgatggcctgaagcctaagctacttatcggaactgatgtcatctgtagtgaaggattcatgcttaattttgaacatggcattacaataattagttcttgcagttga

SEQ ID NO: 5701 - DNA, 435 bp, A.fumigatus
ttaaccttcctaattatcacgcaagctaaactgcatcggatcacttgtgtagtagtatatgcaaagcaaaggtctcttctactagtatattcagttagtaaactggcagtacgtttaaagactgatttaccagctaaccatgactttatctttgacccgctggacggatcaaccttgaacggagccaccatatacgcgcatatggttgaccatgagttctcctttatcgaagtccgcaacgaaacacccactccaattatggtcactcgtcacgctcgcatagggaccatctctgatgccaatttcgtcactgcctaccaagtcagcgaggatgctattccattagctaagccattggagtccaaactattggaattcgagtctaccaagttgagttacccttcctctagataccgcgaacacgtcaaacattaa

SEQ ID NO: 5702 - DNA, 279 bp, A.fumigatus
ctcactgaagtacttatgagctttaatgtctggggcgacgatggctccacagcccgtattcctgaggaagaatggatggaggttcccttgaaggaaggatgggaaaaccgtcttcctaaaccatatgtctatcgcgtcagtcctaaagatcatgaatgcattgatcgcatgtttgaccctctacgtgaagctggcaaacttagtcctgctaccggtcataccccttcggcgtatctagtctttgttgtatggaaaaccgtcactgatcagaacagctaa

SEQ ID NO: 5703 - DNA, 402 bp, A.fumigatus
aagatcctggaccatggcacgaatcgttggtcggcgacgactcgcagcactgttggtcttgcagtcaagaatgcaatgctgggtccagaaagtgtgtccaaccagtacttgtttatcgagtcattcaatgtctcgcagagggacgttctcgctgcgttggaagatgtgaccggaacaaggtgggatgtaacctaccatgatgcagaagaggaaaagcggctcgccttggaaaagctggctaaggggaactatagtggaatccccgcgcttatgcgatatataacctgtgtcaaggggtatggggggaactatatggacagcgaggagagtgcgaacaagctgctgtcgttgcctgcagaaagcctccatgcggtgctggccggattaactaggcatgaatga

SEQ ID NO: 5704 - DNA, 228 bp, A.fumigatus
caaaacagcaaggctcaactcgacaatcgagatcttacattcgatgggaagtgtgttggggagtctttgctttacgaaggtttttacacttgggctgaaactgcgcggggtatggattgggctggtgtggataatgagcagtctactctttgcattggtggggatcccacttacggtgcttcgagtgtaatgctgttcaatttcgagtctcctacagacatagaatga

SEQ ID NO: 5705 - DNA, 1008 bp, A.fumigatus
  unsure (39): Identity of nucleotide sequences at the above locations are unknown.
gctggaccattgggggaagaccaatttcgccatggccantggtatggaacaatgttggccgattatacgacagattcaacccgtccgatactattctttcggattggagtcgttagtgagattgctactttccttgccggagcgataagcgcgcaaataatggctttgaacccttggatcccgacgctgatcggctgtggaattgttgctgtcggcctcacctgtgctttctttctacctgagactctgaaccattgcgcgaagaagaaggctacaatccacagagatgagccagtctcctgcatgggcgggctgattgtcggtgaggaatcgttctactgcagcccaaaggttctcttgaagtcgtccagacattgtcttatcttgggcaagatccgacgcttcctcaaccatgatatcttcatctttgaccaccggctcatgttgctactcttcgcttttgccgtctatgggctcgctcagggttcctctggcttcctggctcagtatatgtccacgcgcttcaactggaccctagcccaggccaatctcctcaaatccttccacacagctgccactctccccgtgttcctgtttctccttccttatctatcaacgcacgtcctgaattacctatcgctgcgcggaagggatctctacctggcgcggatgagtattacttgtctagcggtcggatcccttagcgttggtcttgcgccaaatattgtctttctggtcccaagtctctgcctccatgcggctgggggaggattcccgctggtcgcaaggtctctggctacagccttggtagagagtgacaaaacagcaaggctcaactcgacaatcgagatcttacattcgatgggaagtgtgttggggagtctttgctttacgaaggtttttacacttgggctgaaactgcgcggggtatggattgggctggtgtggataatgagcagtctactctttgcattggtggggatcccacttacggtgcttcgagtgtaa

SEQ ID NO: 5706 - DNA, 1095 bp, A.fumigatus
acaccacctcccagtccctctcaatcttcgcaaggacgacaaggaatcaagatcgaaagatacacaacgatgggatttttccgatcccacagcaaaaagacaatgtcgccagtacacagcttgattgaagagtgcaacagattgatggacgagaatatgtggcatgaagctggagaaaagctgagccatgctgtcaaacagcttgaggaatcacaaggcctttatcacgaggagactctgttcatgaagactaatctggcttacgctcttcgccgccgtggtgagtaccaggaggcagagcgcatggatcagcaagcctatgccgttcgacttcaagtctccgggcctgataacgtcgagacggcgaagtccctgaacaacctcgcgctggacctgaaaggactcggccgattcgatgaggcactggatctggaagaacgagcattagagacgtttctgaaaatcaacggggaaggctcgcgagagacacagaccagcatgaacaacctggccaacagtttccaccgacacggacgcctgcaagacgctgccaggctgcatgaaagagcccttgcgctgcaaaccaacacccttggcagggagcatttcgagacaatcatcaccatggatttgctcggggtggattaccgcgagctcggccagctcgatagagcccttcactatcaatccgaagccttggaactgtccaaggccaatctgggggaggcccacgcaaccactattcgatgctccgccaacctggccaccacataccagaggttagacacggaagacggcgaagccaaggcattagctttactagagcaggccttgacgctttcgcggcgaacctttggcgagaatagctcggacacggtgccggtcatgaataatctcgccgcagcatacgccagggagggccggtttgcggatgcggtgcctctattgcaatcggcatatgcatggaatcagaggacgctgggtccggatcacccacagactcgagcctcggaaggcaacctgaactatgtgatggagaaaatgggtctcactcgtgctacgcgtcttcaccacgaggctggaaggacacggctc

SEQ ID NO: 5707 - DNA, 807 bp, A.fumigatus
  unsure (330): Identity of nucleotide sequences at the above locations are unknown.
accgatatcccccacgggaaatcaatccctcttgttggcctttgcggaggagacaaagaagaccccctccaactgaagtgcctagctccgctcttccaggctcctttctgggaagccgaactcaccggccggtgcgtcgtctatgtcggcgcttacttctttttgccattcatgtcaagtggcttcgcactcggccagaccatcgttaccatcttggtatgccgcgccctgctcgccctcttgggttgcgtggccactatcctcgtggccgcccctttcgacgacatgtacacgcccaacaagcgcgccgtccccatgcccactttctcntacatcgccatcttcggcaccgtaggcgcccccatatacgccggcttcatcgacgaaaccctcggttggcgctggatctcgaggaaatgctccacaattcctccgtccaaggcaatccacatactcgccaccaaacccgccctcctcggctttggtctgtggtttagtctcgcctggttcctcacctcctcttcctctccgtcatccccatcaccttccaggaaaaaaacgcctggagcgagggcgttgccggtcggtagtaccctatatcgccctctgcagaggcacaaccttcggcttcgcgctcaacttcccccagatcagcaaataccgcttcatcgtcacagactccgcccgcgaaccaacacccgaggcacgcctctacggcgcactgctcggctctatctggcagcctatcggactgttttatctacagcttcacgtagttcaaggagctacattggatttcgccggtga

SEQ ID NO: 5708 - DNA, 672 bp, A.fumigatus
gcgcccccatatacgccggcttcatcgacgaaaccctcggttggcgctggatctcgaggaaatgctccacaattcctccgtccaaggcaatccacatactcgccaccaaacccgccctcctcggctttggtctgtggtttagtctcgcctggttcctcacctcctcttcctctccgtcatccccatcaccttccaggaaaaaaacgcctggagcgagggcgttgccggtcggtagtaccctatatcgccctctgcagaggcacaaccttcggcttcgcgctcaacttcccccagatcagcaaataccgcttcatcgtcacagactccgcccgcgaaccaacacccgaggcacgcctctacggcgcactgctcggctctatctggcagcctatcggactgttttatctacagcttcacgtagttcaaggagctacattggatttcgccggtgattgcctgggtcctcagtaccgtgggcattttctttatcttgagagctgctacagttttacgtcggattgctacagggagaattccagctcggccattgcgggccagggcttcatgcggaatacgctcggcgcgctatccccgctctttgcatcgcagtttttttcaataatatgggcagtcggtattcggggttgttggcggttgtggcgacgttgttga

SEQ ID NO: 5709 - DNA, 1260 bp, A.fumigatus
  unsure (147): Identity of nucleotide sequences at the above locations are unknown.
ggaaatctttcccattgcgggagatgctccttgagacaatcaaccattggtttattggccgctcgaaggccgcaagagcgtgatctttatgtcgaatggacgctcattgtgcccgcgcgttgttcccaccttctgcctcacttgagntacctaatgcgccctatcgttgtagcattgcgtgcagactcagactttgtagggcagggcttgcgaacccttgagctttgcgttgacaatctcactgctgactacctggaccccatcatggctcccattatggacgaactgatgactgctctatgggaccatttgcgaccgcatccctacaatcatttccacgctcatacaaccatgcgaattctgggcaagctaggcggccgtaacaggaaattcctgaaccatcctcctgagcttacattcgagcaattctctgatgattcaccgagcttcgatatcaagctcattgggccaagtgagaaacggccgtttcccagctcaattggggtggacctggcgatcaggaagttaatggaggttcccaagacggccgccgcaaaggcctctgatggctactataagcaacaggcattccgcatgctctcatcccaattgaagctctatattggccatgagaatgtcccggaagatctagctgctcttttgcgtttgcatgccaatgacctcttcgagggcaagaccacagccatgacggatatcttggacaaatctgagaggtctagttcaattgcgaagaagttggcgcaggagggcacgctgaaacagctcctgaaagcttgcattttcgccaccacccttccagacatcgaacagagcgcaaccgccttcgtggctgatgtctgcaagcattttgcagtcgttgaagtcggaagggccctcgcgctagccagacataatcggaagccctttgatgtccacagtggagaaggccccgtctatttggactcgcggatcctagctgaggcaatcgttgaaagtctctcatcagacaacctccgtgtccgtgatggcgctgaggcggcaatgcaggttatgaaggatgccgcggggatcatttttggagcacctgagagagttgcgaaactgcccttcttccagcacctgggtcgcgttttctgccatagttgtcatagcgaggaatggttcaccaaggccggaggcagcctgggtatccgccttttcgcgaccaaacttgatcttggggattctgtcttcaccacggggctggaaggagccgagcca

SEQ ID NO: 5710 - DNA, 1650 bp, A.fumigatus
  unsure (15),(1456): Identity of nucleotide sequences at the above locations are unknown.
cagaatacaagtcantggtatgaacccatattgccagcagagcagatgttccttctctcatgccggaaattgttgagagactttattatttctctgtcctctcacctatctcgaaaacgaccggcagatgcattcttggagtttctcacaaattcttcttctatggttatcgtgctcttgaatgaattgtcagcggcgttccagcatgtcgagggccgtttgacgccagaagatgcagtcaaacggtatctggatttacatccggaaagcagcttagcgaacattttgtcggagcagcagcagcgaatgaaattaaaaatggtagcagatgatatcctatccagctttttggaaccaggtgtgtacgcttgttccgtgctgagggacttccttcgtgagattctggccggtgtagtgttagagtcggcgatctccaatctttcgcgatcggagacgatcaatggctggatcattcatcttttaagggaaggtgaatcggagttgttgaacgccattgatgcgggggtcgagggggccaaggagcaagtggtcgctgtcgaaggcgccaacgaagagaacaagcctacagcagttccgtctagcgagtcagatatggagggaaaacctgctggacactctgatacttatggcattcttcctacgaccaaggttattgaggttccaatctatccacccggaggcaccacggttcagacacaggacttgcagccccaaaccgctcgtctgtgttcccctgaagatatgctgtcctcagatgcccagtcaaccatgttgccgcaccactcgcctgtcgggatccaagacaaagaagcaacaatccatacaccaaaggttaaagacgccgcagagattcagaatgattatgattcgacaaagatagagtccacagaacattatcctccagttcaacctacagacccatgcatggcaccgccagcctctcgtttaccggattttcaatctaaaaaatcacctgccacgactcttcatcatgcatccgtttcagtagaggagctttctgaagctagtgagaaagcattaattcggtcaaaacctacatcgagttatttgattcaaattgagccagcagccacacgtcgcactgggtggatgattttcagaaactatgcagattttgaatcactacatggcacccttggaacgatagcgaggcttaataagatacaagattttacggaaagccaccctgtcttgccaccttggaagggacagacaaagggggccctagtgcgtaatctggagagataccttaaggatgcccttcactatgaagcgcttgcggattgcgagagaatgaaacggtttttggaaaaggatgagcgcctcgatcctggtgccagcgatgccccagctaaatctggatttccgtttgccacatcggtggcgctcgaaaacatgggcaaaggtatgctangcgttctgactaacgcaccgaagggcgttgctgaaggtggtaaagccgtcattggtggtgttaccggggtgtttggaggagcaaatggcaaaaaaacatcattcaactccaaaggatatcaaggaaaccatggccgttccctatcaactcgatccacctcacaaatgaactacgggagtgcagtttctgacggt

SEQ ID NO: 5711 - DNA, 408 bp, A.fumigatus
ccccttgcgttatcagtacggtctttcatatcagccttcggtggctcgtcccgcaaggagaatgccggacagcatcatcgtacagcttcagcctcaatcacgttgggcgatcctccgtcaagattcgagaccccttctcccgatacgccctcaccgatcgaaggctcgccgtcgcagttgaccacgaaagcggaacgccgcatttcacggccagcatcgacagtcttctctcacaatcctccgttgacagagctttcagaagatacgccgcccgaacttcagccgatattcacttacctcaataaccacgccaacaaattgtaccatgaaggatacttcctcaagctgaatgatctggatacccgtatgtgctttgcctcaagtgtctgtcgaaccagcacgacctga

SEQ ID NO: 5712 - DNA, 276 bp, A.fumigatus
gtatctggttcacatccgtccaatccgcgttgccagcgtaaaacactgcctcaaactggttcaatggcgccttcaattttgagcactgaatcttccattatcgttatcggagcaggcacatggggctgctcaactgctctgcatctcgctcgtcgaggctacaaagatgtcactgttctcgaccctcatccagttccttcgcccattgcagcaggcaatgacatcaacaagattatggagcacagcgagctgaaaggtacgactggagttatttga

SEQ ID NO: 5713 - DNA, 204 bp, A.fumigatus
gacgaaggcattggtcgagctcgccgaattgataaccccctgttgcttgtacacagacaagacaatgaaacccgtgagaatcttctcatcgttctgtctgctatgctgtcttccattggatcttgctatctgattgtcgtttggagcttcctcgtttcaaccacttatcgtatcttcccctctcatgaggggaacgcaaaatga

SEQ ID NO: 5714 - DNA, 270 bp, A.fumigatus
gaactgacttgggtctcatttgaggagcatagtaatatgacattgtataatgtaagctgtgctaagttctattatacttcaaccgactactccatatcacgcatcggatttaagggagtgaaggtcggagtgttcctgtggcatgccatcctcctaatacgtgctgttgcttccttgaccttgaaccttggcgcccccaagactgcgcaacgcgagactatcgacctcatccgaatagcgttgctgttcatcggctccattgccaaatag

SEQ ID NO: 5715 - DNA, 1677 bp, A.fumigatus
catgggccttcattctctcagttcgcttcgtactacttacaaagaacttatttcttcgatgtgcaccctccatttggcaaattgctcttcgctttcatggggtggctgattggctacgatggccactttttgttcgacaacatcggcgactcctatatcgataacaaagttccttatgtcgctctccgcgcaatgccggccactctgggggctctgaccatccctgtggtcttcctcatcatgtgggaatccggatattcgttgccggcctgcgtgttggctgccggtctcgtactgtttgacaatgcccacgtcggagaggacagactgattctgctggatgcctccttggtactatccatggcactaagcatcctgtgctacgttcgcttctacaagctgcgtcatgaaccctttggccgtaaatggtggaagtggctgctcttgacgggcgttagtctcagctgcgttatctctacgaagtatgtcggtgttttcacatttgtcaccattggtgctgcggttttggttgacctgtggaacttgttggatatcaaccgcccatcgggagctctcagcatggcccattggactaagcactttgctgcccgcgcatttgccctcatcattgtgcctttcttcttttacctgttctggttccaggtccatttcgccattctcacccgctccgggccaggcgatgatttcatgaccccggagttccaggaaaccctcagtgacaacctcatgtcggcgcagtcgatcggcattcagtactatgacacaatcactatcaggcacaaggacaccaaggtgtttcttcacagccactgggagaagtatcccctccgctatgatgacggccgtatttccagccagggccagcaggtcacaggatacccattcaacgacacgaacaatcactggcagattctgccttctgttccctatcctgaaaccgacaggcaaggccacagtgtcaagaacggcgacatcgtccagctccgtcacgtcggtactgacaccatcctgctgacgcacgatgttgcgtcgccttattatcctaccaaccaggagttcaccaccgtttctcatgaattggccaatggtgagcgacacaacgatacgctgttcgagatcaagatcgagaacggcaagcctcaacaggaattccgctctctctcaagccatttcaagctgatccatgtgcccactcgcgtcgcgatgtggacccatacaaccccccttcctgagtgggcctttaagcaagccgagatcaacggcaacaaaaatatccttcagacgagcaatctttggttcgtggacacaatcgagtcgttggaagaaaacagcccccgtgctataaagaaagagcgccaggtcaaacatctccccttctggcgcaagtaccttgagctgcaacgggctatgttcttccataacaatgctctgaccagcagccatccgtacgccagcgagcccttccagtggcccttcctactccgaggtgtcagcttctggaccaaaaatgacaccagagagcagatttatttcctgggtaatcctatcgggtggtggattgccagcagtctgttggctgtctttgtcggggtcatcggcgctgatcagctgtcccttcgccgcggagtcgacgctcttgaagaaagtaagcattaa

SEQ ID NO: 5716 - DNA, 306 bp, A.fumigatus
tcagtcttctctcagttcctttggtcgctccatattaaccctttagcagagaccacaaggcaacaggatgtcaacatttaccttccaagttcccttaagaccgaaacactcaagacggcccacgccaagttttttgaggagaagtacaaagggggattccgcaatgctcggaatcgactgcaagactatgccagctggctccagggccaagctggattcggaaatctcgatcaagccaccaaggatgaagtggccaagcttgcaagcaatcccgaggctcactgtacggaaatatggcccctgtaa

SEQ ID NO: 5717 - DNA, 237 bp, A.fumigatus
agaacaagcagctcttgtgttttattactttatttttattttattttcttttatttgtttcttgctcttttagcagtactgatcaacaatagttctttcattgggtgcaattcttcagatacatttgagtctgtgttcctaactagtaactactcaatgaagggaactaataatggaaggatcctggttgatcatttgtctgtagagccagagcacctctcttttacttttctgtaa

SEQ ID NO: 5718 - DNA, 492 bp, A.fumigatus
gggctatatcgcagagaaatgaaagagaccactcgatcacacagcatttctgacagcgacaagatccctgctgcaataccgagcctgtgggagaccacaatgggattcccccacgatctggaacgcctaggctgctgcaactgcaagcttgcagctgatcgctttcagcgttgcattttcctttccgtttccttttcatcttcatttttaattctaattttgtttttcttttattttttatttttttattttattttttatttttttattttattttatttttttttttttttttctttttttcttttgccaccactattcgtctctctggtttttgttccctggctggttttgggttttggcgccccctgtcagactgatgggtctggtcccctggacttcccaaaaaggatactgcgcaaaaagcatccacatacttctctctctgtctgccccaacgtcatgtgggatcattgtcatgacagaatttaa

SEQ ID NO: 5719 - DNA, 276 bp, A.fumigatus
  unsure (234),(242): Identity of nucleotide sequences at the above locations are unknown.
gatatcatctctggagacgaggttctctccgacaacttcaagatcaaggaagttgacggtgtcctctacgagtgcgaactgcgcaagtacctcaagcggaagaacaaagacatccagcttgagggtgctaacccctccgctgaagaaggtgacgatgatgccggccgtgatggtgaagaagtcatggttcacgacattgaagatcagttccgtctcgtttggctgaaaaacgangaaggcantgaaccttccaaagatgccttccaaaacacctga

SEQ ID NO: 5720 - DNA, 264 bp, A.fumigatus
gttgcaccactctttagtgtaccgaaatcgctgaccgtggacgtcgtagcatggaactggggagccaaaacaggtctgttctatgcgggcaccaaccttctctgcaacgtctggtgttggttccgccttcctgagacgaaggaccgcactttcggagagattgacttgctcttccaccaccacgtccatgcaagaaagttcaagcataccaaggttgatcgtaagttgctcctcgtctactccgggtcttctattctaacatag

SEQ ID NO: 5721 - DNA, 318 bp, A.fumigatus
agacacatgagcgggttgtcgttcatgtttgcttgtatggtgatcattggcggtcttggcttcgcagagggcaacaagggcgcacagctggccatcggcatcctcctggtgatttgcactctctgcaatatgattaccgtcggaccggtctgctaccccatcgttgcagaaacgccttcggggcgattgagatataagactattgtgattgggagatttgtgtacaacctgacgggtattttcagtaactcgcttacgccgcggatgattgctgcttcttgtgagttgcaccactctttagtgtaccgaaatcgctga

SEQ ID NO: 5722 - DNA, 237 bp, A.fumigatus
  unsure (50),(59),(92),(114): Identity of nucleotide sequences at the above locations are unknown.
ctgaacccaacaaccaacacatcgttccacctcatctatttcgtccattntaagagggnaaaaagtgccatcacctgcatcttaatcacctncaaaccttgtgccaatcggcgntgtctcttcgcacatagggtaattctctctttggacgaagaccccctcttctcacctacagcgacgatcatcagtcctcagacgcaagtattccccaccagacgaaatggattcgcaaactag

SEQ ID NO: 5723 - DNA, 573 bp, A.fumigatus
ttgactcgggagctccacgatttggagttgtggaatgggcccaagtgtggtatccatggatgcgagaaccaaaggaacaagtgcttggtcggcggatatccgcataaccatttgcactctggtttcaacttcgctttgcaattcgtccgtcccttttcctttccagtttctttcctatttttttttttttttttttttttttacggccgcaccacaagcaagatacctctgaagtttattctctttctgcatgtggaggtttccgtcatggttccttttttttcttctctttcaccgtgtgtttctccaatgttcaagagcagggtcatgccattcatgggtgggaggttttctggattagcactgcattctaacagctcgctgtcccgacagcttgagctttccgataatacatcatcccatttcgatacgtatggtttcaacagtatgatacgatacaatacgtatttccccacacgggtcctgtcagcttttactaaggctgtccaccacaagttcataactacagtggaaccaaataagcacccgtttgagagactacaattctcgtag

SEQ ID NO: 5724 - DNA, 537 bp, A.fumigatus
  unsure (51),(67),(90),(95),(149): Identity of nucleotide sequences at the above locations are unknown.
ttgaccacgcccttcattcccaacgaacttgacggggttcccgcagttgtnggtacgtcattcaatntgatccactttctttccaatttntttgntccttactttcttgtaacctccaagtctattctcgagcagctgaacgcgccctntggagtcatcccatctctcgatgaactcaaagatggctggaaaccagtggccctgaagggaggccacaagatcggtaaggccaaatatctcttctctcgcatcgacccgaagaaggccgatgaatggcgtgagctcttcggcggttctcaggcagacagacagaagaaggaggatgaagctgccaaagctgctgccaagaaggcagccaacaaagcgagcaaattgaagaagaaggagaagaaagcggcacaggcagctggaactagtgttgaggcttccgctaagggaggtgctgaggtcattgatactactacggaggggaagaacgatgaagcggttgagaaggttgtcgatggcatggcccaggtcacgatcccaacatcctga

SEQ ID NO: 5725 - DNA, 183 bp, A.fumigatus
gtactacgtaggcatcagatgtttagtgtttgtacggaggagagtcttccatggcgtctacctgccgcgaccgtccttgagatgatatataaaatcgctgtctgcagagtagtatcgacttgccccatcgttaccccctattatcccgtcaaagaagatattgtgtcgctaactatttggtaa

SEQ ID NO: 5726 - DNA, 402 bp, A.fumigatus
ttcgcgtacaccgcgtcaaagacttttgtgtcatacactgcttttcctcctagtccggcgctggttgtctgtttaattataccaggaacttgttgcaccggaaacctaaaccacttttattgtttatcatccgtgtgcctcatagttggtgttcattcgttcttcaccacataccgcgcaagccacgaccgaagaaaacagaagagaaaagggctcaccgttcgaatgtcgttattcgggaacgtcggcgctacgtcgacaacagctggtcaaacaaacaccacaggcgatatctccaaagatgtaccgctcagctcgccgcccgaagacggcatctctgatcttcggttttctctcgcaagcgaacatctcgcggtaccttcatgggaacagaaagtccgc

SEQ ID NO: 5727 - DNA, 309 bp, A.fumigatus
  unsure (189),(236),(278),(280),(296): Identity of nucleotide sequences at the above locations are unknown.
aattacttttgcgcacaatttcagaccgaatctgcccgctctgctttgagctctttcacatgtactctttgcaataaatcttactcgcgccatccggaatatgaagctcatatctcttcctacgatcatcaacatcgcaagcgcctacaagacttgaaacaattgtcacgagatccgaatgctgctganaaggcaaggaaggccgagagaaaggcaaatgcaaaggcaggactganagtaatcggggacgactcccgcatcaggaaccggggggcacncngttggggaagagggtntaagatagggaag

SEQ ID NO: 5728 - DNA, 1494 bp, A.fumigatus
ggccaaaagattccttcagacgatgcgttccgccttcgccataatggcatctgcgaggtttgtggaatcgaaggtgatgatggccttagaggtcctcttgttttctgtcagggctgtactagtgcctatcaccaagcttgcttaggccccagatcgaatcgtgatcatctagtcaccaaagtcgctgatgaacagtttgtcctccaatgccggcgctgcataggagtctcccatgcgaaggaccccatatcaccccatcaaggctgttgtatgaaatgtaacaatcaaggcaagatgtcgaagcctctccgcgagcgcttgacaccgaagcaagaacagcaaattcgccaggacaatggtgggaaagacccgattacccctgtgggcatgactactgtcaacaatgtggacaatgtgctattccgatgtacggcctgccacagagcctttcacttcgaacacttacctccaatttccgatatgactgatgatcctgcaacggctcgctttgaagaatactcctatacttggaagtgccacgattgctcatcagtccccgccgagatcggtgcggtagttgcgtggcgaccggcagacccccaaaatcatgttgctgggtacactgcggacggggtgaatgaagcggataaggaatatctcatcaaatggaaggggcattcctaccaccatacgtcatggatgcctggcagctgggtctggggtatagttagtccttctatgcgaagagctttcttccggtcagagaaaaatttccagccccatatgactatagaggaagcgatccctgaagatttcctacgtgttgacattgtcttccaagtgtgctattcagaagaagtggaagagcgaagcctcgagtcagatcttcagaggattcacaaggtgaccagggcgtacatgaaattcaaaggcctgccgtatgaggaagcggagtgggactctcctcctgatcctagccaaactgaacgatggaatgatttcaaggctgcctatgatgactgggttaaacgtgattacatttatatgccagagccaaaggcacttcagaagcatcttgctcacattcgggagcaaaatttcgagtctcagattgtccgagacactcagcctgagacaatgaccgggggccagctaatggactaccagaaagatggggtgaattggctatactacatgtggtttaagcaacaaaatgccatccttgcagacgaaatgggactaggaaagactattcaagttattggctttttcgcgactctcagtccgtaccacaagtgctggcccttccttgttgttgtgccgaaatccaacctgttccaaattggcgcaaggaaatccagtcatggggttccccccacccgcgttcgtcacttttttacggttcatcactcgcccggcaagtttggtccctggatcaccaacctgttccccccttggctcgaacccagattcttccgaatgtctggttgttag

SEQ ID NO: 5729 - DNA, 210 bp, A.fumigatus
gacttttggcatatatctttcacaatgggtaaaaagagacgtggcccaacacttgaagagctgctggctcggccgtggtgttattactgtgagcgtgattttgacgacctcaaaatccttatatcacatcagaaggcgaagcattttaaatgcgacagatgtagccggaggctcaacaccgcaggaggtgagtcagtacagcacatgtag

SEQ ID NO: 5730 - DNA, 600 bp, A.fumigatus
  unsure (135),(285): Identity of nucleotide sequences at the above locations are unknown.
tctgatgtcaagccctgcgaccggtattcacagagccatggacacgttactgctggtgcgggcgattttgctcctgagcacgagtcggaatacgtgcagcacgacaatacgggttacggcgcctttcggagttcntacacctacaccaccaacacctcgtttggtagtctcgcaggcgagcactcgcagctgacaaacgacatcaccggttccccgcagcagaacgggtctggacgtatgactccacgcacaggtggtgggcctcctccgcaatgggcgtcaggntacgcgtctcctcgaccaactgctgccagtagtctgtataacattgtcagcgacacccgcgggtcatcgaacggagctggctcagaaaaatacactgtggcctccaacacggcgccgacatactccatgggcggatcgttgggatctggcaagcggggacgggaagacgacgacatgggccggccggacagccagggagattacgaaagcaagcgccgacggaccaatgaaacaactgttggcggaccggttggcggagtgttgctaggattacagccgatgaaagccggaggtgccatgcctcgtcgtcgatga

SEQ ID NO: 5731 - DNA, 231 bp, A.fumigatus
aagacagccacccccgcggacattgaccacgaatacatggagatcgttgcatcctctcaggagagcaagcccagttctcccattgagtttgtcaagatcctgatcggcaagggcggccgacccggctcgaatctgggtcgacgggcctggctttgtgtgtggcttcagatcatggcttcgtggacgggtattaccgtaagtctatgcgttccgcaagaagtcttggggtaa

SEQ ID NO: 5732 - DNA, 804 bp, A.fumigatus
aagcttacaatgatcacaggctgttaccgcgtattctcccgtgcttctcagccaagccgggtacagcgaggtgactcaaaacggtctcgccggaggactgaacacgatcggtattgtcggcacgatcatcagtgcgcagattgtcgatcgactcggccggagaaagtgtctgatgctagggtccatggtcctgtttgctgtcgagcttgtggtaagtctccgccatggccgtccaaccttttgagagcaggattaatcaaatcatcgttgcaggccggtggcgtgtatgaaggctcccttcagaatccgagcaaagctgcacagtatgcaccagccgccgtggcaatgctcttcctctttaacctggggtatgctgcaacctggggaacggtggccttcttggtgcccaccgaaattttcccatcggatctgagagcccaaggcaacgggttcggtatcacgggttgggctatcggagtcggcatgactaccttagtcaatcccatcatgtttggcagtttgaagagccgcagttacttcctcctctccgggctcaaccttctctggatccccattgtctacctgctatacccggaaacgtgcaatcggtccctggagtcgatcgacgccttgttctccacgcccagcccgttctactgggacatggagcgagcatacaagcttcatagtgatgtgctcgcggagagagcagcgcggaagctcactgacgaggatgcgacaaaagccgatggtcacgaatcagcccacgaggaattccacggtgcaaccaccgtaggtgtatga

SEQ ID NO: 5733 - DNA, 231 bp, A.fumigatus
tcacaggctgttaccgcgtattctcccgtgcttctcagccaagccgggtacagcgaggtgactcaaaacggtctcgccggaggactgaacacgatcggtattgtcggcacgatcatcagtgcgcagattgtcgatcgactcggccggagaaagtgtctgatgctagggtccatggtcctgtttgctgtcgagcttgtggtaagtctccgccatggccgtccaaccttttga

SEQ ID NO: 5734 - DNA, 183 bp, A.fumigatus
ttcatccgggccaatacaaccagcccgcaaagaagaactcagtatgacctgtcatggagaagcccgagccaaccagatattgaccaccctcgacgccgtaactgccgcattaattcctgcctcgcatgtcgccagcgcaagctgaaatgcaaccgtcaacagccctgtgcgaactgcgcctga

SEQ ID NO: 5735 - DNA, 189 bp, A.fumigatus
gatacggaagtcaccaaatctaccaaaccggggtcgggatcgccagaggaggacgtggatgatatgctcgtcgcctcacttgaattaactctactggggattcaggatgcagcatacgatcatgaggaagatgatgactcggatgacgatctatatgacttgggattccgatttggaaaatgcgcgtaa

SEQ ID NO: 5736 - DNA, 639 bp, A.fumigatus
ccgatgttagactttccattcccgatgtatggatcctatgacgcgctaggtctcgatggattttcatgtatggatcgatacacccgctttggtgcatacggctattccgggacggattctcagttacaaggcgccagaccactgccccctgtggactggaaaaaagtgaattggagaaccctgcaagaggaatgctttgaaaggaactctgacagatacgagtcggctcaacagtccttgagcatgcactctctgcctttgacttcagtttctcacgagactcttccccgatacagcagactagaccaatccctcccgcaattcaagccgaggtccgcagtcattttgcgagcgtggcatgacatgccttggaccgagaacatgaagcattatgtgcggtcactggtgatggagctttcattgcatacagggtcggagtaccaagtttttatcctgacacatgtgaaggacaacaacataccgatatacgcggtaaatggggacgataatgctcagcgactgaaggaaaagtatatgcccaaggagtttcacgacatgactatccttttcaacgatcatactttggaatcctggtatccagccatagaagagcataggtatgttcttgcgacgccataa

SEQ ID NO: 5737 - DNA, 201 bp, A.fumigatus
gacgccgctagtcggtcaggggatgctctcatgggtccttgcttcggcttctccgactcccaacgcaccagcacatcaatcgaagactatggtaacgggtcgtgtgtgcaaaaacgtgctcggtctcttttcaaaaggtgcacaagaaacactggaggtcaaactgcgattggtgccagtacctactgttttgcagagtga

SEQ ID NO: 5738 - DNA, 306 bp, A.fumigatus
ctggctaactccagtccatcgagtatcagatcgtctaagcagtacctgaatgacttattcaagacctcctcctcccccgtcgtcgcctccgccccctcctcctcctcctcttcctcccccaccgccaccaccacccttgcccttcctagcagaggtattgttgcacatctaagtaagttagtcgatggtcatcagtgtcgattgccgcagcaaagacatatacaacttactttggagagcccggtttggacgatggaaatgaataagcaaaaaacgcgtaggtgtgtgtcctactcacggccctag

SEQ ID NO: 5739 - DNA, 1122 bp, A.fumigatus
  unsure (753): Identity of nucleotide sequences at the above locations are unknown.
agagtttcttcatatcgaccctcttttctgtttcactttatttcagttcctcgttgccggactacacgaccacgctcgactccggcttgttcagtcattcccatggatgaccttcatcaacacatcactccccgcggtcatgggataaacactacctatgtttacgagtactcgagaggccttggtggggtcaatgttcccagagatgtcataatcacgcggatcatctactggtctgttattattggagccttggccgttttttgcggcaggattgcccagatcagccatgcctatctacgacatgttacctctttgacggctagtcaaagacagcaaatgttctggagtgtcgaggagtcacgattgtgggcaaacattaagaagcaccttctctacgcacctctgggtcgcaaaagacacaatcgggaaatccagctctcttcggcgattaatgtgggcaccctgccgtcgaggtttcactcgatcctgattctgctgtatgtggcaagtcaggtggcttattgctgctttttggattatgctgtgaatgagaaagcggccctcgtggccgagcttcgcggccggtcgggcactctggccgtcctcaatatggtgccgctgttcatcctggcgggtcgcaacaatcccctgatcccactcctgcacatcagtttcgatacgtacaatcttttgcaccgatggctgggccgaatcgtagtactcgagagcgtggtccacacagcggcttgngcagtcaatgcctgcgatgaagaagacttctctcgcatgctggtacgactcaccggtgaccccttcttcacctgggggtttgttggaaccgttgcgatggtcttcctgtgccctccaatccccctcgcccgatccgcatgctttctacgagaccttcctacatctgcatcagcttgccgcgctcctggccctccctcggcgtctatgttcaccttggacctggacaagcttcccccagatccccttggccctggccattggcgctttctggctgttcgaacgatcagcgcggctgttccgcttgctgtacctcaacttttcactcaaaaagggctcaaccaaactggtcgtcgaagcgttgcccggtga

SEQ ID NO: 5740 - DNA, 549 bp, A.fumigatus
cccctgcaaggtgaccttccacttgccgaagcatgtccgcatcaaccctggcggtcacgtctacgcctacatcccgagcgtctccctttggatgtcgcaccccttctcaatcgcttgggtcgaaccaaacagttgcgtgactccttcagccgcgcccgacaacgtaatgagtcccatgacgccgtcactcctggaaaagcagaaccctctgcacttggacgagtacatgaggggcactcaacccacctccgtctctctcatcgtcggcgcccgccaaggcatgacccgcaagctctacaacaaagccctcgccgccccgcagcagaccctctacaccacgggctacatcgagggcccttactcctcccacgcgtccaacatgggcagctacggcacggtcgtcctcttctctgctggcgccggcatcacacaccacatgctcttcgtgcgcgacctcatcatccgcgcctccgagggccgcgtcgcaacccagcagatctacctcatctggtccgtccgcaacacagaacacctcacctgggtccgtga

SEQ ID NO: 5741 - DNA, 1032 bp, A.fumigatus
  unsure (32): Identity of nucleotide sequences at the above locations are unknown.
tactcgagagcgtggtccacacagcggcttgngcagtcaatgcctgcgatgaagaagacttctctcgcatgctggtacgactcaccggtgaccccttcttcacctgggggtttgttggaaccgttgcgatggtcttcctgtgccctccaatccccctcgcccgatccgcatgctttctacgagaccttcctacatctgcatcagcttgccgcgctcctggccctccctcggcgtctatgttcaccttggacctggacaagcttcccccagatccccttggccctggccattggcgctttctggctgttcgaacgatcagcgcggctgttccgcttgctgtacctcaacttttcactcaaaaagggctcaaccaaactggtcgtcgaagcgttgcccggtgacccctgcaaggtgaccttccacttgccgaagcatgtccgcatcaaccctggcggtcacgtctacgcctacatcccgagcgtctccctttggatgtcgcaccccttctcaatcgcttgggtcgaaccaaacagttgcgtgactccttcagccgcgcccgacaacgtaatgagtcccatgacgccgtcactcctggaaaagcagaaccctctgcacttggacgagtacatgaggggcactcaacccacctccgtctctctcatcgtcggcgcccgccaaggcatgacccgcaagctctacaacaaagccctcgccgccccgcagcagaccctctacaccacgggctacatcgagggcccttactcctcccacgcgtccaacatgggcagctacggcacggtcgtcctcttctctgctggcgccggcatcacacaccacatgctcttcgtgcgcgacctcatcatccgcgcctccgagggccgcgtcgcaacccagcagatctacctcatctggtccgtccgcaacacagaacacctcacctgggtccgtgactggatggaccagatccttcgcctccccggcgtcttcaccacggggctggaaggatccgacggtggcgctagcaatcaagcc

SEQ ID NO: 5742 - DNA, 513 bp, A.fumigatus
caccccgcacccccggagccatccgcccactcctactctacgttctcccctcttccctatctacttttccctgctcctctccgacctcctctccccacacctccgcctccgggtcccaccatcatgacgtactacccctcgttcaccgccctatctttcccttccttaccatcatctacgcctccctctagcctcatctacgaactccgcaccgactaccaccctatttccctcacctcccttcctatcttgtactcacgtccctacctcgttcgctctcacttcgctaccttctctcattacccactatttcttctacctaccgctccgtatcgacgttacgtacaatgtcaccactgcatcgtacctccctccctcgctcttcgccctgtatccctctttcccacccttcttaccctcctcactatcgcttgctatctaagtttgcacgcgatgcatgctagccttctctatcgctccctagccatacttcacgtatctatctttcgctag

SEQ ID NO: 5743 - DNA, 573 bp, A.fumigatus
cggcggcctatacagttccaagcgctggctcgaaagatcttggataccgttctccctccaatcggaggattcaagaccgtcggtgcgccggcgccggcgccagcaaggcccattggggagaagaaagctcctcccccgatcaaggtcactggtcctcccaagcccaaccccagcaacgcacgtgctgcatcaccggtggttgcacgggcattggagatcctggctgcggaggtcggtctgtccgaggctgaaatgaccgacagtctcaacttcgccgactacggggtcgactcgctgctttccttgacggtgaccggcaggtatcgtgaagaactgaaccttgatctggaatcgtccgtgttcatggattacccgaccatcaaggatttcaaggcctacctggccgagaagggcttctgcgacagcagcagtcccgagccgtccagcgagcccgagtccaagttctcgttcaacagcgacgcatcatccgaagcttccagcggacttaccactcctggaattacatctcctgtgaagcatgaggcgcccaagggcggacagtcttcacgccgg

SEQ ID NO: 5744 - DNA, 765 bp, A.fumigatus
ggacgcggtccttccagccccgtcgcgaagagacacttgatcacagaatacaaaccagagtaccagggcctaggtctggacgtgtgcgacatgactgtgcccaagcctctcatagccaagtccggagatcaattcttcagagtctcggcggtgatgagctgggccgagcagaaggcgagcgtgcaagtctggtctgtgaacggagacggcaagaaaatggccgagcacgcccattgcactgtcaagctcttcaactgcgccgagcgcgagacggagtggaagagaaactcctacctcatcaaacgaagtgtctctctcctgcaggacaaggcgcagaccggcgaggctcaccgcatgcagcgaggaatggtgtacaagctgtttgctgctctggtggactatgacgaaaacttcaaggccatccaggaagtcatcctggacagcaatgagcatgaagccacggcgcgagtcaagttccaagcccctccgggcaacttccaccggaaccccttctggatcgatagtttcgggcatctgtctgggttcatcatgaatgcgagcgatgcgaccgactccaagaaccaggtattcgtcaaccacggatgggattccatgcgctgcctgaagaagttctccggcgacgctacataccagacatatgtgaagatgcagccgtggaaggactccatctgggcgggtgacgtctatgtctttgaaggggatgacattatcgctgtgtacgggggggtcaaggtatgtctctaa

SEQ ID NO: 5745 - DNA, 687 bp, A.fumigatus
gccccccatcccccaactggacagcctgctgtcttccagccccgtggtgaagacggccggccgtcgtctgcccactcggctcagggcccgagtcttccctctcctattcagaaccgtccctcaatgtctcccacccagggcaatcatgatgttggtccgcttgcggggtttccacctacaggtccctcggacgggtcagctccctggacgccctttggaccacatcgagcggctctgtggcccgacgttggtaacaattcctccctttcttcgatccacagcggtcggccatccttctcggcagaaactcccagtggcagcaggtcctcgcccccgcagagctcgcatggcgtgccattttctggaatcagcccaaccaaacagtctccgcgacccatgacctcgggcagcctttctggggcaccaattcttcctccaattcagaaactggagccgagccctaagttgatgggcagaagttcccctgacgctcccattccacctccagtgaaatctatgactcctgaacaggaagagcgtcggcaaagggaaaatgctctgatgttccagtctcagcctcactctctatctaatggccagtattccgccatgtcatccccttcgctcaatcggatacctcctttaggcccatcagctcttagtcggaacaacgaaccacagtcatag

SEQ ID NO: 5746 - DNA, 1830 bp, A.fumigatus
  unsure (60),(1509): Identity of nucleotide sequences at the above locations are unknown.
cgcttggagacaactgtcagtgccacgatggaggctcatcgtggacgccagcaccacagntgcgatccatgtcggaaggggaagcgggcgtgcgatgcgcctgctcgtagagaccggcacgcggacgccggcagccgaagggtgctagcagagagcaacctcaacatcccgtgctcgaactgcaggaaatacaatcgagaatgcacgttcaactggttagtcgagaaccgcgccgccgcacgggcgggtcgaaagcagaagagccgtaatgtgagcaacttgcctcgagcggacgacgtgagttcgagtcgctcgggaaccgacctgctggacgatctgcggtactcctcgtcgtggctatccaacagtcctgggaatggggtgtcgtcgaacggttcgacggaggaccagcccgggacgtggtcgatgccgtcgaatgccgtctcgataccgctgagaagcaaggagtcggaactcgatccgttcagtgtcatgctgtggaatgcaaatacagcacacgtaccgccgagcaatgcggaaacggcgggctcggctgaggacacttgttcgagtctggactactaccagcagagcttgtccagttcgggaccgcactcgctcgacgagacgctagatctacttcaacagttcgatgattcgagtccaggattgagtagctcgtattactcttcgccacctggctttgtgattccggaaggtagtgacggtctaccgacattcccggcagacagtctctatccctccgggaacaaagatagtctatttgttctttccgataacatctcagacagctatgcccgctcgatgatgacacagaatcttatccgcatataccatgacagcatggagaatgcgttgtcctgctggctcacggagcaaaactgtccctacaacacggcagtcccgtacacctcaccgagcgggctcgccagtaaggcacaagcggcatgggccccgaactggacgaaccggatctgtactcgggtctgtcggctcgatcgagcgtatgcatccgtccgtgggcgaaacctcagcgccgcagaagagaaaatggcatcgagagcgctccacaccgccatcatggcgttcgcctcgcagtgggcgcagaagatgcccagaagcaatggcttttctcttacctcgcccgtcgcgcagcacgagcgtgtcatccgggagaatctgtggaaccaggcgcggcgtgctctggagaatgcagcgggtatcccttcgttccgggttgcgtttgcgaacatcatcttctccatcggacagcgtccgctcaatgtcgatgaggacatggagctgcatgagttgctggagaatgacagcgcgccgttgttcatggaggcggcggtgcgacagctgttttcaatccgatataaactgacccgtctcgagcggcagaagccaaagtcgcgaagttcgccagagcagagcaagatcgatctcgccagtatggatatgccgtcgccacagacggatgcgttntatgccgacccggagcaccaggaaaccgtcaacctcctgttctggctggtggtcatgttcgacaccctgcaggcggccatgtatcagcgtcccctcgccatctccgacgaggacagccagatcacgtccgtgtcaccggcggtctccaacgccaaacccgacagcagcgtcgacctcgacggctggaacatcacgtactcccgcgccctgaaagagaaacaagacctctggggcgacttcttcctccacaaacgcgccgcacgccagggcgcgaacccacccgtcttcaaccgccgaggcagccaaggatatcgcgcttaa

SEQ ID NO: 5747 - DNA, 576 bp, A.fumigatus
cacagaatcttatccgcatataccatgacagcatggagaatgcgttgtcctgctggctcacggagcaaaactgtccctacaacacggcagtcccgtacacctcaccgagcgggctcgccagtaaggcacaagcggcatgggccccgaactggacgaaccggatctgtactcgggtctgtcggctcgatcgagcgtatgcatccgtccgtgggcgaaacctcagcgccgcagaagagaaaatggcatcgagagcgctccacaccgccatcatggcgttcgcctcgcagtgggcgcagaagatgcccagaagcaatggcttttctcttacctcgcccgtcgcgcagcacgagcgtgtcatccgggagaatctgtggaaccaggcgcggcgtgctctggagaatgcagcgggtatcccttcgttccgggttgcgtttgcgaacatcatcttctccatcggacagcgtccgctcaatgtcgatgaggacatggagctgcatgagttgctggagaatgacagcgcgccgttgttcatggaggcggcggtgcgacagctgttttcaatccgatataaactga

SEQ ID NO: 5748 - DNA, 507 bp, A.fumigatus
gacgaatatcctctggtccattctggatctgagaatcaacctttgcacactgcgatcgacgtacaaaccaaaataatggcaactatacgacggttacagcaaactctttcacaccttcggccgccaaaggctccccaactgctgtcgatcgtcgaaggcccaacccaaccagaactactagatattactctcggtgaacttcttacccttcagagcctgcaatacggcgactatgagtgtctcgttttcccctggactggcgcgcgctggacctacaccgatctgaaggatgaagcggaccgggtggctcgtggcttgctggccatggggattcaaaagggcgatcggatagggattatggcgggtaattgcgagcagtatatctcggttttctttgccgctgcgcgtgtcggggcgatcctggtggtgctcaacaatacctatactccgtccgagctgtattatgctctcgggcacacaggtatgtactacctgcagcattcctga

SEQ ID NO: 5749 - DNA, 351 bp, A.fumigatus
  unsure (194),(210): Identity of nucleotide sequences at the above locations are unknown.
tctgcagattgtcgactcctgttcctgactccacgcatcggccgccattcgctcgaggaggtactagccaagttagggcctcgtccaaaagagcaggggacctcgtcagcgttggaggagattatcattttacgaggacaatacagcggtttcagcacatatgaacatgttatccagcgcggtttaccgctccncagccatgcactgcangaccgagaagcggagctccattctacggatgtctgcaacctgcaattcaccagcggctcgacagggaatcccaaagccgccatgttaacacatcaatacgcttctcgagctactggcatgaaagcagctaattcggcatag

SEQ ID NO: 5750 - DNA, 552 bp, A.fumigatus
ttcaatgtggaaatcgaagatacggacattctcagggagcaactgcggatatggaggacatgcgatgcaattgaaaatcgaccgccgccattgattatcgagacatacttggagacaaagggactcacaaacaatcagagcctcgtgatcctggatgagaatgggaagagatgggatgtcctagaagcgcttactgcttctggtcaggcgagtcctgtgaggccaccgcattcaaattctgatgatgtcatcctcgagcgttggagagttgaactgggttctgcatcatccaaaccaccctccgaccttggctctatccttccgaccgtatacaagaaaagtattgtcctcttccgctctttgttcacatattccaaatttctgcccgcatggaagtttgcaaagcgcaatggaaggcttcgcagcaacccggctttacaaatcagatatagaatcctagacgggcgcacggcttcggatcgccgccaagtcgaccacttgactgttccgtcttcaccacagcggcgagatccgctatggttagaccccccc

SEQ ID NO: 5751 - DNA, 930 bp, A.fumigatus
atagttcgaggatataaccccctcacacctcctaacctcctccaacatgaaatcgccatgacagagaagtccaggcaaacggtactggaagctcgtcgagaggctgttgcgattgtccatggcacagataccgacaagcagcgtttgctggttgttatcgggccatgctcgattcacgaccccgacatggcgctcgaatactgcgattggcttctgaaaatgaaggagaaatacaatgacgaattgctgattgtgatgcgcgcgtatctcgagaagccccgcacaacagttggatggaagggtatcatcaacgatcccgatatcgacaacagcttcaagatcaacaagggtttgcgcacctcgcgtcagctttttgtcgatttgaccaacaagggcatgcctatcgccagtgagatgctggatacaatttctcctcagttccttgccgattgtctctctgtcggtgcggttggggcgcggacaaccgagtcgcaggtccaccgtgaattggcctccggtctttcttttcccgtcggtttcaagaatggtacggatggctcgttagacgttgccgtggacgccattggatccgtcaagcaccctcatcacttcctttccgttacaaagcctggtgtggtctccattgttggcaccgtgggcaatcccgactgtttcgtcatccttcgcggtggaaagaggggccccaactacgacgctcagagcatcgccgaagccaaggctaagttgacctctaaaggtctgcctcctcgtctcatggtcgactgcagccatggaaactcgcagaagaaccacaaaaatcaacccaaggttgctgccgttttggccgagcagattgccgcgggagagaccgctatcatgggtgtcatgatcgaaagcaatattaatgagggtaagccgcagttcacatag

SEQ ID NO: 5752 - DNA, 444 bp, A.fumigatus
gacccgccttgccctcaggaggaaccttttggttacctaaatggccagttggtcaactggagttcatgtctcacactatgtgaactgcggcttaccctcattaatattgctttcgatcatgacacccatgatagcggtctctcccgcggcaatctgctcggccaaaacggcagcaaccttgggttgatttttgtggttcttctgcgagtttccatggctgcagtcgaccatgagacgaggaggcagacctttagaggtcaacttagccttggcttcggcgatgctctgagcgtcgtagttggggcccctctttccaccgcgaaggatgacgaaacagtcgggattgcccacggtgccaacaatggagaccacaccaggctttgtaacggaaaggaagtgatgagggtgcttgacggatccaatggcgtccacggcaacgtctaa

SEQ ID NO: 5753 - DNA, 681 bp, A.fumigatus
cgagccatccgtaccattcttgaaaccgacgggaaaagaaagaccggaggccaattcacggtggacctgcgactcggttgtccgcgccccaaccgcaccgacagagagacaatcggcaaggaactgaggagaaattgtatccagcatctcactggcgataggcatgcccttgttggtcaaatcgacaaaaagctgacgcgaggtgcgcaaacccttgttgatcttgaagctgttgtcgatatcgggatcgttgatgatacccttccatccaactgttgtgcggggcttctcgagatacgcgcgcatcacaatcagcaattcgtcattgtatttctccttcattttcagaagccaatcgcagtattcgagcgccatgtcggggtcgtgaatcgagcatggcccgataacaaccagcaaacgctgcttgtcggtatctgtgccatggacaatcgcaacagcctctcgacgagcttccagtaccgtttgcctggacttctctgtcatggcgatttcatgttggaggaggttaggaggtgtgagggggttatatcctcgaactattcatttgcaagaaagctcgtcaatgaaggtcgaggagatcggggcaaaaagggacatactccgcgaatcttcgaggtggtcactgttccctacattagggttttcgataaagaactataa

SEQ ID NO: 5754 - DNA, 585 bp, A.fumigatus
ggatacgctgttttcaaggataatatacggattcctttgcgcccattcctgggttgtatcggcctggctcctgcaacagacgaggacttgtctacggttcctccgacaaacgccggaggtaacctggattgccgtgacttgaccgtcgggtccaccctatacctgcccgtgcaaacggacggggctttatttagctgtggggatggccacgctgctcagggccacggagaagtatgcgggaccgcaatcgagacctcaatcaaggctacgcttcgattcgaactatgcaaggacatgccgtgggtgacgagtccacaatatgagaccccgcccagcctgctgacaactagaatgccggtatttggccaatacgcaacaaccggtgtcggccaaacgcttcacgaggcctccaaaacagcggtccggaacatcattcagtggatggtggccaccaagggcttgactcattgtgaggcatacatgatagccagtgtagcaggcgatctacagatcatcgaggcggtaaatatgcctaactatgtggtggcaatgacaattccgttggagatatttggcccaagttag

SEQ ID NO: 5755 - DNA, 471 bp, A.fumigatus
agtgcatgtaacactaaacaacggcaatatatctttctggaccacatggattccacattggaaggtctgaacagcgctcaaaaagccgcagtaacttctcctgcttccgtcttgcaagtcctcgctcctcctggctcaggaaagacgaagacattgaccgcacgcgtcgcgtatctcctatctcattatggataccaaccgcaggatgtcatctgctgcacgttcaccatcaaagcgagtcgtgagatgcgagaacggcttgcgagtctggtaggcaatgaagtacaatctagactgattcttggaactttccactcaatatgccgtcgatacctggtgagctatggttatctgatcgggctgcggaaaggtttcggcatcgcagactccagcgatagcttggcaattatcaaagtagggagcacctgttggcatcacggttttctatacactctagtcatctgttactaa

SEQ ID NO: 5756 - DNA, 498 bp, A.fumigatus
tatctgcagaggatagtgaaacgtttacggtgcagcatccagccaaacactgcccgagcgcgcatatctcaccagaaagctcacggggtcagcccggatgagcccgcggtgaaatattccacgggttcgaagtcggcagagcatcacgaatttgttcagatttatcgagcatacgagagctacctggagacgtccaatttgttcgagtacgatgactttcttctccgatgcgctgacttgctgagaagacacccacagtgcgtctcgaacgtgcaggcagtcctggtcgatgaatttcaagacaccaaccatattcagtacgagttgatgaatttatttgcagtgagaaatcgccggatcactgtggttggagatccggaccaaagcatttatggatttaggtcagcggagatcaagaaccttgggcgaatgcaacagcattacaaggacacatcagtgatacttcttcaccacagggggtcgaagcatccgcgctaa

SEQ ID NO: 5757 - DNA, 408 bp, A.fumigatus
ctgcccgcctccacaatcctcccagcccgaaagacaaagatgcagtccgcgtccttgatcgtactcaaccgatgcgcaaccgcaatggtactcctcttcccatcgttggcagcctcgctcagcgccgcctgcacaatcctctcgctctccgtatccagcgcactcgttgcttcgtccagcagcaggatctttggatcgcgtatcagagcccgtgcgattgcgacccgctggcgctgtccaccagagagcttcgtgccgcgaggaccaacctcgctgttcaagccgtcaggcaacgagatgacgaaatcaaagatgttggcgtctttgcaggcctgttcgatctgtgcttcggtggcgtccctcgattcgaccaggcccatcgcgacgttttcacggatgctcccttga

SEQ ID NO: 5758 - DNA, 1041 bp, A.fumigatus
gagagtagagagggtgaatatgtatacaaacttgcatcaccccaaagccttatccaacgcctggcccctgcacatctcgtagtagctccctcttgtctccagcagctcggcatgactgcccgcctccacaatcctcccagcccgaaagacaaagatgcagtccgcgtccttgatcgtactcaaccgatgcgcaaccgcaatggtactcctcttcccatcgttggcagcctcgctcagcgccgcctgcacaatcctctcgctctccgtatccagcgcactcgttgcttcgtccagcagcaggatctttggatcgcgtatcagagcccgtgcgattgcgacccgctggcgctgtccaccagagagcttcgtgccgcgaggaccaacctcgctgttcaagccgtcaggcaacgagatgacgaaatcaaagatgttggcgtctttgcaggcctgttcgatctgtgcttcggtggcgtccctcgattcgaccaggcccatcgcgacgttttcacggatgctcccttgatacaggaccggctcttgctgaacgagtgccaagcggcgacggtgatcttgtgggctgaggtcgtggattggccggtcgttgaccgcgatatagccggacgttgggtcataaaagcgggcgagcaggttgatcattgtggacttgccgcagccggacggaccaacaaaggccacgaatttgcccggtgggatgctgacatcgatgccggatatgacgttggagcgagggcgagatgggtaggcaaagtcgagggcgtggcaatcgacggtaacggggccagggtcttgcgatccgtccgaaggcggctcgtcagaaaagcaattgtcgatagcggggacccgctggcgcagccagaagatgtagtttgtcgacccggtcgctttggtgatgctagtcgtgtactggaagatcgcagctgcattctcgcctccgactacgacggcagtgaagaccacgaagaactgctcgttggtgtactcgcccgtcgagatgagcttgcccccgtaccagaagcctag

SEQ ID NO: 5759 - DNA, 1590 bp, A.fumigatus
caagtcatcatcccaggggaggacattcttcctcagggggtggggtccaagctgaccatgccccagaaagtcggccggaggtaccgccgcgaactcttcaggaacaccaggaaacaagagattgcggtcttcgacttggaacacaacgctaccggggcgatttcctcgcggctgctgatccacgcgtcgaacctgaacgagctcctggggatcaactcggggttgattctgatctacattgtcacggtcatctctgtgtccgtcttgggaattgcgtatggctggaaactcggcctcgtctgcgtctttggtgctctgcctcccctgctgcttagtggctacttccgcatccgcctggagtacaagctagaagaagatacctcggcgcgcttcgccagcagtgcggcgattgcggcagaagcaatctcggccatccgcacagtggcgtctcttacgctagagaacaagttacttcagatctaccgggaaagactcaccgcggtcgcagagcaatccgtgaaagccctcacttttacgatgttctggtacgccctgacacaatccatcaacttcctggccatggccctaggcttctggtacgggggcaagctcatctcgacgggcgagtacaccaacgagcagttcttcgtggtcttcactgccgtcgtagtcggaggcgagaatgcagctgcgatcttccagtacacgactagcatcaccaaagcgaccgggtcgacaaactacatcttctggctgcgccagcgggtccccgctatcgacaattgcttttctgacgagccgccttcggacggatcgcaagaccctggccccgttaccgtcgattgccacgccctcgactttgcctacccatctcgccctcgctccaacgtcatatccggcatcgatgtcagcatcccaccgggcaaattcgtggcctttgttggtccgtccggctgcggcaagtccacaatgatcaacctgctcgcccgcttttatgacccaacgtccggctatatcgcggtcaacgaccggccaatccacgacctcagcccacaagatcaccgtcgccgcttggcactcgttcagcaagagccggtcctgtatcaagggagcatccgtgaaaacgtcgcgatgggcctggtcgaatcgagggacgccaccgaagcacagatcgaacaggcctgcaaagacgccaacatctttgatttcgtcatctcgttgcctgacggcttgaacagcgaggttggtcctcgcggcacgaagctctctggtggacagcgccagcgggtcgcaatcgcacgggctctgatacgcgatccaaagatcctgctgctggacgaagcaacgagtgcgctggatacggagagcgagaggattgtgcaggcggcgctgagcgaggctgccaacgatgggaagaggagtaccattgcggttgcgcatcggttgagtacgatcaaggacgcggactgcatctttgtctttcgggctgggaggattgtggaggcgggcagtcatgccgagctgctggagacaagagggagctactacgagatgtgcaggggccaggcgttggataaggctttggggtga

SEQ ID NO: 5760 - DNA, 1413 bp, A.fumigatus
  unsure (1406): Identity of nucleotide sequences at the above locations are unknown.
ttggggggtttaagaaggttattacaagaagctccagggcgatcatatgacgatgggatgtaccatcctggtgataatcgactgtcaggcgttgcaaatccttccaatggaatcgatcaccccgagacgaagccaatcgcggcagcagacgcaacgctagacggacacggctggagcgagtctggaatgcttcggggagcaacaacagacacgcttccaaaccccgtggtcgctgctgtaaaacccgcggccctgccgtcagaagcggccctggatctgcatcaaggacatttcgaccatccagttcaacctatcaccaccataactacgtcgacaaacgcctctccatccacgacatccgcgaccaccttttacaaatctaccatccgtaccacccttcataccgtctcgatgccgactgctactcgggctagtttgactaagagcgcatcccatgccacctccacctccacttcggcgcccgccgcccgtggcgggggagggacggcccccggtacgcaagcggggattgtcatctcagcgatgagcctcgtcatcatcttgattgtgataatcttctggtggctgaatcgcaagaagcgggccctcatgaagtccctccgaggggaggagtcgccgccgccgacagagaagccaaacccggcgtatagattcgcttcaaacctgtatacaagcagtacctctacgctggtcaatgtaacggagatcttcaaggcttccagggagaagaaatcgccatccgtcaatgacggaagcagcagcatctactccaccgaccagatacaaagcaaccagacatggagaactctgttcacccgggctgcggccaaggttagagcattccgaggcagaaaacagccccccgacaggcgaagccgctattcccacggctatatctttgcacaggagttccagcacgtccccccactgccgccgccacgtctacagaagattgtcgccggtctctacgccaacggttcgtcgacgatcaaaaccgtaatagcatcgtttcgagcgcaccctccgccgccgaaagatagcgcgtcctcctcaacgtggagctccacgagcagtcgcactccgtgctcgcgcgcctatgagagctacccgcaagcggatcagttccagcctccatgcgacatcagcgatagtctggacctggtcaaagtgcgcagtgtttcctcgggcactgtcgccatgagtaaccctgccgagatcagcgtcgacgcacaggccggacgcatctcgggagagagcaggccacaccaggaggcggcctgggagtcatccagcccctcgctgtcgcagcatatctcggctccatcccagcggcagtcccccccagtcttcaccagggggctgcagagagccgatcagttaaaatncccgccg

SEQ ID NO: 5761 - DNA, 1179 bp, A.fumigatus
attggtgagactggggccgatagagtcgaagagccatcggcagaagagaacggggatgccaaggcatctgtcggcgctgagaatgacacagcgggagctgtggaaaagggcgaaggtgctgaagacaaggactcatccaagccgaccaagctcattctaaagaccaaagaacccgacccttcacgaccggtaccttcgatagaaggcaccggagacggcgttcagccccctgttcgtcgccgaggtcctgggcgacctcccaaagacggcatcatgtccaagcgcgaacgtgcagagttggcaagggagcagaaactggctgctaagcgggaagccaacggaggcgtcactcctcctccgctaaatcgacccaaagctggtaagacgacaaccacaaccacatcaacggtgggcactgcaaccgctacgccgagtcttcctggcgagggcgagtctccggggtcgaagccggaaaaacgcaagtacaccaagcggaagaagccggacggaacgctcatggactatcccctgccttccaccgagggtggcccatttcctatggaacaacgcccggaagagttcatcaaggctcctccggtcaagaagcgcaaaccttcacgatctccctctcccaactaccctcccgaatctgcctatacaccagaggatctggcgaagcctccgtacaattacgctgtcctgatcttcgatgccctcacagaagcaggcacgccgatgaccttgaagcagatctatcgtgcactaaagttgaaatacccctatttccgtttcaagtgcgagaccgagggctggacctccagtgtacggcacaacttgaacggcaacagtcacttgttcatgcacgccgaacgagatggcaaaggatggtcgtggcagcttcggccgggggcatccgtcgaaaaggaaaagaagagacgtccgtcacctccaccaccatcacagcctccatccgtaccggcttccgccccgcaatacatgccaccgttgaacccatcctatggaaatccacagaatggacaatcgactctggcgaatcaacatttccagttcccgaccatgcctccgaatacatatgctcctcccacgccagctcctacctcttctgctgcagcacctccctccgctcctcctcgtcatctagacccgtatcctcctcct

SEQ ID NO: 5762 - DNA, 1167 bp, A.fumigatus
gatttcatacatcttaacagtcgagttgcgttactgaccgtcatagaaatggagctgaaaaagatccatgtcggtacggtctcttatgcaaacgacgctatggaggaagtggcgtcattcgttcggcaagccttcgctggaaataccttgaccacaccttcagctgcattcggagcccaagcaggacttggggcagctcctcgtacaaggcgagagattgggtcacgcgttcgtgatattgtcctggcgctggctctatgtcataatgtcactcccacaaccgacgaagaagacggtgtgaaagtcacgaattatcaagcgtcatcgccggatgagattgccattgtcaagtacaccgaggaggtcggtctgaagttgtcataccgtgaccggcaatccattgtcctggaaacgaccgagacaggcagtgttgtcgttcgtgttcgcatccttgaaattttccctttcacctcggacagcaagcggatgggtatcattgtacaattcgaaacagccaactcgatcctagagtcttcgaacgaagatgctgaaatctggttctatcagaagggcgcagatactgttatgtccagcatcgttgcagcaaacgactggctcgacgaggaaactgcgaatatggctcgggagggtctgcgtacccttgtgattggtaggaaacggctatccttgcaacacttccaggagttctctgcaaaatacaagcaggcctcgcttgcattgcaaggacgcgacgtcgggatggcgaaggttgtcagcgagcaccttgagcgtgacctggagcttctcggcgtgactggtgtggaagatcgtctgcaaagagatgtaaaaccatcactagagcttcttcgcaacgctggagtcaaaatttggatgttgaccggagataaagtggagaccgcacgtcgtgtcgcaatctccgcgaagttagtagctcgaggccaatatatccacaccgtcgccaaagtgaaggacccgtctgccgcccaagaggcgttggactttttgcgaaataaaaccgattgctgtctgctcatcgatggcgagtcgctgttgctgatgcctgggtcagttccggtcggcattcatatctgtgggccgtcctcctaccgggctgttgttgcattgtccaagctcttccaactcaaa

SEQ ID NO: 5763 - DNA, 372 bp, A.fumigatus
ggtcttctggaatatgagatcaataacctgaccaagattttatgcgcgttgaccctcactctatcaatcatcctggtagctctggagggttttcaaccaaacaacgacaaagaatggtacatcgcaatcatgatttaccttatcctattctcaacaatcattcccatgagtttgcgagtcaacttggacatggcgaaatctgtgtatagcagattcattcagcgagacaaagatattcctgggaccgttgttagaacaagtacgatacccgaggatcttggtagaattgaatatctcctttctgacaagactggtaccttaactcaaaacggtaagatttcatacatcttaacagtcgagttgcgttactga

SEQ ID NO: 5764 - DNA, 663 bp, A.fumigatus
gttgcacgcgatgataacaacctttccaagggctatggattcgtatcttttgccgacttcgagtcctcagatgctgctattgccaacatgaacgggcaatatctcatgaacaaacaagtttccgtgcagtacgcctataaaaaagatggcaaaggcgaaagacacggtgatcaggcagaacgaatgctggctgcgcaggctcgcaagcataatgtccgtccaccaactcagccgcttcctccgcaattcaccaacccgggaactcctatggcagccgctggggttgctaatggagacggcacacaagcgttgaacgccgctccgccggaattagcgacgggaaggggcataccgccgcctaacttgggcttccagaacataccttcaccacaacctaatcgacaactccctcctacggctcccttggcaaacccacctcccggtttgccagcaagacctccgccctcgcaagccggttacggtggccctcagacatttctcccctctggtttcaattctgctggtcaacagccacccttcccacagcaagcggcaccgccgccggggttcgcaccaccgggtttcggtcccccatcgggaaccgctaaccctccaccattaccacctggcttccagcaacctggttatggtggcggccgctga

SEQ ID NO: 5765 - DNA, 399 bp, A.fumigatus
ctttgtagggagcaagataaagaggccaccgtttacatcggtaatctcgatgaacgggttaccgatagcctggtatgggagctgatgctgcaggctgggcgcatcgtcaatgttcaccttcccaaagatcgagtaacgcagtcacaccagggttacggctttgtggagttcataagcgaggaggatgctgaatatgcttcgcgaataatgaacgggattcgcctttatgggaaacctatacgagtgaacaaggcatctgccgataaacaaaaagctgtggaaatcggagcagagctcttcgttggaaaccttgatcctttggtcacggagcaggtcctatatgatacgttcagtcgcttcgggacgctcgtcaatattccaaaggtaagacgacaataa

SEQ ID NO: 5766 - DNA, 228 bp, A.fumigatus
agcaaaatgtccgcacaaaactccggccgtcagtcccctcctcctgaaacccagtccggcgcccagcagcaggatcccccctcggcgggaaagacccagtccgagcttcgtggcgacccacagcattcgcaacgtgagtcgaatgagaccaaggagtggaagctggagagtaaccccaagcatccgcttgaggatatcgaggccgcaaagtactcgaaggtacattga

SEQ ID NO: 5767 - DNA, 312 bp, A.fumigatus
ccttgctgttttccctcctactcagagtccatcgatcacactcctcgccctcaccctgcttctccctcgggcattctccccgactctttcgctgcctaccgctcgaaggctcagcagcacggccctctcggtcgcgcttctttcactcagggatccatcggtcgcctgcccggagctgctctcggccctgttcagcccaagcaaggcgaattctttgatcgggcagagcttcccgccagattccaccgtctcccatggactgaggctgagattgaggccattgagaccggcggtgcgagcctttatgcttaa

SEQ ID NO: 5768 - DNA, 213 bp, A.fumigatus
ataagcatacatagacatgcaaagtgtcctgtggaatgcttgtgctttgtgtctcgagtccaatcttcagtgttcgtcccacgtgccctgattcgcagttatctatccgtcgaccttggcctgtccacacctatcagcattacgtctttcaactacactctgcaagccaaaacagtaaccctcaggttttgctcaatgcgcagtacagcttga

SEQ ID NO: 5769 - DNA, 210 bp, A.fumigatus
  unsure (154): Identity of nucleotide sequences at the above locations are unknown.
taccataaagctgagggcctcgcggccaaatttgtttttcttttttttttttttctcagaaatttctttcctttgttcgacatcgatattagcattgtggggctttctgaattctatttgcctatgtactatattgacagtacgttgagaatanacgcaagtgtgccttgtgcctctgcaatcaggatatttctcatgttcctttattga

SEQ ID NO: 5770 - DNA, 240 bp, A.fumigatus
gccgccttcctgacgcagaaatgctcgctgcctacccgcaccatcaagttcgaaatctgggacacagccggccaggaacgcttcgcttcgctcgctccgatgtactaccgtaacgcccaggcggcgctggtagtctacgatgtcacaaaaccatcctctctcaccaaagcgaaacactgggttgccgagcttcaacgtcaagcccagccctggaatcgtgattgcacttgttggcaataa

SEQ ID NO: 5771 - DNA, 189 bp, A.fumigatus
tcacttgtactgccgcagatattcaccccttttatctcgatggacgatgtggaagaaatcatctactctctagtcaagtatcaaatccacgccaggttgctagtgtctttccaatcaacttttttgcacatccaagagaccaagcctatgggcgtcgtctacgcgtggccagcttttcttaagcggtag

SEQ ID NO: 5772 - DNA, 1632 bp, A.fumigatus
atggcgttagaacatgaccccaattcagcgcgaaggaaacgtcgaaagacggaggacgttaatcagcgaacacgcgacctttctactgagggtgaaccgcatcaaggcgataactccctgctgctggatcagcccctcgctacattgaatacccccagtggtgagatccaattcgccgccaatgctggagccagcaatgccactctcccgcctgttgtttcagatgtcgccagcagtgagtcttcatcaggatcgaactctgcctcagacctccacaatcccgataggggggttttggacgatgcaaatcaggcgttgcagtcacgttccccgccacagaaaatcatgaaactcaccgctaatgggaaactcctaagttcacctgtcgcgaagcaatcggatgatacccctcagaagaagagaaggagcaaacgtaccaaagcagggagccaagggctggagcagggcaagaagaaattggtggtcctgaagtacgccagcgaacccgacaagaaccaaaatattgggcagctcatcgacaagattatctgcggccaaacaaggtatatcccctccagggcaactgttccacctctgccagttgctcaaaaaccgcaacctccgaaacctacgcacccgttcttcctgaaacctgctctgcgcaaaccagacccttccgctgaaactgtacctccgtcaaatctcagccaaggaatacccagcaccacttcggtaccagagacaaagccttcttttaccaggtctaccagccggccagtgcttttctcgtcattcaggccacgtccaaagttccctgaaccaatcgacccggtttggccccctaggggccttggtcatgttcgaggcattccggggggctcagatcggcaggataaaaatttgtgttatcctctgaatattgatcagaagaaagcaaaaatgcctgcggttcgggtacttgacgaggagaacatactccgtacgtggacaaatctaaataaggatgtcccgacagccttacgtttacctcagaggcacacagcgagtggaagagatctgcaacaagcaatattacctgagctttccaattccacctttgctgatgggacgaatttaattgtcagtcatccggccatctcaagagtcttcttgtcaatcccacaatctttaactgcgttcgatcgaggtgaatacgacatgagcttgtggactcaaaaatatgctcctgagtctgcagcccaggttcttcagatgagcaaagaagcaatgatgctacgggactggttgaaatatcatacagtatctgccgtggatacaggaaaacctgcaaaggacattgagaaagtcaatgagaagggtgacgttaaaaagcggaagaagaagcccaagaaggcagaccagctagacggattcattgtcaacagtagcgatgatgattatgaaatgagcgaggttactgcatctgacgatgacgagttagccggtggagtaacagtgtcttccaaaaaaacagtcattcggtcgggtgactcggacggtgtttggagatccggcacaggaaatcaccgtacgtccaatgtaatattcctcagtgtcgtcttcaccacggggctggaaggacaagcgttcaat

SEQ ID NO: 5773 - DNA, 405 bp, A.fumigatus
tttcctacagcatctgcaaatcgctggtgttgttgtggagacagcgggaagactgaatgcgtcaatatcactatgacaatggcagcagaagttgacttgaatcacagcgctggtgagctcaccaccgaagaactcgagcgtatcgtcaccatcctccagaaccccacccagtacaagatccccacctggttcctcaacagacagcgcgatatcgtcgatggcaaggactcccaggttctgtccaacggtctggacagcaagctccgtgaggatcttgagcgcctgaagaagatccgctcccaccgtggtctgcgtcactactggggtctccgtgtccgtggtcagcacaccaagactactggccgccgcggacgcaccgtcggtgtcagcaagaagaagggctaa

SEQ ID NO: 5774 - DNA, 285 bp, A.fumigatus
tgttttttctcgattcctacagcgctcgtgtccggcgagaagacgaacttccagtacatcttgcgtctgctcaacaccaatgttgacggcaagcagaagatcatgtacgccttgacccagatcaagggtgtcggccgtcgttactccaacttggtttgcaagaaggccgatgttgatctgagcaagcggtacgttcaatctacttttgatttcctacagcatctgcaaatcgctggtgttgttgtggagacagcgggaagactgaatgcgtcaatatcactatga

SEQ ID NO: 5775 - DNA, 372 bp, A.fumigatus
  unsure (20): Identity of nucleotide sequences at the above locations are unknown.
agccgtgccggtggatttcntaaaagagcccccgtcgatacttccagccccgtggtgaagacgaagaaccccatcagcggtcaccctgtaggttacaagttcattccgctggctacccagctgttactggcggatcccaactccgtccaagccaagcgcgctcagtttgcacagcaccacgtgtgggtgacaaagcaccgcgatggtgagctatatgcgggaggtcgatacacacttcagagccagcaggaggtggatggtgtggctgacgctgtcaaacggggcgaatccgtggtggatactgatgtggtggtctggagtacctttggtatcacgcacaatcctcgtgtagaggattggccagtcatgtga

SEQ ID NO: 5776 - DNA, 1491 bp, A.fumigatus
agactaattggcggaaagatcattgaccatagacttgagcggagtcggatcacctctgtaccgaccggagagcgaagttttcacgtgctgtactatcttctagctggaactagtccagctgagaaggctcacttaggcttcgacaaagccgtccatgtatcgacttcttcaggcgccattggccataagaggtggaggtacctcggtcacccgactcaactgaaggtgggtgtcaatgatgtggaggggttccagcatttcaagacggctttgagaaagttggaatttccgcgcagcgagatcgccgaaatttgtcagatccttgctactattctccatattggacagttggagtttgctagtgggcaagccacaaccacccatgcggaagaaagtggtggatattcacatgagggtggcgagacagtcactatcgtgaagaacaaagatgtgctgtctatcatcgctgcattcctgggtctgtcggttgaagacctcgaaaatagcttcggctaccgaactaagaccatccaccgggaacgagtaacggtcatgctggatccaaaaggggcccgacaaaatgccgatgagcttgcacgaaccatatattcccttcttgtcgcctacgtgattgaagccgtcaaccagcggatctgcgcagcagaggatagcgttgcgaacacgatttcgattgtcgacttccctggttttgcccaggcctgcgccaccggttctaccctggatcaacttttcaacaacgctgcgactgaattgttgtacaacttctgcctgcagtcattcttcgatcgaaaggcagatgagttggaacgggaagaggtttcggtgcccgcgacaagctacttcgataatactgatgctgtccgcggtctgttgaagcatggcaatgggctactcagtatccttgacgatcaaacgaggcgcgggcggaccgacaatcaattactagaatctctgaggagacggtttgagaacaagaaccctactatcattgtggagggctcgaagaggaccagcttgatctcacagaatgctcgttccgctttcaccgtaaagcactttgcgggtgaaatcgactattctgtcaatggcctaattgaggagaatggagagttcatctccggcgaccttatgaggctgatgaaatccaccaaaagcgacttcgtcagggaactcttcggacaggcggccttgcaaacagtcacccatcctaaggagaaaacggccatcatgcaagcacaagttagctcaaagcccttgcgtatgcctagtatggctcgacgaaagacaagcccatcttcacggctggccttcgatgcgggagatgcagatgaggttgagagtcaagcagagagcatcgcaaaggattcatcttccggcagacggaaaagcgctatgctcactagtggcatacaaggtgccgctctcagtttctttcgtcatcagcccgggcctggaaataaaagcaatgcg

SEQ ID NO: 5777 - DNA, 624 bp, A.fumigatus
  unsure (406),(537),(576): Identity of nucleotide sequences at the above locations are unknown.
caaagagtgattccgcagccgttcaataacgtcttggtttcgaactcatcctttccgtcttcgtcctccacttctaccgcctcggcctttctttttccaagattcaaatacattccttcaatctcaataaacgtctccgaggagcagaatgcgccgacaaatctcgcaacgttcgtccaagcctttcttctcccggcacagctaaatcctatgcaagattccctccccgaatccaagagggcggaactaacccgcaagtccgaacttgagtccagtttcccaggtgccgtcgacatccagtactctcctgttgtactgatatgcggtcatggtggccgtgacatgcgctgcggagtcatggcacctgtgcttgaaaaggagttcagccgcgtcttaagtgcgcggngtttctcaccagccggagcggacggtaatcctactgacagccccgagcatgctaagattggactgatcagtcatgtcggtggtcacaaatatgctggaaatgtgattgtgtacattcctcccggaatgaangcaggcggatcccctcatccgctggcgggtaagggtatntggtatggacgggttgaacccaagcatgtccaggggcattatggatga

SEQ ID NO: 5778 - DNA, 219 bp, A.fumigatus
  unsure (32),(116),(155): Identity of nucleotide sequences at the above locations are unknown.
tatatcaccattccgatcaatcccaccccggnaatgttcgagtacacttcttccactcattacagtctcatccataatgcccctggacatgcttgggttcaacccgtccataccanatacccttacccgccagcggatgaggggatccgcctgcnttcattccgggaggaatgtacacaatcacatttccagcatatttgtgaccaccgacatgactga

SEQ ID NO: 5779 - DNA, 201 bp, A.fumigatus
cttgttgcaagtatccttgctgcgttatcttcagcatactcacttactactagtcgaaagcaatatactagggtccagtacagtgtctctgtcatgcggtcataccgtatgtacgatgtagtcttgggaggtctctggatcgaaagcatcaaaaactttatttgtgctgttggttcttcgaagcgggttgcaaattcatag

SEQ ID NO: 5780 - DNA, 1002 bp, A.fumigatus
gttagtcaaaagaaaatgagctctctccgaggcgtggcacgctcagctcctcgtggtatccaggctatcggactgtggagacagagtgaaagtgttgcggccaattttaccacagcgaaaagccgatttcaaatcagcatatcgaatcgtcgcctattacgctcggctcctgcccggaagatacagaccgtcgccgccgaaaactcttcatcgcgagattcatcgaacccggcactctcatttccttgtctcgacgccctggatgcgaaatcggcgctgctatcggcccggtcgatcgagtcaggtccagagccttcatacacaaccggacaacatgagaacttccactgtgaggagccattgctactagactggggtggtgtcttgccagagtttgacatcgcatacgaaacatggggtcagttgaacgcggacaagagcaacgctattctattacatactggtctgtcagcgtcgagtcatgcgcacagtaccgaagccaacccaaaaccgggatggtgggagaaattcatcggttctggcaagccgttgaatacggataagtacttcgtcatctgtacaaatgttattggaggttgttatgggagcacgggcccgtcttcaatcgatccgtccgacgggaagagatacgcgacgcggtttcctatccttaccctggacgacatggtccgagcgcagttccgtctattggactcattgggtatccagaaactgtacgcctctgttggctctagcatgggtgggatgcagagtcttgcggcaggagtgttgttccccgagcgcatcggaaagatcgtgagtatcagtgggtgcgcccggagccacccgtacagtatagccatgagacacactcagcgccaggtgttgatgatggacccgtcacggcacggtgtcctatatcgctactcattcccgcctccacctgcgtttgtcaacatccagtcttcaccagccggggctggcaaggatcacgcgatgcag

SEQ ID NO: 5781 - DNA, 465 bp, A.fumigatus
ggtcacagaagcagaggcaggatggcttcacttatcaccaccatgttcgtgccctttagaccttttattccctctccttctccttcttcctcatctacttctccgtctgccccgccttcacaccctctctccgccctcaccccgtcaatctcatgcagcaccatccatactttccgtggtccgttgtcggagccaccttcttacctgtctcctgctgttcgcgcgctcaagcagaatctgtgtggactgacgcctcccagcaatgcgcgaaccagggcgccgtttaagccccggtcagctgccaagggcacgagcagttatcaattgaggcagtttgcagaggcgacgctggggagcgggagcttgagaaaggctgtgaagctcccggagggcgaggatctgaatgagtggcttgcagtcaatggtaagtctactggagggattgtcgcggggccccgagtgtaa

SEQ ID NO: 5782 - DNA, 438 bp, A.fumigatus
tgtgatgtgatgatgctgcgagatctatggttcgccgtcgcaacggcattcactcttgtacaggcagatcgcggaccgtattttcagtcgagccgctttgaggatggggaccttgggcaatggcccacggagacatatcgttcatctgctctgatgggccccatattgaactacgtggagtccaatcctcaatgcaaggatgggcaatacaccttgattgcgccccgtggaatggcggtgcgaaatccggggcccatgatcatcgatcaggatggtcacctggtgtggaccaaacactacggccagacgtacaacgtgaacgtgtacagatacaaaggccaggactatcttacattctgggtgggtaacgatgggatcgttggtcatggcgacgggacatactacatggtaagccccgtgtccgtgtctacatggtaa

SEQ ID NO: 5783 - DNA, 522 bp, A.fumigatus
ttagattcggcctatgaggaggcgtttacgatccggggagccaacggcctgccagcagacctccacgagttccagatcactggtcatgaaaccgccctcttcacggtctacgacgtcgtccccgcagatctacggtccgcaggcggcccagaaaagggctggatatgggacggcacgttccaagaggtcgacattgagaccggccagctgctcttccagtggcgcgcatccgagcacttcaacctcaccgacagctaccgcggccgcgaaggcgccggcgactccgaagaccatccctgggacttcttccacatcaacagcgtcgacaaggacgccaagggcaacttcctagtgtcctcgcgctacatgagctgtctcacatacattgacggccggacaggcaacatcatctggcgccttggcgggaagcataacgactttcacgaacttttttgccgcgcccgccacaaacttaacttgcaacaacaagcccggttttcacgaacaacggttcgggcataa

SEQ ID NO: 5784 - DNA, 648 bp, A.fumigatus
gtcactatcaccaataatcacaacagtctcgcatctataagcagctggatttccatcattagtttatctacatcaatcttcctggccagatcgagcagaaaaatggccagttcaacacctcccatccctacccaaacatggaccaaagatgcatacttcatctcaacggactcctcactaatccccctcgaaaccctcaacgactggttcgcatcagacgacatatactggaccaactcactgccgctcgatatcctgaaacagttggttgagaactccatgtgtttcggcctctattacacgcccgaccagccagacaaggccgacgcagagcccgagttcatcggcatcgcccgattcgtcacagactacacgacctttgtctacatcaccgacgtctacgtgctctcctgtcaccagggcaagggtcttggcagctggcttgtagagtgcatgggcgaggtcatcgatgcgatgccgtatctgagacggagtatgttgtttacgatggactgggcgcggtcggtgccgttttacaagaaaatcctggggatgagcgtacaggagagtaagaatggagaggggatggctatactgatgaagaaggggaacggatatccgaagtatgactatgaaaaaggagtttga

SEQ ID NO: 5785 - DNA, 189 bp, A.fumigatus
cgatcagacgggacgaccggaaatgaaggacctagtggcgccaatatgctaaactgccgaccgaagacagtgaagaccattagagatttatactcgatgtctggtttcttcggctgccctcggtcaagtaacgttatcactttgcccgatttcatcacactggcgcaaaacgcggtggaacctccctcg

SEQ ID NO: 5786 - DNA, 1119 bp, A.fumigatus
gaatatcactcagagatgttgcaactcctcaagttgcctccgcagcaagatcgcgacgctgtcatgatcctccacatggggggtgtatttggcgataaagaggccacactggatcggttccgggagaattacaaagctctttcccaggatatcaagaatcggcttgttctggagaatgacgatgtaagctggtcagtgcatgatttactgcccatttgtgaggagctgaatataccgcttgtcctcgactttcatcaccacaatatcgtcttcgattccagcaaagtgcgcgagggtactttggatatcatggatcttttcgaccggatcaaggcaacttggacacgtaagaacatcacgcagaaaatgcactattcggaacctgttccctccgccatcacgaatcggcagcggcgaaagcacagcgatcgagtgtccacgcttccaccttgcgacccgaccatggatttaatgatcgaggccaaggacaaggagcaagccgtgtttgaattaatgaggcggtttaagctgcctggccacgaccttttcaatgatgtattgccttacacgcgaaccgatgagaacagacctttcaagccccctcgtaaaaccaagaagaacggagggttcgttgacctcgaagctcaggtccctcttgctcctaccgttcctgaggaagaagtaggcatgggaggtccagaaagaagggtctattggccaccaggtatggaagagtggcttcgaccgaagaagatcattcgtgtcaaagcacggcagagtccggcaaaatcgaatgtatcgaagaggaacgcaaaaggaaatgaagactcgtcacaaattcaagacgaggatgctgatgaggaaaatgagggaccggcgacccccaagcctaagaactctcgtccacccaagcgcactggaagtgtgaaaaaacagacaagcaggaaaaggaaggcttcaccgacccctccctctactccgtcggtctctgatatcgagggtttagatttggcgaaaccgcccattctttctggtactgagactgccaatactcgttgtagccgacgcgcaacgaccgccaagaaggtcaattatgcggagagcgactctgcatgctaa

SEQ ID NO: 5787 - DNA, 720 bp, A.fumigatus
ctggactactgtcccggaggtgagatcttcagctatcttcggcgtgcgcggcgatttaacgagactacctcgagattctatgccgccgagatcacgctaacgatcgagtaccttcatgacgttgagggcatcgtttaccgtgatctgaagccggaaaacatcctcttggacgctgacgggcatattaagctggtcgactttggattcgcaaagcagatcaacgatcgcgagacgtacacgttatgcggcactccggagtacctagctcctgaggtcatccacaacagcggtcatggcctcgctgtggactggtgggctctcgggatcctcatctacgagtttttggttgggcagcccccgttctgggatcagaacccgatgcgcatctacgaacagattgtcgagggtcgcttgcgttttcctccaaacatgtcgccggcagcccagaacatcatatcatgtctctgcaagaccaatccgagtgagcggcttggccacatctcaggtggctctgcgagagtcaaagcgcaccccttctttgaggacataaattgggatgacttgttccaccggcgcatgaaaggccccatcatcccgcgagttgaccatcccgcagataccggaaacttcgaggactatcccgacgtagacgtgaagggtcaggccatttacaccgacgacatgaaaaagaaatacgaagctttgttcagcgatttctaa

SEQ ID NO: 5788 - DNA, 192 bp, A.fumigatus
gtcaagctgcaactgcaagcagagcaactgtccttccctgcgacaacagtcgagcccagcaaagccaagcaggcgatcccagacagtttcagactagaggccatgacgatccttcctgccggtacgaacgacacgtgggatttacaggggggaggaaggaagataaatgaagcagcccctgggtggaaatga

SEQ ID NO: 5789 - DNA, 513 bp, A.fumigatus
  unsure (423),(460): Identity of nucleotide sequences at the above locations are unknown.
tcgaattccgccacttcgtcgtcaccgatcttgcgtgtacgtttctccccgttccatttcctggcaatccccactgaccctccccagcctccagcgccaaagaatccatctggacctccctcgaactcgacgtcgccatcatctgcggctgcctcccactcctcaaacccctcgtgcaaggcttcctcggcaaagtcaaaagcggtgtctcgaaaggctactcgcagccttcggccgggtccaaacttccctttcccgcgtccaggacaaacaatgacgggttccagccgatcgatgatccgaatgggacactggcgtcggcggcatcgaaaacgtttcatgtggcgactacgccgagccagaatagctcggatgtggagctgcaggggatcacggtgcataccagtatccggcaggatgtanatgggcggtccgatgttgggagtaccggtcccgtatnaaatccggagtggaggcaataatatttgcatattattatctttgtatatataa

SEQ ID NO: 5790 - DNA, 282 bp, A.fumigatus
ttactccctatttcgtttcctcacatctcggttctctccatcgccataatggcgtacaagcagaatacctactggaaaaatgtcctcacgatcgtgccgatcgttggggccggtgtggctaccatcacgtatctgttgcgtctgtactcccgacgcctgacagctgcggggttcttcctcgaagacttactgatgggcattgggttgatcatttcctactgcgctaccgcgtttgtcgtcgagagtgagtgcgtctggccgacagcccggaatcaaaactga

SEQ ID NO: 5791 - DNA, 636 bp, A.fumigatus
gatctcggtgctggttcggtgaaatccgtatgggatgcatcagcccacccctgtcatttccacccaggggctgcttcatttatcttccttcctcccccctgtaaatcccacgtgtcgttcgtaccggcaggaaggatcgtcatggcctctagtctgaaactgtctgggatcgcctgcttggctttgctgggctcgactgttgtcgcagggaaggacagttgctctgcttgcagttgcagcttgactcatttcaatgcgacggttggaggacgcgtgcagcctctgactcctttctccttgccgtgcttctcgagttacaatggccgtccggtggctcgcgacgatgctgcctgtgctgccattcaggccaagtacaccgatccgtggctgcgaaccaactctcccaatggctacatgaacaaccaggatgagatgtggtcgtcggatcccagtgatcagtgcctgctcgacagtagcgatcccaccgatcccctggcgtttgttaatgccacctgccggcagggtaacatgccctcgcactatctcgaggtgcacagcgccaaggacgtgatcgaggccttccgatactcgaacgtcttcaccacggggctggaaggatccgcggctgatgctttc

SEQ ID NO: 5792 - DNA, 1143 bp, A.fumigatus
ctcttggcgcaggtggctgcaagaacccacgatcacagccgaaaggtctggacaatgctcagcgtagctcttcgcatcgcacaagcactttcgctgcacatgaccgatcccccatttccagtcacgccgtttgaacgcgagatgcgtcgccgcttgtggcatgtaatcggctggttggacctggaggcatcgctgaaccgcggatcggaaagcatgatgcggtctgcctggattcagacacactcgctcaccaacatcaatgatgacgactttggatgcgactcggaggatcccttacccgctgcgcaacgcgggccaacggaggcgacccttctgatcctgtttgcgcatggccaatgcgctctacgggccttggatttatcccactttgctgaaccaggcatcaccgacatccaggagcgacagcagacggtggaccacttccgtcgtaccacgaaggagctgctggctggctgtgaccccgaaaatgttcctttccattggttctctatccagatacaggagcagatatcggctgtcctgcaacttatcgccctccgcccactccagaggagtccgacctttgtccctgcagagctaccggcgcctcaaatactcgctctcgcagccgacattctagagcgacgtcagagaattttcaacgatcctcgaggacaaccctggcgctggttcgggctgttattctttccctggcatgcgctggtggtcgccatgaccgaggtctgcgtctgtacggaccgattggtgatggacagatactggcctacggtggagcgcagctatgacctctttcagaagcaggcggttgggacacactatgactggctttcggcgtcaatggacagtctgatgaacaacgcgcgagctgcgcgacaaaaggtggttgactccgacgcgccagggcttcaagcgcccgattcccacctctatatggacatggcgtctctcgagcgccccctactgccggagtctctgccacctgtgcctgacgcggctttagccccggaggggctcacgctactaccggaccaggagatcagcgcctgggcgcagtatggggagttcaccgaccgctttgatgagctgcatgcaatatttaacagtgggctaacctggcgttga

SEQ ID NO: 5793 - DNA, 387 bp, A.fumigatus
atcctcgggctgatgccattgggaacctcgatggattacgaatcggccgactcccgatcgaaagggtgctgggaccccgtccccgtcctcaagcccttctacgagaaatggaccagcgctgttccgacgcctgatttcctggtcgatgacgtctggtgtggcatggtcggtggcattgggtttggcgccagtgcgtcggaggagttgagtgtgttctggacgaagaccctgaaggaggtctacaggggagacgaaggccggaagaaggtccgcatggcggtgatttgcctgttgtcgcgcgatggactgctgctcagactgggtgatatcaagtgtcccgtgtactggttacaggtgagttccaaccctctggtaggtaggggctga

SEQ ID NO: 5794 - DNA, 834 bp, A.fumigatus
gacgttgtccgcccatccgctggtgaaaaccaaactagtcggatacctagtgctggatatcgtcgcccgccagcgtgtcattggcgttgttgtgtccatccccgcttgaccgggatttggtccagaaagggaagttatcccctctacgtgtgccgtctggtctgggacgggaccgggaacggggtgacctggaggggtgcagaacctcggtcgtgtccatggaggggtggagtcggtgacaggtcccttatctatatgacgagttacattgggacgctcctcactccagttgttgttggattgaagaaaccacacatccgaaaacaacaagaaaaagaaaaaaaaaaaaaaaaaaaaaaatacatggcagccaccaagactatccaagtgccccatctgggcggcatcaccgccggttatgctctatccaacgaccggtacgaccccgccaagccgacgtgcgtcctgatcaactcgatgtgtacgaccgtgtccctgtaccgcgatcagttcagcgatgccgccctcacggacgccatgaacctgctggccattgagcccctgggccacggctcgaccagctgcccgtcggaacacttcacatactgggattcggcatggatggcgctgcaggtgatggatcaactcggcatcgacaaggcctttgcgctgggaacgagccagggaggatggattgtgacgcgcatggccctgttggctcccgaccgggtgggcgcccctgcatccgtgaactatctatcctgtgagggggttccgtggcaaacaaaaaaattactgacagatgtctactgttcctctagatcctcgggctga

SEQ ID NO: 5795 - DNA, 318 bp, A.fumigatus
agcagacaaatggtgggaaggaggctccgacacgacctcatcgtatcaactggatatgtttggttcaaatctcagcaaaccatagtgctcaatcctcgtctcgttgagggattcttcctcggcattgaattgatgaggcaaggcggtgtctttgattcctcctgcctacgcaatgccgcacgggacttggtcggggttgctttgggctatctagctagtcggacagcagcttcgtccttcgttgttttcggccacggctcatatttcgagaaatatcctgctcttgatcttattctgtcaaagagcagctccttctaa

SEQ ID NO: 5796 - DNA, 645 bp, A.fumigatus
cccctgatcccagctttaactggtgaggaatgtgatagctaccagataatgacattgactaattgtaccaaggtttttcctccttcagctcatcgtatcgtgcatcttgtatcttccccattattccccccagaacggacgccaattgctaattggatcaacagggtcctgtttttcctgctctactttaatcgtctcttcgcaactctcctgtcatacgctatccgcgcctatacctggcactattaccgtgcatatgtcgacattcatgcactacagatctcgctacttggaggtaggatcttctggaaaggtatccgataccacggggtgaacgagacaatctttgtgcacggaggattcataacatggcattattggaagcgcacagtcagacatactgacctgtccttgctgagttcgagcaatgaaaggacgccggccggatctcaacgccccgatactcagagctcaaacctggctggcagggacaatggcgaaggagaacaaggtggcctgaaagaagcggacaactttccctgtcgcattacaattcagttctacggcctggagtggtttatatacaatcgcacgccggcgtacgacagtatgtcttcaccacggggctggaagggtccgcgcact

SEQ ID NO: 5797 - DNA, 231 bp, A.fumigatus
gtcccttcctccgccaaccgggtctatgcgcttgccgcctcgaaccactatatcttcggcttgagctgcgcctcaagctttgctctaccgctgcagggattctggaatagtcttatctacattactgtgtcttggaaggccattgggacctggtttcgacaggttggggctcgggcgcggcgcacctctagtatcacctttcgacctttccaacatcccttgcgtcgttga

SEQ ID NO: 5798 - DNA, 333 bp, A.fumigatus
gccatgacgacgctgagttcagggtaccaatacagcacgcaactgagtcggcatcagcagtatgtgctgtcgaccatcgagcgtgtatgttcgtgcgtgtctgtggttgcctcgggtgtcgtgattgccacctttatcagctcgtcggcatttggcaaaccgatcaatcgcttgatcttctatgcctcgtggggcaatctcttgtcaaactcggccactctcattgccgattccagtctgcatggtcgtacccaaggcgcgctgtgccagttccaggggttcatgattcagtggtcagtcaatacccgtggtaatgccagtttcgtttactga

SEQ ID NO: 5799 - DNA, 255 bp, A.fumigatus
tcctggtctgtaaggttcttgccagccgattccctgtgggcactcgccatggcttccaatgtgtacctggcaatcttcaagcattacgataccaggcgtctagggatgctcgagtggaagtatctgctcttctgttatggagtgccatttattcctgcgtttgtgtatctctttctcagctctgagtcaaggggcaaggtgtacggggagtctgtggtgagtctcgtggcagtagtgcgtaagggccgatattga

SEQ ID NO: 5800 - DNA, 306 bp, A.fumigatus
agggcagaggtagacgacccaaatgaatttcgatacatctataataagttaaggatattcccgtctgctgctattaacagtacccgggatagcctgtctagccgcgaatatcaatacatccagcgccgaaagtcctttcaaccacctttaatgtttgtttcctatctcttagcgaacgcagatcacaacagacggcacctagtttctagtcagtccgacgaaaaaaacagaattcagcaaatgcagccgctgccggagatagcctgtagcgtccttgcctccagcatgaccgcgcgtgtaatgtaa

SEQ ID NO: 5801 - DNA, 207 bp, A.fumigatus
cttgccgtccgtagaagtgtctctcacttgcgcattgtgcaagccttgttcctctgcgtgagcatctgttccttgcacaagaaccgattcctgaatgtcgaggcattcttctctaccgtgggttccttcaccctttccgacttccacattgctgttacacctatcggaaggaacaacagcttcttgtactgctatttcaggctctga

SEQ ID NO: 5802 - DNA, 1635 bp, A.fumigatus
gacctgcaccttcacaaggaaaccttggggcatattgatgacgagtcgtcgttgtccggagaaagcgccgtggataatagcagtgatagactgtcgaactcggattgtcatggtattgaaatcaagtcgcgcggagacgaggtcgaggctcgctcagagcctgaaatagcagtacaagaagctgttgttccttccgataggtgtaacagcaatgtggaagtcggaaagggtgaaggaacccacggtagagaagaatgcctcgacattcaggaatcggttcttgtgcaaggaacagatgctcacgcagaggaacaaggcttgcacaatgcgcaagtgagagacacttctacggacggcaagctacagaagcaattgaacacagaggttcaagacattggccaaaatgaaagtcatctatgtgatgacattgggcgaagtttgcaattatctgagcctcggccgaatagaggggaccaacagttgacaacgcaagctgacgaagtatgtccaccattgccttctcgagccgatccagagacctcttcggcctctaggagaacacaacgacagtccttagaggcctccaaagatttacagacaagcgccacagccgagactgaagactgcaaagacggacaatcaatcaaagaaaatacgactagcggctcaaaggagcagaatgttcaagggccagcggaacatacctcattgaaaacgccgccaggcataggtgttgaatccgagcagcagcgaccctcgccggcgccttccaaaggaaagagtggaagaaaaaaggaaaagcccaagttggacaccaaaaatgtgaaacatcttccggagcggacatcgagagtagtccagacctatcgcacgaatgaatgggccaagcatctctgtgatgcagaaattcccgagccagaacctatcgtgcttatcacgaaggaaggagcagagagccgcgttgaagaagaggctcctgctcctgtcaacgtcgaggagctgttgcaaacacctctcactgtgcagccaccacctactgccgatttgcgtgtcagcaccggaaaagaacaccacagcccaaccgactgtcagcaaatatctactgactataggttgcggaccacatcgtctaccagtccacaaagagttggagaagctcaaccagtggacaggccttcagaagaatcttccgcaatcgttctatcgtccaccagccctttccagagcacggtgctctacggcattgggcataatgcttctctaggtacatccagcccgcctataccgactggacaatctcaaggcgaacttgagctcagcaaaccgaggtggaaagggccacccccgctcctggcagtacgagaggatatggtgcgaagtcgagtttcgtctacttgtctcagcctcgatccgtgggcgtcgcggaagagcccaaggcagtcgagccctagccagtccgttacattaggggcttcagctccaaattccccgatgacttcatttccggaatcaggggatgacgtccctctctctcgtcgtcgtgcaatactgcatcaacaaaaagtccaaagcccgcatacaagcatgtcagtctcaggtcttcaccacgagggccgccgaaggatccgcaataag

SEQ ID NO: 5803 - DNA, 408 bp, A.fumigatus
tcatgcaccagtggacccggccattctcaagaaagccctcggatccgcactcaagcgagtcattgctgccgaggcattggtcacccggtacgatactatcgtcggcgacggcgactgcggcgtgggtctgaagcgcggcgcagaagccgtcctctccctcctggaagacccatcgtccggcctgacggacgacgccgtcaccgccgtcaaccgcatcgtcactgttgtggaaaacaccatggacggcacctccggcgccatctactcgatcttcctgaacgcgcttgcgcacggtctccgcgcgcaagaccaagggaccccaacacccgcaacggtcgaggtctgggccaacgcgctcaagtactccatcaccgcgctgggcaagtacactccggcgcagccgggtga

SEQ ID NO: 5804 - DNA, 705 bp, A.fumigatus
ttccgccgggacgcggtccttccagccccggggcgaatactttgtccgcccacttacagcgctgatcatgcaccagtggacccggccattctcaagaaagccctcggatccgcactcaagcgagtcattgctgccgaggcattggtcacccggtacgatactatcgtcggcgacggcgactgcggcgtgggtctgaagcgcggcgcagaagccgtcctctccctcctggaagacccatcgtccggcctgacggacgacgccgtcaccgccgtcaaccgcatcgtcactgttgtggaaaacaccatggacggcacctccggcgccatctactcgatcttcctgaacgcgcttgcgcacggtctccgcgcgcaagaccaagggaccccaacacccgcaacggtcgaggtctgggccaacgcgctcaagtactccatcaccgcgctgggcaagtacactccggcgcagccgggtgaccgcaccctgatcgacgcactagttcccttctgcaacacgctggtcgccgccaaggacgtccatgcggctgcaaaagccgcgcaggatgggaccgaagccaccaagagcatgaaggcgagtctcgggcgcagcgtgtacgtcgggggcgaggcggaatgggtcggcaaggtgcctgaccctggcgcgtacggattgagcgagctcctgactgggcttgccgaggcgctttga

SEQ ID NO: 5805 - DNA, 216 bp, A.fumigatus
ccaatgacgaccaccttgaatctcctgataggaattgaacatgacggtaaaagtgcatcatttgcatccgtaaagtctaaagagtcgaacatctcgtaccttgcctctgtctatgcagactgtgtgccacctgtcgtcacttctgaggagatacagggaaagtcgcctaatgccagagcagacaacagagataaacggactacagccttatcctga

SEQ ID NO: 5806 - DNA, 2073 bp, A.fumigatus
ctatgcgcgggtcctgcctgctccgtgagtgaagacgaagtcgcgcacttttcgccagacacccccgagaccgccgctgctgctagaggcgaagtgaccaattggcaagagggtgatgctaaccccttcgcggatggcaactccatggatgccaataccaccgatgagaagcacacagacgagatgatgttccaaggagagtcgatccagggagcagctgctgaatactaccaggcctgcgcccacgagctatttagcggaaggccgtacttcgaatgcgtcaaccatgtttgttccatcacgccgaaggataggatcccggttctgcttgcaagttctattgccgagccagagaataacgagaagcatctccttattgacgtggatgacgatgtgactcaattagctcctgtgaatccttttgagagtgtctcgcactctggagctcgttcgatatccgggaccaccgctgtggatgaccaacctgcgtctcctttgatctcgaatacgggaaagaagtatttggaggaggacacaccaaaagaatcaagaggccactctcctgagccaggacccatcgaaagggagcctcctgtctatgcaggtgatcgaccagagaaacaagcttctcacctctttttccaaccaacgaacactatcagtcctgcggccacgaatatcaacatccaaccacctggagctctaccatcagcctctggagctccgcaggagaggatcatccctcaatatattgttgtaccacctcagaattatgggggaggcgggcatccccaaccacaaacacctgatgctacgtctcctggcctacagcaagcaacagcgaggagtggatcaattccattgactgagatagcttctggaccagctccagcctgtcatgcccatcgcagcgcgtctcatacactaccgcctcgtattgaccctgcccccatcactcaggagcagatgacgcacccttggttcgaaagggagaggattgaaacccgacgacgaagactagaaagggaggatgctattggaaggaaagccggtggactctggcgaggcagaggctgtttcagtaacaaaggctgcttcggcagaccgggaagagaaggccgcctgagacgtcggtggtatatggcgatcacgaccttttttgtcctgattgtggtagttgctgttgtcctggcggttatgctaaccaggaaaggggatggcacacctgttcaatcgcaatggctcaacttgaccggctatcccccgatgccaactggcattgcgacaatcgcaggctcagaaccacagacccaaagttcaggatgcatcactccatctacactctggagctgcgctctgccgccggaacagcagtcagacaacaagccgtacgcgccaaatcagcccagctttcgagtcgagatacgattccgtaacgggacctatgcgaacagcacaacggttgcctccacttcaagccacaagaccagggatataaatggatcattcaacccatcgccatctccaccgagtctcaaagaccagatttttctgggcaatacgactgaccagaacgccatcccctacgcaggcgaggatacccccttcttcatcaccatcctctcgaccgcctccctccgttcatcccgactatcccgccgatccaacagctcctttccagacatcgagtccctcatcccatcccccgatctcaactccgatggcacagccgcagccgctactctctatccactccctgaatcccaacccgtacgcctttataaccggggcctggacacagaacactacggcttctacacgtacttcgatcggtctatcttcctcgagacccttgctcctctcaacggcagcacaacagacaactccgctgcagacgccaaccgtgggcgcagtgagactgacgcccgcgtccgttgcacatgggcccagactcgcttcctcgtgcagatctggacgcagccgattcgcgcgcgcaagaacctcctccgcagtaatcccaccgcagcatcagcccctattacacacccaccatgttttccctgttatctaact

SEQ ID NO: 5807 - DNA, 573 bp, A.fumigatus
atggatcattcaacccatcgccatctccaccgagtctcaaagaccagatttttctgggcaatacgactgaccagaacgccatcccctacgcaggcgaggatacccccttcttcatcaccatcctctcgaccgcctccctccgttcatcccgactatcccgccgatccaacagctcctttccagacatcgagtccctcatcccatcccccgatctcaactccgatggcacagccgcagccgctactctctatccactccctgaatcccaacccgtacgcctttataaccggggcctggacacagaacactacggcttctacacgtacttcgatcggtctatcttcctcgagacccttgctcctctcaacggcagcacaacagacaactccgctgcagacgccaaccgtgggcgcagtgagactgacgcccgcgtccgttgcacatgggcccagactcgcttcctcgtgcagatctggacgcagccgattcgcgcgcgcaagaacctcctccgcagtaatcccaccgcagcatcagcccctattacacacccaccatgttttccctgttatctaa

SEQ ID NO: 5808 - DNA, 480 bp, A.fumigatus
gcacacccagcatctccttcaccagcctcggcttggtggtcctcgacgagatccgctttcccaaccaggagccgttactcgatgttctgggcggctctggtgcctatggttggttctgttctgctgttttcaggggttcgtgatgtacagcatgtcgttggactgatccgtggtgcagccacgcttggggctcgattattcctgcggccgccgctgagcaggaccttgggctggatgatccatactggacatgatttcccggagctcatgacggaccgcctgagaagctgggattcaacgttgattgtaaaacgggaagcagacaagccgtcaactagggggctactggagtatgaggatactacgtttggacgtgcgagtccctttacagcctttgtcaggagaacagcagcaagaactaaccaacccagcaaaacacttcatatacaccacctccatcctcccggtccacgacaatga

SEQ ID NO: 5809 - DNA, 849 bp, A.fumigatus
aacgggaagcagacaagccgtcaactagggggctactggagtatgaggatactacgtttggacgtgcgagtccctttacagcctttgtcaggagaacagcagcaagaactaaccaacccagcaaaacacttcatatacaccacctccatcctcccggtccacgacaatgacctaagaaacaccccccttctatccgcaaaagcataccactacctcgaaaccccgcaagacatgcaaacccgtctctcagcccttctgtccctcaggaacgaagccggcgaaccagaccgccctttcatagtctgggaaccagccccctacgtctgcaaacccgagaacctccagccctgcctctctgccgcgcagcatgtcgacgttctctcccctaaccacctcgaactcgccgccctcttcggcgaatccccagcaaaagctcacgacaaggccacgatcgaggccttggcgcgaagagtcctagacagcggcgtcgggatagatgggaaaggcactgtcgtcgtccgcgcaggcgagaacgggagtgtcgtggtatctcgcgatctgcctcccacgtggctgccgccgttctatccggctggagctgacgggaggcagcattccaaggttgttgatccgacgggggccgggaatgcgtttctgggggcgtatgtggttgggtatctccagacgcaaaatgcggtggaggcggcttgctatgggactgttggggggtcgtttgcgctggagcaggtggggatgccggagctggtctccggtgaggatggggagttgtggaatggtgcggacgcttttgagaggttgcgtgagtatagaaaggtggttgggctctga

SEQ ID NO: 5810 - DNA, 555 bp, A.fumigatus
tatctcggatggctcgcagagcctcatactgcggccgccattgcagcccgaactacgcgaaatgcaaatgccacagcctcaaaacttaggctcagagcccaaccacctttctatactcacgcaacctctcaaaagcgtccgcaccattccacaactccccatcctcaccggagaccagctccggcatccccacctgctccagcgcaaacgaccccccaacagtcccatagcaagccgcctccaccgcattttgcgtctggagatacccaaccacatacgcccccagaaacgcattcccggcccccgtcggatcaacaaccttggaatgctgcctcccgtcagctccagccggatagaacggcggcagccacgtgggaggcagatcgcgagataccacgacactcccgttctcgcctgcgcggacgacgacagtgcctttcccatctatcccgacgccgctgtctaggactcttcgcgccaaggcctcgatcgtggccttgtcgtgagcttttgctggggattcgccgaagagggcggcgagttcgaggtggttag

SEQ ID NO: 5811 - DNA, 312 bp, A.fumigatus
gctctcacctggttgtttgacagtttcgggggggggatgtcttacacaattactctttcggaaaaggccccagaggaaggggtgcagcctgtcagttcgactctgtccgactacgatgccgatctctcgtcgtccggctacccagaaagtccggatcttgaagaccgagagaaatatgccggcatcctagcggatacgaagaaaacagacaaggcagccccgggccttggcttcattgtatggacggcaatcaatgttgcttccaccgttgccatagtatgtacctggccgccccgtcagatcccaacctga

SEQ ID NO: 5812 - DNA, 204 bp, A.fumigatus
cgagtacagagcggcctctttgcttctttggtgaatctctcgcagtttttcatcatccacttggcgggacccatcagcgggacggtggtcggccagctcaagacgtgcatcattgtcgggctgggatgggctttcagcacgcatcccatctcttttcagagcattgtcgggattatgctggcgttggcgggcatgagcttgtaa

SEQ ID NO: 5813 - DNA, 507 bp, A.fumigatus
  unsure (376): Identity of nucleotide sequences at the above locations are unknown.
ttcctcggaggactaatagaagattcatattcggtgacacgcgtgatcgatggtgtcccttatttcttatccatcaccgatacggccggccaggaggagtatagggggctgtttgccctgtccaacctgaggtcggacgcgtttctgctcgtctacgacatcaccaatgcatcgagcctgagcgcattagattacttcatggacctgattgatatcgaggcagaacagcgcgcggaagacaatgctcgcttactgaaggaactcggggatagcgtacgcggcgtggaagtcggcatgcctcctccagtcaagatcatcgctggcaacaagtgcgatctgaaggataatcgtgccatctctgctagggagggactanaatatgcccgcaaacacggttgtgggttcatggacacaagcgcgagagatatggtgaacattgaagagacatttgcccgtaagtatcttgttctctggcattatcaatgctggcgggtggagaccgcctaa

SEQ ID NO: 5814 - DNA, 264 bp, A.fumigatus
ggcttcgatgcccaaccctgcaccagctcggtctctgtatcttgggacatctcaatcaagtgcctaggacaaaatactggagccaacatggttcacaccacacccaccaccctcctggtcctaaccggcctagctgccacagctacagcctacaagcatacatggagggaccacatgaagtgcgcagtaagcatcgcttgtcttcacgttgatctttcgaaagaagccagcttttctaacatctcacccgtcaggctgctgtag

SEQ ID NO: 5815 - DNA, 795 bp, A.fumigatus
  unsure (371),(374): Identity of nucleotide sequences at the above locations are unknown.
gcacagtcccaacgtccaggagcaagagggcgtacgcgccagggctctccccctctgcctcctcggtcgctgtcaaccgcgcactcgtcaccaacgccccctccgcccttgggggaggacagcgacttcgaggacggcgaggagcacggggtcagggtcatcacggagttcctcacgcatacatcctgcgactgttcgtcgtcgactgtagcggctgcaagtagcaggatgtcgagttggccggcgtatgtccatcagagcgcggttcctgtttcgtctttgtcggcggggcatacgcgtgttcatcagactctggttccggtgtcttcgtcatcatcacacatgcttgttcaccagacagcaattcctgnttnattttcgtcgagtcgaccggccaaccttgaccaggttatggcacctgttgcatcgtcgtcatcagctcacgctccccacagcgcaatccccgtggcaacttcatcatcagcgcgcgcgcatgtttatcagactgcggtccccgcttcctcatcgtcgacgcacatgcaccttcatgggagcgcgattccacagccagcttcgtcctcagcacgtgcgcatgttcctcagactgtggttcctggtgcgtccgtgtcgagccagccggcgcaccttcaccaggctgcggttccctctccatcgtcatcatcagtgtcggcatcgagtacagtggttaggtcgcatgcgggtgtctatgcgcctgcgtctctgtacgtctcggtgcctgtcctcttacaccgacgggactggaaggaaacgcgc

SEQ ID NO: 5816 - DNA, 681 bp, A.fumigatus
catctcacccgtcaggctgctgtagcccaggatgcggattacccaacctgcacctcaccctccaagttttactgcttctgcgcgcagccatttgagccgagcaaaataagcagtgcagcaaaggacgtgtgcgagggatttggaatccgtacgtttaaagtccttttctttacctctagacaacggatgaagactgacgcgatgaagcaacggagtctatacacaggttcatctgcgacgacggtggcccttggggtgatgacgatgtgtatgattgggaccatggctaccaccgtaactgccaccatgccttcgcttacgacgatgacgaagacgatggctacgactatgaccggtacagatatggatatcgcatctcccatccccaccgcctctgccaccccaacgtgcgtgttgccgctccggaaagtgaggccgggtcttcaaacacagataagcacagtcccaacgtccaggagcaagagggcgtacgcgccagggctctccccctctgcctcctcggtcgctgtcaaccgcgcactcgtcaccaacgccccctccgcccttgggggaggacagcgacttcgaggacggcgaggagcacggggtcagggtcatcacggagttcctcacgcatacatcctgcgactgttcgtcgtcgactgtagcggctgcaagtag

SEQ ID NO: 5817 - DNA, 219 bp, A.fumigatus
tttgcattcctaagtggtgtggaatgtctgaccttcgcctctgccacgtactgccctcctacttatacggctaggatgtacatgcatatgtatagctgtagcaatggtatgatccgtcgctcggtgtggcaggtgttgaaactgggatacgtcgcagaggatggtatgcagaccaccatctgctatgcaaatccatgtacagatacttgtcgagaatga

SEQ ID NO: 5818 - DNA, 1122 bp, A.fumigatus
agtatgctcaacgcaatccgagatctagacaccacacgcagttttgatatcatgtcgtcgagaactatattgaaatcaacctatccttggacaaagagtccccttctggcctcggctccaatgttgaacattgccggtccccagctggcagtatctgtctcctccgccggtggacttggatttcttgctgcaggattcgatgtttcaagcttggatcataacctggaagttaccgcccgtctgatgaagcaatcaggcggtatggcacagcaagtatacgaggaaacaggcatgctacccattggggtgggcttcatcaactggggtgccgatctcaaagtctctcttgccgcgatccagaagtacatgccatgcgccgtgtggctatttggtccaagggatcaaccagatgacctagtgccctgggtgaaggaggtgcgtggcgtgacctctggtcggaccaagatctgggtgcaagtgggtgccgtggatgaggcgattgtggttgccgaagttcttcagccggacgctttggtcgtccaaggttctgatgcggggggccatggtctagctcattcggcctcagttttgactctgatacctgaggtccaagatgctttacgggagcgagacctaactcatatagccatcatagctgcaggaggaatagttgacggaagaggactggccgcggctttggcactaggggctgtcggtgctaccatgggaactcgcttcctggcttctgcagaagcgaatatagctcacggatatcagaaggagatcctaagagcatctgatggcggtctcaacactatcaggtcgactgtatatgatcgagtgaggggtatcgggggttggcctaatcgatacgacgggcgcggtattatcaaccagacttatctcgatgctgtgcagcaaggaatgagtgatgaggagaacaagagtttgtacgaagaagagctgaagaagggcgatgccggctggggacccaaggggcggcttacaacatatgctggcactggtgtaggcctggtgcgagaaatcctgcctgcatccagaatcgtggaggacacattgtgtgaagcaggagatgcgattcggggaattccactagattga

SEQ ID NO: 5819 - DNA, 219 bp, A.fumigatus
ccttggcagggaagctcagatcactacaaaaacccctctagtctattgcaaatcatttcatccgacaatttacgcgcttggcaaaaaccctatttcgacagagaacataaccttgcaatgtatccttctacgtctcttgccgtttgggcctatgccctacttcttctagcgtccccgagtcctgctgacgcgacatcgaattctgaaaggttcgaatag

SEQ ID NO: 5820 - DNA, 678 bp, A.fumigatus
tctgtcgctgaccatctcagcgctcgcatcaaagtccaccgattctgcgcctttctggacgtccccgtcttccgcaaacgccactgtgacctccaatccgaatgctgtggcgtcgagtccgcacaatccgccatcccctcgcccccggaggacatcccccttccgtcaatcatgaaatccgatctccccgacctcacattccctttctcctcacacacatcatccaagatatgtctccagtctgccctgaacatcgtcaccgttgtcgacaacctcccttacccgaacccagaccataccatccccctaacactacctccgtatctctcacatgcctcccgtgtcgaaataccccgagtgatgccaaccttcgcctgctgcttaatgcaggcaagctatgcgatgctgatgctgtatctcaaggcgcgggcgaaacatgcccacagtcccgaggactcggggtcggtcaaaggcctgtcgctcacagagtttctgaatgagctgcagcagaacctccggcttgtctcgaagatcctggccaattatgcgattgctgctgaagcgttgcagggtatgaagggtgagttcttattcttcgatactgccatgttgtttgctgaccgggtcagaggagatatcgtattgggctttcttggagggttgatcgggtctgtatag

SEQ ID NO: 5821 - DNA, 273 bp, A.fumigatus
cgagtcccgctcagggatacccggggacgcccatcaatcctcaaagtcccccgcctgccgagttacagacgacaacggtgtccatgtcataccccgggcagccagcgggcatggggctaccccggatggcatgatatgaacggtatgccgacaatgaacgtagtgcaatatcctatggatacggcggacccggcacagcaggcagcatttggagctcccccggcacatatgggtcattccgggcaggggcccgtcgtcgacttgatgagctag

SEQ ID NO: 5822 - DNA, 555 bp, A.fumigatus
acaacagatttgctgactgaacctcgtatcgaagggtccacgaatttcgcggcagcaccaacattagacccgtcagttccgtgggacgaatacacgacgatctcggacccccagatactgagcgcaatggcggcagggaagcatcagatgatgaacgtgcctcctaacgcatggagtccgggaccgaacaacatggtggctatgcctcccaaccccgcaatggcagcaacgccaacggtcccgtcccagtcgcagccgatcagccccgtgcagacgtatgccatgcaaccggacggctcagtttggccggtggcccaaccgacacgctcgatgacctttcctgcacagccggagatggcttcgtacccgaatccgagccaattcagtcagcaaatgcacacggatctcaaacgcagaatgacgagtcccgctcagggatacccggggacgcccatcaatcctcaaagtcccccgcctgccgagttacagacgacaacggtgtccatgtcataccccgggcagccagcgggcatggggctaccccggatggcatga

SEQ ID NO: 5823 - DNA, 198 bp, A.fumigatus
ccttttgcggccccgctaaatgacccagtggtcccaagtttaaaaagccaataccaaaaaaatttcggttatgaacagaagaaaagcgaattaagcggaatgcatggcgtgccaacggggtattattctaaaagcaaaatttccttctttgttaaaatatctgtcttccgggttcggcttgtaaagcagccaagctag

SEQ ID NO: 5824 - DNA, 276 bp, A.fumigatus
  unsure (243),(252): Identity of nucleotide sequences at the above locations are unknown.
aaagatcccgggaaggggggggaccataccaaacagagggacccctgtttccgggggcggaatcatgaaatggggtggggtgatcccggcggatcccgtagacggggtcaagggccagccggtaaaggaggcggtttgggaaaagccgggtgttcatcgcccgcggacacgttggagtgtctgcgcggattggattataccgattttctgaatgcgcccaacgcggtgccaggcatcctaagntaccattcngtgcccctgtcatacctgctttga

SEQ ID NO: 5825 - DNA, 690 bp, A.fumigatus
ccgaacggcaaggcgatcacggccagcccagacattttggtcaaaaccggcaaatacgccgccgtgcccatcatcatcggcgaccaggaggatgaagggactttattcgcgctcttccagtccaacatcaccaccaccaaacaagtggtggactatctggccaagtattacttctttggggcgacgcgcgaccagctcgaggagctggtggcgacgtatccggacgtcaccaccgacggctcacccttccgcacgggcattttcaacaactggtatccgcagttcaaacggttggcagccctgctgggcgatctcaccttcacgctgacgcgccgagcctacctcaaatacgtgacggagcttcaccccagcctgccctgctggtcatacctgtcatcgtacgactacgggacgcccattatgggcaccttccacggcagtgatattctgcaggtgttttatggcattctgcccaattacgcgtcgcgcgcgttccacacctactatttcagcttcgtatacgatctcgatccgaactctcgccggggtagtcttatggaatggccgcggtggaacgacgaccagcagctgatgcaggtcttcaacaatcggggggccttgctggccgatgatttccgcaatgacacgtacaactttattctggagaacgtggattcgttccatatctag

SEQ ID NO: 5826 - DNA, 303 bp, A.fumigatus
accatgagagttcctgatgtgatagcccttgcagggcttttagcggtctcaggggctacatcctctggccaggagaccctactcatgcccaggaagcaggccacgcagccaaacgtgctgttcatcatgtccgacgaccaagatctggaattgaattccccggccttcacaccgtatatccagaaacatatccgagacaagggcgtcgaattcaccaatcacttcgtgacaacctcgctctgctgtccgtcgcgggtcagtttgtggacaggacggcaggctcacgacaccaatgttagtatt

SEQ ID NO: 5827 - DNA, 699 bp, A.fumigatus
tcacctacctcgcgagaaattgctgaattgacgggggtcccttcggagatggccgacgtcgaaagcaacgtcgcagacgagtcgtttgcgcagtccgaaacccaggacgagcagccttcgcacagtacagtcagcgcgacggttggcatcaggcgtcaggcgaatggcaccattggctccgtctactcaggaaacaaaatcaggcatctgaaaaaggaagatggtatgccactctggcgcaaggacatccagtaccagtttctcaaattggtcttcgaggacaagactccagtgttcactcgctggtccgatggcaagaagggcttggattttgcggatatttacattgatgcgatggcgaggagcagtaagacgagcaagatacttaaggacaaactgcagagcgataagcaagccgccattaatatggcgatggtttgtctgcttgttaactttgggaggatgaataccactttgaactgtatggttttgcctttctttttgtctcttcactcagcgctcttcgcgatctcattcctttctaaatcctcccttaaacttgtgccattggatctcgagactgacttggagacaaattcagttttccccgaaatgcgcgctcaactacggacttatcactctattccttccctgcaggcacaccaagaacccaacgcatacaagccacttccagatgct

SEQ ID NO: 5828 - DNA, 285 bp, A.fumigatus
cgaaaaaaggtcttccgagccgtcaacactctgtgcatgaaatactacaatcagagccagtcgtctcgcgccttggagatgatcgtccaggcctactggattgaatgctatgaagcacgtattgccgtcatccggctggagaacccgcatttatccagtactgaggcacgagtgactgcactgaaagaggcctgtgcagtcctcagctggaaggaaaaggacctccgaaacagaatgtatctcagtccaccattttccttctccaaaccttcactaacggggtag

SEQ ID NO: 5829 - DNA, 1095 bp, A.fumigatus
gtcagggaaaaatttggttattacactcatttgctgcttggtgtgtttgcaaaccaaggcatcatagggctcagcaaagcacaattcgagccgattgcgtacgcatctcaagaagcttggctgttccgagacagtatcaaggaccacattgtattcgggactgcatatgatcaaaaacgctacgagcgggtcattagagattgcgcgctagagaaagatcttgcagctttcaaggacggcgaccttaaagaggtaggtgaaggtggccgcagtctctctgggggtcaacgtcagcgggtgtcccttgcccgagcaatgtacacgaacgcaaatgtcgtcatattggatgatatcctctcgggattagatccaagcaccttcgagtgggtggtgacgaaatgcatctccaggtcggagcagcagaatcgcacaatgataatggttacgaatagtcagagaatactccagatggctgatctagtcattcagatggagaatggcagaatcgcgcaaataaagaagaatctcagcaccgaaagcacacaagacgtgcccgacaaggattacgtcggtcatttgttccatgatacaccagaaattcctgaagtagtgtctgcaacccctgaaagcaccggtggcagagatgagatgagcccggtgtctgcggaggcccccaatgaaggtgctgattttcagcgcgtgagcagtttgagatatggtaagtctagcagtattgtccatttccaggtattaacccctccaggtttcaaatacatccgatcatttggcagtcggccattcgtcaccttagcagtgatttccactgtaggagctcaagccttggagattggactaccagcatggctctcgatgtggagtgctatatcagtgagaaatgaaggggaaggtagggatggtttttacttaggattttatgcaggtatatcatctccttctgatcgcgtcaggcggcaaatgctgactgcaagagcaggactcggctcagcacaaatagcaatactggcagtctcgctgttgttgccatactccgggtggctgggcgctccaattcgtggacaagcatatggaaattga

SEQ ID NO: 5830 - DNA, 303 bp, A.fumigatus
ttcgcgaactacacccacatgtatggacattttcttacccatcttcagtatttccgtgagccccagatgaagcccaacgagcccgacgaacccggtagcgccgactacaacgagcgcctctggagacgtggccgcaacgagaagatcatcacggaaacccagcctctcaagggaaaagcaggcagcagtcgctgggataactctttggccctgcttactaataccagtcagcccctgaagatgtgtttccatcaatttgaggatcacctcgcagttgcggatgaccgggacacgatcgcgtaa

SEQ ID NO: 5831 - DNA, 1263 bp, A.fumigatus
tggtttcggatgatttttgtaagaaatatccttcagggaacagaaatgtgtgcattttttggggggtttttgagattttgttctgagcattctggactgatgtgggaaattcctttactccgacaatggtcagttctctgcatcagcatgctctggtcggactttcccgaagccaagtggatgggattccggtgtggtgcaccgccaggactctgggagctcaatttcgaccccgttccggaggtcagggcagcgatgctccatgcggcgaccacattcttaggcattcctgattggaccgatcaggtggcacagattgaagaatccctggcattggctgtgctgcccatggcatcagacggtagtgtcctggtgagaaaggagctccttgtcttcttctcgacctttgtcaaacgctaccagaacaaattcctggtcgccgcatacgaagagttccaggacgagaagcaaacctttctccttcggttagagcacgacggctctcgaggcttcacaatggaagatgtgcagaatggaactgcaaactcacgcaacaaatcacagaaattgtcgcagaataccgcgttcggcacgatctggaaacaacttcttatactctctgttgacccacaccctgatattgcgcaagacgctagcacgattattgactacatccacctcacccttctagcgtctcccatggcgtcgcttactgacaaggcccgaaaggaaattatggaactcactagccggttgtcacagaaattacaagttcgcgagagagcggaatcgaaaaaggccgcgcctccaccagctcctccttcccagacggctgctcccaaacaggaaggatacttgtcattgagtatcaaaagaacagccagtgtggccgcttcactcaagaaccttgctttcggtggaccccctcagaacgagcaacaatcatcgcagaacgtaacatcgcccacaaagagccgcactcccgtcacccctcgaggacgtgccccccccgaatggacccggcctccggaagtcaacgaccaggtcgcttccgcggccgcttatcaccaggctccaattcctccctcgcgcggttttgaaccccgagacccatctctagcccccatgataccccttctgagtcggtttcttgattggtccacagaggtaagcccgagcctttctccatttgattcgcgaactacacccacatgtatggacattttcttacccatcttcagtatttccgtgagccccagatga

SEQ ID NO: 5832 - DNA, 381 bp, A.fumigatus
tgtcttgatgctaattttctttacctggtcagaatttgggactggcagagacacaagcgtcttaataggttttccaacgggaacccgccgggctcaaggatcaacgaagttcgctatatcaacgaggacgatcaagcgctgctgatgaccgggtcctccgacggggtactcaaagtattcagaaattacgaatccccgaaagaggtggagatagtgacagctttccgtgctttgccggaactaatcccaagcaatagaaatgccggtcttgttttcgattggcagcaaggccaaggcaaagcattggttgctggggatgtgaagctgatccgtgtgtggaacgcggccactgaagtctgcaccaacgtatgctcctcttaa

SEQ ID NO: 5833 - DNA, 204 bp, A.fumigatus
ttacatatcgtgaagtccagtgtctcacaaaacaaggcgtttcacccgttctacatgttccaaattgcgagtcttgtcctatggtcactggatgaatactattactatgccgtttgcattttcctcatttcggtattcagtatctgcgcaaccattttcgaaacacgaacggtatgtggcggtcgtcttttgactacggactag

SEQ ID NO: 5834 - DNA, 294 bp, A.fumigatus
tcaatgggtgaggctagcgaggcagatgagtccattatatcttctcgcaggtccaaacgcctgtattactccagaccctccgcagaggaccctctctttccgcggcgcccatcatcggctttttgtactggagagcgcacaattgacagcaggctcacccagaaagtttatatcgtgtcggaagacttgaccattgtcatcgctgggttttcaacgagctccacaggcttggcgctatattctttgctatgcgttattactttgggctttgcatatattcttctacgttggtag

SEQ ID NO: 5835 - DNA, 576 bp, A.fumigatus
cccagatggagagttcgactaataggaaagccgacgccccttcgattatgtcaatgggtcgcagtggaggtgggttttccccgcttatcaccgtgtaaagtcttcgctgaatatgtgcaggatcaatggaatcaattcaacgtatgtgaagtgttgagcataccttacggacgtgcgctatccacagtctttgcggaatccgaaagttgtacacaggacgaagataacgatccaactgtctcatacctgagatacattgattatcgttgtctccgcttcttctaccaccctttcgaggacaaatttagcttgatcagtggctggaaagatccactgtggacgaatatcaaacgaatgcgggtcgggttggacgcggatgatcacgatagccgtgcgcaaattttcggagcgaatgtcattgatatacagcagaagtccgtttttcaacttttgatcgatgaagtaagagccatgcttttgattacatatcgtgaagtccagtgtctcacaaaacaaggcgtttcacccgttctacatgttccaaattgcgagtcttgtcctatggtcactggatga

SEQ ID NO: 5836 - DNA, 282 bp, A.fumigatus
ctgagctcgatgcagacgatgaaaaggttgagggaaatctcgctttttgagtgcgatacccgcgtgcttaggaatggcttctgtaagtattcatccgtctgcatcaggaactggaacgcaaagttaatttctggactggcagggaggactgtcccttctcgagaattggtccccggtgatgtctttgaattttcggatccgtctttgaatcaagttccctgcgattgcatcttattgtctggagattgtatcgtgaatgaaagtatgctgacaggtctgtga

SEQ ID NO: 5837 - DNA, 282 bp, A.fumigatus
aacgccttgttttgtgagacactggacttcacgatatgtaatcaaaagcatggctcttacttcatcgatcaaaagttgaaaaacggacttctgctgtatatcaatgacattcgctccgaaaatttgcgcacggctatcgtgatcatccgcgtccaacccgacccgcattcgtttgatattcgtccacagtggatctttccagccactgatcaagctaaatttgtcctcgaaagggtggtagaagaagcggagacaacgataatcaatgtatctcaggtatga

SEQ ID NO: 5838 - DNA, 228 bp, A.fumigatus
ttcaaagacggatccgaaaattcaaagacatcaccggggaccaattctcgagaagggacagtcctccctgccagtccagaaattaactttgcgttccagttcctgatgcagacggatgaatacttacagaagccattcctaagcacgcgggtatcgcactcaaaaagcgagatttccctcaaccttttcatcgtctgcatcgagctcagctatttggctagtccgtag

SEQ ID NO: 5839 - DNA, 306 bp, A.fumigatus
aagccagggcgcttcctctctgctgttgcctcccaggctttggcgaacaggacgacatcatatacgcacaatcttcgaacgatacgtacacaactgcaaggagctcgcctggcaatgggatcgacagtcgagtatagtactatccgtcaagcgacttctacggacctgagcacgcagaatttcggtctgccaagtagaactatcacgcagctagacccttctctgaacgcccggattggcattgttatatcacactacaaaaactcgtcttcaccacggggctggaaggatcagcgctctcagtaa

SEQ ID NO: 5840 - DNA, 1308 bp, A.fumigatus
ttttcattggaccggttgagccacggaataattccccttgggaggaaattccttagaaacgggggaaggggctccgaaatttgggccaatgtttatttccttgagccccaggagggaaacaggtttttaaattctctgatatcatttggaaagaggcaggtgaatcaaaggccccatttggggattggtttcaattatcagacacctgtttcgcagcgatcgggagctgggatgagaatcagaaacaggttttgtgggatgtctcaatggaagaagcactctcgcgataagtctcgtcaacgtaaagtggccagtctcaatgagttagacaatattcaacgaattcctaaatggcccggaagtaagaggtcgccagtgcgtcctgcttttccgcgattccctccaccatatagatcacccacacctccgggccttccatctttcggaagtcctgaagcgatatcctactcaactcagttcttcgttcggtcccttgttcgcgaggggcatatccaacagagacctccaccagccacaggtccaccgacttcgaatggtggcggagtggcgtcttatggggaaagcttgcgcaggttcttcggattctcttcacctgcccctcctcggcctactggacagtcgatccctgttgcaagggccggagatggtacggcagtgctaggacgctttccctatcggcatagcgcccatggtacaagcttggtcagaccactcgacgaccatcctttccaccggagggcgcttcctgcagccgattgtgagactgtcgaggaggaaagcgactctaaccgtccgaatgaatatagtacgaggcttgtgaagtataccaacttagcgcaagtcgaagcatcagtgccgactccgcgtcccgctgaagagaatcgtcgtttcgattcttccagtgtcacgccagcaatacctaaacagactgtgactggtcgatctcgaaacacagggtctgctacggtgtccctggcgaaaaaccccatccatagacagactagcatctcccaaacactgcatggtcgtacctcattgagtggcaatgagccccagcaacagagttcggatcgaattggcgagcctcgtttatctgtcgaaatgaccggaacagtcccgggatcagcagacactttgctgcagtttctaaaagccagggcgcttcctctctgctgttgcctcccaggctttggcgaacaggacgacatcatatacgcacaatcttcgaacgatacgtacacaactgcaaggagctcgcctggcaatgggatcgacagtcgagtatag

SEQ ID NO: 5841 - DNA, 633 bp, A.fumigatus
gacccggctatctcagccgtgtcctcctcgtcgacgactgcaagtctccaccgcatcatgaaccgcccgcagtcaccgtcctacgtcggccccacgagtgcagagtttggtctgactacgcgccaacggcagccggaggacttcgacagcggcgacgacctcgtctcgacggcggtgcagagtccggcccccgcgcttggaggcgacatctcttctgaagatccgctgggatgcctaggttctgctgaggcgctccgtctcgtcgacgtgtacgagaataccgttggcctgatgtacccttgcgtcgatttggcgagcgtgcgtgtctatattgccgagtacttccgggataaggacgggatggagcctatttcaccgcctacgctggaccaggagtggttcttcgcgagggatatcgaggtgttgaagatcttactggcaacggctttgttagccgagacgcatggccgcagtgagaaggcggcgctgctggcggatagcgtggaggatcggttcgcaacaaggctcaaagtccctgaggtggatatgaaggagttgctcattttgactttgctggtatttccgtcatttctgcgtgatgtatctttctttgagtggctgctgatgagatag

SEQ ID NO: 5842 - DNA, 1032 bp, A.fumigatus
  unsure (430): Identity of nucleotide sequences at the above locations are unknown.
tccatcttccattcctatcgcgacgacgaagttatatcctggcggcttatcggcatggcggtgcgaggagcgatgcaactcggcctacactgccaggagacctggcaaaagaccggtggcgtgttccccggagagctgcagtgtgaatatgccagccggctgttctggtgcatctacgtgctcgaccgcaaatggtccttcggcacgggcctgcctttcgccatccaggactccgacatggacaccaatgtacccgaacccggcacaagcacaccctacctcacctgcatgatcaagtacgcgcgtctaagcaccaagatctggggcctagttgtggggtggcgcaacaggtcccgagctgcaacagcagactattgctcctacctcgacttccaggtccagcaatggatccagtctatccctccggagntacgcttcaacccggcccggtcaccaatgctgtctgagcgcgccgggtgctcagccacagttacggctactccacaaccccattcccaataccacacacaaaccgacagcatgatgatgctccaagtccttttcgccgttcaggcaaaccaactccgcatcctcgtttatcgccagaacatcctctgcagcgagagcatcgaagccgacgtgtctggcgcctcgaccgccgtcgaaacagccaaaagcacagtgcacatgctcgattccttctcccgagtgtcgccgttatacttccaacgcccggaacccttcaattacttcctcatctcggcattggcggcactgttcctggcggtcctgcatgcccccgcacggttcagccaagtctgtcggcccgagttctacactgccgtcgatatggtgcgccggtcgtcgacgcgcgcgcgcacttcccgccgcttacagaagatcataaagagcttgaagacgatctggatgaatcttgggacgcagagacccagggagccagtgcagaagaacgggccgaatcatcgcaccccgcgtggactggatgatacgggggccccgcgtcggttttaa

SEQ ID NO: 5843 - DNA, 786 bp, A.fumigatus
gtacaagaactatatattgacccttccagggcctcacgccgccggaatggaaagcccgcctcctgcgagccatgccgcaaagacaaagtccggtgtgatcatggccatcctgcctgttcccgctgcctgcggcgcggcagtactagtcaatgcttttatcatcctgcgcccttgacacgggctacgaggcggagtcgggggtttattgtgggtcaacacgcttctacaacgtccccagccgaactccgtgggtcacccgaggctttgtcgtcttcaggttcgaggtcagaccacttgttgtcagcgggatacttgggaccgaccagttttgtttctgttctgggcgaaggagacggtgcgaatgagctagttactgctgctgatgaaagttctgcggcatcgtctgttccagcgtggtgggcgaagagagctagcgaggtcgtcggccatctcgtagtattccctgctctcaagcaactgatactggaattctatggcgtcagtcaggctgctgtgattgcagcacctttcatcctgaatgcactctcccagatgcaggatacctaccatgcgtacctgttggatcaaggagaggcagaaattccggcgttggttgaaacggtccttgacaacaccgggcagaaatttaatgccccccctaccgtgggacggaccgcacttccacaggctctacacaaggttcatggcctgcgttttggaagatacttggccgtggttttatgctcctggcagggtcaaaccaaatcaattccggattggggggga

SEQ ID NO: 5844 - DNA, 279 bp, A.fumigatus
agacaagcaattgctctcatggatcctgaacattgtacgctcgatacctgtcccatacagaatgcctacatccattaccaacccaccatcgcgggcaacagtgtctatctggcactattcggcatcttcctcttcacccaactaatccagtccatgttctttcgcatgtggggattcgccggagctatggcagctggactagttcttgaggttgcgggatacacggggcgcattctccagcatgggaatcctttcagcttcgactactttctcttgtaa

SEQ ID NO: 5845 - DNA, 471 bp, A.fumigatus
atcatcatcatctaccacggcgaagagatctcgcggttgaagcccagaaactatgccatcttcttcgtttcatgcgatgtcattgcgctcatcctgcagagcgccggtggagctcttacctctgcggccgaagatgccgatggtcgacaaatgggattgaacgtcatgattgccggtctagtcttccaggttgctgcactgactctttttattgccctagcttcggagtttgcaatctgtctacgacgtcgacatctcaagggagaatatcaggtttctcacagtgcatccttaaggaaggacgattatgcggctatacggagaaagaaaacgtggacgctcttcctcttccttacgccacctgccctttgcctgacgaacgaagctaacaatggcagcccttgttcttgcgactatcacggtctatactcggtccattttttgagtggcggagctgaacggcggttatga

SEQ ID NO: 5846 - DNA, 447 bp, A.fumigatus
aatctgcatttccagcccagcagtccatcatatattgcttattatttcattttaattatcgatttctggtctgccgcgacgcttccttcctctttggttcataaaagctatggctcctccgccgcgcttgcgcattttatcaggttggtgtcccagctcttatctgcttctcaaaatgagcttcacatcttttctacaacaattcactatcacaagatccaaatgagactcatgtccgggattgtgaaaagacttccgcagcatccgccgcaacccgaaatgagcccagagctaactcgagcttgtttagtcggtggtaatgctatttcggcgttcctctcctggcgccttcaggctacaacgtcctgtgatgtgacccttgtctggaaatcgggattcgaatcagtatctcagtatggagtatcattcaagtacgcttcctcttga

SEQ ID NO: 5847 - DNA, 669 bp, A.fumigatus
cccttgtctggaaatcgggattcgaatcagtatctcagtatggagtatcattcaagtacgcttcctcttgactcatcgtctttcctctcaaagccgttctttctgatcgcggcgaaacacacaggtcgaaaacatatggcaatgaacgcttcaagccccgtcatggtacgttctctcatcatggcttatgtatcactcgcagtaaacttgctgacatacgcgttccgctttgtagttgttcgcgctcctgaagaagcagcatctcgagagaacgcatacgactatgtcattctgtgcgtcaaggcgctccccgacgtctacgatcttgcatctgttatcgagtccgtcgtcacacctcagcatacatgcatcctcgtgaacacaacgaataccctcggtgtagaatctcaattggagcagcggttccccacaaacgtggtcctctccctcgtttccggcgtggagatttcgcaaactggggctagtgaattcgagcatttggattcgtcagacatctgggtcggtgcaacgagtaacaattccagcattccggcatcgattcagaatgacatggctagtgctctggcgatgactttgagctcaggccaagtcaactgcagggtgtcggaaaacatcagacaggaacaatttgagcgcatgatagggtga

SEQ ID NO: 5848 - DNA, 264 bp, A.fumigatus
ttgtacagggtcctgggaacgaaagcgaatcttatctcaatgctcactggtgtaccgcatgaaaagctgcaggtcttccatcactgggccagctacgccatgttcgtcctggcatcgatccatacctttcccttcatcattgtccatatcgacaagggcgatatggtcacactgtggaagagggaggtgacgtactggactggagttgcggcgctgattccccaggcgtatttgaccttcatgtctttgccggctatccggtga

SEQ ID NO: 5849 - DNA, 540 bp, A.fumigatus
ccgcccatcccttcaccatcacctccatcgcccacgacgcagcttccctgtccaagcacaacgaactcgtcttctacatccaaccccgcggagggatcaccgcccgactcgccagcctcgccgcgcagcgccccggcaccgagcaaaccgtcctcctcgaaggtccctacggcggcctcgctgcatccgcaggcaaagacctcgcgcgcttcgacttggttcttgtcatctcgggtggctcaggcagcggcttctcgctgggaattgtggacgccgtgcttgcctcatcctcgcactcatcctcctcaacaccagctctacagaccatcttcgcaacgcgcaaccagtcaatggcagagtggtatgttgaagaaatcgaaagccgcatctcaacgtccaatgtctctaccagaggcggggacgtttccgcctcggttttcgttacccgtcaacaggaacagcagcatcggcagacagatgacgagagtaaactcccctccacaaaacctctcgcccgcagcatgtcgcagatcggcataa

SEQ ID NO: 5850 - DNA, 606 bp, A.fumigatus
acagctaagctgacgtggcagggattacttcatcgccgggggcgccctctacctcttcagtctctgcgcagcatatatccgcaccaccctcctccacggccgccacaaagccaccctcgacgtcctcccctgtggcttggtccgcatcaaaatcccaaccttcataacctggtccccaggccaacacgtcttcctccgctttttgaacgcctcccagctcggcctgcactctctaaccgcccatcccttcaccatcacctccatcgcccacgacgcagcttccctgtccaagcacaacgaactcgtcttctacatccaaccccgcggagggatcaccgcccgactcgccagcctcgccgcgcagcgccccggcaccgagcaaaccgtcctcctcgaaggtccctacggcggcctcgctgcatccgcaggcaaagacctcgcgcgcttcgacttggttcttgtcatctcgggtggctcaggcagcggcttctcgctgggaattgtggacgccgtgcttgcctcatcctcgcactcatcctcctcaacaccagctctacagaccatcttcgcaacgcgcaaccagtcaatggcagagtggtatgttga

SEQ ID NO: 5851 - DNA, 966 bp, A.fumigatus
cgtggcagggattacttcatcgccgggggcgccctctacctcttcagtctctgcgcagcatatatccgcaccaccctcctccacggccgccacaaagccaccctcgacgtcctcccctgtggcttggtccgcatcaaaatcccaaccttcataacctggtccccaggccaacacgtcttcctccgctttttgaacgcctcccagctcggcctgcactctctaaccgcccatcccttcaccatcacctccatcgcccacgacgcagcttccctgtccaagcacaacgaactcgtcttctacatccaaccccgcggagggatcaccgcccgactcgccagcctcgccgcgcagcgccccggcaccgagcaaaccgtcctcctcgaaggtccctacggcggcctcgctgcatccgcaggcaaagacctcgcgcgcttcgacttggttcttgtcatctcgggtggctcaggcagcggcttctcgctgggaattgtggacgccgtgcttgcctcatcctcgcactcatcctcctcaacaccagctctacagaccatcttcgcaacgcgcaaccagtcaatggcagagtggtatgttgaagaaatcgaaagccgcatctcaacgtccaatgtctctaccagaggcggggacgtttccgcctcggttttcgttacccgtcaacaggaacagcagcatcggcagacagatgacgagagtaaactcccctccacaaaacctctcgcccgcagcatgtcgcagatcggcataacacacggtccccggccggatctgcctgccttcattgccggctgtacatcgccgtccagcgcgcgcggtaagcggttaggcatcttcgtctgcgggccggcgagcatgctgcacgatgtgcggaatgccgctgcgcgggcgcagcgggatgtcctggaaaatgggccggaggaggtgtatttgcatttggagccgttctcgtaa

SEQ ID NO: 5852 - DNA, 213 bp, A.fumigatus
caccagctatacaaatccatatctaaccagaagaaatctactccaccgacgccaacccaacgccaaaccccaacgtcatgccaaagagcaaacattaattacgaagcagacaagcgtctcatcaacccctccctcatccgcacattcaccaccccaccaaccccatacgcaggaacaatcttccccatcctcgcaaaacagctcgccacataa

SEQ ID NO: 5853 - DNA, 1590 bp, A.fumigatus
aaacggaggaggtcgatgagaacgaaaaatgatgacaacggtgaagatggtgcgtcccgggatgatcgtaaccgcagtcgccaactatctgtagttcccggaagtatgatgcccaaggaccaacttgcgggcgtctatcgggaattgcaggccattcggcagcagcagcagatcatttcgaacaccatcaacaagttgaggagagagcacgaacagctctatgcgcaggctgccaatttccaggaacagcataatcgccatgagaattccatcaatgcaattcttacgttcctggccactgtgtataatcgcagcctccagggacaggacggaccgcagaatcttgctaattctttcgcgggtgtcatctcacaggatcaaggtaacgtggtcgacgtgggggatgactttccactgagtgcgctaggtgcggccaatctcaatagccctaatgcacagcgatcgatgaagaaacagcctctgctgctgaaggctcctccgacgactgaccgtcagaatggtcgcgctacaacgctctcccccgcaggtagcacctataatcgctcacagtctcgaagccatagccgacaacccagtgttactcaggctggccacgtcgaggaggtctttgaaacgagccctacgcaaaaggatgccacgaattcgcagaatcgcagtattccccagagcgacataatgtctgtcattcagaatacgaatgcgcggaatggtattcccacgacctttgctgagtttcctaacgtgctttcatccctcgagacttctggcggtaattctccactcaccccgaaccaacgtgcagatatgctccgactcatggccaacgaatctcacaccgatccaaatattccagtgccgtccgacaatgcgttgataactccgacgcctccgcccatgccgcataattataatggtcgtcttgcaagtacccgggctgagatagacaacctgatgaagatgcaagccgaacaagatcgttctgtacagaatttgaccaatctcttgcaaccgcttagtcccaccgggaccattccgggacttgcaggaggagaaaatggaagcgtacccccacccgcgcttgatcttgaccaaatattcaataacgactatttcacggacattggagaccttgagcacaataagtctaacatggatcttggtgatacaacaagctcggttcctgcgcccgcaccagccgacgcgcccgtcacgacaggcgcggaagacgtcaaggatggaagtgacctgttcgacttcgaccaaatccctcccgaaggcgatctttttgatacgtccaccgccgcgcaacagcagagccctactttcttcaatgggtatgacggtgctggctatcctggtggctccgggacaaacggacacacacccattggccacaagaatcccaacggagattccgggcggattgtcgaaactcttaccgacagtgaatcaaccagtcccagcactaacgtggacgaggtgccacaatactctggcccggccgggctcaatgaatctcacggaggtaagggaaatggcggcggtgcgaaacggcgcaggaaggcttga

SEQ ID NO: 5854 - DNA, 1068 bp, A.fumigatus
atcaaggcctacactggaggcgatacgtccgctatcgtggatgcttctgcagacctcatctccaccatcaacgatggcacatccaccgtggcggcccagccagctctgagccaagtggacgctctgaatctggtgaatcccatcctggccttgaccaacaaggtcaagaccaccatcgacgacctcatctccaagaagagtctgatcgtcgaggccggcgcgggtcctaccacctatagccagttgttggaccaatacacggcctcctcgaacttggctacgaccctgtctggcaaggtgccggaggctctcaagcaagtcgctgaagagctgtcctcgggaatcacctcggccatccagaagggtatcgatgcttataaggatgtgagcactcccccgaccactactacttcgtcgacttccacgcctcctacgacttcgcctactaccactcctaccgagacctccactccgtgcgagactactaccactactaccgagacctctaccccctgtgagactactactacgactactcctcctcctgagacctccactccgtgcgagactactaccactactaccgagacctctaccccctgtgagactactactacccctaccgagacctctactccgtgtgagactaccaccactcctaccgagacctctactccgtgtgagaccactaccactcctaccgagacctctactccatgcgagactaccaccactcctaccgaaacctctaccccctgtgagactactactacgactactcctcctcctgagacctccactccgtgcgagaccactaccactcctaccgagacctctaccccctgtgagactactactacccctaccgagacctctactccgtgtgagactactactactcctcctgaaacctccactccatgtgagactaccaccactactacacctcctacggaaaccaccaccacacccactacacctcctgctgaaactaccactaccaccaatgtccctgttcccccagtgacctccactaccaccgctaccgagaccaccccatgccatgag

SEQ ID NO: 5855 - DNA, 639 bp, A.fumigatus
gcactcccccgaccactactacttcgtcgacttccacgcctcctacgacttcgcctactaccactcctaccgagacctccactccgtgcgagactactaccactactaccgagacctctaccccctgtgagactactactacgactactcctcctcctgagacctccactccgtgcgagactactaccactactaccgagacctctaccccctgtgagactactactacccctaccgagacctctactccgtgtgagactaccaccactcctaccgagacctctactccgtgtgagaccactaccactcctaccgagacctctactccatgcgagactaccaccactcctaccgaaacctctaccccctgtgagactactactacgactactcctcctcctgagacctccactccgtgcgagaccactaccactcctaccgagacctctaccccctgtgagactactactacccctaccgagacctctactccgtgtgagactactactactcctcctgaaacctccactccatgtgagactaccaccactactacacctcctacggaaaccaccaccacacccactacacctcctgctgaaactaccactaccaccaatgtccctgttcccccagtga

SEQ ID NO: 5856 - DNA, 693 bp, A.fumigatus
tcatggcatggggtggtctcggtagcggtggtagtggaggtcactgggggaacagggacattggtggtagtggtagtttcagcaggaggtgtagtgggtgtggtggtggtttccgtaggaggtgtagtagtggtggtagtctcacatggagtggaggtttcaggaggagtagtagtagtctcacacggagtagaggtctcggtaggggtagtagtagtctcacagggggtagaggtctcggtaggagtggtagtggtctcgcacggagtggaggtctcaggaggaggagtagtcgtagtagtagtctcacagggggtagaggtttcggtaggagtggtggtagtctcgcatggagtagaggtctcggtaggagtggtagtggtctcacacggagtagaggtctcggtaggagtggtggtagtctcacacggagtagaggtctcggtaggggtagtagtagtctcacagggggtagaggtctcggtagtagtggtagtagtctcgcacggagtggaggtctcaggaggaggagtagtcgtagtagtagtctcacagggggtagaggtctcggtagtagtggtagtagtctcgcacggagtggaggtctcggtaggagtggtagtaggcgaagtcgtaggaggcgtggaagtcgacgaagtagtagtggtcgggggagtgctcacatccttataa

SEQ ID NO: 5857 - DNA, 1068 bp, A.fumigatus
ctcatggcatggggtggtctcggtagcggtggtagtggaggtcactgggggaacagggacattggtggtagtggtagtttcagcaggaggtgtagtgggtgtggtggtggtttccgtaggaggtgtagtagtggtggtagtctcacatggagtggaggtttcaggaggagtagtagtagtctcacacggagtagaggtctcggtaggggtagtagtagtctcacagggggtagaggtctcggtaggagtggtagtggtctcgcacggagtggaggtctcaggaggaggagtagtcgtagtagtagtctcacagggggtagaggtttcggtaggagtggtggtagtctcgcatggagtagaggtctcggtaggagtggtagtggtctcacacggagtagaggtctcggtaggagtggtggtagtctcacacggagtagaggtctcggtaggggtagtagtagtctcacagggggtagaggtctcggtagtagtggtagtagtctcgcacggagtggaggtctcaggaggaggagtagtcgtagtagtagtctcacagggggtagaggtctcggtagtagtggtagtagtctcgcacggagtggaggtctcggtaggagtggtagtaggcgaagtcgtaggaggcgtggaagtcgacgaagtagtagtggtcgggggagtgctcacatccttataagcatcgatacccttctggatggccgaggtgattcccgaggacagctcttcagcgacttgcttgagagcctccggcaccttgccagacagggtcgtagccaagttcgaggaggccgtgtattggtccaacaactggctataggtggtaggacccgcgccggcctcgacgatcagactcttcttggagatgaggtcgtcgatggtggtcttgaccttgttggtcaaggccaggatgggattcaccagattcagagcgtccacttggctcagagctggctgggccgccacggtggatgtgccatcgttgatggtggagatgaggtctgcagaagcatccacgatagcggacgtatcgcctccagtgtaggccttgat

SEQ ID NO: 5858 - DNA, 186 bp, A.fumigatus
  unsure (96),(174): Identity of nucleotide sequences at the above locations are unknown.
tgccggctgtcaagatataacacgttcatccttcgtgataacagcaatctgggtcacctggatgtggttgccatgtcaaccaccaacatccaactntatactcagactatcaacatgagacaatcatcccaacaaacgaatgtatatacattattcttgtccacacccaagaanagcaacctatag

SEQ ID NO: 5859 - DNA, 195 bp, A.fumigatus
ctcgaacggttcgatcggcaccaacctagcgataagttgaccaacaggccaccatacactcagcatggtcaagagatttccggaagcaaaaggcaggaattccaagaaaagagcgccatcaaccggcagattaccgccaacaccgaggcccaggcaggcgaacaaagcacagacactagatttgaggtatattag

SEQ ID NO: 5860 - DNA, 408 bp, A.fumigatus
  unsure (36),(129): Identity of nucleotide sequences at the above locations are unknown.
gggaccggatttcgacctcggacccggaccatgtcntgcagtcgcacatcccccatcgtccccatagtggcatcgccggacctaaccaccatcatgccatttttcaacccgttccgaaaacacgaccanacaaccttccacggtgtcgtcattccccttagcagtgccccatcgcatgcgcgcccagaaagcccagccctggaaaagaagggaagtccaaaggagaaacctgatgattccagtctggacaaggctccatcgcaggagaacggctctgccgcttccatccccgagcgcagccatctgaccattgaatctcttcgtgcggagatcgagtctgatgttgctgcttcggggcatgatactgcttatgaccgtatgtttttgtgtgttgtctgcgactattga

SEQ ID NO: 5861 - DNA, 480 bp, A.fumigatus
ccctctttatttgtggggcctttggtttggccgccgctggtggtcccacatggattgggtatgtccattcgatatttcctgtccgcagttggggccggagcttgcgcgctaatatacctcaaatctagtgtctgtgctttgttcgcctgcctgggcctcggtgttggcggtaatctgccggttgatggcgctcttttcttggaattcctgccttttgcttccggaaatctcttgaccatgctgagtgtatggtggcctgttggtcaacttatcgctaggttggtgccgatcgaaccgttcgagctatgtgaattcaaatcatctaacaactcgctagtcttattgcatggggcctcatccccagttatagctgcgccgatgacctgccctcctgcaaagcagtcggtgacggagtcgcctgctgcggaaaggacaacaacatgggctggagatacttcgtgctcactatgggctccttga

SEQ ID NO: 5862 - DNA, 312 bp, A.fumigatus
aacctagacactaatcagaatcagggagttgcccttacattgacaccggtcgcctctgaattcggcatctcttccactcgggttcgtttcacaacctgcgccttgttcgtagggctttgcctgggtgcatccttctggggtgtcgcatcagatatcgtcggacgtcgaccagccttcaacctgaccctctttatttgtggggcctttggtttggccgccgctggtggtcccacatggattgggtatgtccattcgatatttcctgtccgcagttggggccggagcttgcgcgctaatatacctcaaatctag

SEQ ID NO: 5863 - DNA, 369 bp, A.fumigatus
caactcgctagtcttattgcatggggcctcatccccagttatagctgcgccgatgacctgccctcctgcaaagcagtcggtgacggagtcgcctgctgcggaaaggacaacaacatgggctggagatacttcgtgctcactatgggctccttgaccattgtcatgtttatctgccgcttcttcctcttccatctctacgagtccccaaagttcttgctcgcccgtggtcgccaggatgaagctgttgctgcagtccacggaattgcctacaagaacaagactaagacttggctcaccgtggacattctcaatgagattggcggctaccccgaggagaacgccccccaaacgctcagcaccaaggaaatc

SEQ ID NO: 5864 - DNA, 1026 bp, A.fumigatus
  unsure (19): Identity of nucleotide sequences at the above locations are unknown.
cctcggaggacatatgcanatgcacacgcatatcacatcaacagtatctctgtgaacagtgatggggagactttcatcagcagcgacgatcttcggatcaacctgtggaaccttaacatccaagaccagagcttcaacattgtcgatatcaaacctgcaaacatggaagagctgacagaggtcatcaccgctgctgaattccatcccattagctgcaattggtttatgtacgccagctcgaaaggcacaatcaagctcgccgacatgcggcagcgcgcgttgtgcgatgagcattcaaaacgtatgtcgtgcatgctcgatatgaattccgtgaaacccccttggctgacctactttcccctagttttcgaacaagaggaagatgcctcgtctcgctcctttttctctgaaatcatctcatctatctcggacgtccgtttctcgcacgacggccgatacattgtgtcaagagactacctcacagtcaagatctgggatgtcaacatggagaggcaaccggtgaagaccattccgatccacgagcatctacggccacgattgtgtgacacgtacgagaacgacagcatcttcgataagtttgaggttgtcttctcgggtgatgcggagaacgttatgactggtagttataacaataactttatgatctatcccacggaccctagcaaggaaacggagatcgtactgcaagcagacaagtccgccttcaaggccaagaaggtcggtgtgccgacacctatgaataagaatggcaagaagaacgggtccagggccggtagccctgctggtcctggcagtcggatgaagaaagagaccgatgcggatcagatcgatttcaacaagaagattctgcacatgagctggcatccttatgaggacagcattgccatcgctgctacaaataacgtgagtatccttgctctacatttcccctcctgttatcattcttgtgattttgcaaaggtgctaatacagtcggaacagctgtttgtcttctccgccttgtaa

SEQ ID NO: 5865 - DNA, 495 bp, A.fumigatus
acagttcttacaaaagttcccggtcgcccggggagaacggcattgggggttagtccaatcacaagttatgagattgggcctggcgcacacggaggcacaatcaattctattgtttggaatcaagatacaaacatcttcacaacagccgcagaggatcggaaggtccgctggtgggatcttcgttctcgccatcctgtcatcgagtacgctgtcgaaggcacgataggtagctgcgaactcaacaccctcgccactcgacccaatgaccccggcatcctaactgtcgcggccggaaagagtgtatacctcttcgatggtgtcacccccgggcggcttttgaagaagatggactttcgatacgaggtcgccagcgccgctgtgaacaatgatactggccgattggtcaccggcagtgctgacgatacctgggctcgagtgtacgatctacgcaccgaagaagagctcggtacgtgtataagaaacttctatttctaa

SEQ ID NO: 5866 - DNA, 216 bp, A.fumigatus
gcccacaggttactgcaactatggaatagtttccctgcctacagtgaaccttactcccacgagacgaggtcagtgttcaatactgactatcgatcgactcacctgggtctcgcgactcctatgctcgccacatgtccagtttataaccagcatataaccgggaccgcccgaacatctaccttttgcaatgcagtgctgagtcgcctatcgagataa

SEQ ID NO: 5867 - DNA, 555 bp, A.fumigatus
gggcattctgtcagctcacttcatcatctcctactgacaattttggtacaggaaatccgacggaagagcaccaaagaatcgcaagacatcaaggaagagctgcagcggaaacagatgatgaaggaagcggccaagaagaagcaagaaaaactggaggaacttgaagccaagcgtcgcattaaagccaggattgaagcggataaagaagagcggagactgagagctgagcgggagaaagcggagcgtgccggcatggcacctcctgcacaacaagctgctccagcgcctacaacctcgggacctgttgcttccaagcctgcagctgcttacactgagactcgactgagattccagacgcccaaggggaacatcatgaaaacaatgcccgtcactactaccttgttcgaagttgccgcagccctgaaacaggaggacggcattgacgtgcaaagctttgtgcaaaactttcctagaaaagtctacaacgccgagttctttggtgagtctctaaaagaccttggacttattcccagtgccagtcttattgtccagtga

SEQ ID NO: 5868 - DNA, 195 bp, A.fumigatus
tgtacctatgtttatctcaaataccatgggggcggtttcagtaacagtctccccatggtgattgtattccggttcctggctggctcttccatcccctccattttcctgaacccggccatcgcgtttgatgtgttcatcgtcatcatcatacatggaggaaggtacatgttcggcgccaaggcaccccggggctga

SEQ ID NO: 5869 - DNA, 210 bp, A.fumigatus
ttggcggctcgggctaacgcgctatatatatatgtatatacttatatgtttggccacttaggtgttacgtcattggccaataatatcctccacttcccagtttctatacctcagtctttccaggatccctcctttacagagtatatatgccctacggggagattccggtgttatctctccagaatgtcagccggaaactttacaaagtaa

SEQ ID NO: 5870 - DNA, 1326 bp, A.fumigatus
  unsure (15),(103): Identity of nucleotide sequences at the above locations are unknown.
atatttattcgacgntgcctcgcagaaaggaagtcacttacgtgcattggaagtaggacactgcggcatgacggttcagacgttgatctctttctttcgacgntagttactcaagcttttacgttggaggcagtcgacctttttggtatacagggccggttagttcccggcttactccaacagtaccttgggcactttggcaaactgagaaaacttgatctctcgcgcgtctcccgaacgtcgggcccggaagcgctgatcagcccagagactctattcagatggcggctgcaggaactttctctgagtggaactgcggtcaatagagagactgtcgatgcgatagctacttatctggccagcgatcaatctcgcgacctacgtatacttcggcttgaccagtgtggattgacagggcaggatgtcgccatttttctgcactcaatagctgtggttggtgcacctcgggatctgcatctctatgtcagtgaaaaccgtctagacctgggttgttcctatcttttcgacgctatagctcagaataagacaccgtcgcatctttcaatgaggatgattgactttaaaagggaagagcaatttcaggacctagtggaggctctcagaataaaccggaccctgaagtatctcgacatttccaaagcctcactgccgtatgacgccggaccggagacgtgcagatcgctccagttaatgttcgaggagaacagcacattggaaagcctggatatcagcggagagagtgcacacttggatgtggcacgatttgggattgggctaaacctggccttgactggtttgaaaaagaacaagtccctcaaggtcttgaagatagagcaccagaaacttggatttcaaggcgcgagtactttggcctccgtgctggaggagaacacttgcctgcgagaagtctactgtgaaaataacgacatcaatttgcaatcgttcacggtcctggtcaacggactccagcgaaacaggacaatcttgaatctctcttccatggaccaggaccgggttcagtccctcgataaatttcggcgggagattgagaatgtcaagcgtgatctgagccatgcgcagagttccacgacgagctctattcgccgctcgatccacgctgcaattcatgtcaagaatgcgacggttgggaataagctgtccaaacattcctcagctgccaaccctactcgttctatgacctcgccatctttgagctcagcgtcgaccaccgccgttgcggcttcccatgtgatggatcacgatgttgagattattctgcaatccttgaatgaaaaatgggattaa

SEQ ID NO: 5871 - DNA, 699 bp, A.fumigatus
ggggttgcgcgtctgcgtcgctatctgtttgggaactacttcgtggccaatggaatcgacgatggctacgacgatgccgctagtgatggccggccaactacggcggctagtcttgggacgatgctggaaaacctgaaactgaatggtccggaattcagcgaagaggaacccacgttatctcagactagcttgcaggctacaccgcaatctgacgagaaagccgactctccaacaccatcaactgccagtacagaaagcaagagcagccacctagacattttcaagagcctcgacgccgatagtggctttcgagccgaactcggcgatcgaccacagacagctggtgacgtgctgacccatggatccgcaggcttgccacgagagtactctacctctaatgcaccctcggcgcgtttggcagttccggttcctgcgatgccttcaattacagtcaaacctaacagcgtccgaagtgcccgcagctcgagctccatgtcgacaagcgccggtactacaatgagttcacgtagtacatacggcacagcttcctccacactaaggggcttcctcagcaaaggcgtatcgaaagatcggcgtggccttgataaattgaaacctgggcctctttgtgtctctagtgatgcgcctccccagctggattggacaccacctcagctagaactacgtggtttccgatag

SEQ ID NO: 5872 - DNA, 1338 bp, A.fumigatus
  unsure (612),(706),(717): Identity of nucleotide sequences at the above locations are unknown.
gccccatggattttccacggctggtgtcgacgatgcccgccagagaccgccaataagtcgctcagtctctcattgactccgggagcaactacagatgacgaaaaaatattcaaaccgtatgtctctcggtcagcgggggagatcccccaggcagacgatcccaacggccctgggcttagcgaacccagaaccatttcttggggtcagagccgcaaattcaatcagccgcaatccacggctcaagtccatcccgaaccgtcaatcttaagagcctcaggtgccggggatgacctgaatggccagttctgtgattcagttttagagactccagattctgaggaggatcatggaagtccccgtgcgttactctctgttgatgactgggttgtcaaggcggcagaacaaggcaatggtgggctgcgcaatgcggtctatgcagccgcagaaaccggtatcctgacaaacaaaatgtgggtgggcacactaggcatgcctaccgacttgttgaaggatgcgacacgcgccagcatttctgagacactcgaagacgagtacgagtcgttgacggtattcgtacgcgatagcgagttcgacggccattatacccatttntgccgttcagttctgttggcagccttccattatcagatgccagagaagccccgacacactgaatacgacgactattcctggagacagtatgtcnaggtcaatgangcgttcgcttacactatcgctgctcgatggcgtcctggtgatagcatctggatccatgactatcatcttttacttcttccacagatgctccgacagcggttaccccaggcagagattgggttcttcatgcatgctgcattcccatcctccgaggtgttccgctgcttgaattctcgagatgcactactgaatggtcttctgggctctgactttgtcggcttccagacagaggagtactgtcaccactttttacaaacctgtagccgtctcctcagtttagaagtgaccgttggcggcgtccaactgaaagatcgatttgtccgcgtcaagagtattcccatgggaatcgacgccaacgccctggaccacctacgccagaccaacgaggtaaaggactggattgcgaatatttcttccaggtatagcggtaagcacctaattgttgcaagggatcgattggatgtaccgggcgggatcaagcagaagctgttggcctacgaactgttcctgaagaagtatcccaagtggagggaaaacgtaagtgtccatattctatatgacctacgagtcgacgtactgatagacacaggttgttctcatccagatagcgtcagcatctga

SEQ ID NO: 5873 - DNA, 819 bp, A.fumigatus
  unsure (659): Identity of nucleotide sequences at the above locations are unknown.
acacaggttgttctcatccagatagcgtcagcatctgagatgcctgaactagagtcacaaatctcaaagattgcaacgaggataaattcgaagtattcgacgcttacacaccagccgctcgtgctcttgagtcaagacatcagttactcccaattcttggctttaatgagcgtggcggagattttcatggtaacaagtctacgagagggtatgaacttgacaagtcaggactacatccactgccaggatggcaaagtgacgccgcaataccatggatccctgatcctgagcgaatttaccggcagtgcttcgatctttcatggacacgagtttcttgtcaacccgtgggactacagagaagttgcagatgcgattaacaaggcactgggaatgtcgcccgaacagaagcaacacaactgggagttcttgctcaagaagaaaggcgcctcacacagccgtagcgtggtgcaattcgtttatctcagcccttgccgaagctcacagcgcgcaattgtcccgcgaactcagccttgtcgcgacactctctgtacccgcactgaaggagtcattcgagaaaggcaaccaagcgactcttcttccttgaaggcgaaggagccgtcgcttctgacagcacaccgtcgctgcttgaagaacttctncgcgatccaaaaaacctcgtctacgtcaccagcaacaaaagcccggagcagatcgaatcccaatttgcaagcttcaccgatagaaatcgatacatcggcgaggacgggtgcttcaagcggaaaaatgggacaactcaatgggaagcactcctggacatga

SEQ ID NO: 5874 - DNA, 324 bp, A.fumigatus
gcccgcttcgagcatctgtgcaagggtcaattgttcctcgcctctcaatcccagttgattgttcacttccatgagaaggtcatccaagaagccgacggtaacggcacgccattcaactaccacatcatcatcggccgcgaaaagcgggactacctccacgtttggctggcccttgatctgagcgttctgtttgtatgctgcgatgccgcgctggaggtcggcatctttgagagccaacaaccccatatcaatgaggaggccgccatttcgatattcaggaagtccagtgaggaggtcgctgccagcgatgtggatgttcagtaa

SEQ ID NO: 5875 - DNA, 621 bp, A.fumigatus
cgttgtgtgcgtctagactacttgctttctcatccatcaacgcttgcctcgtctgtacccattgttcccatcaccacattgtggacggtcctcatggatggattcgcgtcaatttggccgccttcaagaacccaggttgatggggtttctatcggagatgcttgggtctgctcaagcatgccccaatcgcctcctgcacaaccctgggaaagcatcgtacccttccataaacttacgcaatggctttgctactcaatcatggtacccatggcaaagttactgaacatccacatcgctggcagcgacctcctcactggacttcctgaatatcgaaatggcggcctcctcattgatatggggttgttggctctcaaagatgccgacctccagcgcggcatcgcagcatacaaacagaacgctcagatcaagggccagccaaacgtggaggtagtcccgcttttcgcggccgatgatgatgtggtagttgaatggcgtgccgttaccgtcggcttcttggatgaccttctcatggaagtgaacaatcaactgggattgagaggcgaggaacaattgacccttgcacagatgctcgaagcgggctcatggaaggtacgtacctag

SEQ ID NO: 5876 - DNA, 237 bp, A.fumigatus
cttcccttgcaggtctactcttttgtgcccattcctggggcgcaacagcacaaacgaccccgacgtcgctatgaagaaatcgaacgtatgtacaagtgtggttggaacgggtgcgaaaaggcttacggtactcttaaccacctgaatgcccacgttactatgcagtcgcacggagccaaacggactcccgaacgtatgtctctgatatattcctctgccttctctctccgttcttaa

SEQ ID NO: 5877 - DNA, 372 bp, A.fumigatus
ctaatcttaccctttgccacagaatttaaagaaatccgcaaggaatggaaagctcgaaagaaggaggaagaagcccagcgtaaagctgctgaggagcgtgaacgtgctgccgccgctcaagctgctcaggcgaaccaggttgatgctcccggtcctaccgatcctgcgcaggctcaacctcctgcctacgctggcggtgtccgccctcagctgccgccaattggctaccagcctgccgacggccaagttcccgggcagtacggcggtgccagtggcatggtgtatcagggtaatggtcagatggcctatcctccaaactaccctcactccccgtatggacaaagcgggcaggtgtatcagcaacgtaagtag

SEQ ID NO: 5878 - DNA, 1365 bp, A.fumigatus
tgcgcgaggcttcaaaacaaaccgtcgctgtcatcggttctgggatggcaggcctggtggcggcgttccttctccaccgcgacagcaaagggagatacagggtggaagtgtttgaaaaggtacgattataacctgccagatgttgtatttgaggacggttgtgtagcttctaattcaaatcagcaagaccaattgtcattagattcagcatcatacaccctggaagcggccaccgatgaactccctcaccgcgtcgatataccgatgcgcgcgttcgatgataactatcacatcaacttgaagcgaatgtacgacttccttggtatcgattacgtatcgcccaagtttctttattccctatcccgaatttgtccttccagcggaaagagagagcctccttattttattcactcatccagcaaccaccaagtaccaccgatccgtcctagatcccggagtcgcatggactggattgccgaaacgttatatttgacagtttgttacttctggttcattgtgtgctgttttgttattgggccgaaaggaaaatctgtgtcctgtggggacgaatcgttccgacgctaccttgagcggatacgattgcctcagtatttctccaggcgctatctattgccgttactgtcaagcatgaccacttgttcgcatgctgagcttctcgattttccagctattgatgtcgtagactacgcgacgagaacataccgtcagccgcattacactgtcgtgggcggcgttcatcgtgttcaggcaagaatatccgacggactagccattaggcttcactcaactgtcactgctgtcgaggctgctggaacgaggtgtcgtatcacatggatcgattcccagaatgacaaagtgtcctcagcagaatacgatcatgttatcatggctgtcactcctgatgtagtggctgctatattcaagccgctagagaaacctctacggtcaatccccaccgttaaaggagactgcattgttcattgcgatacatctattcttcctgatggcggtttgctatgtacagaagctaagaaagcactggagccgccggagattatgtatatggtttccgacaacaactcaaccgaatctgtccacatccatcgttcttctgtcatggtgacaaattttccaattgagcccatcaattcgaacaaaataattcaccgcgcacgtctgactcgggtattacggactgtgaggagtagagaagtggtgaacagaatattttctcgcgagccagtcccaaaacaccctctcggagaacgaccaattgtggcgcaatggggatgggaacgtgtggcttgttggcgcatggtgctgggatggcatggtgcttcttga

SEQ ID NO: 5879 - DNA, 210 bp, A.fumigatus
gggctatcagtgtcacaactcagatcccttattattgatcctgctgtgtcttatgagagcaaagctgacacggaacgcaatcccatgctggtagtgaagaactgccaagttcaagccacttacacgcacctacatagccctttcagattgaactgttgcagatcatcttccgcaaaccaatgttttgatcaatgccgtagcattcggtag

SEQ ID NO: 5880 - DNA, 228 bp, A.fumigatus
gatgcaggcgggctgacaacgacagaatactaccaaatcttcctttccttcagtgtcctcggcggcatatcctcctgctgtctctttactccagccatcacggcggtcggccactggttcaatgttcgtcgcggtctggctaccgggatagcctgcacagcaggcggactcggcggggtcttcttccccttaatcattctctacctcggccctacgattggattcacc

SEQ ID NO: 5881 - DNA, 852 bp, A.fumigatus
ctgttcgctaccctcaatggtcttcatatcccaaccgccggaagcactcttggtccattcaacacggacagtgttgatacccttgacgtgaccgttaccgtcgtcgacaaattcagtagacatgacacagtactcgcgggggtccttgcccatgtgggtcttgacctcggagtggccgtagtcgacacggtagatacggggccactgcggccatgggttatcacgggcacgttctggaggaggctgaggcagcaactcgaagttaacaacagacttggcaccatggcggacagaggtaccaatgcagtcgttaccagtgtcaccaccaccaatgacaacaacatgcttgtccttagcagagatgtactctccatcagagagacccgagtcgagaagagacttggtgttgcggtgcaagaactgcatggcaaaatgtacgccgtccaactcacgaccagggaccttcagatcgcgggcaacggtggcaccagtggcgatgatgacggcgtcattgctctggcgcagcgagttcagggacacctcattgtcagggccaacagcagtgttggtgacgaatttgataccctcggcggccataagatcgacacggcgttggacgatcttcttatcaagcttcatgttgggaataccgtacatcaacagaccgccaatacggtcagcacgctcgtaaacagtgacgctgtgcccggcacggttaagctgatctgcagcggcgagaccagcgggtccggatccaataatagcgaccgtcttgccggtgcgcgtcttaggtggacgaggaaccatccagcccatctcaaagccacggtcgatgatggcacactcgattga

SEQ ID NO: 5882 - DNA, 1275 bp, A.fumigatus
  unsure (1): Identity of nucleotide sequences at the above locations are unknown.
naatccgctcgttgcatggactgtggtgtcccgttctgccaatctgacactggttgccctatctccaacatcattcccaagtggaacgaattagtatttgcgaaccagtggcaggatgctctaaaccggttgctcatgaccaacaatttcccggaattcactggtcgtgtctgccctgccccttgcgaaggcgcctgtgtgttgggcatcaatgaagatcctgtgggcatcaagtcaatcgagtgtgccatcatcgaccgtggctttgagatgggctggatggttcctcgtccacctaagacgcgcaccggcaagacggtcgctattattggatccggacccgctggtctcgccgctgcagatcagcttaaccgtgccgggcacagcgtcactgtttacgagcgtgctgaccgtattggcggtctgttgatgtacggtattcccaacatgaagcttgataagaagatcgtccaacgccgtgtcgatcttatggccgccgagggtatcaaattcgtcaccaacactgctgttggccctgacaatgaggtgtccctgaactcgctgcgccagagcaatgacgccgtcatcatcgccactggtgccaccgttgcccgcgatctgaaggtccctggtcgtgagttggacggcgtacattttgccatgcagttcttgcaccgcaacaccaagtctcttctcgactcgggtctctctgatggagagtacatctctgctaaggacaagcatgttgttgtcattggtggtggtgacactggtaacgactgcattggtacctctgtccgccatggtgccaagtctgttgttaacttcgagttgctgcctcagcctcctccagaacgtgcccgtgataacccatggccgcagtggccccgtatctaccgtgtcgactacggccactccgaggtcaagacccacatgggcaaggacccccgcgagtactgtgtcatgtctactgaatttgtcgacgacggtaacggtcacgtcaagggtatcaacactgtccgtgttgaatggaccaagagtgcttccggcggttgggatatgaagaccattgagggtagcgaacagttattccctgcggaccttgttctcctttcgatgggtttccttggccccgaagaccgccttcttggcaatgaaattgagcgcgatgcccgtaagaacgtcaagacgcctccaggtcattactcaaccagtgtgtccggcgtctttgctgctggtgactgccgccgaggacagtccctcattgtctggtaa

SEQ ID NO: 5883 - DNA, 441 bp, A.fumigatus
aggtccctggtcgtgagttggacggcgtacattttgccatgcagttcttgcaccgcaacaccaagtctcttctcgactcgggtctctctgatggagagtacatctctgctaaggacaagcatgttgttgtcattggtggtggtgacactggtaacgactgcattggtacctctgtccgccatggtgccaagtctgttgttaacttcgagttgctgcctcagcctcctccagaacgtgcccgtgataacccatggccgcagtggccccgtatctaccgtgtcgactacggccactccgaggtcaagacccacatgggcaaggacccccgcgagtactgtgtcatgtctactgaatttgtcgacgacggtaacggtcacgtcaagggtatcaacactgtccgtgttgaatggaccaagagtgcttccggcggttgggatatga

SEQ ID NO: 5884 - DNA, 285 bp, A.fumigatus
gcgatggcaaccgtctcagcacctacccctaagctggatcgctacattgtcatccacgttgcaaccacctgtgatgaacatggcgtctacgtcaccaaagattctgcagaggtgatcgaattggggtggattttgctggataccaaaacctgcgaggaggtgggttctactcttgtgaatcgacaacactcggcctttttccctctcccctccttgcgcctcactccccttttcccttctaagtgcctaggccaccaccaccgctgttcgtccgcctgtcgctga

SEQ ID NO: 5885 - DNA, 762 bp, A.fumigatus
cagtgtctgacagcaagccttacaactctgacatgggaacacgtccgctcggcaggtaccttccgtgacgcaatcaaccgcttcgatgcttttgcccaggaacacctcatcagcaagaatctcgagttcgcctttgtaacgttggattcgtgggatctccgagtgcagctgccccgtgaggctcgtgacaaggctgtcgtccttcccccttatcttcagcactcccggacctttgacctccgcaccgagtaccaaagatggcagacccaccaccctgagtctctccctttcggtcccagctcgctttccaatatctgtgctgcgcttgaagttgaacctgtccagtcctccgctccgatcaaacataacctcccgttccaccttcaggcattggcccccgcctctcctcgccgggcaatggaggaggccatcactctggctcgcgttctccgcggcttgattcgcaagtcgcagccgccacacgagcacccggaaatcttgactcgacccatggatgccagagcggatgttcgtgcctttttgacagagcgcagcaaggtcctccatctgagcggcctgcctcacgacactacacagtcggaattggaaagctggttcacccagtgtggtggtcgtccaatcgctttctggactctccggacgccggatgaacacaagcccactggcacgggctttgccgttttctcgtcccacgacgaggtatgtactctttcacttctccctctgttttctactggatga

SEQ ID NO: 5886 - DNA, 795 bp, A.fumigatus
tattcctactttctgacgttcctgctccggcatagaaaaacgggtggttctggggtctctgctggtggcacaatcgctgtagcggtagtcgtgcctgttgtctccgttgctttgatcatcctagctgccttgtacttctggcgcaaatggaaggcaaagaaagcggcggaggaagaacgaagaaaagaggtggaggagtacggattcaacccaaataacgatccgacattaccgcccatcatgggcgccggcgctgcatacgaacccaaggaggacacatctggatatcggggatggggaacgacctctgctggccgcaaagcgtcgacgaatctgtcgagcggcgccgggccgggattagctatatcggaagctggaagtgcacctggctatcatcacgctgcaactccgagtgacggtaccatccaattttccgaaggacagatgcaagaaactgaaccaatcggggtcttgggagctgctcctacctcctctaataatcgcaccactgacatccaccgtggcccgtccaatgcttcatctgcttactctgcagccaatagatccgaggcctcggaagaaagccatatgtctggcactcatccagctgctgccttctacgaggataatccgtactatagtgatatgcaagggcagtacggggcctatggagacggtccatatgtcccgaatcagcctgtgattcgagatgtccaggcccggcgcaatacgcggatcgagaacccggcggtcttcccgcgacaaggaaacgctggcatcgcccaaaacttttga

SEQ ID NO: 5887 - DNA, 1230 bp, A.fumigatus
tcgtctttctatgactcacccacagtagaattgacaaatcgtcttgtacagtacgacgagatccctatccctcagcacatcaagaaacccgttctcaccatgctccgcgaaacaaaaactacaccctccctcatgtcccagctgaatgtccagctgggcaacatgttcggcgagacggtcaagctcttctgtaagaagcacaatgtgcccattaacagcatcgatctcatcggctcccatggtcaaactatctggcttctctctatgcccgaggagggcgagatccgctccgccctctgccttggcgagggaactgtcatcagtggcctgaccggcatcactacagtcaccgacttccgcatggctgagcaagccgtcggccgccagggcgcacctcttgtcgctttgatcgatggtctcctccttcaccaccccaccgaatggcgcatctgccagaatattggcgggatcgctaacctctgcgtcatcccacccgacagcgagggtggcgtcgacgccatggtcgactgggactgcggcccaggcaacatgttcatcgacgccgcgatgcgctacttcaccaacggtgagatggagtatgatcgcgatggcgagtggggagcgcaggggactgtcaaccaggccgtcgttgacaacttcctcaacaacaacaagtactgtaatcaactgcctcccaagacgaccggtcgtgagacctttggcgacaacgaggcccaggagatcatcgatgagtgcttagcgctgggcatgagcaagtacgacactgtcgccaccatcacgcgtatcaccgcccagaacatcatcaagcagtaccgcactttcttccccaagttcaacgtcgacatcaacaagatcgccgccgtctacatgtgcggcggtggtgcccacaaccccaacatcatcaactacctcaaggagcagctgcccagcgtggcgattctcaagctcgatgagacgggtgttccgtccgatgccaaggaggccgtctcgttcgcgcagcaggctctcgaggcgattctcggccgtgccgctctggtgcccattaacagtgacacgttgacgcccaacaccatctcgggcaagattgcgccaggattgcgatggagagaggttatggcgatggcagtggaattcggaaagggtcgaactcgactgccaacggtcaaggagatggtcgtggaccggccctatacctacgggaagccatag

SEQ ID NO: 5888 - DNA, 351 bp, A.fumigatus
tcgatggtctcctccttcaccaccccaccgaatggcgcatctgccagaatattggcgggatcgctaacctctgcgtcatcccacccgacagcgagggtggcgtcgacgccatggtcgactgggactgcggcccaggcaacatgttcatcgacgccgcgatgcgctacttcaccaacggtgagatggagtatgatcgcgatggcgagtggggagcgcaggggactgtcaaccaggccgtcgttgacaacttcctcaacaacaacaagtactgtaatcaactgcctcccaagacgaccggtcgtgagacctttggcgacaacgaggcccaggagatcatcgatgagtgcttag

SEQ ID NO: 5889 - DNA, 369 bp, A.fumigatus
aggctaagcagattgctgagcgggttgctcagggtattgtttccttgcggccccagatcaatatacttggatactaatggattgatcttagatgtggagtacaaaaggacgacacttattgaggttgtacagtcacttggagagtatatcaacgatgaggatcccatattgcgaggcaaagctgtctcgtacctcactgctgtgatcagagcacttcctccgaagtatctatcaagacaacagatccaagtgctcacaacgttcttctgtgaccgcattgaagatggaggggccgttactggactggatacactacagaaattggatcgctttaacgatacactagccgaggaagtagcacaggcgtaa

SEQ ID NO: 5890 - DNA, 258 bp, A.fumigatus
cgtctgaagactctttttgaagccgtctataattacttcccgattaccttcagacctcccccaaatgatccatacgggattacggcgcaagacctgaaggaccgcctacaggactgtatttcctctactagccttttcgctccctacgctgttcctgcccttctggataaaatggattccacttcaccaaacgtcaaggtatgctttttcacaacctatatgagccctttggctaggatcggactaagaagcccctag

SEQ ID NO: 5891 - DNA, 1458 bp, A.fumigatus
cgcaaagagtttttgcttactttattctcgtcgcagatgcgctccggttctcaagctccccttggtcctggttctcagtcgacccatctccgtcgcgaatcctcccagtcaacacacagtgatatgagcagccatatgggaagtggtcctggacgcggcagttaccctcaccagggtggacgtggccgtggatattcgcagtccggttaccaaggacagatgccctactcacctggtcccagcttccggtctcccaaccagccccggggtggtcccaacatgggccctcagttccacgctccgaaccagggacgacctctggcgcccttccccaactcgccacaccagcgcagcccggctctggcgaccgcgcatcctgctacacctcaaatgaatcaggtcccgatggctcatccccagatgcctcctcagccctacgccgcctacggacaacatatggccccgcaaacagtgagacaccatccttccgtttacaaacccccccgtcgtggcccatttccgaagagacgacaaggatcctgtcgtttctcttcatcttcctcctcaagcctccctcttgcacatacctcccctccccctctccatctcccccctccaaatctcgcgccggaaagcggtcagtttgaacattatctgacgctaatgaaaaaccctcaggcttacccctatgacccgaactacgcttattacaatcccgcctatggcatgcaacagatgcagtacatgactcccccttcgccacagccacggcctggcatgccatataacccgcaggcgccctatatgcaaaaccagtacccggttcagcctcctccccagaccgctcccctgtcgcgcacgccgtcccaggtgtcgaacgaccgtccgggctccagcctgggccagggccagcctcctgcaggcgccccggctgccagccacactcacacgaccagcagatcctccaacagccccgcgccgcctaagcctcagtttgtcattcctcccaccaagcggagccccattgtcatcaaggaccccggtagtggtgttgtcaagaccttcgagaaagcaccggcttcccccgcgcgcgcgactccatctcctgtgaagatctcaacccccaccgccacacctccccctcgcaccggcagtggcgctgatcacaaccgaaccgaatccagggccaagacggacgaggagaagaagaaggagttgagggaggcggtacgtcagaagattgaacaggacgaagcagagcaacgtcgcaaggaagaagaggaggctgccgctcagaagaagaaacaagaggaagaagaggaagcggctcgcaagaagaaggaggaagaggagcaggcagctgctcagaagaagaaacaggaggaagaagaggaggctgccaagaagaaggccgccgatgaagaggcatcttcaccacccggctggaaaatcagcgtc

SEQ ID NO: 5892 - DNA, 492 bp, A.fumigatus
cgaagttgccttcgtcacgttctaagtgcaatcttggggctggtctcagatatcgtctttcctcgtctcatcaatagcgagaaggagagacgtccctcaagcccgcgtgacggtcaacctcattacctgaccatcctcttatcacgcccgttcacttctgcgcagacaatcacaatggccgattttttagcccttccttctttccttgtggagaattccgctgccgtcgccctcaaagacgcatacaactcgttctccgagcgaagggcggccctcggcctgtccaacccaggaactgtggataatattgccagggaagtgcagaaggaggtcctgctgtctaactttatgttcagcggtctccgtgcagacttgacaaaggttttcggcatgtctcccctgttccgtgtctcgcacgccttctccatgggcgggtctggcaacctgcctccatatgccttctcggccatgtacggaactcctaaggtataa

SEQ ID NO: 5893 - DNA, 735 bp, A.fumigatus
  unsure (38),(206): Identity of nucleotide sequences at the above locations are unknown.
gaaagagcgcccaggttgccaccttcaaccgcaccccntaccagcgataccgaccatcgccccagtctgacgccaggcaaggcgaagtccacagttaaaagcacctcgccagacatttcgtttcctcagtcgaccattgcagcgcagcgacagtcatcccctgactggactcacatacctcactcttctggaggcgcgcttttttntacacccctccctcaaccgtcattatatcctcagtccactcctgaattttcccgcatgacagatagccaaagacgatcgagcgtcatggcggcaccgatcaacctttccctactagatgacgatactactggcgaaggtgtcaacctggtcgattcagccaggcctggctcctcgtatgccaacgacgtctcacacaagagtcacgatatgggcagctcggcgccgcccaccaaaatgcgcaagctgtcccacagcgtgtcgcaggcaccgtcacgaagcacatcaacgtcgctacccttgctaaacaccgctggtttgcagcaacccttcgcatcgtctcttccgtttccgaatgaaagtgctgatctactgtacgagtatttccctctgggcctggacgattggcaagctcctgtggatgctgtctaccgtccacatgtggtacatcacaccaatatgccagaaatgaaatttgttgctggaagagggagaagcaagcggtattttgctgcagaagatgtcttttaa

SEQ ID NO: 5894 - DNA, 216 bp, A.fumigatus
aatttgttgctggaagagggagaagcaagcggtattttgctgcagaagatgtcttttaagaactcccttgtatgggaattcggcagggtctcattccactattccgcagagattctttgcaaaaatagcatccatgactcctatctcgatcaaccagctatccactatcctgaaagactctgcatcagaccaccccgcccttccccatacccctga

SEQ ID NO: 5895 - DNA, 321 bp, A.fumigatus
tactgcagcataatggccgcaagacagctccgcagacttagcctaccaacccacctcccccttcccatccggcctcacgttcgccatctaggtacagcacagacaaactgccatcgatttgaccatgaaaccgacatcctaatcgtcggcagcggggcggctggcctcaccgccgctctacgctcccacttccacaggctctcctccctagtcatcgagaaagatgcccaaataggtggcacctctgcctactccggaggcggcctctggatccctaataacccgctcgctgtggatgctggtatcatcgacaccccatag

SEQ ID NO: 5896 - DNA, 1191 bp, A.fumigatus
  unsure (748),(1186): Identity of nucleotide sequences at the above locations are unknown.
caagcaatgacgttactgatatctgtcatcgacgccgacaccgccgaagataccgacgtaggccgcgcctcatcccccccgcgcaagcgcgcttttctcaaccacggccctcacatggtctccttcctccgggaccgcggattcgcctttcgcctcagcccaggctgtccagattattatccgcaggcgcacggtgcgctgccgaccggcgggcgctccatcgagccggacgtgttcgacgcgcggctactcgggctcggcgagaaatggacggaggctatccggcagcggcctggtcggtcgctccctctatttacgtacgaagctagcagcgtgacacgcatgggagcatcgtggcgtgatgtcgggaccgtgttgcgcgtgctcctccggggcatatatctttcccgtgtacggggacagattcctgtcacaatgggcaagtcgctggttgcgcagctgttgtggttgcatatgcagcttgaccaaagtccggtactcacggatacggcgctgcgccagcttatcgctacccctgaaggggtgattctgggcgcgcgcgttgcgacgccagatggggaaaggagcattcgcgctcgttgcggggtgctgctctgcgctggggggttcgcgcataaccaggggctccgtgagcggtatggcccggtgcctgcaaacgccgagtggaccagtgctgcgcggggcgacaacggggatgccattgtcgcgggtgttcgggtcggggcancgacagccctgatggacgaggcatggtggggaccgactctgcgcgaccccgtccggggaatgtattactttgcgcttcaggagcgagcgcggccgtttggcgttattgttgactcatctggcaagagatttatgaacgaggctgagccgtacacggatgccggccaccaccagtatgcgcaaaaggctgtcccggcgtggttcgtctttgactggaaccatcgtaagcggtacgcggtgggctcgctgatgccacggcagcagcccccggcgcaggcgctggacgcagggtatatccaccgagccgatacgatcgcggagttggcgcggcaaatcggggtcaatgaaaaagggttggagggtaccctggcgaagttcaacgagatggccgactgcggtgttgataacgaatttgcacgcggagagagtgcctttgacnattaa

SEQ ID NO: 5897 - DNA, 552 bp, A.fumigatus
gcgcgaggaaaagctaccagggcaaccacaagggtcgccgccatgacttgcaagaagcgtcttcgatccagtcgcgacagtgacgaccaccgggatcccaaagtatctattcctgacgccattcgacagcgcctgaagaagaaatcaaagcctacggccaagtcttttcatcattcactgggcggttcaaaccccgttccatgtgattattcccgtgctgtccatgaggtccgcgggagagccatcctcacagttgaatccagtggacagaagccagcatattatttcacgtttgtgcctgacgttcaaccgctgctaagtcagaaacccgcggccgagatttcggggaaacaagggccatatacctcggacgaaaacgcattgttggtgcgactgaaagaaagagagggaatgccgtgggcggagattgctgcgcacttccctaaaagaagcacatcctccctccaagtccactactcaaccaagttacgcaaaaaggcaactactcgggctgaaagctacaaagacgttgatgagaggcaccaaacttga

SEQ ID NO: 5898 - DNA, 825 bp, A.fumigatus
ctggatagactgactgactcctctgcagaacccccctaccctcagtacggggctcctcaaggcttttcacaaccgccttacccccaaccatcgggttacggtggttttccccttcctcagggccactataatcgaccacccccgcctgccccgtcgccaggcggatatcctccggctcccggaccaggatatccccattcgccgccgcctcagcctccatatggcgctccttcgcaacatccgtaccctccacaaggcggtcctggataccctccacctgcgggcgggtatccccaacccggaccctatggcgccccaccggtaggagggagcggctatcccacaccaccaccgcaacagttccaaggcccacccgccatgccttctctgggttatgttcctggccaaatggcaccgggcgacttccgccgtgaagcagacctcctccgcaaagcgatgaaagggttcggtactgacgagaagatgctcatccaagtactgtctaaactcgaccccctgcaaatggccgccgttcggtccacctacaccaaccatcaccaccgggacctctacaaggacgtcaagtccgaaacaagcagctacttccgccagggcctgctcgccatcatcgacggaccgctccttcacgacgtgcagtccctccgcgaagcagtccaaggcctcggcacaaaggaatggctcttgaacgatgtcgtcctgggccgctcaaacgccgatctcaacgccatcaaggccgcctacgagcacacatgccagtcttcaccggggtctgagtcgccctcaggtaaaaccacccgggcaccg

SEQ ID NO: 5899 - DNA, 255 bp, A.fumigatus
ttgccggcgcatcattcacaaacctccctcgtggtattcctcatggactctgatttctacctactgtacgcgcaaacgaacatctcccaagattttgtcaaacgacaatacaaggcggactctgagatcgctccggtgtggccctggtcgacggctggggcctggaaagaacgaactgttctccccgcatctcatgtattaggggattggggagttgaccatcgcaaacagatgacttcgtgttcatctgaatag

SEQ ID NO: 5900 - DNA, 837 bp, A.fumigatus
tcgaatagacaccccgtcggatccttccagccccgtggtgaagacaaagaaagcaaattagatacgaaaaagaagacggccggttacaatctactcttgaactccctcgcagacctccactcatgcaacgtcattttcttcctcgaagcacgtaagcgcggtcaagatttgtatctgtggctggctcgtcctcccaatggacctacgatcaagtttcacgtcacaaacctgcacacgatgggcgaattgaacactggatttagtggtaactgtttgaagggtggccgtggcattgtcgttttcgatcggtcgtttgacgagcagggtccggtgatgagcagcccaggaaacgagtaccgcggattgatcagggaaatgctgcgtggagttttttgtgtgcccaagcgtggtgtcaagggcatgaagccttttattgaccgtgtcatcggtgtcttcggtgtggatggcaagatttggattcgcgtctatgagattagagagtccgaaggtggagccaaaaaggacgaggagaacagcaagcccgcgcccaagggcaagaatgctgaacctgagatctccctcgttgagattggacctcgtttcgtccttacgccaattgtcatccttgaaggcagtttcggtggccctgtcatctacgagaacaaggagtatgtgagccccaaccaggtccgtagtgagatccgtttgagcaaggctgcgcggtacgcgaaacgtcgggatgttcaaaccaatttgatttcgaagcgctctacgttgggtttggcagaaggcgagaggaagccaggtcctctcgacaataagagcctcttttcttaa

SEQ ID NO: 5901 - DNA, 237 bp, A.fumigatus
ttacttataaaccggggttggacatcctggagggacactccgactccaactttctccgtccaccatggcggcacatttgccatccagctgttcgcagctgtgggatactcgttttgcatcacctacgatattcttcagtatgcttgctctatatcagatcgcttcctcttctgtcagccccaacggcggggtttgcacctaactagatacccttatttgcgacggcggcggcgttga

SEQ ID NO: 5902 - DNA, 1518 bp, A.fumigatus
  unsure (342): Identity of nucleotide sequences at the above locations are unknown.
atcatggcatctattttcacctatgaccctgaccctccaagggtctcttctccttggtcgacgtcggggtcgtctactccccagcttacggcgagtgggaatcgtggactgacgatccggacgcgttctggcacggaactggaccgtgcggatccagactttctgtctgactatgggatcacgaaactggagccggaaccacaagagggacccactgagtacaagctgcatctacttctgcggccccggcgtctctacaattccatgaccactggtcatgtggttggcggttcgtaccattctcgtgcaagtttgtccacctcaggaccgacaccgtccagntacgagtcaaacttgagatcggctcaggtgcgctcaacgcagagtcgccagcaacgtctgcagcagctaacaactcaattgttgtggcgcctgcaacaatcgtcaccgtttcattcgtctacaactgccaaccttgtgttgcctgttcttccggaagcaacacctcatcttggcaccccgcagaaaccagctcgtttaattcctggtttggaggagagtcagggtgctttgtacgagattggtgtggccgatgatgggaccttggttggtctaacgcaagatgagctcgacgagagcttgaccaatctgcaaatcatggcggccagtttgggttgtaaggtcgaaattcttcgcagagtcattgtcggcaaatgtgaatgggctgaatgtccggaagacacaagtgctgaagcagccgataccggccgagttcacacagaaagcctctgggtcgctgaagccctggtcagtccggatttggagttctacggcttgatatcgcatcgcgacgaatttggtaggcagtctccctcgcacggtaccaaaacaaagtctatgcgcgaggacaactattccacgaccgaacagattcggatctcaataactggcccgagtgcagccggaaagtcgtctctgttgggtactctgacttcatctatacttgacaatgggcgaggggcaagtcgactgagccttctcaaacatcgccacgaaatctcgtcgggaatcacgagctctgtcgcccaggaactcataggctatgcgactggagagtcaatgcaagatccggttgaggtgatcaactatgcgtctggaaacgttgcagcttgggacgacattcatgccacggcgaaggatagtcgtctggcatttgtgtctgaccttcctggctctgtacgctatctcaagtctaccttgagaggattaatcagctgggcacctcactatgtgtttctctgtatcccggccaattgtgacgaagaaatggtcccggagcgacctgtctgtggcacttcagaacagatgacagaaatcaatctggctctgtcacacttggatctctgtatcaaatcggggatacccacagtgatcgtgatcaccaagatggatgttgcatcccgagcaggcttgcggcgccatctcgtcttcaccaaggagcagccaggatccgcataa

SEQ ID NO: 5903 - DNA, 189 bp, A.fumigatus
gcagtcgatgattgctggtctgtcaaaagcggacgagacgcgagcacgcagcgaatcatcccggaccctgacaagttccctgatggtatctcgggcgtagcggaccagatacatgatctggggctgaaaattggaatctatagcagtgagtcactgccgatggatagatacagacgaccaaggcgctga

SEQ ID NO: 5904 - DNA, 414 bp, A.fumigatus
cagctcgactccattagccaggaccacctcgctatcctctctaacaagattctcctaaagttccaccaggacccggtgatcggccgtcctgcgcagccatacaaatgggggtacaatcctgactggacgtttgaccccgctcatcccgcagagtactggtccggcgcatcgtcagtgctgggtggcacgctggtgctgatgctgaattcggaagatacgacgcagaggcgaacggctgtgtggaaggaggtccctgagctgaaagatgtgctcggtagacagggaaaacggcgcattggatttcgtgtgacggatgtgtggaccgggaaggatctgggttgcgtgagagatcattacagtgtggaattagagagtcatgatgtggccgcgttagttgttgggagagcgtgctag

SEQ ID NO: 5905 - DNA, 339 bp, A.fumigatus
gtgtcaggggaagcattcagtcgagatgacgacgtttttctctctgaccactgcagctgcagtgttaaccctcgcccgagggagcaatgcgctcatcagacccggcaatgtggtaagctgctcgtctcttccaacatctgtatgagcaggtctaaaactcgacagggaaaactacccgctctaggctggaacacgtggaatgcgttcggctgcgacattgatgcgaccaagatcatgactgccgcgaacgaggtcgtcaatctgggtctgaaggatctaggatatgagtatatcaatagtgagctgcctcatccagcttctaggatgtacgtttgttga

SEQ ID NO: 5906 - DNA, 351 bp, A.fumigatus
tctcggcaagcgactcggctaactaaccctcaatcagacctgaagtacgacaacctgcggcgtcccctccaactggacagacacgtacacatattggtccccgacccgggcagtaaagccacaaacgggacctgtcccgataacaagaatcccgcgccggcgggttatgactggcgcacgtcgttgacagcggagcggtacaggcggatgcgcgatgcgttggtcagcgtcgaccgcacaatcctgtactcgctatgtgaatggggccaagcgaatgtgaacgactggggcaacgagacaggcaattcctggcgaacgactggggatatcacgcgtaagatccaaccttga

SEQ ID NO: 5907 - DNA, 216 bp, A.fumigatus
ccgataccaccagcatcctggcctcgtatcgccgccatcgccaatgaaaactccttcctgatgaaccatgttgatttctggggttatccggacccggacatgctggaggtcggcaacggcaatctcacactagcagagaaccgagcgcactttgcgctctgggcggcgatgaagtcgcccttgatcattgggactgctgtacgtttgtctctgtaa

SEQ ID NO: 5908 - DNA, 411 bp, A.fumigatus
ccataccactcgaatcctatacctcagtcagcatcacgtcacgtcacttcgacttccgatgagagacccacctggcaaagaaagacaacagcatccgcaacctcctcgggaagcacaaacctgccggagggaatagtcttcaaaaaggcctcccgcaccgagtcctccccccaagccttcttcccgagagccgtccacaccacggtgggtgacacggagttggctgtgataccttgtccgccccattccgacgccatactgcgagtcaatcctcacaaggcagccttggaagcgcagtatgccccatgtcgcggtagcgccacatgcgcagcttgcgatgcaatgttgacaattcggccgggcggggatgggttcgcggatgcttctgcggtcttagaggcggcaaagtaa

SEQ ID NO: 5909 - DNA, 366 bp, A.fumigatus
  unsure (66): Identity of nucleotide sequences at the above locations are unknown.
tactggcgccatcatcagtcgagtatgccttttcatgctctaggccgggaaatgatcagagcttcntcgtcaccccagagcgacgtgttctttccaagcatcctcatcaacactgccggatatgtctcgctgagtgacatggagatgactccgccggaggagaccatgcaacatttgaccaccaatatctttgggccaatgctgtgctcgcaagcctttgcgcgactttactttgccgcctctaagaccgcagaagcatccgcgaacccatccccgcccggccgaattgtcaacattgcatcgcaagctgcgcatgtggcgctaccgcgacatggggcatactgcgcttccaaggctgccttgtga

SEQ ID NO: 5910 - DNA, 234 bp, A.fumigatus
ggattgactcgcagtatggcgtcggaatggggcggacaaggtatcacagccaactccgtgtcacccaccgtggtgtggacggctctcgggaagaaggcttggggggaggactcggtgcgggaggcctttttgaagactattccctccggcaggtttgtgcttcccgaggaggttgcggatgctgttgtctttctttgccaggtgggtctctcatcggaagtcgaagtgacgtga

SEQ ID NO: 5911 - DNA, 510 bp, A.fumigatus
  unsure (204): Identity of nucleotide sequences at the above locations are unknown.
caaatcgctgccaaagattacatagagcgggttgcagttgcaatgacaacgatgctcatcagatccgatactcttgactatccagaggtccagcatctgctccagcaccacttcactgagcttcgaagccaaggtcgcccggagacatcgtttgcgctggacctaaccgctttcctggacccgtcaataacttggtataccgcntgggagggcgatagtctattagcctgtggcgcgttgaagcagctcagtccgattcatggagagatcaaatcgatgcggaccgcaccgggacacttgcggaaaggcgttgccaagactattttgaagcatatcgttgccgaggcgagggagaggaagtaccagtcactgagtctggagacggggacggacgggaggtttgaaagcgctcggcggttgtatttgggaatggggtttgaggtgtgtggcccgtttggagactataagagtagtgatgacaatatgtttctgacattgagactatgttga

SEQ ID NO: 5912 - DNA, 303 bp, A.fumigatus
gctacccagctctggcctccagtagtgaaagcaacacccgcgccattttcgtcctggcagcgcacaaacccccctacaacgtctatggcgcgcccttctacaactacgcgggctatggcaacgtcttctccgtcgacccctccgacggccgtctggtcaagaatgtccagaactacgaataccaggagaacacaggcatccacggcatggtctttgaccccacagaaacctacctctactcggccgatctgcaggccaacaagatctggacccatcgcaaggacgctcagaccggcgagctga

SEQ ID NO: 5913 - DNA, 360 bp, A.fumigatus
gatccaatcgatcttatctctgtcaacatgaagcatcacttggtgatcggcacgtggactcccccaggtcggctgtacaccgtcgcgttcgacgacgaggccttgactttggagttggttaagaagaccgagattccagaggatgagcccatctcatggttaactatctctgtaggtatccaacctcttccagcgacattcgctaatgttgtccagcatgacaagaaaaccctctacggagctgccatgaaaaagtggaacagcttcgccatcaacagcccaacagacatcgtccaccaggtcgcccatcctcttgctggtcaccgtatgctcgtatccatctctgcgcggtctggctga

SEQ ID NO: 5914 - DNA, 645 bp, A.fumigatus
aaaagtggaacagcttcgccatcaacagcccaacagacatcgtccaccaggtcgcccatcctcttgctggtcaccgtatgctcgtatccatctctgcgcggtctggctgatgctgatttgagctacccagctctggcctccagtagtgaaagcaacacccgcgccattttcgtcctggcagcgcacaaacccccctacaacgtctatggcgcgcccttctacaactacgcgggctatggcaacgtcttctccgtcgacccctccgacggccgtctggtcaagaatgtccagaactacgaataccaggagaacacaggcatccacggcatggtctttgaccccacagaaacctacctctactcggccgatctgcaggccaacaagatctggacccatcgcaaggacgctcagaccggcgagctgaccctcgtcgactgtcttgaggccccatcgccagacgaccacccccgttgggtcgatatccaccgcagcggcaagtatctatacgcgctgatggaagcggggaaccggctggcggtgtatgtgattgacgagaagcgccatgtccctgtattcacgcacatcacctacccattgctccctgcaggtaagcttttttaccatcggcgctccgtccaggactga

SEQ ID NO: 5915 - DNA, 498 bp, A.fumigatus
cggcagtgcagatctgggaagaaacaatacccgcggctaaaatcaattccaccgcatacatccctacgtatggactcggatatatttgtacttcatctcaataacacattcaagcattcaactcgatacacattccaacatattcgaaaaaaaatcacactgcaccatgcgcctcccctacgctccctccaccccaccccgcgacgccgacccctccaccaccgaaatctacgcccgcatcgccgcccgcagacacccccgcccactcattcccctagatctctccctgctacactccccccccgtcgccgacggctggaacagtttcctgggcgccatccgcacgcgcacaatcctccccggtgcgctcctcgagctctccgtctgccgcgtggcggtcctcaacggcgccgtgtacgagtggaacgcgcacgcgccgctcgcgctgaaggacggggtgacggccgacaaactgcgggcggtgcgcgatgtcaatgc

SEQ ID NO: 5916 - DNA, 456 bp, A.fumigatus
aatcaattccaccgcatacatccctacgtatggactcggatatatttgtacttcatctcaataacacattcaagcattcaactcgatacacattccaacatattcgaaaaaaaatcacactgcaccatgcgcctcccctacgctccctccaccccaccccgcgacgccgacccctccaccaccgaaatctacgcccgcatcgccgcccgcagacacccccgcccactcattcccctagatctctccctgctacactccccccccgtcgccgacggctggaacagtttcctgggcgccatccgcacgcgcacaatcctccccggtgcgctcctcgagctctccgtctgccgcgtggcggtcctcaacggcgccgtgtacgagtggaacgcgcacgcgccgctcgcgctgaaggacggggtgacggccgacaaactgcgggcggtgcgcgatgtcaat

SEQ ID NO: 5917 - DNA, 1695 bp, A.fumigatus
  unsure (1532): Identity of nucleotide sequences at the above locations are unknown.
aattctcagcggagagcctccagccaatccgcgtccgccttttccgcaacacttcttttcctccaccattttttgtggtacctctccatcccagtgtacaatcttacagctcttgacggattacctcggtttctgttcacgagttctgacttaatgttcgctgtgagatcagttttctcactgtcttttaagagctgcctttttactacgcatcctcgtcgtcttgcgcattcccagaaagctttcttcgctcatatcttgccgcatcgcaatgcgccatcgcccataaaagccatgcagagtcctagcagaaaacctcagacagacgcgaagcggcgcaagaagggcagagccgatcgcacgaagaattcgggatttgatgaagtccttcagaccgacattgataaccttcttcggaggcataagcctgaggcagaaaacgatgcttccactccatcacctgcattacccgagctcttcacggagatcgaagtgacagtgtcagatatatcttccactggagatggcctcgcactctcggaaaacaaggatcatgtctacgtcgtccccttcactgtcccaggcgacaaggtgcttgtcaaggttgtccggcatcatgagccgttatcccacagtgtgacagactttatcaaggtgcttgagccagggccgcagcgcaacgatgccgcgatcgggtgcgggtactttggcaagtgctccggatgtcagctgcagatgatgtcttacgaagaccaactggcgcacaagaagcgtattgttgaaaaagcttatgccaacttctcggggctcattccagagctgattcctgccgttgaggacaccttcccttcgcctttgcaatacggataccggaccaagttgacaccacactttacagctcccgggggccacagcgcagccaaaagaaggaagtccggtgaggttccaaccgaagtccccccaatcggattcacatataagaaccggcgcatggatatggacattgaggattgtccgctggggacagacattgttcggcgaggcctcaggagcgagaggaagagggtagccgagaacctccacaaatatactaagaagggtgcaacgcttctgatgcgcgagtctaccaggcgcatcccgaaggactcagccgaggcagaggccggcgccgtacagaaagagggcgataacccaccagaatcagagtccggcgatgtcattcgcatagagcgcgataactacatcgaagagaagcgatgcgtgaccgacaacaatgctacctcggtcgaatacatcgacgactacatcttcaccaacaaagctggcgctttcttccagaacaacaactccatcctctctagtttcacagagtacatccgtcaacacgcgttccccaaaggcaacgaacaagatcccaagccgatcaagtaccttctcgacgcctactccggctccggtctctttaccatcaccctatctcctctcttcaaatcaagcctcggtgtggatgtagcggccgactcgatcgcgtncgcccgcgagaacgcccgggccaacaacctccccaataccggttttgcccgcccagacgccgcaaccctcttcaagaacgtcccatatccgcccgacaaactctattcgtcatggacccaacccgttaaggatgccccgatgatttcttccggtaattgctga

SEQ ID NO: 5918 - DNA, 228 bp, A.fumigatus
gattgtacactgggatggagaggtaccacaaaaaatggtggaggaaaagaagtgttgcggaaaaggcggacgcggattggctggaggctctccgctgagaatttcaccatcccgtcgattgttcccattctgccatctctcacttactccatcacgcggcccatctatagcggcaattccgcgacatcccctcgttccttgctggggagctgcattccctcacaatga

SEQ ID NO: 5919 - DNA, 213 bp, A.fumigatus
ctgcgctctatttcactgcatttgctgattgtgtttagagctgaggataagtccgtacgctatgttgcggaagagaatgtcgaaattatcacccccgacctgtttgagctaccgcaaacgcttgtggaaacagcaggaaagcacttcaagcggtgggatggctgttctcatacatttgtcagcaatattcgagatgaatatcctgatgactga

SEQ ID NO: 5920 - DNA, 210 bp, A.fumigatus
tgctttgtagctaggcttccttcgttccttctcttcgctcttttatatcattttatcctgtcctttttattttttttttcttctaattttttttatctttttaactttatatctctatttttccaaatctccagtccaagaaactctgaccgttctacattcattaccattattgatctacaggtccaaaacgtcgtcgaaagattatag

SEQ ID NO: 5921 - DNA, 417 bp, A.fumigatus
gcatccaagatgcggcgcggtgtcttaatctttctcatcgtcaacctgctcatcatatcgtttcttgtgcgcagtgtcttcaccctactatccttgctggtagaagatgcctcggccgatgcaattcgtcatgcggagcttccctcgccaaattcgagcttaattgaacaacgaccgcagattatacccaagatcattcaccagacatacaagaacgagacaatcccagaagtgtggcgggaggctcaacaaagctgcaaagacctgcaccctgactatgaatacatcgtatgtgcttcatttcccgtcaactgttgccttgttatactaacgtctccacccgcattagctatggaccaacgaaaagtcccgcgaatttatcaagaacgaatatccgtggttcctcgacacatttga

SEQ ID NO: 5922 - DNA, 213 bp, A.fumigatus
ctatggaccaacgaaaagtcccgcgaatttatcaagaacgaatatccgtggttcctcgacacatttgacggctacaagtacccgatccaacgggcagatactatccgatactttgttcttggcttacttgggccggacatatatcgaactttgatgaggaatgtggttccaagcatgcttaccaaaatggatttgggaaatttggttccttga

SEQ ID NO: 5923 - DNA, 696 bp, A.fumigatus
gacgatatggccgtgctcacgcaactaacaaacaacgtgcgcctctacggtacggactgcaaccagacggaaatggtccttcacgcgatcgacaagctcgagataaaggatatgaaaatctggctaggcgtgtggatcgacagtaacgaaacgacgtcccgacggcaaatagaccaattgtacaagattatcgacgacgccaaggatatttccatctttaatggggccattgttggtaatgaagccctctatcgagcaggcagtgacaagacctccgcgcaaacaaccctcatcaactacatgcaggaagtgaaggaccactttaaaaagaagaacattgatctgccggtcgcaacatcagatttaggtgacaactgggacgcaaccttggttcaagcggcagacgttgtcatggcgaacgtgcacccattcttcggaggcattccggttgatcaagctgcggcttggacgtggcgattctggcaggatcacaatgtcgccttgaccaagggcaccaacaagaagcagattatatctgaagtcggctggcccagcggcggaggaaatgattgcgggcagggtgctaactgcccgaacgacacagcgggtgcagtggctggcgtcgacgagctgaacaagttcatggaggactgggtctgtcaagccctagataatggcacggattatttctggtaa

SEQ ID NO: 5924 - DNA, 234 bp, A.fumigatus
ataatggcacggattatttctggtaaagaccctaaaaccaccctcagcagtcaacaagcttcgagcacagcggctaacgagttcgataggttcgaggcattcgacgagccatggaaaatcgtgtacaatactgggaaggagaattgggaagacaaatggggtctcatggactcggctcgtaacctcaagcctggcctcaagatacctgactgtggcggcaaaacggccacttga

SEQ ID NO: 5925 - DNA, 882 bp, A.fumigatus
ggcatcgtgaatgggtaccttgacacggaaaagaacttgaaaggatccgtgctgccgactcttgagcgtctccacaaggagatcaagaacaagtccaaggaactgcagagcggcgcaagtaagagcgccaaggccgttgaaaaagcacgaggcgtgacgcagaaacatatcgagcttctggctcaacaggttgcggcgtttgactcaactgcgggcaacaaattcgatcacgcccacgacccatacatcttgcgccgcggagtcaatcaccgcctgaacaagcaagtcattgaggagaacaacaaccgtcaggacatcattgccgtgcagaacaactttcagcagttcgaggcgcatgttctgcaaaccatccaggccgccatggagcagttcaacgtcttcataggcggccaactcgaccggcagcggggcatgtacagcgacatgttggccgctgctcagcgcattcctccagactatgaatgggttaatttcattacacgcaacgccaacgttttggtggaccccgactcaccgccgcgatcgctgtccaacatctccttcccgaaccaggatcaccgcgccaccgtcccgctcatcgagggcagtctggagcgcaagtcccgggccatgctgaaaggatacagtacaagctactacgtggtcacgcccgcgcgatacctgcatgagttcaaggacaatgacgacttccgccaggatccgtctcccgagctgtccctttacctacccgactgtgtggttggcggcgtcgacggcaacaagttcaccatcaaaggcaaggatgtttcccggcggcaaggtcggcaacgccttccacactaccagcgagtcttcaccacggggctggaaggacacgcgctc

SEQ ID NO: 5926 - DNA, 288 bp, A.fumigatus
cccgtggtgaagacactatgctgtactgagcagactacgggccttctccttgagcgtctccgtgcttggaaacacatgtgcggctatttggaggattatgtggaagtcacagccaaagtgcagaagtcgcaagcgaaggactatgagaaagttttgaaggtatggaggctcttttgtctgagatggtttcgaaagggtgctgatactgccagggtagactgtcagcgatccccttcgggaggggcaccatttctctcagagtgcaggtggagtttcggcatggtttga

SEQ ID NO: 5927 - DNA, 471 bp, A.fumigatus
ctcctaccacgtttccccaatctcgtcaagactcgtccagaaatggctgccacctacggctctggctcccaaagggtgcgccggctttccagcattgatgcgactcgggcggacctgtatggcgggcctaacgtcgtcgtgcccccgaagcatctgatggcctccagcgatgctcatgatacggccattgagatggcgatggccaagcagcacctcgatgaagaagtctcctcggaagaagagtctcctcgtgccgcctcacccctcaccaggtctccccatcatctcacgacggctgatgaattcgctctggcatttgacatcgatggtgtccttatcagaggaggtcaagctatccccgaggctgtcgatgccttgaagtatatcaacgggcagaacccgtttggagtcaagatgtacgtttctctccccgagaagctttcaacgcaacataggttactaactccataa

SEQ ID NO: 5928 - DNA, 690 bp, A.fumigatus
tctagcccttacatcttcgtaacgaatggtggaggcaagaccgaagaggaacggtgtctggacctcagccggcagcttgaattggaggtctcgcccggccaattcatctgcggacacactcccatgcgggagatggctgagaaataccacactgtcctcgtcgtcggcggcgagggtgagaagtgccggatcgtagccgaaggttacggcttcaaggacgtcatcactccaggcgacatcatcaagacacgacaggacacgacaccattccggaaactgactgaagaagagtacaacaactcacgcgtccgcgacttcagcaagacgcccatcgaagctatcttcgtcttcgccgacagccgggactgggccggagatcagcagatcatcctcgacgtcctcatgtcgaagaacgggtacctaggcacacgctcggagacattcgacgagggtccgcccatcttcttctcccacaacgacgtcgtctggtccacctcccatgagcacgtccgcatcggcatgggtgctctcagaacctcgctcgaggctctctacaacgccgtcaccgggaatgaactgactaccgtcgcattcggcaagccccagctcggcacgtacgagttcgccacgcgcctcctccgccaatggcgcaaggaataccacggcatcgacgagccaccgtcgaccgtc

SEQ ID NO: 5929 - DNA, 345 bp, A.fumigatus
  unsure (301): Identity of nucleotide sequences at the above locations are unknown.
ccttatagtctttctatttttgcttcaccttatcttgattctcaactcttttttttgattggttcctcgtgttctaacaggttaatccagatctatgccacctcggaggaacgtaagcaacgtaacagacaagctcaggctgctttccgagaacgtcgcacagagtacatccgtcaacttgaaaccacaatcaagcgcaatgaagaaacactgcagactctgcagcagaatcatcgtacagctgccgatgagtgcttgatgcttcgatataagaattctttattggagaggatcttattanaaaaaggtacggcgactatatttgtctcctccggtctttactaa

SEQ ID NO: 5930 - DNA, 399 bp, A.fumigatus
tcgtcgttgaccacccttcgaccttccagccccgtggtgaagacgatacgcaggctcgccataccgctggacatgaccaagcgcgccgaattgctgtacaacagtgagccattcgaacttgctcacaagtgggtcgagcagaccggcgacagctatgcagatccgacgcgggagcgtaatggtgggcattttgtgagttttgtcaagagcggtgggaagctctgggagcttgaagggtcgaggaagggtcctctggagagaggaattcttgctgacgacgaggacgttctcagtccgcgagcgcttgacatgggcttgaagaggatcctcaagttgaacgcggatggaggagagaagaaccttctttttagctgcattgctttggctcgcaggccttag

SEQ ID NO: 5931 - DNA, 1155 bp, A.fumigatus
ttggtggtaaacgatctgatcctcagcgaagaacaagtgataagtagatacactgcatccccaatttctcgggttctttccccgaagctgagaccccaatcggttcccgcaatatctatctgcctcttgatcttgttgctcatacatacttcgtctatctatctaattcttcctgggcactctctgggctcgtcactactgaaaaattcaacacaatggtatctgaccgtacacttgcgttcattggttgcggtagctatagaaggggccccttcactgagcgtccgtggaactaatcatttgaaaggaaatatgggctcagctatgctgagcggcctccttgatgcgacacgtcggacgacagattcgaatggtagtccatcggcaaagatctcacgttttattgtgagcacgaagagcgctgcatctgcccaccgacttggggaagaattccaagcggataaagatcgtgttgacattagacattcggataatcttctcgccatgcaagaggcggacattgtcctgcttgcctgcaaaccttatctggccgaggaagttttgggcgagttaggcgtgcgggaggccctagcagggaaattggtgatcagcatcatggcgggaaaatcgcctgaagatatcgagaagtatatctatcgcgatacacccgcagacgatgccgaatcgaaagcaatcattgtgagagcaatgcccaatgttgcagctcgtctgcgtcaatcgatgaccatcatcgagatcaacaacaatctctcgcatgacatcgccgacaccttgacctggattttcgaacagattggaaaagtgaaattcctggcggcagatctgttcgatattggcacaatgcttgtgggttcctccattgccgttcttactgttccgttagatggcattctggatggctgcgttgcggagggacttcgaagagcggatgcgctggaaatggcagcgcagaacttgatcggaatggcaggtttgttgcgagaaggtgtgcatccagctatactaagagagagtatctcatccccacgcggttgtacaatccagggtctgttggcggtggagaaggagggcatgagaggagcgtgcgcacaagcaatgatcaacggagctagacatctaaaggaaattcattga

SEQ ID NO: 5932 - DNA, 249 bp, A.fumigatus
atacactgcatccccaatttctcgggttctttccccgaagctgagaccccaatcggttcccgcaatatctatctgcctcttgatcttgttgctcatacatacttcgtctatctatctaattcttcctgggcactctctgggctcgtcactactgaaaaattcaacacaatggtatctgaccgtacacttgcgttcattggttgcggtagctatagaaggggccccttcactgagcgtccgtggaactaa

SEQ ID NO: 5933 - DNA, 1071 bp, A.fumigatus
cgcctgaggcacaaactatcagaagaacgcgtatcgatttgttgcctccgcatcggccaagatatagataacaagagctccccctccgaactccgccagcttctccctcatcttccttgcactgtccacaatcaagaacaatacttactcccgattatctattatcactataaaaagaagtcgagtgacacaggaggaagccacatacgcacccccacagtcaagtcaatcgggtcacctatctcaacccctcactccccgcgagtgactgaaaccacccaaaaatgtccacttacgaaggtacataccactttccgcacggaaatccgcacaaatccacacaggaaacatgctaaaagacacgtttttttttcaacagttgaacacaacacaacagacccctccatcccccaacagcccacccgccgccgccgccccgacctctcaaccttcttttcgaccctctcccaaatcagccccgatgagcaccgctccagaccgcatgccgtcccggtcccgcgcgacgtaagcgccgcgttctatactctcgccgaggcgttggaggttatgcgccgggagtcggagggcgggggtgcgagtgcaggttctcgcgaaggcggcaatggcgacggggatggcgacgatctcttgtcgcagatgattcagacgttgttgcgggaggcggatacgccgcctaaggaggtggagggtgtgagtgaggagttttgcgacagtaggtctttgagatgtgtcatgagggcgagcttggagcgcgaactgactagcggtgtagtgctcgaccgggtaccacgtacgtcgttgaaggagacgcagacttgcccgatctgcaataacccattcctggaggatgagtatccgctcgttgtgcggctaccgtgtcattctacgcatttgtttgatttggagtgcattaggccctggttgcggctgcgagggacgtgtccgcttgatcggacggattttgccaaacaagagcgcgagaaggcagaggcgcgtaggaagaaacctgtcgaggatgacgaggaggagtgggatggtatgtatggctag

SEQ ID NO: 5934 - DNA, 351 bp, A.fumigatus
attggaggaagaattctaaagaagctggtggcgctcgttctgtcgtctggggttggaaagtgtcccgaggtccagtatcagattcgccgacacggcggtgtcgagactatcttgtctggtaccaattttgatgctcacaccccttacatcaaggaacacgctgttatgtgtcttaagttcctgctcgaagggaatcgggagaaccagaagctggtcgaagcactcgaagctcgggaggtcgtcagggatgagaatgggctgttggagagaagtggctttgaggccgtgattgataagacgggcaagttggccattcgactcaaggagggccagccttcagagaagaagtag

SEQ ID NO: 5935 - DNA, 222 bp, A.fumigatus
aggagtaattttttgttctcagctgacaatatgtcttactcatccatggcagtccgttacttcacagctccaaagccactgggaggcgtcatggaagccccccggtctcaaccaagcgtcgatgctagggttaatgcctccaacccaacatcagtgaacggcggatcagccccggctcagtcccgcgtcttcaccacggggctggaaggaccagcgctcaag

SEQ ID NO: 5936 - DNA, 246 bp, A.fumigatus
tggttccaagagggttatctatcaagactatttggttccgtggactggcgttgctctacttcctacgtcatccccatgaagcgagtcaacgactctcccgcagccactacgtcattgtatctcttcaccaacatcatccgatttctgcttcacctcaataggctcaaccagttgacgagagaatcaaatgcagagacagtttatttcagaccaatcgagaaggtcgatcgtccagtgcatgactaa

SEQ ID NO: 5937 - DNA, 300 bp, A.fumigatus
caggtaccgtcccaggatctcccccctcccccctacgacaacaaacctccctctaacatgaaatccagcgcgccaaaatatactccgtactcagatactcctcatacgagcattaccatcccgcccacatttcagcgtttcgagctggatccccgcgatacgatctacccttcctctccgtcgccggcactagcgaagagagtcaggcgctgctgttgtggcattcttattggatttgtggtggcgacggtacttttctacgtgtggctttatttggcgtttcaaaactggcggttttaa

SEQ ID NO: 5938 - DNA, 333 bp, A.fumigatus
agacccggcggtatcgccgtcgccgttggcatattcaatgtcccttcgttcacgctggccagagctattggtggcataatcgcctggtggtggtcgcggaagcacacaaacaccaccacctcgaatatcccgggtgagaccgtagcagatttaccacccggagcatcgagagtccccgcggccgtggccgggaaaacagccgagcaggccgctcgagaagcggacgcggcatcttcgtcggtggtggttctagcctcggggttgattctaggagagggaatcatcagtattgtcaatttgcttctggctagtgggaatgttccacatctctag

SEQ ID NO: 5939 - DNA, 825 bp, A.fumigatus
ggacgtacgtccttccacgccgcggtgaagacgttcggacccggcggtgctacaggccctcctcctcccgggccaagcaatgttcatcgcgtgcaaatggatttccagccttcaatggaggatgagttggagctgcgcgctggtcagctcgtccggcttctgcacgagtatgacgatggttgggcgctctgcgtcagactcgatcgctcacagcaaggagtcgttccccggtcttgtctttcagcccgtccagtgaagcctcgagcccgtccgcctccaggagccggcccaggccctgggccccgcgggccgccccgaccgccgatgatgggccccaacggcccatgggcccctcctcctggacctccaggacctgcaggacctgtaggacctatggggccaccacctccgggcttctatcctcatgatccccgcccacggtcaccctcggcgccgcgcccaatgtccccggctcaacaccctcatggtggacccccgcccccacgcccgtatccccagcacccaatgtctcctgcacaatttcctcctactccgcgatcgttctcgccaggtcccggtggccggccaatgccgcccaggtccatgagtcctggaccttacggacctccaggattgcagagaccggagatgccagcgagccagcggaaacgtagcaacagtgcagggcgggttagtgggacttattcctcgttcaccaggatcaccaggaccaagccttctagccggcccaatgatgccacctccgtccagtgccctcccagcaattcccaccccgccaccgcagcaagcactggttcgagatga

SEQ ID NO: 5940 - DNA, 216 bp, A.fumigatus
attgattcccacggctccttgatggagggattttggttttattccgggttctcgccaaatggtttattactctctcgcctaaagaggaggcccaagatcatcaaagatgtaactcagctcgtcctgtcccgtcgcacccgaatgtgcaatttccttgagtacaaaggtatgctccttttccccacggattgccttcgtacactgcagcaccaatga

SEQ ID NO: 5941 - DNA, 306 bp, A.fumigatus
ctcttgtcattttccttcctagacaccaaggtcgtctaccgccgttatgcctcccttttcttcatcgccggttgcgcctccaccgataacgagctgattaccctcgaaatcgtgcatcgatatgttgagcagatggacaaatattacggcaacgtatgcgagctcgacatcatcttcaacttccaaaaggcatatttcattctcgatgaacttctgcttgcgggcgagatgcaggagagcagcaagaagaatgtgctcaggtgcataagtcaacaggatagtctggaagatattgaagtgagttga

SEQ ID NO: 5942 - DNA, 258 bp, A.fumigatus
ttctccctgataccaaggatcccttgtcttcaccccccaccgcaatgtgtagaggttgtgagcgcaatgaggctcatatccttgactcctccatccgcttgtctgcctgcctccgatcccgtctatgtgcgagaggccgccgccaatcacccttccattgcacctattttcatctcacctactcactacatctccaatactatcgttattcgttgggtcctcctagcctcatccgatgtgaacacgtcacatgtctga

SEQ ID NO: 5943 - DNA, 837 bp, A.fumigatus
atggctgatacccttaaaacaggcgagccatccggttggcgaatacccaaggcttgtcaagaatgcagaaagcgaaaaatcaagtgcaatggagtcaacccctgcaagacctgtcgggtgcggaacactctatgtgtctaccgggatgtgatccggcagcgcaagaaaaagagacatggccctgtagacgagggcctggcttcctgtgaatctacgcgcactgagcttggtacacagcagccatcctcaccaccgccccagccgttaggccgccggaacaaatcagccagctatactttccacaacagcgtttcggcaacgcacatgacctctccgtcatgcaaggtgcaactatattatggaccgacgtcccattttacccttatgcatgagatctatcggggtttggtttcgaatcaaaccactcatcctgaggagccgcagggagaagtcgaagaggctggggctgggcttgatatgttcagtgttcggggcatcttcttcggtactccagctgagacgcatgatcccaataaggggatcggtacgacagtcgcaccggtgatgttcatgccgtatgagctcgccagggtatttctgcaaagatttttgtcaacgctgtaccatctggtaccattctggtccaaagagctttatgagcgccagctagaaaccctgtatcttccttcctctggtaccggctctgacacttgtaccaactccatcttactgatggctttggccatgggctccctgggcacacagcgttatcgctgggggagaatattctggttgaacgggtcaaggcgtcttgtccttcctgggaacaactggtga

SEQ ID NO: 5944 - DNA, 627 bp, A.fumigatus
  unsure (19): Identity of nucleotide sequences at the above locations are unknown.
cgcggatccttggcgcgtngtggtgaagactaccgcagcggcgtgaagaaggaatcgggactgaaccccgccgagcccggggccaaggcgcaccccggccacgtgtcgaacatcctgcacgcgtcggtcaacgagggcgataccatcaaggtctctcatccgttcggcgactttttcctgtctgacgcgaaagccgcgcaccccgtggtgctcctctcggccggtgtcggtctgacccccatgacgtcgattctcaacacgctgacctcgcaggctccggagcgcaaggtcagcttcatccacggcgcccgaaacgctcgggcgcgtgcgttcaagaaccacatcacctctctggaacagaagctgccaaacctcaagtccacctttttcaccagccatcccacggaggaggacaaggagggcgatgattaccagttccgcggccgtgtggatctgagccagttggacagcaaccgggatctgttcctggatgatgccacaacggagtactacgtgtgcggacccgacacgttcatgacggacatgctgaatgttctcaagtccaagggcgtgagcgaggaccgcgtgaagctggagctgttcggaactggcggtgttcctcattga

SEQ ID NO: 5945 - DNA, 363 bp, A.fumigatus
atcatctctactcacgaattacgactttcagataggtttttatcgatatccagaatgttccacatacgtgacatcatctacagccgaatactccatgaatattcttcagcggaatacatattccgctatagcaatataaaagccaccaactctatcaaaatacaaaactacaaaactacaaaactacaatacaactatgtcaaaatgtcccacctaacctactacaactacgacggcgttggcaaagccaaacaagcccagttcaaatacagccaagctgtcagcgtcggcgaccgcattgaatgcgccggacagggtacccccctcccctctcattctccccctactcatcctcactcctaa

SEQ ID NO: 5946 - DNA, 198 bp, A.fumigatus
gaccagacacgtcaaatttccacacaaccaccattgcaagcatcaaccggagcttgtcagccattcatttttatcgaaatctccaaacagatcctactttatcaaatctgcattatctataatgcctcgtgtaaaacgaaagacgaaggcaagaagccaagaacactcttaggccgttccccacggtttaaaatctaa

SEQ ID NO: 5947 - DNA, 210 bp, A.fumigatus
gagtacttgataaagaaccattcctccctgcgtaaacatccttcaataccatacaaaatctgcttcatcatgaaaatctcactcgctctctctgcccttgccttacttgcttgccctgccactgcggtcgaccttgacctaacaaaagactgtggtgcgccctttagtgcctggtggaacaagtgcacccaagctgcctccaactgctga

SEQ ID NO: 5948 - DNA, 525 bp, A.fumigatus
attcagaccatgaccatccgtataaaatggctgagaggcatacaacttcccagacataccaacaccagcatatcaacctcctccactccctcctcctccacctccgctgcctcctccgcagcctcctcctccactcccactgccgcctccgctatctccgctaccgcagcccccgcccccgcccccgcctccaccacaactcccacagctcgcaccacagttggcaccgcaagcagccgcagtggcctgcgtcccacaagctccacacccagtagtgaaactgacagacaccggaaagttcgcattcgggatacgggtgtactccaccgcccaagttgcatactcccccggcggatcgctcccctccgcgccccagaacaccagttcccgttcctgggctgtccgcggcgagtatcgcttctcccgcatgtcctcgtaggtttgaatggggagcctgtcatccgaaacccacttcgcgacgaagaagtcgtcgtgcgtgcggcgctccagcgcgtggatatatga

SEQ ID NO: 5949 - DNA, 405 bp, A.fumigatus
gaggcatacaacttcccagacataccaacaccagcatatcaacctcctccactccctcctcctccacctccgctgcctcctccgcagcctcctcctccactcccactgccgcctccgctatctccgctaccgcagcccccgcccccgcccccgcctccaccacaactcccacagctcgcaccacagttggcaccgcaagcagccgcagtggcctgcgtcccacaagctccacacccagtagtgaaactgacagacaccggaaagttcgcattcgggatacgggtgtactccaccgcccaagttgcatactcccccggcggatcgctcccctccgcgccccagaacaccagttcccgttcctgggctgtccgcggcgagtatcgcttctcccgcatgtcctcgtag

SEQ ID NO: 5950 - DNA, 327 bp, A.fumigatus
tcactccataacgcatgcgcggatcttcggcctcctatggtcgaatacggagtgatatccgtcgctgtcactttggctgctacaccggccccgacgttattgattctctgcatgagtactggtacgactgggccggattccacaaacccctctatccccatcaattcctcttcccctgggactgcaccgaagcactccgccgctacccggtcaaatgcgggacctgcacactctccaaacacgtctgggccttcccctttgactcctggtcaatcatcgccttgcacctctccagagacaaatgcgcctatcccgcgtccgaactaa

SEQ ID NO: 5951 - DNA, 960 bp, A.fumigatus
cgcatgcgcggatcttcggcctcctatggtcgaatacggagtgatatccgtcgctgtcactttggctgctacaccggccccgacgttattgattctctgcatgagtactggtacgactgggccggattccacaaacccctctatccccatcaattcctcttcccctgggactgcaccgaagcactccgccgctacccggtcaaatgcgggacctgcacactctccaaacacgtctgggccttcccctttgactcctggtcaatcatcgccttgcacctctccagagacaaatgcgcctatcccgcgtccgaactaagtccaaattccccaagcgacgcatcatggataaccaaccgcctcactctcctcactgcactggacaccctctccgccggcgcaacagccatgtcgcagagcctacccttccagtccgcaacgcaatggttccatctccaactcgaaccatcaaccgatcggatcaaactcggcggtatcaaccgcgcgcaatcatatatccacgcgctggagcgccgcacgcacgacgacttcttcgtcgcgaagtgggtttcggatgacaggctccccattcaaacctacgaggacatgcgggagaagcgatactcgccgcggacagcccaggaacgggaactggtgttctggggcgcggaggggagcgatccgccgggggagtatgcaacttgggcggtggagtacacccgtatcccgaatgcgaactttccggtgtctgtcagtttcactactgggtgtggagcttgtgggacgcaggccactgcggctgcttgcggtgccaactgtggtgcgagctgtgggagttgtggtggaggcgggggcgggggcgggggctgcggtagcggagatagcggaggcggcagtgggagtggaggaggaggctgcggaggaggcagcggaggtggaggaggagggagtggaggaggttga

SEQ ID NO: 5952 - DNA, 489 bp, A.fumigatus
gggcagtcacccgtatctatatcgtttctcctcgccatgcaaaccaccgatgccgcgagtatctcgaaccgtttaatgcattccaaattctcttccctgaacgcggacaacacggggttctcccacggcgcgtacaattctaatcttcccgtccagggtttcgcggatcggaacgctcgtcgtcccaacatccctcacatcaatacctctaacccggcctcgacccgctcggacggcatggcaaactccggcacggcatttgacatgaacttcacgcctctcctcccttctcagcttctgctgggcagtccattccagcctggaactccctcagccttcgcttcgccgcagtttgctaatttcggtggcttctcccaggccagtgcctccgcacatgcacaaaatcatcaaacccagttgggaagcccaacccaggccgcaccgaacgccggtttgtattcagggatgatggcaaccgacggcttggcg

SEQ ID NO: 5953 - DNA, 204 bp, A.fumigatus
ttatttcccttgaatgctaccttaaaacagtctagtgaactaccttactccatactccagactactagtcctactaatagctttagaccaactaactacaggagcaggagacttaccctcactctccttttctctccgccctcactagagtcactcctccgtcctcgctttgtttttccccctcatcccctatctactatctaa

SEQ ID NO: 5954 - DNA, 195 bp, A.fumigatus
agtacagtcagtaccttgtcttacggcttgaggtaccggactgccgccatgccgactgttcacctgcttgattacgtcgcaggaaatgttcgatcgttggtgaatgcgatcaacaaagttgggttcgatgttgaatggatcaagtctccggccgatatccaaaatgctgatgtgcgcactcttctctgctgctag

SEQ ID NO: 5955 - DNA, 804 bp, A.fumigatus
aaactcatggtgcccggtgttggccatttcggccattgtctctctcagctttccgaaggtggtttcctggaaccgatcagacagcatatagagctgggaaagcccttcatgggcatatgtgttggtctgcaggcgctttttgagggctctgaagaagaccctgacacccccggattgggactgatcccacaacgaatgcagaaattcaacgctgacacgaagagcgtgcctcacataggctggaactctgctatgaatacaacctcggagcgtcaaactttctatgggttgaacccgaacagcaagtattactacgttcattccttcgcggctctctacaaggcaggcgtattagagaacgacggctggtcagttgctacagccacctacggtgaagaagaatttattggcgccatcgctcgggaaaatatctttgcaactcaatttcatccggagaaaagcggacaagcgggactacggactctccgtgcgttcttgaatggtgacaaattccagccattgggaacggaaggtttggaggcaagaaagagggaagacgggttgactcgcaggatcatcgcctgtcttgatgtccggacgaatgatgctggtgatctggtcgtcacgaaaggtgatcaatacgatgtgcgagagaaggccggcgtgggcgcaggaggtcaggtaagaaatctgggaaagccagttgacatggcaaagaggtattacgaacaaggtgcggacgaggtcaccttcctcaatatcacggtcttcaccacgggggtcgaaggatccgcgctaagcgat

SEQ ID NO: 5956 - DNA, 1140 bp, A.fumigatus
  unsure (365): Identity of nucleotide sequences at the above locations are unknown.
tgttggtgcctgccagggaggtcagtgggtgcaaataaggatactgagagtatcgtaccagcacgtccattccggatcctggacgctccttatcttcgcgatgatttctattgcacaacgctcgcgtattcgcctacctctggagttctcgccgttggtcttgcacatcgcgtgtatgtttggtcggagatttttggcgtgctgtatcccccattcgcagaccatcatccctcaaacttcgtaaactctctatctttctcgtcagagagcggaggtaaagacattctggccgtcggaaggcgaagtgggttggtcaccctctggagtgctcctgaagccgagccacgctatgaaattagtcatcncaacagtatcacttcggtggctttcaggcaaacagtgacgcgtaggttctctgagcgattccacaacgttgaagtcaatacagaggaccttgctgtcggcgatgagctcggcaacatatggtactactcagtagaatggcccagtgaggagattcgagaacaatttgggtggaacggtgctatcaccctactcgccagaatttccgcacatacccagaggatttgtggtataacctggtctccagatggcgcctacttggccactggaggaaatgataacgcgtgtctaatcttcgagctccgtgacctcgtgccctggctacagctcaactgtgcaacgaaaccttgtaaatcagctcaaacttgccagtcgatcagcgtgcagtgtcagaatgcattctcttccctttctgcaagcacaagcaaacgactattcaggcgacgtgactttctcaatttgcttccttcatggtctcactttcgcctcggttcttcacaaacatcactcattaaacacaccgagtcgatcgccttgggtactgagagaacggtaataatacccccaaataggcagaagcatatattggctcatgcggcagccgtcaaagcaattgcctttgctccatggcaaccgtctctccttgccaccggaggaggctcgaacgaccgagccattcatttctggcacgccccgtctggggcgtgcctggcgtccatcaatgtatatgcacaagtgtcttcaccacagggggcggacggatccgcgcaatgcact

SEQ ID NO: 5957 - DNA, 324 bp, A.fumigatus
cagatgcgcaacaggcttaccacggcgaactccttcaacggcagcaactgtcgggtgcgactgatcgactggaagccggcaccgctcgagaccggccgagcggacggtcttgaaagcatctcgctcgaagtgctggattccttccggattggcgaccgagtcctcaacgattgccagccctgcgaagagatcgtgctggggaatccgggcaaggatggggtgattgcccggaccatgaccatccccgataagtggaggagctgggaaaggcccaagaggtacgcttggtcaaggcaccaactgtggattttcggacgcagttag

SEQ ID NO: 5958 - DNA, 291 bp, A.fumigatus
ctccttttcccaggacaaattgagcgcgtcatggtggaaaatctctacagacacaaaaccgtccaagtcaattggaacacccagcccgtccgcttgcacgtcgcccctgtgacgaaagacgagcccgaggcacatcctctcaccatcacggtccagaacaaggagaccctcggccaagagacgatacgagcgaaatatgtggttggagcggacggtgcgcacagctggttgcgcaagtatctcaatatcgggttctcaggggatgtgaccgactccacctggggtgagtga

SEQ ID NO: 5959 - DNA, 573 bp, A.fumigatus
cagcaaaaaacctcacgcgccgtcgcatccgctcgccacgaacttggcccccgggcaagggtttgcctgatttccagatggtcaaccattccgacgcggtgccgatccaagctaaccaccgattcaccagtgacggccggttccgctttcttgttttcccccggcgacatttcccaagcacttgcgttcggccgcttcagtcgcctgggagactggctcacctcccacctgccgcccagctccggtctggagataatcacaatccatggggcgcggcgcgcggatgtcgaattgatggatcttcatccagccttccggccgtggagcgacgaagagggatggaattactggacggtgtatgccgacgacgacagctaccataagggtcacgggcatgtgtatgagcgctgtggaatcagcaaggaggatggcgttttggtgctgttgagaccggatggatatatcagcctcattgcctctttcgacgagacacacgaattgatcgactttttcgatggactccagtcaggaccgaggactgtgccgcagccggagcgaagggcgaacttgtaa

SEQ ID NO: 5960 - DNA, 516 bp, A.fumigatus
  unsure (28),(492): Identity of nucleotide sequences at the above locations are unknown.
tcactgatgaaggccggggtctggctangggtgatgaacctggtgcccaagaccgacttcccggatattcgcaaggtgtttgtagtccatcccagggcggggaccgtcatgggcgtcccacgggaggacaaactcgtccgcttatacatcagcatggacgggggcaatcggcacacatccatcgacgccaagagcatcacggcagagaatctcctccaggccgcccgagccatcctggcaccgtaccgcctggatgctgcgcggatcccatggtggtcggcgtactgcgtcgggcagcgagtggccgatgaattcgcccgtcataaccggatcttcctggccggagatgccgttcacacccattcccccaaggcaggtcaggggatgaacaccagcatccaggacggatacaacatccgctggaaactgcggtattgtctggagcaaaaggggaaacccggccctgctctccacataccaaaccgagcgtcngcccatcgcgcaggcgctcattga

SEQ ID NO: 5961 - DNA, 1404 bp, A.fumigatus
agacaaaccgtgcgcgtattctccatgcgaaagcagcttctgcgccagttgttgcttatcccctttgctacggttgccgctgtagcgctcggcagcttgatcgtcgtcacctttgccctggaagttttcatctcggaagtttacgtgggcccgctcaaggggtatctggagtttcttccgactgtgctgttttctctctcgctgccgacaatcacctcgaagctgacggacattgccactcaactgacggagtatgagaattaccgcacacaggatcagtatgatctggcgcagacggcaaagacattcgtgatgaatttcattaccgcgttcctaccaactctgttgaccgcgttcgtctacgtcccttttggtgcgaagatcatcccttacctggacgtcttccatgtcaggggcctccattcctctatatccactgaattccaggtggacacctcccgcttccagcaggaagtaatctacctgtcggtgacaggccaagtcgtaagcttcggcgaggaggtcatcctcccgtacgtgaaaaaggtcatctggagaaaatggcgcgactaccgcctccagaaaacgcaagctggccgcccacgccggcactccaaaatgaccgaccttcttctgatcgactcgccctccgaggctgcgttccttactcggatccgcaacgaagccgaagcggacgagtacaacgtccacgaagatacgctggagatgtgcgtgcagtacgggtacctcgcccttttcggggtcgcctggccgctcgtccctctcctcttcctgatcaacaactggctcgagctgcgcggtgatttcttcaagctcaccctcgaatgccagcgcccgccacccatccgcgcggactcgattggcccgtctctccaaggcttggagttcctgacatggctcggcaccctctcgacggcaagtatcgtctatctctaccgcgacgggatgaaagaggtccacatgtcctccctgctactggtcctgttcatcgctcaacaggtataccttgcggtgcgctttgccgtacgcacgggactgcagaagctcggctcaggtactctccgccgcgaagccgccaagcgctacgccgtgcggaagtcctacctggagaagttctgtgcccggaggacgcatgggaacgggaagccgcgggtgcggttcaatgaccatgtggatgtgtacagttcctcgacggactcgtccccgacagaggctctagaaaccaagtcggcgacgctccatcaggaaacagcctatgcaagtgaacgaagaggaggaattttgggagggacagcgctggacggcggaggaggtgggtgtgaagttgatcaaagcgttgagtggagaggagaagaagcgagagtagcctacagctgtacatag

SEQ ID NO: 5962 - DNA, 261 bp, A.fumigatus
tggggaaccaacatctcgtactggctctcaaactccctggacgtgggctatcagaatcagtccacggcatgggtgatgggaggcaagaatatccgcttcaacggccacggatacggcacattgaacggcaatggacaggtgtggtatgactttgtcaagagtgtgtcgaactatccacgcaggccgcacgccctcaccgtcgcgcgggcatcgaactcggtctttcagggcttgaggttcctgcaaagtcagatgtggtag

SEQ ID NO: 5963 - DNA, 330 bp, A.fumigatus
ggcgggagccatgaatcgtatgcgcgtcagtcatgtcaacccattgtcgttgacatcatgtatcttgcaaatatccttccctgggtccttctgccgttagcggtcattgcagatgccactaccggacagtctcatcgccgaacatgtgttgtcaaggcaggaggttctgaatcagtcgatgatacccctgcgatcctcaatgcctttcgtcgatgtggaaaagagggcaggatcgtcttccagaataccacataccatgtcaacagcgtgatgaacacaagcggactgcacaattgtgacattgacctttatggcacacttttggtataa

SEQ ID NO: 5964 - DNA, 390 bp, A.fumigatus
aaagacaataccgacggagccgacaccatctacagttcgcacattaccttcaataactggacggtcgtcaacggcgacgacagcatcagcaccaaggccaattccaccgacattctcatcacgaactcggtcttctaccggggccttggcatcgccataggcagtatcggccagtacaaggacgtcttcgagaccatcgagcgggtccgagccgagaacatcacgtattacggcacgctgcacagtctctacttcaagacctggacaggcgagcaggtcaattacccacccaacggtggaggtggcggccttggctgtaattgccccttgcccattccccttttcttgaatattcggcccccgccttctgacgtctgctatttacgatag

SEQ ID NO: 5965 - DNA, 648 bp, A.fumigatus
cggcctttcatttctggaagatatggaagacgcgggcgcggttctgcatcccttttgccattggaggattgtgtaagtgatgtgtatcgctttgctgcgcgtatgcagactgactctaacaacctccggacctcagtcgaaatcatcggctatataggtcggatcgactcgcacgggaagaccggacagcttggcccctatatcattcagagcgtctttattctgcttgggccggtcctcttcgccgcttccgtatacatggtgcttggacgcctgatccgcagcattcaagcagagaagcactcggttatccgcgtgaattggctcacaaagatatttgtcgccagcgacgtcctctctttcctcatccagggctcaggagcaggccttatggcgaatgggtccagagcggacatgggcaacaacatcgtcattgcggggcttgtgcttcaagtactcatgtttgggctgttcatggtcacgtcgttcgaattcgagcggcgaatgcaccgagctccgggcggccatgtccttgatgccgacgtgccgtggaagactcacctgcatgttttggatgctgtcagtgctttgatcttgattcggtcggtgtttagggtgatcgagtacgctgaaggtcacgacgggtag

SEQ ID NO: 5966 - DNA, 765 bp, A.fumigatus
tacctgatccttcagtggattttgttggctttccgttcatggcagccaagtcgtcgtcctttattccgcctgactgagaggacgttttccttttgtctaataaaggcgtcctacacatccaagatgcgatttctggggagtatagctctagtcttgagctccatctctgtagcctctgcaaacgtccggtctcgatcctacgatacccacgagttcttcgctctccacctcgacgactccgcttcgccatcccatgtcgctcagctcctgggcgctcgccatgagggtcaaatcggagaactcgcaaaccatcacacattctcgatacctcgggagcgcagctcagacttagatgcgttgttggaacgtgcacgtgccgcgaggaagattcggcgccgtgcgagagatgatgccacgtcgcaagagcagcacaatgatgcactgggtgggatcctctggtcacaaaagctggcgcccaagaagcgtttagtgaagcgagtaccaccgcccgagaggctcgcgagaacgttcgcgaccggcaaagaggacccagtagcggcccagtctcagaagcgaatcgcctccacgctcgggattacggatcccatctttaatggacagtggcacttatttaatactgtacagctcggtcatgatcttaatgttactggggtatggatggaaggtataactggaaagggtgtcactacggcggtggtcgatgacggattggatatgtactgcaatgaccttaagccaaactaa

SEQ ID NO: 5967 - DNA, 366 bp, A.fumigatus
actcattgcatcaaaagggatggactatcgaccttggtcggcacggggggcagcatgctgagcggaggccagaagcaacgcatcgccattgcgcgggcttttcttcgaaaaccgaagatcctgctgctggacgaggccacgtcggcactggacagccagtcggaggctattgtccaagaggccatggatgccatccgaaaggaccggaccacgatcatggtggcgcatcgcctgagcaccgtccagaacgcggatgtgatctgcgtgttgcaggatggcaagttattggagattggaacccacgaacagcttctgggcaagcgggggaagtactgggaaatggtttctatgcagagtctgcactga

SEQ ID NO: 5968 - DNA, 879 bp, A.fumigatus
agaccgaaagccccgaatgagcctgtgccctttatccccgagaaagacctggaagtctaccgcagataccgcgatcctgcgttcgaggtgcaagtaggcattcacgaacttctcgggcatggaacgggaaagttactgcaggagacggctcccgggaaatacaacttcgatgtatcaaaccctcccgtgagtccaatcaccaacaaaccagtcaccacctggtacaagcctggtcagacttggagttctgtctttggggccatcgcatcctcatatgaagaatgtcgggccgagtgcgtggctatggtacttagttgcgatttcgaaattctgaagatcttcggatttggagacgggcaggttgacctcaacaatgaggctggcgatgtcctattcgtcgcatatctgcaaatggctcgcgctggtctggttgcccttgaattctgggatcctaaaacgcagaagtggggccaggctcacatgcaggctcgctacagcatacttcgcactttcctcgacgctggtgatgactttgtcagacttgtttacaccaaggaagacctgtctgacctagagattcatttggatcgatccaagatcctgactcacggacgtcctgctgtggaaagatacctgcagcagttgcacatctacaaatccactgccgatatagacgcgggcaagaagttgtatagcgacataacctttgtggatgagtggtggggtaccaaggtgcgcgatattgttctgaaaaacaaaattcctcgtaagatctttgtgcagggcaacacgatcttaaatggagacgaggtaactctgaaggaatatgagcccaccctcgagggcatgattcagagcttcgttgaacgcaatgtctag

SEQ ID NO: 5969 - DNA, 234 bp, A.fumigatus
ggtcaagagatggcggtctatccttccgcgcagactcaggtcgctgactggatcggcgccgggaaccagccttggatggattccgactgtcagagtgagaagaacgaagagaagaacgtcgctcgggaatcacgactacagggacaacctcgatatttcgaggagggccatccgctgtggcactggctggaacagaggtttcagacgcaatgctcttgcgaacttgttcggtga

SEQ ID NO: 5970 - DNA, 2088 bp, A.fumigatus
gcagaaatcatctcagaacgaaagtccactgggtccagtgatgccagtttcggagatgacaggtctattccagcccagtccgacaagacgctgaggcccaccaatgtcgaatcgtacgatggttgcgacaaggaacgagcgccatccggtgatcgtcgtccaagaatccgaacagagaaatccccctcccgatctgccgtggatgggaacgatgaggatctccctccactacgtggacggaagctacgtgaccgggtcaaagatgcccaaatccgcatggcaagcccttcccttgaacaatttcgtgaggagatagggtggccccccgctgaagaggagttccgacgatattccggtgtgtcgacgtcgtcgacaatcgaagctatgatcattgacgctccgcgaccggccaaccgaaaactgcggcataccggaaagaggcagtctctacgctccaccagctcgcccgtaaccaaatcggcacgtacatcgcttgtttccaatccagactcccagcaccgcctagtccataaagatgctcggatcaccgaacaagttcgcaagagcattgcgtctgaaacctctgttccagccagtgccacagcggatggccctcctcgaaatatcgaggttgtccctgtagtcgtgattcccgagcgacgttcttctcttcgttcttctcactctgacagtcggaatccatccaaggctggttcccggcgccgatccagtcagcgacctgagtctgcgcggaaggatagaccgccatctcttgaccttacccgtcagaggaagcgaacattttccgactcgatcgttactgctactccagcgtcacgtccccgaggtcgcagccttggtcggcgggtgattcttcttcgcagctcctcattgtcagcgcccacaagtagggacagctcacggcgcccgtctttcgcctccgagcgccttccaaaccaggaccttctcatggatcgtgaaatggataagatccctattgaacagctcgaaccaaggctcgacaatcagacctcgaatgccggccgctgggacgccactgatgctccgaagacacaatccatctggatcggcatcgaagacatgacgcacctacgcccaccttccattctcttcacgccagcctcagtcgcatcatcgtcgccagggttgattgaaatcaaggaggcgaagacagttgctttcttccctcataataatgaatctctcctacttgttgatcagcctgtgcgagctgcactcgatcacccagcgtctcagccggatgattgtcaacgacagagggattcacgaacgcctgagaaccttctgcctcaagattcaagtcatgtccattcacctttgaggaaccctcgcccgccaccgaatccgccagtccctaacgttatcccgccgactcccgaagatgaggctgaccggcagctgagggtgtcagatgagagggacgagtcgaatggtatcaatctacggcggtttggctcactccgacgcagggtggttcgccctcgatcagattcctttgatcgcttcgtccggtcgctctccgtagcctcagcaaaaaatcgcaaagcaggcagagatatcgacagccggcttcatccattctggcgcccacgtcggttctgggacgactcgccagagtcggaagaacctccacaacaagccgcccgtacggagtccgatcatatcataagtaactcgttgggaatgcctcagccacgggttgtgttcgacgggccttccctcgctcgtcgcagcccgttccagggcacgaatccccgtcgccaccccaaaaggagcagtgctctgataggttccaccatgcttagccctgaagcgcttcgctctcagacctctctccatcggcgtcgcatgctctccttgtcgtggtggaggctgcgccttcagctgggccccgtgcgcaatttccgcagacgcctgaggcgttcgcttcagcagtgggaagaagcaaagcgcgaggcacgaagggaaaagctgaagcagaagattggcgaagcggtgttggtgggctctagcatgcaggctcgcgaccttcttaaccgaccctga

SEQ ID NO: 5971 - DNA, 186 bp, A.fumigatus
attgccatgagttcattttctctgatagatttcgatgggatgcactctcatgatatgaatgatgtctatgatttgcttgtttgcctacttgttccatgccttttatgccgccgcagtgttttgaccactttggctgacatttacgactttccatatgaacacgatgatttgaccccgacccgatga

SEQ ID NO: 5972 - DNA, 1740 bp, A.fumigatus
  unsure (1708),(1731): Identity of nucleotide sequences at the above locations are unknown.
agattgaccgcccgcagcacaggtactccgaaaggagtcaaaatctcccacgaaacctacaccagtagcgccattccccgggccaatgcggtaggttacacggaggattcccgcgttctcgacttcgcctcctacgccttcgacgtcagcatcgacagtatgctgctgaccctgggcaacggcggctgtctgtgcattccgtccgacgaagaccgcctgaacgacatcaatggcgtgatacggcgaatgaaagtcaactatgcgggcctgacgccttcggtagcccgtattctagacgcagatgtaatatcctcgctcagtggtcttggcctcggaggagaggccgtctcagcgagagatgtcaatctctggggtcaggacaccaggattattatcggctacgggccctgcgaatgcacgattggatgcacagtgaatagtagcgcggcaacgggaagagactatatctccattggccctggtaatggggcagtaatctggatagtcgatcctaacgaccatgattctctcgtgcctctcggcgcggtaggagagctgctggtagaaggtcccatagtagggcagggctacttgaatgatccggagaaaactgcagcagcgttcattgaagacccttcatggttggttgcgggccacgaaggttaccccggtcgtcggggccgtttgtacaagaccggtgatctcggtcgatatgacccagatgggtcaggcggtatcgtgttcgtggggcgcaaggatacccaggttaaattgcgaggacaacgggtagagctcggggagatcgaaagccaattgagagccagactgccctcggagacgactgtgatcgccgaggtgattgtaccccaaggatctgggggacaaccgacgctggtggcatttgttgctgcccagacgaccaagggacatgatcataccggactcgaggcggcagagcttcccgatgagcttcgaagggcgctgtcagaagccgatgcggagctggcaaaggtattgcctcgatacatggtgccaacagcgtatattcctgtcaaccacatccctacgctgatttcaggcaaaacagaccgcaagagactgaggcagttcggcgcaaccgttgacctgcgccagctggaccaggatgctacgaacaccgcagctcgggagctgagtgatctggagcgtcgcttgcgacaggcatggagccagacgttgaagctccaagcgggttctattcgtctacaggacaacttcttcgctcttggtggagactccctcacagccatgaagctggtctctgtatgtcggtcccagggtctcgacctcagtgtcaccagcatgtttagcaatcctaccctgtcagccatggccagcgttgtccgtatttgcgacgtcgacgtgcaaaggacagtcccggcattctcgatgatcacatcagatatgaacagtgcctgtgtagaggcagcagagccctgcggagttggcccagcagatatcgaggacatctacccctgtacgccaacacaggagtctcttttcactttctcgctcaagtcagtcaagccctacgtggcacagagagtcctatgtatcccgtctcatatcgacctcaacgcatggaggaaggcatgggaggatgtggtcgccgcactccccatcgtacggacacgagtagctcagctgcccgagcctggccttcagtgtnttaaccgcgcccgctggaaggancctatcttg

SEQ ID NO: 5973 - DNA, 288 bp, A.fumigatus
agggtcttcaatgaacgctgctgcagttttctccggatcattcaagtagccctgccctactatgggaccttctaccagcagctctcctaccgcgccgagaggcacgagagaatcatggtcgttaggatcgactatccagattactgccccattaccagggccaatggagatatagtctcttcccgttgccgcgctactattcactgtgcatccaatcgtgcattcgcagggcccgtagccgataataatcctggtgtcctgaccccagagattgacatctctcgctga

SEQ ID NO: 5974 - DNA, 198 bp, A.fumigatus
cacagcgcagatatcttgcctcgcagtggtaaacacatcagctacaagcaaatgtcgcatgccatccaacatgcctataaccttgcaccgtcgctcgccgaccagctcacttcctcggcctatcagctcgaccaaggacggggctggatagacctgcaggacctcagcgctttgaacgttagttatcaggatgcataa

SEQ ID NO: 5975 - DNA, 888 bp, A.fumigatus
aatatactaaaaactgttgcagagcgcaagagagttctagatacgaagtcaaagacagcttgtttctaccacccaatgaaactcaaacaccagaagaaacaatacaagtatccatgttgtggaaagagacacggatgcgcctcactgccggcgcatgtttacgcacctgttccaggttttatcctggagaattggcagagctatcaattaacaccgagtcctatgccagggcttcgtccacctcggcgcgtggtcgcgctcgattgtgagatggtcgaggttaaaggaggagattcggaagtagcacaggtctgtgccgtcgataccttgaccggtgaagttattgtcgacatatacgtggtcccgtccaagacggtcacagactggcggactccttggagcggggtatcgcagagacttctcgaggagatgaaagaggctggaaagactgtcaacggatgggaagaagctcgcaaagcgctatgggcgcacatcgatgcggacaccatcctcgtgggccaatcgctccaacacgaccttgacgtcatgcggatggttcatttgaacatcattgacacggctattctctctcgggaggcagtcgcgaaaaattgcaagcaaaactgggggttgaagcgactatgcaagcagatgcttgatcgggatattcagcagtcacggggagggcacgattgcttggaggatacaatggcgactagggaggtggtgctctggtgtgttcggcatcccggcaaaattcaggagtgggcagtgtctcaaagggaatggaaaaagaaagccgatgcgcatgggaaattgaagcggaaagagtcggacaaggctcaggtcaagcagcctcaaaagagtgtctctcaagtacccccttga

SEQ ID NO: 5976 - DNA, 621 bp, A.fumigatus
gccgcacttctgctcggcgaaagcccatactctaccggcgaaaatctcgggaaacccgagggccagtactacgacgccgcgccggtgtctccagttgagaccgacccattcaccgaaggaaaagatcttgctcctcgccaacctgccaccaccgcagcagactcacaggcgccgtacgccagccagtactacccgcagcaagggtcgaatatttatggaggccgaccagcttctgcgaatgatgatcgctcgtacgaccctagtgttgcaagcagcgagcaaggagacgaggaatatagtagctatcgtcacgctcaaggtcgtccgatcgagtatcctcctgccatgtctgaagacagcgaggagtacgaacatgaaccccacgaggagaactatgcatcgagctccctcccagcgtcgtcggcgcctctgtacacaccaactacggtcgattactccggttccggttggggtgtcggagtgggttgggaatcgatgactcctcgtcatcgccatcccacgcgcctcagcgatgttcttgaagaggatgaaccacggaccacacctagtcgagccagtcgggccagtcgggccagccaggctagtcggagtgtacagtga

SEQ ID NO: 5977 - DNA, 867 bp, A.fumigatus
aaagccggtactcagaatggtgccacgcgcaccgctcaagggccagttccggtcaaccatcatcctccaagcggtgtccggacaccaaccgatatcatgaggcagcgtcgggatcgtgaggcccggaagaaggcagaacaagaggcaatggctcgggagcaggaggaagcggagcacaggcatcaggaggagcaagcaaaacaggctcaacagacccagccttacgctgctggcgttgccggtgaaaagcccggacagcggggcgcagctcccagaacaactgcagcgcccggcatgacaaccaatacttctggaatggcccgccgcgccgactcccagatacccagacaacctgtacctcctacccagcaagtacctggtgctcaacaaccggctactgcgaaagctgctgctccgcccagtacattcgccaagccacagggacaggcaccttcggctagccaatcagaccctgtgcaaaatcaacagcaaccacgccgggtcggatttcctcatgcctttgaacggtgggaaaccttgtcttcgcactgggagggactgacgagctactggattcggaagctcgagcaaaacaacgaagcgttggagcgtgacccacttagccagcagatggcccgtcaggtcaccgatctctccgcggctggtgccaacctcttccatgcggttgtggaattgcagcgcttgcgtgcgtcttcggaaaggaagtttcaacgctggttcttcgacacgcgcgcggaacaggagagaaccaaggagctacaagccgagcttgaaaaccagctcaagaacgacgccggcaggccgcgccgaaaccgtcgcctctctacaaaaggccgagatcgataa

SEQ ID NO: 5978 - DNA, 339 bp, A.fumigatus
agcaccaagatgcagcccttcatcgtgcttttcacctggctgatgggaacggcctacgcggctccggctttcttcgacaacatttacgactactccgacgaactggcagagttctacagcaaagtgagcaagtatatcgatgattcaaaggatgtcttgactgcaacaacaacgtgcgatccttccaagataagtctaccggcctttgcatccggattgccctcgcccggcaatcagaagccactatatgtcgctgttggccgcggaacacaggttagcaacaactgcacatccagatcacacattcgtcgcatggctaatgtagctgatcccacgcag

SEQ ID NO: 5979 - DNA, 348 bp, A.fumigatus
ggcgtgaaacaagtcaagcgcaccgatcttgatgctcgattcttatttttagcacccccgtcccttgaagaactagagaaaagactgcgtgggagagcaaccgagactgaggagagcttgacggtatggctgtcctccacattccttcacttccccaactcgccagactgtcccgctggaattctaactttgcgtcagaaacgccttgcccaagctaaaaatgaattggaatatgcggcgcagcctggctctcatgataagattgtcgtgaacgatgacctggagaaggcttataaggaactgcgggattggattgtcgacggtggtaactttggagcgcgtcaatga

SEQ ID NO: 5980 - DNA, 231 bp, A.fumigatus
ttgttcacaaaacatttccgaagttgcctacactgggtattagtagctatactttacgatgacccaagatctctttggtatatcaaattagctatgaacatcacaaactccgcaggagttctctgtgccgaatacaatggctacagcgcttctacagagaatcaccactggacattcgaagtttactcaacacaatacagcctatggtttgtgatgcacgaagacatgtga

SEQ ID NO: 5981 - DNA, 231 bp, A.fumigatus
  unsure (52),(185): Identity of nucleotide sequences at the above locations are unknown.
agaccgcgatcgccaccggggaccgagaccgtgagcgggacaggtatcgganacgctctcggcgcgaccgaactcagtcccctgctgacagtgactattcttctcgccaccattcccgacgtattaagcgagaacgcgaagatggcggcgaacgagaacaagacagcgcctgagatgaagtgtcncccaagactccgagcccgagaaggatccccatacgctagagcgtga

SEQ ID NO: 5982 - DNA, 447 bp, A.fumigatus
tgtagtgcaaccccaacaacgccccatgaagatgcacggacacggaccatatcgaaatcaagatcaagatcaagagccaagtcgccctctaggccgacgagccgatcgcgatctcccggtccgtccgatgtggatgggcgccgctcggtccgccgcgctctaccaacggttgataaggacgccgacgatcgcgaacgtaggcgtgatgcgcccaaaaaatcccctccagaagacaaattcgacgagcactccgcggccgaggatgaccgccgctctcgttctccgtctgttgattctaaacgatcgtctcaccggcgggatagagaacgggaggacagaaatgcacgtcggtcgcatcgaccccatcgccggagtcgcagccgaagccggagtcggagctgcaacggagattcacatgatgtcgatcgtctcccgcggattctatag

SEQ ID NO: 5983 - DNA, 495 bp, A.fumigatus
  unsure (72): Identity of nucleotide sequences at the above locations are unknown.
tacgtcgggaatggtggcgagaagaatagtcactgtcagcaggggactgagttcggtcgcgccgagagcgtntccgatacctgtcccgctcacggtctcggtccccggtggcgatcgcggtctttatcgcgttcacggtatcgatcgcgatcccggtcgcggctacgttctcgttctctttctctgtcacgatcgcgatcacgatctctatcacgatcatggtcacggtcccgccgtctggagtctcggtctcggtctcggtcccggtccctgtctcggtcacgttcctcttcgcggcgactggagcggtccttccgtgagatagatgctctgctctccgagcgggaggcaggctcctatagaatccgcgggagacgatcgacatcatgtgaatctccgttgcagctccgactccggcttcggctgcgactccggcgatggggtcgatgcgaccgacgtgcatttctgtcctcccgttctctatcccgccggtga

SEQ ID NO: 5984 - DNA, 183 bp, A.fumigatus
atgctctgctctccgagcgggaggcaggctcctatagaatccgcgggagacgatcgacatcatgtgaatctccgttgcagctccgactccggcttcggctgcgactccggcgatggggtcgatgcgaccgacgtgcatttctgtcctcccgttctctatcccgccggtgagacgatcgtttag

SEQ ID NO: 5985 - DNA, 705 bp, A.fumigatus
gaagagctaacagtccaccactatagatttcatggcgaggagacatatgaccctgcaagtccactaactgatgcccccacattcgtcgtcgatcctatcgacggtacagtcaattttgtgcacggattcccatatgcatgcatctctcttggatttgcaatcgacagaaaaccggtcgttggcgttgtttacaatccatttaataataccctctactccgccattcgtggagaaggggcatatttaaatcgcaacactaaacttcctctcaacgctaggagccttgagccgttgaatggcctggagaatgctctcatcggcgttgagtggggttcggagagagcaggcaataattgggtgacgaaggtacgaacatttgaaaaactcggcaaaaccaacggtgacggcggtgcaatggtacgctcaatgcgtagcatgggctcagctgcattgaacctttgcgctgtcgcatgtgggaatctcgacttgtattgggaaggtggttgctgggcgtgggatgtttgcgctggctgggtcattctaacagaagctggcggtacaatcgtggacggcaaccctggcaactgggaagctaccgttgatgggcgaaagtatctcgcagttcgaggatcaccaaatcaagcaggacagaaggagctcatcgaggagttttgggggcatatacaaggccatctcgagtattga

SEQ ID NO: 5986 - DNA, 999 bp, A.fumigatus
ctgcttgagcccttcataatgcgtaaccagattggtgtcacggccacacatgagagcgaactggaggcgaagaaggatgaagcgcacattgaagaagtcgtgctcgccaacctgacagaggaggacgtttttaggatctcccgggaagcgctagatcttcggtcttggactggtttccgcttattcttgatcatctttgtccagggatgcaaccaagctggctatggtattgactgggccgttatcagcggcatcaatgccttgccggcatggcacacctactttggatttggaactagcggaggcacatatggcttgctcaatgccctgatgagtattggcatcgtgtgtggtgccccgttcttgtcgttggcggacataatcggtcgacggggaatcaactttctcggcaacttcattgtgatcgtgggcgcggttctccagggctgcgcggtgaacctctcaatgttcatggcggcccggttcctcctgggattcggatctgcgctcttgtccagctctcaatatgtcggcgaggttgccccgacccatctccgtggcttaattgtcggcatttttggtgcatgtttccagataggcagtctgggcatgaacggggccatgattggactaaccaagatagaagggaactggagctggcgacttccactccttttggaagcagtctttcctgcgatagtctgtgctaccatttacctcctcacccccgaatcgccccgttactacatcatgcgcgggaggagggacgctgccaagcaaatggttgcaaggtatcacacgaccagcggcgacatcaatgagcccattgtcgagattgtcgtatcgcagattgaggcatcgcttgagcatgaccggacgggcttcaatcagttctgggattaccgggtttttttcacaaagatggcccgcttccgactccttgttttattcgtgtactctatcttccagcagtggaatggcggaggtatcattacgtaa

SEQ ID NO: 5987 - DNA, 288 bp, A.fumigatus
atcttcacaggcctcgcaaccatgatcctcttccagtttgccgctacaatcacctcctggcagttcgatgtcacgggaaacaccgcagccgctgcgctgactatcctttggatctacctctaccagaccttctccgctatgctgattgccaccatgcacaacctgtaccccgttgaggtcctgtctctgccactccgtgccaagggaatgggtctctatgggctgatccagggcggtgcaggggctgtgcagacatacggcatcagtggtcttcaccacagggcgtcg

SEQ ID NO: 5988 - DNA, 483 bp, A.fumigatus
tttcggagtttttcaccaaggagtaagttgctcttttcccgttctggtgctcgggcggaatgggacgtggtggggcgaaaggctgacattgatgatgcagtggttgtggatgccgtgctgtcgcttgaccaggacgatctgaacgagaagttgattggtatcaagaaggtcaccggtggtggcctccaggagtcccttttcgtcaacggtgtcgctttcaagaagaccttctcctacgccggtttcgagcagcagcccaagtcgttcaagaaccccaagatcgtgtgcttgaatgtggagctcgagttgaagagtgagaaggacaacgcggaggtccgggttgagcaggtttctgagtatcaagccatcgtcgatgctgagtggcagatcatctacaacaagctcgaggccatctacaagaccggcgccaaggtggttctcagcaaactgcctattggtgatttggccacgcagtacgtttga

SEQ ID NO: 5989 - DNA, 738 bp, A.fumigatus
tttggccacgcagtacgtttgaaattcacgctctacgttgttgacggtactttaactaatgtctacgctgtctacaggtacttcgctgatcgcgacatcttctgtgcgggtcgtgtttctgcggacgatatggaccgggtgtgccaggcgaccggtgcggcgacgcagtcgacatgcagcgatatccatgaccgtcatctgggtacctgtggatctttcgaagagcgtcagatcggtggtgagcgttacaacatcttttccgattgccccggtgccaagacctgcacgctcgtgcttcgtggaggagccgagcaattcattgcggaggttgaacggagtctgcacgatgctatcatgattgtgaagcgtgctctacgccacacaaccatcgttgctggtggtggtgcctgcgagatggcagtgtcgcattatctgcatgacttcgcccagcacgacccctccaagcagcaggccgtcatccgggcatttgccaaggcgctcgaagtgattccccgtcaactctgcgacaacgctggtttcgatgccaccgacattctgaaccgactgcgtgtggagcaccgcaaggagaatacctgggctggggtggactttgacaacgagggtgttcgggacaacatggccgcttttgtgtgggaacccagtctggtcaaggtcaacgctatccaggccgctgtcgaagtcttcaccacaggcgtcgccggtgccgcactagaatat

SEQ ID NO: 5990 - DNA, 573 bp, A.fumigatus
  unsure (334),(340): Identity of nucleotide sequences at the above locations are unknown.
gaactccgtgtgctcgcggccctcgaagagcttcggatcaacggccttgatcacgtcgatggtgcggttgatgcgatcgtagaactcctcaaaggttttctcgttgtcttccatcggcacgatgtcggtgccggagaggcgggcgacggagttcttggatgtgttgctgacgcattgcacctggaagctcaacgggagcatgtctgggtagagacgggcctcggcgaactcggagagggggatgttgttttctttggcgtattcttcggcctttttgagcatgaaagtcagggtgtccaggcccttgaggtaggtggggacggtgtaggtgtanatcgangaggtcattttgactgcgtcttgagtggaagaccttcagaagtgagaattgagtttgtgatctctgttcctgttgttctttctttcgctatcgagatgctgggcttccggctcatttatacttcttccgactgccccgcaaacggatcatcatcagagccccgccgtcgatacgggtcgaatgttctcaatccatccggaggaacaagcaatggaatctccagtgcaacctaa

SEQ ID NO: 5991 - DNA, 540 bp, A.fumigatus
  unsure (36),(42): Identity of nucleotide sequences at the above locations are unknown.
aggtcttccactcaagacgcagtcaaaatgacctcntcgatntacacctacaccgtccccacctacctcaagggcctggacaccctgactttcatgctcaaaaaggccgaagaatacgccaaagaaaacaacatccccctctccgagttcgccgaggcccgtctctacccagacatgctcccgttgagcttccaggtgcaatgcgtcagcaacacatccaagaactccgtcgcccgcctctccggcaccgacatcgtgccgatggaagacaacgagaaaacctttgaggagttctacgatcgcatcaaccgcaccatcgacgtgatcaaggccgttgatccgaagctcttcgagggccgcgagcacacggagttctcagtcaagttgggctcgtatgagtcgacttttaccggcgagtcgtacgtcaatcgctttgggctgccgaattttttctttcatttgaacattgcgtatgccatcttgagaagtaagggggtgcctctggggaagtttgattatctcaagtattttaattcttga

SEQ ID NO: 5992 - DNA, 291 bp, A.fumigatus
atttccgtcccctcagcccttgtctgtacacctccggaccgggcccggactcgaaacccgcggtttttattcaatgccgtgctgtccaagattggtctcgatgggcggtgctcgggcaatgcgtacagctcttcgccatactggagtcatggcctgatggcctggttcttgacttgtgtgatgcagccgatgggcaagttggttgtcggccagaacaagtccatgcacgaggccattcggaagcgtgccttgcgtaaggcggagcgagagaaggggaagaagagtacttag

SEQ ID NO: 5993 - DNA, 237 bp, A.fumigatus
tatggtaaaactggaagacgccctgcgaaccaagtctggatcggctgtaccaagagggatgtctacagtggagcgtactctaacagatcttttcgttattcatccttgttgatagtcttaatcagtcttcggtcactatgtcctccaacattagaccttaattcacatgcagtcaccaacattagctgtcgtggtcagggtacgtacggcctgaaagccaaccaatgcccgccctag

SEQ ID NO: 5994 - DNA, 663 bp, A.fumigatus
tcgattgagtcagagtacgttgttaccggccatgctttctttaatgttactgcttatacaatcataggcgaaggttatataccaatgactgcgcggttgtcgcttctggaccagtcgggatcggagtctccatgggctgaagaacgcccagaggcagctacaccgtctcccgcttggcaaaacactcgaactgactctcaaaatatgtcatccatgcctcatgtggtccgtgggaatggctcgacatctcctttccagacctcatacataggcaatgagcctgggtactcttcacaatatctgcagcaagcagatcatgggtcgcttgctccaggaagcggcatcgaaactccttacgtgactgattctaccatgacgactccatcgtcacatgaacttatcgaagtcgatgagccctctcacgccggcgctgagcccactacacagcttctatcacggaatacctcagctgcacctgcgccaccattgccgcagccgccgaacgcagatgcaaatcaggccccaccactaccgttgagaaacgctgcattgtccgaatcagatgaacagcaacagaacgagcagagatccgagacatatacgatccgccatgtcaactgggacagaccccaccggggaaattgccagagtctcccgtcctaa

SEQ ID NO: 5995 - DNA, 297 bp, A.fumigatus
gcagtctgcgaaaatcagccaatataccccgttctaactagttgtccactctactactcgatttattgccttgagaagaacaagccatctgcggcttggaatttcatcaattcagcctcccatatgatccaagcactgggcctgcaacataacgtgcctgctggcacagaacagcccggagtcaaggctcagaacaggtccttgttctggaccatttacatcactgagaagatgctgtcgctgcgccttggatgttcatcgaccttccgagatcaggacatcactttggcccgccct

SEQ ID NO: 5996 - DNA, 408 bp, A.fumigatus
caactttcgatcttcgcaactccaccagacaaaatgctaggctatctccccctgttcgcgtcgctggcttccgccgcaaccctgtatgccacccactacagtggcgctgtttacaccctctccctcacccatcgcaatggcaagtacaatctgtctctcgcgtcggacatgaccacctgcggcggcatgccgagttggttgaccctggaccgcgacacgaccacgagcactctctactgctccgacgagacaggcgacgcgacgacaaatggcactctgacctcttacgccgtcggcaaagatggatcgctcacgcagctcgcaaaggtggttgacgttggtggtggcgtccacagcgtcgtgtacgaaggagaaggcggcgcaaagtacatcgccattgcacattag

SEQ ID NO: 5997 - DNA, 840 bp, A.fumigatus
  unsure (67),(81): Identity of nucleotide sequences at the above locations are unknown.
cagcagagaagctccggttcggcggtatcgacctttgccctccccctcgaatctggggacgagccantacagatcctgcgntaccagacaccaccaggcccccttccccagcaggactcctcccatccccaccagatcatcctcgatcctacaggctcgttcatcctcgtccctgacctaggcactgatcaggttcgcgtttacgcaattgacaagcaatcgggtcaactaaacacctgccccagcctcaactacacccccggcagtggaccgcggcatggccttttctggtcttcccaccactcgcatcgcgatggtctgcgcatccagaaaactgccgccctaaccgccccacacacaattctgtatacagtcagtgaattgagccgccacttccacgctttcgccgtctcgtacctcccctctggctgtctcggcttccgagagactcaggatttcgtgccatacccgggcggggaaatcaccgagggcgcatcgctggccgagctgcagcaagccggatcaaacttgtatgcctcgatccgcagcgaccatgccttctccggcaatgactcattggccaccctcaaccgctctcagaacggcaccgtgacctttcaggaacttacctcttcctatggcctggttccccgtacctttgtcatcaacagggccggcaccctggtcgctatcggggaccagtcctcttccaatgttgccattgtctcccgggatagcgcgagtggaaagctgggtgacctggtcgctaacctccaggtcggagagcccgggaagcccgggacttcaacaggcctgagcagcgtcatctgggcagagtaa

SEQ ID NO: 5998 - DNA, 1377 bp, A.fumigatus
  unsure (1365),(1366),(1371): Identity of nucleotide sequences at the above locations are unknown.
tcccagggcgcgggggtgtcgggggtcgggtcgctccagcgtctcctaacgcagggtcaactacattcagcaaaactgttggcgggttggacctcttgcacgggtggtcgggcgcttcgagaaaaaaagaaagaggagaagctgagggaggaaatagagcaagacttagtggttagttgcgctaccccagctgtcttttcggggccgtcgtcccttggaaactcgacaggactcttgcccgaagctgcccttcgtgagactttgtcgggtttcggacttcacaatatgactccggatgatgcctgggatttcttgaaggcgaagctgttggttatatttgacggtgaagacgtccgtatagcaattgaggacctgaacaagttggtcctaattcacattcaacgctgcgtgcagaagcacacgccaaccgccattgtcgacgatttacgagagctgctcgagacaggatgtgcctcgttaaatcatacactaaacggagtgcctgacgaaaaactggtgcctcatttggtgcagatatggctactggtttttggcaccattcttccatttattcaagctgtgtttttgccactcgatctagagtttcgaggcgcaggttccgtgatgaatctacgggaggcaaaggatttttggaattctgtaccgaccggcaaggactttgaaaatgaactcgaagttcgacacctggtcctggtggctttccgtgacatggtcattctaaaacgttatgaaggcttgaaggctacattttcgcgcttgagccttgatagcatcaatgtgggctcgtcggctctcagcatcacaacaaagagcagtaacaatagcggccgacctgccactgccgcttctctcgatgctggctttggcagctacaattctcaatcatctacgctcctcaatacggcgggcagttactcgtcggactcaatgagcaatcgcagccgtgctgcatcaaacacgtcgtccaatccagaccaacttatctttcagtccttctcatccccaaatcaacgcgcaaccgtcattcacagggcctcacatacggcagatacttcccaactcattaccgagacggtcgggcggatgctacaatgcctcagtgtcctggccagtgtgcagacaggtgatgaagcgcaagagaagattgagactctgagcaaagcactgaagcacaactggctcggacgcggacggacagggcgggatcgacgcgggtttgtcggagcgaaggttcggcccagtataacgacacacacgactagtgatgattctatgaatgatccgagaaatagcgatttaggctggtcttcaccacggggctgggaggttccgaagtctcagttnnagggnttcaat

SEQ ID NO: 5999 - DNA, 636 bp, A.fumigatus
agcccgggggggggggggggggggggggggggggggggggggggggggggggggggggcggggagggggggggttgcggggggagggggggggggggggggggggggagccgaaagcaagggatttcctacgggaaaagaattaagggtaataccgttccagcaaggcgagggggggctttcccgggttagaaggggggttaatcagggattggtaaggggggtggggcggggggggggggggggggggggtgggggggatgggggggtggagtgggacgcatctgtgaatccgggaagtacaaggggacagccatgcgggggggggggagggatgggggggagggggggaagcggggaggctgggggttggggggggggggggggcgggggggaggggagggatggtgcgggggagcgggcgtgggtgggtcggcgtggagcagttggaggccgggtgatcccagggcgcgggggtgtcgggggtcgggtcgctccagcgtctcctaacgcagggtcaactacattcagcaaaactgttggcgggttggacctcttgcacgggtggtcgggcgcttcgagaaaaaaagaaagaggagaagctgagggaggaaatagagcaagacttagtggttag

SEQ ID NO: 6000 - DNA, 375 bp, A.fumigatus
ccctgcgttaggagacgctggagcgacccgacccccgacacccccgcgccctgggatcacccggcctccaactgctccacgccgacccacccacgcccgctcccccgcaccatccctcccctcccccccgccccccccccccccccaacccccagcctccccgcttccccccctcccccccatccctcccccccccccgcatggctgtccccttgtacttcccggattcacagatgcgtcccactccacccccccatcccccccaccccccccccccccccccccccgccccaccccccttaccaatccctgattaaccccccttctaacccgggaaagccccccctcgccttgctggaacggtattacccttaa

SEQ ID NO: 6001 - DNA, 429 bp, A.fumigatus
ccactaagtcttgctctatttcctccctcagcttctcctctttctttttttctcgaagcgcccgaccacccgtgcaagaggtccaacccgccaacagttttgctgaatgtagttgaccctgcgttaggagacgctggagcgacccgacccccgacacccccgcgccctgggatcacccggcctccaactgctccacgccgacccacccacgcccgctcccccgcaccatccctcccctcccccccgccccccccccccccccaacccccagcctccccgcttccccccctcccccccatccctcccccccccccgcatggctgtccccttgtacttcccggattcacagatgcgtcccactccacccccccatcccccccaccccccccccccccccccccccgccccaccccccttaccaatccctga

SEQ ID NO: 6002 - DNA, 204 bp, A.fumigatus
gtcagaccccgatcgggatttggtgttttgagacttgatacatactttgtcctaggcagggtctctggcattgccggaggtggccgactgagagtactccgtgctctatggggtaaagtcgacaacctagagggtaggccggatgccatggataacgctgcggtgcgggacaccggtcatatccgtgtgaatgaacgacgatga

SEQ ID NO: 6003 - DNA, 630 bp, A.fumigatus
tacaaagcgcagttcatgctacagactttggctgaccaattgaaggaaagtgcaggtcaaggtactcgagacatcgccggcgctgctccctggacagggactgaaagtctccacgacgccaccctacgcatgttagatagctcaaagaagccaatgcgggtcccttacaagattcctcatcctgctccggttgacatgcgcattagtcccaaaccttcaaagtccccgggactccgaatcgccgatgcgaaagagcgcagcgccacctataccatgagtcaaaggcccgggatatcggaagacgagcgtgaagccttacgaagggagatgagcgagagattcactgctggtgcacggccgatgccgatgaccctacaaggattatcatctcttgcaaacgaacggatagaggatgcaattgcacgtggacagttcaacaatatcaagcgaggcaaaggcgtcaacgtccagtcagatcacaatgcaaatagcgcgttcatcgacaccaccgaatattttatgaacaagatcatacagaagcaggagattgtaccaccatggatcgagaagcaacaggagttcacgagggaggttggtcttacaccacggcggctcgaaggacatgcgtac

SEQ ID NO: 6004 - DNA, 243 bp, A.fumigatus
aggatgtgggcgaaggtgtttctttcctacgcaacttgcatgtctgtcactcaattgctcattcaaattctctacgcagggatcaccgaagtccaaataattcagtggtacgtcgaagaaggcgctcacatagaagagtggaagccactgtgccagtatcagtctgataaagcagtggatgatgtgagcaagttcttctctatcccgctatctacctatctgaccatctaccaatctagataa

SEQ ID NO: 6005 - DNA, 189 bp, A.fumigatus
gatataatgggcctcgaaaaacaaaccctccggatgggcaatggcaaagaccacccgcagcccggcgaccccgtcgagctcaactacactgggtatctgtacgacgaatcgaacccagaccaccataaagggaaggagtatgtgaccgccgtaaccaacactcatcggcagaggcgaaaagctagctaa

SEQ ID NO: 6006 - DNA, 231 bp, A.fumigatus
gaatttttggcgcgaggaggccggtttgtcctttcagatgatagccacgggctggaccaggtcggcttcaatttccacggggtgctggcgttcatggagaaggctggtatctcgactttgcattatctcgagctgggggatgagccggcggtggacgagcggtttccgcggacgcagatccggtcgatccatgtcagtgagctgaagaagatgtctttctggcaggtctag

SEQ ID NO: 6007 - DNA, 744 bp, A.fumigatus
tcacttgtgaaggtactcgggggcggttctgcttctcaggagggcctttctctctttctcgttggcttcatcatagaccaggaactcgtgcagggcgctaccggcgggaaccatggggagcacgggcaccttgcggtcagtgaagacctcaagcagagcgggaccatcgctctcgatcagccacttcagcttctcctccacctcagaaggcttagtgcagcgctcagcagcgacacccatagaccgagccatgggcacaaagtcagggttcttctggtgggtatgcgagtaccggtcctcgtaaaacaggttctgccattgtgtcaccatgccctgctcttcgttgttcagaaggaggaccttgacgccgatgttgaactgagcagccgtggtaagttcagtaagagtcatgttgaacgaagcgtcaccatcgatatcaatgacgaggcaatcggggcgtgcgaccttggcgccgatagcagcgggaaggccgtatcccatggtaccgagaccaccagaggtaatcatggtgcggggatggcgccaacggaagtgctgggcagcccacatgtgatgctgaccgacaccggtagtgatgatggtgcggtctttgatgggggcagtgagatcgctgagtttctcaatcaaggcctggggcttgatggggccctccgggctctgcttctcgtacagagaaaaggggaagcgggctttccagtcattgatctgagcacaccattgtga

SEQ ID NO: 6008 - DNA, 186 bp, A.fumigatus
  unsure (2),(3): Identity of nucleotide sequences at the above locations are unknown.
cnncggaagcgcgttaccttccagccgcgtggtgaagattcaatgctgggaatgcacggatctgcctacgccaacatggctatgcaggaagccgatttgatcattgccgttggcgcccgttttgacgatcgtgtgaccggtaacctctccaagtttgctcctcaggccaagtatggctgcatctga

SEQ ID NO: 6009 - DNA, 933 bp, A.fumigatus
ccggtaacctctccaagtttgctcctcaggccaagtatggctgcatctgagaaacgtggtggaatcgtccactgcgaaatcatgcccaagaacatcaacaaggtcgttcaggccaacgaggctgtggaaggagattgtgcccacaacatccgcctcctgcttcaccatgtcaatccggtctctgaaacatcacaatggtgtgctcagatcaatgactggaaagcccgcttccccttttctctgtacgagaagcagagcccggagggccccatcaagccccaggccttgattgagaaactcagcgatctcactgcccccatcaaagaccgcaccatcatcactaccggtgtcggtcagcatcacatgtgggctgcccagcacttccgttggcgccatccccgcaccatgattacctctggtggtctcggtaccatgggatacggccttcccgctgctatcggcgccaaggtcgcacgccccgattgcctcgtcattgatatcgatggtgacgcttcgttcaacatgactcttactgaacttaccacggctgctcagttcaacatcggcgtcaaggtcctccttctgaacaacgaagagcagggcatggtgacacaatggcagaacctgttttacgaggaccggtactcgcatacccaccagaagaaccctgactttgtgcccatggctcggtctatgggtgtcgctgctgagcgctgcactaagccttctgaggtggaggagaagctgaagtggctgatcgagagcgatggtcccgctctgcttgaggtcttcactgaccgcaaggtgcccgtgctccccatggttcccgccggtagcgccctgcacgagttcctggtctatgatgaagccaacgagaaagagagaaaggccctcctgagaagcagaaccgcccccgagtaccttcacaagtga

SEQ ID NO: 6010 - DNA, 429 bp, A.fumigatus
cccttcatgagcagagttatcagccggagcaacacagtcatcattcatcatccatcatccctcgccatggataaactccagctcactcttcacgcactccagcatcaaagcattcatttcctcaaactatacgctcagcacccctggctctacaccgcagcatgcctcacagcctacctcactctcaccctatccctccgcttccaacgcctccgcagcatccaagcgaaataccacaagtactcaacccgggcatccttcgccagcatgaccgaccacgacgcctgggcgattcagaagcgaatcctccagctcgagttcccattcaccgcgctgaaagccctgcagtttgctctcttccgcgtactcccccccaaagctttccccgcgtgttcaccacgagcgccggatccggccatagtgggggga

SEQ ID NO: 6011 - DNA, 1242 bp, A.fumigatus
cggatgaagatgtgtgtccggaagagttacccatgcgacactttatttgtcctgtccggcgtctccatccggctggcacgcaaaatgggactccatcgcgatggttcacttctcggtctctcgccgtttgacgcagaaatgcgaagacgactatggtggcatttggtccatgtggactttctgctcgccgatgtgctgggaaccagaccgtcaatggatatctcctgcgcggacaccaaaacgcccctcaatgtccatgacgcggatctgcatccggacatgaccgatctgccgcctgaacgccacggcatcaccaatatctccctttgcctcatcagataccagatcatggtctctttgcatgatttctcaacatcttcccctgccgatatgcgctgggaagtattacttgggcccaatgtccctcccgccaaaaaggaccatatcatcagccaaatcgaggatcatctagaacaaaagtacttgcggtattgtgacccggcaaacccactccatactttcgtatccatcatcacccgattctccatatgcaagatgaagctcgttgctcataacccacgccaattcgcctgcagtcccccgaaagatcttcaagcggagcgcgatatcgtattcgccaacgccacaaaactattggaatatgtcgccttggtgcaaggcggccattgcggtctggagaaatacacaaggcagatcggcacaagcgcactgtggaacgcaatgctttacatgctgatcgaaattcgacatcgcggaaccgggccggaggtggaccggtcgtggcagttgatcggagtcgtgttttcctgccctcggatctttggcagaacccctccccaggtggacacggtgcttcgcaagtggacgctggaggtttgggaccactatgttgccacttcgaagattgaagggctgccagaaccattgacgcctgagtatatcaatgaaattcgtcggtggatcaggtccagaagcgatctatctcgaaacgaaacgcgggctgcggaacgtgatcctgttgctgaaccttcgttccgctgcgcccaagttacatacgaaggacatgaaaggcttcctgggtttccggaactcttgactcttacgagtttaatgacattttgtctttcgagatggacccgaatgaatggatccagtgggagcagttggtcgcagggggggccgctcctgagtgcgcgtatacatgctctcgagaaagactag

SEQ ID NO: 6012 - DNA, 270 bp, A.fumigatus
ttcgggcagtatgccgctgtgatggggatcaggaaggacctcaaattagttggcaacgatttttccaatgcggcgacttggttcttcattgcctacttgatcgcagaggctcccctcggtacgtttcatgcatccgacgatgtttgcatcctactcatctccgcgacgttctccagtaattcttctgcaaaagactcctccagccaaatggctcggagcaaatgtctttctctggggggttgctgcggcggccggtgcgggcacccgtga

SEQ ID NO: 6013 - DNA, 1317 bp, A.fumigatus
tcgcagaggctcccctcggtacgtttcatgcatccgacgatgtttgcatcctactcatctccgcgacgttctccagtaattcttctgcaaaagactcctccagccaaatggctcggagcaaatgtctttctctggggggttgctgcggcggccggtgcgggcacccgtgactatcccactcttctggtcgctcgcatcttcctcggcatctttgaggcgacggttggtccttctctgatgttgctgagcagtcagtactacaccaaaagcgaagcggcgccccgattcacgctgtggtatgtcggtctgggggtggcacagatcctgggtggtctgatctcctttggcttccagcatgtcaagaatccatccttccaaggctggcgcgtcatgttccttgttctcgggctgatcacgtccattactggcgcactgaccttcttcttcttgcccgacacgccgatgaaggcaaagtggttgaccgaccgcgagaaggtcgcccttttgaaccacgtcagcgtcaaccagaccggggtgtggagcagtgactttaacataaaacagatctgggaggctgtatgcgacattcaactgtggttcatcacgataatcaccatgctggtatgtatgctcgcttgtccgattggccccgccaatttcccgatcactgacaccagtatcgcgcagatctccgtctccagtggagtggtgacctcgtactcggcaaccttgattgccggattcggcttctcgggcccccacgcagcgctgctcaatatgccctcaggcattgtgagcatcttcttcactctcctcgtcggctttgggatccgccgagtctcccatcgctgggcctggctgatcgcctccaccctccccggcatcctcggtggcggtctgctttccttcctccccaagcacaacaaagcaggtgttctcattgggatttacctcgtcaatgccatcgtcgccactctcccgatcctgtatcaatggacggcggccaactgcgcgggccataccaagcgtgcgtttgccagtgcgctcgtggccggctccttctcggtcggaaacatcatcggccctcagacgttccaggcgcgagatgcgccggaatatcgcccggctaagattgcagtcctcgcgacgcaggcggcggcagccgtgctttcgttcgtcctcttcctctactatgtgtgggagaacaagcgcagggaccgtgctgcacaggggcagcaggaggatcaggcaccggatgacaccaagtgggccgggttgaccgatcgccagaataaggcgttcagatatgtctactag

SEQ ID NO: 6014 - DNA, 579 bp, A.fumigatus
caacagcaggaatggcagactgcatccatccccttgcataatattggcgcaagacagactggcggaggcaacgactttacgagagacagaatgggacgttatatttatttgagaagaaatgattcacaaagtaatatccatcccaagcctgtcgtagggtggaaggtttgtccttacaccgagtcgatttcagtgcgctctactcgttgtcctatgactcccagtcagttaatacgagaagaagccgtctggagattctccctgcccagagtcttgtcaacgcctacgacaatgttggagacgacggagccaattgcgcacgccagcgagctggacaaacccagcatcgttgtcacgaacaccgaggtcgacagcgaggataacacttcctccgttctgggccgctatataccacagaaatgcctccagaacgcaaggctcgcagctgtaaactcgtgtgtcaacgagatcttcgaggctcgcttccgggagcggcccgacgcccccgcggtctgtgcctgggatggcagctacacttaccgcgagttgaacgacagatcatccgctcttgcccactaa

SEQ ID NO: 6015 - DNA, 378 bp, A.fumigatus
cggacgctagagccagtaccgattccagggaatatagacaccaccacatacggctttaccccattgtgtttagcagcgaagaatggtcatcctgcgggggttcgactcttgctcgaagagggcgcaaatcttattcttccagacaaaaacggcactactccactgatgcacgccttagcagaagggcatagcgaagtagtgtatctcctacttgaagcaggcgcgcaaaaggagagcactccgttagaagtcgcggttgagaacaacaagaagtctgcgattcgaaatcacttggcgcacggcgccaattacgatctcctggccagggagtcctctttatcatggacaatcaataacagagatcaagaggctgtctaa

SEQ ID NO: 6016 - DNA, 219 bp, A.fumigatus
ctgatatgcccatgctcctgcagtgtcaccactcgccgtccacacggaacgctgtctccagcccagcatatgcaggctcccgaagccaacgtcgcttttgagagcatgacatggatagtatccatggaaacttatgctcgaatgtctccgagcactatttatttctacttgcagctgcagcgttgcttcacaggcaaccaagagaggaagctacattag

SEQ ID NO: 6017 - DNA, 408 bp, A.fumigatus
ttgacggcgacactttgcaggttcatctccctcgttgcagcagcatgcatggttctctatggttacgatgcgtccgtctacaactctgtccagggttccaagaactgggtcaagttctttaacgacccagatgagaacatgattggcgcagtcaacacggcctacaccgtgggtgccatcttcggcggtttcttcttgggtggtcccattgccgattatctcggccgcaagattggtatgggcgtcggctgtgtccttgttattgcatccaccttcatgcagacatggtccccacgtggtaacatcggatgcttccttgctggccgtcttatcatcggtatcggacagggtattgccttgagtgagtatcctttgccaatggagtgtattttgtcgtgcactaactga

SEQ ID NO: 6018 - DNA, 402 bp, A.fumigatus
ctcaccagttataccctctcttggagaggatcttttcaatcatcttggcggatagttcgtgtaacacggctttgtatagaatctgaaaagaggatggtagagaagtatacaccaggtgcccaatcgcagtctctcgtccttgtcagccaagccctagactgtcgtagggtgcttgtcgtattatacacgacacagatgctgaaagacaataccctgcccagaggtcccaagagacagatatatagccttcgtgaaggatcaaggagagatggcgcccgaggtgatagaaacgagcaagagccagcccattatattagaccatgggacactcacgcccatggccgcatccttgtgaacactaggaaaaaagcacccgggaacagtccaatcagcatcgattga

SEQ ID NO: 6019 - DNA, 480 bp, A.fumigatus
tggattctgactcgcagtcctggagcgagacacaatctggcccattcatattcccttcctgtcactatccaggagcttggctcgctaggtactggcccggaggaacatgttgataaccccctggctacgactctgtcactgccaatgaactatggcccatcttttacaggcctcgagacgctgcgtatgaatatagctgcattgtacggcagtgaatcagaggcggtcatatcccccagcaacatcatcactacacctggtgcatcgctggcaaactttatcgtgttctttgccctggtcggacccggagatcatgtcattgtccagaatccaacttaccctcagttatactctctaccatccggtctgggtgctgaggtgagtctctggcaagcaagcgagagtaatcattggcagcttgatttggacgaactggagcgcctcatccagcccaataccaagatgatcgtcttgaagtaa

SEQ ID NO: 6020 - DNA, 642 bp, A.fumigatus
cactctgtctccgtcagcaacccccagaatcccacaggcgccatcattaccaagtcagccctggggaagattgtcgacctggcccgccggcactccatcaccatcttcagtgatgagatctatcgcgctctgttccactcaattccgtcgacggacccggaataccccccttcggtgctcgcatttgggtatgagaaaacagtggtgacgtgctcgctctccaagaccttttccctcgccgggattcgcgtaggctggatcgcttcccacagctcttccattatcgatctctgtctcaacgcccggtcctatacggtcatcacagtcagccagatcgacgagcaagttgctgccatggccctcgagccggttcgtctgcgagagttgacgaaacgcaatctgggtctggccacgcacaacatcgagattgtgcagtcattcattgaccggcatgctgcggtctgcgagtgggttcgtcccgccgctggacccgtcgggtttgtcaaattcagccgaaacggcgtcccggtcgatgatctggaactctgcgtccttcttctcgaaaagaagggcgtgctactcgtgccggggcaaaagtgctttggagaggagtttaagggttatggtcttcaccgcgggact

SEQ ID NO: 6021 - DNA, 414 bp, A.fumigatus
ccggtcagctatgatatcaaacccatcattattgaaaaccgccgctgggatccgctcaccggtgtcacctccgcagccgtaggcaccggcactgacttgctcaaaagtaccacaaacatgttctacaaaccgtacaaagaactcgcccggaataaaactgatgttgcccccgatggcgcagaacgtcatcccgttgtcaccgccggggccatggcgggacagtttgcgaaaagcttcggacagttcatgggatcgtacgccaagggtgtcattgtggatattccgcacgcggcagcggaaagcttcaggcaggtcccgcgcctgtatggcgaacaacccaaggactacggcgctgtgcaggattggaattccggggctacggttgggggaaagaactttgtggatggcatgatg

SEQ ID NO: 6022 - DNA, 432 bp, A.fumigatus
aatatactcataagtatagatgtgtgtggcttcttcttccggcaacccccgtcgtaccaaccgccgccagatctcgagcaattccttgcttcaggcccaccgcctgtgtatatcggctttggaagcatcgttgtggacagcccgcaacgcttgtccaatacagtgttgcaggcagtggctgcgtctggtgttcgtgccatcgtgtcacgaggttggagcaaattggctggagacgggaatccaaacatctacttcatcggcgactgtccccacgaatggctgttccagcacgtttcagcagtcgtccaccacggaggtgctgggactaccgcctgtggactggccaacgggaaaccaacagtcgtcgtacctttctttggagagtgggtttgcattcctccgtatactgggcaagagctcattagtatgtag

SEQ ID NO: 6023 - DNA, 768 bp, A.fumigatus
atgtgtgtggcttcttcttccggcaacccccgtcgtaccaaccgccgccagatctcgagcaattccttgcttcaggcccaccgcctgtgtatatcggctttggaagcatcgttgtggacagcccgcaacgcttgtccaatacagtgttgcaggcagtggctgcgtctggtgttcgtgccatcgtgtcacgaggttggagcaaattggctggagacgggaatccaaacatctacttcatcggcgactgtccccacgaatggctgttccagcacgtttcagcagtcgtccaccacggaggtgctgggactaccgcctgtggactggccaacgggaaaccaacagtcgtcgtacctttctttggagagtgggtttgcattcctccgtatactgggcaagagctcattagtatgtagtcaacaattctggggcaacatgattgcaagggctggagcaggcccatctcccattccacatgctacacttagcattcggaatctggccgaggctattcgattctgcctgaagccccagaccgttgctgctgcgcgtgaaatcgccgccaaaatgcagtttgagtcgggcgtcactgccgccgtacagtccttccatcggcatcttccgctagagcagatgaggtgtcaggtattcccagaccaggtttctgtgtggaaatacgcaaggcacaagcgggagatccggctatcaaggaaagccgtgcagattctcatcgaccacttaaagattgatccaaagaatctccgctggtga

SEQ ID NO: 6024 - DNA, 846 bp, A.fumigatus
tcagaacgcggagtctatatagtcgctaacacgcttcgtcaaacccagggtattgtggtcacattcaggcactggagagtcatcttctggctgttgaccgcactgaccggtttcgccgtcctgttaatcatcattttcctcccagagaccattccgtacaaatcaaaggccgagcttgcgggccacagtcatccgaagaggatcaaaatgctgtggcagcgcatctcacccttacgtgctatcattatcccattatcccatccgaatatcttcattaccggcctagcagccggcgctctagtctggaaccaatactctctgttgacgccaattcgatacgttctcaacccccgctttcatttgtccagcccaatccgagctgggctcttctaccttgcaccaggctgcggatacctggccgggaccttcgtgggcggccgctgggccgattacactgtgaaaaaatacattaaaaaacgcaatgggcagcgcgtgtcggaggaccgactccggtcctgcctcccatacatctgcatcgttacaccaggctgtctcctggtttacggctggacactcgatcgagaagttggtggcatcgcggtgcctgtggtagcaatgttcctgcagggcgtggcgcaaatgttctgtttccctagtcttcaatcctactgtctcgatgtgatgcaaccgcatggccgcagcgcggaagtcgtcgccagcagttacgtctttcgatacgtgtttgcggcaattggtaccggcgttgtcttacccgctactcagtcgcttggtgtcgggtggttcaataccatatctgccctgtttctggtattcgctggtgtttag

SEQ ID NO: 6025 - DNA, 189 bp, A.fumigatus
ccgagtaggtgtcccatcttccatcgtctcggcttccacactcacaatcatccgcagtgggaattctacttctacaatgtcgttttcggcctgttccaagccccctactacgctgtacgtagcaccacatctcccagcccgttcgaaacgagactaacctgtcccaccccccgggaaatgcacacgtag

SEQ ID NO: 6026 - DNA, 234 bp, A.fumigatus
gggcggatccttgtcgctcccgtggtgaagacatcgtgcattgccatgctcggtgagaacgaaaagccagatgtcacttacgccgacgtcggtggattggacatgcagaagcaggagatcagggaggcagtcgagctacccttgacgcatttcgacctttacaaacagattggtgagtcggagtcatcgagggcaatgtctagtgcggtttgcttacgctactcaaggtattga

SEQ ID NO: 6027 - DNA, 774 bp, A.fumigatus
cgcatttcgacctttacaaacagattggtgagtcggagtcatcgagggcaatgtctagtgcggtttgcttacgctactcaaggtattgatccgcctcgtggtgttctactttacggccctcccggtactggtaagacgatgttggtcaaagctgtggcaaatagtacaactgccagctttattcgtgtgaacggttcggagtttgtccaaaaatacttgggagaaggacctcgtatggttcgcgacgtgttcagaatggctcgtgagaactcacccgccattatcttcattgatgaaatcgatgcaattgctaccaaacgattcgatgcccagactggtgccgatcgtgaagttcagcgtatcctgcttgagctcctcaatcagatggacggcttcgaacagacaagcaatgtgaaggtcatcatggccaccaaccgagcggatactctggatccggccctcttacgtccaggtcgtctggatcgtaagattgagtttccgtcgctgcgtgaccgacgggagcgtcgactgatttttaccacaatcgcatcgaagatgtctttgtccccagaggtcgatctggattcactcatcgtacgaaacgagccactctctggtgctgttattgccgccatcatgcaggaagctggactacgtgctgttcgcaagaaccgctacaatatcatccagtctgaccttgaggacgcctatgctgctcaggtcaagaccggccaggaagcggacaggtatgctcttccctgcattccaatctat

SEQ ID NO: 6028 - DNA, 330 bp, A.fumigatus
ccatccttgggcgatctgggcgggtccttcgcccctcgtggagaagactcagcgggtgaaaatcccgtcaacctccttccacacctgcagctctttggcatggactccgactgcaacaagcgcggcgcaaagatctgtgtaaccacgaccaacttgatcaagaagacccccaggtacagtcccgaagaatccagtgaccaccggcacccttccttcgcaatccctgatctttctgccaagaacagtagcaagattgttatagaagtcctggtcgaggccttgacttccgatagggaaatcaatcacttccgccagatccacatattgtga

SEQ ID NO: 6029 - DNA, 585 bp, A.fumigatus
ttaaatagactcctgcgagcagcccgtgatgccgaaaacgcccagtcgcacgagtatgtttccttggtggaggcagttcggctcgaacatgtccaggttgttgagattcagataaaatctgaacccctcagaacccagttaatttcagagatcaatggcgagtgcgaaagggtcctgaaggtccttgaggctgcgcaaacgctcggggagataagtgcgcgttgtgtggacaaagtcatcagtacaggagagaaacttagctgccggttgatggctgcctttctacaagaccgtggtgttgattcacaatatgtggatctggcggaagtgattgatttccctatcggaagtcaaggcctcgaccaggacttctataacaatcttgctactgttcttggcagaaagatcagggattgcgaaggaagggtgccggtggtcactggattcttcgggactgtacctgggggtcttcttgatcaagttggtcgtggttacacagatctttgcgccgcgcttgttgcagtcggagtccatgccaaagagctgcaggtgtggaaggaggttgacgggattttcacccgctga

SEQ ID NO: 6030 - DNA, 294 bp, A.fumigatus
aaactactccgtaggtgctccgctttcgcaacccccgccaagttatttaaaaaggtgtccctgctccccgcgccgattacaggaccactatcatacatgttgaattcttgcatttgcaaggcagcgtgttcttgtcatactcgacctagcagtatgggagaccaagtacaatctgattcgagtccctatactctgtcaatgaccaatggcagttcaaactgggtagtacagaaatttgggggcaccagtgtcggaaagtttgccctaaatatcattgatcatgttgtgctgtaa

SEQ ID NO: 6031 - DNA, 477 bp, A.fumigatus
tatttctgggtgaaatcaatcttatacgccatggccattctgcataatgagaatcggcctcgtggactgcgagttccgtcgctttccgccttcaagtccaagaaagctattgatcacgagccagctcccgctgccactcctgtttctactgctccttcggctgctgctcctgcgcctccagctcccgtcgctcctcctcagtaccccgtccgaaccgactctgcccccattcgacctgcacgaccacagaatgacaaggagctacctccgaatccactgcccggtttttcttcccacatcggcatccctagggccggaggatatccacccagcccttcagaaatgaaccgtcagctgcgcggaaccacaattatgcacctcctaccagagcccgcgacgaaccaccagtccagatcccgactcaacagacctcttccagcgagagctcagtaccgccagatgcaggcgacccattag

SEQ ID NO: 6032 - DNA, 666 bp, A.fumigatus
cggcatccagaccttgttatcaatattcccacaatatccaatcggcattttctaatattcagcgagaacaagaacggcgattctgtcgcaattgtggaagatctgtccagcaatggcaccttcgtaaatgatgccattatcgggcggaacaagtatcgcgagcttgaagatggagatgaaatcaccatcctggatgaagcgcgattcgtttttagatacccccggacgagagacacgaacggtttccgccagcagtatcgggtgcttcagcagctcggaaaaggtcattttgcaaccgtttacttatgcgtagaacgggcgactggcactcaatatgccgttaaagtgtttgagaggcgtcctggagattctcagaagtctcaaaacgagtccttgcagcaagaaattggtctcttaatgggggtcaatcacccgaatcttctgtgcttaaaggataccttcgacgaagctgatggcgtttatctcgttctcgagcttgcacctgagggcgagctctttaatctgattgtcagcagacagaagttttccgaagaagaaacccgccacatctttgttcagctctttgagggtctgaaatacctggtaagatccttgttcattggattgcaatctacgctaccagtcccagcggaaaagaagacttga

SEQ ID NO: 6033 - DNA, 300 bp, A.fumigatus
gatccttgttcattggattgcaatctacgctaccagtcccagcggaaaagaagacttgaactgattcaaacacagcatgatcgtggcatagttcatcgagatattaaacccgagaatatacttgtggcagacaagaagctgactgtgaaacttggtgactttggccttgccaagatcatcggcgaagattcattcaccacaaccctgtatgtgctgcctctctttcttcagatcgcttttttccttttgccttggctgatccttttattcacagatgtgggacaccaagttgtaagttga

SEQ ID NO: 6034 - DNA, 183 bp, A.fumigatus
atgtcgctccagagatcttacaggagtcccgtcgtcgaagatacaccaaggctgtggacatctggtcactgtggagtcgttctatacatatgcctttgcgggtttccgcctttctcagatgagctttacacgcgtgaaaacccctttacattggcacagcagatcataatgggcccgatttga

SEQ ID NO: 6035 - DNA, 579 bp, A.fumigatus
cttaacagtcaattcattataataattactatcgacagcgtgtttgttcttatcgcatgtgtggattccacccttatctgcgtgcattattgcttctccctgcccttttttatccctgctgattttctcactctctgttatctgcggtcttggcattgcagcacccgcacaccacccgcttctgccagtttcttatcatcaaatctctcccgatcttatcaccccatcatcgtacatcttccctcccaatccatccactatcaggcctttcattcccacccattctcctcttcctcagtcactttttcgcacttttcgcaatctcataaaattatggcgacaaccttgactgaccagaagcgccctcaattacagcctgtctgccagaattgtggtacctcgaccacgccgctctggcgaagagacgaactcggctcggtcctttgcaacgcttgtggcttgttcctcaaattgcatggcagacctcgtccgataagcctcaagacagatgtgatcaagagtcgcaatagagtcaagaccgccggtcaaggccctaagcgtaaggtgagtcttggatga

SEQ ID NO: 6036 - DNA, 759 bp, A.fumigatus
ggattgctggattctaacatcgcgttattccagtcaagcagtgccgtagatgcgaatggccttccgacctcgaggtccgaagacggcacaccacctttgggatcgcagggttatcgtcgcgcatcgcgaaaggcgtcgcccggccattcggatcggtctaattcaccagtgtcccggactgatactcccggagtttctgccttgcaacaacaacaacaacatcaacatcaacacacctcgaacattgcgccccagcacatgttcgacagtgtcaccctcgccgaccatactttgaatcaacccaatggcctcccctcccttcagctgcatcaaccgtctccgacatcgacctcttctgcagcggtagatcgtcatgccgatgcaccgcagacatacgagggacttcttgcagcaaatgcatcattgaagacgcgcgtgagcgaactggaactcatcaacgggctttttcggggccgcgttgcggagctcgaacagagcgacgcgaccgcacgccggtccgagatgatcgtccgagattcggaagcacgtcttcgccggtctctcgaagaagcgcagcgtcgagaagaagagctcaaacggcgtgtgagtgaccttgagcggcagttagccgaccaagccaactcgaataattcggcgaacaacgacagccccggcgaacccctgtccaaaaagataaggttgtccgacatggtagaacagtcctcagcctcaccaacgaagtcgccaaagagcatataa

SEQ ID NO: 6037 - DNA, 204 bp, A.fumigatus
ctgccgctcaaggtcactcacacgccgtttgagctcttcttctcgacgctgcgcttcttcgagagaccggcgaagacgtgcttccgaatctcggacgatcatctcggaccggcgtgcggtcgcgtcgctctgttcgagctccgcaacgcggccccgaaaaagcccgttgatgagttccagttcgctcacgcgcgtcttcaatga

SEQ ID NO: 6038 - DNA, 399 bp, A.fumigatus
ccttctccgtcgtcaacaccggcggcagtccttgaaccctctgcttcgcatcctcaagcagctccacttccctctcgcgctgcttcttcaccgtcggaatcgaccacgaattcgacgacgcagatttgtacgccagcttgtacttggaccccgtcagatgcgtctcgtacgtgttcgcatccaccttcttcacatgctgatgcgccacaatcagccagtggtactccgtcccgacgggggcgccgctcccctccggcgccttgcgggctcgccgcttgttggtcctgtagtcgatccgccacagatccggctcttctttggtttctttccaggtccctgcgtcgtaggtccaggtgtgggatccccccaccgccatacccgagtacacctgtcccttga

SEQ ID NO: 6039 - DNA, 522 bp, A.fumigatus
tgtctggctaatcgtctgcagaaccgattgagggacatccgtacatctcccctgagcacatcatccagcgtccgaaggtggtctacagtgaggagtcgaataaatatcttgtatgatcatcctctcctactatatgcgtctgctaacggacaccagatgtggtggcatgcagataattccacttacggctggctattgcaaggatttgcaacttccgacaacatcactgggccgtatacttttgttgatgccacggcaccgctgggcaactggtcgcaggattttggactcttcaccgactacaaggatggccgctcctatgcgctctactcgaacggcgacagcaagtacggacgcgacgtctaccttaccgcgtacaacaagaacgtcagcgcgctggaggaggtcgtctaccgattcccaaagtttgacctggaggcgccgaccattatccagacggagaagagttactggctcttcaccccgggagccggaaggaaccgcgcatgcgttaggaagcaa

SEQ ID NO: 6040 - DNA, 420 bp, A.fumigatus
atatcttgtatgatcatcctctcctactatatgcgtctgctaacggacaccagatgtggtggcatgcagataattccacttacggctggctattgcaaggatttgcaacttccgacaacatcactgggccgtatacttttgttgatgccacggcaccgctgggcaactggtcgcaggattttggactcttcaccgactacaaggatggccgctcctatgcgctctactcgaacggcgacagcaagtacggacgcgacgtctaccttaccgcgtacaacaagaacgtcagcgcgctggaggaggtcgtctaccgattcccaaagtttgacctggaggcgccgaccattatccagacggagaagagttactggctcttcaccccgggagccggaaggaaccgcgcatgcgttaggaagcaac

SEQ ID NO: 6041 - DNA, 201 bp, A.fumigatus
gtggtgaagacgggaagcttggtgtctgattatgacgtcgatcatgagtgcatgtgtaaagccaatacagcatgtaacagcatttattacatgagtgcatatatgttactcgagattaccgtcacagcgcgtttgcgggatgacctgcgaaatttggagttctccaaagataaaaattgtttttttgcatttaatgcgtaa

SEQ ID NO: 6042 - DNA, 765 bp, A.fumigatus
tttattgacgtgaataactcgatccacaggacaaaaacaactccccatcccataaaccccccagcacgcgataaagtcgaaatgggctggctctggagatcatcaccctcgaaggaggagcctcaacagatttcctctgtgccttctttctccgacaatgcggcgccgcagccatcacccgcagcagaggcaccaggcaccatgccgtcatcatcgcagtctcggcccttgagtcgcaaggaacaagcggatgcagagttcaaccagttactagagagcttgaaggccgacgtatcacgaaccaaatcaccacagcagtcgtcgaatgtctcagaaactcccctgtccccatcatcaccatcaccttccggccctccgcaacctccatcttcgatcgcccccgagtctctctacccggactccatgtcctgccgctctgcttttgattacgcgtttttctgtcagtcgtttggaggccagtttgtgaacgtataccgctacggcgagctgcggtcgtgcagcgaacactgggataatttctggctctgcatgaaggcccgtggaatggcggacgaggagcgcaagaaagtcattcgggaccactaccggaaaaaggccatcaagtacaagacgggcccgagcagtgaagatgtctgggaccttcgaagggagccagtgcagcatgctttccagggtgactttgaagcactggagagggagatgaaggccgaggaggaagcaagtcgcaacgctggtgggatatag

SEQ ID NO: 6043 - DNA, 1575 bp, A.fumigatus
gcccccacaccctcgcgtttcttccagcccgggctgaataccgccgttaccggacggggcattgttgcccgtcacaaggagtacgccttctaccgaccatctgccgtgtctattgctcgggtggtgatggatttccctgctatcttctgcatggttgtcccgtttacgattatcatgtatatcatgacggggctcgacgtgaccgcttctaaattcttcatctacttcctgttcgtgtacacgagtacattctccatcacttcattgtaccgcatgttcgctgcgctctctcccactatcgatgacgccgttcgcttcagtggcattgctctgaacatacttgtcattttcgttggttacgtcattcccaaacagggcttgatctacggctcgatctggttcgggtggctcttttatgtgaaccctatcgcgtacagttatgaggccgtcttgacgaatgagttttccgatcgtatcatggactgtgcaccatctcagctggtgccccagggtccgggtgtcgatcccagatatcagggctgtgctctccctgggtctgagctgggtcgcagaggcgtctcgggtagccggtacttggaggagtctttccagttcactcggagccatctgtggcgcaactttggtgtcgtgatcgctttcactgtactgtatcttatagtcacagtcctcgccgccgagttcctttccttcgtcggcggtggtggcggtgctcttgtctttaaacgatcgaaacgtgccaagaagctggccacccagaccacccagggcaatgatgaggaaaaggttcaggacgtcggtgacaaggctgcgttgtcgcggggagaggcgatgtccgcaagcaatggcgaatcatttaagcgcatctcttccagcgacagaatcttcacctggtcgaacgtcgaatacacggtaccttatggcaacggaaccagaaagcttctaaatggcgtcaacggatacgcaaagcctggagtcatgatcgctctgatgggtgcttcaggtgccggtaagacgacactccttaacaccttggcccagcgtcagaagatgggtgtggtgactggcgattttcttgtcgacggtcgtcctctgggcgccgatttccaacggggcactggtttctgtgaacaaatggatcttcacgacaacacatctaccatccgcgaggctctggagttttcagccctgctccgtcaggacaggaacgtttccaaacaggagaagctcgactacgtcgaccagatcatagatctgttggagttgaatgatatccaagacgccattatcggttcacttaacgtggagcagaagaagcgggtgacaatcggtgttgagcttgcagccaagcccagccttctcctgtttctggatgaacctacgtctggtttagacagtcaagctgcgttttcgattgtcagattcctgaagaaactctccctggccggacaggccattctgtgtaccatccaccagccctcgtcgatgttaattcagcagttcgatacgattctcgccctgaacccgcattcggccacggaatggaaggaccgcgtc

SEQ ID NO: 6044 - DNA, 195 bp, A.fumigatus
agacgtggccaaacctcgattgttgctgtggttcgtatctgggtcttctcgtttggtgttttctgcatcatgggtggtctttattacctgctgcagggctctacgggctttgacaatctcatgaatggtaaaagctttagccgaagcgtgaaacagagatctctcgaggacttcggtaagcttaccatcagctag

SEQ ID NO: 6045 - DNA, 777 bp, A.fumigatus
  unsure (106): Identity of nucleotide sequences at the above locations are unknown.
gaaaggtctactgacgcttctagcaagagaagacgttctattcagtccaaaccacttacaaactcagcggcgcccgcggaggacgttgagcaggatgatcgtgcgnatgagccttcaggaccgacctaccgtaatagagatcccttcgacgcctttctcgaacctttctactataacaaatcacttacggacccaatcaataccgccaaggataaatggaacttgttgccggctttcctgaaagtgaagggattggtgaagcagcacattgactcatacaactactttatcgaggtgcaactgaagaagatcgtcgagtccagctctactatccgtagcgatatcgatcataccttttatatcaaatttacagatatctacgtcggctcgccgtgtcgtgcggatgagccccaggatgtaacccccgatgctaccccgtcggacgtttcgccgcacgagtgccgcctccgtgatacaacctatgcggcccccattctggtaaattttgagtacattcgtggacgtcaaagggtaactcggaaaggcgtgtcgattggcagaatgccaatcatgcttcgaagctcaaagtgtgtgttggctaataagactccctcagagatgacggtgttgaacgaatgtcctctggaccctgggggatactttattgtcaacggtacagagaaggtcatccttgtccaggagcagttgagcaagaacagaatcatcgtcgaaaccgacccgaagaaggaaattgttcaggcgtccgtcacgaggtaa

SEQ ID NO: 6046 - DNA, 339 bp, A.fumigatus
gactcgttatcttccagccgcggctgtgaagacgtcgaataccgcgcgaaatactatgagtacacaatcagagcgatgctccaggctgtgggcgtgtcgacggagaagttgcgcttcgtcctcggtagctcttaccagaagagccccgaatacgtgatggatgtgtacaaactgtgctcgctagtatcggagcatgacgcgaagaaggctggcgctgaagtcgtcaagcaatccaacaacagccccctcagtggccttctctaccccatccttcaggtgctggatgagcagcacctggactgcgatgttcagtttggaggtgcgcttcctcggctatga

SEQ ID NO: 6047 - DNA, 381 bp, A.fumigatus
gcgagacggcctggagcctctcgtctaccacgatatcaagcagatgcaagaagattacaagaacgatattgtatgtacaggagcaatctgcagcgcaaggggttatctggcccggtactgacttctctacagttgacaccgcaattgctcaagcccgctgtggcagaggctctcgttgagcttatggcccctatcatcaccgcttttgaggcctccaaagaatggcaggagatcacattgaaagcataccctcctccggaaaagaagaagaaggagaagaagcaaaaggataaaggaaaccgctaccctggggctaagactgctgagacagccgagctcccgctccgggaaattggagtccaagaacctacagcagattaa

SEQ ID NO: 6048 - DNA, 303 bp, A.fumigatus
tcccccgtagagagcaagattgatcttctcgaggccgccgatactgtgagaaagaagatccgcaaggcccaggctgctcccaaggaagtcgaaaacaacggtgttctgtcctttgcagaattcgtcctgcttcctgcttccgccctgaagactggccgcccagaattccgcgtcagccgtgagcgagacggcctggagcctctcgtctaccacgatatcaagcagatgcaagaagattacaagaacgatattgtatgtacaggagcaatctgcagcgcaaggggttatctggcccggtactga

SEQ ID NO: 6049 - DNA, 717 bp, A.fumigatus
aaaaattggcgctcgttcttccgtccccgtggtgaagacgagcggggctgggtggtgtacagtaactggggcagccgggagggcaaaggcgggcaggtgtttggtgtgaatgcgggcggcggtgatttccccggtgcgatgccccgtcccgacgaggacgagagtctgctccaggatgtgcaggggggcaatcggtgggctgcgctgacgttctgctggtcggcgctggagcgccaagttcgtatcgaggggctggtggagccgctcagccgcgaggagagcgagttgtattggaatacgagagaacgcggcagtcagatcggggcgtgggcgagctggcagagtaaggtgctgtggtcggcggagcccgagacactggttgaccggcgacggaagagcgttgcggccgcagcgcacgttcagggctcgacacccacgtctggatgtcctgagattccggccgacattgacgagacggacattgatgatgggagggctctgcttgagaagcgggtgcaggagatggaggcgcggttcgcgggagtagagaagatccctcttccgccgttctggggtggtgtgcgactggtacccgagtcggtggagttttggcaaggccgacgcagtcggttgcatgatcgcttccgatatgtgagagtgaaggaatcagatgatgactcgtcgttccaatggcagattcaacgactttcgccatag

SEQ ID NO: 6050 - DNA, 261 bp, A.fumigatus
agaaggtcgatgaagatggccacctccgttgccgctggctcgggcaccgagaacagtggaggcttcaacacgtttggaaatgccaaagtcggaaatcttgataccgcccttgttatccaccagaatgttggcacccttgatatcacggtggatgatgtctcggctatggaggtaggaaagaccttccaatatttgacgtacaaaattcttgatcagcggctcttggaaggtgttgtactgtttgagcatcgtagcaattga

SEQ ID NO: 6051 - DNA, 864 bp, A.fumigatus
ttttggaccccaaaaaactggatggaggattctttgattggtgggggatcttctgtaaggttcttccttgctattcagccaatcactggagagctcatggctttcaaacaagtggaaatactttcggggacgaagggtactgagtttgacaagcgcaagaacagcatggtgacagcacttaaacatgagattgagctgttgcaagggcttcaccatccgaatatcgtccagtatttgggcacctctgcggacgatcagtacctgaatattttcctggagtacgtccccggcggttcaattgctacgatgctcaaacagtacaacaccttccaagagccgctgatcaagaattttgtacgtcaaatattggaaggtctttcctacctccatagccgagacatcatccaccgtgatatcaagggtgccaacattctggtggataacaagggcggtatcaagatttccgactttggcatttccaaacgtgttgaagcctccactgttctcggtgcccgagccagcggcaacggaggtggccatcttcatcgaccttctctacagggaagcgtgtactggatggcgccggaagtcgtgcgacagacagcccacacgaagaaggcggacatctggagtttgggctgccttgttgttgagatgtttattggggcccatcctttccctgactgcagtcagttgcaagctattttcgccattggtagcaacagtgcaagacctccggctcccgagcacgcgagcaaagaagccatggccttcttggacatgaccttccaagtcgattatgagaaaagaccctccgcggatgagctactgcagagcccatttttgtctgcaccgctggcgtga

SEQ ID NO: 6052 - DNA, 264 bp, A.fumigatus
tatggctcgttccagcgaccacctttcttcgacctccaccccatcactctccgcaggcccagtttcccctggttcttcattattattgttgcttcacttctctcgttcaacaaccccttccttttacttatactcaataattttcccttcatagtactttattttcctagaatagttatttgtctaccttttttcacaccgcccttgagcttgcttgggattatctaccgtggtctcggtcatcctctgctcgtggttgactga

SEQ ID NO: 6053 - DNA, 225 bp, A.fumigatus
tcgatcatcggtgatcctgcatccttggtccttattggcagttatttgagctttaatttccggatgttccacctccaatttaagttcggtttgctcatttttgtgtgggttatttttgcggtgatgaatactaagtatgtacggagtacggagtactgtgtacagagaaagctccctcagccaccgctttaccaacctctgttgttattatcaaatgcaccatga

SEQ ID NO: 6054 - DNA, 1464 bp, A.fumigatus
cgcggtagtggtacctcccgggagtatcgcgatgggcgatactacgaagagagaaagccagccgatgcggctttctttgaagatgattataggtacaccgaggagccgcgcccaatgtcccggaagtacgacgagttcgaacggcgacgaccccggacgaagccgaccgaggagaagaagaagtccaaggcggttcccctcgatcatcttcgcacggggaaagatacggctcgtgagagtgttaaatcgacccacaccagtcgggccaaataccgtaccaaggaacggcggcgggaagcttacgagaagcttgaacgggcgggaccgtactacgattccgaagacgactactccgacgcttcgacttccagcgcgtcatctatctatgtgaaagttaaagtcaagcgcccatcggagtcgagaaggagtcgcgactcgacctcgagaaagaccaaatcgactgattcaagccgtcgctctgagcgtgcacggtacgatgacgacgatgactattcagatgaatgggactccaagcacgagaaattacacacaaccgcacaggattatattcttcgctccaaagctgctcctgtcgagagcgatcggagacgtcggtcgtctcgctcacccgtccgccaccatggttacgagtgtgcggaacccgagccatcaacgtctcggcgtcccgtccgctccagccgttcgagccggaaagatgtccgccctgcagcatcccgcaacggatcctacgaacatctggagtctcagtcccgcagctacgagactaagagacccagtatgccaacggctgccacttctccgagtatcaaggtatcctctagcaccgtccggccgtctctccaatcttcgcgatctgcatcgagtgcacaatctcagtctcgttcgagacgagagcctcctagtcgggtagaacaagttctcctgaacatggttcgatcatcggtcaagccaaggggcgtggagagatatgattcgggctattcgagccccggtactccagaaatggcatcgggggatagcccgaccaagacctccacgcgctacaagatcaaagagcaagacgcgacggtggtcgaaccggtcatgccgccggcacccaccagctcgtcgagacacacaagagcgtattcaccgccacgcgcagaacgcccttccacctcaactcgatccgcaccgaaaccggtacggagtagcaccacctatgcctatccttctgaaccgtcgtctcgtcacgaaagcacccgtccaagtgcgtctagacagtcctcatcaagactcttcggcgaagtcgaatatagcgcgcaatttaaggagaaggacatcaagtatgtccgcgagatcaggcccgagcacattgtctacacccgagatgcctatcctcgccagcactacgacgaatatcgtcagccaccggcgccacggcgccagtccacctatgcttaa

SEQ ID NO: 6055 - DNA, 267 bp, A.fumigatus
agttcttcgcgagtttcccatatccggcccctcggtaaggcgtggagacaggccacaatgaaggtcccgcctttctctcacttgagatttgatcttactctacccaaagcgaccgaaggacgcaatcactcctttcagaaagtgtactgggacattggcaacccccaaggcgacacactcagcgttgaggcacgggttgttatgaatctagtcgtcaccattgccaccgtcttcaccagggggctgcaaggagccgctctattacta

SEQ ID NO: 6056 - DNA, 207 bp, A.fumigatus
ttaatcagcgggccccgaactagtctagcccctttacagtccatcccatatgccttggctgctggacacggtcagcatcctcacagcctcacaggattagggacaactacctcacattgtcaagaattaaacactacaagaagaatcaaaggagtagtcatgaccactgaagtgatcgtcaatcgcacactatccttcggggtgtaa

SEQ ID NO: 6057 - DNA, 264 bp, A.fumigatus
accgcgattttggaactcgttgcctggctcggaaccttcatcaacggatatttggccgatgctaccggtcgtcgcgtcacggttgtcattgcggtggttgtgttttgcgtcggcgtcattgtccaggcatgtaccaagaacccggaatacatctacgctgggcggttcgttacaggtctgggcgtgggtaacctcagtatgattgtgcctctgtacaatgcagaactggtatgttccaaggaccgatatgaagatcatgcctga

SEQ ID NO: 6058 - DNA, 318 bp, A.fumigatus
attggttacgggacaaactacattggaggaactggcgaagggcaatccattgctgcctgggagatccccgtgtgcatccagatccttccagccctagttctggccgcgggaatgctcctcttcatgccgcagtccccgcgacacttgatgaaccaaggacgggaagaggaatgcttacagactctggccaggcttcgcgatacctccgttgatgacatttcggtccgcatcgagtttctcgaaatcaaggctctacgcatgttcgaggatgaagtcgctcggaagatcttcaccagggggctggaaggatcaacgatc

SEQ ID NO: 6059 - DNA, 333 bp, A.fumigatus
atcaccagtaaattatggaacacacaccacgaacccgaacacgtcgagggggcgctcgatcaaacactccgcgatctccaagtcgactatatcaatctctacctgatccattggccggtttcgtttcggtactcgacaacaacgaatcagcctgtggatgctgaaaccgggctggtcgatgtcatcgacgttccgctcaaggatacctgggctgcgatggagaagctcgtggacaaggggaaggtgcgctccattggagtgagcaatttcactcggcagcggattgaggagttgatgactacgtatgttttccgtaactttgtcgcgagatga

SEQ ID NO: 6060 - DNA, 246 bp, A.fumigatus
ttgcaggtgcgtagggctcgtattccacccgctgtcaaccagatcgaagcgcacccctatctccagcagagggatttgctcgagtggtccaagcaacaggtgtgtctgtgcctgcatgccgcaaagcatggagtgtacattgctgacggagtagggaatcgtcatcaccgcttactcgcctctcgggaacaatatctacaacatccctcggtgagtattcgacaaccacacaatgctcccagctaa

SEQ ID NO: 6061 - DNA, 192 bp, A.fumigatus
cgacccagggctgtcgatgatccaaccgtcattcaggtggccaaagagctaggcaaaacgcccgcgcaggtgctgatcagctgggccattcagcgcgggacatcggtcgtgcccaagtcagtgaccgcggagagaatcaaaagtaatctcgagggtaagtgtggaccggattcaatgaaggtacaccactaa

SEQ ID NO: 6062 - DNA, 345 bp, A.fumigatus
aacaagggaagagtatcacagccatgtggcgtggaacaatgccagtcaagccccacgaaggtaaaaaagcccgtcggcacagctttgaaagctgaatacggtcacattgacgctgcagccgtctacggcaatgagaaggaagtcggagagggaatcaaattatccggggttccccgagaagagatctttgtatggggaccgtctcaattcctcctgactgcgctgactgcaattgctagatcaccagtaaattatggaacacacaccacgaacccgaacacgtcgagggggcgctcgatcaaacactccgcgatctccaagtcgactatatcaatctctacctga

SEQ ID NO: 6063 - DNA, 1020 bp, A.fumigatus
agaaaagagtttgtcaaaaattctccggcgttccaggtacacaagggcgtcttcgatgtatgcaaaacaatcgctgaaatcaccatttacactgcttcgcgctcgcttcaaggaaaagaagttcgaagcaaatttgattccacattcgcagagttgtaccataaccttgacatgggtttcgctcctatcaacttcatgttaccctgggcccccttaccccacaaccgcaaaagggatgctgcgcagcgcaaattgaccgaaacttatatggaaattattaaggcacgtcgtcaggctggcagtaagaaggattctgaagacatggtctggaacctcatgtcctgcgtttacaagaacggcacgccggttcccgatgaggaaatcgctcatatgatgattgccttgttgatggcgggtcaacattcttcctcttctactgcttcctggattgttctgcgccttgcgacacggcctgatataatggaagagctatatcaggaacaaattcgtgttctcggatctgacttgcctccactcacgtatgacaatctgcagaagttggatttgcacgcgaaggtcatcaaggagactctacgcttgcatgcaccgattcactcgatcattcgagcagtgaagaatcccatggctgtggatggtacttcatatgtgatcccgacatctcataatgttctctcttctccaggcgtcactgccaggtctgaggagcacttcccaaatccactcgaatggaaccctcaccgttgggatgagaacattgcagctagcgctgaggacgacgagaaagttgattatggctacgggttagttagcaagggcaccaatagcccgtacctcccgtttggcgctggacggcataggtgcattggcgagcaatttgcatatcttcagcttggcacaatcactgctgtacttgtgcggttattcagattccgtaatttgccaggtgtcgatggcatccccgacacagactactctgtgagttatccttgtccaatctaa

SEQ ID NO: 6064 - DNA, 219 bp, A.fumigatus
cttgtcctcttcacactatgtagtcaagcactccgctacatcatccgcaacactaccctcccccagcgtgtccgtgcccaggctcagctgcagcttagtcaaatgcacgcctacaccaggccgacgcagatcaagaacagatgtgtagcaggaggaatcgccaggagtgtgatacgcgatttcagaattgccagagtaagtgatttcattgcctgttga

SEQ ID NO: 6065 - DNA, 483 bp, A.fumigatus
tggcgtgccctgaaactcaagacttatttggaatcagggcgatacgactcattctcaaacatcactcgaaactccctgcgccatgccctggcagagcacggtgaaaagccagagaaagatgtcattgacgagattctaagggcttacgacagcctatccacctttccagacgttccgtccgctttgggccagctggcccatcgtcctgagatcactgctgtcgtcttttcgaatgggacgcaagacacggttaccaactctgtacaccactcccccgacttgtcgcctcatagggctgtgttcaaggaaatcatcacagttgatgaggtgaggcagttcaagcctgctccagcagtgtatgcccatcttgcccagacgataggaaaattgccctcctcacagatggcggacctatggctggtcagtggaaacccattcgacgtgatcgcgctaggagttgtggtatgcacgccatctgggtag

SEQ ID NO: 6066 - DNA, 480 bp, A.fumigatus
gtctttcgaagcaagaaacaacagtcctcgcccctcgtcaacctgcctactgagatcctggttcagattttttcctacattaacttacacgacacaattgccctatcaacaagctgcaaatacctcctcagtatcctctctttcgcagccttccctggagactttttgttcaagaaactccctgacctggcacctataaagctgatcctgtttctcttgggactcttgtggccaagggaaatgaatggacgtccgaaaaaaggtctgcgttactgcaatgcctgtcgtcgtatctatccagaaaagagacagtactgggaggagaaattgtcgatgaagatcagcagggatttcttgaaccgcgattgccctaagtgctatctcggccacaaacgaacctatatgtgcctttgccatgccgcatttattaagcgttgggagcagatttgtgccgagcatatcggctggttcggcaactag

SEQ ID NO: 6067 - DNA, 1569 bp, A.fumigatus
cagtgcgtttccttccagccccgtggtgaagattcctcatggatcagcataaactatctgccattagtcaacgctcctcccttacaattggtgattctgcttggcaaggattcggatgggactttcgatgcggtaccggaaaggcagcagcgagaagggaatggtctcgaaactgcaatccgaaaatttagaacggcggcttacttatggcaagcgttcaccgctgagcagatgttccgtaacaattttgggaggcggtgtttccgcttcgaggaggagtggcagacaggcaccctaagccgtcgtgatgcgaccgatggcttgatgcggaatgaggccaaggttcatgttatccgtaccgataagacagtagcagaactccgtgcgcttgatatcgctcagcagcatggtcctgccactaggaaagatgaactgttcaatattgcgaaggaagccgtgaagaactatttccgaccaaaggaggggcaaaagcagtatgtttcagttttgcttctggactctcactgggacaagacatctaaaacaatcaccggccacgctgcgctgggatcgagtggggacaacatcaagatggcgatattcggctcccactgtctccagagttacccatcttgccttgaggaagtggtggaagctttctccgactgtactcgcaccaacaccgactttgtagcaaacgactgcggagaggcgggctcgagctgggaagcagcgaatatcggtattggagctcacctccacgaagttgggcacctcttcggatgtccgcaccaggaatcggggatcatgctcagggactatgtccgtctgaatcgttctttcacaactcgcgagcccttctcgacacgaaccaaaacccagggcctgaagctgtgtctgccgcaggacgaatgtggctggcaccgactcgatgcattgcgcttcaggttccatccatgtttccgcctgccttcagacgcccccgtgagctcggacgatagcgtgcaggtgtggcctgtcgaaaacgggaagattttgttcactgccccctccggcatcgctttcattgaactttatgctgagggggaggatgtgtgccataactttattgagtaccttaacagcgaatccagcagtaacgggctccccaaacaggtaattgtaacggaaagtgaactccgacaacggttgttcggcaacgagaaagagaacaagaaaaatgtcaaattggccgtcttctctggtgcgcttggaagctataccgttgagtctatcgcttccttgaagtccaaactgtctctagtgaaattgccgaagggccagtctgggtacaagagcggcaagcttggtttctctcaaatggacggtagtcaaccagagcagctgctgctggattgtgcattcgtgtcaaccaaacttttgacctcgatcaagatctatcatggactggccctcgacggactcgaattctgttacgaagactctactagccagctcttcgggaagcgagggggaaagcccggtggtgatgagtttgtacttggtaggcacaaccattccccagtgtga

SEQ ID NO: 6068 - DNA, 360 bp, A.fumigatus
cctcgatcaagatctatcatggactggccctcgacggactcgaattctgttacgaagactctactagccagctcttcgggaagcgagggggaaagcccggtggtgatgagtttgtacttggtaggcacaaccattccccagtgtgataaccaatctctgaccctctcatcagacactaggcggggtgagatactgctcggtttttacgttagggctggtgcctggatcgatggaatcgagattttgacaagcttaggccggagatctggaattttcggcaacgctcggggaggctccgggtacctgttgcaccttttcccatcctccaattttcgtaagacgcgcgcatcctgggtctaa

SEQ ID NO: 6069 - DNA, 207 bp, A.fumigatus
aacatactgcttttgcccctcctttggtcggaaatagttcttcacggcttccttcgcaatattgaacagttcatctttcctagtggcaggaccatgctgctgagcgatatcaagcgcacggagttctgctactgtcttatcggtacggataacatgaaccttggcctcattccgcatcaagccatcggtcgcatcacgacggcttag

SEQ ID NO: 6070 - DNA, 1509 bp, A.fumigatus
gctgcgtggcggttcatcatgaacggaccatttattccaaccaagaacccttctcagcccaagggctctgggccttctctcctggcttgtcttctttgccgccataagcatcttaaatgtgacggggtgacccctgtttgtggccgctgcgcagccacaggggcagagtgccagtacactccttctcgtcgtgggtataaaggaccctccaagaaacggcgcgccaacccgtcgtctcccgaacggacaccctctgatcaatcgtcttcgttcgactttcagtcggtcgcactactggatactccccaggattggagcgttccggacggactttcttacattttcccaaacggctttgcctcttcaggctcgaatggttccattctcaacaacgacaaggcactagtgtcggactctgcgccggtcagcaacggttgccctctcactcctgattcggtgaattctgtcgctggtgatgggtatctcatcgatatttactatacgtactttcacccttcgcatccgattcttcctccgcttcgtatactctatcggtctcatgtgccgccatttctcgagcatgttatcaagttcatcggttcccactttacccccgccgcaaatagtgaggtatataggccctccgtgatgtcatcagcgatggagcaagaaagctccgtggagaagctgcaggcgctgctgctgctggctgttgtgctgcattcgcgaaacgagcgggcagaagccgggcaatgcctcgctaccgccgtcgatctggctttcgaactcggacttcatcgtcaggatttcgccatttccatgggcagaggtgatccgatacgggaagaaagtctgcgacgcacttggtgggagctgttcatagtagaaggcatgttgactgccctgggtgtccagcgtaccttccgtaccagcctagtaccactcgaggtcggcctaccgtgtgaggaacgcatcttccaggatggattggctgctccaccgcctcctaccattgctcaatttgacgaccacatttttgccgacgaggagcgagatttttcctcctacacttatcggatcgaagctgtccgaatcctcgggcgggtggttgctatccaggaaatgcttgagggtcaagaagaccatgtggaggcggtcgacgcgcgtatcaacagttttttccaccatcttcccgaatcgaaagccgagttattgcgtccagatgggtcggtggacgagatgatgttccaggcgaaaatgatcgcgaacggagcgagtgtctatctcaacttcccacggtctgacctattatcgtcgcctgcggttgctgctgaggtcatctgtggacatcatggtccctgcagcatcccggccttcacacacaatgatcatgccatgaaagctctcaaggcagccaaggacatctcccagttagcctccatccgactaccagttgtcaaacatacacccgtcttcaccacggggcgccgaaggatccgcgatatgcgc

SEQ ID NO: 6071 - DNA, 279 bp, A.fumigatus
gctggtacggaaggtacgctggacacccagggcagtcaacatgccttctactatgaacagctcccaccaagtgcgtcgcagactttcttcccgtatcggatcacctctgcccatggaaatggcgaaatcctgacgatgaagtccgagttcgaaagccagatcgacggcggtagcgaggcattgcccggcttctgcccgctcgtttcgcgaatgcagcacaacagccagcagcagcagcgcctgcagcttctccacggagctttcttgctccatcgctga

SEQ ID NO: 6072 - DNA, 465 bp, A.fumigatus
cgtcgtgcaccgtcagcggctttgaagttcttccgcaccttggtcagcctgcaagatacgttctatcaggcgttgatgacgcacaataacaccttcgggctgatcctggacattgtctacgaaactatgcctcgcgacaacctcctcaactccgcatgtcttgagctcttcgagttcatcaaacgagagaatatcaaacctattgttcttcacattgttgaaaaataccgtgagaagatcaaggatatcacttatgttgacacctttcagaatttgatcctgcgctacgagcagatgcaaggctatggagcagaggcagactcaacccttttttcacaagaagaggaagctcgaaaattacaggcgaatggtcaacgctggcaaggggtcaaggagatggatgctgctgaagaggaatacttcaacacatccgacgacgaggatgaggtaagatgcgcccaatag

SEQ ID NO: 6073 - DNA, 222 bp, A.fumigatus
cagggatcttgcttgaaatttaataagtgtggggagctagcacaagcccacgctattgaaacccaactaaatttctctcaagaatggacaggacacgaacgcacccaaggtacgggtttgggaatctttattattcgcgtggaacagctcctcgacgcgttgtcatggacctctacgggagtagtccacatcattaccctgatttcgctcgccaatgtttga

SEQ ID NO: 6074 - DNA, 219 bp, A.fumigatus
cccacaagatgctatcggatcttcagatctttgtcaaagttgagagccacaatatccgtaaattcgcacccactagtgactgagcaagtgggctgtcatcaccccatgagtgactcccagtctagtccctacacatgtcagaagaaagtcaaactgtctaagtgcatgccgacccactatggcattgcctcctatgcaacgactgcggagattgtctaa

SEQ ID NO: 6075 - DNA, 363 bp, A.fumigatus
agcttgactatctgttctattattttcattagagactcttacgcgcgcatatcaggactatttaccctgacactgggacaaaaggtcaagggctccttcaaatccagctctctggttgccctgaagagaagtagggatcaacagacagggcatggacggatattatccgcaattagcggcaatgatatcaccggcaccggaatctcttcatggcaagctgctaccaaatacattgcgactggatgtaggagtagaagacagaagtacacatttctaagagtgatttatttcccgatattccgaaaacgcagtttcttaagaagcgatgtctttatcagtgagatctctcaaaccgagcagtaa

SEQ ID NO: 6076 - DNA, 243 bp, A.fumigatus
tcacactcttggatggatcttcaatcatctgctaatacctgttttgagcagatattctacaccgcgcaaacggctcttgcgtacagcgtcggtcgtgttgcacatggcctggcgaataatagcttgaccgacgcccaacgggctgcactgtcccctgatgatccagagtaccgagccgcgtatgtagatctacttgtgcagggcaccgaggtcgatgagcgagctcacacgtctacagggtga

SEQ ID NO: 6077 - DNA, 267 bp, A.fumigatus
caatcgcactcgccagacgcctgccaggccgccgtctccgacccgatcatctgggcctcctttgcctccaacgtgtccaccgatatctatctcatcttaatccccatccccatgctctggaaatcccgcctcaaactcatcaaaaagattgccgcgaccgtcgtctttggcgctggactgttcgtcctcgtgtgcgcgatcctgaagagcgtgtttgtcttggtggtgagtcgtgatgtcacatttgccacttcggccgggagctaa

SEQ ID NO: 6078 - DNA, 810 bp, A.fumigatus
  unsure (360): Identity of nucleotide sequences at the above locations are unknown.
cgggtaccgtggtttagggtagctgccgtagaagcatgccgctgggccactcgttgtattcctcgagcaccttatgtgacgtctctctcatgggtgtcgcactatggttgcaagtatgtcgttcatggagatgatattacatctgacagcaacggggaagattgctatcgatttgtcaaggcagctgggcgctttcgggttgtgaagagaacccctggcatttccaccaccgatcttgtcggccgtatgctcctatgcaccaaagggcactttataaagagcgtcaaagacacccttgcgggagtagagggatctgacaatcaggaagaaaggaaacaattcggtgtggagctaatgcanaggattcgggactatgcaacagatgagagtggtttgcgccctggtcctcaggtttggacttggaccggctcgaggccggcgaaggttagcgacacagttgaggaagctggtacatttgaaactctggtgaatggcaaagcaatcaagccagggcagcgggtagtctacgtggatggaggcttcgatttgttctcctcgggtcacatcgagtttcttcgacaggttctagagcttgaggagttggaaggccgccaacgaggatggtatgactcggaacaagtcgaaaagagacttcacgaatttggtgaagactattccccggcttatgtggttgccggcattcatgacgatgatgtgattaatcactggaagggattcaactaccctatcatgaacatttttgagcgggggctttgtgtccttcaatgccgagtatgtcccttttcttaa

SEQ ID NO: 6079 - DNA, 186 bp, A.fumigatus
attccttgtcaaggtataactggggtattgttggccaatcggagtactcctttatacctatggaaggtcgagagatttagccagactgagactcccacgcaaatatacacgaccggtttttttccctctaaaaaaaagggttactatacgtaccctgacgcagctcgggatcctccaacacgttga

SEQ ID NO: 6080 - DNA, 345 bp, A.fumigatus
cgattctcccagtatattcatgcagttattttctctgctcccttctctcctagccagccctatttggaagctatgccatttggtgttccggatgttgtttatcatggaccaacaaccttcattccgctgacatacgatccttacactgctcccaaacgaatgggcatatttaggcagataaacgatcatccttttcagcatgtgaatgctggtgagattgttgataggatactcagaagccgcgaggcttatgaagagcgacaacgcgctaagctacagaaggccatcattgaagaacaggtcaaatcagaagaaaagagtctggctggggaacttggtgcatag

SEQ ID NO: 6081 - DNA, 258 bp, A.fumigatus
  unsure (17),(25): Identity of nucleotide sequences at the above locations are unknown.
acggctttccaactgcngcatgccntccatgcccgatttctctcggaacagacaaggtcggcaattgacaaggctattgcgtctgcacctgtcgtcctcttcatgaagggtactccggagacaccacaatgtggattttctcgagccagcatacagattctggggttgcagggagttgacccgaagaaatttgtcgcattcaacgtgttggaggatcccgagctgcgtcagggtacgtatagtaacccttttttttag

SEQ ID NO: 6082 - DNA, 480 bp, A.fumigatus
cgggcacagtgcggttccttccagccccgtggtgaagacctggctgacctgcgcgtcgtcgaggaggatgccgtcctcggtgtcttctgtcggcggtggggtgtcccgctcatcgacggcgggacggtacggctgcaggcgattgtggggttgggacgagctttggatctgattctcactgggcggggggtcggggcgcgcgaggcgctggacatggggctggtgagtcgggtcgttgcgagggggaaggcggtggaggaggcgatggtgttggcgagggacttgatgcggtttccggagaggtgtatgaatgttgaccgggggagctgctattatagtgcgtatgccgcgggatcgatggaggatgcgctgcggagggagtttgagatggggtccaaggtgttggcgacggagagtgtgcggggggcgacgaggtttagggatggggaggggcgacatgggcgctttgagaagttgtag

SEQ ID NO: 6083 - DNA, 222 bp, A.fumigatus
atatcgctgcagatatccgctaattcgagcgacaccgacgccatctggaaccagcaacgattgatgttggatttgagtcatcgctccactgccggccccaacgctaacaccgcctctatggcgggagcttctttggtggagatcttcaaacactacgctagtattattatgactatgatagatgagagtgagacatcatggacactaattgtttcatgctga

SEQ ID NO: 6084 - DNA, 486 bp, A.fumigatus
gaactcctacaacttctcaaagcgcccatgtcgcccctccccatccctaaacctcgtcgccccccgcacactctccgtcgccaacaccttggaccccatctcaaactccctccgcagcgcatcctccatcgatcccgcggcatacgcactataatagcagctcccccggtcaacattcatacacctctccggaaaccgcatcaagtccctcgccaacaccatcgcctcctccaccgccttccccctcgcaacgacccgactcaccagccccatgtccagcgcctcgcgcgccccgaccccccgcccagtgagaatcagatccaaagctcgtcccaaccccacaatcgcctgcagccgtaccgtcccgccgtcgatgagcgggacaccccaccgccgacagaagacaccgaggacggcatcctcctcgacgacgcgcaggtcagccaggtcttcaccacggggctggaaggaaccgcactgtgcccg

SEQ ID NO: 6085 - DNA, 210 bp, A.fumigatus
acgagtccgttgtactgcaggatgggaatcgatgcaacaacagtactagaagataagaactcctacaacttctcaaagcgcccatgtcgcccctccccatccctaaacctcgtcgccccccgcacactctccgtcgccaacaccttggaccccatctcaaactccctccgcagcgcatcctccatcgatcccgcggcatacgcactataa

SEQ ID NO: 6086 - DNA, 813 bp, A.fumigatus
tcctccacaatggctcccaagctcaacatcacccacatcggcacggcgacggctgttcttgaaatcgatggcgtcaacatgctcactgatcccttcttctctcccgccggctcctcttggcccgtcacagagacgataacgctgcaagtgagcgacgatcctgctctccgcctcgatcaactccccgtcatcgacgccgttttactcagccacgaagaccacgttgacaacctcgatgagctgggtcgccgtctgctcgacggccgccgcgtcttcaccaccgtggacggagccaagaacctgtctccgcgccctggcgtccacggactcaagccttgggagaagatcgacaccgtcattgccggaaagaagttccagatcatcgccacaccgacccagcacattgctggagatgagtgcactggcttcatcattaccaacgaggaattcggacgcggccgggatggtcttcccaacgcgatctggttcaccggggacaccgtgtacattgatgagctgaagaaggtcggggagcagtaccatgtcctcgctgccatcatgaacttgggcaacgcctacggacccgtcgacaagacagaccccagcaagggcgcctgccagatcaccatggacggcaagtctggcgcgcggttgctccgcgacgtcaaggcggatgttcttgtccccatgcattacgagtcctggggccacttcacgcagttcggaaaggagctccgcagggactttgaggaggagggtatccttgataaggtgtgctggctgacacctgggaagcctgtttctgttctataa

SEQ ID NO: 6087 - DNA, 297 bp, A.fumigatus
ttccagaatttttgtctattgctggaaaaaaaagctgtaatcaacatccctgtacctacagtgggttttcttttctttctttttcattttgagacggagtttcactcttgtcacccaggctggagtgcagtggtgcaatctcagctcactgcaacctccgcctcccaggttcaagtgattctcctgcctcagactctcccgagtagctgggattacaggcacccgccaccatgcccggctaatttttgtatttttagtagagatggggtttcaccatcttggccaggctggtcttga

SEQ ID NO: 6088 - DNA, 210 bp, A.fumigatus
ttctcctgcctcagactctcccgagtagctgggattacaggcacccgccaccatgcccggctaatttttgtatttttagtagagatggggtttcaccatcttggccaggctggtcttgaactcctgacctcaggtgatccacccgcttcggcctcccaaagtgctgggattacagttgtgagccaccgcgccggctgggttttcttatga

SEQ ID NO: 6089 - DNA, 219 bp, A.fumigatus
attattattattgctatttttaagacagggtctttctctgtcacccaggctggaatgcagtggggcaatctcagctcactgcaacctctgcctacctggttcaagcgattctcctgcctcagcctcccgatagctgggattacaggcccccgccaccacacctggctaatttttttttttttttgtatttttagtagagatgaggtttcgccatgttag

SEQ ID NO: 6090 - DNA, 333 bp, A.fumigatus
catggcgaaacctcatctctactaaaaatacaaaaaaaaaaaaaaattagccaggtgtggtggcgggggcctgtaatcccagctatcgggaggctgaggcaggagaatcgcttgaaccaggtaggcagaggttgcagtgagctgagattgccccactgcattccagcctgggtgacagagaaagaccctgtcttaaaaatagcaataataataattcataagaaaacccagccggcgcggtggctcacaactgtaatcccagcactttgggaggccgaagcgggtggatcacctgaggtcaggagttcaagaccagcctggccaagatggtga

SEQ ID NO: 6091 - DNA, 255 bp, A.fumigatus
aaccccatctctactaaaaatacaaaaattagccgggcatggtggcgggtgcctgtaatcccagctactcgggagagtctgaggcaggagaatcacttgaacctgggaggcggaggttgcagtgagctgagattgcaccactgcactccagcctgggtgacaagagtgaaactccgtctcaaaatgaaaaagaaagaaaagaaaacccactgtaggtacagggatgttgattacagcttttttttccagcaatag

SEQ ID NO: 6092 - DNA, 1314 bp, A.fumigatus
gtgaagaccagcggcattgatgtcaaggccattcataaggcggcctatggataccccgagattgaagaggcggtggtggggcttcgtacactgtacgccggcaagaagatcattgtcggccgggatcgactggacagtgttcgcggtgtggcccagaagctgcaggcatttgaacagttcctggagaggtatccggagtggcgggagaaggtggtactcatccaagtgaccagccccaccagcgtggaggaggagaaggaggacccggagaacaagatcgccagccagatctcaaatctggtgtctaccatcaacggccgcttcggctcgatcagcttctcgcccgtcaagtactacccccagtatctctcccagcacgagtactttgcgctgctgcgtgtggccgatgtgggtctgatcacgaccgtccgggacggcatgaacacgacgagtctggaatacatcctctgccagcacaacactcatggtccgctcattctctccgagttctctggtacggcgggcacgctgtccagcgctattcacatcaacccatgggacacgaccggcgtcgctgaagccatcaatcgagccctgacgatgtctccggaggagaaaaaagcgcagcacgtcaagctctacaagcatgtcaccacgaataccatctcgacctggtcaaaccacttcgtcacccgcttgctgaccaatctttcctcctttgaccaatcggtggcaacgccggcgctagaccgagcgaagctgttgaagcagtaccggaaagcgcgcaagaggttgttcatgttcgattacgatggtaccctcacccccattgtcaaagacccgcaggccgccatcccatcggaccgagtgctgcggactctgaagacgctggcagcggaccctcgcaatgcggtttggatcatcagtggtcgcgaccagacgttcctggatgaatggatgggccacatcccggaattgggcctgagcgccgagcatggctgcttcatccggcagccgcggtcggatgactgggagaaccttgccgagtcaagtgatatgggatggcagaaggaagtgatggaggtgttccagcacttcaccgagcgtacgcaagggtcgttcatcgagcgcaaacgggttgccctgacttggcactaccgtcgagcggatcccgagtacggtgccttccaggctcgggagtgccgcaagatgctggaggatacagtagccaagcggtgggaagttgaggtgatggccggtaaagccaatctcgaggtgcggccgacctttgtcaacaagggcttcattgcaccg

SEQ ID NO: 6093 - DNA, 2364 bp, A.fumigatus
ttcattacggcaaccaggaacatgtcagcctttattctccgtgatattgaaataaaagccgccttggtcctccaggagaactctgcagctgaagtcatgacctcgctacgagcatggcaaggtagcaccaaagcctccgagcgtctctacgaattcaatgtctattcagtgaccgctgagaatcgatggacggagcattgtcgtggcctagtgggcggttctgacttgtccctggacaccgagtacgagatcagttcccaggtgccgaaacaagcctccgacctcagtgtcatagacacctcgacgttctacgagaagctagctagcattggcctcgaatatggtccttgctttgcgaacctgacgcacgctaaccagactggcaacctgtgctttgctgaagtcactatccctgacacagcagctgtcatgccaatgaacttccagtatccacacttgattcacccctgcacgctagacagcatatttcatactgtgtttgttcaaacaaatgttggagacgatcctgccattcctgttcatatagatcagctttccgtgtctcggagtgcagagcattcaccgggtaccaaaatgcatattgagacacatattgaaaagcggacgagaaagagtattgttgcctcaataacggtgataaacagcaatgatactatcgctatgtcgattaaaggattgcgatgcaagcacctcaagaacagcgacccgaaggatatggtaaacccgaccgagcgccttgggtacatgcttacgtggaaagcagattccgatctactttcaaagcaagatttcagtactgttttcactgaggacaatcaccacacccaagaatccgccaaaagacaattgttggaaggctgtgcgttctcctacattcggaaagccatccaagatttagaacccgcgaacaaggaaggattgcatccacgcagaagagagcaacttgactttttcgtcgatcggacgcaaaatagtcgtttggtggcatcatcagtcacaaacaatgctgatatccaggcactaagtgcttccggaccggaaggaagactcctcactgcagtcggcgaacagctcagtacaatcttgaaagattcgaaattttcgaacatcgatatggatctttcaatttgggagcaatactgggacactatccgtctaagcccggtgtacgaaaaactagctagctatctggagctagtaggccataagaatccaatgatctcgatacttgaggtggagggtacatttggacaagcttcacaagatcaccttgaacggctcttgggtaataatggacatggtccgttatgcagggaatacacaatcactcatgaaggccaatcgatccctgaacacttttccccagtggtttcgaaatggaaaccacttctaaaggtgaaggaattgaatctcaatcagagtccagaggcacagggcttttccaaatatcaatacgacgtcgttttggcgcctttggggctttgtacggtcccagcgaagttgcaagctctcaggaatattcacgcccttctgaagccacaaggtcatttgattgtcgtggatcccattgctggacatgacaatctaaccgaatctgttatctttgcgaattctttgggatgctggtccgaaggtcgatttgggtatactctcgaaggctggaatctcgtgctctcagcagctggattttccgaagcggaagatgcaagcatacctcgagaagggcgcttcatgatcatcactcgtccgttgcatgggcagtcaataccgaaacaaagtattctaatcatatcagaagatgatgacaatggtatagacttgtctgctctgcaagactctctcagccccatgtcgtccgatatcgaaattgcagatttcacccatgccaagccaaaaggaagggtttgcatcattctcagcgctcttagtcgccacttgatggcagaccctactccagatgagttggaagtatcgaagcaaatcttcttgaaggcatctggcgtcctgtgggtaactcgaggggcgacgatatccccggtgaccccggacggtgcactagcgactgggtttgtacgaacttcacgctctgaatcagggattgaaagaatcgtgacattggacctggacggacggaagccgctttcaagtcatcgcgctgctgagattatatgtaaagtggtgcgcgagcgaattctgaccgacggaaacggtcaaagtgatacagagtatgctgagcgaaacggcgtgctccttatccctcgagttgccgaaaaccaggcctttaacaggtgccctgcggccttgtttttcaccacagcggccgggccgatccgagcaatgcat

SEQ ID NO: 6094 - DNA, 306 bp, A.fumigatus
gactttgcgtccaacccatggcgggggggggtttcgaatcgagtaaccggggtggatcttcaaccgtactttcgaatcttcaatccactctttcagagcgaccggttcgatccagatggagagtatatacgaaaatgggtgcccgagctgcgagatatccaaggcgcggcgatacatgagcctaacgcacgaggagggggggctattgcagcgaagaatgggtatccccgccccatgctgaatcactctcagagcagggacctggcattgcatcgatataaacgagctagtgagagtggacgatga

SEQ ID NO: 6095 - DNA, 549 bp, A.fumigatus
acctcccaccgcacgccttttgtgcctcggtatcacctccgccagactcccggcgcggacatttttgacccaccgctaactccttgtcctttatcttttttcttagacagaccctatccccgctcgcgttattctactcaatgtcggcctgaaatggatcttgcccagccgggggacgcaccgcctactagcacaaacaccgcagggacgcttgaagattcgtccagcaccgcaaagcgtcgatggaggagaaatcgtatagcctgtgactcatgccattcgcggcgggtacgatgcgaccgggcatttccctgttcgcgctgtcttcgcagtgagatccgttgcgaatttacgcgcgaacgacggaaacgagggcggattgcacggtcaaaacagacggcaacagtcccgaacggcggatcgatggagaagctgcccaaggctcccaatgtgcagcctccagtcccagcggcggtgccagcagatgcggcgccaacaccattaccgaatcatgcctcgccgaccacgtccttccagcatcggtcgccg

SEQ ID NO: 6096 - DNA, 630 bp, A.fumigatus
  unsure (287),(299): Identity of nucleotide sequences at the above locations are unknown.
ttggccgcgactttggcttcatcgttgctctcttcggcaatattttttctctctcttaactccgccccaactgtctccatctttttccttctttcttggctcggtccaacgagtctgttatctgtttatctctcgctggaattcatatccgtcatgtcaaaggctactattgcggccatcgctgccgccagtgcagctactggtgctggtatcaccgctctgctgtactcttcatcatcctttcgacctcaacaacagcagcaacaacaacaacaacaacagcttcntcctccccatcntccgtcccaaccggctgcaatctctcctcctgcaactattcctccgccgtctctggccaagactgccgccagtaaaccctccggtggctcccccgtcgatcctgccggtatctaccagtatggcttccccggtccgatcgccgataccatcacctctttacccttgaccggcgcctacgaccgtcgcacacgtaatcctgcctgggtcgccgaacacatcacgccgtactcgctctccctgaagaacgccgaccggaaacacagcgccttcgtcgaagacgccagcattcccgccatcgtcttacaccgacggggctggaaggacacgcgc

SEQ ID NO: 6097 - DNA, 435 bp, A.fumigatus
gtcaacggtatcaccttcatcaactatgaaaacttacatcagcagctcctccgagaaacgatcggccttcacacctgcgacagtcgatcgtcgaaagcagccatacaggccgagtaccccgagtatatcattgaagatggcttcgcagaggaagaccccctgtatgatccaaagctacgggagtccgacaccgcgcgtgacgctcgccttcgcgacttactccagaacatcttcactcacgacaaaaacacttttatctctttaacggcacattcaggcgccattacaagtatcttgcaagtcacggggcaccggaaatttgcgctcgctacgggtgctgtcattccggttctggtcaaggtagagcgagtggctgggccattgccgaaaatgcatattgatcctcctacgacggcgccggtttgtaagaattga

SEQ ID NO: 6098 - DNA, 432 bp, A.fumigatus
  unsure (136),(138),(150),(255),(350): Identity of nucleotide sequences at the above locations are unknown.
cagggggaccgggtaattcagccaagtggggcccaacgaatgatcccgaccactttcgactatgtgagctgcggtgaaacatgcccatcacctacagacatagttgatactgaccagttgccatcaaattttggtntnatacctcgaagntatgactcggacgccgagtttgatccagacggccgaagaacccaatgggagcgctttgagtaccagatcaacaagctcaatgaagagagtggccccgatacaagntacagactgctcttcctgggcagacatggagagggataccacaatgttgccgagcgccgctatggaagggaagcatgggatgtaagtatttccgntaatgccctctacccgagactccttatatgggcgcaattgactgttacagtgctattggtcccttctcgacggcgacgataa

SEQ ID NO: 6099 - DNA, 285 bp, A.fumigatus
ctgttacagtgctattggtcccttctcgacggcgacgataacgggacatgggtggacgcccgtctcactcctgtgggcatagcccaggcggaaaccgcgcaccgggcttgggagacgcagatcgagagcaagattccatcccctcagtcgtactacgtgagtccgttgaaccgatgcctggctaccgccaatatcacgttccgcggcctgaagatgccgcatacggagcccttccgcccggtcgttaaagaggtaagtcaacggtatcaccttcatcaactatga

SEQ ID NO: 6100 - DNA, 615 bp, A.fumigatus
atcaagatcacgagtagatgtagcaatgctgccctgccaatggatccatcaagtctgcaatcttccgcgggcccccgagcacgccaaactccacgaccgtatcgacactcacattcgtcgcccacggcggatcaaacatccacgccgtcccattcagcgcatcccgtcgccccggacctgcctcctgccacatcccccacagccgatccaccatcgcatggtgcaggaagaacgctggatcctgcaccgacgaaaacacatcgcccatcgtggggcccagcgcaacatggaccgcggcatgcgcgcccaaccggccccgcggtgctcgggtccagcaccgcgagaaactcctggatcgtctgcgccgccaggatccgctgcacggcggcggcgccggcgaaccggtgcagcggacgagcgttaaagctgcgctcgagacagcgcgggttgtatcgaaaggccgacagatcgagcgggcggttcagatcgtccaggtcgtggacgtacagagggcccattggaggcgagaggatgggacctacgcgacgaagtcatcgaagcgatcctgcactccggggtattgctacttcaggaggactgcagggagcgaccgta

SEQ ID NO: 6101 - DNA, 1131 bp, A.fumigatus
cccgtggtgaagaccgtccagcgcctcctccccgtcagcgccaccaagaaccacgcacacatcaagatgaaactctcactcctactcctcctcagcgcagtctacactgcaacaggtactgccgctacaactacaactgctacagcagcaacccacgtaatctactcctaccccggcgtctcccccccagccagcctcctctccctcatcgccgcaggcaaagtaggcggcctcatcctcttcggcgaaaacatcgatgacaacttgcccgccaccatcgccaccatccagaaaacctacgcctcgtccccggactacaatggcaccccgctgctgatcatgaccgaccaggaaggcggcaaggtacggcgtctgcccggcggtccgaccctctcggcaaagcaggtcggtctgtcctctgacccggcggcgactgccggcgagaccgggaccgaagcagcgacgaccctggcccagtacggcgtgaatgcgaatctggcgcccgtgctgggcgtctatcgctcggcgggggactttctagacgagtacggccggtcgtacgggaatagctccgagctggtcgcttcgtgcgcggaagccttcattcgcaaccagcaggcccggaaagtgattgcgacggcgaagcatttccccgggctgggggctgcgggggccgatgcgaatacggatctggtccccgtgcagatcgacctggggctggaggagttgcggcgggtggatgaagcgccgtatcgcgcggcgattgccgccggggtggagatggtgatggcgtcgtgggcggtgtatcctgcgttggatgcgaagccggcggggctgagtgagaaatggattcgcggcgagctgcgacaacggcatgggttccagggggtgaccatcacggatgcgattgaggccggggcgttgcgcgcgtacggcgacgatgcggcgagaggcgtgcgcgcggcgcaggcggggatggatctgcttcttgcgtcggcgaggaatgtcacgcagggcgaggcgatcgtggatgcactgaccgcggcgctggagcacggcgagctggatacggaggagtttgcggccgcgacggcgcgaatcatggcattgagacggacgttacatgtatag

SEQ ID NO: 6102 - DNA, 435 bp, A.fumigatus
atcggaactagatcaagatcacgagtagatgtagcaatgctgccctgccaatggatccatcaagtctgcaatcttccgcgggcccccgagcacgccaaactccacgaccgtatcgacactcacattcgtcgcccacggcggatcaaacatccacgccgtcccattcagcgcatcccgtcgccccggacctgcctcctgccacatcccccacagccgatccaccatcgcatggtgcaggaagaacgctggatcctgcaccgacgaaaacacatcgcccatcgtggggcccagcgcaacatggaccgcggcatgcgcgcccaaccggccccgcggtgctcgggtccagcaccgcgagaaactcctggatcgtctgcgccgccaggatccgctgcacggcggcggcgccggcgaaccggtgcagcggacgagcgttaa

SEQ ID NO: 6103 - DNA, 681 bp, A.fumigatus
tggatccattggcagggcagcattgctacatctactcgtgatcttgatctagttccgatctatggctatacatgtaacgtccgtctcaatgccatgattcgcgccgtcgcggccgcaaactcctccgtatccagctcgccgtgctccagcgccgcggtcagtgcatccacgatcgcctcgccctgcgtgacattcctcgccgacgcaagaagcagatccatccccgcctgcgccgcgcgcacgcctctcgccgcatcgtcgccgtacgcgcgcaacgccccggcctcaatcgcatccgtgatggtcaccccctggaacccatgccgttgtcgcagctcgccgcgaatccatttctcactcagccccgccggcttcgcatccaacgcaggatacaccgcccacgacgccatcaccatctccaccccggcggcaatcgccgcgcgatacggcgcttcatccacccgccgcaactcctccagccccaggtcgatctgcacggggaccagatccgtattcgcatcggcccccgcagcccccagcccggggaaatgcttcgccgtcgcaatcactttccgggcctgctggttgcgaatgaaggcttccgcgcacgaagcgaccagctcggagctattcccgtacgaccggccgtactcgtctagaaagtcccccgccgagcgatag

SEQ ID NO: 6104 - DNA, 474 bp, A.fumigatus
accgcccgctcgatctgtcggcctttcgatacaacccgcgctgtctcgagcgcagctttaacgctcgtccgctgcaccggttcgccggcgccgccgccgtgcagcggatcctggcggcgcagacgatccaggagtttctcgcggtgctggacccgagcaccgcggggccggttgggcgcgcatgccgcggtccatgttgcgctgggccccacgatgggcgatgtgttttcgtcggtgcaggatccagcgttcttcctgcaccatgcgatggtggatcggctgtgggggatgtggcaggaggcaggtccggggcgacgggatgcgctgaatgggacggcgtggatgtttgatccgccgtgggcgacgaatgtgagtgtcgatacggtcgtggagtttggcgtgctcgggggcccgcggaagattgcagacttgatggatccattggcagggcagcattgctacatctactcgtga

SEQ ID NO: 6105 - DNA, 1500 bp, A.fumigatus
  unsure (1456): Identity of nucleotide sequences at the above locations are unknown.
aataggtcgaccggtgacatccttgtcacaaatgacggtgctacgatcctcaagtctattgccttcgataacgccgcggccaaggtgctggtgaacatctccaaagtccaggatgacgaagtcggtgacggaacgacatccgtgacggtgttggcagcggagttgctgcgtgaggcagagaagctcgtgaaccgcaagattcatcctcagacaatcatcgagggctaccggatagccagcaaagccgctctggaggcccttgagaaggctgctgtcgatcgaagcaaggatatggaggctttccggaaagatctgcacgctatcgctcggacgacccttagctccaaggttctggctcaggaccgcgaacacttcgctgctctcgcttgtgatgcagttctccggttgaagggctcaaccgacctcagtcacatccagatcataaagaaggccggcggcaagctcagcgactcgtacttggacgaaggcttcatccttgacaagaagatcggtgtgaaccagcctaagcgcttggagaatgccaagatcctggtggccaacaccgccatggacactgacaaggtcaagatcttcggtgcacgggtcaaggtcgagtcaacgggcaaactagccgagctggagaaggcggagcgcgaaaagatgagagccaaggttgagcggatcaaatctcacggcatcaactgcttcgtcaaccgtcaactcatctacaactggcccgagcagttgttcaccgaggccggcatcatgtccatcgagcatgccgactttgacggaattgagcgtcttgccctggtcactggtggtgagattgcttcaaccttcgatcaccccgaacaggtcaagcttggccattgtgatgttattgaggaggtcatcatcggcgaggataccctcatcaagttctcgggcgtggctgccggtcaggcatgcactattgtactgcgcggtgccaccgagcagcttctcgacgaggcagaacgatccctccacgatgctctggctgttctctctcagactgtcaaggatccccgggtcacactgggcggtggctgtgctgagatggtgatgtccaaggccgttgagcaggcggctcagaacactaccggcaagaagcaactggctgtggacgcattctcctacgctcttcggcaattgcccactatcttggccgacaatgccggtctggactccagcgacctggttacaagactccgccaggccatcaacaacggcatgaccagttctggtctggatttgcttacccctggcggtggtattgctgatatgcgggagttgggtgttgtggagagctacaagctaaagagggcagttgtttcctcggcatcagaagccgcagaggtaagcatggtcgtcgatttgcttttgcacaaacgcttagctaactatgtccgtctacagcttctcctgcgtgtcnacaacatcatccgggctgctcctcgcaaacgcgagcgtatgtga

SEQ ID NO: 6106 - DNA, 465 bp, A.fumigatus
  unsure (71),(82),(101),(118),(134),(214),(229): Identity of nucleotide sequences at the above locations are unknown.
ggcggttcgggaagaaaaccctggagtttggcccaaattcggggaatttttggggacgtcccgccattaanagggattcttnatcagggatttgagaccanttttcccccccttgagntgctgcctttcttccntgccggtagatacttcctaactatatactatccatcatggtttgtaatctcccaaattaatttcttaaaggacaaaatgntgaccacctccaggngtcttcgcccaatccccacgcagatctttgccgacgatgtcgtcgaggaaaagggcgagaatgccggtctgtccgcctttgtcgggcccatcgctgttggtgacttggtgaaaagcacattaggtcctaagggaatggacaagatccttcagtcagcgaacgtggggtggttttctgggaatgcgggggtttgttggaaaacgagtttgccagaactaactctcgggttaaaatag

SEQ ID NO: 6107 - DNA, 966 bp, A.fumigatus
caaggtccatttcttttccaggttgagacatctcagcagctgaaagagcgtacgtctgcctgtgagagcaggttactgccattggcacccaatgcgggtcaggagaccaccaccaccaccaccaccgtggacgacaaggaaaaaaagagcattgcgtctgaagttcttcaagagttggaccaaattgccaaagaagttagcgagctccagaagtacagtcgcatcaatttcactggtttcctaaaggctgccaagaagcatgaccgcaagcgtggtgcacgataccgtgtacggccgctgctgcaagtacgtttatcgcagctccctttcaacagcgaggactattcgcctctagttcatcggatatcggtaatgtattcctttgtgcgacagatcctgagtgagggtgctgtcgaatccaaggatgccagcgagccccgttctggccaggatgcgtactcatcgtacaagttctgggtccatgaagataacatcctggaggtcaaaacttacattcttcgccgattgcctgtgctcatttacaaccccaaatcctcgagggattttgagtcgcttcctgaggaccccacaattacatctttgtatttcgacaacccccagttcgacctctacaatcagaaagtagctaaagcccccgaagccgggtcgatcagacttcggtggaccggggatctcaaggacacgcccgccattttcctggagaagaagattgtgaccagtgatgactatagcaaagaggtgaaagtgcagcttaagaagaagcatgtgcaggaattccttgagggcaaatatacgttcgagaaacagctgcatcgaatggaaggtttgaataacggcgaatcagcagaggcggagacgctcaaaaaggatgttgaggagctgcaatcattcatcccggagacatattcgttacaggggtcgaagaacgcgcgcgactttttttaa

SEQ ID NO: 6108 - DNA, 1086 bp, A.fumigatus
gccccttacttttccaccaggttgcctttccaccctgggcccagtccggtcgagttccgaaggcttcttcgcaaatccttaaaggatatccaggctttgaatgatgtcaagggagcatatcggaccaagtacaacctattcgactcgatcaccctccctctcgcagactttctgaaaggagagggggtggatttccgcttcaacgttgacgtgactgatctactgctctatcccgaaagtgacccgaccacagtctcggaaattaagctgatcaaggagggagatgaatgcctgatcacgttggaccccgaggacatctgcattgtcgaccccggttactcccgctcgggggcagatttcggcactgatactgctcccccgccgtttcttacttcgaactgggaagacctgatgatgaaggagtggaagttgtggcagaaactatctgacaagtgtccgaagtttggcaaccccagcaacttcttgtcacgcgcccttgaatccggcgtcgaaacatttacaacgacgctctgggggccacagttcatgaacctgtacgagaagctcactcatgaccagccgaggacggatgccctgctctcgttgacagagagcaagtggtcaatcaccctgagcatcccacatcaacccatcctcccaggacaacccccggatgctcatattgtatgtggatacgcgctgagcccgtggaacgaaggagattttgtgaagaagccaatgtttgcgtgctctgggaaagagatcttcactgaggttctttcccacctcgggttccccgttcaatccatcctcgacgcggcgacaaccattccctgtgggttgcctctgggcacggcgccgtttttgacacgggggaatagagatcgtccgcacgtcattccaccttataccaccaacattgcatgcgtcggccagtttgcagagcttcccgaagacaccaccctgagcatggaatacagcgtgcgaagcgctcagatggccgtctatcagttgatggacctgcaaaaggagccagccaagctcaagaagaatattctcctggaactgtttgatttgttgatataa

SEQ ID NO: 6109 - DNA, 1137 bp, A.fumigatus
cctgtaatcgagccgacaaacctacttaaaggagcaggtcctcgctcaggcttcctacggattgacaaagtcctcgtaaccatcgctgcaatggagaccaaaggcaaccctaaagattccatgaagtccacctggcgtactgccagcagggatacctggagcctcggacactggctcattcatatactcaacgcctaccctttagaactcgacaaagaggtaccggtgcactccaaggatgaaccaattccattcatgccacagtggtcgctcaacctatgggttattttctactcgtctctaccactgttgtttcaccaggcctacgcatggtacaccgaacgcaacctgggtcctttagccacgtttaatctgtatatgtttgccttcaatgcgatcgtcatctaccaggtacacatactccggcgactcggtcacatatatggctttctagatggcgacaaacacgaacgagacggcattcctgacgtcggggtcggcaaggtcgtggcctcggtgtacaaaacgaccggttctcgcttggcgctctcggtgtacttctcctatcagacgagtcaacttcctgcacagatgaactggtactggttaccggttgaggtcggactgtacggcatcgtgctcgacttctggttctactggtaccatcgcctcatgcacgacgtcagcttcctctggaagtatcaccgcactcaccacctgaccaagcaccccaatcctttgctcacggcatacgcggaccacgagcaggaattcggcgatatggtcggggtgccgatgatgacctacttcactctgcggctgctggggctgccgatgggcttctacgagtggtggatctgccatgaatatgttgttttcgccgaggtgtttgggcacagcggtctgcgcttgcatctgaccgtcccgtcgcccctcagctggctcatgcagtggctcgatgccgagattgtcattgaggatcatgacctgcatcatcggaaggggtggcggaagagccacaactacggcaagcagactcgtctttgggatcggatctttgggacctgtcatgaacggattgagtcggcacctgagaatgtggattatgtgaataccgccaggatgccattgttttga

SEQ ID NO: 6110 - DNA, 594 bp, A.fumigatus
ccaagtaaccaagtaaccaagtataccatggactccgtcaaaaacaaagtttacgccgtcactggcgtcgcagggatcggcctagccgtcgcacagcaactacacgctcgcggcgcgcgcctctccctcgcagacatcgacgccaacgctctaaccagcgcattcgcaaaactcggctccgacagcgagacggttctgacaacagtcgtggatgtggggtcttccacgtccgtggatgcgtggatcgaggccacggtgcagaagttcgggcgcctggacggcgcggcgaacatggcggggacgattgggcggaagcatggggtgggcaagctcgtggagcaggatgatgaggagtgggattttctgcttagggtgaatctcacggggacgatgtactgcctgcgggcggaggtaaggagtattgcggcgacggcgggggagggcagtattgtcaatgcagcgagtattcagggggtgagggggttcgcgctgcatgcggcgtattcgacgacgaagcatggggttgtggggttgacgaagagtgtggcgaaggaggttggcccggctattagggttaatgcgattgctccgtaa

SEQ ID NO: 6111 - DNA, 636 bp, A.fumigatus
agactacttctccattcgttctatcttccaagaccatcactgttatacatcaaaatgaagctctccattgcagcaacattgggctttttgggctgtgccctcgccttgcccgcccctgctgccagggagaccgacctgccattccccttcccagctggtggctctggcactgggcctggcagtcttccattccctattccttcaggcgctcctagcggctttccgttccctattccttcgggtctacctcacggctttccaactgattttccgttccctattccgtccggcttgcccactgggttcccattccctatcccatccggcttccccactggatccggctccggcggtttccccggcttccccggcctaggcggtagcggcgactacgaaaagcgcgaggaagctcatcacagtcgccccaagccatctggcgtcttccccggatggccgtgggccatggccatggcccgaagccccactggtggcttccctggatggccaaagccgactggcactccttccttccctcctggaggcagccccaccggcggcttcccaggcttcccaagcatcataccaacggcttacgcccagcgcaactccttccggcttcccccttcaaggggctga

SEQ ID NO: 6112 - DNA, 222 bp, A.fumigatus
ttgtcttctgggatgttgctgacgagctgcagtgggagtatccagacgccgttgcttgacaaggctcgtgatattcagggcacgttgaatgctatgcccacgatcatcccgcgcattgggacggcagatgaagtcgcgcagtcggtgctgtttctgctgagtgatgcctcgtcgtatacgactggcttggtactgaatgtcgacggtggttgggatccttga

SEQ ID NO: 6113 - DNA, 1611 bp, A.fumigatus
  unsure (1548): Identity of nucleotide sequences at the above locations are unknown.
ttgcaaaccactttagctccatgtgaactgtctacacactgtatcatcaaattatcaagaatgtcggagcagacgaagaaaacaccccaaagggtcaggaaatttctacctaatgtgattgaatcatcatctcgcagttcccgcaaccgccagtcaaccccctcagtgcaggcctcttccatggaactggagttccaatcaggcaagccagcaggaacactcattgcagatacacggccagttccacccggcgatctcacgagttcacaacgacagcaagacgactcctggacattgaatgacattaaagaagttagtgacaaccgggcctttggccttccccagcggcagccgataagggaagaagtacttcataattcagttgacaccaaaacgaacggagaccgactgtcctaccctgtttcgagttcggctaccgagaaggtcgtacttcagatgagatcatgccctagaaagtttgcacctcagcttgttgagaccaataaacgttcatttcgccgcaaggaaacgtcgcacactttgtctggagctcctgtacaggggtatgacaacgtgtctcgaacgcaaagcggcacctccacctgtgcgaactcaaatgctttctctgccactatcgaatctaaattttcatattctagtctccaacagcgccaagagtcaaggagccactcatttcgagtgccagacctccctgcaatcccctccagctgcagtgacgcctcggaggggtcggacacaccgtcgttctcggcatctccttccatttcatccaatgtatctgctcatcactcaaaagccgaaaacggttgtaaaactggccgtgatggtcatatggcggagtactttctttctctcgcaggtcagtcggtggaaagtcaactgaaggagcaggcacttgcagcatttcccaatgaacaagtttatgagcctgtggatcactttgcgatcgacaaggatgaagacgaatgttccgaggaggactcgaaaaacggccatctacatgtatcaaggcgggaatcgtcggccgatcttccgtgggagcttgaacatatgcgccggcataaggaggatgccgaaatgagggatcgtgctatggcgggtacgaaggggagacgcctttcgtctgcaatattcaaccctcgtcagttttacagtggaatcgataatgactgttggagaggaaagtatgagccagatctctccaggcatctcgcgcgtccacctatgctaggcgatgaccttgtattcccacagagtttatctcccgaagcgacaatatgtgagagtggatctgtgcgggactgtgctaccgattcaagacatcgagtacgcaatgattttggcctttggtgtacaaaacctggtcatgtgcaggatgatgcaactactggtctctggaagggaacgtgttgcaattacaagcatactcaacaatccaaaagatctttaccgtgcgtgacagacaattctcgtcactctaacaacaatgagtgtcaatctaaagtatgcagtgacgagcaggaccangaacaatctacttctaactcttatcatctgggcttagatgttagagaattatcacggcattga

SEQ ID NO: 6114 - DNA, 348 bp, A.fumigatus
ggtggaagtagaaccatggtctggagagacttcggagtgaagcttaggcgcgatttcacaatggttcgcgcttccgcaccacccaagcatatcaaaacaatggaaaaggagaccgcggtcaatccagcggacagagttattggcgctctcaaagatcgcaaacttccaatcaatcggcatgagatcgagtcggctttgatcgacatcgataacaagaatgttgagagcattcagtggctggaggagcacctccgacccgacacgctgctttcgcaggaggagctaacactgtatgtttcccattcctcaccccgttggattccatttctctctatttcgaagcgatag

SEQ ID NO: 6115 - DNA, 183 bp, A.fumigatus
agagctcctccagagtcgcgaatcattctgcgcgactctagaggctcttacagctgcttacaggacggaaataggcaatcagttttccgaaaagccttcttcaaggcgagagacattgagtatgaggaggcgttctactccgttgctatccatccctaccgctccagaaaagcccatggataa

SEQ ID NO: 6116 - DNA, 195 bp, A.fumigatus
agacgtgttgcgtattttacgcattcagtccggaagtacggagtagagggaggatctaaagtgttactattcggcgccctcccccctcctgttctagcgctgctccgcagcgggtattcaactgctagtcaggagtcccaactacggcttattggatttgagttgggtgtcattgacgcccttgcgcaggtttga

SEQ ID NO: 6117 - DNA, 1323 bp, A.fumigatus
cagcaacggggttcgttgatctctgggaacaaccttgtcagcaacaacgcttctgttttagatcttctagttgtggacaacgctcatgctgcgccttgcatctccccagcgacgcccgtcaagatgccaaccaccacgtctgcatccgacaaatcgagacaaacctcggctggcaaaggatttttcgggaggaagctgcataaggagaagccggtagatgatcggtatgagggttatggagggtcggagaatctcgcgcctccaggaaatgctacgggatcccgttcgtcccggcactcgaaacgatcatccgtccaatctgtggattactcgcatgatttcgatccaagcggaatctcgatgaccgccggtgtcataacatccattccctatgagagccttactaccgatactaggtctccgatcccggtagattatctgtccagggcggagacatcaccacgaaaggagccgtcgccaaatcaccttgccaagggaggcggtgattttcatcaatacccagcatggaacccgacaggactacgagaaaacaacgccttttcccatcctacggggcctcgtcccccaccgcatgcgtccaatgtgtctatggtcgggagtactgcaggggacaagagcgcgaggcatcagcagtgggcaagaccaggaagttcagccactaacgctgggttcagtcataattcctcatccaccgtggattcatcatcgacgtcacggatgtcctttgatcaaaccagcatccattcgtctctctcttccaacacaaggggttcaagttatatctcttcggacggctcagcacgaacgctcacaacatcgcattcgggtgaccgtggaactctattcccaagcagcggcaactccaatcggttctccaccgcacaagcggcatggcaagctgctcagctggctacccattctgctgcaccggtcctcaatcccgagcagtatctcacgcgacccagggacgatcgcgtagtggaccaactgttccttgacttgatgcaaaagcgaggttggcagaatcttccagagcaggccaagcggcagaagctggcgtatcccgcatccaagaagtggacgctagtacatcaggaccgcttgacagatctgcagggtgaacagaagcggaggcagaatgcaaggcaaacacacggccatgatggtccagccggcattctcgagcgagctgatgaagaagggagcccggagtggtatgtgaagaaggtcatggatgacagtatcacgtcaaagcaattggccagcttgagtgtcagtctgcgaacgcaacccatcaagtaa

SEQ ID NO: 6118 - DNA, 501 bp, A.fumigatus
gatgacagttgggtcagagcctttgtcgaagcacaaggtcaaatcgctttgaccaatgtgctctccaagatcaatcgcaggaaagcttcgggccctgtccccgcaccaccaacaggcgatcgagacttggatagagagtacgatattgtcaagtgtctcaaggctcttatgaacaacaaatatggcgcggacgacgcaatcggtcatcaacaggtcattattgctcttgtcagctcgctattatctccgcggctgaacacaaggaaattggtcagtgaggtcctgaccttcctatgtcactgggcggaaggggagggccatcagaaggtgctgcaggccatggatcacgtcaaaaatcagcacggtgaaactggccgctttgacgcctggatgcgaatcgtggaggtaacgatcgatggccggggcaaaatgggcagcttagttggtgccagcgacgagtatcgtagcggttcttaccccagcggggccgagatcaggtaa

SEQ ID NO: 6119 - DNA, 549 bp, A.fumigatus
ggaattcaagcggtgagttttgatgttgactacctaaatgcaaatcttgcgtatgctgacagcattatagtcgaggaagtggtcgttccactggccctgaaatatctggctcgtgccggtaagctctctgccctaacaatgcccactgcttcttttcttgtgatcttcccacgtgctgacaagtcctcatatgcagatactgtcaccctcactgtcacggagactgtgtgcgacttttcaagcacgactctctcaaagccttctaccaccatttggatcccgccaattccaaccatggttaccaccgcttcgatgccaacatctcagactagcgtttccacgtctgaatcttcaactacgtcgtctgtagagcagacggcttcccgccgtaccagctcgaccagtagcagcgatgcttctgctcctgtgcccagcagcagtgaaccaccattcgctcctcctctatcggattctgccactggtcaagggaaaatacactttgcttctctggtatggaccttggtgatgacaagtttcatgaacgtatag

SEQ ID NO: 6120 - DNA, 207 bp, A.fumigatus
gctactaaggatagccctatctcatttccagcatatattactagcccccatggcaccagcaagctggtcaatcagtatgaaagtgtcttagcaattactactaattttggcgttgctgccgtgattctatactttagaaagttgatcaataattacaataaatctgtagcacatgcttatcgcttacatttcatctggcaggtgtaa

SEQ ID NO: 6121 - DNA, 330 bp, A.fumigatus
ctgtcgagacaggtgggatggtatgcaagtgccttcttcctgaccattgcttcgttccagtccacatggggcaaggggtataaatacttccctctcaaaaccactttcttgggcgccatttccaccttcgagatcggttcgttgatctgtgccgtggcccagaacagcaccacgctcatcgtcggcagagctgtggcgggaatgggagcagccggcatcgcgagtggtgcctacacgatcattgcctttttagcccctccgaggcagcgccccgcgtttactggcttattgggttttcaccacgggggtcgaagcaccgcgctatcgaat

SEQ ID NO: 6122 - DNA, 228 bp, A.fumigatus
atccttataatttctctatttgtgaagtctggccctgcggagaatattctatttctgggtgattataagcacgcctttatacactgcaaagaactaaactattataaaataattaaggctaaagcatcaggacagtatataactaggctctctaatagtaaagaagcgcggggcaaatcccttataatgggtgagttgctgcaattatgcttggaattatcatactaa

SEQ ID NO: 6123 - DNA, 423 bp, A.fumigatus
cttctacagtggatcgctagactaagcatcaatagcactttcggagcatcggttctggagccagcagtgactgatgtgatggcggatttttgcgtcggtcgaacccaggctactttatgcattaccctctacacgcttgggcttgccactgggcctcttgtgctggcgccaatttctgaagcctatggtcgacgatgggtttacataccggctatttctttcgtgctcgcgttttccgcgggggcagcagctgctaaaagttttgcaatacttcttacttgtcggttcttcagtggctttttctgctcggtgggtatcgctgttggaggaggaacagttgccgacatctggcccagaggaaaacagcgagcaactgcatccttgtcttcaacgcggggctggaatgaaccgttcgttggggta

SEQ ID NO: 6124 - DNA, 1167 bp, A.fumigatus
  unsure (1072): Identity of nucleotide sequences at the above locations are unknown.
agacgggaagaagatttggcggcagatcgctgctcgcagagtctcagttctctgttcaagaacctccctgaactcttgaaaaaccgccagagttcggtgaagcctgtcaacctcaagcgtccggcaccagctgctgtctctcggcatgctgcaaatgtaaagaatcaacaatctgcgcccgagatcacgcctccgcagagagctagtacgttcccagtacaactactgagccgacagtccaaggccgaggccagcaatacccccaagagcttagatgatagtcataattttggcagtggcaagatgtatcagagcccagtgaatacccaggtcagtaccccgaagtggaccccatctaccccggaagccccgaccgacaccacgacgacaacgcccgaaccctttattgccgatcaagctcgcccatcgactacggcatctccaatgccagggatgcattcacgagagccctcgtcggggcaattctcagcacagcagttggccaatgccggaaatttgccggacctcatgcccatcatgttcccttccgacgatccctttgcctatccgactcaaccaatgtccacgttggaagatgatcatttccgcgtcgacggactgggcctacagtcagcaaatcagttcgctttcgatccgtcctcgcaggggttaccgtcgtcggcctcgaatgattcagccatcggcgcggcctccactccgacgtttgacaactttggcactttcccgcttttcaataatggaacttcagccggcatcaatgccacactcccgtatcgcgtcgcaccgcagaagcagcaggccatgagccaagcgcggcttcagtcacccgggtcgcatagctcgactcccggcagcggcactgaggcggtcaacagccccgacctggtgtcgatccccaatcagaacttcatgtggcaagggtacaacttccagccacaggcaattcccccggaatcatcagggccccagcaggcaccgacgacgactgaatctcagggctttagcatgggaacgaacgagaataattatatgggagtgggcattgacctgngttttctccctctggacgatatcttcggcgacccatgccgaccaaacacactcgccaacgacgactggattcagtggatgaatgtgggaaattga

SEQ ID NO: 6125 - DNA, 336 bp, A.fumigatus
  unsure (2): Identity of nucleotide sequences at the above locations are unknown.
anaacttcccaagcgcgcagtctcgtcgacgacaccttcatcatcatcgacgacggcatcaccccggagtgccccctcgacccaacctaccgcatccacttcctctcccgcacccccttagtcatctacatcgaaggcttcctcaccaccccggaagcagaccacctcgtcgacatcaggtaccttttcgccttcgatccacaggtccacacgaccccttcgctaacatttaccgaaaagcgtaggaaaatacacccccagcataatctacaacggcatcaccgagcgcgtcgacccctccacgcggctctccgagcgtgccctgctcgaccgtga

SEQ ID NO: 6126 - DNA, 630 bp, A.fumigatus
catttaccgaaaagcgtaggaaaatacacccccagcataatctacaacggcatcaccgagcgcgtcgacccctccacgcggctctccgagcgtgccctgctcgaccgtgaccacaccgtccggtgtatcgaggaccgcgcgcgcgccttccaggggtggcgtccacacctgtacatcgagcgtatgtgggcccagcgctacaacgcctccggccactacaggcaccactacgactgggcgggctccgtcgcgcgcggcggcgaccgcgccagcacgttcatggtttatctggatgataactgtaccggtgggggcacgaatttcccgcgcttgcgcatgccggtcgataggcggtggtgtcggtttttggagtgtcatggagatgaagagacgctggaggtgggagatggggccaaggacacagcgccgagaaaagaaacggcgagggccagagggacgggggaaggcatcacgttcaagcctatcaagggaaatgcaattttctgggagaatctgaggcccgatgggacgggatatcccgagacatggcatgcggcgctgcccgttacgtcggggacgaaggttggcctgaatatttggagctggtaccagccgccgcgaagggggtga

SEQ ID NO: 6127 - DNA, 477 bp, A.fumigatus
tctacaacggcatcaccgagcgcgtcgacccctccacgcggctctccgagcgtgccctgctcgaccgtgaccacaccgtccggtgtatcgaggaccgcgcgcgcgccttccaggggtggcgtccacacctgtacatcgagcgtatgtgggcccagcgctacaacgcctccggccactacaggcaccactacgactgggcgggctccgtcgcgcgcggcggcgaccgcgccagcacgttcatggtttatctggatgataactgtaccggtgggggcacgaatttcccgcgcttgcgcatgccggtcgataggcggtggtgtcggtttttggagtgtcatggagatgaagagacgctggaggtgggagatggggccaaggacacagcgccgagaaaagaaacggcgagggccagagggacgggggaaggcatcacgttcaagcctatcaagggaaatgcaattttctgggagaatctga

SEQ ID NO: 6128 - DNA, 1737 bp, A.fumigatus
  unsure (81),(96),(131),(213): Identity of nucleotide sequences at the above locations are unknown.
caagagcagtgctcaacacatctgttcccgtggagcgactcaacgacttgttcactcgaattgtggctgcgtggtatcatntgggggcaggatacntgggaacgtccgccgccggaaggcaacggcggccntaatttttcttcatggaccaacgacgaggtggggtggctgcatacgggaagcaacgacggttcttatgctagggtgaaccantacgttgacgcccagggcactggaccagaggcacatagcatcattgcgagaaaagttgcggcggaaggaacagtgttgctgaagaacgtagatcgcacacttccgctgtcgcgcaacgcctcaagtccatccggcggtattctccgcgttggtatctatggtgatgacgccggaccggcgttgggcccaaatgcttgccctgaccggggatgcaaccagggcaccctggctaccggctggggcagtggaaccgtggagtttccgtaccttgtgagcccgattgaggcgttggaatctgcatggtcgacggaaatcgagagcaccgcgtacctgcgcaacgccgttatgccagcggacgctgttgacaaagatttgtgcctcgtctttgtgaatgcagactcgggggagggctacatttccgctggcggaatccacggcgaccgcaacgatctctttttgcagaaaggaggcgataccctggtccgtaccgtctcgagcaactgcggaggtggacaggggaagaccgtggttgtcatacacgcggtcggtccggtcgtgatggagtcgtggatcgatcttcctggcgtgcacgccgtcctgcttgccaacctgcccgggcaggagagtgggaatgcattggtggacgtgctctttggtgaggtggatgctagtggccggttgccgtacacaattggaaagagtctggaggactatgggccaggcgcacaggtcttatacgaacccaatgcaccggtgccgcaggtagactttttggacgctctgtacatcgattaccggcattttgaccggcataacatcacgccgcgcttcgaattcgggttcgggttgtcctataccacgtttgaactgttggatctcagcatcagcccgctgcagcaaaagtcgcggtctgtacccccacggcctacagatgccgtggctccacccgtgtacgatattagcctgccggatcctgcgtcggccttattccccgctggcttccagccagtcttcaagtatatctatccctacctttcgaatcttgacggaacggcgccgcacaactattcattctaccccaagggttacaacgagactcaacgtccatcgccggccgggggtggagcaggtggccatcccgcgctatacgaggagatggtaagcgtaaagctccaggtgagcaatactggggatcgcaaaggacaggaagtggtccaggtctatgtatcctttccgcccgatgtgaccgaggagggcgactgggtggaggtggactctgacgcagacaagaccggggagaaaccgagggagcgggtgaaaatcgagtttcctgagcgggttctgcggaatttcaccaagatcgagctggagcctagtgagcgacgcgaggtgcagatgacgctcagccggaaagatctgagctactggagcacgcgcgagcaaaactgggtgatgcccgagggcaaattccagatctgggtgggacgtagttctcgcgatctaccattgatgggagagtattga

SEQ ID NO: 6129 - DNA, 798 bp, A.fumigatus
ctaagctgcttgctagacctcttaaagctcgcatcctttgtgcagcaatcaatgctctcgagccggcgcaaccatccaataccccaagatttcgaactcgcattcaaaagacaccatttgcacgtggacgatctgcttccgcatttaaaacctctgccaaatatcgagcctgttcctacactcctacctagccctccaccagaagaggttgcttggttggatttaccgtttctcggctctgaactgagcggcgaaagtgaccgtgttcgaagcgcttatatcccaaagcatttccctcaatttcccagtaaacatacataccggcacacacctgtgttcacacagcgggagcaagacccacgaaagatccgtgagcgcgcgactgaagagggaagacatggcgaggaggcattgcgcaaactggcgcgggcatccttcaaggataatcaactcggctgggccggtcgtgaaaaaagattgtggggtcggaggatggagagcttagacagtatgtttgaaaaaacagtcaaaggcatcgcaaagaaaatgcacaaagatgtgactgcaccggggacagttgcagcaatggatattgattcgggggtggctgtggatccggagctcaaggcgactcggccgaagcttccattcagcctggagcttccgccagtcatcaattgcgaaagaggtctctggcgccgaacggcggcacccagcaatcggaaagcggaagagaaaccagccggaacgaaggatcctacaagtgtttcgcgagtggaaagctggatgagcacatag

SEQ ID NO: 6130 - DNA, 204 bp, A.fumigatus
caacttcctcgacctcgtccaccttccgcaatgtctccgcctgcaaccgatgccggttgcgcaagaaccgctgcgaccagcgactcccccggtgtcagtcctgtgagaaagccggtgtccgttgtgtcgggtatgatcctatcactaaacgagagatcccgcgcagttatgtctattttctcgaagcgcgcgttgcttacctag

SEQ ID NO: 6131 - DNA, 1488 bp, A.fumigatus
ttcgtctcgaaattttcggcaaactatcccctcgttccacttgacctgcgacaaacttctattctcgagacatggttgtcgcacctcggcacgccttctccccgtctcgcctttcccgtcatgttgaacacttccccggcctcgcctacctccctcgggaggaaacgaccgcaccctccggctgagccttccttaacgcaatcacagcctgcggcacaaacgcaacagcagacagctggcgatggcactgcgaaaccaccaccgcctgccgtgacaacttcctcgacctcgtccaccttccgcaatgtctccgcctgcaaccgatgccggttgcgcaagaaccgctgcgaccagcgactcccccggtgtcagtcctgtgagaaagccggtgtccgttgtgtcgggtatgatcctatcactaaacgagagatcccgcgcagttatgtctattttctcgaagcgcgcgttgcttacctagagaaaacgttaagggaccaccagattgaattcaaagaagctgtggcctttgatgaagaggaggccatcaaggtagaggcggggtacgaccaggatcggccgcagatggctggttcagaagcgtcggcgggtgccgagacattgtctactaccgttgtcgaaagtgacagattgactcggcaaaaggcagataaagctgcgcaggttccgcgatcgggcaggaacccggagagtgaacaggatgcggaaaacagccgggactatgagaaagaggataattggcgcatacataatcttgtgtcgaatattggcatggtatcggtgcaagggacttccgatccacggtatctggggtcgacctccgggatttcttttgcgcgtgtcgtcttcgctgcggtgaagagctccgttgccggcaacgtgggagagcgcggaccaatgcggccttctgaacgcttgccgcatagtgccacgggtaccgcagggagtgggagtaccatgcgggattcgttctttggtcttcagacaaggccaacgatgaagtgtgcggcattccctgaccgagagttggcggagaagctcgtcaacctttatttcgagcatgcaaacccgcagatgcctatcctccaccgggaggatttcatggaacttctcgatcggacatactcagttgaggagaaggaccgctctcctcgcagcctttataccctaaacattgtctttgccattggcgcaggtatcatattcgaagataagaccagctcagatgatgaagacaacacgctgagcaacagcagccgctcaacctcctcgtccacagcaaaaatgccgcggctttccacccgtcaatatcagcctgaagagtaccatgcctctgccattattcatttagaatctttccttggcgcgtcctcatcgaacgaacggtttggtgcgctagatgagctgcaggccgtcctcctgctggccagttttgcacttcttcggcctgttgcgcccggcctttggtaa

SEQ ID NO: 6132 - DNA, 318 bp, A.fumigatus
caacggcgtcgacgaatcaacagacaaaagcaacacaaggtgagtgctcgatctcaaaccacagatggagcttatactaacatctacagaaccggtctcatgttctacgagctgaatacgtgggatctcttgggcggaagtccctggaagcggagcgacaatcagccattcgaaggaacttttgagggcactgtgaacaaattcgcgcagattacacgtctgatagatccagatgccaagttcacagaacaggcctttatctccgacgccggcactgcttctgttgcctcattcaaccgaactagtcgatggtgctag

SEQ ID NO: 6133 - DNA, 225 bp, A.fumigatus
caggagggggaaaaaaaaaagactaatctgatattgctgcgtttagaacaaatcgccttagcatcgtacgtcaatccgctcgctgacccagtcgcttgggaccgcatgattgcctacccatcaaacaaggtgagcgtcctggtcgccaatgtcctcaacggcccggacacgacggtgaatgaggattgggcaaaggtcatcgaccgggcccatgcatcgggataa

SEQ ID NO: 6134 - DNA, 186 bp, A.fumigatus
cattctctccaaggagtcatgactgctctgctccaggaaattatctccgtttaccccctgctgaacccttcccagttgaccgctgcggcgtcgaaccgagtttgcaatgcgctagcgttgttacaatgtgttgcgtctcacaacgagactcgcaccctttttctgaatggtattttcccactgtga

SEQ ID NO: 6135 - DNA, 417 bp, A.fumigatus
gagacagcattgctgatgagtacgttgctttctctagctcacatccctctttttctttacccatttctcaacacaacctcgaagtctcgaccctttgaataccttcgacttacttcactgggggtcatcggggcgttggtaaagaatgattcgtccgatgtgatcaatttccttctaacgaccgagatcatccctctgtgccttcgcatcatggagacaggatcggagcttagtaaaaccgtcgccattttcattgtacagaaaatacttcttgacgatatcggtcttgcatatatttgtgccacatacgaacggttttatgctgtgggaacagtgttgagcaatatggttacccaacttgtggagcagcagactgtgagattgctgaaacatgttgtccgctgcttccttcggtaa

SEQ ID NO: 6136 - DNA, 189 bp, A.fumigatus
tatcgtatcagactcagcgacaatagcagggctcgtgaagctttacgccagtgcctccccgaaccgctccgcgacgccactttctcctctgtactccgcgacgatgcggccacgaaacgctgccttgcacagcttctcatcaatctctctgataatgtttccgacggcgcttcgggagttaccatgtag

SEQ ID NO: 6137 - DNA, 342 bp, A.fumigatus
cgcctacaggcttctctggcaattgtctcagacatcctcgctctgttcttacatttccagtatatcggcttcatcacagcgacggccgtccttgacatcctggtcatcatcctctgcgcgattggggttggcaccatctcgacgggggattttgtctcctacctgggactttactattatgattacccgtcggtgttggcgcaagcggagattgtcgtctttgcgttgaaccttcttgtcgcgtacgtgtgccagtccagtcgctggggatacatgagactaatgaggttgttgaaggtgggagagattcctttcgattattttatgctctgtttcgtgtag

SEQ ID NO: 6138 - DNA, 255 bp, A.fumigatus
aaaacaaaaggtacaatggtaatgttttcagcaatggcatccaacttttaccgcgcgcaggacgcacccaggtatattctgggacactcattggagctggggtttgcggtggtgggaatcattgccgtggtgatcctgcggttctcgtatcagcgcatcaacaagaaacgggatcagatggatgtctcgggctatgataacgctcagttggccaggatgggggatcggtcgcctctgttcaggtatatgctgtga

SEQ ID NO: 6139 - DNA, 270 bp, A.fumigatus
ttactaggacaacttagcatgagctcactccccgaaagacactggcagcagagattccctaccttccaacaagtactcctgcgcaagaacatcgcggcactggacaacctgctccagcaacgcttgcaggatcccggacttataacgttcgagatcgaccagctggctaagccggacgatattgctgcccaccaacatttccagctcgggggggtcctggatcctcttttccctttcccgcgaagggaccttgatgttgaaaccgcaccc

SEQ ID NO: 6140 - DNA, 1047 bp, A.fumigatus
gttgtcctagtaatcaccaaggtcttccccgatgaattccatctccatacgctcgatctcttactatcggcaatttctcgtctcaatccgcatgttgacctgaagaagatcgtgattggactcatggaccgtctatcggcctacgcggctcgcgagacagaatcgaccactgaccccgaaatacgaaagcagaatgaagaggaagccgtcacaaagttcctcgaaaatctgaagattgcggaggaaaataagacccaagaggctcccacaggcacagctcatgagaacggcgttgagcacttgtcaaccgagccgtcgaaggaaccctcgaaagacacagacaaaccagaagcagagacccccaaaggcgagcaagagtcgaatgcaaacggcgagaacgatgcaaagcctggcgtcccagcagatgtcaagctatacgccattttctatgaccaggtggtcaatctgatcaagacccggggcttgccaatccaagacaccatggcattattagtgtcgcttgttaacctggctctgaatacctaccctgacaggctggaatacgtagatcaggttctcgatttcgctacgcgtgagacagctgaatacgctgatcatgcagatctccacgcggcgccgacccagcaaaacctccttcatcttctcctcgcacctcttcgctcttatgtctcaattttcacagcgttggcattgccccattatctcccgctgctgacttcccaatcctatcccacacgacgatctgtagctggcgaaatcgtccggagcctgctcaagaaccgaaccctgatcacaacagcagagaacctcgaccgcgtcctgggggcattaagagtcctgattaaggaaggcttgcagcaggctgtcggctatcctggttcccagcgacggggcggagaaacggacgaaaccatcgaagagcagggatggctcgctcggttggtacacctgatacaagcgccagagaatgacgtccaattgaaggtacgtttcttagggcgaaacagagatcagatccaccgctaa

SEQ ID NO: 6141 - DNA, 246 bp, A.fumigatus
gggtgcggtttcaacatcaaggtcccttcgcgggaaagggaaaagaggatccaggacccccccgagctggaaatgttggtgggcagcaatatcgtccggcttagccagctggtcgatctcgaacgttataagtccgggatcctgcaagcgttgctggagcaggttgtccagtgccgcgatgttcttgcgcaggagtacttgttggaaggtagggaatctctgctgccagtgtctttcggggagtga

SEQ ID NO: 6142 - DNA, 594 bp, A.fumigatus
ctccttcaagccacacgcaaagcgtatgccgacggcaacgaacgcatccggtacacaacgccagccattatcactgcatctattcgactggcccgtaaactcaagtctcgtgaacattacgacgacaactggcagtcacagtcctccgccctttataggttcatgcaccagtgcgtaaacactctctatcagcgcgccaaccctgggtgcgccgacctggcactgcgcctgtttgtgatgtgcggcgaagtggccgatcaaacgggatttgaagaattcagctacgagttctttgcccaagcattcaccatttacgaggactccatcagtgactcgcgcgcacagttccaggctgtgtgcatcatcgccggagcgctccacggaacccggggtttctccaaggagaattacgacaccctgatcaccaaggccgcgctgcacggaagcaaactgctcaaaaaacccgaccagtgccgtgccgtgtaccttgcaagtcatctgtggtgggtagtcgaaaacccccaacgaggcgaagaggaccccaagaacgtatgtccactctgttccctttgcttccatgatcattgcagctaa

SEQ ID NO: 6143 - DNA, 636 bp, A.fumigatus
cataacctagtgcgcatctgcgtctgcggggatgagggcactggcaagtccagtctcattacctctctcgtgaagggtgtcttcgtgacgaacaagatccaacccgtcctacctcaaatcaccattcctcccacgatcggaacgcctgagaatgtcacgaccaccacggtggtggacacatccgctttaccgcaggagcggagcaacctggcccgggaaatcagaaagtcgaacgtaattttgttggtctattctgatcattacagctatgaaagagttgctctattctggttgccgtactttcgatctctgggggttaacgtgccggttgtattatgtgccaacaagtcggacttagctgccgatcataccgaagcccaagtcatcgaggaggaaatgctaccggtgatggcggagttcaaggaaatcgattcctgcatacgtaccagcgcacgcgaacatcgcaatgtgaacgaggctttcttcctttgtcaaaaagccgtcacccacccgatcgccccgctgttcgattcgaaggagtccgctctgaagccagcagcggtcgcggccttacaacgcattttctacttgagcgacaaggatcgagatgggtatctttcggataaagaaatctaa

SEQ ID NO: 6144 - DNA, 210 bp, A.fumigatus
accatcgaggccggggtaaagcggtcggccctgcctaactgccttactggcttggcccccgaagatcccacgctcatccctttttctctttggcccttcagtcattgtatatcaaacttctatgagtgtattgatgcctcatcagatatcagtaagtatggtaactcacaagtcaaccctaagaaactactccagactgtaaatccgtga

SEQ ID NO: 6145 - DNA, 195 bp, A.fumigatus
atccatccaatagatgttgcaatcatcctgctggaccctggtccctcctcaacctctgacttctcgcatgcttccatctcctcaggggctgcatcggactccggtcaagcccagatgaccctgattaattttctccgttggtttatgcagttaatctactatgagtacaatgtatcccgtacactcggctcctaa

SEQ ID NO: 6146 - DNA, 777 bp, A.fumigatus
acgccattctcattccatcccaccatcacaatgtaccaccgcagtgcattcggcctcgttctcgccagcatattattgctcaatccagtcgctggcaaaccgcctctaggccaaaccccccaaatgggctggaattcatggaacaccttcaagtcccagatcaacagttcggtaatcgagaacaccgtccagctgttcgagcacctcggcctcaaagacgtgggctacgagtatatcctcctggatgagggatggtccgattactcgcgcaccgcagacggataccttcagcccaacctgacctcgttcccgaacggcatcaagccgcttatagacgatatccacgcaaaggggctgaagattggtttgtatggcgatagcgggatcctaacctgcggctttcggcccggaagctggagctacgaggagcgggatgcgcagacgctcgcccgctggggcgtggattactggaagtatgacaactgcggcggattccaggccatgactgagccgccgcaggtgcgctttgggatcatgcaaaaggcgctggagctgtctgggcggcagatcttctactcggtctgtgaatggggctatcagtttccgtggcactggggagggagtacgttctacccaccatccgcaacttctggaaagtggctaaagaaacgcagagatcggccattcctatcgcatgtcgggcgacatcaccgccaaattcaccaacgagaccggcagcgccgtattcgcccacaggggctggaaggaccgcaaatc

SEQ ID NO: 6147 - DNA, 597 bp, A.fumigatus
  unsure (205): Identity of nucleotide sequences at the above locations are unknown.
gcttttctagtctaccggctgagccgaggctcgtcctggtttctgttccagtacatttcgactcggtataaatggaccttcgcggaagccaaccttctcatctcattcaaaccggctttgacaatcccactcttcctgttcatcctgccggcgctctctcggcatctccttcgcagcatgcacacgagcaagaaggatctccagntagcccgcgtcagcattatctgcctctgcctgggcactctggggatcgggctgtctccgtccattgccacgttggttcccagtctacttgtgcagacggcgggatccggcttcctctacttgatccgatcattgatcaccacaatggtgaaacaggaagagaccgccaggttgtttactattattgaagttctgcaggccgtgggcaacgttatcgccagtttgtccatcactacggtgttccaattgggtctggaactaggtggtccctggatcggcctcgcctggatgatgacaagtacagcatttgcgttagtgggtgctgcggtctggtgtttccgattgcctccaatcgtcgagggtaagaatgaggctgaagttgctgaagtctga

SEQ ID NO: 6148 - DNA, 1428 bp, A.fumigatus
gggctcatgcattgctttggactgctggtcttagtcagtgggtggtggtttagatattcacactcaacacgcatgtcaaattcactacacgatgaactcgagtcctttgttttcctttgtttacatctcttgatcatcgctcttctcttgacgcgccttcacccatcctttgtatcgcttaacaaacatttccttcaagtctcttgctcggcatttcctgtagacagtgctcctttactaacaacgggtttgtctttcccttcgcacccgagtgttttcgagcaaacaacaatggcacgaactattcagagtgagttgaccccaagtgctcatgaaatagggaaaggattgccgctgacaacaagatatactttagcggaccgcaaacagtccaaagcaccaaccaggcctgaacgtactcctgatgaattggaggccggcgaagctctaatcctcctctccagggggtatggagaccccccagcaggcccgaggcagaacatgcagacacaaaacgatctgggcagctaccaaatgcggaacaaccggggtgtgccctcgaatgcctatcctcgtgctcgtcagaacacggtattggcccaggcagatggtaggatgcaaattcctcaaaacgttccgcagcaaccggcgagtgctgccatgccggcaatgcaaactggcccctattggaacggtaatccagccgcagcacagcgagttgctttgacgggccaggaggcgctgcaggcatatctgatcagacagcagatccttgcaggtgtagcgccccaggatattatcatgatgagagggccaccgcagcatggacgtccagctgtcccaccgctggtgcggataacgaaccaaggtgtttatgctcctgtcatacctcccgcgacattcaacggtgtgtttcacccatttccgatgttgcctgttcagcagaacaaacccaatgtcccggcacctacggctgcacctggtgttccttatcctgccgttgctcctggtatttctcctcaaaccgctagagaaccccagtgccattgtcctcctaatgggcgtatgatgccacaggaagctggcaagtttcaagctcaacgacccttgaacagagatcattctaacgcagcagcaatggctggtttagatacaaacctgggtgctcagaaccgagtggtcttaccagcggttatgcagcccaatgggcagcagccccaaggcccatattttctacccgccaggactatagcggaaagaaatgtgaacatgccagcaaataatatgatagcgagacataatggaatatttgagaagaatgctgggtctcaacgtccatcctacaaaacaccccgaatcaaaactgagtctcctgagcccgaagaggttcttgcaaatcaagttgaccataccagcattcggaaaacc

SEQ ID NO: 6149 - DNA, 186 bp, A.fumigatus
tttgcaatgggacctcagcgcttcaagcggcagttcattgtcgcaattctcctggccgcctcgatcatctggttaatgcgttctttcgaacatgaggatgccgacgtggcccgtacgatgccgctactacaaaaatacattcatccgcctagtggaaaaggaggtggtaagacacaaacacactaa

SEQ ID NO: 6150 - DNA, 318 bp, A.fumigatus
tttactgaaaaagatatgagagctgattgttctgtagactggcacacttccggtggagagtcactaggcatgtcgctcatggggtatcaaagtcttctagaccgtgcgtggccttcttgccatgttcctgattctgcgcaggctaatgaaaaggatataggaattccggaaccttcccggcagctagttttcgaggagttcatcaactcgccccgagaatacaagcacgatggcctgcccccggcgcctcatatctatccggttccgtatgttgggaccgaggaggcaagcatcttgaaggcagccaagcgatcatga

SEQ ID NO: 6151 - DNA, 204 bp, A.fumigatus
tcttttgcctcacactgccgtcaatatgagacccaagctgcatgtcgtcacttcaactgcgcagagccttactcgtccttcattatcgctcaagtctcctggtcctttcccccgcacaccaagctcgccggttcctctaagcccaggcgggaagcgtttctcgagtattcaagcgcaatcatacagttacaccaattcgtgtaa

SEQ ID NO: 6152 - DNA, 1809 bp, A.fumigatus
gcaggctcacaagaaggactctactgtggttttcttctggctgaacgctgcggagacttggttgaaattgtcaagtcgaaatcctcgcccgaccctctttctcttggagtaggttcgaagacagacacccaaactcattggttttccgagtcgggacgtattgatttgtttgtcttcttgggccccactccgcaagagatcagcaaaacgtacggtgaacttaccggctacactcaattacctcaacagttcgctatcgcttaccaccagtgtcgttggaactatgtcacggacgaggatgtcaaggaagttgatcgcaagtttgacaagtatcagatcccttacgatgtgatttggcttgacattgagtacacggatgaccggaagtactttacttgggaccctctgagttttcctgacccgaagggtatggaagagcagcttgatgactccgagcgcaaactcgttgtgatcattgacccgcacattaaaaacaaggaaggatactccatctctgaagagctgaagggcaaggatctggctattaagaacaagggcggggagacctacgacggctggtgttggcctggttcatctcactgggtggactgcttcaatcccgaagcaatcaaatggtggaccagcttgttcaagtacgacaaattcaagggcacccagccaaacgtctttatttggaatgacatgaatgagccctctgtcttcaatggaccggaaaccactatgcccaaagacaatatccactatggcaactgggaacaccgcgacgtgcataatgtcaacggactgacctttatcaacgcaacatacaatgccttactggagcggaagaaaggcgtggttcgtcggcccttcgtcttgacccgatcattctacgccggggctcaacgggtatctgctatgtggacgggagacaatcaagccacctgggaacatctggccgcatccttgcctatggtattgaataacggcattgccgggttcccgtttgccggtgccgatgttggcgggtttttccagaacccaagcaaggaacttttgacccggtggtatcaggccggcatttggtatcccttcttccgtgcccatgcgcacattgacactcgcagacgagagccctacttgatcgctgagccattcaggtcgatcatatcccaggctatccgtctgagatatcaactgctgcctgcatggtacactgcttttcatgaagcttcggtgaatggaatgcctattgttcggccccagtattatgtccacccggcggacgaacaaggctttgccattgatgaccaactctaccttggatctactggcctgctgaccaaacctgtggttgtggagggtgccaccactacagatatctacatcgctgacgatgagaagtactacgattactatgattttactgtctaccaaggagcgggcaggagacatacggtgccttcccccattgagaaggtcccattgttgatgcaaggaggtcatattatccctcgcaaggaccgcgcacgtcgtagcagcgggctgatgagatgggatccttatacacttgtgatcgtcctcgacaagaacgggaaggccgaaggcacactctatgttgatgatggggagtcgttcaactaccagcagggtgcatacatacaccgtcgcttcaaatttgaaaaatctacccttttgtcggaagacatcggcaccaagggttcgaagacagccgaatacctgaagagcatgacgaatgtgcgggctcaaaaggtcttcttcacgagaagcaaggaccgcgtaaagtta

SEQ ID NO: 6153 - DNA, 666 bp, A.fumigatus
cttaacgcttcgcggatcttcgcgccccgtggtgaagaccaagattttgatctttgtgacgactgcagattgttaatctttctgttcaggaatccatgtatccagcgaggaagttctgcgcttgcgatcggttgcccaagaagcagcgaagaagaagcaatctatcgtctttttgccctgccacaagtctcatgtagactacgtgtcgctgcagcttatctgctatcgtctgggaattggcttgccgatcgtcgtggccggcgactatctcaacattccgttactcggcccttttctacaacatgcaggtacagtcattatcacgccaattttgtaccatcacagctaaccatttcaggcgctatgtggatcaggagaagcttcgggaacgacccactgtatcatactgttgttcaggcatatatcgatacgcttttgcagaaagggtttaatttcgaatgcttcattgaagggggacggtcacggacgggcaagctcttgtcaccaaaattcggtatcctgaatttcattgtggacagcctgctatcaggacgggttgaagacaccattatttgtcccgtgagcacgcagtatgacaaggtcatcgagaccgagtatggcaccccagaacgtatggttccctgtcacattcttctgacacattaa

SEQ ID NO: 6154 - DNA, 399 bp, A.fumigatus
gacaggtctcattcctatcacaggtatgtttatcgtgattacaaagggcacataggtactgactcgctgcagctgttccgcggtgaattcattttccctcccgagggtttgacaactaacctggagaaaacactgcgagggctagaaaaggatgaagtcattacggtctccagagattcctccgggaagccactatttgttgaacttagtgatgctgagcgtcagcggggaagagagaactacgacttctactgtttccttatttggcctttcattgaggcggcctggcttggcgcagtgtccctcatggggcttactccgcctctggatgggccaaaggacgtttggatcgatcaaaagaaggcgcaagatagtgcacagatcgtaagtgttttttga

SEQ ID NO: 6155 - DNA, 273 bp, A.fumigatus
tctttctgttcaggaatccatgtatccagcgaggaagttctgcgcttgcgatcggttgcccaagaagcagcgaagaagaagcaatctatcgtctttttgccctgccacaagtctcatgtagactacgtgtcgctgcagcttatctgctatcgtctgggaattggcttgccgatcgtcgtggccggcgactatctcaacattccgttactcggcccttttctacaacatgcaggtacagtcattatcacgccaattttgtaccatcacagctaa

SEQ ID NO: 6156 - DNA, 768 bp, A.fumigatus
caaggtcatcgagaccgagtatggcaccccagaacgtatggttccctgtcacattcttctgacacattaattaggtcctacattagcgaactccttggccagccgaagcgaaaagaaaacttggctgaccttctttcgtcgtcttctgttctgtcattgaagttgggtcgggtcgatgttcggttccatgagccatggagtctgcgagaattcatcacgcagcaactgagtcggttgcccaaccagatcgacgcaaagtctggtcagaaactcagctacgcagaaagaggacgcattctgagaacgctggggtaccgagttctctctgatattaacaatgtgtccgtgatgatgccaacggctcttgttggcaccgttttattgactctccgtggtcgtggtgttggcaagggagagctggtacgccgtgtcgaatggctctgccaacgggtccgagcgaaaggaggacgtgttgctcatttctatcgatctcccactgaacttgttgtagatcgtgctctggaagtcctgggccccaaactcgtgggcgaggtaaccggtttggctgagcctaccttttatgctatagaccgcttccagctctcattctaccgcaacatgacaatccatttgttcataacggaagcacttgtctctgcagctatgtacacaagggtcaaacagggcggtggtcctgcacatcaacgtatttcgttcgaagatcttctgagacaggtctcattcctatcacaggtatgtttatcgtga

SEQ ID NO: 6157 - DNA, 1848 bp, A.fumigatus
cggcaggactatacatcctcgcacggtgcggatgcagcccagtcacttggatccgaggagctctgggaggctgcagagagcgcctggcagaagctccccagagccggtaaatcgaatgtggcagcttcgcgttcggcttctgaattgcatcgccagtaccagcggcacgtcttgcatatctgccgtgggctatgggcgaagtttgatgtacccagcatgttgcagggcgttggaattctttttgcagcgatcgtccttctcgtcttctacgcacgaggtatcacagccgcccgaacagaactcactgggtctctgctctcctccgttggggtgggatccgtgttgggtgctgtgactggagcctgcttgtcttactcccgtatgttgtctgctcgagcagtcgagtcttctgctctgctggctgccgtaggaagcatcgttggcgcatcgtgggccattttcggcaaatctgggcgcatcgtgttgcctctccccaatagtctttggggatggctcgcaattctcttcacagtgtcccaatcgatgggctttgcatcgaactcgtacacaatatgggaggatgaaatcctcctgttcttcctttccacctttggagtcgtcgcgggtgcatcatcgatgcggcagaagtcaaccgcggaccgcgtgcttggtgtctatcactcaatcttatttgtgattctgggcagaattgcgtccttctcccgcctgtgccgcgaagagcatatgccattctgccgctccacttattatgcttccacgacatcctctacgtctgctccttggcaacttgtcattccctttctcgtgaccctcacccttccggcagttgtccggtctttctatgcaggctccaaatcctatgaaggagcagcgacattgtggattggctttgcgttccggtttggcctctttgtcacttccatattctggacgctcgaggctgccgacgacagtgaatggggccttttaagcaaggagacgctgaagaccatacgtgtattcttcgctcaggttgtcctagcccttgcattcgccgctggaaccaccgcattcgtttacaccaaaccgtgcgtcagcataagcgtcagccaaggcggcgctgaatccgagggtagagaaccggccagaaagacggtgactatcttgggattcgggaatgtttatggcacacgggctttccttctcgtcgttaatttctgcctggccatcattctcatgcagaaaccgatgggtcaaggggcgatcggcctgctgctgtggcagatcttctctctcctggagatccttgacacgaatgggcttgtcatgggcaactcggccatcgggcctgtggtcttgggtcttcttgggtcgttccacttcttcaagaccggacaccaggccaccctcaccagtatccaatgggaaactgcgttcatccctttgtcttctgttcaatatccttggtcgccgattctggtcatcctcaacacgttcggcgcgcagatcctcactgcaattgctgttccgctcacggtgttgtggaaacgacccctccaactgcacgatagcagctcgtccactacatctagcacgccggccaccaggattctgtccgatgtggcgcaagcggccgcgacatatattctttactttgcaacgatcaacctcgcaaccacgatgtgggctggccacttgcgccgccacctcatgctctaccggatcttctgccctcgattcatgatgggggcggctgttcttggtgttgtggatattgtgttgatattattctctgtgactagcgtacggttcagcatattgagtgtggccgaaatctttggctggtag

SEQ ID NO: 6158 - DNA, 747 bp, A.fumigatus
tatcaacacaatatccacaacaccaagaacagccgcccccatcatgaatcgagggcagaagatccggtagagcatgaggtggcggcgcaagtggccagcccacatcgtggttgcgaggttgatcgttgcaaagtaaagaatatatgtcgcggccgcttgcgccacatcggacagaatcctggtggccggcgtgctagatgtagtggacgagctgctatcgtgcagttggaggggtcgtttccacaacaccgtgagcggaacagcaattgcagtgaggatctgcgcgccgaacgtgttgaggatgaccagaatcggcgaccaaggatattgaacagaagacaaagggatgaacgcagtttcccattggatactggtgagggtggcctggtgtccggtcttgaagaagtggaacgacccaagaagacccaagaccacaggcccgatggccgagttgcccatgacaagcccattcgtgtcaaggatctccaggagagagaagatctgccacagcagcaggccgatcgccccttgacccatcggtttctgcatgagaatgatggccaggcagaaattaacgacgagaaggaaagcccgtgtgccataaacattcccgaatcccaagatagtcaccgtctttctggccggttctctaccctcggattcagcgccgccttggctgacgcttatgctgacgcacggtttggtgtaaacgaatgcggtggttccagcggcgaatgcaagggctag

SEQ ID NO: 6159 - DNA, 1647 bp, A.fumigatus
  unsure (537),(686): Identity of nucleotide sequences at the above locations are unknown.
cccatggctggcacatatactttccttcctggcgacctcaacgcttcactgaaatctcggaatagaccctacactggactgcgcttgccttcgtcgtctcctgctaagaaacgggcctcgtccttctatcctgagcacggcccagagattgtggacgagaccaacccggatccattctatctcgagcactccctaggcaggtcgggtgcttggggccgtagcagaggggacattcgcgatgtccgattctgcgaggaaaccaaccaatatttcaggttatcccccgtgaatcacagccagaaggaaccgacgttccccaaatctgtaagaggcgaatcaaagcggactcctcgtcccagtcaacctgatcgatcgacacttaccgtcgttggattcgagcatcaatactctattccgccacaagttgcagttccacgttgggaaaagcaccccccgcacgagagccagggctctttcagctccgaacagattgacgcaactcccgacttgactccgagcagctcgttctcgtcaagntactcctccccaatttaccccgacagtggtttacagggctccgagtaccctgtcctgccagtccagttgccagcccagaggacacaatcaaggtcctcggaaaggttccaccaagcttccgctaagcaaccagtcagtctccgaccagnttcgtccaaccgtccatcaacgcctgcgcggaataccgaaatcacaagttccgcggaaactttgagaatgcctcgaacagaggaccaggacctctcagtccgacgcgggaaaccgctcccctctcttcctatcaacccccgtcacggcagtggtgtgcccagcaagaggagcactaattcgggccgtcgaccttccattgaaccctcgatgatatcccctcccagtctcatcaaccctgtcactctcgagcctcacacaacccatttcgatcaggccatgtttattcctgccaacgactgccccagccctgtgcccagtcgtggcccgccctctccaacgacaacgagtgaggcccccgtctcctcgagaagtcagaggccgtcgacctcagcctctgaggccccctttgagcattctgtgtgggaaccagattctgattctgagtcccttggtccgaaatcattgtcgaagaagcctatggacaccctgaaaaaagtccgcagccgggtgcatctccgtgttgcgaagtccgctcccaaactgcagaactccacggcctctgcgccaacagatccacccctggagaaatttccaacaatgcctgatcatccgcccagggatccatttcccgaacctgtcaaatccatggcaccgttgactttgtcaagccgtgaggtctttcggccgtcgccgttgcagacactgcgactcgtcaacccgtcaaccacctcccttgccagacctcgaacacctcgatctcgtcgaaacagcagccaagctaggggtcaggaccgggatcagcctcggaactacgactttgaccggtccgccgcccccgccatcaaggccaaatcccaacgcaaacagcggtcaaaccccctggccactcccgccgtaatggaagggaaaagtgtagcccttccgcctgcaagaatcccctcgaattggccctcctcctaa

SEQ ID NO: 6160 - DNA, 1398 bp, A.fumigatus
ttgccaaagtctgtcacagccgaggtggttgcggagaacgcacaggtacaggctatcattgagccacggctgaaaatgctaaccgacattgcgaacgggttcctgacgacaatcattagctccgtggacgaggctccctacggtatcagatggatttgcaagcagattcggagcttgtctcgccgcaagtatccggatgcccaggatcagaccatttgcacactgattggcggtttcttcttccttcgatttatcaatcccgctattgtcacccccaggtcctacatgctgatcgaatcggttccgaccgagaagcctcgtcgcaccctcactctgattgcgaagatgctccagaatttggctaacaaaccttcgtacgccaaggaaccatacatggctaaactccagcccttcattcagcagaacaaggagcgtgtcaacaaattcttgctggacctctgtgaagtccaagatttttacgagagcttggaaatggataattatgtagctctttccaagcgcgaccttgagctgcagatcactctgaatgagatgtatgctacccatgctctgctggaaaagcacagcctggctctggcacaagaccagcactcgcacctcaacgagctcttgcaggaactgggatcggcacccccgctggtcccgcgaaaggaaaaccgaacgatcaccgttcccctgtttagtcgatgggagactgctcttgatgatttgacggccgctctcgatatcacccaggaggaagtgtttttcatggaagcgaaatcgactttcgtgcagatcctgcgatcattgcctccgaactcggcgatcgcccggcggccgcttcggctggatcgaatcgcagaggcggtcgccactctgaagaacgatgctgtgatggtgcgaaagggcattcggaccatggagctgctgagtcagctacaggagatgggcgtcattgaccgttccgacgacttcagtcttttacgagatgaggtggagcaggaattagtccaccttggctctttgaaagagaaggtccttgaagagacaaagaagctcgaggaagttttcgcaacgatccgtgaccacaacgcgtacctggtgggccagttggaaacctacaagtcatacctgcacaacgtccgcagtcagtcggagggcaagcagcgcaaacagcaaaagcaccaggagctgggcccgtacaagttcacccaccagcaactcgagaaggagggtgtcattcggaagagcaacgtaccggagaatcggcgagccaacatttacttcatgttcaagagccctctccctggtacctttgtcatcagtcttcattacaaaggtaagtgcggcctgcagccttccatttgttgtgatttactgtcctgcggtggctga

SEQ ID NO: 6161 - DNA, 747 bp, A.fumigatus
  unsure (286),(555): Identity of nucleotide sequences at the above locations are unknown.
aattcttgtgttttcaaaagcccccaaaagcgaagaattggttccctccatatgacccctgtcgataagggcgttttgccccaatacaatcccggccagtttgtaagcgtacgatgctatgttccgagtataggctcctatcacctcggccataatagtttgtctgacattccgaacggcggacacttcgggatttcagtcaagcgagagagtgcgagggattcgaggccagccggtcggatctcgaatgtcctccacgagtcactgcctgttggcgcggagctgnacgtgagcatgccattcggtgacttcgtgctcgatctgaacgccaccactccagccgtgctaatcagcggcggcgtgggcttgacgcccatgatgtcgatgttaaaaagcatcgtgagccaacaaggccaatctcggcgtgttgtgtttatccatgcagcccgaaatggtcgcgtccacgccatgaaaaccgatctgaaccggatcgtggctgaaaatccgaccgttagccgcatcgtcttctatgaaaatgccaccgaagatgatacncagggtgtggactacgattatacggggcgtgtggatttgactcagatcaaagacaaggctgttctgccggatgcagactactacatctgcgggccgcagcctttcatgaaggcccagagccagagcttggaagctctgggcgtggctccggaccgcatccacatggaggtttttggcgctccgcgtgattga

SEQ ID NO: 6162 - DNA, 198 bp, A.fumigatus
caacttattgtccccgacatagtgccagccaatgttgactcggacgatgtccatgggtgcaacatcatgcctacatcagacgaggaaatcgtcaatatgctattgttgactagcctcagaaagtctcccgaagatggctatggtacacccaggatgactgggaagcacataccagaccagggaggtgttgctgaatga

SEQ ID NO: 6163 - DNA, 225 bp, A.fumigatus
agcaatctggaagcacatcagaagatcccatgtacaccctatcttgactacactcactgcatttcgacatccattaagctcaccgtagcatcacagaatggccacccctcgacttcagccccatgttgctccaacacccccaagctagtcattcccgacatcaaaatcttcaattccgcactgggccgccaactcaacccacccccgatatccacttcatcatga

SEQ ID NO: 6164 - DNA, 588 bp, A.fumigatus
ttgaatcctattgggtcgattagcaaagtagacctcaaaaagttcatcgcgtgggctcgcgattcattcgatctcccaattctgcacgatttcttaacagcaaccccaaccgccgagttggagcctattacagctacttacgtccagtcagacgaggccgacatgggcgtgacatacgccgaactaggcaccttcggctacctgcgcaaggtcgcaaaactgggaccctggtcaatgtacgagaagctgctccacgtttggggaaacgagtacagtccccgcgagatctacgagaagacccgtcactttttctaccactatgctattaaccggcacaagatgactgtcttaacgcccagctaccatgcggagcaatactcccccgaagataacagacacgatcttcgtcagtttttgtgtcagttactctccagcaccgacggtcttcttgctagggttaatgctgacttgtgtcttctagatcccccgttcacatgggcctacaagaagatggaagagagcgttaagtactgggaatccaaagggtggactgctggcaaggcacagaagaagagcgtcaaggcagac

SEQ ID NO: 6165 - DNA, 387 bp, A.fumigatus
tctagccgcatattccacaccagctttatgggcacccagaattccagtaaagaaacgagagagcgggccaaggccctctctaccgaaattggatcctatcatatcgacttcaacttcgacactgttgtgactgccatcacaaacttattcactgtgatcacaaatttccagccgcggttcaaagtccatggcggtactggagccgaaaatgccgcgttacagaatgtccaggctcgtttgagaatggtcctgtcgtacttgtttgcttcgctgctcccaactgttcgtcaacgtccaggtggaggtggactacttgtgctcgcatcttccaatgtagacggtaagatattctctcgacttcatctgttaagagtccaagcccactaa

SEQ ID NO: 6166 - DNA, 198 bp, A.fumigatus
gcgcactttgatgtgttcaacgcacttacgcttcacgataaccctctgttcctcgaacaactcaaatttggagctggcgatgggcagcttcacttctacctctacaactatcgcaccgcccctgttcctggaggagttaacgagaagaacctgccggatgagaaaagaatgggaggcgttggcatcgttatgctgtaa

SEQ ID NO: 6167 - DNA, 1014 bp, A.fumigatus
gctgcaggagctgtgggatttgttgacgtatcactacgtagaggacgacaatgccatgttccggttcagatattcgcagtcgttcctacactggtgggtgcacaacgcggccgagggatctgtttctcaccggcttgggagggtgtggattatttgagcgctgacaattttgaccgtagggctcttatgtcgcctggctggaaaaaggaatggcatgtcggtgtccgcgctacgaagtcgcgcaaactggtagcgtccatttgcggtgtcccgacagagatcaatgtgcgcaatcaaaagctcaaggtcgtcgagatcaatttcctctgcatccacaagaagctccgctcgaagcgcttgaccccagttctcatcaaagaaatcacccgtcgttgctacctcaatggcatctaccaagccatctacactgcgggtgtggtgctccccactcctgtcagctcatgccgctactaccaccgtcctttggactggttgaagctttacgaggtcggcttctcgcctctccctgccggatccaccaaggcgcgccagatcaccaagaatcacctgcccagtactacctctacccccggtcttcgccccatggagcccaaagacattgacacagtgcatgatcttttgcagcgatacttgtcgcggtttgcgctgaaccaggcctttacgcgagaggaagtggaccattggctcgtgcacaagccggagacggtgaaagagcaggtcatctgggcatacgtggtagaggaccctgaaacgcacaagatcaccgacttcttttccttctacaacctcgaatccaccgtcattcagaatcccaagcatgacaatgtgcgtgctgcttacctgtactactatgcaaccgaaacagctttcaccaataacatgaaggctctcaaagagcgtctgctgatgctgatgaatgacgctctgatcctggctaagaaggtaactacagggatccactgccatttccctggagttgacttacgaagctga

SEQ ID NO: 6168 - DNA, 708 bp, A.fumigatus
tggtcccccgcgaaacgtctcccaccatcagtgtatatcttaagactaagacgtggggccgtcgctgaaaaccttcccgagatccattatctttcgcgccttcgattttcaaccacctcgctcctcgctctccacactctagaggtaatgtcgaactctaaggatcgcaaaggcaaggcccccgagggccaatcttccgaaaagaaagatggcgcggtgaacataacccctcagatggcggagtcgctattggaaaacaaccccgctctcaggaacgagacggccggcatggacaaagacaaggcggcggaggcaatgcgcaaaatgaacattgccgaattgctgacaggcttgtcagtttccgggaagaaccagaaggatatggcttcgtacaagttttggcaaacgcagcctgtgccccgattcgatgagacgagtaccgatactgggggccctatcaagatcattgatcctgaaaaggtctcaaaggaaccggatgcgctgcttgaaggatttgaatgggcgacactcgacctgacaaacgagactgagctgcaggagctgtgggatttgttgacgtatcactacgtagaggacgacaatgccatgttccggttcagatattcgcagtcgttcctacactggtgggtgcacaacgcggccgagggatctgtttctcaccggcttgggagggtgtggattatttga

SEQ ID NO: 6169 - DNA, 450 bp, A.fumigatus
tccttccagccccgtggtgaagacaccagcttcctgagcctggtggaggcagacaagaccgataggatggaggaagttaaggctgctttgaaggatcacctgaaaatcgagaaccctagcgacgccgaatgccaggccgtcaaagtcctggtgcatgccattggcaagcgtgctgctcgcctcagcgctgtgccacttgctgcgatcctcatttccaccggtaaactggagacggatgatatggtcgacatcggtgtggatggaagtctggtcgagttctaccctaactttgagggatacattcgcgaggctctgcgggaggtccctgaagtgggtgctgctggcgagaagaaagtgcgtattggcatttccaaagacggcagtggagtcggtgctgccctgattgctcttgttgccagcaggaatgaaactggatctgggccgaaatag

SEQ ID NO: 6170 - DNA, 186 bp, A.fumigatus
tctaggaaagtaacatgtttctctgagtcgtcgccacgagacaaagcacatcatatgatggtgttggaggttaaactagataaagacccaaccctccgtccactttactgtgagtctgtgtctgttattgtggaatatttgtgcttggttaatcctgggagagcttatggttattgtacatggtga

SEQ ID NO: 6171 - DNA, 1344 bp, A.fumigatus
aggtatgtcgtactcattcctgttaaatgcgtaaaggctgatatttcaggtcgaatcaccaccaacggaacgtcggttgtggtcactggtgcctcgactgtggatatattctttgacacccagacatcctacagatatcccgatgagaccgagcgagattcggcggtcaagaaacagctagatgctgcagtaaaattaaattacccagcagtgaagcaagctgcaacctcagattaccagtctctttctggccgcgtcaaactggacctgggttcgtcgggatccgcgggaaatcagcccacggacatcagactcacgaactacaaaaccaatcccaacggggaccccgagttagtgaccttgatgttcaactttggtcgacactccctcatcgcatcttcccgcgaaggatcgtcatccggtcttcccgccaaccttcagggtatctggaaccaggattactcgcccgcctggggaggcaaatacaccgtcgacgtcaacctggagatgaactactggcatgcacaagtcaccaatcttgcagacacatttgagcccgtcattgatctgatggacaaagttctcccacacggacaggacgtcgccaggaaaatgtaccactgcgacacggggtatatcctgcaccacaacaccgacctgtggggagatgctgctcccgtcgacaatggaacaaagtggaccatgtggccgatggggagtgcctggttgtcgatgaacctgatggaccaataccgcttcacgcaagacaagacgctcttgcgagagcggatctggccgctcctcaaaagcgcagccgatttctactactgctacctcttcgaatttgaaggctattacactagcggtccctcgatctcgccggagaacgcattcagaatccccgaggatatgactctcgcgggtaaatccacaggaatcgatcttgcccccacaatggacaaccttctactccatgagcttttcctcgccgtaatcgaaacctgcaaggccctcgatatcacaggtgaggacctggccaacgctcagaaatacatctctagaatccgacagccccaaattggctcctacgggcagattctcgagtggcgacgggagtaccaggagaccgaactaggacatagacacatgagtcccatcctaggcctctaccccggctcacagatgaccccgctcgtcaaccagaccctggcaaacgcagccaaggtcctcctcgaccaccgcatcacctccggcagcggcagcacaggctggtcacgcgcatggacaatgagtctctacgcccgtctcttcgacggcaacagcgtctgggcaccacgcacagta

SEQ ID NO: 6172 - DNA, 636 bp, A.fumigatus
gctgctcaaagacaagtcgaagaagccctgccaaacaggccgagcaggaccgtgctagtcgatctcatgggcggcgccgatgttccggcaacgaacccggcggccaatggatctcagaacacggcagacgtacttgcggacatcctcggtggagactctggcatctcttcgcccgccccgcaagctgcacacgcacctgcccaatcagtcaacacgagcgccatcatggacctgttcggctcaaacggagcaaccccctcaccacgcccagcggagccggcatccgcatctgtggatatccttggaggactgggatccgcgccatccccagcaccatccccatcggccgcagcggtccatacagcgtacaacaagaacgatcttactcttactttgcaggtacagcgagctggtcatgggaatgcacagatccaggcccgtttccgcaacgtctccgactttagtcaattctcccatgtcggcttacaagccgcggtgcccaaaagtcaacggcttcaactcagcgcgatcaacaaatctgagctttctgcaggagacgaaggcgtgcagatgctaaagattgcagccatcagtggtgtaagtttgtcggcattttacaagtcaactcctggctaa

SEQ ID NO: 6173 - DNA, 363 bp, A.fumigatus
atgtatggaatgtatcacttccacagtcgtagtagtcatagtggggcgacatctccgcacgagtcttctgtctacctccaactttctcacaccagaaccctcagcagtcttcaccacctcaacactcaactagacaacctcccagtaaccctaaccatggcccaaacaatccgcatccctatccgaaccgaaaaggcccccctcccacccccattcctctctcaaggaatcaaagtagggaacatgatctactgctccgggcaagtcggcgtggatcctacaacggggaagatggtggagggccccatacaagcgcgcactgtactttcactctccccctcctctacgatactacaaagatga

SEQ ID NO: 6174 - DNA, 216 bp, A.fumigatus
aacgatggaactaaggcaacgcagaagcaaatcctacataatctctccgctgtcctggaagcaggcggatcaagtctgcaagacgtggtcaaggtgaatatcttcctggctgatatgggggactttgccgctgtgaatgaagtctatcaggcggcgtttggggagccgaagccgggtagtttccttctatccgttttgctctgcgttttgagatga

SEQ ID NO: 6175 - DNA, 1092 bp, A.fumigatus
tcattctcaagcagtgagacttcggttttattgatcgtcttcgtcacctttcaaagagtctggcaagttcaactcgtggccccgatgcccatcctacccacctcaatcgagggcttctcgcctcacgtagactcgaatcccggacgagccatcgagggtggacagtggaaaccacagtcagcgccgaggacacacgctcgacatggaatgtcgtttttgtcttggatggctcctttcctgcccgcttggctcacccagcggacaaatagcgatacaaacccaaacacaaactcaaatgaaaagcagcgacagcgtacccggccgacggcatacctcgatggattgcgagggtttgccgctctcgtggtctactggggacatcatgaactctgggcccacgagggcgcaggcgttggaaaggccttcgagctagcctacggttacgacaacaagtactatttcgcatgccttccgggggttcgaaccatcttcgccgggggtcattttgccgtcagcgtcttcttcgtgctgtccgggtacgtgctctcgatgaagccactgggatgcatccaggatggcgactacgcggagctaggtaaaaacctttcctcggcggtgtttcgccgatggtttcgtctctatatcccggtcatttgcacaacatttggctacctgaccttcttgcatttgtttaagattcgcacgatcccagagtttcagggaatctaccgctcggagctctggagctggtacgctgaattcaagaatttcaccttcgttttgggaacaggcggggagccgtggttcacgtacaacttccatgtttggtcgatacccgtcgagtatcgcggctctctggtggtttacaccgctgcgctcgcttttgcaaggtttcgccgcaacgcccggctgatcggcgaggtcgcgctggtcggataccttttgtacattgcggatggggcgcactttgccatgtttgttgctggcatgctcctccgagatctcgatctcctcgccatgcgcaacgacttgcccggctttttccgccgcctggagcccttcaagtccgtgatgatgactggactcttttaa

SEQ ID NO: 6176 - DNA, 1317 bp, A.fumigatus
agggcatggcgtcgcacgcgacgtccacaagctttttccagcaagcagatgggtaatcgagacacgaaggcaacaaacactaacggaaggattcaactcgatcttctgcagttggtccaaagagactatcacctgcgaagttacacgttgaactccgtatcttacgagttccttaaggagcagaaagaggatgtccatcatacgatgatcacggaattgttcaatggaaccccagactcgaggcggcgattagccgtgtattgtttgaaggatgcgtacttgccacaacggttgatggacaagctgatgtgcttggtcaattatactgagatggcgagagtcacgggcgtaccattcaactttcttctctcccgcggccagcaagtcaagttccttagtcagctgtttcgcaaagcccttgagcaacagcttgtcatcccgaatataaagtcgacggatgaacaagactacgaaggggctaccgttattgaaccaattcgcgggtactacggtgttccgattgcaacccttgatttcgcgtctctatatccttcgattatccaagcacataacctatgctacacgactctgctaaacaagaatattgttgagaaactgaagctcaagaaagatgaagactacattgttactccgaacggcgacatgttctgcacaacaaaagtgcgcaaaggcctcctatcgcaaattctggaagaattgcttgcagctcggaaacgggcaaaaaaagagttggccgtcgaaacggaccccttcaagaaagcagtgctgaacggaagacagcttgccctgaaggtcagcgccaacagtgtgtatggtcttactggtgccacagtcggaaaattgccctgtcttcctattgcgagtagtaccaccagttacggacgtcaaatgattgaaaagaccaagcaggaggttgaagccagatatactatcgctaatgggtactcccatgatgcaaaggtcatttacggtgatactgactcggtcatggttaagtttggcgtgactgaactggaagaggccatgaagctcggacaggaggcagccgattatgtctcttccaagtttcccaaaccaatcaaactcgagtttgagaaggtctacttcccctatcttctaatcaacaagaagagatacgccgggctctactggaccaacccgaagaagttcgataagatggatacaaaaggtattgaaaccgtccgtagagataactgtctgttggttcaaaatgtcatcgagacggtgctgcacaagattttgattgagagagacatcgatggggctcaggagtaa

SEQ ID NO: 6177 - DNA, 360 bp, A.fumigatus
gcgtttcccttccatcccgtggtgaagaccgtcattcagatagcaaacgttgtcacccgctatggagaatcgaaaccattcattcgaaatgttttcgttctggatacttgtagcttgattgtgaacacgcagatcttggaattcgacaaagaggagaaaatgttgatggcttggcgcgacttccttgagaaggtcgatcccgatgtgataatcggatataacatcgccaacttcgattttccctatctgttggaccgggctaagcatctcaaatgcactggattcccatactggacacgtctgaagggcatggcgtcgcacgcgacgtccacaagctttttccagcaagcagatgggtaa

SEQ ID NO: 6178 - DNA, 1110 bp, A.fumigatus
gctggatggatgggaaaggggaagaatagggacagcgagcaggaacagcacgtctctcgacccttgtcatcgctcaaggacccatccgctttcgggccaccaccgaaacacattgcagtccatggacctggtgcggttccaaatcagacgacgccggatcgcaggggattaggggcgcctctatctcaggaagagatccagcacgcacaggccaggcagcaggagcagaatcgggcagaggaagccgaacccccaaaaccagctggtccgccgctgccctaccgagtgaatacgacgggtataaatacagataatcttccacctcctcccgcccgaagattgcactcgccagcaagttcagtttcctctgcgggttctaggccagtgccgagtgtaccacctccggttcctcctcgcatgaactctactacacagtcgcacccagcaacccctcccccagcatattccccatcagaaacggcttctgagggattcttgaatcaaagtgctgtcacccgtctatccaatgctggagtttcagttccttcgcttggcattggacacaatagaagcagccctagcaacacacccggtggagtagccggtccagcctcagtcaatgagcttcaagctcgcttctcgcaaatgaggacgagcttatctcaatctccatcgcaagccccctccccaccggttcgtggaagcacaacacagcccgagttatcgacagcatctccacatagcaacttgcacgagcggcacaacgataaacttcaagcaggcaaagaacgagtccaggacctaaatgacaaatacaagatcactcaacgcttcaataactttgtcgacgagaaaaggtcggcaaacacatccatctcatcccagcaattccggcttcctcctacacccccgcaccctgatcgaagccagccttcacccgactcagtagaactagacgcattgaaccggcgaaaggccccaccaccgccgcctcccaagaaagcagcgatgcgatcaacacctgtcaacgccccttcttcaacgtcacctgtgccgccgccgctcccgctgagtaccaaacccgcccgagcggaggttaggtataactga

SEQ ID NO: 6179 - DNA, 1308 bp, A.fumigatus
agccccgctgatcgtgtagatgacaactgttattcggacgccgcgaccaactaccctaatgtcaactacgaacccagcacatctcctcgtccccgctacgaaatcatgtcgtccgccctcgcccgtgtcggccgaccaatcctcttccaaatctgcgaatggggtatcgactttcccgctctttgggcccctgcgctcgggaactcctggcgcatcggcaacgacatcatccccgcgtggcgaagtatcttccgcacgctgaaccaggccgtcgccaacacggatttcgctggacccggtcagtgggcagatctggatatgctgtatgtgggcaacggggtgttttctttgccggaggagcagacgcacttctcgctgtgggctattctcaaaagcccattgactattggagcggcgttgaaggatgatgacacgagtatcagccaggcgtcgttggaggtgctgaagcagaaggatgtcattggcttcaaccaggatgcgctgggagtaagtgcgagtctgaagaggaggtggtcggatgaaggctatgaggtatggagtggaccactgtcgggcaacaggacggtggtggcggtcatcaattggcgcaatgagtcgagggatctcacgctcgatctgcctgatgttggtctgcagtatgcccaagttgccaggaatatttggggcaagaccgtggtccgtgatgtgcgaacatcgtacacagcgggagtggcaggacatgggacgattcttcttgagttgcagggtacccttccgtcaggattatatccggccaagatcttcgcaaagtcgacaggtcaaagatccactttcgagtcaatctacgcagctaccactagcgcaaactacgagctggccatcaccttttcgcgaccgtccaccgaaaccgtcaccatcacgacctcctccggccagaccgtctcgatctccggcaaatcgggccgaatcgcgttgaccgctggatcgaacaccatcaccatccagcacaaaacccctatcgagtcgatccagattaccccaccgaccggcacctactacgccaacacggtcttcaacgttaccggcagcgccaagcacaccacctgcggctcggggtgcagccccgtgggctcgaaaattggatacctcagtcccaccagcaacgcctacacatctatctcaacgaccaccgcggggtccaagtacctcgcgatcgactacatcaacaatgaagtcgccttttcgtcaagctggggctggggctctaactcgcggtcttcaccacggggctggaagggtccgcgcctt

SEQ ID NO: 6180 - DNA, 447 bp, A.fumigatus
ctggccagatggaactcgtacaactactactcatgctcgcctaacgaagccataatacgctccaacgccaaagcgctcgttgatctaggactcgccgaattaggctaccgctatgtgaccaccgactgtgggtggtcggtggccgatcggctgcccaatggcaccttaacctggaacgagaccctgtttccgagcggctttcccgctatgggagaatatcttcacgaattagggctgctgttcggcgtttatggggactcgggaaccaagttgtgcgggagtcccccagaccaagttggcagcttgtgtaagtccccatcatccatgattcttaccttggctaatgtaccagaccacgaggaacaggatgcgaaaacgttcgctgaatggggagcggattcgctcaagtgtatgtctgtctgcccattaaagatgaagccccgctga

SEQ ID NO: 6181 - DNA, 519 bp, A.fumigatus
gcgacagccaaacacttcttcgacgacccgaatcacctggtccagacggctctccattccctgacactcacaaatccatcgctggcgtttgattcgaaacacaaggttattttccgtcggccggatgcatccagaaaacccaaggtggccatcatctcaggcggaggttccggtcatgagcctgcgtttgcgggctatgtcggccatggactcatggacgcgtctgtcgcggggagcatcttcgcctctccgtctgccgaacagattcgccatgccgccatgaactgcgtcgacaatgaaaagggcgtgttgatcatacctatgaactacactggcgacgttctcaactttggcatggctgccgagaagtcgcgggctgcaggaatcaagaccgagttctttgccatcaacgatgacgcgggcgtcggcagaaagaagggcggaaaagttggtcgtcgcggtatcggtggtggcatcctcatcttgaagattgtcggagccttggcggagactgggtaa

SEQ ID NO: 6182 - DNA, 714 bp, A.fumigatus
  unsure (683): Identity of nucleotide sequences at the above locations are unknown.
accgtcttgtgcagagcatccctcgaagacgtctaccgcgttgctcaactagcaaacgctaaccttgcgtctgtgggttcgtccttggagcacgtccatatcccgggtagaggagtcccagaggatgtcatccctgatggggaagtggaggtcggaatgggcattcacaacgaacccgggtcccaccggatgaagttttcccttccagaggtgatcaagacgatgctcttgcagatcctggatcacaacgacccagaccgcgctttcctgacctaccagccaggcgatcagttcgtgctgcttatcaacaacctgggtggcgtcagtaccctcgaactgtcgggtatcactgacgaagtataccgccagctcaccaaagatttccacatcaagcctgtgcgaatcattcaaggaaccttcctgaccagtctcaacggactgggcttcagtgtttcactactgaagctcgcggatacgggactgggtcctggcaagtctatgctcgagctcctcgatgcgcctgccgaagcagtgggctggtctgctcctatccgcacatcgacctgggaggcacaccagtccgatgctcccgtgcaggtcaagagcaccaagcttgctgaagatcaaccgaccaacatcaaccgtaagtttaaaattgtgcctcaccacgccgctaaaagganccgatttggcgaaccacccgagaaagaggta

SEQ ID NO: 6183 - DNA, 204 bp, A.fumigatus
agtggacaaaagtcgggggatatacagatcgccgactactccccccgattcgaggatgccgctggacctacagagagactacccctcttcgctttaaataatctgtcggcaactgtctcgcgcgggatgagttccaatccgacaatgtctgggcgtatttccccctcaattgacgccaaccccggccggggatggacttggtaa

SEQ ID NO: 6184 - DNA, 462 bp, A.fumigatus
cggccctgcggtaaaaaaaaacagtcggctcggctcactacgagtcgagcccagcttcaaagtgtccagatgcaagtgaatgaggcattttcgatgcgtaagatccaaggcagtctgaagaaatcgactggaattatgaaggacgtcaatacattggtccgactgcctgaattgacaggaaccatgcggcaactggcgacggaactggtgcgtgccggtatcattgaagagatggtggacgacgcgatacccaacaatgaactctatgaagacgaagaagatgaagccgaggcggaagtcgacaaggttctacaggagatcttgcagggcaagctttcccaggccggagaggtcaaagctgaagaaccagcagaaggagagccggctattgaggaccagatggaagatcaagaagcggccctggaacagatgagaggccgattggaagctctgaaaagctga

SEQ ID NO: 6185 - DNA, 360 bp, A.fumigatus
acctctcactctccaatccggaccactcattcaagctcaacaacaatgtctaccaagctggacaagtctctcgacgagatcctcgtcaaccgtcgtcaaaacgctcgccgccgcactcgtcgaccagctgcttcaaagcctggcagtgctgccgttccagttggaggagtgaagaagaatgcaaaggctgccaaacctgttgcaaagggcgctcagggtggacacccggtcgcaacagagagcaagatcatggtcagcggcttggtaagtttccacttacgctccgagcttgtaatgtgcggatatgctaactccctcaagccctctgatgtgaatgaggccaatatcaaggtatgttga

SEQ ID NO: 6186 - DNA, 1047 bp, A.fumigatus
cagggacgtgctccacgcgcttggacgcgcctcgcgtcgtcgtacaagcagaatgggaccatttccgccctgggttcgtattatcgcttgacaccttgcaccgtcctacttcaatgcggagggactatcacgggcttcgctgaatatactaatgatcaattgacatatctgttatgcaccttatactctgattgcaccaactacaccatgtcaaccccctccacaccgcggacggcgcgctcagcgtcggagagtggcacccccatccttacaccaggaagaaagatcagggccatcctggccgctttcgatagcgattcagagtcagacaatgccaacaacaaacagcgaacgatacagaagccagttgaaaccatgaatgatgtggaaagcgaagacgacgatgacgacgacattgtgaagcctaagggccggctagcggctcgtatgcaagcgcatgatcagacaagcgctagcccaccagtgacggaacgaacggcattcgaccgtgtttcgaagttcttacgagccgaaagagagcagtccaaggaaggcgagcaagcgcgtcttgaatctgcttctgcttcggaggacgaggatgaccttcctaaggctggtcctaggaggaggcgcaatgtaagaaagacaccggagccaggtgagaacaacacgtctgcctcgtcgtctcgcgctcggtccttttcccctctttttatgtcctcccccgcgccgcagcgcaatgaggcactttcagacgacgaggcgaatgatgacgatgaagaggatttgaaggccgaccctcgtgttcgcgcgctcattatgcagaagcggaaggagcgcgaagaaaaggaaaggctcgaagcggagaagcagaccgcgcggctggctcagagggatcagtttagctcggaaatcgcttcggtcgaagatattgatgaggaagaagctggacggaagctaacacagcaacggcccgctgctcgtaaggctagccaaaaaagctttgggaaggagatggaacccgcgaaacgccagagaatccgcagg

SEQ ID NO: 6187 - DNA, 480 bp, A.fumigatus
tggcacttgcagttggagttggcggaactgatgggaccaaagctcgctttcagcacccaaccttcgaaacctcgcaaggagaagtcggattatgagcgcctcgctgagttgaacctgcgcggccagaaactgaacaccgaaagtgtgcgtcgtgcccagctcgaggagagaaaggcgagtcggaaagcagctgcagcagttgctcgtggtgaagctcaagccaatccattcatgcgtgttcgcaccctcgccaagacccactacgatgccaacggaaacagcctgataccggactcactgtccagccgcggcggaactcctgctacaggatctgagacgccatctaagcccagtacgcctaagcctgccgtcactacacaaaagaagcaatcgaagggtggcattgggtcgatccgtcatcgcaatatggacgacgagaatattgcggccctggacctggagttggatattgaaatctga

SEQ ID NO: 6188 - DNA, 1491 bp, A.fumigatus
  unsure (1219),(1241),(1263),(1271),(1279),(1389),(1419): Identity of nucleotide sequences at the above locations are unknown.
cggcaagaagaacgccccgcaaaggttggcaaacgcctggcagtcttttcgggacagatttcgccgaatgacttcccgggacccatgaccaagcgacggaaacacagcaattccggccgccttccgtcagatctgaccatgaccaagcttgagaacggacagtcatctgtgggtgggtccaattcaggggtcttaggaaacgacacttctttcaatgcggcacgtggttttgcgtccccggcggagaggccctttgtgacaccgtccgccatgtcgggtcagttcgccaaccggccaccaacacccaatagcggagacaacaatcctttcttcaatcccagcgcgacccaaaccagcttggatacattcattcaacagcagttaatgtcggcgccaaactcggctcagcctagccgccctggaacgcccggtaactcagcgcgccacggtttccaggatcagtccatcaacatctcattaggctcaagcacatctactcccgcttggcctcctctcacaaatgctggcaaccggctgccttctgtcattcacaaggttgtcccagcagaaggctccatcacaggaggcacagaagtgacgctgttaggaagtggcttctaccctggtatggaggttgtcttcggtgataccctggccacaacaacgactttttggggtgataagtgcctaaattgcttgactccgccagccctccagcctggcatggtggctgtcgtgttcaagcatgagcatccgacatttggtcaaatgcagccggctcagcctctgatgcccaagcagcagcaattcttccggtacgttgacgacagagagctccagatgtatcgccttgcacttggcattctggggcagaagctgggcaaccaggcagatgcgtttcaaactgctcagcagatcatgggtagcgatcccaaggctgttttcaaccttcagaaagacttctccgccggttctggcggccatcagcgacaggttcctggcctagagtctcagggcgaactcagcgatctggactcgaagatgttgacgtatcttgaattcatcgaccttgacgacaacccgcggccgccgaagtataactcgcgctgcgcgaccgggcaaactctgcttcatttcgcctcatccttaggcctgactcgtttcgttgccggactgctcgcccgaggagcgaacccggaggtacaggacaatatcgganacacgcccatgcacctggccgncttgcatggtcatgcgcatatngtgaacangctgcgtntggctggtgccgacgttaacgctcgcagcatcaggggtttcactccggccgacctaaccacaactcttccaacccaccaagctgcacttgatccctgctcgcacaaccgnttccgtaccgttgggtcggtaacctcgttncgacgcaggccttacagttcttgttccctcaattccctttggaaatcgccgccggattcggggatcaatgaa

SEQ ID NO: 6189 - DNA, 186 bp, A.fumigatus
  unsure (54),(62),(70),(92),(114): Identity of nucleotide sequences at the above locations are unknown.
gtcggccggagtgaaacccctgatgctgcgagcgttaacgtcggcaccagccanacgcagcntgttcacnatatgcgcatgaccatgcaagncggccaggtgcatgggcgtgtntccgatattgtcctgtacctccgggttcgctcctcgggcgagcagtccggcaacgaaacgagtcaggcctaa

SEQ ID NO: 6190 - DNA, 1503 bp, A.fumigatus
acacaacatcagaatcccgatggtgttgtggtaagcttttctcaaccacccgagactgataataattattttaccacatcacgccgctcttttaaccgccacaatatcagcgaacagaccaagacattgggagacaaggcctgttggccgctcaacaattacaatatgccgaggaacgtgaagaagaacccgcgagatgtcactaagctctccgggaagcctctggctgagacgatagagccatcacctgttctgaaaaccctgcaggaggggtgggtaacctcgccagatctgatagagggtgatctctcctttactctagaggtgattcaaaacatgacggtttttctgttggcgaatcccaacctgaattcaagccacttgttccgtgcggatattctttatgatagcctgggcgttctcagcgccccgcatgctatggagcagagtcgatatcaggggagcggcggcagaaaccaggatacccaaaaagaagattatgtcgagccccttcccgcaaggagtgtacctggattcgaactgaagaggacctttgtgagaaggctcatccctaggaataggaatctggaccggcccctcgaacagacctgtcatttttacgaggcggatgaacttcccccaacatctaacagtacaaacattgctcaaagcgagcaatgcgaatcgaaggctgagtcgcctcgccaacgcttcttggtcatttacctgccgcatgtctcgtccaaggaggagatgccatggtaccaccccttgctacgatcattggcctttctgtatgagtttacacccaatgcctttccacattcatccgaagagaataaaggaaccgggataatgtcggtgcacttccttccctacgaggaagaaccgatccagaaccgtctagagcgcaccctgctcgcgctgttgagtactcatatccggcttgctcgtcagacgcgcctggacgaaaagccagaaagagggaactacaacccgcccaaagataacgtgataccaaagcacctcgtgcaagacacctatgcccgactcaaattgaagtatgccgcggacctctgtcaaaattgggtggaggatactgaaccgaccaagcatgttcttgaagactctcccatcacggccttcctgatccagttgtggaagaatatgtacggaattgttccccccaatgagagaaccccgacccaatggaacagggaagtaccacttaaattcccccgggttcctgaatttccctgtggaaccggggtccggtcaagttcccctctcggaagggttacatgctggggaattaaggccctcctccaaaacacggaattatttcccctctccctccggaaaaaaatccgggaggaattttctttccgaaccctttgcaaattgttgccaaaccgaaaaaggcttggggtaaaacccccagggctttttctggaaaccttccctcttctaatctgggaaaaaactaatctggggctcctttgg

SEQ ID NO: 6191 - DNA, 1527 bp, A.fumigatus
  unsure (762): Identity of nucleotide sequences at the above locations are unknown.
ccgcgtctagctggtggactgattgcgcataatgatggctttgccttgttgaccaacgaagccctgccttccggaaccagcaatgcgcccccgtccaacacccccgttccagtcctctaccgctacaccaacggccagcagacgtggaagacctggctgggtggccccggagtgcacgaggctgacggcctgtcagcttctcccgacctcaacggcgatctggcctactccgaaagcgccaagatgtacggcgcctattttgtcgtcactgactacacgggctgggcccagggccacttcggcgacagtattcagtacgtgtcggacaacggaaccctcgtcacgatccccggcgccagcagctcctggggctgcagtcacaacaccggcattgcgttcgaggccgcggacgaaccaccctttgccagcatctgcgccgaggaccaaggcgccatctggctcaacaccaagacgcagggaatgtccaacgacggggtcaagatctccaatgagaacaccaccaacggagcctcgggtgagcccatgggcggtatgtccggcagctacagtgctctagcccgcttcgccgacactgcccgctacatcttcgcctgggtgtcccggggtgccatggacgtgacggagaacagctggatgggtgccggatacacccacgtgaataaccggacgaacggccgcaacgtcgccattgcgcttttctccgacaagtacaccaaggtcggtgctcaggcgacgtcccangtgggggccgaagatggcgacagtcaggtcacctggatcaccagcggctcgaacgactgctccaacgcgcacgcggctacctttggcgctgactcggcgctgatcacctgggaggagatctcgaatcctacctgtgactacatcgccatgggctgccgtggacaatttgcgggctccttcttccagcaggtcgactcgagtggcaagaaagtgggcgaagctctcaccagcaccgatacatacgtggcgggtgacatggtgaccatggccgacggtcgtgtctgctggccctatgtcagcatgacctgggatctgtcccagcctgtcggcttctcatcctccaccaccaagaagatgagctttgcttgtatctcgcttggcggggcatcctcgtcgtccagttcgtcttctgcggcatcctctgcatcttcggcctcttccgcttctaatgtagttactcctcaaccggaggcgtcctcttcagcttctgcgactgcaacccctgaagcaggagcttcctctgaatccgctgccgttccttctggtgcttcctcggcttcttccgactccactgttgacacggagaccaattatgccagcgaacccgctgctcaggatgcgtctgtgcccgcacctacggatacgcagccagcggttgaagctgaaaccccgaccccagcacctaccgcgtcatccggcaggaaaggttctcacggacatggacacctaaagtacaagcaccccacttcttgccgggcgaaataa

SEQ ID NO: 6192 - DNA, 525 bp, A.fumigatus
ccaacgaagccctgccttccggaaccagcaatgcgcccccgtccaacacccccgttccagtcctctaccgctacaccaacggccagcagacgtggaagacctggctgggtggccccggagtgcacgaggctgacggcctgtcagcttctcccgacctcaacggcgatctggcctactccgaaagcgccaagatgtacggcgcctattttgtcgtcactgactacacgggctgggcccagggccacttcggcgacagtattcagtacgtgtcggacaacggaaccctcgtcacgatccccggcgccagcagctcctggggctgcagtcacaacaccggcattgcgttcgaggccgcggacgaaccaccctttgccagcatctgcgccgaggaccaaggcgccatctggctcaacaccaagacgcagggaatgtccaacgacggggtcaagatctccaatgagaacaccaccaacggagcctcgggtgagcccatgggcggtatgtccggcagctacagtgctctag

SEQ ID NO: 6193 - DNA, 231 bp, A.fumigatus
  unsure (8): Identity of nucleotide sequences at the above locations are unknown.
agcgctgntccatttatcccggcggttggacacgaccatgtcgacccggcggtcctcctgggcttcatgtccaagtacacatccagcagtgccgactgggcgcgatacatgcgcaatgacccgagcaagaactatacccggaacctggtggccgatatcagcgggcgtgcgaatctagtatgtcatctatgtcactcgcggtatctccctaatctagaggtccgggattaa

SEQ ID NO: 6194 - DNA, 396 bp, A.fumigatus
ctgctgttagtctggaaccccgagaagggatcacccatccacgaccacgccaacgcgcactgtatcatgaagatcctcgatggggaactcaacgaatcggtctactacactcccacagcggaggaccaggactcgcccctgaagatcaagacgaatacgacgtatcagcctaacgaggtggcctatatcagtgatcagattgggctgcaccgcgttgttaacccggccaaagaccggctggcggtttcgttgcattgtacgttcatgatcatggcattttggcgagtttggactaacgaacaacgcttagtgtatacgcctccgaacgcagcggactttggatacaatatctacgatccaataaccggaaaatccagtcatgtcttccaggcgtag

SEQ ID NO: 6195 - DNA, 186 bp, A.fumigatus
  unsure (112): Identity of nucleotide sequences at the above locations are unknown.
cagttaactccgacggacgggggctggatgccttccgcattaattggccaagcgcagcgtttcaacaatgtccccccaaaggcaaaaaacggaaagatctttttgcctgtanaagagaaccgtcttccgaaaatataccatgggacaaggccgtttgcccttcaacattttgtttccatttcccgg

SEQ ID NO: 6196 - DNA, 1248 bp, A.fumigatus
acagaccagttactggcgggcagccatccactcctccaccaacccccggtaatcctccatcccatacggactcagcaccctcccgaagataccactcttcctcacactgctcacccccaaatcattcagcagcagatccacatacggaatcgcatcaaacacaaagtccgggttccgcttcccaaacccgccgggataccgccacttgccaaactgggtatgcagcgccgtctcccacaccagatccatttgctcgcgcttttcgtccagcttctcggcatctacatctgcgtggtcgtcgttctcgtcgaccgcccgcagcgcacgaggacaccgctccgtcgtgcgcaacacgggactccctccaaagaacgcagcgatccacagcgcctgcacctgcgccagcaacgtcgtgttgatcgtcatggcaatccccataaacgccagggagcgttccctcgccaacgagcacggcaccatgaagcgggccaggcggaagggatgcgcgacggtggcgggggcatccggcgcgagcggggcgtagtccttgggcggggcgggctggttgcgcagccgcgggaaccgacggaggatttcttcgtcggcggcggcgaggagatccgctgggatggggtctgcggcccaggggaagccgcagtcggtctccaagccgggcgggaggaagtcgaggttgggggtggctttccagccggtggagcagatgagggcgtcggaggggaggtccgtgccggaggagaggtggacggttccctgggcgagacgggtgatgttggcgacgtggacgcgcacggcgccggagcggaccagctcgaagaagtccgttgggtagttgaggatgctgaggccggaggcgatccagaaggggctgatccagggcttgagcttggcggtctccgggtgggcgtcgtagcggttcagctggacgacgtcgttggcgaggatgcgccaaaacgcgtcgacgatcttgcgcccgagcccggtgccgtgcaggaagcggcggatgcgcgggtagccgtcggcggcgccccagatgcaggggctgaagaaggtcaggaggcgcgtggtgaccagcttctcgagccacttcttcagcggggtgacgtacggcggcgccatccagacgggcccgtgaccgttctggcggatgacccagtcgacctgcgcgcccgccgtggcggccgcgtagacggcgtccgtcttcgaccacaggggctggaagaacccgcg

SEQ ID NO: 6197 - DNA, 327 bp, A.fumigatus
agcgcgtttccttccatcccccgggttgaagagctatgtcctccgtatgggctggagcagaactggtcggatggcccgtttgagacggcggtgcgaacgtggtattggggacgggagaaggttggccccttctctgtcgtctggtttgatatgcttcctgctgggcacggcaccgaggtggtcagtgggtatgtggctgttgggatggaagtggtggtgtctgtccggccatggaaggacggatggcagctccatatccgccagtgcgtgcggatgtgccggatggggttcagggtgtttataggattgggatggaggtggatgtga

SEQ ID NO: 6198 - DNA, 513 bp, A.fumigatus
accgctacgacgcccacccggagaccgccaagctcaagccctggatcagccccttctggatcgcctccggcctcagcatcctcaactacccaacggacttcttcgagctggtccgctccggcgccgtgcgcgtccacgtcgccaacatcacccgtctcgcccagggaaccgtccacctctcctccggcacggacctcccctccgacgccctcatctgctccaccggctggaaagccacccccaacctcgacttcctcccgcccggcttggagaccgactgcggcttcccctgggccgcagaccccatcccagcggatctcctcgccgccgccgacgaagaaatcctccgtcggttcccgcggctgcgcaaccagcccgccccgcccaaggactacgccccgctcgcgccggatgcccccgccaccgtcgcgcatcccttccgcctggcccgcttcatggtgccgtgctcgttggcgagggaacgctccctggcgtttatggggattgccatga

SEQ ID NO: 6199 - DNA, 1095 bp, A.fumigatus
gcgcgggttcttccagcccctgtggtcgaagacggacgccgtctacgcggccgccacggcgggcgcgcaggtcgactgggtcatccgccagaacggtcacgggcccgtctggatggcgccgccgtacgtcaccccgctgaagaagtggctcgagaagctggtcaccacgcgcctcctgaccttcttcagcccctgcatctggggcgccgccgacggctacccgcgcatccgccgcttcctgcacggcaccgggctcgggcgcaagatcgtcgacgcgttttggcgcatcctcgccaacgacgtcgtccagctgaaccgctacgacgcccacccggagaccgccaagctcaagccctggatcagccccttctggatcgcctccggcctcagcatcctcaactacccaacggacttcttcgagctggtccgctccggcgccgtgcgcgtccacgtcgccaacatcacccgtctcgcccagggaaccgtccacctctcctccggcacggacctcccctccgacgccctcatctgctccaccggctggaaagccacccccaacctcgacttcctcccgcccggcttggagaccgactgcggcttcccctgggccgcagaccccatcccagcggatctcctcgccgccgccgacgaagaaatcctccgtcggttcccgcggctgcgcaaccagcccgccccgcccaaggactacgccccgctcgcgccggatgcccccgccaccgtcgcgcatcccttccgcctggcccgcttcatggtgccgtgctcgttggcgagggaacgctccctggcgtttatggggattgccatgacgatcaacacgacgttgctggcgcaggtgcaggcgctgtggatcgctgcgttctttggagggagtcccgtgttgcgcacgacggagcggtgtcctcgtgcgctgcgggcggtcgacgagaacgacgaccacgcagatgtagatgccgagaagctggacgaaaagcgcgagcaaatggatctggtgtgggagacggcgctgcatacccagtttggcaagtggcggtatcccggcgggtttgggaagcggaacccggactttgtgtttga

SEQ ID NO: 6200 - DNA, 1239 bp, A.fumigatus
cgcgggttcttccagcccctgtggtcgaagacggacgccgtctacgcggccgccacggcgggcgcgcaggtcgactgggtcatccgccagaacggtcacgggcccgtctggatggcgccgccgtacgtcaccccgctgaagaagtggctcgagaagctggtcaccacgcgcctcctgaccttcttcagcccctgcatctggggcgccgccgacggctacccgcgcatccgccgcttcctgcacggcaccgggctcgggcgcaagatcgtcgacgcgttttggcgcatcctcgccaacgacgtcgtccagctgaaccgctacgacgcccacccggagaccgccaagctcaagccctggatcagccccttctggatcgcctccggcctcagcatcctcaactacccaacggacttcttcgagctggtccgctccggcgccgtgcgcgtccacgtcgccaacatcacccgtctcgcccagggaaccgtccacctctcctccggcacggacctcccctccgacgccctcatctgctccaccggctggaaagccacccccaacctcgacttcctcccgcccggcttggagaccgactgcggcttcccctgggccgcagaccccatcccagcggatctcctcgccgccgccgacgaagaaatcctccgtcggttcccgcggctgcgcaaccagcccgccccgcccaaggactacgccccgctcgcgccggatgcccccgccaccgtcgcgcatcccttccgcctggcccgcttcatggtgccgtgctcgttggcgagggaacgctccctggcgtttatggggattgccatgacgatcaacacgacgttgctggcgcaggtgcaggcgctgtggatcgctgcgttctttggagggagtcccgtgttgcgcacgacggagcggtgtcctcgtgcgctgcgggcggtcgacgagaacgacgaccacgcagatgtagatgccgagaagctggacgaaaagcgcgagcaaatggatctggtgtgggagacggcgctgcatacccagtttggcaagtggcggtatcccggcgggtttgggaagcggaacccggactttgtgtttgatgcgattccgtatgtggatctgctgctgaatgatttgggggtgagcagtgtgaggaagagtggtatcttcgggagggtgctgagtccgtatgggatggaggattaccgggggttggtggaggagtggatggctgcccgccagtaa

SEQ ID NO: 6201 - DNA, 189 bp, A.fumigatus
  unsure (83),(85),(87): Identity of nucleotide sequences at the above locations are unknown.
ctccggcgttacagtacgtcctcccctcacctatctcatctaggtaattatgtggttctgtatgagtatatcaacgcccgccncncnccgagctcgtatttgacgctcttccacatcgcggtcaataactactgcgacgattcttccttgctcatgattattactggcgcagactgcacagactgttag

SEQ ID NO: 6202 - DNA, 1233 bp, A.fumigatus
  unsure (1218): Identity of nucleotide sequences at the above locations are unknown.
ccgatgaggcatccacccttcccgttagtttaccagttgaaaacaaagtcatacactgcatgtaccaaccatctaacatacaacaacttgaagactgcaacgattcgcacggcctccgacgcggatgatgacgctggctcaaattccgatattgaccgacacggagtcgatgtcgacgacgcgcgtgctcatttcctgggggctactgtagacgctcgcgatgtcaatttctccgatagcattgccctgaaacgaaaatcatacagaagcaaaagccgacgacgacgaagaggtcctgatggggtagaagacgtgggcgatgccagcgacacggaggaggaaagcttcgaacggaaactggcccgcctgcgcagggaagtcgaggaattgaaggatgagatggcctcacgaaaagcaaagtcggaatccaccgaggagcctgcccaagcggtagacgacggtgtgctggaactgagccgggcgctggataaccttcatgggtcttctcaaaatgcgtcaggatcgcactccgctgccgcagtactgtcccggaagcttgtgtccacatcttcccaaggcattccaggcgaatccaagggagctgaccagccgattgcgacagaagatgcagtgactctgtcctccgctggcgttctggcacatgctgcagcctttgacggccggctagcattaattgaagccgccatgggcatctccagctcttccaatccttttgtttctgacggcatctccgagccggcccttcagcccgtccttccagccctcgaccacctcacgtcccgactatccacacttacgaatatgcttgccggccccactccggcatcagccgtaccgactactggatcagctccaccatcgacaacattcacaaccacccacctcgaggccctatcaagccgggtacgaagactgaccgcggatgccgatgcactcgcttcagcgcggatacgtgcggttgacgccgccaaagccgcccagaaagcccgtatcgcgacctccacgatcgagcaggcctccgacatgtccgtgtcatccgggtcgggcacagaaatcgaacaagcggctgctcagcgggacgagcaagccacgaagattcaagccctctacgctaacctcccccaatatccagtccctttcatcctatccctaaccagcgtggtcgaaccgttaacgttccctccgtggccttccacnccggggggcgcccat

SEQ ID NO: 6203 - DNA, 570 bp, A.fumigatus
  unsure (561): Identity of nucleotide sequences at the above locations are unknown.
gtgacagataaagcggagtcgccgtctgtctattgccgtgatctcatcgctatattgccctctggatgcgcgattccgtatcgtgtagctcacatggctccattcacgtttctggtagggatactatccctctgtatttgctgcattgttcttggtgcagctgcagagcccagctacgcggtcgttgagcagctcagaaatgttcccgacggctggataaagcacgatgcagcgccagcgtctgaattgatcagatttcggctggctatgaaccaggaaagaaccgctgaattcgagcgaagggtcattgacatgtcaacgccgggtcactcgagctatggacaacatatgaagcgtgacgatgtcagggaatttctgcgtcctcccgaggaggtttcagacaaagtcctttcctggctgagatcagagaatgttcctgctggctcgattgaaagtcatggcaactgggtcactttcactgtcccggtatcacaggcggaacgtatgctaagaacacgctttttacgccttccaccacgttggagacaagtttccaccccnagttcagaa

SEQ ID NO: 6204 - DNA, 273 bp, A.fumigatus
aaagcttacgctcctacccggcatcgatacactgccctgagtttaacggcctcaaatgtctgcctcaaacgcccgagctctgacgatggcgttctcagctccaggctaagtaagtcctttaagttttcaactctcatgtctctgattatgaggagaaagaagtcatcgcaccccactaggcaggctaatgcagggtcttctccaggaaaggcgcagactgacaaccgcgcttctgctgtcattctgctcgtgcaaatactggccaacaagtag

SEQ ID NO: 6205 - DNA, 207 bp, A.fumigatus
tatgcggggttcaatcaagcaaagaagcatctacattttatcaacgccatgcgttatgtacgagcatcgatggttatatgtattcccttcctgaccctctatattttacaggttcggactgatgcagtcattgcagcagtgtacatctcgcgctcctgcggtgtcatctctcgtctttcgggtcctccacggctcccgtcgccttga

SEQ ID NO: 6206 - DNA, 1191 bp, A.fumigatus
agtcaagatctgcaaccaattcttaagcaaggaactgaaaataaaagaaccgttgatttgactcaacctcatataacgagaaacatgaacaagaacgacagcgtcatcatcatcggagctggtgccttcggcctctccacggccctgaggctcgctcaagatggatatacatctatcactgtcctagacagatgcatgcctccagttccagatgggagcagtaatgacatctcccgcgtcattcgattcgactacggcgatccggtctacgctcaaatcgccaaagaggcgtacgatcagtggaagacaccccagtactccgaggcgtttcaccagacgccttgtctctgggtgtcgcaagaaggaaccttggagcaacccgtgcagcctcgtgcggcggagtatagccgcaagacgcggcaggtattgacggaaatggggcaggagtggcatgccgttcctagtgtcgaggaggccaagagacggttccctgctttgagtgggaagctggcaacgcctggctttgacggcttttacaacactaatgctggatgggcggacgcgggactagctgtccaaagacttgccagtcgttgcgtggcagcgggtgtcagctttatcaccggtccgaatggccatgtcgtcgagcttgagtatggacgggatggagtcgttgacgccgttcggactatcaacggcaaccgcatcaccggcgacagattcattgttgccaccggcgcctggacggccagtctcatcccctcctggaactcgatgatggctactgggcagattgttggatggcttcgcctgacacccgaggagatggttcggcttaaggacctccctatttacttcaacttctcaacgggcttcttctgttttcccgtccatgaagccacggggtacctgaaggtcgcagtccacgggttcggatatacatcgccacatcccaaagctgtatcggcacccccaagctcggctgtttccgcaagagccaacttcatccccgcagatggtatgaaacgactgttagccgggctgagggatatcttgcccgaacttgccgaacgaggattcgaaaaagtgggtctgtgctggtacaatgacacccctaccggagactttattttcgattatcaccctgagcacaagaatttgttcattgccacagggggcagtggccagtaa

SEQ ID NO: 6207 - DNA, 606 bp, A.fumigatus
tcctcttcaaacctgcgtcatgagtccagtcgatcattcctcgctctcactatgggcgcgggacgtagtcggcgacctcaagtctgcgccggatacattctcgagttgggacaagtgcatggcaaaatcttattgcaagtacgctgcgctttttctggtctcatcagaatcgatgtgctgactgagattagatggcccgtcatcgttggtatcattatcggcgcagtcatcctcatctctgtgattgcgtgcgtgattaattgtttgtgctgcggcatccagtgttgcacaggctgttgtcggtgctgttcgtgttgctgcccgtcccctcgtaacaaagctccaagaccgaagtacctcgatgacccgggttatcatcagccgcctccgatgccggcaaacgatggctatcgtgctcctccaggtcctccggtttaccgtggagcccaggttgcgcggttcgaatcgacaaccagtcctgcacctgccaaggtgaatgaggatgcgctgcctgcgatgccaacttggaatgatgctgtcaccaggagagtggaggataacagcccccaggatacgatggaaatggagccgctgaatcctgcataa

SEQ ID NO: 6208 - DNA, 522 bp, A.fumigatus
caggactatcagcgagtgcagtcacctagaaggttcaatagccctggtcaaatggatgtccctcccgtcaggacacaaacttcttctcccggctatttccacgcgtcttcaccctacgatgacgagcgcctgtatggccatgattcctccggaacatataatcagagcacaacctccccctatgatcgcgcatatcatgactattctccacagaacttctcgcaacctatgaccagaaacgcggccccttacagctcgcaaacacagtactcaaacatgcctacagcactgtcaccttccgctgaggtaccccgccatctgccgtaccgccaaccctctccaggcatgtcaagcatgccgccgccatcatacagaggaatgtccccgaaccctcctacatctccacctcccccattctcggcgactaatcccgttcctcttgaagtgagcgacccgggcaggccccccagtatcctacaaagcgggcgaaagcccgcacctaattcataccgaaatgtttag

SEQ ID NO: 6209 - DNA, 468 bp, A.fumigatus
gatgcgaactttcacaaaaggcaagagttgacaatcagtctggcagacatcatcgattccaagacacaggagatccgagccgaagatggcgaagtctactcgaaaatgcaggatctggcagacgagctccctgaatcttccccacgcttcattcttctgagctatcccttgaccctggtaggtggcatctgtgctggaggctccgatgcaccacccctcaagtcctgttcaaagaatgttcgtgtgctcgaaactaactttttctcatctcaccagggttccggtcgcctgacagtcccttacgtcctcctctactaccttcccgaaaattgcaatccgtccatgagaatgacatatgccggcgctgtggaattgatgcgcaatacggcagaagtcaaccgtgtgattgaagtccaggatgaggatgatatactttccatcgagtcgaagcttcagggatcggactaa

SEQ ID NO: 6210 - DNA, 252 bp, A.fumigatus
tgtcaacaactccagaccatcgacaccaattcggccttcttcgctaaatactgcttctcgcttggtattcaactcaagcgggttgaagtcattgccgatgatgaggacgagatcattgaagccgtgcggcggatgagcaacaactacgacttcgttgtgaccagcggaggcattgggccaacgtccgtacacgccctcacctacacatccctgacaactccctcgtgttatattgcaagtgttcaaagctaa

SEQ ID NO: 6211 - DNA, 198 bp, A.fumigatus
ttaatatggagatataggcctctatctagcttttttataaagagtcctagtactactgctaggctagataattccttaatctaccccttcttaagtattttattaagatatttatatagagcctctagctctagctataatatagtaaataaggggctatatagtagtaactttctattaagtagctatattttatag

SEQ ID NO: 6212 - DNA, 531 bp, A.fumigatus
cgcttgtcagatattgtcaaggtgcggttacagacaacgtcagagtacaaaagcgctctagactgcgccacgaggatcttcaagaatgagggtcccctggctttctacaaggggactttgaccccgctcattggtatcggtgcttgtgtaagattaagattcgactcacttgacatttgcttgcaagaactcatattctgcaggtcagcgtacaattcggtgcgttccatgaagccagaagacggctggaggagctcaacaagaagaaatatgccgatccgaccctctcctatggtcagtactatctggctggaagtttcgcgggtctcaccaactccgccctctcgggacccattgagcatgtccgcatccgcctgcagacgcaacctcacggcgaggcccgcttgtacagcggtccgctcgactgcatccggaaactcatttctcagggaggcgtgctgcgcggtctctacagaggccagaatgtcacgtatctcagagaagcccaggcctacggtacctggtttctga

SEQ ID NO: 6213 - DNA, 687 bp, A.fumigatus
catttgcttgcaagaactcatattctgcaggtcagcgtacaattcggtgcgttccatgaagccagaagacggctggaggagctcaacaagaagaaatatgccgatccgaccctctcctatggtcagtactatctggctggaagtttcgcgggtctcaccaactccgccctctcgggacccattgagcatgtccgcatccgcctgcagacgcaacctcacggcgaggcccgcttgtacagcggtccgctcgactgcatccggaaactcatttctcagggaggcgtgctgcgcggtctctacagaggccagaatgtcacgtatctcagagaagcccaggcctacggtacctggtttctgaccttcgagtacctgatgaaccaggacgccaagcgtaacaacatcaagcgcgaggagatctccagcatcaaggtcgcgacctacggtggtcttgccggtgaggtcctgtggctgagcagctacccttttgacgtggtcaagagtaagatgcagtgcgatggattcggtgcgcagcagcaatacaagagcatgaccgactgtttcaagaagacctttgccacggagggctttggcggcttctggaagggcctggggccgactctactgagagctatgccagtgtctgcgggtacctttgctgtgtacgttccacttacatcattgatatga

SEQ ID NO: 6214 - DNA, 183 bp, A.fumigatus
cttcttaaagaagaaagccttgtcgtcggaatgccgatatattatgtcagtactgccactgccatggtcaacaatagcacggagcgcagtgtcaagtgtctcccgttattcagttaccaaccgttcagcttgaggtgcgttccgcgtggccgacctataggctatgctcagtctacaggatag

SEQ ID NO: 6215 - DNA, 468 bp, A.fumigatus
ttccaagtcaatgccgtgtgggcttcgctaggcgcctccgccgggatctccatcctcctcgccctcctcttctccctctttcgtcctcgtcacacccttgtgtatgcgcccaaagtcaaacatgcggatcgcagacatacgccgcccccagtgggcaagggcttcttcgcctggatgagacccgtcctgcgcacgcgagagcccgagctggtggaatgcatcggcctcgatgcaaccgtcttcctgcgcttcaccaagatgtgccgcaatatcttcatcattttgagtattatcggatgcggcgtgatgattccggtcaatctcacccagagtaacggttctggaatctcgtcgttgtcggcgtttgcaaccatgactccgctttatgtcaccacggaggcgatttggagtcaagttatttgcgcctgggccttcgacatcttcacgacgcggctggaaggaaccacg

SEQ ID NO: 6216 - DNA, 645 bp, A.fumigatus
cacatgacatcatcatgcaccaatgattggcgcctctctctggtcaacataaacatcaccggaggaggatttccaggaacaaatactttcgcagtgtctttttcatttcaatcacagataattttgtatccagtatctgtcaaggccagcatggatacctggcaacggaatatccgaatgatgcaccaagtcggcgagttcctcgatctcgactccaccaagtccgacatggttgccgaatttattgctctcatccaagctgtacgagaaggtctcatgcaaatagacgataatttccaaattcccgatgctcatatcaacacgctgtttctgaccaagctcaaatctcgtccgcaatggaaggaatgggcaacgaccatgctacgtgacccgcgcataaccgctgccaactcgaccgagcacgttacgttccaggagctcgcaagcttagccatcgagcaggaaaaggctatccaacagggagacgcaaaagggcgaaacgcttcagataacgcagcttctgttgcagcgacatccaacgtggaagcaaacccgagagcgcttacacaggacgaaatcaatgcgtttgtcgtcaagcagatgaaccgtcttcaccacggggctggaaggatcgacggtggtgct

SEQ ID NO: 6217 - DNA, 222 bp, A.fumigatus
ttcaatacttgtacctactggttgctattatccctttacttcgttcctaatccttatcttgtcggcgtttatcttattttttttatcatctgcaaccctctctgcttagtccctagtttttctgctcctactgaatgtgattttcctgggtgtggtcacagaccttcagatcctccaggtcagaatcggcaaggtacccgaaatccgacaatggaactctag

SEQ ID NO: 6218 - DNA, 252 bp, A.fumigatus
actaacttctcttacaagctcatctcccgcctcgccagttccaagtttgcaaaatcgaaaacgaaaacctggcacgaatcagataactccatcgaagaagaacatcttaccagatcctgttatctcagcgcttcagaagggaagaaagagccctacaatccagactgtctgctctccgctctgaactcgatacagtacagcaagctcttcgaattgaatcatcatcgaaagatgccgagctcgaagctctga

SEQ ID NO: 6219 - DNA, 1086 bp, A.fumigatus
  unsure (145),(186): Identity of nucleotide sequences at the above locations are unknown.
atgtacctgcgcggcgaaggcgtcgagcagaatttcaaccacgctcttacttggttcacgcggggattggtcattggcgactcgctctgtcagcacgagatcggactcatgtatcttcacggctacggggtgccccaggatgcgntcaaggccgcctcgtatttcaaatcggctgctgatcaggantatcctgcctcggagaccagacttggagttcttttcctggatcagggggatgtcgccacggctacccgatatttcgagctggctgctcgctggggatccatggaggctttctattacctggcggagctatcgaacaatggcatcggcaggcaacgacactgtggcatggccgcatcgtattataaaatggtcgcagagcgtgccgaagcgattcattcgtcgtttgccgaatcaaacgccgcgtacgagagaggcgataaagaagcggctttgatcccagctatgatggctgcagagcagggctacgaaagcgctcaggcaaatgtagcattcctactcgatgagcagcgctcattgctgtcgctcgacactatgctacctgggattaagaagtctcgcccgtctctccttcgaaacgctgctttagcgctgatctactggacacgttcggccaaacaggcgaatatcgactcgctgatcaagatgggtgactactatctcagcggaactggtatcgaagccgaccctgaaaaagcttctatctgctatcataccgctgcggaagcccattacagtgcacaggcctactggaaccttggctggatgcacgagaacggagtcgccgtggagcaagactttcatatggccaaaagatactacgacttggcgctcgaagcaaatgcaggagcttatctgcctgtgaaattaagcctgataaagctgcggatacgtagttattggaacaagattacgaatggaaaggtcaactccattcgagaggaagaaggtaagggtacccaagaagatttttttcgcttacgcctgtttaacatgctgaccggacaccgcagaacaaaagcctcgtcggacattcaaagagtggattgcggcgtttattga

SEQ ID NO: 6220 - DNA, 480 bp, A.fumigatus
ctccatcgaagaagaacatcttaccagatcctgttatctcagcgcttcagaagggaagaaagagccctacaatccagactgtctgctctccgctctgaactcgatacagtacagcaagctcttcgaattgaatcatcatcgaaagatgccgagctcgaagctctgatccttaaatggaagactgtaagccaggaagctgcggaagaggttttcgaaggagctcgagagcgggtctctcggatggggggtatgaaggcttggagagagcggatgcagagcgacagcgccaggcgggaacaggaggaaatgaacttgtggtatggcaatgccgaagcggaggggccggagattaatgaagaggaactggagcagcggaaagctgagctccttgatgaagttgagatgcctcggaaggaacaggaggtggttagtgaaagggagatagctgaagacgaggtatgcttgaatgggtttctctga

SEQ ID NO: 6221 - DNA, 183 bp, A.fumigatus
attaaggagccgtatacttcgggcggatcagtgtctacagcgatttcaggaattactcttagttctattcccatcctgaatccatctatcctgaagaagcagccgctaccgatgcatgacaagcggggcgattgccaatcagccctctggaaagcatcccagtatcgcgatcagagacactga

SEQ ID NO: 6222 - DNA, 465 bp, A.fumigatus
ggcgttagcatcctctcgtccagtcagagaaacccattcaagcatacctcgtcttcagctatctccctttcactaaccacctcctgttccttccgaggcatctcaacttcatcaaggagctcagctttccgctgctccagttcctcttcattaatctccggcccctccgcttcggcattgccataccacaagttcatttcctcctgttcccgcctggcgctgtcgctctgcatccgctctctccaagccttcataccccccatccgagagacccgctctcgagctccttcgaaaacctcttccgcagcttcctggcttacagtcttccatttaaggatcagagcttcgagctcggcatctttcgatgatgattcaattcgaagagcttgctgtactgtatcgagttcagagcggagagcagacagtctggattgtagggctctttcttcccttctgaagcgctga

SEQ ID NO: 6223 - DNA, 639 bp, A.fumigatus
atactggtcaatgcgggctcgcaaagttataagaagatcatatcatccggcgaccttgaacaatccaccatcaatcgactttctcatacgatgactaccctccctgagtctaaaatgtcaacgactagatatactatgtggtactggtatgaccagagctgcgccttcaagacagaagatcccaatttcagtcttaaccagctctcgaagctcgtcaatgccgtacaaaaggaggtgaatgacgaaacacttgtgcttccttctcaaggccccgcccgtcctcgccagatggaggtggctgtattctttccgaccagtgacgcggatcaaggccggttcagccgtgagactgggacagagcttatcaatcgcaaagctcgcgagctgaagctcccttgcagcgatttcgtgtcccagagtgttgagaatgtgcgcagttttaccaggcaggagatagagcgggtcttcagctttgcgaagcttccacccaatttgattaaggaagcttccgagaagatcccttccggccagtcgcactctggtatttatatgactcgccgggacttaaataggctaacatggctgactggcaagagccttgcaaaagagatggaagcaaagctcaggggtcccccttga

SEQ ID NO: 6224 - DNA, 1371 bp, A.fumigatus
actgctccctggagatttagtgtcaccttgttttcgatgagctggtcctggagatgcctggattcagagctgcttctatctcgattgcgttcaaatttgctttctctcttccccccatatttaaatgatcccctgcgacgtggccaccgtactgactcaacacgccatactagacacaaacgatcgaagagtgccctggcccttgcaattttacatcgtgataaatcaaaagataacgacgatctgaccggtcgtgaaagtggttcgcttgagtctggcgcgtcttctccgattaacagcacctcctctttctcgctgctgtcacataagaatagcatcccccgaaagtcgccccaagaggccaaatcgcctcccatggactcagaggcgtcccttgagccacccggctccaataacagcgcagaaaatgttgagaaaatgccaactcaagctcaatcagcgattggaagcatgacacttgaacaatcagtgcgcacctttcgactattcgagattctgcggagcggtgacacaaatgcgatatcgaaagcgattaaagagaccagggaacctcaaggggcaggcgctttgactggcacaaccattctacatttagcaatccaatgtgccgagccgcaggttgtcgaattcatattgtctctgggagatgacctggatatcaacgcccgcgatcgggatgggaatactcctcttcatcttgcggcgcagctaggaagaggacctctggtgcgcgagttgctgaatcgtccatcagtgaatgattcaatcgtcaattaccgtggccagactgcccttgatgttgcgcgtaaccccgaaatatttcaacagctccagcttgcaaggtctttatttattgacagcaagacacaagaaatccagtcccttgtgtatcaaggcgattacgataaccttgagagggtattggaggagccgcgcgtggagggaatcctagatgtgaacagcctggacttggtcaccgaccctactaccgcacagtctggaggtaccttgctgcatgagggcgctagaaagaaagatacgagactcatacaaattctactgatgcacggcgctgatcctttccggcgcgataagaaaggtaggctacctcaagatgtaacgaaagacgataagacgcgtgccattgtcaaaaaatctcctgcagcagttattgcacagcgtggcattcaagagaaagccatcctcggcagcaatcccgctcaaggtgtctctggacggacaggggcaggtgaggcgccgctcgtgggcaaagatgcgcgtgaaatgagaggatacttaaagaaatggacaaattataccagtggatataagctgagatggttgtcttga

SEQ ID NO: 6225 - DNA, 264 bp, A.fumigatus
caatgcacagaaaataccaagaagaagatcttcacccttcacacgtccaagatgtcccttgcggatgacgttgacctcgatgaattcatcaaccagaaagacgatctctctggtgctgatatccgagctatttgcacagaagccggtctgatggcgctgagagagcgccgtatgagggtgcaaatggatgatttccgtgccgcaagggaacggatcatgaagactaagcaggatggcggtcctgtggagggcttgtatttgtaa

SEQ ID NO: 6226 - DNA, 702 bp, A.fumigatus
  unsure (115): Identity of nucleotide sequences at the above locations are unknown.
tggattcgcagattcaaggagtcccgagaatttgttggatttggccttggctcaacccggaaattgtatgaggaggtgggtatcaaacccccaaagggggtcattttatacgtgnttccaggtaccggtaaaacttggtttgccaaggctgttgcaaaccagaccagcgccactttccttcgaatcgtcggaagtgagctgatccagaatattttgggagatggtcttcggttggtgcgacagattttccaggtcgctgctgagcatgcgccctcgattgtcttcatcgatgaaattgatgccatcggtaccaagcgctacgactttacatctggtggtgaacgagaaatccagcgtactatgttggagcttcttaaccaactggatggtttcgacgaccgtggtgatgtaaaggttattatggccacaaacaagattgagactctggatcctgccttgatccgtcctggtcgtattgaccgaaagattctcttcgaaaacccagaccgtgagtaccctgctaagcagctcgctgtggtttccttgactgacaatgcacagaaaataccaagaagaagatcttcacccttcacacgtccaagatgtcccttgcggatgacgttgacctcgatgaattcatcaaccagaaagacgatctctctggtgctgatatccgagctatttgcacagaagccggtctga

SEQ ID NO: 6227 - DNA, 612 bp, A.fumigatus
ttagctttgaataagcactttgcaagatctctttcaatcacaatggacgggttcgacgaagaagcgttcaaaaaatttttcccgagtagctttggcaaacaagaaaagaagcttgatgtgaatgcccagattgaccgcaccaagcggtcgaaactttcaaccgaaccagatggcgataaagaagaagttactgacaacaaaccggcagtcgaagatggtgaagctgaagatgagacaagaggacacgatcgaaaagccgactcagaagatgattccgacgatgatgactctgaagaggaggaggacgaattcccagtctctcacgagcttcttatcaagacacatgagcgcgcagtgacgaccatgacggtggatccggcaggagcgcgattgattacaggctcgactgactgcaccctcaagctccatgactttgcctctatgacaccgactactatacgcgcattcaagtccgtcgatccgtctgctaagaagcaatccgccgcccaagaaacacacccggtgcactatgtcgcattcaaccctctgtctccaagtcatgtcatggttgtttcggcaacgccgcaacctcggattctggaccgcgacggc

SEQ ID NO: 6228 - DNA, 477 bp, A.fumigatus
  unsure (468): Identity of nucleotide sequences at the above locations are unknown.
agatcttcttcttggtattttctgtgcattgtcagtcaaggaaaccacagcgagctgcttagcagggtactcacggtctgggttttcgaagagaatctttcggtcaatacgaccaggacggatcaaggcaggatccagagtctcaatcttgtttgtggccataataacctttacatcaccacggtcgtcgaaaccatccagttggttaagaagctccaacatagtacgctggatttctcgttcaccaccagatgtaaagtcgtagcgcttggtaccgatggcatcaatttcatcgatgaagacaatcgagggcgcatgctcagcagcgacctggaaaatctgtcgcaccaaccgaagaccatctcccaaaatattctggatcagctcacttccgacgattcgaaggaaagtggcgctggtctggtttgcaacagccttggcaaaccaagttttaccggtacctggaancacgtataa

SEQ ID NO: 6229 - DNA, 558 bp, A.fumigatus
agaaaagccgtcttgctcaatctacgtagccataagacacctattgacgaaattcctaccttacaaatacaagccctccacaggaccgccatcctgcttagtcttcatgatccgttcccttgcggcacggaaatcatccatttgcaccctcatacggcgctctctcagcgccatcagaccggcttctgtgcaaatagctcggatatcagcaccagagagatcgtctttctggttgatgaattcatcgaggtcaacgtcatccgcaagggacatcttggacgtgtgaagggtgaagatcttcttcttggtattttctgtgcattgtcagtcaaggaaaccacagcgagctgcttagcagggtactcacggtctgggttttcgaagagaatctttcggtcaatacgaccaggacggatcaaggcaggatccagagtctcaatcttgtttgtggccataataacctttacatcaccacggtcgtcgaaaccatccagttggttaagaagctccaacatagtacgctggatttctcgttcaccaccagatgtaaagtcgtag

SEQ ID NO: 6230 - DNA, 507 bp, A.fumigatus
  unsure (392): Identity of nucleotide sequences at the above locations are unknown.
tctcggcgctcgcgtcatcaaaatcgaacgccccaaggtaggcgactttgcccgcaactacgacagccgcgtcaacggcctctcttcacactttgtctggaccaaccgatccaaggaaagtctggcgctcgacgtcaagaatgcccgcgaccaccgcatactcatgcgactgctctcccgcacagacgtcttagtccagaacctcgccccgggagcaagcgcccgactcggcctttcattcgcagacttatccgaaaagcatccatctctgatcgtctgcaacatctctggctatgggccggatgggccttaccgcgacaagaaagcgtacgatctcctcattcaaagcgaggcgggtctcctctccgtcacggggacggccaccgagccancaaaagttggtatctcgattgcggatatctgcgcgggcagctacgcatactcaaatatccttgctgccttgttcgagcgggaaagagaccccgagcgccgtggacgcaacattga

SEQ ID NO: 6231 - DNA, 828 bp, A.fumigatus
  unsure (487): Identity of nucleotide sequences at the above locations are unknown.
agaacagcaacaaaagaaagtcccttgtccggtattaccgtggtcagtcttgagcaggccattgcggcaccattttgtactcgccaactggctgatctcggcgctcgcgtcatcaaaatcgaacgccccaaggtaggcgactttgcccgcaactacgacagccgcgtcaacggcctctcttcacactttgtctggaccaaccgatccaaggaaagtctggcgctcgacgtcaagaatgcccgcgaccaccgcatactcatgcgactgctctcccgcacagacgtcttagtccagaacctcgccccgggagcaagcgcccgactcggcctttcattcgcagacttatccgaaaagcatccatctctgatcgtctgcaacatctctggctatgggccggatgggccttaccgcgacaagaaagcgtacgatctcctcattcaaagcgaggcgggtctcctctccgtcacggggacggccaccgagccancaaaagttggtatctcgattgcggatatctgcgcgggcagctacgcatactcaaatatccttgctgccttgttcgagcgggaaagagaccccgagcgccgtggacgcaacattgatatctccatgctggagagtatggtcgagtggatgggatttcccatgtactatacctacggggaccagccgggtccaacacctgcaggtgcggcgcatgcggcgatatacccatttgggccttttgagacaggcaaggggacggtcatgctggggatccagaatgagcgcgagtgggctaagttctgcgagatggtgctggagaagccagagatgatcgacggatga

SEQ ID NO: 6232 - DNA, 357 bp, A.fumigatus
tcgacggatgagcggttctgtaataattccttgcgggtgaagaatcgcgatgcattgagggaaacgatttgtaaagtatttgcagcttactctgctgagggggtattaagacgcctggatgaggcgggtatcgcgaacgccattgtgaacgatatgcaaggtgtatggaaccatccgcaattgagagccaggcaacgctggacgcagatacagacgcctgcaggggctgtgccagcgctgtttcctccgggaacggggcccgatgggttcgaagctcaaatgggtgcagtgcccgagattggacagcataacgaggccatattggctgaattggggatcgatacagatatcgaataa

SEQ ID NO: 6233 - DNA, 1218 bp, A.fumigatus
gagccagttcaagcccccatcatcggcaggaaacgcaagaccaagaaggccccgacaagcaatgctgatgcatccaacacgagcgccgacaatgcgcctgagcccacaaaagtcagtcagcctggcccacaagaggcggctgagagggttgaaccgaagaccgaggagacgaagaagaataagcaggagaagcctccgaagccccatatcgaagagaagcaacccgtatccgagaacaagccagcagagccatggcgctcgaagaacacgctggaacagctgataaaggattccgaacaaagcggcgtctcgattaaagatctgtttctggaacggacttcgccattgcaggtcttgcttgctcagctgcacaaggctggccagttggatctaaacaatcaccctctcttcaatccttcgaatctcagtcagcgctttgacatgaaatgtacatccgacgattacgaacttttgaagcagcctatcgagttgaccgaggagcaccgcaaagccttgcttcgcggggaacctgtccgtctccattcctcttctagccaactgaaggatcgctgcctcatcacgcctcgcggttgtgtcctccatcacctgacgccggaggaagaagacaggtatctcgctttggaaaagagcatggaatggacaaccgaatctttccaggaatatccagcagcccttattacggaacccgacgtgaccaatcgtggtggagggttggatgcgctcttcgccacgcccgagaacttcaacatttgctgggtagatgagactacaaccaatctttcatctgcagcacatgctggatcaccgccggctgccgatgcatctgtctcgtcaactgcctctgctccgccaaacgtcctgtcgactatggaggcggacagtactcgtagccataactgggccattgcgagcactgccgagttggccaacgcaacggcggcttccgtccggtcttttgcggctgctactgcgaaacatatgcttggagccgctggtgtggttatggggactattccggacctcgacgatgttgttggcatgaccgatgaggagctgcgttcgtttgcgctcaagtcccagaaggatcttgaaggctcgcgaaaggaactagatgctattgataaaaagctcgctgcattgttcaaacgcaataagaaacttgcacagcaggctctcgctacgactgtggaggtttag

SEQ ID NO: 6234 - DNA, 300 bp, A.fumigatus
  unsure (18): Identity of nucleotide sequences at the above locations are unknown.
gaggactggaaacgccgngacaacccgatcattcgcttgcggaagtggttggagaatgagggcctgtggaatgaggatatggagcaggagacgcgcgatcagctgcgcaaggccgtgctgaaagaatttggggacgcggagcgtgagaagaagcctcccattcgggcggcattcgaggatgtgtatgatgagttgacggaggaagcgcaggaacagatgaaggagctcaagcgcattctcgagacgtatcccgaggagtacgatctccgtcaatacgaagatggcattaaagggttgtag

SEQ ID NO: 6235 - DNA, 1518 bp, A.fumigatus
  unsure (1487),(1494): Identity of nucleotide sequences at the above locations are unknown.
ggggtatacgcggatcggcatctcgtagtgaagccccgttggccgctgcttttcaattccttccattcattaacccagtgggcgtcagccatccgtctttccctgttcgagcacacctcgctctatgaagcgtatacaggttcgatcattgccggcaaaggcaaaaatctcaataacattcgatccattctcgagcgcaaccgcttcaagcaggaagattgggctcgtgtacgattcggcgcagggacaccgtggagacgctgctggtttgtgatctcgcctccgaacgagaaagagtaccaaaaggcgcagaagtcgttgaagaaatctgcctatgatcgggccccgaagctggccacaggagacatcaaattctacgacacgaggaagaccaaaaaggcgaaacctattgcgaccatcaccgacgcctacgctgcatatgccatatacccccagtccaaggccttaattgatcagtcgactcttgtgaaaattgagggtactgtcacaattcattcgaatccagagtcaacttctgaggggttcgtcttcgtcatgcccgaggtccatcctgccatctccggcttcgaaatgatggttcgcttcctcatccccactttcgacactttcaacctctatgggcggccgacacgcctcatagctgccacgaatcatgtcaagagcatcatgttcgcattcactagccaacggcgctatggatacctggacgtcctggatgtagcgagtttgatgcagatgccgggtagccactcctggactgaggcggaatggaggaaacagctgaaggatgcgacagctcagcgtatggccgcggcagggagcaggaccagcagtatttcctcaagaaaaccacgctacagagccagtctccccaatcgctatagtaatgcgcccgcagggggccctcgcaacaatcacttgttacccgagagtcggccagaatacaaccagtcagcagatgccatcctaaacgaatcgcaaaaagaggacattgcatccagttatcattctcgaggctattccgataccacaggaactgagcccatgcaacaacgcgtgcaggctcgggtcatggagggctcaccatcatcttccgatcaagatctaatgcccgtggaacggcaacaggccggcactgctagtgtcagtgaccgcagcagtgaagagggcgactggaaacagcaagtagatcctccggccaccgctgttggtgagaatctacggcctcagtctcctcctgatccggtagccatgccgccggcatttatgcatgcaccaggagagactccatcaaaccgcccattaccttctccggatctgaggaaggccaataacaggatgtccgacggcactctcacacagctcgccgccgctggaaagctgaatctatccaacttggcccttccctcaactaccgaacatagagtccagggtcttcaccacggggctggaaggatcgacggtgnctcaaangaaatccacacggggtttcaatcc

SEQ ID NO: 6236 - DNA, 234 bp, A.fumigatus
tttcactcctgggcactgataattactcttggccctatctatttcctaaatgaagatcttgctcagtcctcttccccttactactcccttcttcccttctgttccttcttactagtcctttctcctggtcgcgttggttatatctttaatcgccacgatctcttgcttctgttctgtttatacgcctccctaacttcagtcattcttttgaagacccttggaccctttaactaa

SEQ ID NO: 6237 - DNA, 183 bp, A.fumigatus
ttgtccgttctttccaacagctaccagcccggcggttcatctggcttcaccaaggacaaggaccctctcagcgatcctgatgcatgcttgcgggatgccgctctcatgcagcgtttgggcgtaagattcactggttccctgagcagatttttttggtacgttacttatgcgaaagtaggttaa

SEQ ID NO: 6238 - DNA, 201 bp, A.fumigatus
gtgctacagaactctgggccaaatacaaatggctgccagttcttcataacaactacagcgacccccttcttgaatgggaagcatgtcgtgtttgggcaggtagtggatggcatggatatcgtgcggatgatcgaaaatacacgcacgattagggacaagccaagccaagatgtgatcattacacaatgcggagagatgtga

SEQ ID NO: 6239 - DNA, 234 bp, A.fumigatus
cattcagtcgcaataggcgtgccgctaggtcgcattaaaatggagttatttgcagatgtcactcctcggacagccgaaaattttcgcagattctgcacaggtgaaagcaaaaactcccaaggaaagccacaaggatacaagaatagcaagtttcaccgagtagtacgtctacagcccttcgtatcggcgcagaaagctgatccaaaaccgctttcaagatcaaagattttatga

SEQ ID NO: 6240 - DNA, 189 bp, A.fumigatus
gttaacccgggtattgttgagttgtggacggtgctgagtgctacagaactctgggccaaatacaaatggctgccagttcttcataacaactacagcgacccccttcttgaatgggaagcatgtcgtgtttgggcaggtagtggatggcatggatatcgtgcggatgatcgaaaatacacgcacgattag

SEQ ID NO: 6241 - DNA, 1386 bp, A.fumigatus
gaacccaaggagggtagtaaaggacagaagaagtcggcgacaggaaccgtcaaattggactttcacgacatgggaaagctggagaaaatgaagaacgttcccaaaacagaggacagcgccaaatttggaaagggtgacattaccgctgaaatcaaagccatataccacgggaagaacttccattcatcgacggcgcagataccagatggggaacagataggcatcattttggaccgcacgaatttttacgctgaacaaggtggacaagagaacgacactggcagaatcatcatcgacggacgggctgagctagaagttggtgatgttcagctttacgctggctatgtcctccataccggcttcatgaagtacggttctttctcaataggtgacgccgtcctgtgtgaatacgatgagcttcgtcgctggcccatccgaaataatcatacgggcacacacatcctcaactttgcgctcagaagagttcttggagattctgtcgagcaaaaaggctctcttgttgctgctgaaaaactcagatttgatttctctcacaagtctgcagtcacagagaaagaattagagaaaatcgaggaaatatcaaccgagtatatccgccaaaactgtgatgtctactcccaagaagttcctcttgcaactgctcgccggatctccggtgttagagctgtcttcggcgagacgtaccctgatcctgtccgagtcgtttctgttggggtggaggtggaggagatattgaagaatgtggaagatcctcgctggcttgaagtcagcatagaattttgtggcggaactcacgtccagaagacgggggacattaaggacttaatcattctagaagaaaacggcattgctaaggggattcgtcggatcatcgctgtgactggggaggacgcccatgaagtacagcgagttgccaaagagttcgagaagcggctagatcgcctggatgcaatggctttggggccgcagaaagaacaggaagccaagcagatacaggttgaactaaaccaactctcgatctctgctgtccagaaatctcgtttccgagagcgttttgcgtccatcaacaagcaagtcattgacggacaaaaagcgcaacaaaaactcgagacaaagaaggcgcttgaggctatcatttcttacttcgaatccccgacgaacgaaggaaagacctgtttggttaccagacttcctatttctgcgaacccaaaagccgtgagcgagtctctaaactatgttaagtctaagctgcaagacaagaccgtctatgttctagccgccgatttggaacagggccgcgttgcccatggttgctacgtttcaaaggtgagccttccctcttttttcacatatggcttggggtga

SEQ ID NO: 6242 - DNA, 450 bp, A.fumigatus
aacaaactgtatttgacaataggtcgtgttcgagctaatcatctttatggttatccatcctactttaggatcggaaaaaagcacggacttagaccagaacaccctcacatctctccgcattgtgtaatgatcacatcttggcttggcttgtccctaatcgtgcgtgtattttcgatcatccgcacgatatccatgccatccactacctgcccaaacacgacatgcttcccattcaagaagggggtcgctgtagttgttatgaagaactggcagccatttgtatttggcccagagttctgtagcactcagcaccgtccacaactcaacaatacccgggttaacttacggccatgcttaagacacctgcgcggtcgtgcttcaagacaaagttctcatctgcaaatttgggagtgccatatatggtacaagaacctgttccatccccgttga

SEQ ID NO: 6243 - DNA, 1152 bp, A.fumigatus
gacgcgtgtgctgaatgccggcaggcggctgtcgcgggatgcggggggatgggggagatggtgccggctggacgggggcggggggtgatcggggacgcgggcgatctggcagcagctgcagttgaattactcaaccgcgcggactgcatgttcgtcgcctcgacccatggtgccgaagacatggacaccaatttccgcggcgggcctccaggctttgtacggctaatgagcaatggacctagtggttctgttttggtatatcccgaatattctggcaatagattataccagactctgggtaactttcagatgactcctctcgcagggtactttttcccagactttgacacaggaaacgcgctctatgtcacagggacccctgagatcttgattggcaaagatgcggctgatctgcttccacgatcaaatctcgctgtcaaattgacagtcacgtccgctcgcttcgtcgagaagtcactcgcattcagaggaattgcaggcccgccctctccatataccccgactgtacgttacctggccaccgaaagggtcaatcaggtcgctcagtttagtgacgatgtctctgttacggctaccatggttgcaaaaacgatccttactccaagcatcgctcgttttcgctttcgaatatcagatccatccaaaatcggggcctgggctcccggccagtacgccaccttctcgtttcaggaggagttggacctgggctattgtcatatgctcgatgacgatccgttgagtctgaatgatgactatgtcaggacattcactatttcatcgtatccagggcatggactgccagcggatgaatttgaaatcactgttcgcaagcacggcaacgtgaccagccacctcttcaggaccaacgaacgcgccggtttagaagtccctctcaaaggcttcggtggcgggtttaggctggacgatcaagaaggtgactgcacaattccagttataataggcggaattggtatcaccccggtcattgcacagctgccaggcataagtgtttctcgcttacacctcctgtggaccatttccatggctgatgtgggccttgtcttcgacacattccagcgcttccctcaactgccaggctcaaccaccctgtttctcacaggacctaagcca

SEQ ID NO: 6244 - DNA, 405 bp, A.fumigatus
aagttacccagagtctggtataatctattgccagaatattcgggatataccaaaacagaaccactaggtccattgctcattagccgtacaaagcctggaggcccgccgcggaaattggtgtccatgtcttcggcaccatgggtcgaggcgacgaacatgcagtccgcgcggttgagtaattcaactgcagctgctgccagatcgcccgcgtccccgatcaccccccgcccccgtccagccggcaccatctcccccatccccccgcatcccgcgacagccgcctgccggcattcagcacacgcgtctcatagagccatagatatgatcgaaatcctaccaagacatccctggatgaacagagacaggtgcgccattcctctctcgctttggccctggcaatcttga

SEQ ID NO: 6245 - DNA, 1683 bp, A.fumigatus
tacttgtatatatcactgactgaattgtcagaaattggttgtttcggcgccttttcgcgcgagcgaatcgctatcggtattgacaagcaaatttccgatttcaatgatccgctgctttggccggctcaggggtctgcagcagaaccagatgcagacctatgcagcacctttactgaagaatatatcgatattctaccgcctaactggaacgtactttccttgtccctcagcgctgactgcacagaattcattatctcgcggctccgcaaggatcactcgcccttcctccttcgacttccattaaagagagggaatgccgaagacgacgaggatcagttcacattcgaggacggaagacgagagatgcaggaaattatcaggttggcgaacgagactgcacacgccgcgaagttacagaaggaccggcactccaagaaggagtggtggagaaaccgcgaagctctcaaccagcgcttgcagaacttgctgcagaacattgagaacgtatggttcggtggtttccgggggatcttttcaccgatggctcacgaaggggctgctctctcgcggttcgccacgtcttttcagaacatcctggacaagcacctcccttcgagacaaaaaggcggccgttcagcaacgccaaggctatcactacatcgcaacgttttggagctgttcgttggcgtgaacgacctagaaggccaggaagaccctgaggagacattgatggatctcttgtactttgtggtcgacatcttgcaattccagggggaacgcaatgcctatgacgaaatcgacttcgatatgatggtggtcgagacccttgatgctgtgcgaggctaccatgaagcggcgcggcgattacgagaaggacagcggccgcagcatactgtcttagtcttagataaggccctgcacttgttcccttgggagtcacttccatgtctggaaggattgccggtatgtcgtgtgccgtccttggaatgcctgcgcgagcggattctccagtctgagagcgtcatcaaactaaatggtagcgaaatgggatttgccattgaccgtggaaatggcacatatattctcaaccctacaggagatcttcaaacgacgcaagccacttttgaggccgaccttggccggttggctacttggacggggatcaccaagcgagagccgaccgaagaggagttcaaagattacttggaatccaagagcctgtttctgtattttggccatgggagtggcgctcagtatatccgtggaaggactatcaaacgacttgaccgatgtgcagttacatttctcatgggatgtagcagtggcacactgaccgaagcgggcgaatacgagccatacgggactccgatgaattacttgcatgcaggctgtccggctctcgttgccaccctgtgggatgtgaccgacaaagatattgatcggttcgccaagtctacgttcgagaaatggggactgattgaagaccagaataccaatggcgaacaagcgacactcccgagcaagggacggtcccgatcggcaaaaatgagcagcaacacggaatcttctgacccggttatgctggatgaagcagtgtccaagtcacgaagtgcttgtgtgttgaagtacctgaatggtgcggcgcccgtcatctatggcattccttcggtgtttctggaatag

SEQ ID NO: 6246 - DNA, 192 bp, A.fumigatus
  unsure (101): Identity of nucleotide sequences at the above locations are unknown.
tacgccaaccaccccctcgtgacccaacataacaatgtcattttcaataagaccgcactttcatcattcgaactccacctcactgaactgcaaaatgtctntaacaaggtcagcaataagcggattgaatggagctgctccgcttgtgtgttgtcgcatgacgagctgcgtgagggaaatcaccccctttag

SEQ ID NO: 6247 - DNA, 726 bp, A.fumigatus
gtgttccaaaaagaagctttcacctttcacgcgggagttgccgtaattggaagcagacggcaaattcaaaagtttaccatgggcacttacaccaagatcttccttcaattcaacgagaccttctggccctcaaacacacagtacttcttgtatgcggaccctaagctgcgtggatggtatcccatctggcaatcattgtcaacacctggtttcctcccgggatccaacatcctcttcgtcaccgtcaccaacgagttctcctaccacgtcgagaaccagtccgacgaggagaccaaagccgaggtgatggcagtgctgcgcaagatgttcccggacaaggacgttccagagccgactgcattcatgtatcctcgctggagtaccgagccctggtcatacggaagctactccaactggcccgccagcaccggtctggaggaacaccagaatctgcgcgccaatacaggcagactatggtttgcaggagagcacacgtcaccaagctactttgggttcctgcacggggcctacttcgaaggtctcgatgccggacgacagattgcggcgctcttgcaaggccgctgcgtctattataactcgacgatggaaaggctatgcgggcctcgcaggcatttcgagacgctgcatggaatcactccgctggctgattatagtgcagtcaatggctggatttccaacagtttctatgattacaatgatgaatag

SEQ ID NO: 6248 - DNA, 342 bp, A.fumigatus
cccctcaacctgtcacagagaacacgaccaaaggcaagttgcaaccacagcagcggccacagactacacagtgccatgaccgaatacgactatatcattgtcggcgcaggcatcggtggcctggtgctggccaaccgcctgagcgcagacgcctctgtcaatgtccttctcatcgaagccggggccaatcgcatgggcgatcctcgtatcgacacccctgggtttctgggcatgttgtacggaaacccagacttcgactgggattatatgagtgtccctcaggtatcacctctcttccactgctccatttacggcaacaatgcaacaatgctgatcgtatag

SEQ ID NO: 6249 - DNA, 1422 bp, A.fumigatus
ccgcatgtcaacaaccgacaaatcgcgcagccccgcggccgggtcgtcggcggttcctcggccctgaatttctcggtcgtcctgtaccctcccgcatcagacttcgaggcatggaaggcgttgggaaaccaaggctggggcgcagaggatatggcgccgtacctgcggaagtttcacacgttctccccgcccagcaagtccacggccgaccttctcggcgtcgatagctacatgaaagccagcagccaggggtgtgacggccctgtgcctgtttccctgccggacgtatatgggccgttcaacgaagcgtgggataagacgtttgagaagcttggttggcggacggacgcggatcccatcgccggacgcaaactgggtgcgttcaccccgccgctgaccgttgacgcaaagacagggaagcgggggtatgcagcggcctactactcccccgaggtggccgcacggccaaacctgcgcctgctggcagagaccatggtcgagcgggtgctgttgaccaggcaggacggagacgtgctggccaccggcgtgctggtcaaggacaaggatggcgcgcgagagattcacgcaaagaaagaagtcattatctgcgccggcagcctgaatacgcctcagatcctggaactctccggcattggaaatgcagggctgctacagaagcacgacatccccgtggtgatcgacaaccccggcgttggcgagaacctccaagatcactgcatcagctgcatcagcttcgagatcgccgacggtcaagtctcgggcgacattctccgtgaccccaacgtggtacaggccctcgtcaagctgtacgaggagactcgcggcggcccgctggcaggcatgcccatcagcgtggcgtaccttcctttcgttgacggacgaggcgtcgtcccgcggccagaagtcgaggagctgctggccaagtatctcgacagcgccgcccttccacccaatctgcaggcgcagtacgcgcacctcaggaaagcgatcctcgacaacgataccccgtcgtcagagtacctcttcctccccgcgcagctacacatgaaacccggtgcgacaagcttgcccgacgtcctggccaagcccctgccggagaactacatcagcatcatgatcctgcacaaccaccctttctcacgaggatcggtgcatatctcctcccccaaggcggaggacaaaccgatctacgatccgaactttctctcccacccgctggacttggagatactcgctcggcacacgcaattccttgagacaatcgccgccacggagccgttcaagtctcttctcaaggaacggcggatcccggaaaacgcgagggacttgggcgatctggagcgagccaacgagctggtcgtctttcacccagggggacgagacatgcccgctatggaggga

SEQ ID NO: 6250 - DNA, 309 bp, A.fumigatus
gacaaaatggtggccctgtacgatgcctttggctttcccattgtgcgcgaccagctcatcgccaacacggtgctggtcgccttggccactcttgcggtgcttctccggttcatctcgcggcatatccggaagagtaagatctggtgggacgatggttgctgtgtagggtccatgctgcacacatacggcatgctggcaatgcactaccactacgctcgcgtcgggatgcgcaagcacgtcaccgagatccctcccgagaacctggtggccatgctcaagatgctgttcgtctaccaagtcctgtactac

SEQ ID NO: 6251 - DNA, 573 bp, A.fumigatus
cagccctgcatttccaatgccggagagttccaggatctgaggcgtattcaggctgccggcgcagataatgacttctttctttgcgtgaatctctcgcgcgccatccttgtccttgaccagcacgccggtggccagcacgtctccgtcctgcctggtcaacagcacccgctcgaccatggtctctgccagcaggcgcaggtttggccgtgcggccacctcgggggagtagtaggccgctgcatacccccgcttccctgtctttgcgtcaacggtcagcggcggggtgaacgcacccagtttgcgtccggcgatgggatccgcgtccgtccgccaaccaagcttctcaaacgtcttatcccacgcttcgttgaacggcccatatacgtccggcagggaaacaggcacagggccgtcacacccctggctgctggctttcatgtagctatcgacgccgagaaggtcggccgtggacttgctgggcggggagaacgtgtgaaacttccgcaggtacggcgccatatcctctgcgccccagccttggtttcccaacgccttccatgcctcgaagtctga

SEQ ID NO: 6252 - DNA, 207 bp, A.fumigatus
aaccggagagcactcaacgctttggatggtgaattggccaattgccacctagttctgctggtcaaggcgaaaactattgaaaacgcagaagaatgcctattcttctcgtttcgcaaggaggtagaaatcactactgtcctctatcacattgttcacaatgtgtattttacgttcaacacatcagatcccctgaatcttatatcgtga

SEQ ID NO: 6253 - DNA, 900 bp, A.fumigatus
cattcagcaggatgtgaacaacaacactggatttgtagcggcggaagacacaagacaacccttattgaaatcgcaggaatggactccaatactgatccctattccgagcctccatgcccgcttcaacaattgcggacgccggccccgatctccccctccactcttgacccaaccgaaccaggttcatgtcatcgcgagccgatatcgagcacccacaagacaacgcatagtccatatgaggtttgggggtgcgacagcaatagtaccaatggcctggtttcccctaccactcggccatccgagcctgatcttttcaatggtctctcgactctaattcctggattgcgccggctggattatggagctagggcagcgacaaacgcagaacgcaaaatcacattcttggatggttgccggctatacccaaaggcgatggcgtggtcggcggttgtgtcttccactctcatcatggaagggttcgacactctactcctattcactttcttctcacttccggccttcaaacgatactatggcgtgccaagcaagaacggcgactatgaaattcctgctcgttggcagtttggtttgtcgactgcgatagaggtaggggagattgctggactgcttctcaatggtctgttggctgatcgcgtcggttatcgcatcactatatctgccgctatcgttcttctctttttctgtatcttattgccctttttcgcggtcaatttgcagatgttgcttgcaggacagatcttgtgtggaatcccctggggcgtctttcagaccctgactatcaactacgccgccgaagtcatgccagtcgcgctccgcgcataccttctcagcagcatcaatatgtgctgggtagtgggtcagctcctcgcaacggggtga

SEQ ID NO: 6254 - DNA, 198 bp, A.fumigatus
  unsure (49),(74),(120),(124): Identity of nucleotide sequences at the above locations are unknown.
cacccggaacggccaatcattcgtgaacgaggaatgaccattgccccantgcgcttcatgccaagtagtattgngatccttggcgttcgccaggcggatgaaagattcaccgtcaaaganacanacaacatttcgtctcagtttgagtcttttggcatgaagaatgaaaatgaggcatacgaaagtgtagccagttaa

SEQ ID NO: 6255 - DNA, 1053 bp, A.fumigatus
ggcatcgcgttccatctgcatcgatcgatcctcgtatatcaacgcaaattcgtcactgcttcctggcagttgtcatcactatacgcaggattcttaatctttcttaacagacctattcaaccccatctcttaaccagcactgcacaaccacacctaccacactgtgaaagacctgatgcaacactatctccaatgactcccaccgaacaacaagaacaagaacaaccctccccaacatcaacaacaatcatgcccgcctcaccttcccgaacaggaaccctgcttgcgaacctttcgtccgtaacctcacgcatcagcaccgccgccttgaacgccaaccgccccgccacaaaacctatccgcctcatcgccgtctcaaagctcaagcccgcagccgatatcctcgccctccacaacccgcccacgaaccatctccacttcggcgaaaactacctccaggaactccttgagaaatccaagctcctcccgccaagtatccgctggcacttcatcggcggactgcagtcgaacaagtgcgtcacacttgcgcgggacgtccgcgggctctgggccgtcgagtccgtcgacagcgagaagaaggcctcgctgctggatagagggtggggggagcgatcggaggaagtccgtggtgttgcactcgaggaccggctgcgtgtgtttgtgcaggtgaacacctccggcgaagagaacaaggccggggtggaccctgtagctggggcggtgccgcttgcgcggttcatccgggagaagtgcccacggttgaagctgcagggcgtgatgactattggggcgattgcgcggtccaaggctacgacgccggagacggagaatgaggattttgtgtgtttgcgggagacgcgggatcgcatcgttagggagctggggctgcagggtgatgatgccgagctggagctgagtatgggcatgagtgaggactttgagggcgcgatcaagctggggagtgatgaggttcgtgtcgggacgacgattttcggggagcggccgcccaagtccgaggcaaaggtggtgtag

SEQ ID NO: 6256 - DNA, 669 bp, A.fumigatus
cgacgcgtatttccagcccgtggtgaagacagtcgtaaatcatcacccttctctccccacatcatctacaccacctttgcctcggacttgggcggccgctccccgaaaatcgtcgtcccgacacgaacctcatcactccccagcttgatcgcgccctcaaagtcctcactcatgcccatactcagctccagctcggcatcatcaccctgcagccccagctccctaacgatgcgatcccgcgtctcccgcaaacacacaaaatcctcattctccgtctccggcgtcgtagccttggaccgcgcaatcgccccaatagtcatcacgccctgcagcttcaaccgtgggcacttctcccggatgaaccgcgcaagcggcaccgccccagctacagggtccaccccggccttgttctcttcgccggaggtgttcacctgcacaaacacacgcagccggtcctcgagtgcaacaccacggacttcctccgatcgctccccccaccctctatccagcagcgaggccttcttctcgctgtcgacggactcgacggcccagagcccgcggacgtcccgcgcaagtgtgacgcacttgttcgactgcagtccgccgatgaagtgccagcggatacttggcgggaggagcttggatttctcaaggagttcctggaggtag

SEQ ID NO: 6257 - DNA, 384 bp, A.fumigatus
agcgcatgcgcggtctttcggctccttggggaagacgaggtcgtcttgactggcaaacactacaagtctggcggcacatccgccgccagccccgtctttgccggtattgtcggtctgctgaacgacgcccgtctgcgcgccggcaagtccactcttggcttcctgaacccattgctgtatagcatcctggccgaaggattcaccgatatcactgccggaagttcaatcggttgtaatggtatcaacccacagaccggaaagccagttcctggtggtggtattatcccctacgctcactggaacgctactgccggctgggatcctgttactggccttggggttcctgatttcatgaaattgaaggagttggttctgtcgttgtaa

SEQ ID NO: 6258 - DNA, 183 bp, A.fumigatus
agctcgattctttaccctgaggaatttcagggtcgtcccaacatcgattggcaaaaatgggctggtttgatggaaggtcgtcgacttcgtcttctcgtcatgttcgccgacgctccccgtctcgtcgatctgtctattcgacatcgcactctcgccattcagcgccatcgattttcagcctag

SEQ ID NO: 6259 - DNA, 576 bp, A.fumigatus
tcgatatattcagacgctgccaccggtgtgctcattccataccttcagcctgcatatgatattggcttgctgaaagtgtccatggtctatttgatcaatttcgccggatggctagtggcatctttcgccaacattcacgtctgctcgaggctgggaagcggcgggacactggttgtcggagccacgatccagtgcttcgggtacgtgctcatgttctggaaacctccatatcctcttttcatgactgccttctttttcaccggcatgggcgttgctttccaagacgcacaagcgaatgttttcacggtcacggtcaggaacgcgcatcgatggctcggcattctccatgctgtttatggagtcggcacgatcatcgcgccgctaatcgcaaatactatcgcctctcgaacaccgtactggcactattactacctcgcgatgtttattctgggggtgatcaacgttgtcctcctggcttggacgttccggaggggtctattcaagccaaacgtctctaatgccaaagatgccaatgccgaattgatattcccccgaggcgcaaatccgcctaagtta

SEQ ID NO: 6260 - DNA, 288 bp, A.fumigatus
gcagcctggaccaagccaagaggaatgagatctgatctatccaggatactgtctacctgcgccacctccgcgtatatcatcggcattttcatcttgaagaggtttaagcctgtacattacagtaccctgaggctcaaaaatgcctctctgttcttctctagttctaccagaggtacttgcactcagattatgagcatgatcgctcaggactacaatgcaaatccgaagcaaggtctgcaagaagatattcagctatttccacgcactttaagcttctctcctcgttga

SEQ ID NO: 6261 - DNA, 333 bp, A.fumigatus
cctagtctagttgcatgtttctacattcgctttccacggaccaaccaaaacggcgatgattattaccgtgcagtctatctgaccgagcgaaccgttcgtgatctgatggaaaagatttcaatgaagcagaagatcgatccacagcgtatagtacgcgttctgcacgttaaggagaatggccttaagatcatggttgatgacgatgtggtccgtgagttgcccgatggcccaaaaatggtcgtcgagatttcagaagcatcagcattggacaatgcagtcgcaaacaagttcgatcacctaaattctgcggtggagttcaaattgagctactga

SEQ ID NO: 6262 - DNA, 201 bp, A.fumigatus
acgagttcccgggcaatgataccctgtcgcaatatgattgtttcgttgattttatttgattttattgatctcatccatctcgatatttcctcacttcatgtgcatatctttcttacgacctcttccaccttcctccgcaccatatactgcactatctttgctttaggattgttaaatgtgcagtcgcatatcagcttataa

SEQ ID NO: 6263 - DNA, 999 bp, A.fumigatus
gagagcgcttcgtttgatggattttgtgttacgtggaccgccaatccggcgactggagtacctgaatgcgccatctccgttcgcttcaatttcctatccacggattttagccattcaaaaggtgtcaaaggcattcccgtaagactttgtgccaaaacggagatgattggtccggagagcgcagactctcgcgaagccgaagtatgctactgcaaagtcaagcttttccgtgaccatggagcggaacggaagctgtctaacgacgtcgctcatgtgaagaagaccattgagaagctgcgccagcagatcgctcaggctggaataggtgcaggcagttatggcaagcggaagcgagctggtaaccctatttctctgaagaattctgaccaacgccctgcgaagatctccaaacacaagaggacttggtcaatgagctcacaggatggcgacaaactgtccgtggaagatgatcttcatgctaagttagccatgttgcaggacatgttcagttccactcggccaatgagtattctcggacttcggggcgacgaacaagacgacccggatctatatcccgtgatcttacctggcgactcatttgatcaggtgaagaaggagggctcagcgaagcccggtgaccctcgtcttagtatcgatgcctctgcttatactctgtcaccgaccagcagcaatgtttcgatcaactctccctgtcatcccccacagcttcagcagcagggacatttctacgattccggttaccagggatcaatgggcaactcaagggacaattcgcgacctagttcggaattctctggagagaaaatgattctcaagcacccagtcaaagtgcagagaatctctggaggctcgaatctcccaatgggatatatcgaagctgtggatatcgatcccacctatagaccacctgcggagcgtcctcaaaagccgagtaagtcgagcacgagatcctactttgaggccaaagtactgacctag

SEQ ID NO: 6264 - DNA, 225 bp, A.fumigatus
actaaaggctatagcactattattattaatcttaccctactaaatagcactaaatatatcagatctattatactactaaaagtctggcatacactagctcttacttataatctaatttctattagaaagcttatagaattaggtattaatactatcttcaggaagaatagtagtattaagcttatctataatagtttaattaaggcctttgctaaaataatatag

SEQ ID NO: 6265 - DNA, 288 bp, A.fumigatus
ataacactagccgtggatccttccagccccgtggtgaagaccatcgactgcgatggagcgaacaacagtgctggcgactgcgccaatgacccctccggccagagcatgacggcgttcatggacaccgtgaagcagtacggcatttcggatctggacgccaatatccatccgtacgtggtgtttgggaactcgggcagctcgccgacctttgatcctcagcagtatgggatggagccgttaagcgtgatggcagtggtgtgcaataaccaactggtatgttgctattaa

SEQ ID NO: 6266 - DNA, 258 bp, A.fumigatus
ttttacggtatctggggtgataccaatggtggaacttctaccggggaggcctccatctcgctggccaagctgtgctttcccaatgacggcatcacaggggataacggccatggggaggaggatgtactctacattggtttcatgggacaggacgctgtccctggcgctagtgctgcctggaccgctcgcgacactaagacttttgaggagagtatcaaggccttgggtgatcgccttgtcgctaagcttagtgcgtaa

SEQ ID NO: 6267 - DNA, 495 bp, A.fumigatus
  unsure (14),(15),(38),(40),(41),(46),(51),(52),(57),(75),(84),(85): Identity of nucleotide sequences at the above locations are unknown.
gggcccccgccccnntttttgggggcccgcctttgggnanncctancccannaattnaccccaagggggaaaggnccaattttnngaaatcgcgcaattgttcttgcgtctcagaatccgcaggtccaattccatgtcgttgatgacgatccgcgtctgatcaccgcgtggaattcggatcgcttgccggtcgttgaacctgggctggatgaccttgtttatgaggaccacgccgtggcatcaaacataccgaagaagcaagctggtcaccagcttgaaacacatcagtcagatctacgacagccgcgaatacgaaaactgcgtaatatcactttctcaaccaacatccatgccggaatagcagcatcagagatcatcttcctctgtttggaccctcccttggaccacgtaggcttgccccatcctcaacctgcacagcaatccatactaattcctagtcctgctccgacgatgagactcccggtttcgacttga

SEQ ID NO: 6268 - DNA, 957 bp, A.fumigatus
  unsure (13),(17),(37): Identity of nucleotide sequences at the above locations are unknown.
tacagctcaaganaacngcatcccatcccgcctcctntaagttctctccaacccgagttcctagtcccaggaagcgccatccgcgaccttctctatccagtccggatcataatcggccacatcttctccgaggatatgtcgcccgaggcactaaccgcgctgaagggcttgtattcttggatccccgaggaccgcatagtcaccatggacgcctggtcatccgagttgggtaagatcgccgcgagcgcaatgctcgcgcagcagacaagcagcatccagtctctgcgggcgatctgcgagtcgacgaatgcaaatatcacgcatatcgagcagaccgttgggacactttctacgactggatacgggtcttctgaatcgatcttgctcagagacgtcgggtgtctggtttacttagcgcaggagctggggttgccggaggtggcggagtactggagggcggtgctgaggatggatgcgtatcacacacggcgccttgctcaacacattaccgagagtgtacctgcgggaacagagcggagagatgtcgccatccttggcttcgcgagcaagtggaacacgatcgagattggggataggagcgcaacgcggctggtgcaggaactgacaaggactggtgtcaaggtggacatctacgatccgcatgtgtcaaaggaacagatcgagagagcgctaggtcttgtgagcggtcatttggatgccgtcacggtcgtggaggacctgcacgcggcgtgttctggttgcggtgcggtcgtcctgcacaccgattgggacgagttcaaagaggatcgcctagactgggagaaagttgcggggaagatggagtctccaaaagcgctgtgtgaccctcatgggatgcttgattggcagcggatggagaagctggggttcaaagtactccgaccaggagtcaattgtgctaacaagcttcaagcatga

SEQ ID NO: 6269 - DNA, 741 bp, A.fumigatus
cccccgtacccatttaatttgcccccattgctatacgcgatcccaactgaccctttcccacgaggagcagaggcacccagaatcccatctccacgccatccagcccgtcgacgcgccccattccgctcccagtacaacgccacaaccgccccgacacccgcagccagcacgaagaagaaaaagctggagaagaacgacgccacgccagacgatccctccgcagaatcaaggcccccagcaggccaccagatccccttcccgccctcaacccagctaacatggaaggtaaacgtgagcggctcaccgcgaataaccttcgtgccgtggccggccgtccagggatcgcgagccgcctcggaaatagccaaagccgcgtcatcctcgtcaacgtctttgtccttcggaagtaggccatcaaactcggggatcgagtacgcggttccggccacgacataccccgggctcgcatgcttgctcttccggttccttttcttggtcttggaggccgatggaatattgtgcacgacgacgttcatgtctgtccagatgtgtaggtggctgcgctgcagggtgccctgtagagcgaaggtaaggggggtgtatgccggtccgccattgtcgagaggggagaggtcggtgttttcgctcttcttggcatcaggggatgagcctgcttgcgccgaagtggtgagaggtgctgtgggcacgcgacaggccagtggtacatccgagtggacgtaa

SEQ ID NO: 6270 - DNA, 1005 bp, A.fumigatus
aatgtctctgctaacagctctcttcctgtacagatcacagacaatctcggcaagctacaatacattccgttcccaacctgcaacgagaccttcctcccgcttgcactccgctacggcgtgacagaaacagtcaattgcacaatcagctcgctccccgacgagctctaccacctcctggaatattacgtccactcggatgtaccactggcctgtcgcgtgcccacagcacctctcaccacttcggcgcaagcaggctcatcccctgatgccaagaagagcgaaaacaccgacctctcccctctcgacaatggcggaccggcatacaccccccttaccttcgctctacagggcaccctgcagcgcagccacctacacatctggacagacatgaacgtcgtcgtgcacaatattccatcggcctccaagaccaagaaaaggaaccggaagagcaagcatgcgagcccggggtatgtcgtggccggaaccgcgtactcgatccccgagtttgatggcctacttccgaaggacaaagacgttgacgaggatgacgcggctttggctatttccgaggcggctcgcgatccctggacggccggccacggcacgaaggttattcgcggtgagccgctcacgtttaccttccatgttagctgggttgagggcgggaaggggatctggtggcctgctgggggccttgattctgcggagggatcgtctggcgtggcgtcgttcttctccagctttttcttcttcgtgctggctgcgggtgtcggggcggttgtggcgttgtactgggagcggaatggggcgcgtcgacgggctggatggcgtggagatgggattctgggtgcctctgctcctcgtgggaaagggtcagttgggatcgcgtatagcaatgggggcaaattaaatgggtacgggggttattccccttcaagcactccctctgtggtcgctgctggtggtgggggctatggatatgggggatatggaaagaaggactga

SEQ ID NO: 6271 - DNA, 816 bp, A.fumigatus
cgtcgagacagaccacatcctcggcatgccaacctacgagcagaacctcagagaccctcatcagcagatatatcgacaaaatcagtcacaccaacagtaacgcctaaactcgaagctgctactccggcgcctgccagcgcaagaccaaccgcaccccagaaacctggctccgcatacccacccgtgcaggcgtcgacgatcgatgtcaatgccaaccctgttcatccctctacgggcaaaccgatcctgtcaacagatatggactcggactttccaaccgaggacgacaaaccatggagacggcctggttcggatatctccgactatttcaactacggttttgacgaattcacctgggccagctacgttctgaaacaacaagagctacggaaagaagtccaggaccagaagaagcaattggatgatatgcagaatttcttgaccatgggtcttccgccaattccaggagctccaggtcctgctgcacctcctggcagcgcgccgccagctctgcccggtatgccaggaatgccagatattgcccctgatatgatgcagggcatgctggcaagtatgatgtcgcaaggcatggatccgtcatctatggatcccatgtccttcatgcaacatgctcaggcgatgatgggaaggccaaggtggtgctggcgccgggcagcagcaaggccagcctgggttcggcggccagtcgcaaaattcgggatttggaggacaaggtggaggccagcctcatatgggatttggaggttacgaacagagaagtggttttggcggtcggggacgaaagaaaaaatgtaa

SEQ ID NO: 6272 - DNA, 351 bp, A.fumigatus
ctcattcattgggacatgttgctaagtgtgatctcttgcctctatcagtctgtcctccgcaacatcaagaacctcgctcccctcctggaccgtgtcctcgtccagcgcatcaagcctgaggctaagactgcctccggtatcttcctcccagagagcagcgtcaaggagcagaacgaggccaaagtccttgccgtcggccccggtgccgttgaccgtaatggccagagaatcccgatgagcgttgccgccggtgacaaggttctcattcctcaggtacgtactggccgttttggatgctttatctccgggcggatccgatgcgcaacggacattggattcttctgtcgatga

SEQ ID NO: 6273 - DNA, 510 bp, A.fumigatus
agcattactttctctactaacttccgatatctagatcagtttgacaatgaagaaggcgaagaatatgaagcctcgaacttcggcggcttcggcgactatatgcgccgcaagaagctcaagctgcagaatctggacgctgaaatacgctcctcctctccggatcggccgcccatattccgcggcgttgttgcgcacgtcaatggctacactcagccatctttacaggacctccatcgtcttatagtaagccatggcggtggtttccttcaatatttggacggcaagaccgccgcaacccatatcattgccagctctctcaccctcaagaagcgtgaagagttcaagagatatcgtatcgtcaagccggcatgggtggtcgaaagcatcaaggccggacgcttgctcccgtgggacgcattcagggtggtagatgaaggccatgctcaaaaggttctcaattttgacaacggccgacttctaagccaggcgaatgtacagcagtccggctaa

SEQ ID NO: 6274 - DNA, 291 bp, A.fumigatus
cagttccgcgtgagcatggctgccattgatcctgatgagactcccgagttcgaggatggacagacccgccccagagctactctcaagctcgttcgccctcccgcggacatggacattgatgaatcggacgatgactacgaggaagactctgaggaggattctgatgatgaggaaatcaacggcggccccagcgacaaggagaaggcccgcaaactcaaggaggcagccgctctcaaggagctcgaggatgaggacgaggacgatgatagcgagggtgatgatgaaaactag

SEQ ID NO: 6275 - DNA, 201 bp, A.fumigatus
tttggagaattccagaccaaattgttcccatacccccgtatacacattcccctgtttccccaagcttccgttatttttggtgccaaggttttccaaagaggccaattttttcaaagaatcaacatttggttgtttggggcccaaccaacgagatggtcaagtgtaccccccccaacggcaagaacatgccaccctgcttga

SEQ ID NO: 6276 - DNA, 315 bp, A.fumigatus
  unsure (239),(315): Identity of nucleotide sequences at the above locations are unknown.
ttggagaattccagaccaaattgttcccatacccccgtatacacattcccctgtttccccaagcttccgttatttttggtgccaaggttttccaaagaggccaattttttcaaagaatcaacatttggttgtttggggcccaaccaacgagatggtcaagtgtaccccccccaacggcaagaacatgccaccctgcttgatatacgtggtgatgttgtgcccaaggagacccacgccgntgttgttaccttcaagaccaagcgcaccatccagttcgttgactggtgccataatggtatcaagatcggtatttgn

SEQ ID NO: 6277 - DNA, 240 bp, A.fumigatus
actaacggcaactatagctgcatgctgtccaacaccacggccatcgccgaggcctggtctgctctcgaccacaagttcgacctcatgtactccaagcgtgccttcgtccactggtacgttggtgagggtatggaggaaggtgaattctccgaggcccgtgaggacctggctgccctcgagcgtgattacgaggaggtcgccgccgactcgatggatgaggaagtcgaggccgagtactag

SEQ ID NO: 6278 - DNA, 210 bp, A.fumigatus
gtccgcatccccctccatttcgtcattccgtctactccgttccccattcattccccttacagtttgacgatctatgctcgtggcatcatcttcactctagtccacagcattccgctctaccacctcataagccacaattcgacgagtatccgcgaaatttggccgaaggaaagaggaggcgcactcctcctgagctacaatcatggctga

SEQ ID NO: 6279 - DNA, 351 bp, A.fumigatus
actcctgaggagaatgaccgaccccccgatcgaacagcaatttctccaagcgcagtgggactgacagagtgtctcaaccatttagcacaacgccatccaaatctcaatttgacacccgaagagaaacgggtgttttaccagctctttcaggctgctgataccaccaacctcggtgtcatcaccggcgaggttgccgttcctttcttcgagaagaccaagcttgcaccggagacactcggactggtgagttgcgttgcatggatcgtgtcttccggcgcatgtctggctgactggtcaccgacaatgtgtagatatggcagatcgcagataaggagaacagagggctcttga

SEQ ID NO: 6280 - DNA, 234 bp, A.fumigatus
  unsure (123): Identity of nucleotide sequences at the above locations are unknown.
attctctctctagctgggccgctgcctaagtttgaaggcgtcattattgaacctacatctcccacctctcgctccgctggtgcgaccagcccaccaccagttagtgggccaattcgagtcctnccactcaacccggaagacgtcaataaattcacagcgctatttgagaagtctgatgtgtcgaggagcggggttatctcaggcatgcatcccgcaaaacgaggaagtatgtag

SEQ ID NO: 6281 - DNA, 495 bp, A.fumigatus
cctggccaagctcgaccgtgctgtgtaagtttcttccctgtattcttattctcaccaaacaaatggagcatgaaaatagtgagtgaactaacggcaactatagctgcatgctgtccaacaccacggccatcgccgaggcctggtctgctctcgaccacaagttcgacctcatgtactccaagcgtgccttcgtccactggtacgttggtgagggtatggaggaaggtgaattctccgaggcccgtgaggacctggctgccctcgagcgtgattacgaggaggtcgccgccgactcgatggatgaggaagtcgaggccgagtactagacggacgtcatcactcggcaggattccgaagaatggctgtagagtttggccgtccgatttgatgcagaggctgcttctggccgtttctgtgttgttgtattggggacaggcgtttgccaaggtgatataccatggacctgcgcgactcatgttgcatgcaaatacatag

SEQ ID NO: 6282 - DNA, 705 bp, A.fumigatus
  unsure (110),(390): Identity of nucleotide sequences at the above locations are unknown.
ctgggccgctgcctaagtttgaaggcgtcattattgaacctacatctcccacctctcgctccgctggtgcgaccagcccaccaccagttagtgggccaattcgagtcctnccactcaacccggaagacgtcaataaattcacagcgctatttgagaagtctgatgtgtcgaggagcggggttatctcaggcatgcatcccgcaaaacgaggaagtatgtagctttgaggctaataatgcttgcattacaggcgacatcgctaagcaaatctttgaacgcgcacggttaccaaacgagatttttggccgcatttggaacctagcagacacgaagcaacgaggcgccctcgatgccacagaatttatcatcgctatgcacctcttgacctcntacaagtcgggcgccatgaggggcatccctcagactttacctcctggcttgtatgaggcggcagcacgaaggggcccggtgcgaacctccgtggggtcccgacccgccctcgacgttcctccagtccctgccattccgcgacagttcaccggaccccagcggactcaaagccctctgaataggtcccagttcggaacaccgctcactgcgcagtcgacgggcggagattggcttatcacgccagcagagaaggcacaattcgataccatatttggaacgattgatactgcgaagttgggcgtcatacattggtga

SEQ ID NO: 6283 - DNA, 771 bp, A.fumigatus
acgcctcagacgaacgtggtattggcattgtccgaagaaaaagtcaagggattcgcccgcacacaactcagccaacccacaggactagactcgtcatatttcgaacaatacccttgcccaccgttcaagatcatcatcctggatgaggcggatagcatgactcaggatgcacagtctgcactcagacgcacgatggaacaatacagccggatcacccgtttctgtctcgtctgcaactacgtcacacggatcatagagccgcttgccagtcgatgcagcaagttccgcttcaagccgctggataattcggctgcagcggagcgcttggcgcatattgccagattggagaatttgaagcttgatgaaggcgtcattgataagctgattagctgcagtgaaggtgatttacggcgtgccattacatacatgcagagtgcggcccggttggtaggcgctggtcgtccgacgagtcaaaaagatggggacgaggactctgagatgacagacgccagctcagaacctgtcactatgcaaatgattgaagagattgccggcgttgtccctgaaagtgttatagatagactcattcaggccatgcagcccaagaaattagggtcttcctacgaggctatctctaccgtcgtcacggatattgttgcagatgggtggagtgcgggtcagcttgtcttgcaggtaagctctgttcttattccctttacacgaggcttcgttcaattgcgagattccgtccttgtggtcaaagagtgctga

SEQ ID NO: 6284 - DNA, 249 bp, A.fumigatus
gctctgttcttattccctttacacgaggcttcgttcaattgcgagattccgtccttgtggtcaaagagtgctgataatccgcagctgtaccgacggattgtctacaacgatgctattccggacatacaaaagaacaagattgtaactgccttctctgagatggacaagcgtctggtcgacggcgcagacgagcatttatcgatactagatctcgcccttcggatatcaggcatcctaggcggctcgtaa

SEQ ID NO: 6285 - DNA, 243 bp, A.fumigatus
tggtccccccaggtacaggaaagacctcgaccatccttggcggttggaaaaatcgatatcgggtctgctctgtatcggtcacgtatcctcgaactgaacgcctcagacgaacgtggtattggcattgtccgaagaaaaagtcaagggattcgcccgcacacaactcagccaacccacaggactagactcgtcatatttcgaacaatacccttgcccaccgttcaagatcatcatcctggatga

SEQ ID NO: 6286 - DNA, 189 bp, A.fumigatus
acaatccgtcggtacagctgcggattatcagcactctttgaccacaaggacggaatctcgcaattgaacgaagcctcgtgtaaagggaataagaacagagcttacctgcaagacaagctgacccgcactccacccatctgcaacaatatccgtgacgacggtagagatagcctcgtaggaagaccctaa

SEQ ID NO: 6287 - DNA, 900 bp, A.fumigatus
  unsure (609),(815): Identity of nucleotide sequences at the above locations are unknown.
ttgaaccgacactccctagcagcagcatcatcatcatcatcatctcactcatcccaccccaaagttgtattcacatctgcgcgctacaaaatgtccacaccaactgtgatcgtcttcggcccaacaggcagggtcggctcggtagctgccctcagcgcgcagaagcacaacgcaaaggtcatcctcgccatgcgcgacaccacaaagtccatccccggtctcacttctgagcaagaaaccaccggcaacttcgagcgcgtgcaagtagaccttacttctccggaaagcatccatgccgctgtcaccaagaccggcgccaagcacgcattcatctacctcgcttttggcacggcggatgcaatgcgcgccagcatcgaggcgctcaagggggctgggatcgagctggtcgtgtttctaagcactattagcattagtctccacggggctgccgacgccgtcccgccgagtgactttattgcgtttacccatgcgcaggtggaggcgaatctgcgggatgtctttggtgacgactatgtggcggttcggccggcgttctttgcgagcaattccttgtggtggaagagtggggttctggcaggagaggtcaancaggcgtatcccgaggcccggtttgattttctcgcgccggaagacattggaagtgttgctgggaagtttctggtgaaaaggttgccaactgggggagatgggagccaactaaaatacctcgaacttgtaggaccggaacagatgttgataacggacgcatttggtctgattgggaaaattgttcgcaaagaaattcacatccccancatctataaccatgacgcccggcaggatatgaccaagggtcaaggggtgccgggagccggtttcgaacaaaatatttggctcccc

SEQ ID NO: 6288 - DNA, 609 bp, A.fumigatus
ggccaagacatctatggcacgatgtacctcgtcctttcgacgttcagctctctgtggactcgtgtctacaacgaatctacgggcattggtggtctgaactacatctcccttgggttgggattctggttgggctctcagctctgcgctccactgaatgaccgcatttatcgccgactcaaagcccgtaacaacaatatcggcaggcccgaattccgagtaccactcctggtggtgggcgcattcctcaccccagtgggtctctttatctacggctggaccgctcagtttcgccgtcactggattgctcccaacattggtgcctgcctcttcggtgctgggaacatcatcgcctttcagtgcatccagacctacatggtggatacatacacgagatttgctgccagcgccctagccgcggtggctttcttacgttgcatatgtggattcgcctttccgctatttgcaccgtacatgtacaacgccctgcactacggatggggcaatagtttattggcctttgtgtctattggtttgggaataccggcaccgatattcctctggaagtacggagagattctgcgtaagcgcagtccatatgcggcgggttag

SEQ ID NO: 6289 - DNA, 267 bp, A.fumigatus
caatcatcaggcccaagaacaggacatggtatgtacagtcagcggacagaatcgactagcaacccacccctccctaggtctgtcatacacgaccgtctacctaatgtaggaaatttcgcaatcgaaaccaaagcgtttactgatgaatacccgcatgatcccctcctcaaccgacgaatgcaatcggatctcgccccctttccttccccccccccctcccccactcccaaactccccggtcaaaattcgtcacagactcaagcttag

SEQ ID NO: 6290 - DNA, 2019 bp, A.fumigatus
caccaccgtcggtccttccagccccgtggtgaagacgaatctactcaaagcttagtcaagtattcgggatcaagttcagctggctactcaacggactcgttgcctgctccgacagccgagaacgagcaacacaatccctatttgaacaattcagctcaagctagattgcaggtatctgatcaagctgtttcaagctcttgcggactagaccatgccgagaccaacaatgtcgggtccggacaggcgtcgtcttgtctatcgaagcgtcctgatgagaccccgctttctttcagcggcgaaggatcaagcggaagtaggacgacgaccgagcagtctaaaacaccccagaaaaagagcaaaggattcaagtggagtttcttccagagacatggaaatgtgcaaaaggagaagaaaccaacccgtgagccgcttgtatctcctaacacccctcggctccatgctacagtttccccagccttagtatcacggcctgtcgcacactacgccctggtggatgccgactccgaccctctggaagatatcattaaccacgttgaggagtcgcctccgacggagattgaggatctggactcacgggtagaaattccggctgccttgaatatcaggaagccaacccaatctatcctgcttccatcgcctccgaagcttcaaggcgagttctgtcgagatcgcccggcttcaccaaaggtctactttaacaaggatccttcactctccaactccgaggcaagcacatctagtggacgcccacgacggttggcatctgtgggccgtattcctgaagtgattccgaggcgagatcggcaacacaaaccagcacttcaatcattctcgaggcccttcagcatggcagattctccatcgataattgctccggcgacagttaatcttcttcccgaattgcaaacttccagtcagcccacggtcactgctcagtccaacgaggcacctcgtcgtccgttgggtcttggttttgacctcacttgcccctttggtgatcctgaggtagcgactgctctcaatttcatctcaggtccttactccaaagacgaattcctaacgttctcaccaaggaaggattcgggtgtttccacgtcaagtggttctgaagcttcggccactatcactgctgtggttccgatgccaggttcagaccccaccgaggacgaggtctgggccgagtatgacgatctcattgaacacgttctttcaccagaggccccagtacgtagtttgtcgggggaacctaccgaggatgagaaattggaaatggccaccgtggccagcaaagcgcttcaagccgagatagactcaaatgtcagtaaacactcgcctgttcctctcgtcgacactccgaccgtggctctcactccctcaacacctcgaccaagtgatagctcgttccatttacggcgttccgcgatagcttcagccctccacacttccattaccccttcttcccaaccttcgttcagtgacatcattgctagctactgctatcatcaagatgaaaagcaaacaggtgatgagaagatagatgacaactcagcctcacttgcacctgttgagcaacaagcagccttcctcagctcgtcttcactggacttatccgagacgttcgagacttgccggcaacggaataccattctctttgatattgccgagcgcgatagagagggtccaaccgcccagaccaacatacgctcagggtctctcatgacaagccgttggctgtcatttggaagggtgctctttagtcccgcgcataatcatgtcaaaaacggcgagcaagagcggattctcgtcatcgatggactagggaacgacgactggtcattttattgcgccctcacctacccgaatgctgagatctactgcattaatgacggtcccacgaaaacgacattaaagcatccagctgcttggcaaccaccgacgaaccatcatacgtcttcaccacggggctggaaggatcgcgacgggcgatgctatcgaaga

SEQ ID NO: 6291 - DNA, 894 bp, A.fumigatus
agacgaagcagccctccacgtccgaagcaggaagcgaagaagcccgagcctcccaaggagcctgaacaagacttgtttgactttggcgaggaggagccggtcactgctgcttccacgtctactgcggctggtaagaagcctgccagcagtaacggcctggatattctcgagtccaaaccaatcgatgacgatgacgagtttgatgaattccagtccgcaacgccagcaccgcagcccgcagccaaccaatttactattcccgcacccgcgtccacagtcagtacgacctcgagtacccagtttgccgctccccggcccgtctctggtgtgcaagggccgaatctgaatgggttggtcggatttacatcaatgaccccgactccgacatcgagcacggttgcgtctcccacactttctcagaactctatggtgccgccatcgcagcaggcaaagccctcacagcccaaaccgacgggcttccaagccgccactcctaactacttcacctccgttaccaccgccaccacacagcagccaacagccacgacacccggccaccgaccgggtatgccctcaacttcctctttcacttctgcccggggcacttcatcggtcggtggtaaaccggccgcatccaagtcgtcgggtgacgcttttggatctctctggtcgaccgccagtgccagtgcgggcatccagaagtcatccgcaaatgctagcaaggggcccaatctggcgagtatggctaaagagaaggctagcgcgggaatctggggagccccggcttcgtcgagcagtttcactccaacttctccgtctccttcggtgagctcatcgacacagcaacaggggacgaagacgggcagttcggggcttgacgatttgctgggctag

SEQ ID NO: 6292 - DNA, 291 bp, A.fumigatus
attccagtccgcaacgccagcaccgcagcccgcagccaaccaatttactattcccgcacccgcgtccacagtcagtacgacctcgagtacccagtttgccgctccccggcccgtctctggtgtgcaagggccgaatctgaatgggttggtcggatttacatcaatgaccccgactccgacatcgagcacggttgcgtctcccacactttctcagaactctatggtgccgccatcgcagcaggcaaagccctcacagcccaaaccgacgggcttccaagccgccactcctaa

SEQ ID NO: 6293 - DNA, 210 bp, A.fumigatus
cgtggcaatagcaggggcgccgcccatgaaatgacaggaggaactggtggagagtactgtgtaaacatgcagtctgagctgagtacctatctactttgtaagtacgtacttggtggcgagaccgctggacgctcccacggaccatatgttccgttattagctaacgtcaaaacaaccatgtggtattacgtagaagacgtgagaccttaa

SEQ ID NO: 6294 - DNA, 675 bp, A.fumigatus
  unsure (387),(391),(458),(567),(570),(579),(582),(589),(608),(638),(642): Identity of nucleotide sequences at the above locations are unknown.
agacagtgcataagtctaaaagatccctgcaagtcggagatttttgtacgctggccaaggatgtcgggtagtgcgatgcacgactggtgtagcaatgcatgtttcgcatccttgagagggagagggggaaactgcttctggagtatcatactactagcgggtaatccatgcatcccagcatcagatggcctaggaaacgcacaggagctgctgtgtccaaggaactttatgtggcccttcaggacattcagtatcgagccagatcctttttgcagggcaggcccacccccaccccccccagcgccgtatttgctccctaccaacggcctggtttctgtaatttgcctccccccgccggccgcccgcacgccacccatgtccccccgnacgntcctggcaacaccccccccactatcactagtttgcgcccaaaaccgaaaaccatttagtgcctcttnacaggaacgacccccccccatcgactgcccccctccctccttgctctcccgccccgatcttttcagggacagtccaacgggaaaggaaccactcttgttgcatgggggntgnacgaaaaanatntttctgnaaaaacaaattcataaggncgttgaacaaagggggggtatcggggaaantttnttgcattatggagcgttccccacttcaccccct

SEQ ID NO: 6295 - DNA, 210 bp, A.fumigatus
  unsure (25),(29),(59),(78),(85),(88),(97),(100),(209): Identity of nucleotide sequences at the above locations are unknown.
agtggggaacgctccataatgcaanaaantttccccgataccccccctttgttcaacgnccttatgaatttgtttttncagaaanatntttttcgtncancccccatgcaacaagagtggttcctttcccgttggactgtccctgaaaagatcggggcgggagagcaaggagggaggggggcagtcgatgggggggggtcgttcctgtna

SEQ ID NO: 6296 - DNA, 603 bp, A.fumigatus
  unsure (11),(18),(21),(30),(33),(142),(209),(213): Identity of nucleotide sequences at the above locations are unknown.
atttgtttttncagaaanatntttttcgtncancccccatgcaacaagagtggttcctttcccgttggactgtccctgaaaagatcggggcgggagagcaaggagggaggggggcagtcgatgggggggggtcgttcctgtnaagaggcactaaatggttttcggttttgggcgcaaactagtgatagtggggggggtgttgccaggancgtncggggggacatgggtggcgtgcgggcggccggcggggggaggcaaattacagaaaccaggccgttggtagggagcaaatacggcgctggggggggtgggggtgggcctgccctgcaaaaaggatctggctcgatactgaatgtcctgaagggccacataaagttccttggacacagcagctcctgtgcgtttcctaggccatctgatgctgggatgcatggattacccgctagtagtatgatactccagaagcagtttccccctctccctctcaaggatgcgaaacatgcattgctacaccagtcgtgcatcgcactacccgacatccttggccagcgtacaaaaatctccgacttgcagggatcttttagacttatgcactgtctctag

SEQ ID NO: 6297 - DNA, 183 bp, A.fumigatus
  unsure (124): Identity of nucleotide sequences at the above locations are unknown.
ggcgatgttccccttaacttccggaatcctatattcatccatccgcatcccccaccggccggttttggcccctttgaaccccgggagaactatccaatggccccccctgtttccaaggaaccanaaacgggccggaatgaaaataaacctggtttctcccaaacattttttattccttccttg

SEQ ID NO: 6298 - DNA, 201 bp, A.fumigatus
accgcaacgggacattacttcaaaggtcgtttcgtcaacactgagctgaaacagcggttgatgacacaatccttaattgtgctggactgctcggttagaaccttgtataccgccgtcctgaatcaatctgaagaacgcaaaacaaggttcgcatttatcctaaggtttggcattgattgtaaatgtaccgtcacggcttga

SEQ ID NO: 6299 - DNA, 918 bp, A.fumigatus
  unsure (705),(860): Identity of nucleotide sequences at the above locations are unknown.
attgcggcacaggataatggagccaaagacatatcaacctcggtgagttctggattccttgcaatctctatcgttctaccacagcatctcacaatgaccatcgtcgactggcaagaaaaagctcagcttaagcagtctgaagctgctagcaagatccctccagaatggagactctctttagatatcctgactgccatttccaacgagtctaatgttctcgacattcctacaaagtgtggtattctttctgctcgcgagctcgacatcaccgaacactacgacgccactgatctcctgcagagattggcgtcaaaagagctcagtgccgtggaagtcacaacagccttttgcaaacgggctgctattgctcagcaacttaccttttgcctgaccgaaacgttcttcgatcaagccctcgcccgagctcggcaattggacgatcacttgacggccacaggacagaccgttggaccccttcatggccttcccatcagcctgaaggattgcttcaacgttgctggcgtaccgacctctctcgggtttgtatcatacctggaccgtccggctccaaccacaaattcgtcgctggtggatatcctcctcgccgccggcgctgttctctatgtcaagaccaatgttccgcagaccatgatgacagccgattcgcataacaacgtcttcggccgtgtcctgaacccttaccgncgcaacctcacagcgggtggaagctcagggggtgaaggtgctctgattgcccttcacggctcggtgctgggcatcggcaccgacaatgcaggatccatccgtatccccgcgctgtgttggcgggacgacccgctttcaagccttctggttcgcgngtggcatacggggggccaaactgccggcgggcggagccgggatggtaggaattacggc

SEQ ID NO: 6300 - DNA, 192 bp, A.fumigatus
cagcaatatccaggaggcggaggtttcgttcctggaatcgttttcaacccgtcagctaaggggttagcgtacgctcgtactgacattggaggcgcgtaccgtctcaactcggacgacacttggacgcctctccaggactctgtgggaaacagtaactggtatgtaacctgttctgtaagtgagatcgactga

SEQ ID NO: 6301 - DNA, 261 bp, A.fumigatus
cgttttaggcatgactggggtgttgatgcactcgctaccgatcccattgataccagtcgcctgtacctggcggttgggatgtacacgaatgaatgggaccccaacgccggctcaatcatgcgctcgaccgatcagggtaatacttggtcagagaccaagctacccttcaaagttggaggaaatatgcctggacgtggtatgggcgaggtaggtaacagtccttttccctgcattgcttgtttctcggctaagaccatgtag

SEQ ID NO: 6302 - DNA, 186 bp, A.fumigatus
atctcgtttgtcgacagttgggaagacagtggtcatctgtacatccagacggaattttgcgaggaaggcagcctggatgtgttccttgcccaggttggcctcaaggcgagattggatgactttcgcatctggaagatattgttagaattgtccttggtatgtcaccctatctacgtttcctgttga

SEQ ID NO: 6303 - DNA, 285 bp, A.fumigatus
gcaagggctaacctccagcagggtctgaagcacatccatgactccggcttcatccatcttgatctcaagccggcgaacatcctcatcaccttcgagggtgtcctgaagattgctgactttggcatggcagccagatggcctgcagaagatggcatagagggtgaaggagatcgagaatacatcggtcctgagattttgatgggccgcttcgataaacccgccgacatattctcgctgggcctgataatgttcgaaattgcgggcaatgtggaacttccccgataa

SEQ ID NO: 6304 - DNA, 501 bp, A.fumigatus
tgttcgaaattgcgggcaatgtggaacttccccgataatggtctctcatggcagaagcttcggaacggcgatatgagcgacgtgcctagcttgacctggagctcggagaccagcatcttccgcgacgcttccggaaatcccatctcggaagagccgtcattcgaggagctctgcgcctcggacttgggcgatgacgactttggagaggatagttttctggacagccgccttcgtcaggcagtgcttctggcgcgcagtggggagctggtcaaccctccaagcttcatgatcgatgcgagccacgagcaagccttggacaagatcgtccggtggatgatttccccagatccttctgatcgacccacagcggatcgggttctccaaacccatggggtccaattcgtagaacgtcgacgtcgtgctggggccacagtctacgaaggcaactggggccctgcggacgagatcctggctgaggatgccgaaatgatcgacgtgtga

SEQ ID NO: 6305 - DNA, 315 bp, A.fumigatus
gaagcgaggaagattatatttgaggccgcttctcaacttacaaggcgctcggcaggtttaccagctttggccacaggtatccttctttcgaagccaggagggccgctcttccgacaggtcatggatgagctccatgaaatatctcacctccctgccgagcaagatcttgtcaaacagaaagtcgaactaccacaggtccacgccacgaattgcttgaaagacatatttacgaacaccaaactcggtcctttcacagaatcttatatcatgccggccctgaccctatccgctgaacagctaggatcgcctatgtaa

SEQ ID NO: 6306 - DNA, 603 bp, A.fumigatus
  unsure (444): Identity of nucleotide sequences at the above locations are unknown.
tccaagtcatccctcacagaagagcatatatctaagctcacctttccttctcctcttcatggctacgagagcgatatatctaagcaaagagctccttatacttcgcgtaccactataataaagctattgactatgaccctgccaattccaccaaacataatgttttccttcaattctctaagaggccatggcttgaccattggtatcaccgcatgctgtggggtgtcattcatgctatttggctacgatcaaggtgtcttcgggggcattctctcaaatcccacgtttcagaaacagttcgatcatccaaacaccacaatgcaggggcagattgtgtcaatatacgttcttggatgcgtggcgggggcttttctgtcaatgtacactggagatcgactcggaagacagcgatcagtcttactagccagcgcttttctcacaatnggcggcatcctccaatccgtggcttttactctcccccatttgattgtgggccgcattgtcgctggccttggagttggcatgaacaccacgacagtgcctatgtggcagagtgagacatgtcttcaccacggggctggaaggatccgcggtggcgcattg

SEQ ID NO: 6307 - DNA, 204 bp, A.fumigatus
gaatggcttaccatccaaaggctggcaaagatgtgttgtatgaggaaggaatctaaagggaataacgccattatcttcgcaaagttgcaagaatttgacagtgagatgagagccatggccatcaaatataagtatctgtttctcccccttctttgtacgctcgtttgttgcattaataaagctttgaagccattgaacagctag

SEQ ID NO: 6308 - DNA, 387 bp, A.fumigatus
actctgttctgcagacacgaggaccgctcctttcctccgatccggttcgggaaggcgaccccacggcggggccttgccctggagaaacatggggaaatccgggggagttatagggtatctgtgactaaggctccccctcaccgctccgcgttgagggtgagccacagcgaaaccaccaaccacaccgaatccaccatttttcaatttgactatttgaagctattcaaaccacccaacatgcctaaatcttctaaaaataatgaatcttacctcctcaaggcctgcgaggctgctcaggcccaaaaaaagccaaatatctctaagattacgcgtgaatatggcattccttatataatactatataattatgttaaaaagggtaggtag

SEQ ID NO: 6309 - DNA, 573 bp, A.fumigatus
gttcctaatgatttttcccttcctttaaataataatctatgctcgcttcctaaaggcaacggaatcttcatggaatcttggttcaatgagagcgaggccttaccaccagatactacgatagcgacgtctcctaatggctggatatcagatgaactagctgttcaatggcttcaaagctttattaatgcaacaaacgagcgtacaaagaagggggagaaacagatacttatatttgatggccatggctctcatctcactgtcaaattcttgcaactttgcgaagataatggcgttattccctttagattccttcctcatacaacacatctttgccagcctttggatggtaagccattcttaagctataagcaatacttctattatatgaataataagctatcttactgggctggtaagcctgtagggaagttagaattcttatacatgattagaccagtacaagagaaggctttcaaccaaaggatcatccgtgaggcctttaaagatcgtggaatctggccagtcaatagtaagatagctaacaatcttggggtcccactatgtcttttccac

SEQ ID NO: 6310 - DNA, 405 bp, A.fumigatus
cacccccgcggatccttccagccccgtggtgaagacgtcctggctcgtgcggcgaacgaggaggcggtttggctgatgcctgactttggctactgggcctgggacaatcccgataatgcgatcggaccgtttgaccaagtggtcgcgaggatccagcgagctgatattccatgggaagcgaagaagcagcagctggtttggcgtggtaagcccagttttgcacccaagctgcgacgggccttgatcgaagctacgcgggaccagccgtggggcgacgttaagcaagtcagctggccggatcggaccaatgttctgagtatggaggatcactgccagtatatgtttatcgcgcatgtggagggtaggtcttctcggttcatttttttgaggttggacgatagctga

SEQ ID NO: 6311 - DNA, 477 bp, A.fumigatus
cactattctttaacagacccaattttcaaaatcacgatccttggacacgacattgtcttcatcaccagcgcaaaactgctcgaggagatttgcgatgagaaacggttccgcaaatgtgtgaccggccccattgtcgaaatccgtgaggcggtccacgacagtctgtttactgcgtaccacgatgaggaaagctggggtattgcccaccgtatcatggcctctttgatgactccagaggctgtgatcgacgcttttgctggaatgcgcgagaccgccacagatctggttaagaaatggactgcgggcccccggcagcgaattaacgtcagcaatgacatggaccgtctgaaccatgccgccaacatgctctgcttctttgaccagcggatccactgcctcgagggaccagagccttcggtcctccaggccatcggaggctgcgtcttctaccgacggagacgaaggcccagcgcatag

SEQ ID NO: 6312 - DNA, 1305 bp, A.fumigatus
ggacatacccacagttcaaccttgaggcatggctctctcactcaatctgaacagttgaattgtcattctcgtccaccttcaatcgcatcggagctaactgtttcgggtaatggcggggatctccgccaagacatcccgaacccatgtctttggagtcgacgcgacgtgcgcgaagagaaccaatttttccggaccaacgcatggtgcatcgacgacgttacactcacaaattcaagcaaagcacttgatacatacagacttcgccatgattataatacagtttacttcgacatgtctcggtcgtctcctgttccctctgccgctttgtcttcgcccagcagctctgtgaaacaccagtctcagttcacttatcgccaactacagcttctacgtcagggctcgacggcgactccactgagggtaatcgctcatatcgacctcgatgccttttatgcacaatgtgagatggtacggctgggaacgccgaaggaggcgcctctcgctgtacggcaatgggattcgctcatcgcgatcaattatcccgctcgatccttcggtataagcagaatgatgtcagccagcgaagcacagaagcattgtccggagattgttctgcagcatgtggccacgtttcgcgagggcgagggcgggaagtgggcttataggaaagacgcatttaagaacatcagtacagataaagtatgcctggatccttatcgcgcagaatctcgaaagatcctgaaagtgatgaaagaagaactttcaagatggcacgcgggtctcgtggacagcgaacatgaaccctactctcactatcaagttcaaccttctagcctcgaaaaggccagcattgacgaagtatttatcgacttgtcgtcactcgtctatgctttattgcttcagcggtacccggaactgcgtatcgaaccgcaaggtgacggacgcagcactccgttgcctcgccccccgacgacagcgttggaatggaataccgaagactgcttgatagaccttgatgagaatgagacggaagttgatgatcctgactgggatgatattgctatgctcataggctcggagattgttcggtcagtccgaacagctgtctggaacaagctcagctatacctgttccgggggggtcgccagaaacaagatgatggccaagttgggaagcgcttgtcacaagccaaacaagcagacaatcgtcagaaaccgcgcgatccacaattttctgggtagcttcaagtttaccaagatcagaatgcttggaggcaaactcggagaccaggtggctactctcttc

SEQ ID NO: 6313 - DNA, 195 bp, A.fumigatus
ccccccgtcaatctcctcgcagttctttacgaccatcatggcaagggcggtatcgccgacatcaccgaggctgaaaaatggacgaacgtcaatgtcaattttaacatcatgtgcgattacggaactcacaatggaatcagcgcaataacactgccccagccaaagcgaataccgcacagattgaataggcagtag

SEQ ID NO: 6314 - DNA, 213 bp, A.fumigatus
gacattatatcattgatctctgtcagagacgtctacacacatacagagaatctgagaggtctcggaatctttcctcacgaaatcgatctgatccttgctaaatctcttctttttgtatcaactctcgatctagataacattcgattttacttatcgactaagaagaagccatgtcaggtgctctggcgtccttggtcggcaagagaattttag

SEQ ID NO: 6315 - DNA, 657 bp, A.fumigatus
ccggagagtcctcacacaggtgaaacgcagggcgtacagactagactactgcctattcaatctgtgcggtattcgctttggctggggcagtgttattgcgctgattccattgtgagttccgtaatcgcacatgatgttaaaattgacattgacgttcgtccatttttcagcctcggtgatgtcggcgataccgcccttgccatgatggtcgtaaagaactgcgaggagattgacggggggttaccagcacggctcaggatgataatgatgatcaatgtgctgatcgacttcgttatcggtctggtcccattcataggggacgttgcagacgctgtgtacaaatgtaacacaaggaacgctgtcattctagaaaagcacttgcgagaaaagggggcgaaagtgcttaaggcgcaaagtcgaactccggaagggatcattgataccagcctgcccgaggaattcgacagatatgaccagagtgcctcggacgaaccgcctagatacgagagccaggcacaaacgggacctgctaggccggagcctgccaggcatccgaagagagaccggtcgcagaaagggtggtttggtaaatcgtccgatcgagcaggtgacttggaggctggagtggcggataactcacaatcccgtgttcaatga

SEQ ID NO: 6316 - DNA, 570 bp, A.fumigatus
  unsure (569): Identity of nucleotide sequences at the above locations are unknown.
ctaacatgcaaagctggtatccttgctgcacttctagcgtgcaaaacagaagagctcaacgacggcgcctcacacgactacttcccttggatagcagaaactgtcctcggcctttgtagactatgcattgccaacaacggccatcttccaactactataccgcctcgtcagtctactcggcgagcatcaccattggtgcaaatctgccatggtagtcctgctatattacttctcttaggctgtgccaggagaaaccgctaccttgtttcaaatttctggcagccagaatgggacaaggctatctttctagcgaccgagagggtctgggaggaagggctgctatcgaaaggcgggagtctctgccatggcattgcgggaaatgcatggccattgctgcttttgcacgacagctgtgagtatgacgacgagttggtggagactgcgaagcggaattacggggaacgggcaaagaataccacggtcgaacaaccgcagccagcgctcacaggagactactttctgtctagagctcttgcgcttctgctccatgcgtcttcaccacggggttng

SEQ ID NO: 6317 - DNA, 441 bp, A.fumigatus
tgtatctccatagcatgcagcatgagcttcctgcacctgcatcctcgtgcaaccgagctcttcgccattacatcggggcgcgtgttgtctgaaatgattccagagacgggggtccttgactctgaaggccaccaacgggtcatccgtgccgagctcggccctggcatgctgactgtctttccggctgggtcgtttcacacgcaagtgaacccagactgtgagcccgccaatttcaccgcagcctttacctcggatgagtttgccgtgggcattgtcgctgcacagacattttcgttcagcgatgatgtcattgctgccacattcggggagactatcgctggtgaggatattgacaaggtccggcatgctattcctgccaccatggccatcaaggttgaggaatgtttgaccaagtgtgggaagcagaaacgccaggcttga

SEQ ID NO: 6318 - DNA, 294 bp, A.fumigatus
cccattcagagctgcgaacaaatgacgtatatcgagcatcctacgggatctcaagttgttcagaccgcattcgcaataatcgcagtcctgagcgttgactatcccgatgttgaacctatccaccgtggagttcgcatgattatgtctagacagcagcgaaacggggaatggctacaggagggtatcgaaggcatctttaacaagagctgtgctatcacatacccgaattacaaattcatcttcccgattcttgcattaggcaaatttgggagaaaatacccccacctcgtgtag

SEQ ID NO: 6319 - DNA, 1053 bp, A.fumigatus
agacctacacgggcggaagactgggtcagtaaactaattgacatggaggatgcgaattcagattatgccgatctagcatccgtgaatggacccttgaacatgattgtttgctatatccgcgatgggcccgattcctactctgtgcgtcgtcaccgggaacgcatggaagaattcctctgggtgaataaagaggggatgctcgccaacgggacgaacggtgtacaatgctgggacacagcgtttctgatacaggctgtgtggtcggctggtctagctgaagacgcgcagttcaagcccatgctggtacaggcgctggagttcctagatcgacagcagatccgcgagaattgtcaggatcagggcgtttgctatcgtcatgtccgtaagggggcctgggctttcagcaatcgcgaccagggttatggggtgagcgactgcatttcagaggcgctgaaggctgttattgtgcttcagaaagaggccgatggatatccacagctgcttgaagaccaaaggatctttgatgccgtggacaccttgctcacttatcagaacccatcgggcggttgtgcatcctacgagccgacccggggaagtgaatacctcgaaatgttgaacacagcagaggtctttggacgtattatggttgaatatgattatcctgagtgcacaagcgctgtgctgacagctttggtcttgttctccaaacactggcctgactaccggcgagaagagatacagacatttatccaaaggggagtggattttatcaaaagggcgcaacgccctgatggcagttggtatggaagctgggcagtatgctttacatacggcacgatgtttgctctggaatgcctgagatcagctggagaaacttatgagaatagtgaacatgtccgcaggggttgcgagtttctactgtcgaaacaacgcgaggatggtggatggtcagaaagctttcaggtgagtactgaaatcaacaagccactacactacccctatgcttcgataagatacttgaaaactaacccattcagagctgcgaacaaatga

SEQ ID NO: 6320 - DNA, 186 bp, A.fumigatus
ccttcggccccgctggtgaagattcaatttgcactgggtggaaactccaagactctcatgtttgtgatgtgtagcccattgcaagctcaccttgcagagacattgactagtctcaagtttgctacaaaggtgcacaacacacacattggcacggcaaagcgacagactcgtgttcgtgatgtttaa

SEQ ID NO: 6321 - DNA, 1470 bp, A.fumigatus
ctgaaagacagccaccacctcgcccccatctccggtactatcgacccgacggacaaagatcccctcacagccgcctggcgcgagctccacgaagagaccaccctctcgcccgcaaacctaacgctctggcgcatcggcaaaccgttcaccttcagcgacctcgctctcaaccgcgaatggaccgtccaccctttcgccttcaaactcaaacccgcaagccagggcggccaaggcgaggcagccattaaaacagaatgggagcacgaaagctgggaatggcacgatccggcctccatcgtcgacgacgaggccttcggcggcgtgccgcgtctccacgagacgctccgccgagtcttcccagagtgtgagatggacgagcgcgcgggggagaccctcgcaagggggctggaaaggttgcagcaggaccataagagcggggcgcacgagctgacgggcattgcgctggcgatcttccgagagattatcgcgcagacgcacaagatcgacgaggggtggtggaggacggtgcgcatggccgcgtggcatctcatcaagaacggccgggagagcatgggtgcagcgacactcaacgcgctcctctcaatcctcgtaacgctagacgatatcgtgcatcagacgacaggtgcagagcaggatcagaaacgagaccggatactctccactatcgactcgcatatcgcaaatgggacagctaacaccacccgccttaaagacgcatttacctcctacgtccaaaccacctttcttgcaacgcagccaaaacgagacagagtcggcatgctcaccttatccgccagctccacgacgcgaaatatcattctcgacgcctttgactcgtttgacgtccccacgctcgaactacgggtgctcgaatccagaccggttttcgaaggcgctaaccttggctcctccatatactcccgcttccagtctcagttcggctcgacggacaagaagctcgagatcaagatatacacggatgcagcagctgccttggccgcacaggacatcgatgtcgtcctcctcggtgcggaccgcatctgttcgtccaagggcgtaagtaacaaaacagggtcgttgcctgtcgtgctcagcgcgaagcatgtcatgccaagcgcgaagatccttgttatcagtcagctggaaaaagtggttggggacgacggcattctggaagataaagttgaggataacgaccccgacgaggtatttagtgcgtggcgcaatgagagggtcgagggttcacaggtgctcgaagatagtttcagagattccaagacaaacaaggacaacccggcaactatccaaatcaaaaatatctattttgaatgggttccgttgacgttggtggacgcctttgtgagcgatgaaggggttctcgatgaggcagcaatccaaaacaagtcacagcagctacgaaagctggcacgcaaatactttgacttttga

SEQ ID NO: 6322 - DNA, 330 bp, A.fumigatus
cgctctggcgcatcggcaaaccgttcaccttcagcgacctcgctctcaaccgcgaatggaccgtccaccctttcgccttcaaactcaaacccgcaagccagggcggccaaggcgaggcagccattaaaacagaatgggagcacgaaagctgggaatggcacgatccggcctccatcgtcgacgacgaggccttcggcggcgtgccgcgtctccacgagacgctccgccgagtcttcccagagtgtgagatggacgagcgcgcgggggagaccctcgcaagggggctggaaaggttgcagcaggaccataagagcggggcgcacgagctga

SEQ ID NO: 6323 - DNA, 594 bp, A.fumigatus
  unsure (591): Identity of nucleotide sequences at the above locations are unknown.
gggtatgtacattgtcaagaaagggtcaagttcccgttcgtgcctaatcttttacaccagttgctctattcgctcgactgtgaagaagatcgaatcgccatcttgcagacgcttctcttaatgacatattggtcggaccatgtcaacaacccacaaagagacatctgggattggataggaatatgcaacacgcaggcccactctataggattgaacagagaccccaccacatccgacatggaccccagaatgaaacggttacgggtccgcctgtggtggagcttgtactgtcgagaccgtcttattgccatggggttaaggcgaccaacccagatcaatgaaggaaccagcagcgttccgatgttgcgactggacgactttgattttgaaccgtttcatccgtccgtgattgagatatttcgctgccgtcaactggaggatgtgtcccaccagaagcgtctagcgaccatgttcattgaaaaagctaagctttgccagagcattggccgcgtactattcgcgcaatacgcaacttctcaatgccagttcggtcttcaccacggggctggaagtatccacggtagtcagttncca

SEQ ID NO: 6324 - DNA, 729 bp, A.fumigatus
tccccttcttctttcttctctagccgctcataccccgtccatgtatatcaaattacatcgtttttctgccggtgcagccatctccaggttgcctcgctcaggatggtgaccaccaagcgaaagctgtctagcgtagacatcgatgcagagttacccaacaccaaaaagagcaaccttctgggatatgatgcccgcacaccttggctcttcgactccaaaccgtcgtcgctaggtcggcgaacagccgggaaccctgcggtacagcatagccttccgctggccaacatggtctccacagtacaagatctcattgacccggatttcgaccctctcatcgcgatacttgatgacgaaccgcgttttctaaagccactacccagtcgaatatcatcggaggacctggagtttctgagatttcgaggtgcactttcgattcccgagagcggactgcgcaatgagctactacgatgctatattcagtgggtgcacagtttcatgccggtcctgaacctgcaagagttcctgcgatgcgttgcagaaaatgacccggaagggaacattagccttctcttgtttcaggccgtgatgtttgttgccacggcgtttgtggatttcaaacatctgcaggatgcaggttataagactcgaaagagtgcacggaatgctttctatgaacgattaagggtatgtacattgtcaagaaagggtcaagttcccgttcgtgcctaa

SEQ ID NO: 6325 - DNA, 735 bp, A.fumigatus
cacagaccatctccaaagaccttgtttcccaaaattgggtccagtctggtgcaggtctactctggcgacgaccatgactactgcgagatctcccaccgcgaattcagtggctctcccaaggaaatcactgtgaagagcctcagctgggcaatgggcgtccgtcacccgggctttttactcaccagtctttggaatcccattgacctgacaacggggaagccgagagagcactcttcgtctacgattcagaaccatctttgcctcctgcccgatcaactgggcattttcatccactacggggctctttttggatttacgttggccatccttctcatccgggcaattgttttggtgctgtacttcccacggccaacctcacctgatcccgtcctacctctctccgaacaagacttgcacaactcttcgccatcggtcacctctcttcccccattctccagtacgtccagctctacacttccgtcaccgcgcggtctagccagtcgcgctgtgaatgcaccgccccggcccaagccctaccatgatgcttacccaggactagcagagtacgaggccgagcagaactccaagtggagaccgtcgcgcgatgaatatcggcggaaacccggggctggccgttcagctcttgccagaatcagaagggagctcattggttcggtgcagtatgtggccagcgtcgtgttggcatggtacttctttttaatctggcggtggtaa

SEQ ID NO: 6326 - DNA, 789 bp, A.fumigatus
agacccttgacggtcaggtacacggaccagtatatgcgccgctcttttacatctatccaaagaagtttagggcccgactcggtcgtattccttggcgacctgtttgacggagggagagagtggggaacatcatcgacgacgagccctgagaagcgctaccagcaatacaaagattccttctggaagcaggaataccatcgatttgtcaagatcttctctgatcagttccatgagggggacgggcagtcgacggagccgcgaggtcgacggatgattgccagcctaccgggcaaccatgacctgggcttcgggtcgggtgtccaggtacccgtgcgtgatcggttccaatcattctttggtccaggaaatcgcgtcgatgtaatcgggaaccacacgtttgtgtcgatcgatacggtttcattgagcgcgatggatcagcccgatccacggacgggcagctccgggactggagcgggggatggagagcagcctaacgagcgtatttggagggaggcgaaggacttcctcgatgaagtgcctcggcatatggccaaggccgagacggaggaactgctgatgttgcgcaatgagacccaagcgagcaaaggccgtctttttaaacacgacgcagtgcaagtgttggaaaatgcgatcgtcaaggaaccacagtgggaagctcttggtcttccgacgattctcttgacacatgtgccgttgtaccgcaggccgggttacaccgtgtgggcctctcagagaacgctatccaccctcatcagatggggagcttga

SEQ ID NO: 6327 - DNA, 207 bp, A.fumigatus
tcgatttctaggctacactcaaatgctattgtgtacaggtgtcgtgaggatgaaatttctttgtatgaaattattaccctcaatatcattatactatgcctgaacaaaggacttcttttctatcaaggtagccgaattaccaccgccagattaaaaagaagtaccatgccaacacgacgctggccacatactgcaccgaaccaatga

SEQ ID NO: 6328 - DNA, 477 bp, A.fumigatus
gtggttgaccggatgcagaaagatcaggatcggaatattgatgttttcatcactggtatatcttcgcagctcatgtcaacttttgactcggcactccacttggatgatcaacttacatcggacctgagccgagaactggaaaacggccgtcttgtgcgactgatggcgaagctgaacttcgtgaacgaacggccggaatacgaacatgacagacaatggtccgagaatggagaacgttacttcttgaaaattttccgcgattatgtcttccatcaggtggatgcgcagggcgaccccgtcgtcgatcttggccacgtgatcacatgcttgaacaagctggatgcgggaacagaagaaaagataacgctaatcagtcgagatgagcagagctgcttcattgtcagctacaaggagctgaaaaaggcgctcgaatcctcattccaggcgttgatgaagcccgcaaggagaatgcattga

SEQ ID NO: 6329 - DNA, 747 bp, A.fumigatus
  unsure (118),(121),(178),(372): Identity of nucleotide sequences at the above locations are unknown.
gctcacttcccagggatatcaacaggggacgcaactgacctacatacacagggcgccaccaacggcatcatccatggcattaacgccatcctcatcccaccccccgaaaccctcacgnttntgaccattgtcccctccgaattcagcaccttcaccctaggcctctacaagaccggcntggcaaccgctctcaacaaatccagcacaccccaccaccacggcggcaccatgttcgccccctccaactcagccttcaagcacctcggcctcaagatcaatgcattcctgttctctcccatcggcgaaaagtacctgcgtgctctgctccagtaccacatcgtccagaataggactctatattcggacgtcttntacacggcccaaggggagatcaagccgtttggcgtaaagggcttcacgcatcttgatctgccgaccctcctgcacgggcggaagctggcggtcgatgtcgcgcggtttggaccatttgcatcgctgaagatcaatggcttccagcgggtagcttttgcggacgcgttggccaaggacggcactgtacatgttgtcgaccgtgttttgatcccgcctcggaaagtcgatgattccgcgcctgattggactggcaatgatgatgagttgactgttgaggatcttaaaagccgcctcggagactggttagcagaagacgagggcgtggatgaggtcgaaatgatgcatgacatattggctcatggtgccgagctgtaa

SEQ ID NO: 6330 - DNA, 324 bp, A.fumigatus
  unsure (11): Identity of nucleotide sequences at the above locations are unknown.
attccccgtgnacgcttttccttgcagcccggcggtgaagatccacctttcccgcctcaccacccctccttcaacaaaaccatctacgaactgatcaaatccagcaagtataccaccatcctcgccaagatcatcgacgaggatgacgagctggtccagttcctgaatagcactgacgcgaaccataccttctttgctcctacaaacgaggccttttcaaagatcccccatcactgtcctggccgcgatcacgatcacgacggcgacgaccaccataagcaccacaaggtccccaaggaggttatccgggcgatattccactag

SEQ ID NO: 6331 - DNA, 213 bp, A.fumigatus
cacgtcgcaccaggccgctactcggcggcagatgtgttccataaccacaccgtgccaaccgccctcaaagagtctgctctcggccatgacctgccccagcgtctggctgtccgcgtacgatggaagggcctgacgctgaactactacagccacattgtggccgcagatattgtaagctcacttcccagggatatcaacaggggacgcaactga

SEQ ID NO: 6332 - DNA, 297 bp, A.fumigatus
gtctattacccgggagattgggatggagctgactcgacaggcgtaatcctcgactacgatctggcatgcaaacgctccctcgagccgctgcgacagttcgactttgtggcgccggccgcccacaccgccggcctctccatcggcatgatgctcgcctccacgggaaatccgtacgtcaaggccctggtcgataatctcccgctgtacaaccggcggtggttatatctgccctatgtcacggtgatgttcagcacgggctgccactacgcttcgtacggttttcccccaacccgttga

SEQ ID NO: 6333 - DNA, 237 bp, A.fumigatus
tggctcgaggcccgcgagctctgcgtcaagcatcatgcctcctggagtacctttgtctggaacgaggagagcgcgaacaagctggtacgcgaggactttccccatctctacgaaatgtggaagggctatccgtacatgatccagcgggtggatgcgctgcgatatatgatactccacaaacacggtggtgagtctattacccgggagattgggatggagctgactcgacaggcgtaa

SEQ ID NO: 6334 - DNA, 210 bp, A.fumigatus
tctctcggtggacccagcagcaagagtcagcgatgtgaagggttgccgactacctcgagcagcaaggatgtgttcttgaggcagcccactctcctcattgctggcgagaacgccggttctctctggtacaaggggaacctggataacaagataggaggggccaccaagaaggtgattgtgccgaatgcagtccagatgggacttttataa

SEQ ID NO: 6335 - DNA, 375 bp, A.fumigatus
accactcaaggattcagtcgaaaacagtcaggaacatacattctatttaactctgcaattccgagccatcctccgtcatgccgtccatgtcgatcaacaaaggacgaattcaggttgccggcttgctgcacaagcctgcaacgtcacccaacgctcctggcaattgtgatcgtacatcctggaggtggcgtcaaagagcagacggccggtctccatcgaagaagctcgcgcaagaaagctttgtcaccgtctcctacgatgcctctccaccaagccgagagcagaggcgaacctaatctctcggtggacccagcagcaagagtcagcgatgtgaagggttgccgactacctcgagcagcaaggatgtgttcttga

SEQ ID NO: 6336 - DNA, 984 bp, A.fumigatus
tactcaatctccctcatcatgtgtttactttcaaagatctctgccagcttactgttggcaatggcagctccaagtttatcctaccccacaggtatccaatcgtataccaatcctctcttccctggttggcactccgatcccagctgtgcctacgtagcggagcaagacacctttttctgcgtgacgtccactttcattgccttccccggtcttcctctttatgcaagccgagatctgcagaactggaaactggcaagcaatattttcaatcggcccagccagatccctgatcttcgcgtcacggatggacagcagtcgggtatctatgcgcccactctgcgctatcatgagggccagttctacttgatcgtttcgtacctgggtccgcagactaagggcttgctgttcacctcgtctgatccgtacgacgatgccgcgtggagcgatccgctcgaattcgcggtacatggcatcgacccggatatcttctgggatcacgacgggacggtctatgtcacgtccgccgaggaccagatgattaagcagtacacactcgatctgaagacgggggcgattggcccggttgactacctctggaacggcaccggaggaatctggcccgagggcccgcacatttacaagagagacggatactactacctcatgatcgcagagggaggtaccgagctcggccactcggagaccatggcgcgatctagaacccggacaggtccctgggagccatacccgcacaatccgctcttgtcgaacaagggcacctcggagtactttcagactgtgggccatgcggacttgttccaggatgggaacggcaactggtgggccgtggcgttgagcacccgatcagggcctgcatggcagaactatcccatgggtcgggagacggtgctcgcccccgccgcttgggagaagggcgactggcctgtcattcgttatcagccgccggatggaagatatacgtcc

SEQ ID NO: 6337 - DNA, 408 bp, A.fumigatus
  unsure (207): Identity of nucleotide sequences at the above locations are unknown.
ccttgggtctcacaagggccgggcagcttgcccttcttgcgaacagggacaaagctagcgccaagcctcaaggccaagctggggccgaaaaggaaccctcgagcctccagtccaacgataacatcgggcttctggttaccgtgggtttcgaggatgtgcagttcaaggcaacggaggagagcttcgtgcagggtcggatcggcgaanaataggaagatatcctcgaaaagaatgccaggagaccggaagtcggggaattggcgccaagcggcgcgggattcttactttaagaaccggagaattcggtggttgccggaaggggatggggagaggggtgttcccgccaacttgggtgggcggcgggcttctgggagttttgcgttggatttgagaaaacaatttgactgg

SEQ ID NO: 6338 - DNA, 465 bp, A.fumigatus
  unsure (75): Identity of nucleotide sequences at the above locations are unknown.
gaatcccgcgccgcttggcgccaattccccgacttccggtctcctggcattcttttcgaggatatcttcctattnttcgccgatccgaccctgcacgaagctctcctccgttgccttgaactgcacatcctcgaaacccacggtaaccagaagcccgatgttatcgttggactggaggctcgagggttccttttcggccccagcttggccttgaggcttggcgctagctttgtccctgttcgcaagaagggcaagctgcccggcccttgtgagacccaaggctacgagaaggagtacggccaggactttttccagatgcaagccgacgccatcaagcctggccagaaggttatcgttgtcgatgacattatcgcaactggtgagtttgatttatttcaggaaaatactcttcatcattcattgacgtggttacaggcggctctgcctacgctgccggagagctga

SEQ ID NO: 6339 - DNA, 204 bp, A.fumigatus
tttatttcaggaaaatactcttcatcattcattgacgtggttacaggcggctctgcctacgctgccggagagctgatcaggaaaatgggcggagagctcatgggattcatctttatcctggaactggagttcctcaatggacgggataagctccctgccccggtgtacactcttctctccggccaggagagtaaatatcagtga

SEQ ID NO: 6340 - DNA, 348 bp, A.fumigatus
agacatactgataaggatcttggagtcaagatccacgcgactggcgatgtgagaaatggtttcgagttcgagattaagcgcagcagcaacttccgcacaaacgaacttcctcccacgaagaggataccgttgcaatgggtttatggccagtactttgatgaaaaagcgatgtctaacaacggagaacacaagattgacaatgtgcctgtatgtcagttcgaggccagtgcgcacaagattaaggcccctgggaagagcctgaatacaactagtgatgctgtaagtcccaactatatttctcatgcagcctcttgctctgtctcggtgtccgggaatcatatcttctaa

SEQ ID NO: 6341 - DNA, 489 bp, A.fumigatus
ctcgagaactgtctccaggcatcgctgttacgggaggcggccaggaaaggtcatgcgggggttgtgcagcagctattagcggttgcgggagtcaacccagctgctgttgatagacaccatagcactccgctgatagtggcagatctgcaagggcatgccgaggtggttaagcttttactggcgacaggcagggtgcagcttaacacaagggataacaagggaatgacaccattaatgtacgcggccaaatttcagcggaatcctgttgtcgagttcttgctatcaacaggccaggtgcaggtcgactttgatctgagaaagctgagcaagggacctcgctcattaaatcaacaaaacccaacattggatcagtctcttgttgaggttatcgatgcctacaaaagagacaatgcatcgccgaaatcaggtctgcttctgaaaggacaaaagccaatgtttctgatagttttgtgccctccgcctccttag

SEQ ID NO: 6342 - DNA, 189 bp, A.fumigatus
gtaaaggatatcgagaggacataccataacaccaacattccatatatcgaccgggtaactccaatcgactttcagcatcacttccggcgatctataaacatttggctgcgcatcgtgatttctcctctgatctccacgtacggcagagccaaaatcactcaacactgctcaaccaaacacctttggtaa

SEQ ID NO: 6343 - DNA, 288 bp, A.fumigatus
gcagtgttgagtgattttggctctgccgtacgtggagatcagaggagaaatcacgatgcgcagccaaatgtttatagatcgccggaagtgatgctgaaagtcgattggagttacccggtcgatatatggaatgttggtgttatggtatgtcctctcgatatcctttactcaccagtcgggaataacgtttataggtgtgggatttgtttgaggggaagcatcttttctatggaaatgactcagatggcaaagggtattcaacccgggcgcactttgcggaagttatga

SEQ ID NO: 6344 - DNA, 600 bp, A.fumigatus
  unsure (597): Identity of nucleotide sequences at the above locations are unknown.
gttcgtcttgctaagcacacgagaatgatcctcgctgaaatcaacatctacgcagaagatggctcgttccatggtaacgggtttttcatgcacatgccaggtgctaagaagcccttcattctcacggccgcacacaacatcatcagtaagaacggggatccttcggagaacatcgtcatgagagtaatgggctcaaagaagcggttccctattcacggaagcaccgtccgcatctgtcctgcgtatgagcaaaaccccacaactgccgcggaagaagcagactgggctctcatcttcgcaccggacgagcttgaacaagacccagcacgcgcaggcatcgggccactgggctttgcgctgaagctggcctacgaagagcgcctggactgtgagatgcgcgtgaccggggttccagtttcgagcaagaaaaacagcccaaacgcaaccacgatggggccggtgactacgacaggaaaatgtctgaacccgatcgtactccccgctcagctggagtacaccgcgaagacagataaaggactgagcgggtcgccggtgtggacaatgtatcacggagtcccaactgtcctcgctatccantaa

SEQ ID NO: 6345 - DNA, 798 bp, A.fumigatus
gtaaggagaaagggacttttgttcatcccagcaccaacggttgcaggcgcggataaataccgtaattggaccaactggggaaccacctggtcgagctggaccaagtaccatggcggtaacgacaccatcgaagagctgccgtggcaaggcaccaaaggacagcggtgggaaggcaaacacgtccgcgtggaatactggagcggcttgaccggtagcagcgactactaccaagaaggtgatgtgggctggccccaccaagtgccccgtcgattccctcatatccatttcaacggtcctttcaaccagtttggctacgatggcggtctccccaacaagctcaagctggacaccaccactgggcattggaagtaccacttcacctacgagtggcctgcacaagctcagatcaacgtctggggcatgaaccccgatggcaggccggaccagagttgggtgctgggcgacatcgacggtgaccacgttttggaccggatgcccccgtcgtctctgtcggcgaccatgatcaatatcacggaccttccgccgtcacctcacctcgcgtggatcatctcgatcaacgacgggaccatgcggtatacgttagaacccaccggtgatcaaagtacgcagatggccatgtacattctcttctggattgtgcccttgctcacaggtgcggtgtgcgtctacttgttcaagaaatccttctaccaggtcaagttcaaccaggtcggtgtcagccaaaagcggacgctcattcccctgggcccttcagcggaaggtcacgcgtgcccgtaa

SEQ ID NO: 6346 - DNA, 1647 bp, A.fumigatus
aacccaccggtgatcaaagtacgcagatggccatgtacattctcttctggattgtgcccttgctcacaggtgcggtgtgcgtctacttgttcaagaaatccttctaccaggtcaagttcaaccaggtcggtgtcagccaaaagcggacgctcattcccctgggcccttcagcggaaggtcacgcgtgcccgtaatggcgagggtgaggctatgaaccccctgatgcgcctggccaacaagtccggtttcctccagagcgcgacggatctcacagccgcttcgggcggttccaaacgccgcatggtcctcattgccacgatggaatacgatatcgaggactgggccatcaagatcaaaatcggtggtctcggtgtcatggctcaactgatgggcaagaccctcggccaccaggatctcatttgggtcgttccctgcgtcggtggagtggactaccctgttgaccggcccgcggaacccatgatcgtcaccattctgggcaaaccgtatgaggtccaggtgcagtaccacatcctgcagaatatcacctacgtcctgctggatgcgccggttttccgtcaacagtccaagtcagagccctacccaccgcgtatggatgacctcgacagtgctatttactattcggcgtggaatcagtgcattgctcagactatcaagcggttccccattgacctctaccatatcaacgattaccacggatccctcgcacccctctatctcctgccgcaaacgatccccgcctgtctgtctctgcacaacgccgagttccagggtctctggcccatgcggacagaaaaggaaaaggaagaggtttgctccgtcttcaacctggataaggaaatcacccgccgctacgttcagttcggtgaggttttcaatctgctgcatgccggtgccagttatttgcgtgtccaccagcaaggattcggtgctgtcggtgtgtcgaagaaatacggtaaacgttcgtatgctcggtatcccatcttctggggcctgaagaaggtcggcaacctgcccaaccctgatccttccgacgttggcgagtggaacaaggaaaaggccctcgccaagagtgaggacccacctgtcgatcaggaattcgaagccggtcgtgctgagctcaagcgccaggctcaagaatgggctggcctggagcagaacccggacgctgatctcctcgtgttcgttggtcggtggtccatgcagaagggtgtagatctgattgcggatgtcatgcctgctgttcttgaggctcgtcctaatgttcagctgatctgtgtcggccctgtcatcgacctgtacggcaagttcgctgccctgaagctggaccgtatgatgaaggtctatcccggccgtgtcttctctcgtcctcagttcactgctctgcccccctacatcttctccggtgctgaattcgccctcattccctcccgtgacgaaccgttcggtctggtcgccgtcgaattcggccgtaagggtgctctcggtatcggtgctcgcgtctgtggtctcggtcagatgcctggctggtggtataatgtcgagtcaatgaccaccgcccatctgctccatcagttcaagctggcgattgagggtgctttgaaatccaaaccccaaggtccgtgctaa

SEQ ID NO: 6347 - DNA, 393 bp, A.fumigatus
  unsure (63),(86): Identity of nucleotide sequences at the above locations are unknown.
accaacggtttccgggtcccccaatggattgaagatcttgagatcctgcaatctacattcatncgaatccacaacaagggagcctncaagtccaacattagtcccgtgacttctacccggcccatgaccccttggggactgggtacgatgaacccaactttccccgggtgttggaacccagacccgggtgggacgcacttttgccgagattgcttcgtgaacctgaaggaattgtcagaaattgggcacaataacggcgaaaccattattttcttaaagcaaaacaacctttgggtgggaatggatggaaaacctctgcccggtatggccccaaaaacggccttgggggtccataccggcccggggatattaaccggcccgggggggggggaa

SEQ ID NO: 6348 - DNA, 1404 bp, A.fumigatus
tgcagttgccacgtagcgagaaagtatagagatgagccacgaccaagacagggcctgcttcgcgggcgagagtttcttatgaaggatctctacacgttcgattacagtgttgaagaagctttgaagacgtacaacttagtgaaagcggcttacaaaaatctttttgatgagctgaagataccttacctagtcgctgctgcagactctggtaatatgggcgggagcctgagccacgaattccattttcccagctcgaaaggcgaagacactgtcatcagctgctcgaactgcgaccatgtctacaatgacgaactcgcagatggaaaggcacatggcatcgaggaggctcaaaatgccggttctgggcaagtatcaggcttcgacacgggggcaacttcaaccggggatagtccaaccgtctcagttgatttatggatggcgatatcaagagacaaaaagactctcttgcggggatggtaccccaagttctccatgcgcgaagcaaaccaagagcccgtggaacgcgaagtcaactcccatgcagtcaaatctatagccaccgcagccggggttgacatcgaccttagcgtagagaatccgcttgaacaatgggtctcacaggtcaagtctgacagggaatccagtatctccggctcttctgagcgtccgcaggtcctggatctgtatgacgcacaggtaagagtatacaagcgcccgcctctaggtgaccttctggagaaggtcaaccgcactgcggatgagattgattactccatgctcgatcgcttccccggcacgaatcaagcgctgaaccttgtcaaagtacaagatggcgacaaatgtaccaaatgcgcaaaaggttccttaaagacccatacggctgtcgaactcggccacacattccacctgggcacccggtacagcgaagtcctccaggcatccgtcatggttgatcgatcgctatcggggggctctcaatccaaagaccagctggtgcccatgcagatgggctgtcatgggattggcgtctcgcgcatgatcagtgccgtggctgacagtctctcagactcaaagggccttaattggccccgagctatggcgccctatgaagtagtagtcgttcccgggaagggactggagacggaggcagagaaagtgtacgattctctcgtctcaaatcacacctcttccgttgacgctatcctggatgaccgcgacaaaccgatgggatggaaactcggggacgcagacttgattggataccctgttatcgttgtagttggcaaagggtggaagaaggcacagaccctcgaggtacaatgtcgtcgcttgaacaatctacgcgaagacgtgccattggatcagctgccgtccttcgtgcagtccctactagagcgactatga

SEQ ID NO: 6349 - DNA, 387 bp, A.fumigatus
gctctcgcttcccttgcatatgccataactggatatattccgtattctgcactttccaatcggagagccgtgattaacggagcgtccacagtgaacatcacatctctctctgtgcctcaactccgcgccctccaaacccgcctcacctcggagcttgagcatctgaccacctcgcatcagaaactgcgcgccgcgcaatccagattccgtgattgtgtgcgatccatcaatgatggggttgtgggttcggagaagaagggaacagctgggaaggatgatatactggttcctctgacgagctctctgtatgtgaggggtaagctcgcggatcgagaaaaggtgcttgtcgatgttgggacgggcttttatgttgagaaggttagttga

SEQ ID NO: 6350 - DNA, 192 bp, A.fumigatus
gaatatgagcacaaaggaggaaagtgtgtgtcgtggacttcaaagaaattcattcctattcatccgagtcgagacacgataacatgctgcatcgttacaatcgacgagtcaggatccaagaacacgaaaacccgttttccatcaaacaaccagcatatgaagagtaacatgaaaacttgccagtattgctag

SEQ ID NO: 6351 - DNA, 612 bp, A.fumigatus
  unsure (113): Identity of nucleotide sequences at the above locations are unknown.
aaaaccgtatcatcgcagatggtggctccgttcaaaacattcccaacattctcgccgacatcaaagctctctacaagaccgtgtgggaaatctcccaacgtaccatcctgcanaatggccgccgaccgtggtgctttcattgaccagtctcaatctctcaacattcacctgaaggagcctactatgggcaagctcaccagtatgcactttgctgggtggaaaatgggtttgaagactggaatctattacctgcgtaccatggcagcctccgctcccatccagtttactgttgatcaggagcaatttaaggttgctgatactaatgttgctcgagccaacgctgcatacaagaagagagccgccggatccgtgcataccacatactctgctgttcctcgtacaacgagcgctccgctcaacggccacagcgaggacggcagcccgcgagctcttgccgccgatgtcactgcagatagtgaaaccggcgtgaacggctcccaggaggaagatgatgagcgggagagcggcgagcgggagggcgacatttactctcaaaaggtccttcagtgcagcatcgagaataaggaggcttgtctgatgtgccaaggttag

SEQ ID NO: 6352 - DNA, 960 bp, A.fumigatus
  unsure (930): Identity of nucleotide sequences at the above locations are unknown.
aaggctcaaaagctttggtatgctattcttgaggctcagaccgagactggcaacccctttatgctttacaaggatgcctgcaacaagaagagcaaccagaagaacctgggaactattcgcagctccaatctttgcacggagatcattgagtacagtgctcctgacgaagttgctgtctgcaacctggcttctctcgcgcttcctacttttgtcgacgcggcccgtggagagtatgacttcggcaagctgcacgaggttgtgcaggtcttggttcgtaacttgaacaagattattgatgtaaactactaccctgttccagaggccaagaagagcaacatgcggcatcgccccattgctcttggtgtcaatggtttggccgatgccttccttgccctgcgcctgccgttcgactccgccgaagcaagacagctaaacatccagatctttgagaccatctatcacggtgctttgactgcatcttgtgagctggccaaggagtttggtccttatgaaacttacgagggctcccccgtctctcagggtattctccagtatgatatgtgggacagaacccccacggacctctgggactgggattctctgaaggcgaagattgcccagcacggtgttcgtaacagtttgttggtggcaccgatgcccaccgcaagcaccagccagattctgggcttcaacgaatgttttgagccttacacctcgaacatctactctcgccgtgttcttgctggtgagttccaggtcgttaacccttggcttctcaaggatcttgtcgaccttggtctgtggtcggacaacatgaaaaaccgtatcatcgcagatggtggctccgttcaaaacattcccaacattctcgccgacatcaaagctctctacaagaccgtgtgggaaatctcccaacgtaccatcctgcanaatggccgccgaccgtggtgctttcattga

SEQ ID NO: 6353 - DNA, 237 bp, A.fumigatus
  unsure (13),(14),(22),(41),(51),(52),(54),(55),(57),(63),(64),(78),(82),(83),(84),(85),(101),(102),(104),(114),(115),(117),(118),(119),(120),(121),(122),(123),(124),(125),(126),(127),(128),(129),(130): Identity of nucleotide sequences at the above locations are unknown.
ccccccccccccnncccccccnccccccccccccccccccncccccccccnncnncncccccnncccccccccccccncccnnnnaaaaaaacgaagtacnnanccaaaccaanntnnnnnnnnnnnnnnnnnnnnnnnnnnnnannancanaaaaacactaagaacacccaaaaannnnggtaggaagaaggatctggagaaagacggaaggcagtcagacagagagactgactga

SEQ ID NO: 6354 - DNA, 1404 bp, A.fumigatus
ttagttttggccaagtggcatccgaacgtatccaaattggatcaatacacgccggcgcgatcatggtcggccctcatggaggccagtatgcggcagtccggcctccatacatatgggagtgtccgtgttattgccacactgcctttgttcgaggcgcagacgatccttccacgatcagtgtccaatcgcagccgtccggctttgatcacggaaaatgtcgctttacacgcctttgaagtcgcatcgactcaggatccaagcgtctggactatggccaagggatgggacctagcagctgccaacgcggcacgtgtcgctgaaaggagcgcgcaacacaatgttatagttcctgcaggtcgacaagtcccgccggtacccttggctccagaggcgcctgagccggggcactctccctatccctatgtatctcgcctcaaaaccgatatgcacgacaggatcttgaaaacgatcaagactgcggagaagtctcccagtgatatcgccttgaagaaaaagaaacagagggcactgatccaattgagatacgacaatcggaactcattccttcgcaaagagctggcggacaaacagatcaagatcgacgagctcaatcgatccctggcgcgtaaggctgcagattccaccgccgacttgcaggatctccagccgatcctggaccagataggttccctcaaagccgacatcgccaagctaagttccgaggtccactatgaagtcctccaccacgtcccgaacatgattgacgacgcccgcagcgcgctctccaccggcagcttcgatgatgcagtcctcctttgggaccggcgcctgtttgagcccctccacatccagcccgaggaactctaccccagagaaaccgacatgactatgatctacttcgaggccgacgccaatccccccatcatgcgcctttgcaaccaggtcgacgaggcctccagagccgatctatatcgcatttacgaggccgtctccctcatttttggcagccgcagcgcaatgcccgtctccgagcttctcaatgctctctttcccaaccgacccatcaacgacctcgtccgcgccatccccagcctagcaacgcatgctgccagaacgcccaagccgaactttgacagccttcccaaaaccgtccacggtcggccgggagaagaccccagcaaacaactagaccctgtgttcaatttccaggagaacttagattatgacctgagcgacgtgcggatccgctgtctctcctctatcacgctgtgggagatcatcctggagtatcagaaagagaacgatacggaggtcaacgtggtgcagttgaatcgtctgcttgggggaacgttgacctcgttccgggctggtgaatatggcatggaacctaaaaagcttagatag

SEQ ID NO: 6355 - DNA, 546 bp, A.fumigatus
accaccatgaagaccatcttcaccaacggccgcatattcgcgccctcgtcaaacgatctaaacgcagacaatgcatttgcggaatcaatggtcattgaagacgaccacattgtcaatgtgggtgtacaggacaaggctccctctggagactatacaatcgacttgaatcgccgaattgtcgtgcccggcttcatcgacggccacgtgcacatcctcaactttggtctgtccttgggcaagctcgacttgatggactgtacatgtctagaggacattcaggcggccattagatcatttgcagcaagtcatcctactgcgcctcgtcttctctgccgagcatggattcaatcaacaaccagtggcgttgctctggcaagtatgcttgacgacttggaccctcgaccgattcatatcgaatccctcgatttacactcagtctggttgcattcggcagccttagaagaaatgggtatctcctctacccgcgatccacctggcggaacgatccaccgggatgagaaacggaaaaccatcggggccccttga

SEQ ID NO: 6356 - DNA, 570 bp, A.fumigatus
atgccgttctggccacatccaccggcgaagccaccgtcatcgagaatgccatctgcatccacgaagaagacaacggactgctgtacaagcatactgacttccgagacggcaacgtcatctcagctcgagaccggaaactcatcatctcccagatcattaccgcggcaaactacgagtacgccttctaccacaccttcacgctcgacgggacgtacaagctcgaggtcaagctcactggcatgctcaacacgtactgcctgcacccctccgaacaagccgcccccttcggcaccgagatcgcccgcggcctcgacgcccagaaccaccagcacatcttctccttgcgcgtcgacccggaaatcgacggccccggcaatactgtcgtgcagagcgacgcggtccccatggccgaccccgtcggctcccccgccaacccctacggcaacggcttctacgcaaagaagacccccttgcgcaccgccctccaaggcgcatcggactactgccacgaaacctcccgcggatgggacatcatcaacccctcccgtcttcaccacggggctggaatga

SEQ ID NO: 6357 - DNA, 483 bp, A.fumigatus
cttccgagacggcaacgtcatctcagctcgagaccggaaactcatcatctcccagatcattaccgcggcaaactacgagtacgccttctaccacaccttcacgctcgacgggacgtacaagctcgaggtcaagctcactggcatgctcaacacgtactgcctgcacccctccgaacaagccgcccccttcggcaccgagatcgcccgcggcctcgacgcccagaaccaccagcacatcttctccttgcgcgtcgacccggaaatcgacggccccggcaatactgtcgtgcagagcgacgcggtccccatggccgaccccgtcggctcccccgccaacccctacggcaacggcttctacgcaaagaagacccccttgcgcaccgccctccaaggcgcatcggactactgccacgaaacctcccgcggatgggacatcatcaacccctcccgtcttcaccacggggctggaatgatccgttcaat

SEQ ID NO: 6358 - DNA, 978 bp, A.fumigatus
gtatgcctcaggctttcagaaggagtatgtcatactaatatggcagaccccctgtccgctgatgagattaccaccgctgctacgctccttcgccagcgtgcgcacccaacggcactcaagtttaactgcattacccttcacgagcccctcaaagctgagctgaacgctttcctcagtggaacaggaccccgtcctgcccgtcgtgctttttccatcatcctgaaaacgggcacacccgaggtctccgaggcgattgtcaacctgaccgcaaagaaggttgaatcatggaagaatgtcaaaaatgtaatgcagacgctgaccctggacgacctcaacatcatcgagcacatcgccagcaaggattgcaggatcattgaagcatgccgggagatcggcatcactgacatgtatcgggtatattatgatgcctgggcgatcgggatcgacgagcgctggggctttgagcgccggctgcagcaagcactgccgtattaccgcagctcccaacatgacaatcagtatgcgcatccgcttgattttacagtggtcgccgatacagagacgcaggagatcctcagcgtggacgtcagacgtgtgaatggggaacgtactccagtgcctctggacgagcacaactaccttcctcagtttatcaaagatcagtaccgtccagagcgcctcaaggcgattgaaatcacgcagccggagggtgtttcgttcaagatgaacggcaatgagattgaatgggccggactgaaaatgcatattgggttcaactaccgcgaaggcatcgtgctatccaacgtccggatcgatgacccgtacgagaaccgcgagcggaagctcttccaccgggtcagcgtggtggagatggtggtgccgtatggctgtcctaagccccctcatcacaagaagcacgcctttgacgtgggggaatacggttcggggttcatgaccaactcgctcaaggatggttga

SEQ ID NO: 6359 - DNA, 609 bp, A.fumigatus
gactgcaagggggccatccagtacctagatgccgttctggccacatccaccggcgaagccaccgtcatcgagaatgccatctgcatccacgaagaagacaacggactgctgtacaagcatactgacttccgagacggcaacgtcatctcagctcgagaccggaaactcatcatctcccagatcattaccgcggcaaactacgagtacgccttctaccacaccttcacgctcgacgggacgtacaagctcgaggtcaagctcactggcatgctcaacacgtactgcctgcacccctccgaacaagccgcccccttcggcaccgagatcgcccgcggcctcgacgcccagaaccaccagcacatcttctccttgcgcgtcgacccggaaatcgacggccccggcaatactgtcgtgcagagcgacgcggtccccatggccgaccccgtcggctcccccgccaacccctacggcaacggcttctacgcaaagaagacccccttgcgcaccgccctccaaggcgcatcggactactgccacgaaacctcccgcggatgggacatcatcaacccctcccgtcttcaccacggggctggaatgatccgttcaatt

SEQ ID NO: 6360 - DNA, 375 bp, A.fumigatus
cgccgagcttctgattataccatgctccctcttccaccagcggtaacggccttgtccgcgccgggcaaggtcctcctcactgggggttatctggtcctggaccgcagctacactgggactgtgttcgcccttgacgccagaatccatgtcattgttcagcaattgagacggaaccatcggcgggaagccgcctcgggatccgcgcatggccggtcggacacacctcaggcggaaggcaatgttcatggagacaaggaagacgaaggcacgatcgtcgtacactccccacagttcgtggatgcggtatgggagtatagcatacaaagatgcgaggacggtggaggagtcctagtgaaacagagaaatgatgggtaa

SEQ ID NO: 6361 - DNA, 1155 bp, A.fumigatus
agcaacaatattatagtatcagtaaattgcccaggagctgacccatccaggccacgcaacctgtttgtcgagacctctctgaacttcgccttgacttacatcagctatgtggccgactcgaaggatttcgggtcattatcgattactatcctcgccgacaacgattactactccgagacggccttctccaaggcttcgggactccggtcgtcaagcagattcgtggactttggtgttcgccttcaggaggcacacaagacaggcctgggctcttcagccgccttggtcactgccctggtgtcgtctctcgtcatccaccgtactatgcaacccgacgatctcggtccaggccgcgacaagcttcacaatctggcccaggcggcccactgcgctgcgcagggtaaagtcgggtccggcttcgatgttgcagctgccatttacggctcctgtctctacagacgcttctccccctcgattctcgaatcagtgggtgacgctggttctccaggcttcgaagagcggttgttccggatcgtagaggacgccgacccccagcatccgtgggacaccgaatgtctagacttcggcatgaagctcccccgcggaatgcaaatggtcctctgtgacgtcgaatgtggttcgcagactccatccatggtgagaaaggttttggagtggcggaaacagaatcagaaggaagccgatatgctctggggcgctctgcaatcgaacaacgagagacttcgcctggaactcagacgcttggcacagagcccggacgaacatactctcagtgactttgaaaatgtccgcacctatattcagcgctcgcgtaaccacatccgttccatgactcaaaagtcggatgtcccaatcgagccgcgcgtccaaaccgagctacttgacgctctgtccgagctggagggtgtcatcggtggtgtggttccaggagcagggggctacgacgccattgtgctcctcatccaagacaatccggatgtgatcaccagattgaaagccttctttgagacttgggagagcaaagcggaggacgatttcggtggcaagattgggaaagtcaggcttcttggcgtccgccatggatcagagggagtcaagaacgagatgctcgagcaatatgcgggctgggtgtag

SEQ ID NO: 6362 - DNA, 195 bp, A.fumigatus
acaccaccgtcggatccttccagccccgtggtgaagaccgcgaaggagctgccgcggcttacggacgaggagatcgaggccaaggcggcggagtatggaatcctggacgacaatgagaagactgaggagagagttatggagggggatccggccgcgacggcggagttctcgtctttccagcctactcagctataa

SEQ ID NO: 6363 - DNA, 327 bp, A.fumigatus
aaatctggctggtatcgccgttgcccgtgtcaacgagcggctcaaaccccggaagtcatggagaaaaacacccgtgtcgatcttctgtctcgcctgatggaaggcaaggacagcaatggcaacaagctcggccgcgaggaactcactgccgaggccttgacccagctcatcgctggttcggacaccacctccaacaccacctgcgccatcctctactggtgcatgtcaactcccggcgtcatccccaagctccagaaggttctcgacgaggctattcccgacgacgtcgatgttcccacacacgccatggtcaaagatattccatag

SEQ ID NO: 6364 - DNA, 612 bp, A.fumigatus
tatcttttgaatgtctacttactaccctacagcgatttctatgatgcctttgtctcgattcgccgcggtcttttcaatactcgcgaccgtgcagaacatacccgcaagcgcaagactgtctctcatacattcagtatgaagtccatcggccagttcgagcagtacatccaccaaaacgttgagctgttcgtccagcaatggaccaagctcgccaagctcaatggtaatccccggtccggatatgccaccatcgacgctctcaactggtttaattatctggcttttgacatcatcggcgaccttgcctttggtgccccctttggaatgctcgagaagggcaaggatatagctgagatgcgaaagactcctgactcggaacccacctacgtccaggctgtggaggtcctcaaccgccgtggtgaggtctctgctactctcggctgtctcccgaggcttatcccctatgccaagtatctccccgaccgcttcttcaaggatggcgttcaagccgttgaaaatctggctggtatcgccgttgcccgtgtcaacgagcggctcaaaccccggaagtcatggagaaaaacacccgtgtcgatcttctgtctcgcctga

SEQ ID NO: 6365 - DNA, 765 bp, A.fumigatus
cccagctcatcgctggttcggacaccacctccaacaccacctgcgccatcctctactggtgcatgtcaactcccggcgtcatccccaagctccagaaggttctcgacgaggctattcccgacgacgtcgatgttcccacacacgccatggtcaaagatattccatagtatgtccctatgtcctgttcgctcctcccccttttcgccacttgctaacaacccttacagcctgcagtgggtcatctgggaaactatgcgcatccacagcacctccgccatgggtcttccgcgcgagataccccccggcaaccccccagtcaccatctccggtcacaccttttaccccggcgacgtggtctccgtccccagctacaccatccaccgctccaaggaaatctggggccccgacgccgaaaaatttgtccccgaacgatgggaccccgcccgccttaccgcgcgccaaaaggccgctttcattcccttctccactggtccgcgcgcctgcgtcggccgcaatgtcgctgagatggaactactcgtcatgactggcacgatcttccggctcttcgagtttgagatgcagcaggatggacccatggagacgcgtgagggcttcctgcgcaagccccttgggttgattgttgggatgaagcggagggctgtgcatgctttctgtttgaacacctaccaggtaccaatatgttgggttggtggaattcaaggatttgactttggaggaattatacgctgtggaggccctgattaa

SEQ ID NO: 6366 - DNA, 870 bp, A.fumigatus
ctgagatgcgaaagactcctgactcggaacccacctacgtccaggctgtggaggtcctcaaccgccgtggtgaggtctctgctactctcggctgtctcccgaggcttatcccctatgccaagtatctccccgaccgcttcttcaaggatggcgttcaagccgttgaaaatctggctggtatcgccgttgcccgtgtcaacgagcggctcaaaccccggaagtcatggagaaaaacacccgtgtcgatcttctgtctcgcctgatggaaggcaaggacagcaatggcaacaagctcggccgcgaggaactcactgccgaggccttgacccagctcatcgctggttcggacaccacctccaacaccacctgcgccatcctctactggtgcatgtcaactcccggcgtcatccccaagctccagaaggttctcgacgaggctattcccgacgacgtcgatgttcccacacacgccatggtcaaagatattccatagtatgtccctatgtcctgttcgctcctcccccttttcgccacttgctaacaacccttacagcctgcagtgggtcatctgggaaactatgcgcatccacagcacctccgccatgggtcttccgcgcgagataccccccggcaaccccccagtcaccatctccggtcacaccttttaccccggcgacgtggtctccgtccccagctacaccatccaccgctccaaggaaatctggggccccgacgccgaaaaatttgtccccgaacgatgggaccccgcccgccttaccgcgcgccaaaaggccgctttcattcccttctccactggtccgcgcgcctgcgtcggccgcaatgtcgctgagatggaactactcgtcatga

SEQ ID NO: 6367 - DNA, 279 bp, A.fumigatus
gtaaaccaggacggcgttggacctctcacagcggacattgatccgtccagcggaggaaccaatgcgaaggcatttgtgtcggccaaagtgattcagaacatccccggtgtggcagggttctcaacatccagcactatggactacgaggtcaaggtccaggtgcctaatgggatgaaatgcactggaacagtcggtgctgccaagaatgtgtgcattctgcgggttcggaatacggctatctccgggccatttggcggttctgctgcatttacgatgtga

SEQ ID NO: 6368 - DNA, 342 bp, A.fumigatus
tgcagcgcgtgtccttccagccccgtcggtgtaagactggcaatcatccgaggacagaaaatgggaggtatcaaggcctcgcctctgggccgtactatgggcgctggtccggtatatgcggccacagtcattaacaagtttatgggcgctgcgacagacaaaaggggtcgcgcttccccctcggaaaggcgtatgagattgccttcgcattgcagcatcaactgggctaatatgttctcatgccgacaactcatcaacgatgctgcaagtgtcattactaacgccggtggaactattctcaatggtatggattcactgggtggacccagacgagcagactaa

SEQ ID NO: 6369 - DNA, 1197 bp, A.fumigatus
ttatgcaaagacccccattatcaaaagatctattccctttctcgcagaaatcctggaggcggaaacgcaaaaatccaacatgcaaccctcgacctccggggctcagccgaggacatggccaggaacctcaaagacatctcagccgagtatgtctttttctgcgcgtacctggcacatgatgatccagcggaattgtcccgcgtgaatgggttgatgctgtcaaactttatccaagcattggaaatcaccggtgctatcagaacagtgaagcgctttgttctgacctgcggcctcaaacaatacggcgtccacctgggtaattgtaagcagccgctcattgaggatgaccctctgctggaaggcaaccagggtggcaccacctggcccccaaacttctattatgaacagcagcgaatcctcaaagaggccgccgcacgaggcaagtgggaatggatcgtcacactcccgcaggatgtgctaggctacgcccgaggtaacttcatgaacgaagccaccgcactgggtctctactgcgctgtcagcaaggccctcccgggctccgagctacccttccccggttgcaaagccaactactttgccttcaactgctggacgtcggcaaacctgcacgccaagttctgcctctgggcggcgactgcccccaacgccggcaacaatatcttcaacgtgatggacggcgatacggagtccttccagaatctgtggccgcgactggctgcgcggttcggctgtaagattccaaacccgatgtttcctcatggagggaccccggacacacaggggtttcgtgaatatgaggcaacgactgtgcggatgccaaatcggcacccgctggctgtacacgcggacagaattggcgtttcggccgatgatacgcccaccttgtttctgcaggtcgatccggagaaatgggcgaagcgcaaggatgtaaacgaggcctgggctaaactgcgtgataaatacaatctcgaccaatgcggatgggacacggccacgtgggatttcctcacttttgccctgggaagggactggagctgtgttgccactatgagcaaggcacggcggctgggttggaatggttatgctgatacttgggaagagctggaggataccttcagggttctggaaacggagggtattttgcctccagtggacaagctcagaggagacttttag

SEQ ID NO: 6370 - DNA, 1095 bp, A.fumigatus
tattcaaggcggcagattccggcagaatttctgtatattttcttatcaatcgatagaaatctagatatccatgcacaacatagcaacggaggaggaagattcaagtatttgagtggctggcaacaagacaggcgaaagatggacttctcctccaaagtcctccccgtagccgccctcggggtggtccttgtggtcctcactccaagagtcatcaaatgggcaagcacctacaaatccagtctactccaagccctcaggctccaaaaagagaccagcagcgagatcgtctcgctacgcatctaccccatcaagtcctgccgcgggattgaactccccagaaccactctccgcctgcatggcctagacctcgaccggcagtggatgttcgtagacgcaaaaacccacgagttcctcaccatccgccaactcacccaaatgacactcatcaacaccgccctcagcgacgacggcacctccctcctgctgagcatcaccggatccgacgagaaggttcagatccccgcccgcccagacgccgcctggctagcggcccacaccaccctcgcccaggtcaaggtctgggacacgctgaccgacgggtacctctacggcgacgccgtcaatgccccgttcaccaggttcctgcagcgcgatgtctgtctggtctacaagggccccacgccgcgcatcctgcagggtaacggagacccgcgcctcctgggacggcagcagagcacaaacttccccgacgtgcatcccgtgcagattgcctccgaggcgtccctggcggagctgaaccagaggttgcggcgcaagggcgcgcagccgattaccgttgagcggttccggccgaatatcatcgtccgggggacggtgccttgggcggaagactcgtggaaaacggtccgaattgggtccgagctggacttggatgttgtggcgcgctgtgcgcggtgccaggtgccgaatgttgatccggagacggcggagaaacataagcgggagccgtgggatacactgatgacgtaccgccgggtggatgaagggatcaagtataagcccttgctttgggatgctgaatgcgccccggaatga

SEQ ID NO: 6371 - DNA, 429 bp, A.fumigatus
  unsure (254): Identity of nucleotide sequences at the above locations are unknown.
atctccagcaggtcgaggacgcggttcttgaagttgaccatgttctccttggcgtccttcttgtctttcttctggcccagggcgtcccggcgcgcgcggaacactttgactagctgctcgtcgatctgctccatctcgtcgtcgttcatgtctgcgtcggagccctcggactgttcgttgaagtcttggtcggcgcggtgcgtgcccagtgcttcggcgagcttggcttcgaaggcgggcatttcttcttcgtnttcgccttcgtcggatgcggcttcgtcgtcgtcgttgtcatcgtcgtcgtcatcgtcctcttcgtcctcgtccgagttctctgcgtcgatgacttccacgtcgctgtcgtcttcgtcgacgtccatcatctcttcgtcctcttcgtcatcctgctgctcgaataattcctgctga

SEQ ID NO: 6372 - DNA, 372 bp, A.fumigatus
actccccagaaccactctccgcctgcatggcctagacctcgaccggcagtggatgttcgtagacgcaaaaacccacgagttcctcaccatccgccaactcacccaaatgacactcatcaacaccgccctcagcgacgacggcacctccctcctgctgagcatcaccggatccgacgagaaggttcagatccccgcccgcccagacgccgcctggctagcggcccacaccaccctcgcccaggtcaaggtctgggacacgctgaccgacgggtacctctacggcgacgccgtcaatgccccgttcaccaggttcctgcagcgcgatgtctgtctggtctacaagggccccacgccgcgcatcctgcagggtaa

SEQ ID NO: 6373 - DNA, 462 bp, A.fumigatus
  unsure (38): Identity of nucleotide sequences at the above locations are unknown.
caacgacgacgacgaagccgcatccgacgaaggcgaanacgaagaagaaatgcccgccttcgaagccaagctcgccgaagcactgggcacgcaccgcgccgaccaagacttcaacgaacagtccgagggctccgacgcagacatgaacgacgacgagatggagcagatcgacgagcagctagtcaaagtgttccgcgcgcgccgggacgccctgggccagaagaaagacaagaaggacgccaaggagaacatggtcaacttcaagaaccgcgtcctcgacctgctggagatctacgtcaagaaatgccactcgaaggttctggccctcgacctccttctccccctgctgcgtctcacccgcaagtcgaccgtcaagcagctagccaacaaggcgagcggcgtgctccgcgagtataccaagttgtgcaagggcaatgcacttccttcgctggactcggctga

SEQ ID NO: 6374 - DNA, 1014 bp, A.fumigatus
  unsure (49),(50),(60),(67),(325): Identity of nucleotide sequences at the above locations are unknown.
gggagccaggtattggcggttttggtaaccaggttcacgaagaatgggnngggattcccntgggttngggaagtgcactcccttcgtgagattagttttcatggtaaccaacatattcgattttggaggccagggaaagcctttgttggtcagcaggaattattcgagcagcaggatgacgaagaggacgaagagatgatggacgtcgacgaagacgacagcgacgtggaagtcatcgacgcagagaactcggacgaggacgaagaggacgatgacgacgacgatgacaacgacgacgacgaagccgcatccgacgaaggcgaanacgaagaagaaatgcccgccttcgaagccaagctcgccgaagcactgggcacgcaccgcgccgaccaagacttcaacgaacagtccgagggctccgacgcagacatgaacgacgacgagatggagcagatcgacgagcagctagtcaaagtgttccgcgcgcgccgggacgccctgggccagaagaaagacaagaaggacgccaaggagaacatggtcaacttcaagaaccgcgtcctcgacctgctggagatctacgtcaagaaatgccactcgaaggttctggccctcgacctccttctccccctgctgcgtctcacccgcaagtcgaccgtcaagcagctagccaacaaggcgagcggcgtgctccgcgagtataccaagttgtgcaagggcaatgcacttccttcgctggactcggctgagccggtgtgggagctgttgaagtccatccacgccgaggcgatgcatagtggcccgccggcgcatgcgtcggcctgcagccaggcgagtctgctggtggtcaaggtgctggtggcgcatgacaagaacgcccttgcggatgtggtgggtgtgtatgcggctacacgcaaggagcagcttctcagcaagaaatgtcatgtccagccgcagttcttctcggactggaacaactggtgtgtctctgccagcaagcagatgaagaattag

SEQ ID NO: 6375 - DNA, 252 bp, A.fumigatus
acacgatggggtgtcggattcggtccacgagactgtagtgactatcagacaggcatcagtgtcataccaatcgagcgacttacggaagcagatcgtaagtggatgctcaccgctgaatatggtggaacaggagggcgacctattgagtctggcatggtggttgaggaacctgacattgaaatcggtgctggtgtttcttcgaagggtaagaggatttctttcttggtccttcgtatcaacgagatgaagtaa

SEQ ID NO: 6376 - DNA, 192 bp, A.fumigatus
aaacctcaggtcaacgatattggcaagagcgacgatatgctgcgtattctcaagaatctgagtgttctctcttccgagcttcctaatgctcttgagaagatcgtggatgctaaggatgctgaggagattgatggtggagagaagtgggttcagggattgtttgctgatgctatcaaggcctactctcagtga

SEQ ID NO: 6377 - DNA, 534 bp, A.fumigatus
atactcccttttcacctcacctctctctgtcctcgccctttatcctccacttgcattctcctcactgccacgctcttaagccaattgcatccttcgcttcccaaacaacacacctggtctacaacaacaaccaagatggttgctatcaagagtctcttcagcgccctcgtggccaccgccctcatcagcagcaccagtgcccttccagtccccaacactgtcaacgacgttgtgcatagtctcgacgacaccgcaaacaagtacaccgacctggacaatgcaatcaaggccttcgatggacaccctgctgggtacaccaccatcaccgagagggaggctaccgttgaagtgtctcttcatcgcgccatcgacgccgctcatgccaccgcttctctttccgtcgaagacagcaagtttgtgatgcaggctcttgcgaagccttaccccactttcatgggtaatctgcttgctgacatcgtttccaaggtgagtcacctctttgcgttagataatatgcatagcgggagagactaa

SEQ ID NO: 6378 - DNA, 939 bp, A.fumigatus
gaagacaacaatcgctgcgggatgacgccggagcatacaacgctgtcgactggtgatccgcggatgtggacgtggaacatccggcaggtgggggtgctggacttgaccgcgcttgtttcgcgggtcctgtttgagaccgggtttgagaagctggggcttgtgtgccactcgcaaggtaccgcgcagacatttgtggcgctgtccaagcaccaccgcccggaacttggcgagaagatatctgtattctgtgccctcgcaccggccgtgtatgccgggccgttgatcgagagggtgtactttcggttcatgcgagttataccgcctgacatattccggacgattttcggcatccacgcattcatccccatcatgataaccgtccaccgctttctccatccccgcatctacggggcgttggggtatcatgtcttcgcgcacctgttcggctggagcgacgtccgctgggatcgcggactccgcgatcgcatgttccaattcgcgccagtgtatatcagcagcgagacgatccggtggtggctgggtcagggctgcttcgcgacgcagcggtgcatcctggccacgatggaagagaccctcgccgagatggaggaggatgtccgtctgcagcgcgacggagaccaaccgggctcgcgcactgacaccgcctggtacgggccgcagacgcccccgtttgcgctgtgggttgcggggtcagatgcgctggtcgacggccggcctctcctccagcggttgcacagcggacgcgagccgcatgtgcaggtggtgcattccaaagtgattgaagagtatgagcatctagatgtgctgtgggccatggatgcggtggagcaagtgggtcaagaggtccgcgatgttatatacaggaccatgccggaggcggcgcggaagtgctgccgggttccaaagggtgtttcatga

SEQ ID NO: 6379 - DNA, 420 bp, A.fumigatus
gtgttaccgcatctggctgccggtacctgtcctatttcactaatataccattgcgcctttattctcacagcctccgaaaagtgccagcaagagaaacgcaagacggtaaatggggaggatatcctgttcgctatgacttcacttggcttcgaaaatgacgcggaagcgctcaagatctacttgtcaaagtatcgcgaggtaagactttgtacaacatgctatggctgcctgtctccccaccaacggttggtggtttggtgggtgtattatcatatgctaagtactcctccagactcagtccgcccgtggcgaacaccagaatatgccaacgagcagcggctacaattctggagggcccatgggcggatccaacacgcaaggtggacgacctggtgcatcggcttccggcggctttcctga

SEQ ID NO: 6380 - DNA, 189 bp, A.fumigatus
acagctacatgtgctaacatctaccgtcaagtggcccgtatcatgaagttggccttgccagagaacgcgaagatcgccaaagaagctaaggagtgcatgcaagagtgtgtcaacgagttcatctcgtttatcaccagtgagggtgagtgttaccgcatctggctgccggtacctgtcctatttcactaa

SEQ ID NO: 6381 - DNA, 267 bp, A.fumigatus
gtactcctccagactcagtccgcccgtggcgaacaccagaatatgccaacgagcagcggctacaattctggagggcccatgggcggatccaacacgcaaggtggacgacctggtgcatcggcttccggcggctttcctgaaacaacagatagcacaaacaatatcataaaccccggtctggacccctccgaacaggacagttcaacctatggctaccctccgatggtcggccagcctcataatggagcaggaggcgactcgtactga

SEQ ID NO: 6382 - DNA, 567 bp, A.fumigatus
agatcctcctgtgatatctcccacccgactcaaccgttcaatcatcctctcaggatgaaggacaagatcgtcgagcctacggtcgccgtcagcgacaattctctggcggacgagacggcacccgatgaggtcttgaagcatctcaagcatatcaaggagcagcatcagtgggaccccaatctccccgacgatgtggccgaggagctcgatgtggccttgcacacggatgacaagggcgctcgtgttggcgttgcccacgaacttatggaagattcaccttacgtcgaggttcgctccgcggttccaaactacgacgagggtggacacacaaacacaatccgcgcctggactattggtctggtgttcgcgacccttggttcagctctcaacatgctgttttccatgcgccagccgtacatcgtcatcccctcgtacgtgattcaggtcatcgcctacccggttggagtggcttggtacaaggtaatgcccaacaagcagttcaaattctttggcatcgattgcaacctcaaccctggaccgttcagcaagaaggagcatgctcttatc

SEQ ID NO: 6383 - DNA, 198 bp, A.fumigatus
ccccctgcatctgcttcgcgtccgaccttcctcccccttctcttcctcttctcatccttcgctgatcatctaatcgctcccctgtcgatcgtgtatgggaccaacctgaggtggatccttctcacgacggcgctgctccactattcactgcttcttctatccttttacagaccttctccattgaagatcctcctgtga

SEQ ID NO: 6384 - DNA, 228 bp, A.fumigatus
agctggctgaacctgaggcgcaaaatggcttcaatcctgtgtagggcagtagctgctcttcttctacttctccaattcagcaccgtctggtcacttcccctagatatctccctcgccggcgatgcgggttcaggtcgtaaatctcactgggtggatatatggacgaccatgccgcagcttgtcgagccctacaatctgcctcccgccccatacgtgagtcgatcatga

SEQ ID NO: 6385 - DNA, 186 bp, A.fumigatus
  unsure (160): Identity of nucleotide sequences at the above locations are unknown.
tcgacatctacctcgctcaaggccaacaaagcaacgccatcaacgggacatccgggaagcaaaacgacctcctggctgtcctttgggaactacgtcggggcgaacaatcttaacgatccgtcggtgaagaacgtgaattcctggtggggatccacctggnaagtttactaccgaaccagcttatgc

SEQ ID NO: 6386 - DNA, 519 bp, A.fumigatus
gcacatataaccgcacatcaggaaccttctgtccctgatgtcttctgccagattccatcaaagagctacacaatggctgccatcttccaatcccagaaatctgccctcatcaccggcgcagcatccggcatcggcttcgccatcgccagagtctgccgcaccaaaggcatgcacctggcgctcctcgatgtcgacactgccaatctggaaaatgccagaaatgagctgtctgctctcgacccctccttgaaaacagagatctacactatcgacgtcggcaaccgggacgcctggaaggacatcgcaaagcagatccgctcgacattccacgacctcgatcttattgtcctcaatgccggaaaatcatacaaagcgcagagtggcctggcaggacgactaaagccatgggccgatgccgagtactggaggaaggtgatttatttgatccgctcatgcccggctatagctgacgagctagacattcgacaccaacgtcttcggcccgctgaacgggcttga

SEQ ID NO: 6387 - DNA, 837 bp, A.fumigatus
cgggatccttccagccccgtggtgaacacggaagcgatcagactgagcttggctagcgaggaagagaggcgcaacaaggccgagaaagaggccaggaaagaagcaaagcggcgagagaaggaaaacaaaaaggcagagaaggctgcacgcaagcatgggttctacagcaacaatgctagcagttccgctttggacgttccttcggatgcccgacttggaagggtcgcgagcacctcctcctcgataactggcgaggatgcatctccaagcaagggtaaggaagtggatcgcacatcgccagctgctactgctgcttcctcgcagtcaagtactgaaatcgcctctgaatctatgaccatcaacccgcatccaaacgtggtagaactgggatcaagcgcgcaatcttcgatggctcagctctcgccacgggagctgccaaaaccatcgcatctgcgtcaggtgtccagtgcatcctcatcattctcatcacttgttgagtcaacgggagaagatcacagtggggcttacgatggcaatgcttcgtccaccgagccactattcaacttccgcagcttagctgctgttatcggagatgaagacaaaggcgatggaactgcagagcatgtggaagatacatcattaaaaccgagcgccgaggggtcagcttccagcacggcgcctgtggccgatgagatgcctggccaatccactacacctgctgacccgatagctgtgaaaaccgtcgcagaggaccgggactgcttgatgcccaaggaactcgagactcagtcggtagaaatcaccagtgccacgcggaatgccgaggcaacaacttga

SEQ ID NO: 6388 - DNA, 687 bp, A.fumigatus
accgccctttcgcatcaccctcgggtgaagaccaccgagttcaagaaattgaagcctgcctacaaggccgttatcaaggatatcacggagaagatgggcaatggcatggctgattattgtcgcaaagctgcgctggacgatgcaagcgtcaagacggttgaggaatacgacctgtattgctggtatgttgctggcctggtcggagaagggtcaactcgcctctttgttgaggccgagttcggtaaccctgccttgctcaagcgtaccgagttgtacaagtccatgggtcttttcttgcagaagaccaacatcattcgcgatgtccgtgaggactttgacgacggtcgtcagttttggcccaaagaaatttggtccaagcacgtcaccaactttgaggatctcttcaagccggagaatcgtgaggctgcactgaactgtagctcagagatggttctgaatgcattgagacatgcggaggagtgtctcttttaccttgctggtctgcgtgaacagagcgtcttcaacttctgcgccatccctcagtccatggccattgctaccctttccctttgcttccgcaacccggcaattttcgaacgtaacatcaagatcaagaaggggcgaggcgtgccagttgatgatggagtcgacacagaatctgcgaattctttacgaggccttccgtag

SEQ ID NO: 6389 - DNA, 486 bp, A.fumigatus
gacatgcggaggagtgtctcttttaccttgctggtctgcgtgaacagagcgtcttcaacttctgcgccatccctcagtccatggccattgctaccctttccctttgcttccgcaacccggcaattttcgaacgtaacatcaagatcaagaaggggcgaggcgtgccagttgatgatggagtcgacacagaatctgcgaattctttacgaggccttccgtagatatgctcgtgagattcacaagaagaataccccaaaggatcccaattttctcgagattggcattgcttgtgcgaaggttggtatccttcattcgtcttcatttgtcccaagtattaacagtcgcagatcgaaaaatttatcgagaccatcttcccatcgcaatcagccgaagaggccaacaggcgtgtcttgggccaaaagtccgaagccgaacaagagaaggccagactggaggctgaaacccgcaaagacgtcctctttatga

SEQ ID NO: 6390 - DNA, 435 bp, A.fumigatus
  unsure (101): Identity of nucleotide sequences at the above locations are unknown.
tggaaccgatacgcaaaattctccaggtacaccacttgggttttttacgggcttttgaaaactgacgattttcagattcgccacgaaggtaaaggtgtggnagttcaagatatggacccccttcccaactggaatcgaggacgcgcaatcgttatcggggatgcggcccatgcgatgaccccattgcaaggtcaaggggcgaacatggcagtcgaagatgctgacagtctccgcttgttgcgtccaggtctttcccatgcggaaatcgaagcggtgcttaagcaagtggacaatgttcgccggccacgtgcttcaaaggtcctggaggacacccgtgtcatggcaaaagatattagcatggagcaacgactggccaacttagactttacctgtggttacaatggagtattcgaagctctaaaggagattcagtga

SEQ ID NO: 6391 - DNA, 555 bp, A.fumigatus
tctatccccgacctgacgaaacgaacggatctctgcctttgctcggcaaccgcatcaatggctgggccgactgaacccatcagaaaacgccgacgcccagccttgtcctgtgtagagtgtcggcgacgcaaggtcaaatgcgatcgaaacagcccttgtgggcaatgcagggcgcataagtcgaccgcttgcacatatgcggtggcctgggccacaggtcccgttagacatgaatcacaacggacccaggaaccgttgctgcccgaaccggccgaccaaggcgcaagcgaaccgcaacagcctgcctccagttcacccaatccaacaattggcgagagcactgggccaggaatatctcttgtactaggggggcctgtgcgatgcactcccccagacctggacagcacccacactcttccgcagaaagtgagcgtcagctcgtccaccatccaagctcctcctggcccattccacggcatcttgtccaaaacgagggtctttggccatggccattggatgagctctgtacctctggtacgccgcccagctacgtag

SEQ ID NO: 6392 - DNA, 312 bp, A.fumigatus
  unsure (212): Identity of nucleotide sequences at the above locations are unknown.
agcacgtggccggcgaacattgtccacttgcttaagcaccgcttcgatttccgcatgggaaagacctggacgcaacaagcggagactgtcagcatcttcgactgccatgttcgccccttgaccttgcaatggggtcatcgcatgggccgcatccccgataacgattgcgcgtcctcgattccagttgggaagggggtccatatcttgaactnccacacctttaccttcgtggcgaatctgaaaatcgtcagttttcaaaagcccgtaaaaaacccaagtggtgtacctggagaattttgcgtatcggttcca

SEQ ID NO: 6393 - DNA, 321 bp, A.fumigatus
agtcgttttgttcttttcacttccggaattacactctttgagacggcaatggctgccccccgacttttccgcccagcagctcgcctgctttcatctcgactttccgctacacccttccgctctactttccagaagtccgcctgtgcgccctcgatcctacgcgctcggggatatgcgacggaaagcggtactaaggaagttactgtccgagacgcattgaatgaagcccttgcggaggagcttgagagcaacccaaagacgtttatcctgggtgaagaggttgcgcagtacaatggagcgtatggcattaccttctcttag

SEQ ID NO: 6394 - DNA, 429 bp, A.fumigatus
catttggttaggcttctgtatggtcaagcattccccatgagcgaggctgctcagaaggatgacttcgttcttccccttggaaaggccaagatcgagcgtcctggaaaggatctgaccattgtttctctgtcccgctgcgttggacagtctctcaacgctgctactgagctgaagcagaaatatggagtcgaagctgaagttattaatcttcggtccgtcaagccactcgatgttgagacgatcattcagtcgctcaagaagaccggtcgcctgatgtgcgtcgaatccggctttcccatgttcggtgtcgggtcaaaaatcctcgccttgcccatggagtatgggtttgactattctcactgctcttgctgtttggtgttaccggcgctaaggttcatacaccttacgctgttggtcttgagcagatga

SEQ ID NO: 6395 - DNA, 219 bp, A.fumigatus
gcactcggtaggtttgcgaggatcataataatttgcctctgtatcgttgtttgcatactcctcgtcagtatcgctctctgcattgccgtgttgagcgtccgtatcctgtctgggtttgttcctaacgagttcgctcggttcacccgctcctaccgcttggttggcgtcgtcgtcatcgtgtcttcaccacggggctggcaatggccgctccagccccat

SEQ ID NO: 6396 - DNA, 477 bp, A.fumigatus
tactcccatcacagaggcgggcttttgtggtttggctgttggcgccgccctcgctggactgcaccctatcgtgagtcgaatgtttacctattcttgaaaagacttgaacggctgatgggtgcttcacatctacagtgcgagtttatgaccttcaacttcgctatgcaggccatcgatcagattataaactccgccgccaagacacattacatgtctggaggaattcagccttgcaacattactttccgtggacccaacggatttgctgctggtgtcgccgctcagcactcccaagattactcggcctggtacggcagcattcctggcttgaaggtcgtggctccttggagtgctgaggacgccaagggtctgatgaaggccgctatccgcgaccccaaccctgtcgttgtcctcgaaaacgagtatgtactgccagaaccgcttgacgttgccgggcttgagctgacatttggttag

SEQ ID NO: 6397 - DNA, 312 bp, A.fumigatus
atagctatctattactactcgtttggacgggaaaacgagctacagctcactggttccttccaaagtcatttgatggtgtggaacattgctctgaccaggatgaagtaccttgcttactgggctcttctctattcatcttcacccggcctagctattcagccgtcagctccagatgctataccggcgcccattcgcgatctccaatggggtcagctgaatttcctccacactacagacacccacggctggctggctggtcatctacaggagtatggctttgccatctattgtgccattgttgatgctcgctga

SEQ ID NO: 6398 - DNA, 636 bp, A.fumigatus
tgcagatcgaaaagggcttcctatggagcagactggggagattatatctctttcaccacccgcatgcgggaaaaggcactcgctcagggcaatgatctgctgataattgacactggtgacagggttgaagggaacggtctttacgacgcttcggaacccaagggcgcctacatttccgacattctgcgtcaacagcagattgatttgatgtcagccggcaatcatgaactgtacaagcagaacacctcggagactgagtttttgactactgtgcccaattttcgtgatagctacctggcgtccaacattgacatcgtccatccaatttccggagagctcgtgccgttggctccacggtttaaaaagttcacaactgagaaacaaggcatccgcatcgtcgcttttggttttctgtttgatttctccaaaaattacaacaacacaatcgtttatacagtggaggatacaattaaaacgacttggttccaagaagccattcgtgacgaagaagtcgatcttttcctggtgatcggccatgttccagttcgctcgaaggaatacaatgctgttttcgaagagatcagaaacggtcttcaccacggggctggaaggatccacgggtggtgctatcaagaa

SEQ ID NO: 6399 - DNA, 183 bp, A.fumigatus
ctgccaatctcatctgtgtctttgacattgatgtccaggaagtatcctctatggcatcatggagtgcatgagaacatgatctccgtccagccacccactagcccttgggctcggtggatcggttcggagcacaagcatggccaaggaacccccagcgagatgcagcatggaaccagccaatga

SEQ ID NO: 6400 - DNA, 1428 bp, A.fumigatus
tggagcaacagctttgaagctcggacggcgatgaggctggcaattgaacaagcaggatccgtattcactggctggattgcgtcctgcttgtcctgtctgcgccctgaaggtgatgttcagagctcacattaccagagggcaacgaagtcgaacggtatgtattcctttcctgaccgtatataccaccaacagacgctaatgtcttgcaatccaggcgtcgaacgagagatgaggatatgtcacactcaacctcatctcgtgcctccaatgaagctggtggtctatgataaccttccgagccccggtcctccacctcggacctcatcctttccaccgtggataacggagggcagaagtatcgcctcccgagcatccaacagggccagcatgtcgttcaagcgacagtccaccaccccattgaggatcagtgcgccgaccgacttcaggagagttgagacgttccaatcctttgcctccagcccagcagaatttcaacctctcgtgttgaagatccacacaccgggcaaccgtctttcggatctgccaacatttgacgaatttacttcacaggagggccgacgacgatctctttcctggcctgcaaaagcagttgtctctcccactgacccctcgcgtattccccgcgttcgatcccatcatcactcttcgtcatctttccaattagcccgcaaacccgtaggatcaggctcccgtcgatcttccctttcgaacttggagcagcttctggacaagcaatctcccatcgcaagccctggaatgcctcacttctcagcccgtacctcaaccgccaccggcctcagcgaggccatgttcttaccaacacactccaggctgcaggaaccctcggctggctatgggtcaatgccccaacgccaacgcatcgatatcaccccgcccatcgcggtgccccccaagacacctcccaaaactcccctgcaggacaggccgctaccacctcttcctaccggtaactccccatcgtcaacggaaacgcccacatccaatccctcatccacccccctctccgagaacgacgtccaaacccaaaccccaaacaccaccccgtcccgctccggccgcgtcgcgcagtggctcctccaaacaagcagcaaagcctctccccctgtctcctggaaactccaggccggccggagcagaggcggcagcgcgagcgcaaacgccttccgcatccgctcacgcaccctcagcggctcaacggccgtctcgtccgcaccgagcacaaccaccaccacaagcttaggtcccaggacgcccacatcgcgaggcacgcgagacctcaatctaaatcaactatctgaaaaggatctcgaggcctttccttcccggggtcttcaccacggggctggaaggagcgctgcgttgggaagtggagcgcaatgggacccg

SEQ ID NO: 6401 - DNA, 582 bp, A.fumigatus
gatcaggctcccgtcgatcttccctttcgaacttggagcagcttctggacaagcaatctcccatcgcaagccctggaatgcctcacttctcagcccgtacctcaaccgccaccggcctcagcgaggccatgttcttaccaacacactccaggctgcaggaaccctcggctggctatgggtcaatgccccaacgccaacgcatcgatatcaccccgcccatcgcggtgccccccaagacacctcccaaaactcccctgcaggacaggccgctaccacctcttcctaccggtaactccccatcgtcaacggaaacgcccacatccaatccctcatccacccccctctccgagaacgacgtccaaacccaaaccccaaacaccaccccgtcccgctccggccgcgtcgcgcagtggctcctccaaacaagcagcaaagcctctccccctgtctcctggaaactccaggccggccggagcagaggcggcagcgcgagcgcaaacgccttccgcatccgctcacgcaccctcagcggctcaacggccgtctcgtccgcaccgagcacaaccaccaccacaagcttag

SEQ ID NO: 6402 - DNA, 729 bp, A.fumigatus
aattcgtccttcggcatgggtgtcgaagcagattccaaactacccgatcggtccagcagtgcgcagagcaaggaagatgttgatcctgagaccggcagcatccaggaaggcgaaggactcgaccgtctagggtacaagcaggagctccatcggaaccgctccgttctcactttgctcttccagaccctggccattgctgccattccctacggagagggaagtcctctactcaatgccatctacggcgggggtcctctgtcgatcttcgtcggctggatcatggtctgtgttctcgatgaatgtgtagcgttgtccttggctgagctcgcatctcgctggccgacctctgcaggcccttactattggtcgtttcagatttcaaggagctccaagacggtgctatcgtttatcaacggttggatctggctggtcggcaactggaccatcacgctttccgtcaactttggcttcgcatcgctggtctcggccaccgtctcgatgtaccatccgggctgggccgctacggactggcagctcctgttaatcttttacgccatctgcataggttcgttcttcatctgcacgtttggggaaccgctaccttccccaggtcgacatcgcgtgtgccaccttcaccgcactcaccatcctcatcagtctcattgcattgtccgtcaaggccgacgcaggcagacacagcgcggcctacgctttgggccactacaatga

SEQ ID NO: 6403 - DNA, 321 bp, A.fumigatus
gttcgttcttcatctgcacgtttggggaaccgctaccttccccaggtcgacatcgcgtgtgccaccttcaccgcactcaccatcctcatcagtctcattgcattgtccgtcaaggccgacgcaggcagacacagcgcggcctacgctttgggccactacaatgagaacctctctggctggggcggcttccccttctttatcggacttttacccgccgcctacacgttctctgccatcggcatgggtctcctcaatggcagaaagattgtgccatccccccattcccacttgccccggggccattcaaccttttgcgttccc

SEQ ID NO: 6404 - DNA, 285 bp, A.fumigatus
  unsure (233): Identity of nucleotide sequences at the above locations are unknown.
cctgtggctaacaaaaagaagagtattcttcatctcacggcatttgagaattcagctgcctttcgcgactacatcaacgctaccactgccgagttggatgatccatttgcgcaggatgacgctaccgattttggactccttgcattgagagacaggccggttgccgactggggcccgtcagttgaaaaagtatgcatcaaatcaacctccgattttaccgaaggatgtctaanaattgggtatggaacatttgaacatccaactgctgccctgaacccttaccct

SEQ ID NO: 6405 - DNA, 231 bp, A.fumigatus
ctccagaaagaagacctagattgttccggacttcactggacttcaccagctcatgctttcaccacgcaaaaacatgtttgcttgaccctgaccttcgagaaagactctcacattcacttcgacgctttcgccaacgctcactcactgccccaagacattcccgttatcctaaatctctggattcttccgacgatcctcaacacactgacacttctcaaattgggactctaa

SEQ ID NO: 6406 - DNA, 189 bp, A.fumigatus
ttgatctatacgagtctactcgttctgatccaaatatccgcccgttatgcgacgaacctgatggacccagccgactacgacaaagttctagccaatcctcaagaagtcaaggaccggatcattggtagtaagatcgtcattggtttgtcttcaccacggggctggaaggatccacggggattctacaat

SEQ ID NO: 6407 - DNA, 912 bp, A.fumigatus
agaatgcgaaatgtacagtatacgcaccttcctagcggtggactttgtatgattgtctttgctgattttatcctgcattcagatgatggataccggctcacttacggaggtctcgactacctcgcgctgaacgctcatcagaagcagaaatgcatttactccgtgggaaaccagatcggtgttgggaaagagtcagatatcatcgtcgtcgcgaatagcaaaggaacacaatgcatcttaaagatccatcgcctgggccgcatttccttccgaacagtcaagaccaacagagactatctgcgcaatcgcagtacaggttcatggatgtacatgtcgcgattggcagcgatgaaggagttcgcttttatgaaggctcttcgagagaacggtttctcagtacccgaacccatcgcgcagaacagacacacgatcgtcatgagcttgatcgacgcattcccgctaagacagatttcgagagtccccaagcctgcgttactgtattcggagcttatgggtaccatcatggagcttgctcggtttggccttattcacggtgactacaacgagttcaatatcttgatcaaagaagaagaggatcccaatgcgaagggaaaagctcctgctgatgcggacaacgatgagaatatccggctggttccggtcattatcgattttccgcagatggtgtcaatcgaccatccgaacgcagagatgtatttcgaccgtgacgtgaattgcatcaagcgctatttccaacgaaagttccatttcctcagtgatgagccaagcccttttttctcggacgcgaaagaacagctttttgaagaatcctgggaaagcggttggatgtccacgtataaagcttttggtttctctaggcaagatggctcgcgagctaaaaaccttacttga

SEQ ID NO: 6408 - DNA, 654 bp, A.fumigatus
actaataattctgcatatacatcaataggttcgtctcttagaggtacttcaactgccatgcctgaactagctgaagtctcgcgcatcgttcactttatcaatcaacatcttgtcgggaagactctcacaaaggtttctgctcagaacgatgatattgtctacgggaaagttggcaccagcgcctctgaatttcaaaaggccatggaagggaaaaaggtcgtcagcgcaggtcaacaaggaaagtatttctggctcatcatgaacgagcctcctcatgcggtgatgcatttcggaatggcaggctggctcaagatccgagacgccgatacatactactaccgcgtcgagaaacccgaagacaaaacatggccaccaaaatactggaagttcctgctggaaacagacggggacccgaaaaccgaggcagctttcgttgactttcgcagattaagtcgtattcgacttgtggattgccctggagaagagatccgcaaacatagcccactcaaagagaatggtccggacccggtggccgataaagacatcgtcacagaagagtggctggcagacaagctcaagagcagaaaggttcccatcaaagcccttctcctagatcaggctaatatcagtgggattggtaattggatggggtag

SEQ ID NO: 6409 - DNA, 522 bp, A.fumigatus
cagccgttcagtgacgagatcttatatcatgccaagatacacccggagcaatatagcaatactctcaacgatgagcagatcaaacagcttcactcctccatccattatatttgtaccacatcggtagatgtactcgctgactccgagaaatttcccgagcattggctgttcaagcatcgatggggaaagggaaagaagaacaagccatcagtcctgccaaatggcgaaaagattgtttttctgactgtcggaggcagaacgagcgcagttgtgccgagtgttcagagaaaaacggggcccgttgctagggatattgacgacgaggataccaatggtcctaagaccgagaccaaacggaagagggtaacggctgttacaaaggaggaggatgtgaatgacgatgagaaggagcccaaatcgaagaaacatggatcacggtccggacaatccgaggatacagtggagatcaaggaggaaccgaagcaggagagaagacgacgatccacgcgccttagaaattga

SEQ ID NO: 6410 - DNA, 1761 bp, A.fumigatus
cgcccaatctggcccatcggggccgggaaaagccctgtccctcttaaactcgactccacgctcaagcgagccgaccttgaaaaaattcgctcctctcgcaaagatcgtgcaaaagaaaagcctgcacgccctgtgcgtgacgacaagatgcaggtcggaacttatcccagttccagccattacgctgctgctccagttcagcggtcaccttccagaccccgacaacgagacagtgtttatgtgcgtcacgtcccaggtacctgccgggattgcgatcaaggattgtatcacgcctcaacgccaatagaaccgagacgaatggaacatccatactatgtctcgcaaccaccgccctcagtttacgactatcctccgccgccaccatcaccacaaagccgataccccccgtccatcatccaggacgttcatgtctctcacagcagccgtccctccgcccgttccggccgctctaactcgtatcactcgactgctcgtccgtcgagctttcatggaatgatgccaggtatggggcccatggtgtataccccgtctcctatgagtcgctacgaagccgggcctccgctggcttcacccgtttatgccaatagtccgtcctatgcagcctcgcattatgcccaacagtctccatattatggagcacaagagttcccggctcttcctccaaccgaccaccaccaggaacgatcggtctccaagactagagagaagcagccacgtgcgcggcgcccttctctttatggaccgcccgtcgtggatcatgtgcctcccaccccgccttacgacgagagcgaggatgacgacgatgaagaagacgacgacgatgatagtgaagacgagcaactactcgaaccgccacctcctcccgtccggacccggccacgccttccttctcagtcctctcataatcgcgatgaagattattatcgcatgccgcctccgccaatcaaaaataacaacactcggccgcacgtcattcagaaacgccccgacccaccacgaaagtcagcaacaaccacgtctctcacctcggagcgccgctcatccagaagctttgatctctcggagatggaagacgcgctgccgagctacggataccggcggtcttcacgcgagaccgtggttcccgagcgaagccagagtctgaggggtagcaggcgctctacgtcctatcacgactccgtgcgcccggctcgaattgccatcgagggtgctcgtcgccaacggactactgtctatgactacaattcaggcggcgatatcgaggataagcagcgagaggcagaagaataccaggcgtcaagatcaggtaaaaccgtagcggtgccacttaccgcggatgccctgcgcaaagccaaaacatcgcagcgtgcggaaagtgacagcggaagtcagaagagccgtagcagccgaggtagtgatgctcgcactcaaaatggtagcagcggcgaggccaagccggaggaagacgataacattgtcatgaccatgaatggtgtgactatgagtttcactcagaagtctgtcgggggaaagaggatcagcgtccgcactggcgacacgggagcggttgagctgaacattgagggcaagcgaccgaagaagtatctaaccggcggctccgattataccggcagcgtctcccgaagggaactagaagacgcgcggcgtccccgaggtgaccggcggtctgacaaggccagtcaccgatccagtcgatcgacttacagcgggcgatactag

SEQ ID NO: 6411 - DNA, 303 bp, A.fumigatus
atacttcttcggtcgcttgccctcaatgttcagctcaaccgctcccgtgtcgccagtgcggacgctgatcctctttcccccgacagacttctgagtgaaactcatagtcacaccattcatggtcatgacaatgttatcgtcttcctccggcttggcctcgccgctgctaccattttgagtgcgagcatcactacctcggctgctacggctcttctgacttccgctgtcactttccgcacgctgcgatgttttggctttgcgcagggcatccgcggtaagtggcaccgctacggttttacctga

SEQ ID NO: 6412 - DNA, 231 bp, A.fumigatus
ccccaaggtgagaattaccagcgctaccaacgttgctaccaactaataacgttgcagtgctatctatgcccctgcaatcatcgcgccaatggtgtcaccaaccctcaatatacgggtacttttctcttcgagaatgactatagcactgtccggatggacgagggagaatacgacacagatacgttcaaaaagggtgcgtcaagctggtttcagttatctttacctggctaa

SEQ ID NO: 6413 - DNA, 489 bp, A.fumigatus
atttcgaattgtggactaatagttattcggaagaccatgagtcctcaggaaaattctcgagtggagtatcttcccctttcacgcagagcaactgacgggacagaatttggggcaaaagaaagcttccacatctcctcaactcttgaaaaacttgggtttatacccagaattgtccttgtcataaccttcttatcgcttacggcttggatactcaacttcgttcatccaagccatatctctgtccacgaggctaattcgggccgcaagcctctggtacatacactgaacggctcgtacgagggcattcacttggatgcgctgaaacaagacatatttctgggcatgccatacgcagctccgcccttgggacctctccgattccgacatccacagccattgacagaatcatgggacggcgtgcgtaatgcgtcaacttacgggccccaatgtcgtcttacaccgacggggatggacggtatcgcgctgcct

SEQ ID NO: 6414 - DNA, 1155 bp, A.fumigatus
  unsure (570): Identity of nucleotide sequences at the above locations are unknown.
cactgtccggatggacgagggagaatacgacacagatacgttcaaaaagggtgcgtcaagctggtttcagttatctttacctggctaattatggcagagtccttgcaagatgttgcctcggtcctgctccgtgccgaggtggtgatcggtcgatgctatgttcttacatattcacccaatcaccactacactatatctcatatgacacctgaagaagtgcttgccatcattgaagcctggactatggtctacgccaggtatctctctcctgataatccccagagaaggagtacaacgagcatctccagtcacggcccaagatttggggacgagacaacctcggataccgcgaacctcaggtatatgcagatatttgataacaacggggaaattgtaggctgctctaatactcacccccatggccagatctggataacctcaagcatgccagatgaagtgaggctggaacttatacaaatgagtgagtatcgcaaagaccattgtggacggcatttgctggaggactatgctcgactcgaggtggacagacaagaacgtgttgtctggcanaatgatgcgttcctggccatctgtccttggtgggcagtctggccattcgaggttctactcttaccaaaacgtcatgtccgtggcttggtggatctcaacaagactgaaagacttcagtttgctgaagccatactgcatgtgaccagaagctacgatactctatttggaatgacttttccttacagtatgtgtttgcatccacaaccaagtggctctccaggagactcacagctaacacactcagtttcggcccttcaccaggcgcctctaaatgccactgaagctgaggtggatagcagctatcttcatatgcactttagcccgcctttgctgttcccctctgtcaagaagttcttcggcggctacgaactacacggagagccgacacgcgagatcacaccggaggctgctgcagcattgttaaggcactctggaacccagcttccagtgtgcgccgataatttgaaagctgctcaacatcagtttcaagtacggtcagatggggtcctttgcaggggaggaacctctacgtggtgggaacgagtactgagaacatcaaggtgggtcaaattgtggttttcttag

SEQ ID NO: 6415 - DNA, 345 bp, A.fumigatus
ctgctgatgcgaccttgtctagatatacgtacgtggttttcaaatgtggagcaacatgcaagtgaaggagtacacaaaatcctcattggtaacaagtgcgactgggaagaaaagcgagccgtctccacagaacaaggccaacaactcgctgatgagctaggtattccattccttgaggtgtcagccaagaacaacatcaacatcgagaaagcattctacagcctcgcctctgccatcaaaaagggcatggatacatcgaagtctgaacaagtggggtcacagggggtcaatatagaccatcacggatcggggacatctgggagtactggcggtaaatgttgttag

SEQ ID NO: 6416 - DNA, 408 bp, A.fumigatus
  unsure (249): Identity of nucleotide sequences at the above locations are unknown.
caatgcagcgaagtgctccggggtacctccctgcgacaactgccgcgccttcaaccgcgtgtgcatcttcgacgagtcactcgaccagcgccggcgcgtcgcccagaaacgcaccgccgaggaactcaactaccaccgggacatgctcaacgatctcttccgggtgatccgcaccgcggacgagcctcacgcactcaagctgctggagatcatccgcaagaacgcaaccgccgaagagatccgcgcgtncatcgacgagacgctcatccggctggacggggagggccggggcgcgggctgtggccaggcggtgcagaagctcgaggatgtgcggcggacgatcgatgtcgagggggcggatcccagcttccggcggaaggtcatggacatccattatctgtgcgatga

SEQ ID NO: 6417 - DNA, 627 bp, A.fumigatus
cgaaaatctgacagaatgcatagcgtggtgcatactggcttcctcaggcccagtctcatcgccaaagtcaacgtggaccggatcggtcgagaggacgacggagccagcctgtggacgccgtatccgtctcaccgagctgctcgtccagcgtacctcaaccagtactttgacgagtcgtgcaatctgtgtgagattgcgcgcgacatctcccgggtcttgttcgctgacgaccagagccacgcgtcgaccgcatatcggcgccagacaaaggacaacctgtacgagcggctgcgtcgctggcacaacgccttaccggacgtcttcgatcccggacgacggcctccaccgcatatcatcctgctgcggctgcgatactttaccctggtcatcaatctgttctcgtgcagttcgtccaccgacgatacctccagcctcgcgtcgaacgcgccgaaaacccctgagagcccgccgcgacagagtcccatcggcagatacaacgcctgggaaatcacgcagtcggccgcccgcggcatctcgtctttgacgcggctccatcgacgtgagtacggcatgagccgggcgcatcacttcgccatgtacgcaatcaacctggccctgttcgtcttc

SEQ ID NO: 6418 - DNA, 1134 bp, A.fumigatus
  unsure (527): Identity of nucleotide sequences at the above locations are unknown.
agactaaccccatgcctcgacatgaatgatccaacgtcaacacctcgccagatagtccccggccgggtacagacctcgcccacttcgccgacatcagacagtccccctcagggaagccaagcgtcgccgacgagttcatggaagaaacgcgtgtcgacggcgtgtttggcatgtaagaagtcaaagcgaaaggtgggagggcgcccccttatttttcattttcgctcgtctggaccgaaccgctccaaccttctggacatggacacggacatggctgacaatgcagcgaagtgctccggggtacctccctgcgacaactgccgcgccttcaaccgcgtgtgcatcttcgacgagtcactcgaccagcgccggcgcgtcgcccagaaacgcaccgccgaggaactcaactaccaccgggacatgctcaacgatctcttccgggtgatccgcaccgcggacgagcctcacgcactcaagctgctggagatcatccgcaagaacgcaaccgccgaagagatccgcgcgtncatcgacgagacgctcatccggctggacggggagggccggggcgcgggctgtggccaggcggtgcagaagctcgaggatgtgcggcggacgatcgatgtcgagggggcggatcccagcttccggcggaaggtcatggacatccattatctgtgcgatgaggcgccgtggaaggtgcctgcgaagccgtggacgagtgtcacggaggatgaggacctcgtttcgcacctggtctcgttgtattttacgtgggattatccgttccatgcgtttttggaccgcgatgtcttcctggcgcatatggcaagggggagggaggattcggacttttgcagtccgtttctggtgaatgcgttgttggcaaatgcttgtgtgcgttctctcttgttctgtcctgtttttcccgcgtggaggttggttttatattggggcgaggtgattgctgaccgtgacgagacagcacttctccgagttctccgaggcgtatgtcgtgccgggcgacttggtgaccaagggcgcggactttttgtcggaagcggagaggctgagggaggaggactctccaaagctcagtctggcgtacctgcaggggacgttgctgttgtatga

SEQ ID NO: 6419 - DNA, 342 bp, A.fumigatus
atatcactttcaagcgcaaaaaaaaaaaaaaaaaaaaaaaaaaaagagaaaaaaagaaaagaaaagaaaaaagaaaaaaaatccagggataacatgagaatgaaatcgcttgatcttcgttctttccttcagctaagtgctcaagcgcatccttcagcagcgtgtccttcgaaaaacaaaaggcatgatggtagcggatggtttcagccaaagcgacctgtgactgccttgagttcaggaaggcgcggtgaagttcgaaacaccaagccggaaaggtatgaacagagaggaccagaggagacgggaaggatagacgcaaataggtccagcatcacttactga

SEQ ID NO: 6420 - DNA, 258 bp, A.fumigatus
ttgtatcgaatgctgcgaaatgtgctaagcctcacgatcgattacgtcgataatatccccaaatcgcgtgccgcaggaaccgtagacacgccgggagcgataccctccctgttcatccacttactcggtccttttatatctattacgatctatacttgggatatcctgctcagcggtttttgcttctatacatttttctgtatgccgcttgttttgttcatgaaatacgaccttccaggaataggtgctcgcaaatga

SEQ ID NO: 6421 - DNA, 822 bp, A.fumigatus
  unsure (136): Identity of nucleotide sequences at the above locations are unknown.
aactgtcagatgccactggccctgcgactggctctggaaccagctcgcctggcgatggatcttcggacgcatctggagggtcagcattcagcaaatattcagagtacattgacacgaaggcagggactcttaaatntcaagaacaaggcgattctgcccggtggcggcgtcgaattctcgtccggacatagtttcagcatctcgttagatgaggttgagcgactggatgagctaggtaagggcaactacggaaccgtttacaaagttcgacatagccggccccatatgcgcaaacctggtatggggcttcgcggcatcattagtcgcccagctgagaactcgaccccggatagcacttctgcggctaagccccaggacaatctttctggttacattatggcgatgaaggagattcgcttggagctggatgaaaacaaatttgcccagatcatcatggagctggatatcttgcaccgttgcgtttcgccattcattatcgacttctacggcgctttctttcaggagggtgcggtctatatgtgtgtggagtatatggacggaggctctatcgataaactctacaaggacggcgtacccgaaaacattcttcgaaaggtcgcattatccaccgttatgggattgaagaccctcaaagatgatcataacatcattcatcgggacgtgaagcctactaatattctcgtcaattcccgaggtcaaatcaagatttgcgatttcggcgtgagcggcaatttggtcgccagtattgcgaagactaatattggctgccagagttatatggcacctgaacgtattgcatga

SEQ ID NO: 6422 - DNA, 327 bp, A.fumigatus
ggcggtgtccatctctccggcgcgactggtggtggaacttatagtgtgcagagcgacatctggagtttgggcctgaccatcatcgaatgcgctatcggtcgctatccatatcctccggaaacctttaacaacattttcagccagttgcatgtgagtttgaaacccctttctcaattattccgcatggtcgaacactgtctaatgccatttcaaggctatcgtgcatggggatccgccaaccttaccggaggaaggatattcggaagaggcgcatgcatttgtccatgcttgcttggacaaaaatcccagcaagcgtccttcgtatag

SEQ ID NO: 6423 - DNA, 414 bp, A.fumigatus
tgccatttcaaggctatcgtgcatggggatccgccaaccttaccggaggaaggatattcggaagaggcgcatgcatttgtccatgcttgcttggacaaaaatcccagcaagcgtccttcgtatagtaccttactcagacatccctggcttgctcccttgatgcaacccccgacagagtcgaatggtaccgaggcaacgttcgccgatccatctgctggccaacctggcgggcccgatacgagtactgcgactgaggatgaggaggtggcggaatgggtcaaggagcgaattgaacgtcgccaacgggggcacctacaagaggcagagaaacctgcattgcatgcagtggccttggatgcagtgcccggtagccctctgcttgatgatccctcctcgctcccatcactttcttag

SEQ ID NO: 6424 - DNA, 318 bp, A.fumigatus
attcagacaaagtttacgtctgttcatgggcaggaccccaataaaatgccctatgatcctagaacttcggtgacagatcaggttcatgcctcggtcaagtcatctctccacaatctctgcgcgccagatgcctcatcaagtgttgaagatgcttacattgatacgtttctccttcactcgcctctgtccacgatggctgaaactatggaggcttggcttacgcttgaatcatatgtacctcatcgcatccgcaatctgggtatatcaaactgtaccttaccaattctgaaaaaactttatgcccgttgcgacggttaa

SEQ ID NO: 6425 - DNA, 1311 bp, A.fumigatus
  unsure (710): Identity of nucleotide sequences at the above locations are unknown.
agactgctaacttttcgaatcattcttagcgctgcaagaggcaacacgtccttagaatccgcagtttcgctcacgaagacacttcgattggatatgcaagctctcgggcagcgattagcaaacgctgctgcctccgaggaattgctacgaaaaggcgcaaagtctcccagggaccgctcacgtaatgatgcggagatcaagctcatagtcagggacatcaagagacttctgacacgaattgaggatgcagtgccgctgatgaacttggccattaccacatcgggagccagactatcaaccaatcttccagcgacggtgtcgccatctaggttgttgcaagccagtaccttcctgactgctggggacactcagtactggatgtctcctacacaagctatccagatcggccctacttttaccctatcgatatacatgctctttgcgggtcacgttcggccccaggatgaagagggcattcgagaaaccacgtggaaggaggtcatccacaaggcacgcgtgaagcttcggcgtgtgccattagatcttacgtccataacactagctccgacttggcgagctaaacttccggcagaggcacgaatagacgaataccaataccaaatgttgatcattgaagatttggacgacggaagagtgcattcgtacgatgaagatgaaccaaagccggagccctacgaaggaatcccccnagctgggatgcgcgaaatactgccgatccaccagatatcgaagatcttctacgcggatacgagtaaagtcttgaatatcaatacagaaggcgaagttaacaacccggtactgctattgaagcgagatataaatgctattcctccgcggcggatgcttgagcgtgaagaagcagattcgttttatgttcaagaagaacagggtgaggaggaaactgacgaaatccaggcgcagctggatgctcagttgaatgggacgaatgctaaagattcattgaatcaaagctacaacgagaagtctatcccagaacactggcgctttccgaaagatctggatcctgaatggatagcgttcgaagtctacaatgaagatgagtcttcggacactgaatccgaagcggacgcgcccgatagggagcactccatagatccgcaaatgatggcaaagctatctcttgatgccgaggatgacaggtccaaacaaacaactccaacctcttcacaccctgccgccacaaccactgtctcgaaccccctcttcaacaacattcgaacttccttctccatcgtcttacaccgacggggctggaagaacacgcaatcc

SEQ ID NO: 6426 - DNA, 585 bp, A.fumigatus
  unsure (72): Identity of nucleotide sequences at the above locations are unknown.
gtcatttggtgcaaaatcaagacacccaaaaagcgcccctcacttggacagcgttgtttttgcaacctaacntatccttcgttctccccatcttccttgtggttgtccttctcacgatatcccaagatggccaatcagacccccgattcctgggaagacgagctctcgaagcagaccgagggcgtaaacctgaatgcccgcggacaataccgccctcaggcacaagctccctcattccaccccggggctgcctctttccagcctggtgcaccttcgttcgtgccaggccaaacttaccagcagtacggcggtggatacccacagtatggtcagtacggtggctaccccgcctacgaccagcagcaacaaggctttggtcaatatggggcttacgcccaacaacctggtggctataaccagatctacaacaaccagtatggtggctacaaccaacatcagcagcagcaatacactcaaccgcctcgtcaagcggcaccggtagctactcaagcaccttcagctcctgctcagcctgcccaaaccgctcccaatattcaccacgggcctggaaggaaccgcaattgc

SEQ ID NO: 6427 - DNA, 210 bp, A.fumigatus
aacatttttctgcccctccgcaaccccgccattctgtacccaacaaccatggcttcagaaaccaagattttgcccaagaagggcgagcggaacattctcgtcacaagtgctctgccttatgtcaataatgtgcctcacttgggcaacattgtaggttcagttctcagtgccgacgtcttcgccaggtgtgtcttgtacgccgctctttga

SEQ ID NO: 6428 - DNA, 816 bp, A.fumigatus
gatttgtccagatatcacaaagcttgcggacgacagactctctatatctgtggaacagatgagtacggcactgcaacggagacgaaggccttggaggagaaggtgacgccggaggaactctgtgccaaatacaacaagatccatcaggaggtgtacgagtggttcgaaatcggtttcgaccatttcggccgcactcccactcagcagcacacagaaatctcgcaggcaatctttaagaggctttacgataatggatacctaacggagaagaccgcggaacagccattctgcgaggcgcacgggtcttttttagcggaccgctatgtcgagggagaatgcccgcgatgccactacgaagatgcacgaggagatcagtgcgacaagtgcggccaccttctcgatccttttgatctcatcaaacctcgctgtaagctcgatggagctacgcccgtgcgccgctccacgaaacatattcaccttcttcttgacaagctgcagcctgagattgagaactgggttcttcccgccatggagaaaggcaactggcccaagaattctagggacatcaccaaggcatggttgaaagaaggcttaaaggaccgtggcatcaccagagatctcaaatggggtgttccagttcccctccctggattcgagaataaagttctctacgtgtggttcgaagcctgcatcggctatccgtcgatcacggccaactacactgcagactgggagaaatggtggcgcaatccagaggaggttgaattgtatcagttccttggcaaggataatgtgccctttcacagtgtgattttc

SEQ ID NO: 6429 - DNA, 324 bp, A.fumigatus
actgacatatgcgtcctgtacagtccaggtgtcatttctccaaccctgtggtccattggcactgatctctcaaatcgtgtcctgacgaccctagacaagagcctgatcacatcttgcacgagcctcttcgctttattagcaagtcccttggcaggaatattggccgataagctcggtcgtcggagagttatacttgtcgcagacgttctatttactctgggagccttggtacaggccgttaccggtcaagtatggggcatggtacttgggagaagtgttgttggtctagccgtcggtgccgcgagcctggttactccattgtag

SEQ ID NO: 6430 - DNA, 1092 bp, A.fumigatus
ctgatcattgtcttccccagatatatctctgagttggcgccttcccatgcccgagggagactcgtgactatcttgtgcctcttcatcactggtggtcaggttgtagcttacatcgttggctggctattctccacaatcaccagtggctggcggtggattgtcggccttggaactctcccggctgtgctgcaattcgtcattgtcgttgccttacccgaaactccccgatggctggtccaagcggggctggaggcagaggctctccatgtattgtccaaggtctatcagggccagtctgacaaccatcaaattgctaagcaagtcgtgcgaagtatccagcttgaggtagctgaagagcaagaagagatggaccgcattaaacctagtgtcgatgcgactaggataccatggcttcggaaagttgcccagcgcgctcaagatctttttctcgttggtggaaacagaagggcattgataatcgcaaccatgctgcaaggactacagcaactttgcggcttcaacagtctcatgtatttctcggcgactattttctccatgctcgcattctcctcgcccaccctcacgtctctctctgtggctgtgaccaattttatttttacgctgctggcgtttgcgctgatcgataggattggccggcgtcgcattctgttatattcaatacctgtcatgagtgcatcactaattgtctgcgccttggctttcggctccatggagctgccaggattctcttctgagccgcgatcacaaacccaagccgacaatggcgccacggataagtcgtttcttccaattgctgtgcttctctgcctcactgtatataccgcctcctatgctttcggactgggcaacgtgccctggcaacagtcagagttatttcccctgaatgtgcgttctcttggatcggctctcgcgactgcaacgaactgggcgtcaaatttcattgtcggacttaccttcttgcccatgatggattggcttttttccgggttggacatgtacgccctacgccggcgtttgtgtggttggatggtttggcatttgaaccatttaccccgaaatgggcctggtccc

SEQ ID NO: 6431 - DNA, 468 bp, A.fumigatus
aaacagcagacacgcgagtttggaggaagattagggacatcttcagttccggctgagatactgtgttttatggacaacagacctgcctccgagtacgcgcagtcaggttcgcactttccgtatccaccgtctgccactgcgcattctgaactcccagctgcagaccaggcttctgctgctgccactgctcaatacacgcctcagcaagaggtccgtcccacccctcagtatacgcctcaacccgaggttagacctgcctctgccgccgccgccaatatttcgtcctccaacacaccgcagtcggactacggtctgaaccagccgcccgccgcgcgctcgcccgcatatccggactacctcgctccgccgcctcaataccatcacgcccccaacacccaggccggtggtgcggcaggtatggctcaagcaacaagtccgtccatgaccaccctccatgatgggcaccaa

SEQ ID NO: 6432 - DNA, 186 bp, A.fumigatus
aatttggccgcggccgaaattggaggctattttaaacccctaaaatatgattttattactaaatctagttattcttgcgctgtggatattataattgcctatagtccagaatatggtagttactgctgtgtgggggtgcctgttaagggtgttattctatatctactacctgctctagagagatag

SEQ ID NO: 6433 - DNA, 222 bp, A.fumigatus
atgtgttttgacttctatttcaaaagctgcagtgctcagccagccactataccactaaaagcatgtataaacttaaaaaatttagttgagcaggagggaagggtcctacttatagtattagctttaaaaaataaggaaattcttaatatttataaagctgtgtgtatctataatatgccttatactaccctccagcagcgcctaaaggggcatactttttaa

SEQ ID NO: 6434 - DNA, 537 bp, A.fumigatus
cctgatataggcttcggcaccgtgttccttgcccacaaaaacactcctcacggacaggctaactttgccatcaagattaacgaacacaacaccattgcggccgtggatgatgggtcacatgtagccgaaatgatgttctttgaagagggtggaaaagttcgttatataccgtgtgaagcaatgatcatgctcttattgactcgcagcccaaggtttccaaccctccactctgtctatactgagaaggacaaggtcgcgattgtcatgtctgcttgtatcgactacgatacactccaactctcaaatggaatgcaagagacggaccaagtttgggccattgaaggaggtcatctccgcactcgtggaaaggaaccaaggctgaatgagcttcaggcctgcaaggtgtcaacgcagctcttggaagcaatcgcttacctccgtgatatgaacatcacgtatggcgacgtgtcctatcgcaattacctcgtgggcgagaatcttgaagtaagtaaatttcagaattttcaattcggttga

SEQ ID NO: 6435 - DNA, 285 bp, A.fumigatus
ttctctgcagaacaagcagccgtagcagataagtcagcagaggcggcaacacaatccactgagacgcagcctgggtcctccactacaacagctcccgaagcgaagacagaggctcctgctcccgagcccacggctgctgctcccgctgttccggagacaactacttccgcgactgcccccgcggaaactgcccctgctgctccagccccggctgctgagccgacacctgctcaaccaactgctgaaaagcccgctgagaccgcggagccgcctaagagtgggtaa

SEQ ID NO: 6436 - DNA, 318 bp, A.fumigatus
ttatcagctcctgatgctcttcagcaattgaagaagggtttaaaagccattttctcccgcaaaaagaagaaggctcagaacaatcaaaatgagcctgccccggctgcggacaagcctgtagaacaggcagcaaccgcccccgccgctggcgctggcgctgctgctgcggcggccgctgtacctgccacagaagctaagccagcagaaccagcacctgctaccgaacctaagcctggtacgttgttcctttatattttgcttgatccagtcaagttgtccaaattaattctctgcagaacaagcagccgtagcagataa

SEQ ID NO: 6437 - DNA, 234 bp, A.fumigatus
gagcactcagacgacactgatcatcaagcaagctatattgctctaattcctgactgggaaagatataaaaaaaacgaggggtatattatgcgacgcaaacacggcaacgacaacgacgacgataaaaagacgatcaactcaacagaaggaacatttgggtattatgcggcaactgctcgctactgtggaaacgtgaaggagcagagtaatgatcgaattaggagggactgttag

SEQ ID NO: 6438 - DNA, 453 bp, A.fumigatus
  unsure (33): Identity of nucleotide sequences at the above locations are unknown.
ggtggtcggaagtgtcctgggtatgtgttggcntttccttcgtctcacttgggtttgatattgtttgcttatttttgtttctcgcagcccgggtgctatctaccatggcgggttatacacctcaagcggcaacataccaagatacctcctgcatctgccgatccaactgcggtcgcgactatttgcattacgaaccctccgacaagagacccaaagtctcgaaagaagcccggcaagaagcgacgtatccagttgcggaagcgaaaaaaggcggcagaggaagagaagcagagggaggccgagaagcgaaatcgcaagaaccgggagaggaaaatcaaacggagacaaaaggcacgagaattgaaagctgcagctgcagctgcagctgcatcgggaccaagtcaagatgtcgccgaagtggagatgaaaaattcttctgatgtgagcaattga

SEQ ID NO: 6439 - DNA, 237 bp, A.fumigatus
aagactcttcagatgtttgttagtgccggagggttgaatgttcttgtggaatttttggaagacgattatgaggatgaacgagatctggtccttataggcgtcaatggtatttggagcgtctttgagctgcaagtaagtccagctcatcagactaggttcactcaacatctgacacttgcaagggatcaacaccaaagaatgatttttgccgaatcctgtctcgcagttcggtcctag

SEQ ID NO: 6440 - DNA, 543 bp, A.fumigatus
aggagatggttgccgaacgaactgttttgcacagtaagtgtggatacttgcctggcgaggtcatacctttctgactctaaatacttaggagtgctgaaggaactgaagcgcatgactcctgcccatcaaataacgatgttgaagtttatcaagaacttgtccatgctgtcaactacacttgactcgctgcagaattcaaacgccattgacgtgctgactgatctcttgcggtcaaccatcaaaaggccacactttcgagaagtctccaaccagatcctgaatacaatctacaacatgtgtcgtctaaataagtcccggcaagaggacgctgcattgaacggtatcgtgccgctgctccaaaagattgttaagactgagcgacccttaaaggaattcgctttaccaatcctctgcgatatggcacattccggaaaggtgggccgtcgtgagctatggcgcaatagaggattgcctttctatatatccctgctttccgacccttactggcaagtaactgccttggatgccatctttacctggtaa

SEQ ID NO: 6441 - DNA, 414 bp, A.fumigatus
cctcgccaggcaagtatccacacttactgtgcaaaacagttcgttcggcaaccatctccttcacatgattttcagcctgagagaagacgaagaagatgctggcgatgcgcccctcgacaatttcggcgagttctcccccttcgtccaatactcggcttaatacgagtgaaagagggtctaggaccgaactgcgagacaggattcggcaaaaatcattctttggtgttgatcccttgcaagtgtcagatgttgagtgaacctagtctgatgagctggacttacttgcagctcaaagacgctccaaataccattgacgcctataaggaccagatctcgttcatcctcataatcgtcttccaaaaattccacaagaacattcaaccctccggcactaacaaacatctgaagagtctt

SEQ ID NO: 6442 - DNA, 732 bp, A.fumigatus
  unsure (718),(719),(725),(726): Identity of nucleotide sequences at the above locations are unknown.
tgccaatgccttggtcaccatatcggactccaatcaggggatatcgggaaggttgtatacgacgttgcgaaaggatatcaagtggggaggagtagatgtggcagcatggtgattatactggcgacttcctgcatggctatgctcctgacggataacaggtaccttttcaacccatttaccattgccgcctgtctcggccgatccacaagcgcctttacttcgaccgcaatcctttatgctctgtccaatgccgtcacggggaatagctttaacgccatgctcgctctaggatgcgcgtcatatttgtcaatctacccggcccttctgtttattccgctcgtgcttctgtgttacgatcgacgtgctcaagtcgcgaagccttcatctggagttgcaatcttcgccattcagcactttggcatacttttgctcggcgtcggagggcttctaagtctgtcttacttagtcgttccagacttccagcagtttatctctgcaacatacggtttccaattacttgtccctgaccttactcctaacattggactctggtggtatttcttcatcgaaatctttgattctttccgagagttcttccttggcgtcttctggctccatttaacaggctatgtcggcggtctcaccgttcgattgcgcaagcagcctctttttgttctgacctcgtcttcaccacggggctggaaggagccgcgccatnnaaaaanngcgcca

SEQ ID NO: 6443 - DNA, 306 bp, A.fumigatus
cttcaattgggatctgtcaatatggcaccgaccagatcatcggcctcgtggctctcatcagccctggccgtatgtgccattctctgtcttgccgtgcccgccaatgccctctacttctacatggatggccgtcaaacaaaatgcttctatgaggatctgcccaaggacactctggttgttggtacgcgatggtcattctattattcccagttggttgctaattatcacatttttttccgaatgaacaggaaacttcaaaaccgaagtcatcaaccaacagtccaacacgtactcggtcgaccctaa

SEQ ID NO: 6444 - DNA, 471 bp, A.fumigatus
acaggaaacttcaaaaccgaagtcatcaaccaacagtccaacacgtactcggtcgaccctaacctgaagatgctcatcactgtcgacgagaccttcgacaacgaccaccgcgtcgtctccaagcgcgacggtcacgccggccgcttcaccttctccgccgccgacgccggccagcacagaatctgccttacgcccgacaccaacgctgccgtgggcggctggctgtctggtgcgcccgcgggcgccgtcagggtgaacctggacattgccatcggcgagacaagcaagattgagaccgaggacaaggacaagatgaaggatattgtgcagaaggtcaaggatctcaatgggcggctacaggacattcgccgcgagcaggtgttccaacgggtatgttgttcttttccgactgtcttacactgtctggaactcgggagaatggcggttgctgatttgccgacttttgtttaa

SEQ ID NO: 6445 - DNA, 597 bp, A.fumigatus
tgcgcaagtaattctcctacgcctctccacatctctgttgacaagcatctggacgtcctcttcagctctataagcagtactgactccaaaatgtccgcgagccctccatctagtcctcttgagcgtccccccagcacagagaaaggcgccacggacagcttatccgagctgcccgtggacaaccagggagaatccaagactcgcgaacgggatattcatgaggaagaacaatcaacacagaacaaggtcgatggaaatgacacatcacaaagcaagacacaagatgccggagaaaaagtaacacgcccacaaaatgataaagagaataccaaggaggaggacgcttctgcgccaccattaccagacgagccactcccaccaccgcttcccaacgaagctcctcccgatggggatgatggctgggagcccgtctgggatgcaaccgctcaagcgtactacttctacaaccgcttcacaggcgtttcgcaatgggagaacccacgggtgccggatgcaccaatagcgtcagcaccagcattggcaccggtgcctctcagcgaccccgcggaaggtgtaaaggccacaacccggtcgtag

SEQ ID NO: 6446 - DNA, 552 bp, A.fumigatus
tggctgggagcccgtctgggatgcaaccgctcaagcgtactacttctacaaccgcttcacaggcgtttcgcaatgggagaacccacgggtgccggatgcaccaatagcgtcagcaccagcattggcaccggtgcctctcagcgaccccgcggaaggtgtaaaggccacaacccggtcgtaggcggttacaacgcggcgatccatggtgattacgatcccacggcgccatacgcgcagcagtatgaggagcccactctcggaggtgctgcggcggatcccagtagctcctacgaggctgttggtgcattcaacaggttcacgggccggtggcagcctgccaccctgactccggagaactacaatgatgagaataaatcgcgacggcagttgaatgcgttctttgatgtggatgcggctgccaatgcccatgacgggcggagtctccgggcggagcgcagtgctaggaaactcaccaagaaggaattgaagatgttcaaggagaagagaagagagaagaaagaggagaaacggagggcatggctacgcgattga

SEQ ID NO: 6447 - DNA, 345 bp, A.fumigatus
tttcgggcgcgcttttatgttttgaccgaccacggagcattacttctcagaatgtctgatcattctagagtctctataggaaccgcctttgtggctggaatcctcctcgcggtggggttttctgagcttctgtatccggagttgaagaatcgcatccgagggactcgttctcagccgacaaaggtcctgcaggatggctccgcagactctttgacggtcaggtcagggcctcctgcaattgttgacggcattgaaggctgcatcggaaacactcctctgttacgcatcaaatcattatccgatgcgactggatgcgagattcttgggaaagcagaggtatggtga

SEQ ID NO: 6448 - DNA, 243 bp, A.fumigatus
cagtgctgtcaattgtgggtatattcttgttggtacctagtttgctaccttgctaatcactatgatacaggttttgcggcagtcaaaacagcgatgaagctcggtcctggccataggatcgtcacaatcctgtctgactctggctcaaggcacctttctcgattctgggccaaggctggagatgtcggcggtgcggtagataccaaactcgaggacgttctgaacgccaaagatgacgaatag

SEQ ID NO: 6449 - DNA, 798 bp, A.fumigatus
aacctcactccggggataccatatacgagggcacgtcaggttcgaccggaatttcactggctagtcttgccagagcaaagggctacctcgctcacatgtgagtatcgactcgtacgcttgcatgaagtgttcataccgcaactgacgcttattagttgcatgccatctgaccaagctatcgaaaagtccaacctgctcctgaaattaggcgcaatagtagatcgtgtacctcccgcaccgattgttgaaaaggacaactttgtcaatcgcgcgcgtgccctcgctcaagctcagacactgtctccctcgggtggcagaggcttcttcgcagaccagtttgaaaacgaagctaattggagagctcattacaacggtacagggccggaaatttatgcgcagtgcaatggtaaacttgacgcgttcgtcgctggcgctggtactgggggtacaatctctggcgtcgccctcttcctgaagcctcggattccaaatttgagtgtagtgctggccgatcctcagggaagtggactctacaatcgagtacgcttcggcgttatgtttgatattaaggagagagaaggcacgaggaggcgaaggcaggttgacacgatcgttgaaggaattgggattaatcgcgtcactgccaacttcgaagcaggaaaggagctcgtcgacgatgctgtgcgagtgacggatgcgcaggcgttggccatggctagatggttagtcgaaaaggatggtatcttcgttggaagtagcagtgctgtcaattgtgggtatattcttgttggtacctag

SEQ ID NO: 6450 - DNA, 231 bp, A.fumigatus
tactcacatgctcgggctggtgacgagttcgcaggcaatgccgactcggcgtttctctccaccagaaatgccccggcctttgccttcctcggatccaatcaactggtctttaatgtggtggattccaagctgcttttccacttcaaatacacgctgttctttatcggctcggctcatgtcccgaggcagtctcagcaatgcgctggtcaggatagtttcatgcaccgttag

SEQ ID NO: 6451 - DNA, 213 bp, A.fumigatus
ctgtcggaggtccggctggtactcagccgctctcagagcgaaaggaaaacattgttgatcgatcttcgcgtacaaataagtcatgatgcgtttgagatctacagttcggctctccctaactgctctcctctcattaagcgcatcaactatatcggcgcgcagcaactactcccagtccgagctactccccccgctcttctccgtgctcgatga

SEQ ID NO: 6452 - DNA, 1608 bp, A.fumigatus
gtcatgatgcgtttgagatctacagttcggctctccctaactgctctcctctcattaagcgcatcaactatatcggcgcgcagcaactactcccagtccgagctactccccccgctcttctccgtgctcgatgaccgacctccggaatgtcctccgtgcttcaactgccagctcgatgcttttcaatgcgcccaatttgcgccctgcaacaaattcaacggcaagtgtgtatgtccgcctggtttcggtggtgatgactgctcggagccggtctgtggctctctagccgacggggtgaatcgagcacctcgaaagggcgggtcctgcgactgcaaagagggctggagcggtattaattgctacgtgtgccagacgaaccatgcctgtaatgcgatgatgccggaaggtgaagaaggcgtctgctacaagcaaggcgtcacggtcaaggagaattaccagatgtgcgatgtgaccaatcgcaagatcttggaccagctccaaggcagaaagccccaggtgacgttttcgtgtgaggccgacgaccacacctgcaactttcagttttgggtggaccaaaaagaatccttctactgcgccttggatacctgcgactggaatctggagacaggctacaaccagaataagacgacgtacaactgcaaaaatatcaactgcaaatgcattccaggacgcatgttgtgtggcgaggagggttcgattgatatcggagagtttcttgcgcaggagatcaagggccccgcctctttccgaaccgtaaccactgaaggtggcagtcccgaggacggaagcaagttccaggagccggcgatggatgacttgatcaagagcgtcttcggggaccctagtatcttcttgaactgtgatgctggcgagtgcttgtatcatacagatgtcccaggatatgtgcgcccgatcaagcaaatcaacacccctctgattgctggtgtgatcgcaggctgcgctctctttgttgtcgccgtcattctgggtgtttggtacctctcccgccgatcctaccatggacgaatctatcttcctctatccgatgactcggacgatgaggccgccagacttcttgcagaccacaagccggcggcattgtactgggataatgtgtcttactaccttaacggaaaggaaattctatctggcatccaaggcgctgcgcaccctggcgagattacagctatcatgggagcatccggtgcaggaaagacaaccttcctggacatcctggcccgcaagaacaagcggggtacggtgcagggtgacttctacataaatggagaaaagctcagtgatcacgacttcaagagcatggtcggctttgttgaccaagaggacactatgctgcctacactaacggtgcatgaaactatcctgaccagcgcattgctgagactgcctcgggacatgagccgagccgataaagaacagcgtgtatttgaagtggaaaagcagcttggaatccaccacattaaagaccagttgattggatccgaggaaggcaaaggccggggcatttctggtggagagaaacgccgagtcggcattgcctgcgaactcgtcaccagcccgagcatgtga

SEQ ID NO: 6453 - DNA, 1098 bp, A.fumigatus
caccggacgctaacggaggtcaacagtatcgtcattcagtttgaggacttcaagaatcccttccccgctttggagcggtatcgtgatgcctacacatgcttcaacgatgacatccagggtacgggtgctgtcatcctcggcggtgtcatcaacgccgtgaagcgttcgggacttccctgcaaggagcaccgcgccgtcttccttggtgctggaagtgctggtgtcggtgtggccaagcaaattgttgcatttttcatgcgtgagggcatgacggaagacgaggcccgctcctgcttctacctggtcgacaccaagggtcttgtcaccgctgatcggggtgacaagcttgccgatcataaggtgtactttgctcgcacggacaacaacggccagcagttcaagaccctcgacgaggtggttgatcatgtgaagccgaccatcctcatgggtctgtcgaccctcggcggcgtcttcaccccggagatcctacgcaagatggctgattggaacacccaccccatcatcttccccctgtccaacccctccgccaattccgaatgtgactttgaaagcgccatcacccacaccgatggccgtgcgctcttcgcctccggttcccccttccaacctttctccttcaagaactcctccggagagagtcgcacctactaccccggccagggcaacaacatgtatgtcttccccggtattggtctaggcactattctctccaaggcggtcaaggtgacggacgagatgatctacgcctccggtgcagctctctcacaagctctgaccgctgaggagatcgacctcggtctcctctaccccgacttgacccgcatccgtcaggtcagcatcgtcgtggcccgcaaggtcatccgcgccgcacaggatgccggcgtggaccgtgagacttctctgcgtaacatggacgacgagagtcttgatgcatggatcaaggctcgcatgtacgaccctcacagcgaagtccacgctttggagagagaagtcggcgctcttctctcgaatctcgggcctgcatctcctgccttgaatggctatgtcgaggaccagagcaaggatgccaagctgtag

SEQ ID NO: 6454 - DNA, 459 bp, A.fumigatus
gatctgacgctaacggcgttcatttgcctaggcatgtatctgagctgggaggaccgcggcaatctggccgctgtcatcgccaactggccgcaaccaaacgttgaaatcacgtgcatcaccgatgggtcccgaattctcggactgggagatcttggcattaacggaatgggcattccgattggtaaactcgcgctgtatactgcatgtgcggggatccgtcccgaggccaccctgcccttgactctggatctggggacaagcaacaaggctctccgggaagatccgctgtacatggggacacgccgtgacaaaatctcccccgaggaggaacgggaattcatggatgagttgatggcggctttgaccgagcgctggcctgggtatgtggctccacctccccatctctttccgatgacaccggacgctaacggaggtcaacagtatcgtcattcagtttga

SEQ ID NO: 6455 - DNA, 423 bp, A.fumigatus
atgacgatactgttgacctccgttagcgtccggtgtcatcggaaagagatggggaggtggagccacatacccaggccagcgctcggtcaaagccgccatcaactcatccatgaattcccgttcctcctcgggggagattttgtcacggcgtgtccccatgtacagcggatcttcccggagagccttgttgcttgtccccagatccagagtcaagggcagggtggcctcgggacggatccccgcacatgcagtatacagcgcgagtttaccaatcggaatgcccattccgttaatgccaagatctcccagtccgagaattcgggacccatcggtgatgcacgtgatttcaacgtttggttgcggccagttggcgatgacagcggccagattgccgcggtcctcccagctcagatacatgcctag

SEQ ID NO: 6456 - DNA, 1569 bp, A.fumigatus
caatttggcaagactcatagccgaaatccattcttggctccggtgtctccgtccagtatcggcagtacaggggcgccagcccagtcgtccggccatgaggcaggaacaaactacaactttgaggcacctgacttgactaacggcaacttgattccaccggaagttccgctgtcacagggtgattgggctggccaatggccaactatgggaactctcgatgccatgcctgtacaactgccttcggagccgcaagacgctttccacagtccgcttgcgaaggtaaatcaacttagaaacaatcttcaattgtgggactcattagtactgcaagctctgcctgaactcgattattctcagctggtcgacctgagaagtttcgttaaagctatcttctgcaggctggacacatcaatacaggagagactagacctaggtgcttccaatataccttctccgcgagataggtacctttgcaagctctgcagtcaaggcaaccggaaggtgtatggaactcgtggaacctttcggcggcatgtgagccttactcatcaagcggagcagaagtactattgtcctgcatgttcgttcagtacacctagaagggacaagttccgtggccacttgcaagtcaaacacggttcttttgcccttaccctactaaacaagggctgcctcgacagcctagcccgaccatgcccacctcccaaaacttgtggactttgtccaaagcaagtgaacacatggaagagatatttcgagtgcatcgtgaagcactgccgcctacctggcggaagttctccatacaccagtgcaagccagagcagacggggcagcggcaacactggcggagacgggacagactttgatggccagcaggggtttgaccccagcggtattgatggatcaggttttccctcatcgtcttcagctgaaggaaacaacatggatggaggcgactatgacttcaacaatattagccagcaattcagtttccatgctaccagtctttctcagcgcaatacacaagacagtatcgttgctgatactgttgacgaggcccagcaaagccccccgctcgcaatcaacgctcatgcccgtactggtcccaactcagtaccgaacaaagacggtcctgagcatctatcatccgtccatagtccaacaagcttacaaggctatcaccgcaccctgaattcgactcttaaagaatgctcatcagcttctaccaagagaaaaactagcttggacagcttcaagcaattgtctgccgcccgaaatgcaccacattcaacggatagttctggacgaagtcgcatcccaaatgcacggtcaagtccaactgatgaaactcctcgaaaaaaccgatgccctgatcttgggaagtcttgccagataaagtgcaggatctgcagtcataccatgcagagttgcactctttgtacagcctccaatggagctgagcggaaatgtcacctttgcgcaggcaaggctcgccagcgaagtaataagtcacgcccctggcatcatgaaacatatcccgattatgcgtatattcctgggaaatcttta

SEQ ID NO: 6457 - DNA, 234 bp, A.fumigatus
acttctgttgagacattcgttatcatgaatcgtctgaacaatggccatattattgacgacttcaatcacgagcaagacgatatatacactggccccaatgccatctggcgtttcatccactacactgaccctcccacccagacacttgggggccatttagctccagctccgactaccaacatggcttttgtgagtcaaccacctacaagtgtatttctcggtatatcgaaatag

SEQ ID NO: 6458 - DNA, 402 bp, A.fumigatus
tcctccacaccagcatccacacctgacccaacagcagatgcatcagtcgcaccagcagcagcatcggcaacaacaacagcagcagcaacagcaacaacaacaacagccgcagcaacaaactcaatcaatgggcatcggctgggaccatccgatcttcagtcagcagcatccgcaaaggacacatgtaccatcacatcaagaccaagatcatggcatctattcatcgtcaactccgcagtcgtggcaacaaaattcactacaacaacatctccatcatcatcaacaacaacagatactttcgccagctccacagggtcttggggtgcccactcagtatcatcaggttcatcgatatcctccaggccaggtgacattcgattcacggcctctccctgcagctaa

SEQ ID NO: 6459 - DNA, 834 bp, A.fumigatus
caactaccacctgcgatcaaagtcaacgcctgttatagagggcaaattaagcccagaatggatcatccctcgtcacagggcatgatgcctggcttgcattgcaactcagtaactccgggttcagttcagcctgattattggaacaatctggattcgttatattccggtcgtgatcctccacaccagcatccacacctgacccaacagcagatgcatcagtcgcaccagcagcagcatcggcaacaacaacagcagcagcaacagcaacaacaacaacagccgcagcaacaaactcaatcaatgggcatcggctgggaccatccgatcttcagtcagcagcatccgcaaaggacacatgtaccatcacatcaagaccaagatcatggcatctattcatcgtcaactccgcagtcgtggcaacaaaattcactacaacaacatctccatcatcatcaacaacaacagatactttcgccagctccacagggtcttggggtgcccactcagtatcatcaggttcatcgatatcctccaggccaggtgacattcgattcacggcctctccctgcagctaacaacccttcatatcaaacttactcattccctcagaacttctattcttctcagcacatgtcgcttccagatgcctttcctcaatcaaatccaccgcaggcctctcgatcgcagacttcccagcagaatcattaccagaccgtcgcacatcagacgcctattgcatcatactcgcttcctaccggatattttgaagggaactcggtaagcacacagatgactcatcatcttaaggacgtttcactgacatacagtagatga

SEQ ID NO: 6460 - DNA, 345 bp, A.fumigatus
cccaacagcagatgcatcagtcgcaccagcagcagcatcggcaacaacaacagcagcagcaacagcaacaacaacaacagccgcagcaacaaactcaatcaatgggcatcggctgggaccatccgatcttcagtcagcagcatccgcaaaggacacatgtaccatcacatcaagaccaagatcatggcatctattcatcgtcaactccgcagtcgtggcaacaaaattcactacaacaacatctccatcatcatcaacaacaacagatactttcgccagctccacagggtcttggggtgcccactcagtatcatcaggttcatcgatatcctccaggccaggtga

SEQ ID NO: 6461 - DNA, 189 bp, A.fumigatus
gtacatatcagtcattaccttggggaggttctccgcaatggccctgatcctatattgccatcattcaccgcctttgctgtaagatggcgcaagtatcaaggtatgtcgcttgaccatagatgcgaatccgatactacggagctgatggctggtttcattcctttctacatctatgaagagatagactga

SEQ ID NO: 6462 - DNA, 444 bp, A.fumigatus
aactcaagggccgaggttcgtggccgtccgacaagcctactacttcagatatacgatgtcgaatcttcatttctaaccggtcgatatcaggtccaccgccttgtcgcccctcgggatcagaagtatcagtcgaactttgttgagtttaaacggagtacaaagattgtgtaccggagatatgcagggctgttcttctgtgtgtgtgttgacgccacggacaatgagctagcctatctggaggctatacatttcttcgtcgaggtcctagaccagttctttggcaatgtctgtgagctggatctggtattcaacttttacaaggtgcgtgaggtctatgcaggtggtttatgttcaaggacattgagggctgcaggagatgtcattcgattgtccgacaaccatggtgctaaccgggggatgtgcgtaggtatatgcgattcttga

SEQ ID NO: 6463 - DNA, 519 bp, A.fumigatus
aagacggatccggatatcgtagctcgtctaccggacctacaattcatcgagcaatatgaccccgaagacactgatagcgcaaccgctgtcagccagccctatgcctacgtcgcggccaaggtgattacactctcggaacctggtgctaaggcgccggggctcagttggaatcctgaagacttggctaaggactcccccttggaaccaagtgaaatggaagccctgacacaactccgagataagtacgccgcaggagagagaataggttggtggattgtttacaatggggacccagacagagctttccctcgctacgaggaggacgacagttatgacgaatacgattatgacgatgatgacgatgatgagtacacggaatcaaatggcgatagtgttaggaactcaacagctccagagacacctcctagcccggtggtaagtcttgcccttcgtacttccttgatacttgtgaccgattatattgatggtttggcacatttaaggctcgattccccgtga

SEQ ID NO: 6464 - DNA, 1284 bp, A.fumigatus
tctctttgcgttcaattattcactgacaatccgatcttgacaatagtggaacaactggccattcagcagcagattgagctgcttcagcagcaacaacaacaaattgcggcgacacatcaacagtatgtcaacatgggactcttacagccacagcaactgggccaagtttcggcattctctccttcgcttcagggcggtgcgtctatggggggcgtttcccctcagatcaacgccttccagtttccccagctagctcagcaacagcttggcgtacccatgaacactcctactcagcactcgcaccgacgcaatcaatccgcacttcccggtctgcctatgggccctccgcctgccccatcctcaggtgcttccggatacactgattacaatgcccagcagggtaaccctcaacagaaggaaaacaataaccatggccgtaatcgggggccgccaggtggtggtcaccaacgtcgtcattcgctcgctttaccagaagctaaaaaggccgcggagctagctcaacaaaagagaacagcatccggctttcagttccccgccccaggcgctggaggtagctcagagaacctatccggctccgaggataaaccgacctcgaccacaccacaacccccccaggggcttggtctgcaccgtgccggcaaccttcgggctggcgcccatggtcgcagccaatccgtcgctgttggcaactcccggggatcgctgtccggacgcggtatgggtggctttcaatttccacaatctagcgacattggagggcaatccgagaaccaacgacgtggcagccagccgggccatgcacgcaccccatcgagaaatttcgacggtaactggcgtcagcctaacaatcagaatcaggcacaggaccagcagaagagcttcggacagcaaggtggtagcactttccaacctggccaccgcgctcgtgcgtccaaccaatcgattggttctattggctccttccagtatcccgcccagccccagcttatccagttgcctcagggtcaggttgttatggcgccacctcaactgttcggcgctggacagcagctaagcccgttgcaactggcacagctccaagccctccagcaacaaagcggtcaattaaatggacaagggcttggcggcctgcaggctagccaacacgctccgccacagctgtctgctcagcaacagcagcagcagcaacaacaacagcagcgcaagactctatttattccttatctgcctcaggcgaacctgcctgcttcaccacggggctag

SEQ ID NO: 6465 - DNA, 729 bp, A.fumigatus
ttcgacgttcctagtgctcctttgccactacactttcaaaccgttacccctcaaaccgaaaagctggagctaccgtcgatctcccaggtccatacaagaggtcctgttgatatcccttggtacaaccaccacgccgcggaacgacctttgttgtctggtgacaaacttccggccctcagtcttcccacggcctcgcagccgatcgtctcgggccagtcctacagggctagctacgaagagtcggctccgggttcgaccacctcaagcgctcggacaagcctatcgtccggcaccgcaccgaccatcagcgaggtcagaacaccgccgtctgttgaccttgtggctggtggacacggccgtctctccctggaatcttccgcctcgcaggactataccgttgcgcataatcaggtgagcgacagctactacccgaatccgacccctcggggcagcatgaaccaaacccacccttacatggacttcactccgtcgaatctctccatcggcgcaacccgtacgcctcctcatgcgggcgaacggcaaggagccaagggccccctatccgccaatatcctcaaacaaaccacctgttcctggcaacccagccctccaagttactgtcctggccaacttctctacttcgccattatggccttatccctaaccgggggttggcctccgtctccagaaaacggcctcaaccccccgggcattcaacaatcggaatga

SEQ ID NO: 6466 - DNA, 267 bp, A.fumigatus
  unsure (77),(113),(121),(184),(240): Identity of nucleotide sequences at the above locations are unknown.
ggcctttcgttgttactaaaccttccctccaagcaagttcacacaagccacaccccggtaaaccacgccgccgtgtnttatattggccaacacccatcacggggtactccccnaatttccnacgggtgttccccctcaattaaatcctacctggggaacaatagtggcgcccccccccgtgttngtccacagccgcccaaaatcccctgtgccactctttgtttgggtaagggaacaaanggggaattctcctgtgtatatcccggt

SEQ ID NO: 6467 - DNA, 330 bp, A.fumigatus
agtccccaaaggctgtcttatctattcactatgactatcctcaaacaaaccctcgataatgcagagatacaggagagtgctattgtcactatgactgctggtaataaaagcggggcttctatgctggagaatgcttttgggtcccaaggggctcaggtcatgctcccagaaccagcttggagcaaggtccggacttactgccgtgatgcattttctgaattcttcggaactatgatcctcatcctctttggagatggcgtggttgcccaggtcacacttagcaaaggagaaaagggtgactatcaatcaatctcctggggctgggggtga

SEQ ID NO: 6468 - DNA, 735 bp, A.fumigatus
tcctcatcctctttggagatggcgtggttgcccaggtcacacttagcaaaggagaaaagggtgactatcaatcaatctcctggggctgggggtgagtatatctcttggttttgctgctcaatcctctggcacttactgacggggttgctctttaggatcggagtcatgttgggtgtctacgcgagtggcatctccggagcacacatcaacccggcagtgacctttgcaaactgcgtcttccgaaaattcccatggcgaaaattccccgtctatgccattgcccagatactgggagcgatgtgtggagcagctattgtctatggaaattacaggtcggccatcgatcagtttgaagggggggcacacattcgaacggtgcctggatattctcctacagccaccgcgggtatcttctgtacctacccggcggaattcatgaccaggacgggacaattcttctcggagttcatcgccagctccatcctgatgttcttgatatttgctctgaaagacgacggaaatatcggggctggtccccttaccccccttgcgctcttctttgtgatctttggcattggcgcttgttttgggtgggaaactgggtatgccatcaaccttgctcgagatttcgggcctagattggtttcctatatgatcggatacgggcccgaggtctggaaggcaggaaactattacttttgggtatgcctggctctatttgaatatgatgactga

SEQ ID NO: 6469 - DNA, 813 bp, A.fumigatus
tttggtatcgtgactactctcctcatggagatgcatacagtggtgttcccccccggaaagcctgctcctccgccagctgcacaaccccaagccgtcgccgctcctgcgccggaaaagaagaaacgcgtgcgtcgatggcatcgtcgtggctttacaggttgtttaacctgtaggcgacgtcatgttcgttgcgacgaggcctctccgtcatgcaaaaattgtacacggttgggtctcgattgcgatgggacccaaggtcgaatgaccttcaaagtctatggcccgtcgcaaggtgcacaggacttgtccccgagcccaaacaatatcagcacggcaaatgcaatcacggtcaaaaatcagcaagcagatatcaagcatgtcaagcaggagccccgggacgagaaggatgatcttgttgatggcatagtgatttctccgacgaccgttggcgactcggctccggtcaaatatcgattccaagaccccctttctccttccggtttcatgccctcgtcgttagatctcgtagagggccgctattatacccatttcatcgaacaggtctccacgttgctcctgatctacgataattcgaataacgtcaacccgtttcgacaatactttcccgaactcgcgcagtcgtccccatccgtggcgagcgccatgcaagcgcttggcgcgttgcacctcgcaaatacgtccgccggcccaaaacgcaatgtccattttcaacaagcaatgggcaagtatggggaggtggtgaagacctttaggacgtcttcaccacggggctggaaggatccacggagatca

SEQ ID NO: 6470 - DNA, 228 bp, A.fumigatus
gttcttctagccagctacagacaagatagccatcttcacctcacagaaggaggatgcttgctcgaggcaaaaacgctacgaccaatcatctgggtgcatctcgaactcggcaaggagttgccttgcaccgagaaggttacatggaaggatgtcacctccattcgcaaactaactgttcctggacaactcctcgacggaaacaatcacaggtggacgcggcagtgctga

SEQ ID NO: 6471 - DNA, 195 bp, A.fumigatus
gggtctattccgcgccggtacgttctcactctagcttttaccatccggaaggctcacatggtcgtagctatcatggaatccggtaacgctgttggacccccatggaacggcacggactggcatcagccgatgtacgaccgcatcgtgaacaaggctgggtatcttaatcgctcctcacgatggagtttatgctga

SEQ ID NO: 6472 - DNA, 189 bp, A.fumigatus
gagatctatggctcatttctcatacagatcccttttgtctttgcgaatcctgtgcagaacattacaccgctgggaactgatccctcccgtctcgaactgggcaacatggccgctcggatgtggacgtccttcgtgacggaccttaatcccaatgggcatggaggtacgtctggatcaagacttgactga

SEQ ID NO: 6473 - DNA, 804 bp, A.fumigatus
acaaggctgggtatcttaatcgctcctcacgatggagtttatgctgacaatagtagttgctctacgtcctcggacacactccagtgtctgcgagaagtcccctaccagtccttgtacgacatagcgtacgagggcctggaatggttcgccgccatcgacggttcatttatcaaagagtatcctcagattagctatactgaaggcagactggcaaaagtacccatcctccttggatccaacacagatgaaggaaccagcttcggtactacagggacgaacacggacgaagaatgcattaaccaactcatatgtgggtttttctgtcggccaaggcaacgactagtactgacgatgacagcctcaaagcgctgggtcctcacccgtgaagaagccacgcgccttctgacgtactaccccaacgaccctgccctgggatgtccctatggctgggggaacgtcacttggccgaagctgggactgatgtacaaacggtacgaatcgatggcaggcgatctgactatggtggcaccaaggcggctgcttgcgcagaccatggcaaagtacacaaaacaggtctactcttatcgatgggacgtgccggccttgaacacaagtagcaccatcggtgtcggacatttcgcagaggttagtcaccaccacctgcataggagatctatggctcatttctcatacagatcccttttgtctttgcgaatcctgtgcagaacattacaccgctgggaactgatccctcccgtctcgaactgggcaacatggccgctcggatgtggacgtccttcgtga

SEQ ID NO: 6474 - DNA, 387 bp, A.fumigatus
cttactcggaccttgcgcgtcgtggtgaagatgcatttgaagtcgtcctgtccgtattggtttctgtactgcataatgggtccacaggaccagacaggagcgaaacggatcagggggaagcccgttcccagtcagccaggatctcatggcccgacagtcatgaacgtgccgccgccatcaacagggtccagggaggcctgcgatgagtgccggatccgcaaggtccgttgcaacaaggaatatcccaagtgctccagctgccgcaaatccaacctcgcctgtggcttctcgaacaaggggaagcgagtcaatcataccaagaaactgtccgtcttctgtgttcttctagttgatctggatgattctaatctccctgtgcctggatag

SEQ ID NO: 6475 - DNA, 294 bp, A.fumigatus
aagcacgcatctttcctggccggcaagccttgcctgcttccgtcgtatgactgcgggctgccgttcccagtggccaagtcggagcatctcccacgggatcaacgttcggcacacatctctctggcccggatccaagaagacgtctaccaacgtctctactcggcgcaaaccgctcacaagggccgcgagtacatcagtcgtcaaactcagcagatcaaccgaacattggatgactgggaaatccagcacaaacacatcctctctcctgcaagcaccatgacggcccaggaagcc

SEQ ID NO: 6476 - DNA, 1401 bp, A.fumigatus
ttgatctggatgattctaatctccctgtgcctggatagggtgaacgatgtcgaaatcctcggaaaccgtctcgggaagattgaagaggcgctcattcgctgtttgtcggccgtcgagcgttcgcagactccgtcaaacgcgacggcacggcaaagctcggttatcccgtctgacgacagcagccatcccgaccccaatgatagtgcgcctacggacggaaacacgctcacagatgcgtcgttagaaacgaatgccgaagcatgcaatgaccctaccttccctggatcaaccccgattgcttctttttataccgaagcccaggcggcgtgcgacagactgagatcggtagtaccgttcgcgagtccagacagccagcacagtccggcttcgccggatttcataccagaccggactggttcattacagtcacggcttcaagaagtcggcgaactgtttgagaaattcgcccgagaaagcccggtcatgtcgatacccgagtccgatggcctgctgccttcattaccaccacgagcgctggtggagacctgtctagaaacatactttgcctgcttgagtccctttctgcccctctacagccggcagagtgtcatggcggccattgacgagcaatacggaccccgagtcaatagtcccgaccctgcctgggtgatctcgttcaacaatattcttctgcagaccctggatgccagatatagtgcagcgacacgagcgggttccatcactcacaacctcctggaagaggagctcatcaaaagtttgttgttaaactatcgacgagggtacaacaatttcgagagacttttgagaccacagttggcgaacgtgcaagccctgttaagcatggtaggccgtcccttcttcatgcatggtatattcactgtcttaccggctcaggctttgatcgccttaaagtacttttctctcgcgaccttcgagacagtcttcgcacaggcgtgccagctagccaaatccattggtctccatcaaagcagtccggactcggagaacgcagaacagaaagatctgtggtggtcattgttcatcatcgatgtgagtctaccaattgtttgtgtcactttcccctgctcacgacggaatagaagcacgcatctttcctggccggcaagccttgcctgcttccgtcgtatgactgcgggctgccgttcccagtggccaagtcggagcatctcccacgggatcaacgttcggcacacatctctctggcccggatccaagaagacgtctaccaacgtctctactcggcgcaaaccgctcacaagggccgcgagtacatcagtcgtcaaactcagcagatcaaccgaacattggatgactgggaaatccagcacaaacacatcctctctcctgcaagcaccatga

SEQ ID NO: 6477 - DNA, 195 bp, A.fumigatus
gggcgtcatctcggtgatctatacttgatattcaaccctagtagccgaggaattcagaactctatactcggtattcttggggatcttctcgcccgtggatggttcgaccctagttcacagtttaacagagcactaggtactgtctccggccatgagttcctcgtgtactacaccatgggacgtgttagaagctaa

SEQ ID NO: 6478 - DNA, 201 bp, A.fumigatus
ccttaccaccccggcttgcgtttgtctcaagacctaatggatacaatcggtgataagctttccaaggagccagacctggccaaaactggcttggagatcgattatattgacccaacccagatctgccgtactcccattccagaaaccgcttccccgacgcgctatagtagtaccctggatgcgactctcatgttacattag

SEQ ID NO: 6479 - DNA, 1083 bp, A.fumigatus
  unsure (275),(528): Identity of nucleotide sequences at the above locations are unknown.
agacgttttaagattttcttttcctttgactatgtcgcccgcggaccatggaaccaagatgacgtgactgagttgttgttgagatacaaagtgaatgaggcatactataggaacaatggccgtccgctagcatccaccttcgagggctcggagaacgcagaggagtggataaatatcaaagccagcacagattgcttctttattcccgactggtcctcactgggagccaaggcagctttggagatagggtacggaattgtggacgggctgtttanctgggccgcctggccctccggtccgcaagatatgaacacgcaggtagatttatgctatataaaactccttaacgaatcggagggtctggtctatatgatgccggtatctccatggttctatacgaatttgcccggttatggcaagaactggctttggcgcggggacgacctctggcacgatcgctggcaggaggtcttatccgtccgcccggaattcgccgaaatcatttcgtggaatgactatggtgagtcncactacatcggaccgctccacgaaggcgggtatgagctattcagaaccggcaaggccccattcaattacgcggagaatatgccacacgatggatggcgaaccctactgccattcattattggtacttataaacgtggtcatgcaaaagttaaacaggagtcgttggtaacgtggtatcgtacaacccctggatctgcctgcggtactggtggaacttcagcaaatacgcaaagtcatgcgcatattgaattcagccctctagaggtcgtggcggatcggattttctactctgctttactcactgagtatgccacgcctgaaatattcattggtagcaccacgcaaaaggggacgtggagaaacctaccggctagcggtaggggcatctatcacgggagcgcgccattcaacggggcgaagggggatgtagaagtgactttgtggagagaaggcaacagaatcttgacactgaaaggcaaggggatctctgggagctgttataacggtgttcagaattggaatgcctgggtgggcagtactcagtcacccagctaa

SEQ ID NO: 6480 - DNA, 549 bp, A.fumigatus
catgagttttcgaatcccctacgcaaaaggcctcccgatcttttctacgatgacaatgaatcccggaaatacactacttcatcccgtattcgtaacattcaagcagatatgacccatcgagcgctggagctccttgaccttcgttctccgtcgctcatcctcgatgtggggtgcggttccgggctttctggcgagatcctttcccaagttcctcctcagcagggtggacctcatacctgggtcggaatggacatttcaccaagcatgcttgatgtggcactgcagcgagatgttgagggtgacttgctcctggctgatattggacagggcgtgccatttcggcctggcaccttcgacgcggctatcagtatcagtgctatccagtggttgtgcaatgcggagacaagcgatgtcagccccgagggccgtcttcgtagattttttgaaggattatactccagtcttcgccgaggggggcgtgctgtctgccagttctatccaaagaatgctgcccaacggggttttcaacagccggccgagatccagcaa

SEQ ID NO: 6481 - DNA, 240 bp, A.fumigatus
ttgtgggctttgagcgcccttccacccccggtgaagacatcgattaactggcacgtgttcggtatggttgcggtgagtactactgaatttggaactatgaagggctttcaagcatatgtgtgtttgttcgagattatccgcggatcctccatgcggtgtagttggagttgtgaccgatgccaatggaaatatgcagagttgcctgtccccatgatcccatacttagcctggaccctctga

SEQ ID NO: 6482 - DNA, 204 bp, A.fumigatus
acagtgctgtgcgagcttctggatgccctgcttcaatatgatccagctcagaggctatctgcaaagcaggcctgcatgcaccattacttccgcaatagcagctcatcctcatcctatttcaaccgtactcagggcggtgctaaccaatctctagacagagagcatatcacagcatcattgatgttggtcactaactgtgaatag

SEQ ID NO: 6483 - DNA, 336 bp, A.fumigatus
gatcttctggtgcgtagctttttgctagttcgagttggccaaatagagtttgacactttgttctataacccccatggcaccccagatggagagatctggcctggttttattacattttcagactacaagcccactttcccaaagtggaggcgctccccagctccactgatcccaggatttagacagtgctgtgcgagcttctggatgccctgcttcaatatgatccagctcagaggctatctgcaaagcaggcctgcatgcaccattacttccgcaatagcagctcatcctcatcctatttcaaccgtactcagggcggtgctaaccaatctctag

SEQ ID NO: 6484 - DNA, 210 bp, A.fumigatus
ataaaatacctaactttctcgagagatattatttgtaccacccggagcccaaaccctatgccctatgtagccgtatttggtagcctgtcctaccgcccagcaatcagagggtccaggctaagtatgggatcatggggacaggcaactctgcatatttccattggcatcggtcacaactccaactacaccgcatggaggatccgcggataa

SEQ ID NO: 6485 - DNA, 213 bp, A.fumigatus
attagatctttgacgaggattgcgctagaaaatggcgccagaagcctcgagatgatggattgggtcatcgaggaagttacgttcaaggctgaaacattcctcaaaaaggaaatggtcattgtgttggacggagacgtcgtcaaatccaacattgctatcaaagatatagcttgccctccaggcggatgtggagcctttggagaatattgctga

SEQ ID NO: 6486 - DNA, 204 bp, A.fumigatus
ctgtctttcccattcaggaggggccaaggccttgggggtgaagatgatcccttcagcgtaatcaataatggcagagccggaaccaaaggtgagtttcttgacttgttcactacatatagtctggattaccagtatctgccatgtgagatcaactttaaagacactactgagggctgccgtattgcatcctcctacaacaattag

SEQ ID NO: 6487 - DNA, 396 bp, A.fumigatus
gtaatgatacctcaggtggtcctccggagattggagatgcagcgtgtgctgttcatcattctggaggcgagacaagatggagaggagagaaccaagaattgcagtgtagccttcgtgttggtgcaatggtggagttacgctaagagacttgcatgcactggtgcgcatctcatcccaggtatgttccattgtatggtctttagtggatatgtattccatattcacatgttcctgcaagcttgtgcacttctctcatcaaagctggttctgaggagtggtatgatcatgagcgcttggtgccaagtgtccactcagactccttttaagggccatatcagattctacagcatcaataacaatgcagaggttctgcatgcatcgctcaagacggtgtaa

SEQ ID NO: 6488 - DNA, 453 bp, A.fumigatus
agtcatctctcgcagtcaaccacacacagatcaatcatggctgagaacgctcttcccagccccaaacgctacataaccgagaacgatgatgagggcaactcctttttctcgaataccctcagcgagtcccttcctgttgtgaacgatctcggcggagctctcgcacgtctgggctatactacaaatagaccacccgtggtactcaccaacggcaacgacgtcaagctctacgagacatcgctcaaggagctacctccactggtgactccggggggcggtgccaatgtttggtatatcgacacgcctccagactcggaaagtcccgtgcatcggaccgtgagcctggactttgtcttccagatcgcgggcgagatcgagcttatcctgtcctctggtgaaacgcgcatcttcaagcccggggacttgactattcagcgatctactctgcactaa

SEQ ID NO: 6489 - DNA, 723 bp, A.fumigatus
gcaaaccccgaatcgccaatctcggagaccggttcggcttcctcgaccttcgctcctgaggaccgtgttgtgctcgggtacacgcgcaacaacgccggtggtctcaaggatgccatcgatttcttgatctcccggcttgtcgcccatggccttgatgccaccacggtcaagggtgcgatcccgcgccccaagtccgactcgtttgaagagtccctcccgttcttcgactcgaaactattgcagcatgctcccgcgcccattgttaccgactcccccacccggcccagcttccccgatgagacgagcgagcgaggatcgattttcgagaggcttcggaagcccggcagcatctcctcgttttcttctttcattggtcgtaagaaccattcggcttctcccggttcgttctttaaacacgcatccagcaacgcgtcaaaggcctctcttgtttccatggagtcccgagacagtggctaccgcaacccatggaatgactcgggtgtgaatctgccggaggacgacttacctgtccttggcagttcccacagccacagcaacagcacaaacggttggccagcacgttttgataccaaatttccgttcggtaccgcgccgggcgacatgactcccaagcatgatccccgcgcatcttttgatagtggtcgtcctagtacttccaattctacttctggatacccggctcctattgggccaccgcgttaa

SEQ ID NO: 6490 - DNA, 186 bp, A.fumigatus
aagaagctcaattaccacgtcttcttccgcgcctgtgaagataagtttgttattctgggacagtctgaatccggaatgtgcttgaaggagcaggcttcgggcatcgcttgggtctgcatcaacgatgatatcaatgtcctgagtcaaattagctgtaagactcatttgagggttgacaaggcatag

SEQ ID NO: 6491 - DNA, 1785 bp, A.fumigatus
  unsure (38): Identity of nucleotide sequences at the above locations are unknown.
cgcggatcttccgggccgtgtggaagacgactcgccangaatataatgaagaagatggcactgcagaccctccctctcctggaaacacagaacaacgcctcaagctacggcatgtctgagtcactctttacatctttgaaggacattttcgagtccgtcgttgggagtcagtcccgcatcggcattatacgtccgcaacagttcttggaggtcctcaggcgagaccacgaaatgttcaggacggccatgcatcaagatgcacatgaatttctgaatctattactcaacgaagttgtcgctaacgtcgaagccgaggcttccaaacagcctcctatagaaaaaagccttcctgcgccagagactgctgactccgtagatcaatcgtcgagtaccggctcgaagactcccaatactactcgctgggttcacgaactatttgaaggtctcttgacctcagaaacgcagtgccttacatgcgaaaaggtatctcagcgtgacgaagtgtttttggacctttccgtggatctggagcaacattcatcagtcacatcttgcttaaggaaattttccgccgaggagatgctctgtgaacgaaataaattccactgtgacaactgtggtggtcttcaagaggctgaaaagaggatgaaaatcaagcgcttgccgcgcatcctagcattacacctcaaacggttcaaatacacagaggaccttcagagactgcagaaattgttccatcgagtggtttatccatatcatctccgtctgttcaataccaccgatgacgccgaagaccccgatcgcctctacgagctgtatgcggtcgtggtgcatattggtggtgggccatatcacggacactatgttgcgatcatcaaaactgaagatcgaggatggctgcttttcgatgacgagatggtcgagccggtggacaagaactatgtcaaaaacttttttggcgataagccgggtctagcatgtgcttatgttctcttctaccaggaaactacccttgaggctgtcttgaaggaacaggaacaggagaatatggactcgaatctggcggctaccgacgcaaatgacactatcttgaagcagaacgggttccctcagtcgcctttggcccacgtgcacagcgcttctcagatcccttcccacgaagataacctccggccgaatggccttaggcgagcccctaccgcgcctcagctttctactcaccacgagcatggagaccccgagagcgctcctttcagtccgctttctccgctctctccgctttctcagacccctcctgtccctcccgttccggagagagtcaccacagttgcaaccccaccaaagaatgatgcgctggccaagaaggaacgggcccgggaagaaaaggaacgaaaagcggctgagaaggaaagagaaaaggctgaaaagctgcgccgcaaggaacaggaagcaagaatgaaggagaaccaacgccgtgaggaagccgagctaaaagccgcgctagaaatgagcaaagcgtccaaggccgaggaagaccgtcgccttagccatgaaaacggcaaggagaaacaaggtggtagtctgagccgattgaaacggggcagcaaaagcttgagtcacaggctcggcaaggacaaagagacgcggagtgtgtcgtcggatctaccgcctgtacctatcccggagcattcaaccctttcgcagactggcccaacatcagagcaacaacagcaacaacaacaacaacaacaacatcttcacccaggcctggaaggacaacgctag

SEQ ID NO: 6492 - DNA, 204 bp, A.fumigatus
gctttcgtcaactgtatccagaaggggaagattactgacacactgcagaggagagttcccgagagcctgtacccggttgcatttgatatatggggccactcgcatacgatatggcatgtctttgtgacgttttccataggtgctcatgtcatgggactgctgcatggtctggagtacagctatagtcaagcagagtgtcgatga

SEQ ID NO: 6493 - DNA, 609 bp, A.fumigatus
cagcttcttccagggacaaagaacagcaaaatggtcttcaatgggctgctccgtttccggatcattcgctctaaacaggtcaaggagatcgccctgggcggaggacatgatcaatcgcagcctgtcgagaaacagactctcctcaccatcaagcagcttccaccatggtacgaccccaacccgttcatcctttcggggtaccgtcccgagacccgctcctactaccgttgcttcgccagttggctatactgccacaacgaaactggaaacatctactcgcatttgattccaggcatcttgttgctttcgtcccagggcatcctgtacgagtacattcgcacaaagcatgagaacctctccaacttcgactggtccatcgtctcactgcaacttgtcacagcctcaatatgtctcctgacatcgacgacgtaccacactctgctgaaccactctgcagccgtcgcgcaccgctggctccagctcgactatattgggatcattgcgctcattctgggcaattttatcagcggactgcatttcgggttctattgtaacccgcagctgaaacatttctactggtcgcttgtcagtaccctgctcgtagtataa

SEQ ID NO: 6494 - DNA, 285 bp, A.fumigatus
tatggatgcctgcagatcctggccttcagttctgcaaccgccgtggccctcctcagtccgcagttcaggggtctcgagtggcgctcgttccgcctggccagcttcgtctgcaccggtctctcggcgtttgcgccaatcggccatgcgtgcatgctttggggcgtgccgtatctctggaagataggcgtgaagtattacctgcttgaaggggtatgtctgatcatcggctgctacttttgggaggtaggctttcgtcaactgtatccagaaggggaagattactga

SEQ ID NO: 6495 - DNA, 501 bp, A.fumigatus
gaatcatccaagtcggctcgacctactactggatcggtgaaaacaagctcaacggaagcgcgtttcagtcgatcaactgttactccagcgaggtacgtgcatacctataggagtcccccggccaaggttaacttcctacagaatttggtggaatggacttatgtaggagaactgctctctcgacagagtagcggggatctcgggcccaaccgggttgtcgagcgacccaaggtcctttacaacgaggccacccgcaaatacgtgatgtggatgcatatcgacgacagttcctataaggaggcgaagaccggtgttgccacgtcgtccagtgtgtgcggaaagtatacttacctgtacgtctggctctttgattgtgcatcagcagtccacaatctaacgcggtggctagcgggtcgtttcagcctttggggcagcagtcgcgcgatatgggtttgttcaaggatgatgacgggtccgcgtatctactcacggaggatgtag

SEQ ID NO: 6496 - DNA, 258 bp, A.fumigatus
ccccgcttggctgtatatataccaatggtcaatgacttgcaggatgggaccgcgttgtcttgcatcattgtcgaaggatctctggcagagtacggtttcataatgttgctcatcagccgtctggtcgctgctctggctcttgcagggacagccatcgcttcgctgcagattgttagctctcaaagtcctgacgtgggatatattgctaatatgactggactagattcccggagggacatggactgcgagtggtactaa

SEQ ID NO: 6497 - DNA, 564 bp, A.fumigatus
agccaatacaccatggcgcacacccacgccagctccaagaagcggcggcgcgagccagtcaccatcgacaccaaactcgtcgagatctacgaggacctcgcgaatgagaaggacgagatccggctaaaggcagcgcaggctcttgtgtcgcagtttacgccggacaagaagcctacggatgagcagatgcgaaaggcgctgcagagacttttccgcgggctttgcagtagccgcaaggccgcgaggattggcttctcgattgcgttgactgagattctggcgcagatttttgcggcacagcgagaagagtcggagatcacgatcccagcggttgtgggtatctgggaggcgcagtctaatgcgtcggggagcgagacgggacaggtaaagctgggtttgaattctgcgtgtttgaaaactgctttgctgacagttgtctcaggaacaaagagatcaccactttggccggctgtttggagcggaagctcttgtcaagtcgtctattctgttcaagggcgcggtgcccccggcagagtggaccaagcttttggatttggtgtttga

SEQ ID NO: 6498 - DNA, 402 bp, A.fumigatus
cagttgtctcaggaacaaagagatcaccactttggccggctgtttggagcggaagctcttgtcaagtcgtctattctgttcaagggcgcggtgcccccggcagagtggaccaagcttttggatttggtgtttgatctcgcgaagaagaagccgtggattagagaggactgcggatggattatctaccgctgcgtctttgatcttgcttcgcaaaaggcgggtgcgaagtatgtggagatcgcactggagcggctctgtgcgaacgatctcgctcgtacgccggaaggagtctcgatctggctggcggcccaggaagcataccccatagctgagttccctggccaagtctgggaacatgatgacccgttggattccccgggagaggaaccctcttgggcctag

SEQ ID NO: 6499 - DNA, 648 bp, A.fumigatus
gatgtgaccaattctgcagacaagacagggattgagcttgcatatgtcattatgggcagcatcgggaacaatatcgacgccatccagagggatttggacgaggttgtcgatgccaccaaggcatacaagacttccgacaatgattacagtgcccgctacgatttgatggtcaaggccacgcgcctgctgcagaccatccgtggccccgtcgatatgctctttgccaattttgagaacgtacataccctgccctgcgccttggatacgagagagacactgacgaaaatagatggccagcatgggtgccctccgcaccctgctcgaagccggcgtcttccacgctatgcccacgggcggacaaagcatctccgccaaagacatatccgcgaagactggaatggacaaggagctgattggtatatctcttctgtgaccccccgaaacccccagaatgagaaaaagaggccagctgacgcgacagtccgactgatgcgcgccctcacccccctcggtcccttccgcgaaaccggcgaggaggaatacgcccacaccccgttctccgaaatctacatggtgccgcagatgaacgccatcttcaaggtgctgtacgtctgctacccgctagatctcacctgggatcgatcctga

SEQ ID NO: 6500 - DNA, 453 bp, A.fumigatus
cgcgacagtccgactgatgcgcgccctcacccccctcggtcccttccgcgaaaccggcgaggaggaatacgcccacaccccgttctccgaaatctacatggtgccgcagatgaacgccatcttcaaggtgctgtacgtctgctacccgctagatctcacctgggatcgatcctgatgtttgacagagtcgacgagtactgcccgcccatgctccgtaaccacgagttcctggccaggaacaactggaagaacaccatgacgctgaccgacaacccctacacacacgtacacaactgcaccgggcagaccatgttcgattacatctcgcaatttcccgagcggctgagccggctcaacgacgccatgatggcgcaagaatcggggctcgtcttgcacggtgtgtacccgttcacgcaagaagctggggggctctggcccgcgacaacggaatga

SEQ ID NO: 6501 - DNA, 189 bp, A.fumigatus
  unsure (179): Identity of nucleotide sequences at the above locations are unknown.
tgccgcggcactgacagagatcgccatcgcagactctcatcatatgcgacagtcaagggacaaatgattgtcatgcgcttgaaagagaaacagaacaagactgtccgagtgcctcaggatacaatgatcagcgtgaatctgacagctctctccggaatcgttgcaggtggattgattancacgagctaa

SEQ ID NO: 6502 - DNA, 231 bp, A.fumigatus
gcaactctgagatctgctgctcgtgaaaagagaggaaagggtcgccttcccttgactgcggccagagaaaatgatcaaattaccgtcatgacttcataccgaaagacgcgcggcgaaatgctcggcccgaccgccgcgacaaacacactaaaccaaatcaagccagatgtcaacattgcccaggctaagcccagaagccggatgctcaccgcccaaaacacatctgtatga

SEQ ID NO: 6503 - DNA, 255 bp, A.fumigatus
cattggcaaggaagttacaatccgcctgcagaggcttggactgaactgaacgtcgatgctgaggctgaacttgctgacatggttcatcaaatcggagagaagagaatcgaaatgtctctgattctggggttgctcaaggctgctgtttttagtgggaagtatccgtccgagtataagactgtggacaacgagcttctgggtctgggcattatgggtgaagaggagttggaagcaatgtttgggggggaaatgtaa

SEQ ID NO: 6504 - DNA, 918 bp, A.fumigatus
  unsure (137): Identity of nucleotide sequences at the above locations are unknown.
tggaggcaatccggcgctcaaaatatacgccgatgtgcgtggggcgtacctgacgtcaagtctacagaatcttgccatagcctcgctgaatactgtcaaacgaagagctgcggacggccctacaagcagggcactancgggatagggatatactccaacgcgctcgaaaacttcatatctaccgaatacgagattattgctcagatcttcacaggcgaccagcgagggctagctctgcaaacgacgttccgatctgcgctggccgaatactcaaaaaccttgcgtgagctcaacgagtatatcaaggccaatctgatgacagactgcttcttagcgttcgagatcatcgaaattgtcacggcgatgtcttaccgcgttgactcgaggacgggcgagctaaagagcttgttcatagaagctcttcggccagttcgtgagacggcaaagtcatctctctcggagctcctcgaggaaacaaaacgcaaagccgcgagcatccctgttcttcctcctgacggcggatcggtccctcttgtgaacgaagtgatgagctcgctcactacattgactggttattccggaccgttagcatccatcttaacttccttaggtgacggcaactggcgctccacagccaatgcgtcagggactgctcctttagatgtcagtccagacagctcagctttgttatcacactttatcctggatatgatcgaagctctgatgagttctctcgaggctcgaggccgagcacttcatcgttcaaaagccgtgcaaggcctcttcctgtccaatgtcttatgcattgttgatcgcgctattcgacaaagccctgagttggcacgccatttgggtacgccagacagtatcgcgcgtatagacacctttcgagaagcgggccacgtccacttttcttga

SEQ ID NO: 6505 - DNA, 324 bp, A.fumigatus
acctcgcgtgccggagcccgaccagcttctggtggcattgtcgattccagcgcaatagtcaagtcgctgtcatccaaggacaaggacgccatcaaggacaagttcaaggcattcaatgcaagcttcgatgaactggtcaaccgtcacaaggctctgtacatggaacgagaagtacgcggagtattggcacgtgaggtacaggccgttttagaaccactatatgcgcggttttgggaccgctaccacgaaattgataagggcaggggcaagtatgtcaaatatgacaaaggaagtctctctgcgcagttggctgcattggcataa

SEQ ID NO: 6506 - DNA, 957 bp, A.fumigatus
  unsure (862): Identity of nucleotide sequences at the above locations are unknown.
accgtttgctacttgtacagaatggctggatgtgcgaagatccttgttataggcgcaggcgagttgggcaaccaggtcttacatgctcttgctcagcatcctaatcgaggtggcgcaactattgctgttttactacggccctcgagcatcgcatccacccatccggacaaagtcaaggaactcgaggaactgcgcaatctgaatgtgcaactgattcctggtgacattgccaaagattccgaggagcaactctcggacatctttggtgagtacggcacaatcatcggctgtaccggctttgcagctggctctggcacccagctcaaacttacgcgtgctgttctggcggctcaggttccgcgatacgtgccctggcaattcggagtcgattacgatatcatcggacggggatccgcgcaagatctattcgatgagcagctagatgtgagggatctactgcgctcccaaaaccggacgaagtgggcgatcatatcgacgggcatgttcacgagcttcttgtttgagccttggtttggtgtcgtcgacttcaagggcgataccgtaacggcccttggaagtcttgataccaaggtgactgtcacagcaccggaagatatcggcaggattactgccgaggctgtgcttggctcgagagctgactcggtcttcggtgacaagccgatctatgtggctggagataccttgacttatgagcagctggggcagttagtggagaggatcaccggccgcaaatttacgaggcatgtaagaacagtggaggctgctcgggctgaccttgcaagggaccctggcaacaccttgttcaaatatcagatcgtttttggtgaagggcgtggtgtancatgggatttgtcggagacgtggaactgtcaggtcgggatccgtgctctgactgcagaagaatgggcccgacgaaatctgcagaatatcatgtag

SEQ ID NO: 6507 - DNA, 1368 bp, A.fumigatus
agctgctgcttccgtcaccagttccacctcgtcccttttcttcccctccgcctcctccccaaactcccgcgaccgatccgacaatatcgaccactcagactaaggtctgagattgcgagaagatatgaagaaagactaaaggcaaggccgacgattgttgagcgctcgtccttcatagcgctcttcgtttcgcccttcaccctgtctcacctgaaatctccgcacgaggctccaacttatccagccctcccagcttcggctgtactcacgagaatgctcatcccgctccgctaccgtcgtcgcatcactctgatctctgcggtgctcggactgttccttatataccacttcatttcaatcagaccgaatctcccgcgaccgttgtcgaccgtccgcagcaacttacaacagcaacgacaacaaccaaaacagaagccggacacccattccgactgtcctctccttcccggcatcgaagatgttctggtgattatgaagaccggcgtgaccgaagcgcttgacaaagtccccgtgcacttcgagaccaccctgcgctgcatccccaactacgtgatcttctccgactttgaggaagaaatcgcgggtgtgcgcatacacgatgccttacgcaacatggaccctgaggtgaaacgcacagttcccgactttgacctctacaatcgattgcagaagctcggcagaaagggtctgggaacgcaggacttcgccgacgaggccaactcagccattgggaaaccgaacaacccaggctggaaactggacaagtggaaattcctccccatggttcaggagacactacgccacaagaatgacgcaaagtggtacgtcttcatggaagccgatacctacttcgcctggcccacgctgctggaatggctgtcaaactacgacccccagaagccgctctatatcggcaccgaaacccagatcgcggacgtcatcttcgcgcacggcggatccggcttcatcatctcccgacctgccctgcagctcgcagcggacgagtacgcagcccgcagagtcgagctcgacatgttcaccgacgagcactgggccggcgactgcgtcctcggaaaggtcctgctggatgccggggtcccactgacgtattcctggcctattctgcagaactcgaacatccgcgagctcgatccctttacagcaggcttctaccgccagccttggtgcttccctaccgtcgccttccatcacctctcctcacaggacatccggaacctgtgggaattcgagcagcgacgaaggaaggtaagatcatcctcggccttgcaatgctcaaaacatacatgtgaacaattgattaacgggttttctagtccgccaaacacc

SEQ ID NO: 6508 - DNA, 477 bp, A.fumigatus
aacgcacagttcccgactttgacctctacaatcgattgcagaagctcggcagaaagggtctgggaacgcaggacttcgccgacgaggccaactcagccattgggaaaccgaacaacccaggctggaaactggacaagtggaaattcctccccatggttcaggagacactacgccacaagaatgacgcaaagtggtacgtcttcatggaagccgatacctacttcgcctggcccacgctgctggaatggctgtcaaactacgacccccagaagccgctctatatcggcaccgaaacccagatcgcggacgtcatcttcgcgcacggcggatccggcttcatcatctcccgacctgccctgcagctcgcagcggacgagtacgcagcccgcagagtcgagctcgacatgttcaccgacgagcactgggccggcgactgcgtcctcggaaaggtcctgctggatgccggggtcccactga

SEQ ID NO: 6509 - DNA, 192 bp, A.fumigatus
gacagggtgaagggcgaaacgaagagcgctatgaaggacgagcgctcaacaatcgtcggccttgcctttagtctttcttcatatcttctcgcaatctcagaccttagtctgagtggtcgatattgtcggatcggtcgcgggagtttggggaggaggcggaggggaagaaaagggacgaggtggaactggtga

SEQ ID NO: 6510 - DNA, 360 bp, A.fumigatus
cttattcttgcagagtatgatgatgataccacaatcattccccgttccacttctgttatcgctcggaggttgcctgcctctcggcctggcaaaggcggcgctgctcgttatgtatctgggaaaatgcccgttagcgctcgcggtgcgcctcgtaatgatgctacaatgtcgacccgagctatatcaaatactagcagcacagtgagcaacagcgttttagagctcaataacgcgcagacagaggaggagaagattaatgctcttttcaacctgcaagcaagccaatggaaagagcaacaacaggagatggcaaagtatgcatatacctgttacatgtggatgtactggatgtactgctaa

SEQ ID NO: 6511 - DNA, 522 bp, A.fumigatus
ttacattcacaaactcacttgctggacgcgcaattcaatacaatgtcatcctctgttcacttcaagttcaagtctcaaaaagagccttcaagggtaactttcgacgggaccggtatttctgtttttgaattgaaacgtgaaatcatcaatcagagtagattgggcgatgggtcggattttgaattgtctatttacaatgaggatacaggcgaaggtaagctctgcggttttgttcttattacttttcttcgggctggtgtttcgaggaagaaaccagaaaactccgaaaaaggaaaaccagaaagcgtcatcgttgacttattcttgcagagtatgatgatgataccacaatcattccccgttccacttctgttatcgctcggaggttgcctgcctctcggcctggcaaaggcggcgctgctcgttatgtatctgggaaaatgcccgttagcgctcgcggtgcgcctcgtaatgatgctacaatgtcgacccgagctatatcaaatactagcagcacagtga

SEQ ID NO: 6512 - DNA, 405 bp, A.fumigatus
cccattactccactacccatggacgctacaatgccaccgatgagtgcacctccaacaagctgccctgcacttgataatatgtttatcagggcctgtccagatgccctgtgttcggggggagtttcagatagcattatgtacctgaggggtgcccctatgacggttatgagtccgagggccatgagcacctcagcaagtatgaagagaggggtggttgatgagaggagggccatgatggtacacccaaccatcaggataaggctccctgagatcatcactacccttgaaccaaccctgtccagcagaacacccacaatgggggccgagagggccatggtggtgacgaaggggaggaggctgaaactggccatggactctgacagtgaaagggcgaggagggcgtag

SEQ ID NO: 6513 - DNA, 402 bp, A.fumigatus
ctgggtatgaatacgattgcagcctgggataggccattaccagcagagattgcggttgcaatgcggacctcacggctggccagcaggtcaacctgcaccacgggatcgggtgcagccctttcaaccctccaaagtatgggtgtgagtgccgctgcccagatgagaagtaccactacaatggggctcatcaaactccctgtgaggtcagtggtatcgatctggtttatccccactgcaagggaggcccacaatgatggcaaaaaaagggtccctctggcatcaaaatcaccatcctccgttttggctgtaactggcaacataaagaaatcccccgacaactatcgtggccgcatttgggatgttgatgaggaagagccactgcccaccataggggaagtttga

SEQ ID NO: 6514 - DNA, 855 bp, A.fumigatus
ttgtcgggggatttctttatgttgccagttacagccaaaacggaggatggtgattttgatgccagagggaccctttttttgccatcattgtgggcctcccttgcagtggggataaaccagatcgataccactgacctcacagggagtttgatgagccccattgtagtggtacttctcatctgggcagcggcactcacacccatactttggagggttgaaagggctgcacccgatcccgtggtgcaggttgacctgctggccagccgtgaggtccgcattgcaaccgcaatctctgctggtaatggcctatcccaggctgcaatcgtattcatacccagctacgccctcctcgccctttcactgtcagagtccatggccagtttcagcctcctccccttcgtcaccaccatggccctctcggcccccattgtgggtgttctgctggacagggttggttcaagggtagtgatgatctcagggagccttatcctgatggttgggtgtaccatcatggccctcctctcatcaaccacccctctcttcatacttgctgaggtgctcatggccctcggactcataaccgtcataggggcacccctcaggtacataatgctatctgaaactccccccgaacacagggcatctggacaggccctgataaacatattatcaagtgcagggcagcttgttggaggtgcactcatcggtggcattgtagcgtccatgggtagtggagtaatgggttacaggttctcattcctcttccttgttgcagttgcattcacactcttcctgctatcaaccggtctcaagggaagaaaggaacagcttgagacaatgaagaggcacatttaa

SEQ ID NO: 6515 - DNA, 1455 bp, A.fumigatus
  unsure (1334): Identity of nucleotide sequences at the above locations are unknown.
tttggtaaccttggtagcgagggggctgcgaaacccaaaaaagcacaggataacttgaagacgaacacgttctgcgtccctgacgacgatgatgaggtgattgagatcgtcgacgaggcccctataaatcctgaatcgactgggtcttatgtgcccgaagacccagacacttcctcggactccgaacatcaccagtctgctgggaactcaactcccgtgacttcgcctctgaacaaggatgtttctgtagaatcggtggagaacaaatcctctgcacccttcagtgagcttcaaagtcatgtggccagatcgcagcaaagtccggttgatcttgaggaagagaacaatgagcaccgccttgtaactccgcggatgaccccaccgtctgtcgaggatacttacgaaggttcctacaccggtatagctgatgatatgggtgacatcgattatgctccagatcatgaacccgcacctactggttacagccgaggggactcgaccactggatccgatggttgggaggaaagtgaagagcaagacgagtctgacgatgatttaatgcctcattcatctctcagtgttgacaccgatgagttcggtagagaggccgatgctatggcatccaataatccttcgacttcagtgatttatgagtcgctagtggctgtggataacggagcccggtcggaagaggaggaaagatcgcaacccactcaaaacgatgcaccttgctcgaaagcggtcaccagtggcgagcgtgtttgtctccagaccgctgctccgaacctgaacaactggaaatccacggcgagggagaattctaccgagtcgtctcccctcaagttcggctggtcgtccatcccacggcccgtcagagtctccaatctggtgtcccggtctagcggaagatccctcgatcactcacttgcctgtttccataacaccacgtcgtcaacaagcggggacaaatgttggccgaactttggccatcatcgtatcaaccctctaccgcaaagggaaagcaatggcaatgctatatcgcaaaatcaccgcacaccggatgctccttatagtgatgggccattcgtcaacagtcacacacataccgctttcgatgaatctgacaaggggaatacagttcactctgccgcttccactaacatcagtcagtcaagtcgagagcaacaccccaatgaagagagtgtcgagacttgggacgacagcagccgcgtggaattgcaatcaaagaatcattcagtatcatctatggccggatcaggagttacgcgggactccaatacacgccactctatggctgacattggtgatacttncgaatggacagctacatctggcttcaagctgtcgcggaagaggaaggttcctgacatggaattggacgcggaagaacttgtccaggccttacgggcaacttcccgatgtaactgccaatga

SEQ ID NO: 6516 - DNA, 732 bp, A.fumigatus
ctgactgcgggaacaaaggggttacttcacctagaagtcgctttcgagaatgggctgtgcaagattcgtccgacatggcactccgagaatatgttgccgtttacagtgacgcgatacgccaggaccctcatcgacacggttaggctgtgcatttccaattgcgatgccgccatccaagactgccttcggcctaccgcatacgatctcgacgagatatggcgctggaaccacaacctgcctcccacgtacaatttctgcatgcacgaaataatctccgaccaggctcagaagttccccgacaaggaagcaatcgcatcctgggacggcagcctgacttacagacagattgatcagtattcatcattcgtcgcgcgctcacttataggcatgggagttgggctgcatgatgtcttaccagtctgctttgagaaatcccgatggacgattgtcgcggttctggccgtaatgaaagctggcgcgacgtttgtactaatggacccgacgcttccacttgcacgattgcagaacatggcccagcaggtcggcgcgaagatgatggtttcatctcggggccagtacaacctggcgacggagatcatacccaatgcaaacgtgctcgtcgtggaggaaaacacgttcagcagtctgtccgccgaacagaacggcgagcccctgccaacggttgtcttcaccacggggctggaaggatccgaggctggtgctatcccaagg

SEQ ID NO: 6517 - DNA, 1617 bp, A.fumigatus
aacttggaagccgcctgtgggctcctgcagcacgtccttggctggaagagcctcttggcgggaataactactttagccctcctcatgcttctgaatcatgcctgtatggctagatatactctggcagggaaaaatctgatggcctgtcgtgaccgcaaaatcatcgctttgacggaggcccttcgtggtatacgacagattaagttctctgcggccgaggataggtgggaagaacagctgaaccaactcagggatgcagaattgcttgcccaggcgaccagctttcggtggaatgtgacatgtttctccctttgggttctggccccgatccttctatcggtagcatctctctccgtctacactatcagccatggagagcttacggcatctgttgcctttaccgcgatttctgctcttacttcgatcgagaatgctttgtctactcttccagagctgattacaaacgcaacggatgccttgatcagcatgaagcgcattgctaactttctggacgcccctgaaagaaactcctctacagtactactatcgcccagcatccgcttcgacaatgccacagtcgcctggccagatagtactcaaaccagcgatgtttcgccaggaacacgctttgtgctgcggaacttgactgtccactttcctgaacatggattgagccttgtgtgtggccgaacgggctctggcaaaagcttgttgctttctgcgatacttggcgaatgcgaaattctggaaggtatagtcaaaaggccatcaattagaagcatgtacaagcgtcctggacccggagaagattggataatagactctgccacagcttatgttgctcagactccgtgggtagaagcagctacgatccgccagaacatcttgttcggaatgccgttcaatggggaacggtataaaaaagttctcttcgcatgtgctttagtccgagatctgcaaatgctggaaggtggtgacctcactgaagtcggacccaatggagtgaatctgagtggcggccagaaagcacgcatctctctagctcgtgctctttacagccgcgcgggcatcataatcatggacgacatcttcagtgcagttgatgttcacaccgcgcaacatctgtatgagcatgctctaaccggcgaacttgcaactcgccgcactaggatcctcgtcacgcatcatgtgcgactctgtctaccgcgggtggactacgtggcctatttagacagcgggaatctcatattcgctgcatctttgactcagatgcgacacagcagcgtactcgaggagcttctccgcagtcagttcgacgtggataatacagcagctgtgtatgagattcccgaagcatcggcgtcccaggaccgtttggcatgcttcaacgaaagatgtcaaagctgcccggcagatcttcggttagcacagcatccaattgtttctaaacgtccgagaaatttcatcgaggaggaatcccttgaaaagggggccattcccttgagcgtctttcgtcgatacatccagaaatgcggcggactgcgggcatgggtcgtgctggctctctgctttgccacatatactggcctggcgctcggaaaagtaagcttcccctga

SEQ ID NO: 6518 - DNA, 1020 bp, A.fumigatus
  unsure (135),(148): Identity of nucleotide sequences at the above locations are unknown.
ggaccccggaggatccagcggaggggaaggcgctcttatcgccatgagaggatcgcccctaggcgttcagaaccgatattgcaggtaagaaagctcctggtcgacaggaagtggttaacaaaccaggttcaattngaatccatgcttntatgctgcggaacgtacggattccggcccagtgcatctcgtatcccaaacggtggcggacgcagctgtagtacccccggaatgaagttcatcctgtcctgtgcagggccgctagctctggatatggatgcagttgaggtctttttgaagacagtcatcgatgcgagacccggcctgtacgattcctcggtcatcgatggaccctggagacaggcgacggtcaaacatcccttgcgaattggcgtcgtgcctccagactatagcttccctttgcaccctccggtgaaaaggaccttagcgaaggccgtcaagttattgaaagctcaaggccatcatatcatcgagttgtcagccgaggaatgtaaggtaatggagatcaacgaggtcgcatggaatatctttactctcgacagtggagccatggaacacttacaagcggccggcgagccaccggtgcctgctctccttaacgtccagcgtcaggtagagatactgaggcaggcggggaaaacttacctacctgatttcagccatttagaccgactaggaagactcgctgctctgaacaccaagcgagccgatcttcgagagacctggaggaagatgtggatcagccacgatctggatatttgtctcgcgccatcagctcaaaacacggctgttccgcacgatatgtttgggcttgcaccgtacacgactttcctgaactgtcttgacgtaagctgtctcttttgtcgcttgaaaatttcgtctaacgatgctcagtatccttcatgcattatccccttcggacgggtcaacgagatggatgctcgggagacttttgagcttgctccgggtcaggctggaccgagctgtaagtacttttgctga

SEQ ID NO: 6519 - DNA, 366 bp, A.fumigatus
agacagactcggcccctatcccaggcttgtcggattatacaaatggactcccaaaactccatatccggctggcagcacaaagtcgcccaaaaacagcaggaatgcctgcagaagatccccgctgagtggaagatcccggaaagcctcctctcttccctccagctaccactagccgagaacagaaatgacctgattcaaggagacgctgttcgcaaagctggtatcctaaccgagcgagaactgcaaatcacagagcaatacaccgtgtctggccttctgtcagcattggcagatgggcgactgacctcgcttgaagtgacattggcattctccaagcgagctgcagtggcgcagcaattggtatga

SEQ ID NO: 6520 - DNA, 324 bp, A.fumigatus
gtaaactgcctcacagagaccatgttccccgaagcccaagagcgagccaaatatttagacgaactcaaggtgcaaggcaaatccgcaggaccgttgcatggcttgccgatcagcatcaaagaccttttccacgtcaagggaacgcatgcgtcgattggcatgatctcctttctggatgagaaatcgaccgacaactcgcctttgatcgatattctgctgagcctgggagctgttatctatgtcaagacgaatattccccaaacaatgatggtacgtcttcgtactagtctcggatgtatgatcactaaccatttcctaccgtag

SEQ ID NO: 6521 - DNA, 1458 bp, A.fumigatus
aattttatcctagtcagcctacttcatcgacatcttctcgttatgccgctgactatcctctcccaagcgcagctccgctcgctgctgctgtccctaaaccgggatgaggtgtcctcactacagcaaagcctcgcccaggccctactagactattcaaccggaagccaggaacagggttgtgccgctacttaccaacctctacggaccgctatcacccggcagaatggctgcacgacactgtttatgcccgccagtaccggccgaacgatcggcatgaagatgatctctctacaagacgggggtgctgcagggtgtgctgtggaaggagcttttgaaattcccgagggaacaaagactgcttcaaggtcgcggtcggcaggcccaaggcgctccatgacgtccctgtcgtctgaaatgagtgatctgtctatatcatcacaggaagaaggatcgtcgagttcatctagcagccgatcgctcaggtctgacactgtgaatcgacaatcggttggctcgagctccagctcgggcatctccaagacactcggtgcatggcccggagccggtactcgagacacctcgccgcagggcactgtgacgttgctggacgccgacagtatgccattcgggctgatcaatgctcatgaactcacaccgttccggacggctctggccacgatgatgattttcaacaagcgcaagagagtgcgcactgtagtggttttcggggcgggtaagcaggcttactggcacattcggttggctctcacgttgcgtgcggcggatattaagcgggtcgttatcgtcaatcggtcgtttgagcgggcagccatgcttctcaaagatatatactcgactgaaaactccagctggcgcggtgatgtgaaattctccgctgtcagtactgatttcggcgagtacgaccgtatcatccaggatgccatccataaatcggacgcaatcttttgctgtactccgtccatcgagccactttttcccgccgagcttctcacctcccgcgaaggtcgccaaaagggccgattcatcagcgccattgggtcgtacagacctcatatggccgagctgcatccagacattctgcgcgacgaggtgaacgcgcaccattccggtcgacatttccacaaacacatcaaacgtagtggagtcgtggtagtcgacagtctcgaagctgctctgaaggaggccggagaattgatccaggcggggatcaagccgaaccaggttgtcgagctgggagagctgctgatggtacgggacgcttcgcgaaaggacaacaaccaggacgtggaagacaccaagagtctgcgcgagtgggttgaacgaggcaatgtcatctacaagagcgtcggcatgggcttgatggacttggtgaccggaggcgacctcatccagatggctcggacaagaaatttgggaaccagcgtggaggacttttag

SEQ ID NO: 6522 - DNA, 585 bp, A.fumigatus
aagatacgtccttcgtgccgcttgttgaaaacacatctggatgctcttgctctgaactttgccgcgtctctcaaagatctaaaaccactaaagtcagcctttgcagtggcagaagcaaatggattccaactctttctctcttttgattatgtgggtgctggcccctttgacaaagccactgtgatcacgatcattaacgagttcaaatcgtcgtctgcgtattatacctacaaaggaaagccgtttgtgtcgaccttcgagggtcctgggaacgcagcggactggaaagacatcaaagcagagactggatgcttcttcattccctcatggtcctcccttggggctaaggaggctctgaagctgggcaccccagatgggctcttcagttgggcagcctggccatgggacaatcaagacatggatacgtacgttgatgcatcctacctcgactatctgggacaggctggaggcaaggagtatatgatgccagtctccccatggttctacacgaaccttcccggatatgaaaagaattgtttatggcgaggtaatgtctcccggagagcaaaacaaacagagaaatga

SEQ ID NO: 6523 - DNA, 765 bp, A.fumigatus
  unsure (662): Identity of nucleotide sequences at the above locations are unknown.
tcaattgaatatctaggcgacgacctctggcgagaccgctgggaagaagttatggtggtgcaacccgatttcgtccagatcatcagctggaacgattatggggaatcgcattacatcgggcccctgtacaacattgataaatatgaggcgtttagtgtgggcgaggcgcctgtcaactatgcacacggcatgccacacgatggctggcgtctcttcttgccctactacatcgacatctataagaatgggaaggcatctatcacgaaagaaggagtggtgggctggtaccgcccgaatccttcttcagaatgcaacgatggtggtaccgcagccatcacggccagtcaattgcaatatgagtttcggcctgcagaggttgtccaggataagatcttctattcagcactgctgacctccatggccactgttaccgtcactgtcgggggcgtgtctattcctgctacctggcaggatatcccggacggaggcgtgggtgtgtaccacggcagcgttgggtatggtactttctatggcgatgtgaagatctccatttcgcgcgcacgaagtactattgccaaattcagcagtgctgccattaccacgagctgcacagacggctacgccaactggaatgccgttgttggcagtgcaaaaggccccancatctccgctgtttcccccaagcttgctatcgacaaatcaggctgcattgaaggcacaacaccaagcaacttcgaggggctgtgcaagttcaactgtcagtaa

SEQ ID NO: 6524 - DNA, 888 bp, A.fumigatus
  unsure (35): Identity of nucleotide sequences at the above locations are unknown.
tggtactgccccaatggaacctgtgtgtgttacanaaatggtgcgcccagagtcaaacccaagcccacaggcatgaaaggatatccaattgcagttgaagcatccagttacatcgttctctgcagcttcgctcgtcagtacggatactgtccacatgcagcatgtgccccggtggaggtgcccctctcggagcccacggtctcgcgtttcctgccgtccgcatgcacggcaggcaccggccagggcgacctggcggggctttgctcatacgcgtgcacgtgcaccggcactggcgctctccatcagccccctgcggccaatagcaccttcaccgcattctaccaaggcgacggcgacgacgccggcttgtgcaaatttgcctgtcagcacggctattgccccgatgcctgcgccagtacagaaggtgaagttccgtcctgcgacgaggatgacgacgacagccccgattgcgcgttagaagacaccccggacctctgcgatctcagtcttcacttctcttcgtgggaagctctccaggcagccacagacatccccgagctctgcatgcccatgtacgccatgcaggttctgatggacacactcaacaccgccctgcggaactacacggacgtcaacaacggctatgacgaaaaattcggctactacgtcaaatatctccgcggcatggtgccagaggtcatcaataaggttatcgcagataacggtaaatacgtccaatgctctcaggcgatcaatggggggtggtctaaacccagatcatgctttatcccgcttgtcagcgattcatggaccgtcaagtataccttcgtcgacgagcaaggattctacgacgaattgcaatccaaatacggcatccagcgggactag

SEQ ID NO: 6525 - DNA, 429 bp, A.fumigatus
ctaagcaatcgatcacagcatactctttggcgtcttgatcaaatgcacatataccggcgtcaaagccttccctctcagcaaaaactcctcaatattctccatcgccaaccgttcaaaacccacatgcgtgtcaaccgtaccgccggcattatgccgacatcatcatcactcgcccatgtctcgccagccggggatgcacatacggctcctctgcatgaacatccaacccagcagccgacatctgcccttcatcaagagcccgcaatagcgcctcctcgtcaaccaatgatccccgcgcgatatagaagaaccgcgccccgcgctagaacttccccagcctctccgcatcgatcagcgtcctccccgcaaacggcgttgcgaccaccacgcaatccgccaaccccagcaattcgtccaactcgcccatga

SEQ ID NO: 6526 - DNA, 330 bp, A.fumigatus
ctccgacgttgtcttccaccgctggttaagactgattcttctcatctcttgcaaccactagatattagttgttttggccctttaaagcatgcttatggaggccttgttgagcaaaagatgcgcttaggatacaactatattaataagtttaacttccttaaagcatatccagcagctcatctagaggtctttacacctctaaatatccaaaatggcttcgcggcagctggaattcaccctttaaagctagagagggtgcttgagaagctaaatatccatatctcaacccctaccccccctctgagccgtgcatcaactaactcatcttag

SEQ ID NO: 6527 - DNA, 435 bp, A.fumigatus
cttactacacctcatacacttcagcaattacacaagcaagcatcctcagtcaagaagctcctaaaacaacaatctcaaagccctttgacgccttcaaaattagctatccagcagcttattaagggttgcaagatggctatacataataccgccctactagcaaaggaaaatcatgatctacgcgcagccaatgagaaggagaagcagaaaaggaagcaatctagacatcagatgactcctaatgaaggactcagtatacaggaagctagggatctcatccaggcgagaaatgagcaagggaatgaggttgaggggtcatcaattgattctgcgcctttacctttagaaccaccaaaacgcgcgccaccaaggtgtttaaattactttattatagggcatacgagagttagatgccctacacgcaatactagctag

SEQ ID NO: 6528 - DNA, 201 bp, A.fumigatus
ggagagtttcgtacacgacttttggtcttcggatttttctggattgggacattgccccggaagatctgcatttttgcctcaggctatgttactcttaccacctcggtcacacccgacccgacaatcgttgtatgggattccttacgtatcggtcaacactactatgtcactatccagaaaggtatgctggtgcagcaatga

SEQ ID NO: 6529 - DNA, 420 bp, A.fumigatus
ccatcatcgctgcagactcattcctcaaccccgacatcacccgcggaactgtggagaagtagatcggagagtatccttgaaactgcccttgagacctgtatcatcgtgagcatggctcctgctgagaacattcatataccccgtggttcccgccccgaaccaggtcctctctactctgatttcttccaacaacaagtcgcaaagcagcgcaataataattatcattcgacttctctaagaaacatggttgccacatcagttaatcacactgctctgcaccccggtggtgttcagtatgtcttcccctatctaccttgctgccttgtgaatcccctccagtgcctttgccactctgcttcagtgtccatctcgtcctcttgcctatcctcatcgcaccacactttcacgcaaacaaagtga

SEQ ID NO: 6530 - DNA, 321 bp, A.fumigatus
  unsure (43),(141): Identity of nucleotide sequences at the above locations are unknown.
acccggattggatggattagtccccaggccaggattcccctanggaacaacggaaccaccaagggaaggatttggaggaaagagacccccagacccagtggaacgcactcagggcagggggcaccacagacatgcaaggtntacccaatatcttccacacttaaaggacgaatcgattccggaacaatggccagtgacacaagctcccgcctttccgagcacgtcacgcacaatgatgcctccggtctccccacctttacctggccacgaacccgttaccgactcgggagtcccaatgacagcgatccgaattccccttga

SEQ ID NO: 6531 - DNA, 612 bp, A.fumigatus
  unsure (98): Identity of nucleotide sequences at the above locations are unknown.
ggaacaacggaaccaccaagggaaggatttggaggaaagagacccccagacccagtggaacgcactcagggcagggggcaccacagacatgcaaggtntacccaatatcttccacacttaaaggacgaatcgattccggaacaatggccagtgacacaagctcccgcctttccgagcacgtcacgcacaatgatgcctccggtctccccacctttacctggccacgaacccgttaccgactcgggagtcccaatgacagcgatccgaattccccttgaggatgtggagcggccaccttcacccccggccaaagcttttctgagccaacctggaacctcggcagagctgccaagcgcggctgaaccatcctcagcacctgcccccaacgctgaaccgactactctgcgcgttctcgttgctgaggacgaccctgttaacagcaagatcgtggagaaacgactcagtaaattggggcacgctgtcatcctcacaggaaatggcgaagaatgtgcagctgcgtttcgccgtgattctacgaaggtcgacgttgttctgatggatattcaggtgattaacttcatttcctccgtgatgtattccaggccatgctaa

SEQ ID NO: 6532 - DNA, 219 bp, A.fumigatus
  unsure (16),(69),(71),(78): Identity of nucleotide sequences at the above locations are unknown.
attggaactttgcatntcgagaagttggcaccttttaaggaacaaagtgaaaagaaaaagggagccacncnatgcccnatacctaatattccccacttgaaattcaaccatctccttgctgaaatcacttttttctctaccccgatctctctccccttggcatgggcccctcctccgaatgcctgttacggcttcctgccggctcccacaggggcgtaa

SEQ ID NO: 6533 - DNA, 528 bp, A.fumigatus
ccagctctttcgatcgtttatagcggagatatcaatcccgtgcgcaagatctgttacatcggcctcgcaaataacctcagctccggcatagccagccgtccaaaggatgagaaggtcacttggaccctggacaaatacaatcgcacaccaggcacgctcttcactggtcttcgcgtcttggctgatcgcgccacgcagataccagacttgcctgattctggagtacggcaggtagttgtgcgcatcactagccgtcagtcaacgagcaaggtcactattcccaccaagcgcggtgctgaaagcgctgtcgctgcagagcctacgccagctaagcagcaagattgcactgaatacatcgttatccagaagcttcggtggaccggtgaagaacaggagtggcgtatctggggccatgccactcctacgactgtcgaagatctcgacagccccttctttgccccaggactcacactctccgagcgcatggatgctatgaaggacatgatgacaggaaaaaaaatgatgtga

SEQ ID NO: 6534 - DNA, 309 bp, A.fumigatus
  unsure (294): Identity of nucleotide sequences at the above locations are unknown.
tttgtattattcagcgtgataaagggagtctggaccgttagacctcgttacgaactgtaccatatcaagattgcacttctcgttattcatgtgattactggacatatctcaaaattggactgccaatacatccaaggcaggaatacataccatgtcctgaaggtgaattatgaaacaggagtggtatctcatcagaaagacagtcaatccaacgtcaaaagacgcaatatgtacatcgggggctatgtgaaaacgatgggaaatatgataggggaatcaagaacgacgattganatgtgtaatctgtag

SEQ ID NO: 6535 - DNA, 345 bp, A.fumigatus
  unsure (84),(167),(273): Identity of nucleotide sequences at the above locations are unknown.
atctgcaagaagcctattcgtcatctcatccgtcattctgaaactcccgataagtggaaacacatagcagaaatagacatgtangtcaaagtcgctactggatgctctcagcattctcacgcctccgctgtcccatgctgctccctcacacccagcggcgtatgccntccactactcattgaccgacctacatcctccgatggcaaggacgaacgtccattagaccccttccaatacgactgccccgaacaggacggaacgcttctctcatcngaaaacatgatcgactcgcgatccaaactcacgtggctcgctgttttcgcgtcctcggcggtcgggcccaaa

SEQ ID NO: 6536 - DNA, 1914 bp, A.fumigatus
  unsure (1228): Identity of nucleotide sequences at the above locations are unknown.
acagacgataacacttcgtttgtcgagatgacggaagaaaaggccgtaccagggaagctggaagtcgcgctcttcctcgccgcgagcaaaggctacgatacgatcgtcaaactcctcctgagcacccccggggtgcgtctcgacttcaaagacgaggacgggcggaatgcggtctccctcgccgcagagggtggacatgagagtgtcctgcagatcttgctcgagaccgggcaagtagatgtgaatgcggtggatactaaaacaggccaatccccgttatgttgggcagtgaaaaacggacatgcaggcgtggtgagcaaattactcgctgttgagaatatcgacccgaatattcccgacgccaacggcgagacgcccttgtacgcggctgtgaagagcgagaatggggggataatcgaccaactactcgcacgggcggatctcaatgcaaacaccccggacgctgctggacagacacccctctactgggctgtgaagaacggaaacgaagcggtggcgggggcattactcggacgcgcggaggtggacccgaacgccgctggtgccgatggacaaacgccgttgtatttggctgtcaggaatgggcacgaagggatcatgaatcgtctgctcgcgcgcggtgagaccaacccggacatccctgacgcgaatggccagactcccctctactgggctgtggaacagggaaacctgccgtttgtggtgcagctgctcaaggtgaatgccgacccggatgtcaaggataatcagggacggacgccgttgctatgggctgcggagaagggacacgaggaggtggttcgattgctgatcgggtcgaggagagttaatgtgaatgctgccgatgcggtcggcaggacgccgttgtggtgggctgcgagaaacggtcacctccctgtggtccgactgctcgtgcgcaacggggcggatcgagaagcgcagccgtctcctgatgacgaaaaggtcgctcatggcacgccgctgtaccaggccggcaggaagtaccataccgacatagtgaaatacttgatcaagaagggcgctgacatcgattgcccatgtggagagtccggcctcccgcttctgttggcgctggtggtacacgatcgcacgaagcgcgggatgaaaatgctcaatgcgctacttgagaaaggcgccaatgtcaacgcgagggataccaaaggaaggactacgcttcacatattancaaaggatggcgacatggatctgactgccctgttcctgcagagaggcgcccaggtcaatgctgccgccaaggacgggacaacaccactgcatctggccgtgattcatgaacatgaggagatagtcgagatgctcctggccaacggcggagaccccgaagcagccgatcacacaggagatacaccccttcatctcgccgtgttcgcaggccatagacgactagtcggcttgctactagagaaagactgcgatatcaacgtgacgaaccactgtggagaaacaccgctgcacaaggcagtggaacgcggccatcgcaagatggtggagtttcttttgaggaacggggcggaactcgaaatgcaggacgactataagaggaccccgctgcatcgagcagtcaaggcgaagaaccacgtaatgaggttgttggtcaataaaggagccaacatccacgcgacagatatgtacggtcagaccgcattacacatcgccgccgaggcgggactacgcgacgacgtggactttctactgggccacggcgctgaagctgaagcgaaagatcacaagggtcggataccattagatctggcagttaaggctggcgaggtcgaggtcgaggagctcctccaggaaatgagtcttgtcgtcgtcgacgcatcgtcaggaagcgaagagtcggggggctga

SEQ ID NO: 6537 - DNA, 204 bp, A.fumigatus
cacgacgttgcttccaaacaggcagacttccccagcatcatgtcgcaacgagcccttgttctccaggaaatcggccaccgtctggtcgaggttgaccgtcccatcccccaaccgggcccgggcgagctcctcatcaaactcacctctgtcggctgtcggcctcacctcctcctgctcccttgcaccgcacaaactaacgattga

SEQ ID NO: 6538 - DNA, 546 bp, A.fumigatus
gtaattcttcttctaccttctttttcgctccctttggcggcggcgtgccagtccgccgtccgtctggtccatttccgtctggtcttggcatttctctttcccgtcgctcgacaatcctctcctcgaccgttgcgacgctgtctactccacaataccacgagcaaccctcacttctttgctcacacggtcttcaatttcagtcacccgcgggataaaagtctaaagagcaagaactatgtcctcatcctactacgtcaccccaagccagcagcgcacgttgcgcgcctgtatggtctgctccctcgtccaactacacagcgtacgtcccctcgctcccaccctctaccacacctactgatcttaccgttttttttttacatgcagaaattcatgcgcgacggctgcccaaactgcgataacgtcctgggcctccgcggcaacaacgacgccatccaggaatgcacctcgcaggtcttcgagggcctgattaccctgcgcgatccgtcgacgagctgggttgcccgctggcagcggttggagggatag

SEQ ID NO: 6539 - DNA, 189 bp, A.fumigatus
gaggaatcgacggcaatcgcatcaatgtccaagtcctcaaacgcagacggcggctccccaacctcaattgccttctcaaactctaaccgccgcacaagcttctcgcactctgccagctttagtttcgcatcgcggttgttgggctcctttttcacgacagccttgaagtctttgagggcttcgcggtag

SEQ ID NO: 6540 - DNA, 315 bp, A.fumigatus
tctctccccgcgcaaaccccgcgtttgcttccaattcctctcttgttctcccatccgtggaaatcgccctcgtgcccatctaccgattccatcgcaccctttgcctcggtcgattactacgctttgcagatggctgcatccgatctcgaggccgccaccgcactgaaagtgcaagggaacaaggcatttgccgagcatgaatggcctaccgcagtcgagttctacacgcaggcgatagacaagtacgatcgggaaccgtcgttcttcagcaaccgggcgcaggtatgtttggggcggagcgggcgtctacactag

SEQ ID NO: 6541 - DNA, 315 bp, A.fumigatus
tacagtggggcacaggcatatatcaaacttgaggcgtatggttttgcgatcgcggatgccaccaaggctctggagctggacccctcgtatgtcaaggtgggtcgaatgtgcattttcccgaggcacttgttgcgaaaatactggctgaccgcgctgctaggcatactggagaagagctcttgcgaacaccgccatattgaactaccgcgaagccctcaaagacttcaaggctgtcgtgaaaaaggagcccaacaaccgcgatgcgaaactaaagctggcagagtgcgagaagcttgtgcggcggttagagtttga

SEQ ID NO: 6542 - DNA, 417 bp, A.fumigatus
gcatactggagaagagctcttgcgaacaccgccatattgaactaccgcgaagccctcaaagacttcaaggctgtcgtgaaaaaggagcccaacaaccgcgatgcgaaactaaagctggcagagtgcgagaagcttgtgcggcggttagagtttgagaaggcaattgaggttggggagccgccgtctgcgtttgaggacttggacattgatgcgattgccgtcgattcctcctatgacggtgttcggttggagaaggagatgactcaagaattcatcgatgatatgattgagaggttcaagaacggcaagaagatccatcgcaagtacgcgttccaaatcatcaaggctgtcaaggatatcgtctatgcggatcttcaccacgggggccgaaggatccgcgctaagcgtatacaacga

SEQ ID NO: 6543 - DNA, 471 bp, A.fumigatus
ctggccttctctgacagattcccccgcgtgcgggcatgcctttttgatatggatggattgctcatcgactcagaggacaaatacacagagataacgaatgcaatcctccaggaattcggaaagccgctacttccttgggaaatcaaggctcaattgcagggtcgaccacagcctgaggtgagccctcctcagcatcctcagtccgttcagtccttgagactcaaaggtcttgttccaacactattacgttctgtcctaatattctacggtaaaggcaagcaagatcttccaccactgggctcaacttcccatcagccccgaggaatacggcgcgaagcaggccgccctgcaagccaagtacttcccccagtcgcagccactaccgggagtcagaactctcctgtccaagcttctctcgacccagaagacggaccaacctgtttacatagccctggcgacatcatcgcatag

SEQ ID NO: 6544 - DNA, 714 bp, A.fumigatus
tattctacggtaaaggcaagcaagatcttccaccactgggctcaacttcccatcagccccgaggaatacggcgcgaagcaggccgccctgcaagccaagtacttcccccagtcgcagccactaccgggagtcagaactctcctgtccaagcttctctcgacccagaagacggaccaacctgtttacatagccctggcgacatcatcgcatagcaagaatttcaaactgaagaccgaccatctacaggatctgttctctgcgtttcccgagtcacagcgcgtactaggtgacgatcctcgaattggtaagggaagaggaaagccgctaccggatatctatttgctcgctcttgagacgatcaatgagggcttgcggcagcgaggagaacctgagatcaggccagaagagtgtcttgtctttgaagatgcagttcctggtgtcgaggcgggacgccgagctggaatgcgggtaatttggtgtcctcacccgggtctcctaggggcttataagggtcgagaagcagaggtgctggctgggttgacgggtgaacataaggaagaggagaagtccgtcccagagaaggaggcagaggagttggcggcgtggagaattaaaggagccggtaaccccggcgagattgacgatggatggggggagttggtgtcgactttggaagacttttcctacgagaagtacggtattcgtcctgcgtag

SEQ ID NO: 6545 - DNA, 651 bp, A.fumigatus
gagaatctcacgaaatcaaaacagaagccaacaaactgttcacggctggctgctatgatcaggctatttcctgctatgaccgggcccttgccttcgtgtcccaactacctcgactatgaagttgccgttcttcgaagtaacatggccgcatgctacctgaagctggaagactggaaggcagctgtcgactctgcaactacctgtcttgatcgtctggaaaacatcattccgctgtctcagcagaatcaggatgaagacctaccgaaacaaaactctcaactgtcaaaacagacagacgcggtgatcgagatttccggtgaaaacgaagaggcagagaaggaggagctcaaacgattagagaaaatggacgagaaaaagaacgacgtgatgcgtattcgggcaaaggcgcttatgagacgtgcgcgagcgaagagccagctcggcggctggggaaatttacaagcagccgaagaggactacaaagtgcttactgggatggaaaacctacctatagacgataagcgggttgtgcagagggcccttcgcgaattgcccgcgaggataaaccatgcacgggagaaggaaacggcggagatgatgagtaaactgaaggatgtgagtcgacaacttttccgtactgaccctggatga

SEQ ID NO: 6546 - DNA, 234 bp, A.fumigatus
gtttgttgtctaaatacccaacgattgtttcttcgactaatgctcccctcttctcgatctagggtagcaactggcgtgacattcaagcaggcaaagggcgaattggccaaactgggctgggatccccgtactcagaccaagggcgacaagctgtactggctgaacggctccacataccagaagctagacgagcagagttgggcctcaatagagagcggacgggctaaattgtga

SEQ ID NO: 6547 - DNA, 504 bp, A.fumigatus
cattgcatagctactacattgggaataacgggctctcgctattcagtacgttactgccgtcttgagaatcgatcggaaaagaagactgatgaaggtgtagattttgctcccactgccttccagaacctcctctaccaagccgcaggcgaccagggaaccctccccttcgcaggccgccagcgctcgatcaacagtatcgtcctcctcagcaacggcatctccttcgccatccaggtcgttgtcttcctggtgataggcagcttcgccgacttcgggacctggcggcctaacatcctaatcgtcttgtcagttatcgcttacgccatcggcttcggctggttgggcgtccacacgcaggagagatggcacatcgcggtgggattgtacattgtaggactgatcgcgtatcagacgacactgacgttctggacggctgcgtttccgggtctggcacggaatacggccgagatgaaagatcgtgcagatgccgtatgtggccggtag

SEQ ID NO: 6548 - DNA, 444 bp, A.fumigatus
ccatgcgcggtcctttcgcctccctgtggtggacacgcctccgatgcgaatgcataccccacgctgtcgcaacctccagtacctcgtgctccgactcctgcaaaccatgtaacttcactcccgcctctgaaagttctttctggagaatattcccacccgtctcagcccaacgcgcagagcccgcatcacgaccttggttctggaaagcgtctattgtgggaaacgaatcatacgctatccaagcgatcgcacgaggaaaccttcggcagtgatgagcgtcctctgcacaatggcatgcggcctgatatggatcaataccctagcatgggtcggaagcagcctgattatggccggcttccattctacaccgattcgcgcgatgagatggcatacaaacgagcgaatggaagaatggtcatgaagattttgcctgcgctaccatag

SEQ ID NO: 6549 - DNA, 564 bp, A.fumigatus
acttgtaatcggccagatctccctcccgtgaaaccctcggctattgcgatgggtactatcttcacccatacggcttcactgggtattctcgcacctgtctttggtgatacttatcatcgtgcgcaggccgccaattccaaggaggaatttatcaagtccaaggaggctgcgggagcagcggcggcttggggtagctccctggttggaagcgccgttcagacttatggtgttgccgccctgatcaatgctactggaacgctgagctacaagggagctgcctatttgggaagcttaattttcatggccagttctgctccaagtgtgagtattccgattctctcccaccaaattttacatgatatgctgactttgcattatgtttctagtttatcagccaaatcttcaccgaaaagcgacccctcgatactgttgctgttggtgctgtcagcagggtgtttgagacagttgggcttagtctgttccttacctggtggggtactcgcacaaatcctttcgattaggagcgactcctggttaatggtcagggaaattatgattttgtga

SEQ ID NO: 6550 - DNA, 549 bp, A.fumigatus
gctggggtaacagattgcagagagaaaaacatacacagcaggatagccttgaccttgaccaagctgatacttggccgcagaggcgttcaagttacaaggagttggcggcagaccatcggcgcccagaacgccctggatgcccctcttgtccttctcaaatatggcagcgaggccacgctcttctccttgctgtttaacctcaaccaactgctgctctcctgcctgcccggtctgcagaacgtcgtccttgggcgccgcccggctacctactgtaagaaggccaacagcgtctgcctggttgactatgctaagtctggggtaatttctccggacgtcgcgcttccagtaagggttgtcggcaatgtctgctgctgggacagtaacggggtcatcataagattgcggcgggagagcaccaggagtcggaagtcgatattgcgagttaagtgggactccagtagagcgattgggatcgatggcaagaagacggcgaagacgttcccatatccccgtagactggacggtgtatttctgatcatcaaaacttag

SEQ ID NO: 6551 - DNA, 198 bp, A.fumigatus
atcttaattcacaaaatcataatttccctgaccattaaccaggagtcgctcctaatcgaaaggatttgtgcgagtaccccaccaggtaaggaacagactaagcccaactgtctcaaacaccctgctgacagcaccaacagcaacagtatcgaggggtcgcttttcggtgaagatttggctgataaactagaaacataa

SEQ ID NO: 6552 - DNA, 714 bp, A.fumigatus
tggagtactttttcacttctaagttttgatgatcagaaatacaccgtccagtctacggggatatgggaacgtcttcgccgtcttcttgccatcgatcccaatcgctctactggagtcccacttaactcgcaatatcgacttccgactcctggtgctctcccgccgcaatcttatgatgaccccgttactgtcccagcagcagacattgccgacaacccttactggaagcgcgacgtccggagaaattaccccagacttagcatagtcaaccaggcagacgctgttggccttcttacagtaggtagccgggcggcgcccaaggacgacgttctgcagaccgggcaggcaggagagcagcagttggttgaggttaaacagcaaggagaagagcgtggcctcgctgccatatttgagaaggacaagaggggcatccagggcgttctgggcgccgatggtctgccgccaactccttgtaacttgaacgcctctgcggccaagtatcagcttggtcaaggtcaaggctatcctgctgtgtatgtttttctctctgcaatctgttaccccagcttacattttaatctaggtatccttgccggacgttcgtctaagtattcgttaactgcacatctgaaattgaattgctatcttctttctgtcctgggacgtaaatcatctattagcgaaaagtgttcaaacgtggaatgggtacgatag

SEQ ID NO: 6553 - DNA, 192 bp, A.fumigatus
cccccgaacctcgctcctcaagcttccagtcctgaacaacctatggagtctagtccgttgacccaatatcttggggcgcaatgtccacctatcaatcattgtctagcgttcatgactctcatgctggaacgcgctgctctcttactagaatcctttgttccaagtcatggcacctgtctagctagaaagtag

SEQ ID NO: 6554 - DNA, 1083 bp, A.fumigatus
cgatggcaggaatgtaggaacctccccgaactctgttccgttgatatgacgattgctgactcttacgctcgtagttctatcttctttatttccacttacttttccgactacatcattgtgcctctgagtagtaaagctcaggtcattgaagcgttggagaggcgaggatttcagttcgaaatcaccaccgaggctttcataaatcataatcagagtcagtacagcggctatagcagtccggtttcatctcgttccgcgagtagtcttggttctccgccggcaactcctcctccctcatcacttgacgaactgcagggacgaacctttgcctccctgcggaagaaccacattgtgccgtccgtcgatcgatctctccgcttggtgcaatgtgcggcccatcacccatacagcagtgatgctagctcaatatcaatcctccgtacggcactgacgacggcactggttgtggacagaccacgcttcctctcactcactctgacggctgccgaccctgcagcgtccctcctgttggaacagcgactcctgccccgattcttgaatgatggtacctcgtctgccgagtctactgatgagacaagcctgcttctgggttccaaggaagacgtcctcgtccctatcacgttggatctacgcaaactccctctcgaggccaccggtattgtttgcggtgttgccagtcgattggctgatgctacacatggcgcctgggatgaaagcaccgaagcatcgaccgtggctttgtcgcactcttttaacggtatctcctcctttgaaagctctctcaatcgctacttctcgtccagtgtggactctgggggaccagtcaggccccctgctcagaaccctacgcaccgaacacccaatggcgatctgtcgacaccctcaacccatcatctgcagccagacctcgacacatctctggaggccgtcgagatcagcttccttagcactgcacgtgcagggacaatccttgtcggtgaacacgaactgcatcgggctatggatgcgctcgaggccgaaagccatgaacccgacctgccggctggtgtgctcgaagtgtga

SEQ ID NO: 6555 - DNA, 339 bp, A.fumigatus
gaaagtttcccaacacacacccccaccagcatgccgtccacaaccatcatccgccaactggccatctccctggccctgtgcaactctgccttgggccaggtcgtcaatggcgctgattacaacaaacctaatggaggacctccggccagcttcttcgccgctgcatcgaccatgcccgtggcggcccttcaggcagcggctgccaaagccaccaaggttcctagcctggccacgtaccccgtgagccaggacaaaggtgcggccaagtcgaccatccataccgactgggcgtccttcaggttttcaccacgggagctggccggatcagcacttaagtat

SEQ ID NO: 6556 - DNA, 342 bp, A.fumigatus
tttgtgtccaacagtgaacacatggtgcttcctctttggcggtcgctgcattcggtcaacctcatgcttcccaaggaagagcgccgtgctatgctcctacgtatatttaacgacgagcctcagctgttgaacattacccagcaaggcacgcctcagtcgtccactccagtagtcgagacgaatgaggaagacgtgtctggaatggctcctacggaagcggaagagaatgccctgaagcaggaaaacctagcaataggtgaggatcagcaggagcaggttgatactcgggagacgtggaccaaggccggcgacgaagatgaccggtttaacacaactgtataa

SEQ ID NO: 6557 - DNA, 408 bp, A.fumigatus
aaatggaacatggagactaatactacttccagaatcgaggagactacaccgcggaagcgcattcatttttctatcactctcccctcgtctgcatctggttactccgccaccatgccactgttcaatcagttccttcgctttactgacaagcttgtcgcgtctgctcatttccgtccggaggtgatgcgcaagatcaagcacgttcgtgaagaagagatcaagaagcttcgccgcgctgctgaggaagaaaaagcagaggagcgcaggctggcagctgagaagattaagaaggaggagcgagagcgactcctccgtggcatgactgccgaagagcagcgcaagttccttgagcgtgaatcgcagaagggccagagacggtctatgaagaagtacaccaagagagcatga

SEQ ID NO: 6558 - DNA, 804 bp, A.fumigatus
gacacccagggtgccacggcggttccctacacaaaatggtaccgagtttgggagcggacctcaccaaaggactttatacaagaagcaatggtcatgccattgatccttctgattgttgtatttcacctctggggcacgcgcaagaatagacggagagccagggaatgggcccaggctcatgcgccagctctccagagcgagttcgcggttgtgggattcgatggcgtccacaaattcaccggcgcggtcgattccgctcctgcggaactgatctccccggagtctactttgaaggagaagtctgcgcaggagttcatttcctatgccaccggcagacagaacgtcgctttcgtcgacatgtctatcaagttgcccaaccggtacaaccccattgtttactggtccgattatgctctcagttttttcttcgacagctggcaggctcctgccgagacatttgaggcaatcgcctacacctttgatggcagggagaaggatcttgttcccgtacccgccaacgatacttcgtctctcaaggtgaacaactcggcctatgacggtttcatctgggctgttgtgcacaagaaccacatgcgcaagttccgcctggatcggtacgatgcgtcaatgacctttaccaaggacaatgccaagctaccatcctgggttaccgttatgacagaaagtgccgagatcacagatactcttctcactcctgagctgatccaggctatcgagaaggctggagactctttcagatatttcattgtcactgaccagcccgttgacaagcccttgaagtga

SEQ ID NO: 6559 - DNA, 1242 bp, A.fumigatus
  unsure (1166),(1167),(1201): Identity of nucleotide sequences at the above locations are unknown.
atgggatgctttctcgttcgtgaggtctcttggctggtcagaaacgaggcagcttttgtttacctcgatagtcacatcagcaatccgttgttccaccgcccggagctaagcactttttctccgcagcaagtgatccgttgccgcagtttttcttttatcggaatcggcagtggaaaactcgaatcctcatcccaaaaggcattttattcccatgccattgcagtactccagatgcgaggatgcttgcagttagccagatggctgagcgctgcaccgaaaggcacagctgcaagcctgacgagggcgccgttcgtccttgctaacgctccccggtatttcaccagctccgcttctcgtgctggatcgagatcgaccgctaccaagccgttatccgacctcgagaagagaatatctgcgattccaatcgagcgataccggaacttttgcatcgttgcccatgtcgatcatggcaaaagcacactttcggaccgcctgctcgaactcacggggacgattgagcccggctcgaacaaacaagtgttggacaagctcgacgtggagcgtgaacgtggcatcaccgtgaaggcgcaaacctgctcgatgatatacaatcacaatggtgaagactatttattgcacctggttgatactccaggccatgtggacttccgtgcagaggtatcccgtagttatgctagttgcggaggagcattgctcctggtcgatgccagtcaaggaatccaggcacagaccgttgcgaacttctacctcgcttttgcgcagggcttggaattgattccagtcatcaacaaggtagatttgccctcggctgaaccagagcgagctcttgagcagatgaagaattccttcgagctcgacaccgagaacgcagtgatggtttcagctaagacaggcctcaatgttgagaaattacttccgacagttattgagaagatcccagcgtatggccatttccccgtcgattctcatgagctgcttccgttactgactcttagcagccccatcggcgattgcaagaagcccctgcgaatgttactcgttgactcgtggtacgattcctacaaaggcgtaatctgtctggtccgcatcttcgacggtgaaattcgagcaggccagcaggtcgtgtcgtttgcgtcttcaccacnnaaggagccacggatccgcgaaaaaagcccttcgngggcgcccccgaacccgcccacaaaagaaaaagaaaattaa

SEQ ID NO: 6560 - DNA, 267 bp, A.fumigatus
tcaaacccagttaccgccgacgaccatgtcaaggcctacatcaagaagattatgtcgcagttaaataagtggatgcttggaggcaagatatcgaaacttgttgtggtgatcacagataaggagactggggaacacgttgaaagatggcagtttgatgtatggcagccccctgaatggatgcgtgcagaggctcatcagaatctattatcaccaggtccagatatttggaaagcatgccaagagccaaacttctcggaaatctgctga

SEQ ID NO: 6561 - DNA, 315 bp, A.fumigatus
tacaaccttgtactctgcaacagagacacggaaaatcaaagttcgactgcggttgagaagaccgagaaagagatccaggaagagatacaagctatcttccgccaaattacggcctcggtcaccttcctcccagttctggacggagactgcacattcaacgtcctcgtgtacgctgacgcagactcggatgtgcccgtcgaatggggcgacagcgatgccaaagagattaagaatgccgagaaagtgcagctgcgaagcttcagtacgaataaccacagagtggagaccctggtcagttatcgcctggccgaatga

SEQ ID NO: 6562 - DNA, 201 bp, A.fumigatus
ttgatggtctccactaccatcttcatgaccagccggttaccactaaataactgctacaatggccttgttcgtggttcggatcagtttgctgataaaaagactccgggtttctctccccctgctgatgactctccgtacgtcttggctccaattgctacgatctacctttctgcttcgcaagcccgcatactcaacctctag

SEQ ID NO: 6563 - DNA, 825 bp, A.fumigatus
tcgaccgaatataagatgcgttcctttcttttcggtggcttggtagccttgagctcgacgctcggcgcctttgcggcgaactacaattcttctgcctacagtgactcggcatctgggatcgactttcagagatggtgcgatgcgaataccgggttctgcttcggtctggccctcccggagactgtaggaactgactttgtcggtcaactggtggtgccgctggacagctcgaaaggatggggcggtgtcagtctgggtggctccatgacctcgactcttttgatcgcggcctggccgaatggtaactctgttgtctcgagtctacgcaagacaaccaactacgccaacccagacgtgtacagcggaggcgccagtctcaccgagatccccgatggcacttctgtcaacaggactcatctcacttatacgttcctttgcagtggctgcatcctcggacaaccagcgacattcgacgccaccgatgaaacgtacttccttggctgggccctcagcaagaccagccctaccactcctgcctcggcctcttcggctctgacataccatgccgccggcttcggtagttttgagatgctcctcggccaggccaaatcctccaagtactccacctgggctgccatggccaagtcgaccggcggatcgccctccagcactccttcagcgtctgcgtcggtcaccccgtcccctagtcgcagccctgtccctagcgtgaccccgacggtgtcaaactccacatacgactacatcgttgtgggaggtggtgcgcctggtatcttcaccacgaggcgccagggccgcgttacgcta

SEQ ID NO: 6564 - DNA, 528 bp, A.fumigatus
actacccgaaatgggagatgcttggcaactcgggatctagggaaggcaatgattcctttaattctggataggttcactattcacggtccaaatggtgagcatgcttgctatgtcacagcaactgcgagggctagcctatctgcgctgaaagacgggtcatgggtccgtttattcgagcttgatgtagcccggacattggccgcacagctcgtccttgctgtggattatgtacacgcccaaggatttgtccatggagaccttcatttaggaaacattcttctcaaagtcccgcctagctttgatcggctgtcacccgaacaactatatgaagaatacggggcaccggaactagagccagtcattcatctggatggtaatccacttcctcccggtgtcccatcccacggcattgcacccatatggctcagagaagcaagtgagaaaataatgcttgcagaagccaggatcttgctttctgactgtggcgagtcttcaacacggggctggaaggatccacgcgggcgctat

SEQ ID NO: 6565 - DNA, 879 bp, A.fumigatus
ttcgcttcgcgcatcagctgttccacccgttcctggggtacaccggttgggaacaccatcttgctcggtgttgatgacttctttccgggctcagaaccgggtgtccccttgcccttggggttggtctgcggagtcgacttgggaatcggcgtcgaggtggtaataaccacgtcctctccttcggcaaaagacacagaacgccgttgtgccgacttctctgcgggcgaatccttgcgtaaagccgaatgtaactgcttcactcgatccagagcaggagtttgcttcgatggcgtggcatcgttttccaccaacgacgcacggcggatcgtagacgctttgctggagaagaggggagtccctatcgacgtggtcgcttcctgggacaacgggaccatcacctgcggtttgctagggggactctttgtgataccaaggccgagaccggcttttgcagactcgggtttctcagagacgcttgggcgtcggccaattccagagaatgacggagctctctcgtgtcttcgcaccaacggactgctgacgggtggctcggacagcgactggctggggttgttctccttgtccgacgatccagggcttctggcctccaatcgaggctccttgtttggttgctcttcctccaagctcttctttctcttgcgttgtcgaaccgcgggcaacccccccttagacgagctctctttgctcccattcaccaccggctcatccgtctcctcagcttcggcctcagcaggcactttgtccaacgccgcaacatcgctgtcattcatcgcaacatctccatcgttgtccaaatcattaaattgttcttctacttcttcttcttcttcttcctcatccgactcgcgcccctgctga

SEQ ID NO: 6566 - DNA, 1656 bp, A.fumigatus
acggggagcgtacacttgcagctaccgtggacgatcgcgagcgtcgcagggacgtgccggtctcctcccgtggaacaagaggagatccccatgtcgcctccgcggtggggggagtcgcccgtccatgagaacgactcgcaggatcccaagggtgtagttgttgcggcgacaccacaacacaagcgcatggagagccaggagctgggggagtcgccttcaccggaacggcaatgggccccaacgcccaagacgcagacatcccccgcaaaacgcggctccgtctccaagcacgtgccggccactcggtcaatatcacagtttgtcgccgaaccggactttcccacgtcgaatcgaacggaacgtgagcgcatcggatcggaatcgcccctgagtccaagacaagcaccgtctcggccagaacgcgaggtggacgaggaagaggaagtggaaacagacatctctcagcaggggcgcgagtcggatgaggaagaagaagaagaagaagtagaagaacaatttaatgatttggacaacgatggagatgttgcgatgaatgacagcgatgttgcggcgttggacaaagtgcctgctgaggccgaagctgaggagacggatgagccggtggtgaatgggagcaaagagagctcgtctaagggggggttgcccgcggttcgacaacgcaagagaaagaagagcttggaggaagagcaaccaaacaaggagcctcgattggaggccagaagccctggatcgtcggacaaggagaacaaccccagccagtcgctgtccgagccacccgtcagcagtccgttggtgcgaagacacgagagagctccgtcattctctggaattggccgacgcccaagcgtctctgagaaacccgagtctgcaaaagccggtctcggccttggtatcacaaagagtccccctagcaaaccgcaggtgatggtcccgttgtcccaggaagcgaccacgtcgatagggactcccctcttctccagcaaagcgtctacgatccgccgtgcgtcgttggtggaaaacgatgccacgccatcgaagcaaactcctgctctggatcgagtgaagcagttacattcggctttacgcaaggattcgcccgcagagaagtcggcacaacggcgttctgtgtcttttgccgaaggagaggacgtggttattaccacctcgacgccgattcccaagtcgactccgcagaccaaccccaagggcaaggggacacccggttctgagcccggaaagaagtcatcaacaccgagcaagatggtgttcccaaccggtgtaccccaggaacgggtggaacagctgatgcgcgaagcgaatcagaaatttgccaagcatcacaaggacaaggaagaagtcgaggagatgattaaggtggccaaggagcagaataaggacccggcattcgtgcgcaatctggaagagctcttggccaaattggaccgggtccagaaactcgagaaacgcaaccgctccagcgagagagacaggcttgagcgagcccgggctgatctacgggcgaagcgggaagaaattgctaaaatggaagcagatatgggtatttcttcgcaggataagcaacagaaggcagactcggccaagtcttccccacggggctggaaattcccgcgctgc

SEQ ID NO: 6567 - DNA, 312 bp, A.fumigatus
cgaacaatggaacattcatctccgctggctgccatgcagcccccgtccgtgatgttcggtcactgctttcgttcggatgctcccacatcgtacccaacctttggtccaaggtcggggcttggtccgaacagtttcaacttcaaggaattgtccatgaacaaagcctccggcgattactttggcatgaacccggttcgaggatcgtctccaacggctagtctggcagcggacctgtcccagaattttcacattgaccagaggttggcagatgcccttcgctgtttatcctgttttctttgtcatgctttatga

SEQ ID NO: 6568 - DNA, 207 bp, A.fumigatus
gaaaagccgacgcaaggggatttcctcggtaaaggacagctgctgctgcagactattctacctggcatatactacaacggcaagatgaagtatggtcaaacgcctcaaacgccttgtaactcggtcttcgactctctgttctttttcctcaattgcgtgtcctgctcgaattccagacctcacaaatcgtgggaaacgcctttctaa

SEQ ID NO: 6569 - DNA, 435 bp, A.fumigatus
agctggatctctagattctcttccttggcaatgaacatcatgaatatacaccaaagtttgtgcatggcaggacgcctgcctgtgtttacatcacgcctctgctctggaaagcggctcttatgttacacggcgcaaaagtcgtccaagtcagatgctaagactggttcgtgcatgatttacccaagcaataatcgtctctcattgctaaagtttctcgaagttcagagcccgtccgaggatccatcgaaagtccgcgacaacaaccaggaatcaaaacccaaagtgaccagaagtgttgctcaagcggacgaggagcttcgtgaacgcctcgagcagatgtctggtgagggtggggcctctggtatcgaatatgaggatggcaaaccaaccgccatgaaacggagtgttcgcaacaacatgtttcgctacatctga

SEQ ID NO: 6570 - DNA, 225 bp, A.fumigatus
actgtagaatttaatgctttctataaggaaaatataattatttacctttatataccaccttatacttcctaccttctacagtcactagatattagtgtttttagcccgctgaaacacgcatataggaagttagttaaaggaataatagttataggaaataactatattaacaaagaagactttctgcacctatatccacctgtatataaaaaagtctttaattaa

SEQ ID NO: 6571 - DNA, 267 bp, A.fumigatus
tgggaaccattagtcagggcttcatttgttacaacaccacaagtgacacctacagcattgtccttgagtgaaatgcctatgcaagtaggcacgaaacagcgcgtctctatcttacggcaagcttgtcttgcatgtgatcaccaccggtgtatgatatctcgcaagtttgatatcatcgaggcccggaagcacctccaagagaacggggataactctaaagacgacgacggaagccttctaagcattgagttatgggttggattctag

SEQ ID NO: 6572 - DNA, 399 bp, A.fumigatus
  unsure (269): Identity of nucleotide sequences at the above locations are unknown.
cgcgttcgacgaaatcgtcacgctgggataccgagagaatctgtcgctttctcagatcaagacattcctggaaatggaaagtcacgaagagagaatacaggaaattatcgaaagagtatacgacacactggccttcgggtacaacagcttgctaataatgttgaacagaacaaagagcttgaagccagcgaggagcgcaaaagaaaggcgaagcagttggagatgcagcgaaaggaggcagctcgcagtggccggtctatggcacccanggccccatcctatcctgtatacactcctccatcacgtcctgctgctcccgaaacatacgatacttatgaggcggagaagaagaagtcatttgcgaagtatgccttgatctcatatgttccttatctctga

SEQ ID NO: 6573 - DNA, 855 bp, A.fumigatus
  unsure (827): Identity of nucleotide sequences at the above locations are unknown.
gaggctgttgctaaccaagctcgtttctttagacggttgcccacacgcggaaaaggcatgcaacttggcaaaaaatcgaagaccacagatatctacgagaaagttcgtggtgatctgggccccgaagttgatgaatcgagtccattggtaactccccaagttccgacgccggcagccgagagggtcccctccgctcgggcctcattatccgccgacagagagcctgtccatatcactattgctgaaacaatttctgccaaactcacccgtgaaggtgccctgaagtcgttcgaggtgaagggcgacctccagctccgtatcaccgacccatctttcacgaaaatcaagctggacctgctggccaatcctacacatggcgcacaattccgcacccatcccaatgttgacaaggccgttttcaccagctcctcagccattcagttgaaagacttgaccaagcgtttcccagccaacaactcgattggcgtccttcgttggcgcgttgctagttcggggtcagaaaatgctgatatcctccccatcacgttcacagtgtgggtgaataagggctccgactccaccactgtgacaatcgagtatgagctcacgggctcggatacgctgagagacgttgttgtttccataccttttggcgcaacagagcctacagtctctagcttcgacgctgtctatgaggtctctggggatagtttggactggaacatcggtaccgtggacgaaaccaacgcttcaggaagctttgaatttgaatctgcaggcgatggagacgagtacgagttcttcccgatgaatgtgcgcttctccanagtcagtccatccgttgaagtaaatgtc

SEQ ID NO: 6574 - DNA, 705 bp, A.fumigatus
  unsure (598): Identity of nucleotide sequences at the above locations are unknown.
gttgttctcgcagcatcaatatgcactcgggggggcaaagcagtgctctcacgtcaattccgggagatcgcccgctccaggattgaagccttgctcgcgtcctttccaaagctcgcagattctggaacccagcatacaaccgttgaacaggacaatgttcgctttgtctaccaacctcttgacgagctgtacatcgtcctcatcacgaaccgccaatccaacatccttcaagacattgatagccttcatcttttcgcccaagtgaccacgagcatctgcaagagcttggacgagcgggagattgttcgcaatgccttcgaattgcttagcgcgttcgacgaaatcgtcacgctgggataccgagagaatctgtcgctttctcagatcaagacattcctggaaatggaaagtcacgaagagagaatacaggaaattatcgaaagagtatacgacacactggccttcgggtacaacagcttgctaataatgttgaacagaacaaagagcttgaagccagcgaggagcgcaaaagaaaggcgaagcagttggagatgcagcgaaaggaggcagctcgcagtggccggtctatggcacccanggccccatcctatcctgtatacactcctccatcacgtcctgctgctcccgaaacatacgatacttatgaggcggagaagaagaagtcatttgcgaagtatgccttga

SEQ ID NO: 6575 - DNA, 195 bp, A.fumigatus
cacactccagacacctatgccatggccactgcatcgtcactagcatttaccaacatggaagtccctggtcttgatgacacgatggagatggcttctccctatcagggtcatgtggatgattttgacattgacctcgatgtcatggaagaccaagcctgtcttcacctacggggctggacggatccgcgattgagt

SEQ ID NO: 6576 - DNA, 402 bp, A.fumigatus
tcacatcacccatggcgccaagcttccgcaatgccaattattgtggttgctgtatccgctagaagcgttctcttgttctcattcacattcctcgcctctcggtctttattaccatcttatgacagcatatcctatataaacatcaccatgtcaacggaaatggaagtcgacgtcccgcaagaggaggtccctcagggacaatctggcggcggaggttccgatcctcgaacacaggcgggagccgttgcagtgcgcagtattgaagggtggattatcattgcaaccaacattcacgaagaggcctccgatgaatatgttaccgatctttttgctgaatatggagaaatcaataattttagcctgaatctggatcgccgcacgggttatgtcaaggtgagctga

SEQ ID NO: 6577 - DNA, 222 bp, A.fumigatus
  unsure (102): Identity of nucleotide sequences at the above locations are unknown.
ccttggtcgacccctcccagtcctccgacgacgcaatcccactccccgacccctgcgtcagcaccgccaggatatccaacgtcacgaacatccacggcagcngtttacccgaccccccacacagaaacgccgcggggggttgttttgcacccgagtcggagctggtctccaacttccccagaagcatgtagagactcgcgcagacgaacaccggggcgatga

SEQ ID NO: 6578 - DNA, 531 bp, A.fumigatus
ccccctgttacagtcctctggagttcggcccacgcaaaaacatggcagatcgtcattctctgcattgtcttcttcggtttcgtctgggccggcttcctcttcgtcctcagccacctctccaagaaacacagctggatcttgcccgtgttcgcctgcggtctcggtgccccccgctgggcccagatctggtggggtgtctcgggcatcgggtactacatgccctgggtcgccggcgggctcacgggtggcgccctggcgtctcgcagcatctggctgtggctgggcgttctcgacgcaatccagggcctgggtttcggtatgatcctgctgcagaccctgatccgcatgcacatgtgcttcaccctcattgtgtgccaagtgctgggatccatcgccaccatctgcgcccgagcctttgcccccaacaacgtcggcccgggccctatctcccccgatcccacctatggtgcgagtgccgtggcgaacgcgtggttctggatcgccttgatcttccagctgctcatctggtaa

SEQ ID NO: 6579 - DNA, 531 bp, A.fumigatus
  unsure (33),(50): Identity of nucleotide sequences at the above locations are unknown.
gtcggtctgctcatgttttttggcctgcccaantactaccgccagagtcntggtaaggttccgtccttctatcggtcggtgttccgccgcaagatcgtcatctggaactttgccgtcgtcattatccaaaacttcttcctcagtgctccttacggccgcaactggaattgtaagtcaccttcatcggtccacgtgaatgaagatcctaaccccctgttacagtcctctggagttcggcccacgcaaaaacatggcagatcgtcattctctgcattgtcttcttcggtttcgtctgggccggcttcctcttcgtcctcagccacctctccaagaaacacagctggatcttgcccgtgttcgcctgcggtctcggtgccccccgctgggcccagatctggtggggtgtctcgggcatcgggtactacatgccctgggtcgccggcgggctcacgggtggcgccctggcgtctcgcagcatctggctgtggctgggcgttctcgacgcaatccagggcctgggtttcggtatga

SEQ ID NO: 6580 - DNA, 594 bp, A.fumigatus
  unsure (494): Identity of nucleotide sequences at the above locations are unknown.
cggccatcttggagaaacatcaacactcagtgcaagctcctacaaatcgtcaatatccagctttttcattgggcctatattactcagtcatcgactcaacacaccatggcctcagacaacgatgacaccatctacttgtacaatccctccctcggggcctccatcctcttcaccatcctctacatcctccctctcatctaccagtcctacatgaccctcgtatacccccgcaaagcccacacccctcgagccaactacttcatcccgatggtgattggcgccgccctcgaagtagcaggctacgcagtccgctgcgccagcgtccggaaaccagcggatatcgccctgtacgccgtctccagcaccatcatcgtcatcgccccggtgttcgtctgcgcgagtctctacatgcttctggggaagttggagaccagctccgactcgggtgcaaaacaaccccccgcggcgtttctgtgtggggggtcgggtaaacngctgccgtggatgttcgtgacgttggatatcctggcggtgctgacgcaggggtcggggagtgggattgcgtcgtcggaggactgggaggggtcgaccaag

SEQ ID NO: 6581 - DNA, 1368 bp, A.fumigatus
tatcctattctcttctctatcgccttgtttatccctggtggaatccctgatattgcacatctgttgaccatgattattccggccactttcaagccttctctgacaagaatcagaagcaagagacgcagcaaggggatcaagaatggagatactcactcgatatgtccagcatgtctctatcatctcagcattatacaagggaggacgaccatcccttccacgctacttctccatcatgtacagctcgacacaccttcggagtcaaattgtctgatcaacggagagacacttaaggaatgtccagtatgggaaaccagccctctcccctgcctgccaatcctcttgtctccaaccaggttcggcacttttggtggccggtttgctcccgagtcccatatggacgccttgcaggagctcacattggcgttcgaccgtttcagctcagactacagcttctggaaagagttcgtaaccttccccggtatccgtcctagcccgcttcggttcgcagaaaacctcacgcgcatcgctggcggcgcgaatatctggctcaagcgggaggatctaaaccaacatggtagtcacaatatccgcagcattgtcggtcaggccctgctcgcacggcggctaggaaaggccgaagtcgtgatggagtgcggctcagctaggcacggtatcgtctgcgcggcgacctgcgcacgcttgagtatggagtgcaccatcctcatggggagccgggacgcaaccgaccagaaggacagcgtggacatgatcaggaaactcggcgcgacagtcctcaccgcagacatgggggcgtcgtcgggtcgtgggaccctccgagctgcagtcaacgaggcccttcggtattcagtcgcccatctcagcaccgcataccacatcatgagcggtccaatcggtccccacccgcttccaacaatcacacgcaccttccaatcaattctcggcgaggagatcaaaacgcaattcggcggcgccagcggtgaccggcttccagacgccctcgtctcccccgtcggaccaggcagtgcagccgtcggcatgttctacccgttcattgagcatccgtcggtgaaactgctcggcgttgaggcggcagacgcagctcccctatcccacgatgaaattggcgtcctgcatggatgccgcacctatctcctccaggacgagcatggccagatcctcgattcgagctcgatatcccccgatctggactttcccagcgttggccctgaactggcgcactggaaggagacggccagggtggaatatgttactgccacggacacagaagccttacggggtctggacattcttcggagccaggaggggattgtcccgggagcgatg

SEQ ID NO: 6582 - DNA, 1581 bp, A.fumigatus
  unsure (1553): Identity of nucleotide sequences at the above locations are unknown.
caatcggccgatgtggcgttcaagctccatctacgtgcttcgtcaaatcccgaggtccgtgttgatttactagttgagctgccaacgacatatcccaaaacgtatccaaatctttcattgggtaattcggagaacattagtcacagggctaggttgaaaattcaagacattattcgaaacaaaccgaaagagctgctcggctctgagatgatttatgaactcgccgtgtcgatacaggacgtcctcgaggatgttgcccaggcacaggcccaggataaggatctaccaagtttagaagaggaacgcatggtgcaagaagctgctgccaatcagcgtgcagaattggaacggcaagaagagcttcgaaaacaggaggcggccactgcggaagaggagcgagctttgcagcagctgttggaggacaaacttagagagcgcacgaaggctcgtctctccaggcgaaagagtaggtcttccggtacaggcttgtccggctctatcgatgcggttgaccaatttcccgacgccattacttttgatccaccattaattataaacgacacaaatgaacaaccgttggcctttagtgctgtatttgggaagacgcttctacaaagcagtccgggaaagcagacattcacagtcagacccgtggtgtccgggagtcgctcccatgcacctcttatcgtcctgaaagaactttctctcgatgggaatgggacggcaccgatttgttacagggagcgaatgcgtgccagtgaggacaaactagaggctctgaaaagacttcggcacccgaatcttgtggattttattggtttcaagatatctaggcccttagactccatcgacgcccaagacagcacctggagagtatatctccttcttgaatatgcgaacaaagggtccctatcggagttcctggacatcgtggggagcgtgtcggtggagattatccgtgcttggatgatccaactgctcgaagctcttgaattctatcatcgcagcggatttgtgcatggggatatccactgcggacgcattcttcttttcaggaacccgcaaggcggtaccattgtaaagctgcaaggaagcattgaagatgcgctcccggatacggagaacagcaagagatctctgacaatctcaaagtcacccttctggatgcctcccgagctcacacaagaaagtacgcctccaacaatgaaaattgatgtatgggacatgggtatagtgtttctgcagatggcgtttggtaaggatgtgttgcagcggtacacatcagcgaacgcactcatgggaacattgggtttgtcagcacctttgcaggacttgctgcatgagtttttcagaccagatccaaagaagcgtccaaccgctttccaactccaacccttcgagttcttccgagtcgacacacctttgattgctcgcacgagtacttcgaactcagtgtcactgcccagacgtccacgccttgactcgactggagggcttcccgctttctcgcgatacaaccaagactttgatgaagcagggcgcgtcggtaagtnttgcccgcaagctgaagtaccatatggg

SEQ ID NO: 6583 - DNA, 279 bp, A.fumigatus
atctgggttcagactttaaacaccgcccaccgccccggtatgcctcacaagcagaagaagaatcctagcaatgtccataaaaacggctctccccgagcggagaggaagcagtcgacgtcgaataccattccgcttgctcagcctggactagcgacgacgaattaccgggagatccaccagaatgaggctgaggcgttacgctccatctatggtgatgactttgaagaaattgagcacaggccctccgcctggcaggtgcgcgcggtattctccgactag

SEQ ID NO: 6584 - DNA, 1710 bp, A.fumigatus
acggaggaggagaaaattgccccgggaaccgaggaagggaggaagagggaaggagcttcgccagccgaggaaggagaaggagagggaaaagaaggagcagctcggaagggagggaaacttctcaccaggccccggaaggaagctaaggagcgcatgaaatttggtttgaagcagatgcttgcagccggcgttggtaaggttgctggtctcgaggagccgggaattgagaagaagaagcccgtatacgacaacaggaagcgaaagggtctcaagaagcaggaggaagacctcgaagctgctgctgcccgcgctcgcgctcaacgtgaggctgaggaggagcgacgcagaaaggaggaagaagagaagaaggctaaagctgaggctgaggctgctgctgccgccgctgctgctggtgacgaggagagcgaagtggatgattgggagaaggctgctgaggccgaagaagaagtgaaggacagctgggatgctccttctgaggacgagggagagaaaccagccacaaacggcgtggccaagcccgcagctgcgccccaacagaaggccgaggtgcacgagtccgaatccgaggatgactcagaggacgattcggaatccgagtcagaagatgaggagaagtctgccgcgcagaaggctatcgctcaaagaaaggccgaagctgccgagcggaggaagaaacagcatgaggaagcattggccgctcgttcgaaggacaatctgcgttctcctatttgctgtatccttggccacgtcgatacgggtaaaaccaagctattggacaagattcgacagaccaacgtgcaagagggcgaagctggtggtatcacccagcagattggtgctacatacttccccgtggacgctttgcgccagaagaccgctgtggtgaataaggatggcaagttcgaattcaagattcccggtttgctggtgattgatactccgggtcacgagtctttctccaacttgcgttcgagaggttcatctctctgtaacatcgccattctggttgtcgatatcatgcatggtctcgagcctcagactttggagtccatgagattgcttcgggagcgcaagactcctttcattgtggccctgaacaagattgaccgtctttatggctggaagaagatcgacaacaacggctttcaggacagtttggccatgcagagcaagggtgttcagaacgaattccgcacccgccttgaacacacaaaacttctcttcgccgagcaaggtttcaacgccgagctctactatgagaacaagtccatggcccgcaatgtctccctggttcccacttccgcccacaccggtgagggtattcccgacatgttgaagctgttgaccaccctgactcaggagcgtatgaccaactcgctcatgtacctgtccgaagttgagtgtactgttctcgaggtcaaggtcattgagggccttggcacaaccattgacgttgtgctttcgaacggtattctccgtgagggtgatcgaatcgtgctctgcggtctaaacggccccatagcaacgaacattcgagcattgctgacaccagctccccttaaggaactccgtctcaagtcgcagtatgttcacaacaaggaggtcaaagccgcacttggtgtcaagatcgctgccaacgacctcgagcatgccattgccgggttcgcggttgatggttgttgggactga

SEQ ID NO: 6585 - DNA, 435 bp, A.fumigatus
aggacagctgggatgctccttctgaggacgagggagagaaaccagccacaaacggcgtggccaagcccgcagctgcgccccaacagaaggccgaggtgcacgagtccgaatccgaggatgactcagaggacgattcggaatccgagtcagaagatgaggagaagtctgccgcgcagaaggctatcgctcaaagaaaggccgaagctgccgagcggaggaagaaacagcatgaggaagcattggccgctcgttcgaaggacaatctgcgttctcctatttgctgtatccttggccacgtcgatacgggtaaaaccaagctattggacaagattcgacagaccaacgtgcaagagggcgaagctggtggtatcacccagcagattggtgctacatacttccccgtggacgctttgcgccagaagaccgctgtggtga

SEQ ID NO: 6586 - DNA, 372 bp, A.fumigatus
agaatatgcctccgacagaaccagattactcgcatcgacttcccctccgaaattgcgcctacgctgctcgaactcgacctctacgataaccttatatcgcatgtcaagggtctcgatgagttccgggatctgacgagtctagatcttagtttcaacaagatcaaacacatcaagaatatctcgcatttggtcaatctgacagatctttattttgttcagaacagaatttccaagattgaggggttggagggcttgacaaagttgcggaatctagagctgggagcgaacaggattagggtgggtgtattccaggcggacttgaagaaggactgggctgaatgcagcaggaaatcgagaatcttgacactctag

SEQ ID NO: 6587 - DNA, 1488 bp, A.fumigatus
ggcatcgcggatcctgccagcctccgtggtgaagacagggagggcaagggccagctgctgagcctggacggactggtggacgtcgtcacgagggaaagaccagcggaggcaggtgatggggccagtaagcatacccttcatgggcttcttggagatagagacggcgttcttggactccttgacagtcatgggagcgggacgcgagatatcaccaacaatgatgggagggcgcacgcaacgagatccgtaactctgcacccaggcgtgggtggtgaagacgtaaccggtgagacgctcaccgaagtactgcaccatgtcgttacgctcaggttcaccgtggacgaggacatcgaggtcaagctcttcctggattttgacaacctcggcaatctcctgctcgatgaacttctcgtactcctcagcggtgatctcacccttggtgaacttgttacgctggatacggatctccttggtctgagggaaggaaccgatggtggtggtggggaagagaggaaggttgatggacttgctctgctcggcaagacggactgggaagggagacttgcggttgtgcatctcctcggtgacagcagcctggcgctccttgaccttggggtcgttggtgcgagcagacgaggcacgagcctgaacggacttggcgttggcctcgagctggtcgcggacagcagcagggccctcggtgacggccttggcgattacaacaacctcgtgcgtcttctcgacagcgaagctgaaccactcccggacctcgggatcgaggttcttctcgctctcaagggtgtgggggacatggagaagagagctggaggtagagacaataactcggtccttgccaagcttctggatagcgtgctcaaccttctcgatggcagccttgaagttggtcttccagatgttgcgaccatcaacaacaccagcagagaggacctgcatggggccaagagcggcaataacagcatcgagctgctcagggttgcggacaaggtccacgtggataccatgaaggttgtgcagagcagggagaacatcaatgttgtggacaatgtcaccgaagtaggtggcaaggacaatgcgaggagccttgtcaccgagagcaccaatcttctcatagacaggcttgaaggcagccttggacttggcagggagatcgaaaacgagaacaggctcgtcaatctgaacgtcctcgacgccggcagccttcagctgagcaaggaggtcaacgtagacgggaaccaggtcgttgatcttgtcaatagggtcaattttctgaccacggtcggccttggcgagggtcaggaaggagacgggacccaggatgacgggacgagtaatgatgccagcctccttggcctcgaggaactgagcaacgggcttggggttagaagcgagcttgaagacctggttctcctggagggtaggcttgacgtagtggtagttcgagtcgaaccacttgaccatttcctgtag

SEQ ID NO: 6588 - DNA, 1668 bp, A.fumigatus
gtcgtccctgagagatacagcaagtacaaccttgaccctcttgatgagtacttcgccatgggtcgtggtctccagaagcccgcatctgagggtcagcccgccattgacgttcctagcttggtatggtgctccgttccatcaaccaaacgtgctcagaaggttcccattctaatacgatatctacaggaaatggtcaagtggttcgactcgaactaccactacgtcaagcctaccctccaggagaaccaggtcttcaagctcgcttctaaccccaagcccgttgctcagttcctcgaggccaaggaggctggcatcattactcgtcccgtcatcctgggtcccgtctccttcctgaccctcgccaaggccgaccgtggtcagaaaattgaccctattgacaagatcaacgacctggttcccgtctacgttgacctccttgctcagctgaaggctgccggcgtcgaggacgttcagattgacgagcctgttctcgttttcgatctccctgccaagtccaaggctgccttcaagcctgtctatgagaagattggtgctctcggtgacaaggctcctcgcattgtccttgccacctacttcggtgacattgtccacaacattgatgttctccctgctctgcacaaccttcatggtatccacgtggaccttgtccgcaaccctgagcagctcgatgctgttattgccgctcttggccccatgcaggtcctctctgctggtgttgttgatggtcgcaacatctggaagaccaacttcaaggctgccatcgagaaggttgagcacgctatccagaagcttggcaaggaccgagttattgtctctacctccagctctcttctccatgtcccccacacccttgagagcgagaagaacctcgatcccgaggtccgggagtggttcagcttcgctgtcgagaagacgcacgaggttgttgtaatcgccaaggccgtcaccgagggccctgctgctgtccgcgaccagctcgaggccaacgccaagtccgttcaggctcgtgcctcgtctgctcgcaccaacgaccccaaggtcaaggagcgccaggctgctgtcaccgaggagatgcacaaccgcaagtctcccttcccagtccgtcttgccgagcagagcaagtccatcaaccttcctctcttccccaccaccaccatcggttccttccctcagaccaaggagatccgtatccagcgtaacaagttcaccaagggtgagatcaccgctgaggagtacgagaagttcatcgagcaggagattgccgaggttgtcaaaatccaggaagagcttgacctcgatgtcctcgtccacggtgaacctgagcgtaacgacatggtgcagtacttcggtgagcgtctcaccggttacgtcttcaccacccacgcctgggtgcagagttacggatctcgttgcgtgcgccctcccatcattgttggtgatatctcgcgtcccgctcccatgactgtcaaggagtccaagaacgccgtctctatctccaagaagcccatgaagggtatgcttactggccccatcacctgcctccgctggtctttccctcgtgacgacgtccaccagtccgtccaggctcagcagctggcccttgccctccctgtcttcaccacggaggctggcaggatccgcgatgcc

SEQ ID NO: 6589 - DNA, 531 bp, A.fumigatus
tcgccaaggccgtcaccgagggccctgctgctgtccgcgaccagctcgaggccaacgccaagtccgttcaggctcgtgcctcgtctgctcgcaccaacgaccccaaggtcaaggagcgccaggctgctgtcaccgaggagatgcacaaccgcaagtctcccttcccagtccgtcttgccgagcagagcaagtccatcaaccttcctctcttccccaccaccaccatcggttccttccctcagaccaaggagatccgtatccagcgtaacaagttcaccaagggtgagatcaccgctgaggagtacgagaagttcatcgagcaggagattgccgaggttgtcaaaatccaggaagagcttgacctcgatgtcctcgtccacggtgaacctgagcgtaacgacatggtgcagtacttcggtgagcgtctcaccggttacgtcttcaccacccacgcctgggtgcagagttacggatctcgttgcgtgcgccctcccatcattgttggtgatatctcgcgtcccgctcccatga

SEQ ID NO: 6590 - DNA, 255 bp, A.fumigatus
catgggctctgtagtgccgttttgggtttcccccgtatgggaaagctccgtgaccttaagaaggccaccgaggcttactggggcggcaagatctctcgtgatgagctcttgagcgagggaaagagacttcgtgctgagcactggaagatccagaaagatgctggtgtcgatatcattcccagcaacgattttgctttctacgatcaggtcctcgaccacatccagctcttcggcgtaagttgtcctgattgttaa

SEQ ID NO: 6591 - DNA, 354 bp, A.fumigatus
tatcaaagatgtagtcgtcgttgcagtaatggtccctatacacagggagaagggcttttaggcctcctcgtcctcctgtgcccctacagtgaactttttgcgcccggttcctgtgagcttttgcagtttgaccctgtccagctgctcccctacttttttctcgatctgctcgatctcttgttctggatcgacggcctcctcgtttgcgaattccaataccaatcttctacccaggagatgcgtattcttgagcgcgtccatggcattttccgcttcgcgagcgcttacgaagtcagcaaaaccgaaaccacgagcagaccggtcaaacttcttaggaacccgcacagagcgtag

SEQ ID NO: 6592 - DNA, 441 bp, A.fumigatus
gaggctatggatgctgccgaggagagaagacgtgaggatacagcaaagaaaatagcggcgcgtcgcacgaaaatcatcatcaagaacttaccattccaagcaaccaagaaagatgtcaggtcgctttttggagcctatgggcagctacgctctgtgcgggttcctaagaagtttgaccggtctgctcgtggtttcggttttgctgacttcgtaagcgctcgcgaagcggaaaatgccatggacgcgctcaagaatacgcatctcctgggtagaagattggtattggaattcgcaaacgaggaggccgtcgatccagaacaagagatcgagcagatcgagaaaaaagtaggggagcagctggacagggtcaaactgcaaaagctcacaggaaccgggcgcaaaaagttcactgtaggggcacaggaggacgaggaggcctaa

SEQ ID NO: 6593 - DNA, 573 bp, A.fumigatus
tcgctgcttggtgactgctgcgttcttagccaggcagtaagcatttcgagggcctcatcacacccttctctttggaatctgtcattctttcccaagagccctttgtgttggtgtccacccccgatggctactgactggcagcccgagtgtattgcgcctcagcatcagtcaggtttggagaacatcggacaccatacagatcgagctctccagaacacctcgggcaatgtacagtcctactcagacgctatccttcacggtgggatgagtggtcgtgatgaccatctacagcatctggcgtataaatattcccatgcccctgtgcatcctcaacccatgcagactgctaccactctgcatcctcaccacatcctaaacgctcgagttcaagcaaaaaagcttcgacgtgttcaatcactcggcccgaatcatgctggagctcgtaggggaagaagctacctcaagtctcaaaagtatttggagtatcgggcgcggcctcggcgggacactggcaaggacggggaaccggtctggtctgatgagcttgaggacgcttttcagcaaggtaactga

SEQ ID NO: 6594 - DNA, 570 bp, A.fumigatus
ataactcttagcgcgggtccgttcgcccatgtggtgaagcctgtcgatataatcgaccgaggactcgtcagcctcacggtagcttcggaggctttcaatagattcgtgactcatatggcgcctcagatgccgtttgtggtattccctgcgggcacgacgatgagcgatgttcgaaaatccaaaccggcgctccttcacgctattatcgcggtctctatcggcgccatacagcccgatgctcagctcgcgttgctggaagacttctacaagactgtcgcagatcgaatcgtggttaggggtgaaaagtcctttgacctggtgcaggctttgttagtctcctgcaactggtacactccacctgaccattttgagaagctgaaattttaccaattgactcacatggccgtcactttggcgatggatctggggatgaacaggaagttgttggttcgaaacaagcctttaccgatgttcaaggatatggttatgaagaagccgccgtcaatgaatcttgattccccggagacgcgacgaacttggcttggttgttatttcatggctgtccagtaa

SEQ ID NO: 6595 - DNA, 462 bp, A.fumigatus
  unsure (270): Identity of nucleotide sequences at the above locations are unknown.
catctcaaacagggtcaaacccccctccacctcctcagcgaagttgccaacagccgctccgctacagcccatccttcctcgcaccatcaaccaagttacgcctcccagtcctcagccgaacccatcacccagacaccatcctccgatttgaccgcgcaaaccgtcccgtctagcactgctaccgactccgacccttggactcagtacccttccgtctctctctcatccgcgacaacccaggctcaacagcaagcccaatcgcgccagttntactcgcctttcaactcgaattaccaggatatgtcgtcttaccctgacgggggcattatgatgatgtctccgatgaaccagggattctttgtgccagagttaggaatacaggttgggttcgactcggggaatatgtttgcgctggagcacctgctgacagatgggctgttgaacctttcactaccccgctga

SEQ ID NO: 6596 - DNA, 378 bp, A.fumigatus
tacgagtttcataataatgataatcttcagattgataaccatttaaatgaggcacagacacctaccagacgtggcaagcctcatactaaatcctgtgcaaatttaactgacaacaaagtcacgtcgcgtcgatgtagcaaggtacccgacgtgtccgacaggtgccagctagtctgtacggagtattgctacatccgtccagtccctatgccctgcaaccgtaaacagcacatgtatgccgtactagcattcatgaccactggtgtgctgaactgctggcagggtgagcgtgtgatgactgcaaacagcgaggtgcaccctggcgtcgatgtcgatccctactccggccagagcaatggcatgttggctgacgggtga

SEQ ID NO: 6597 - DNA, 498 bp, A.fumigatus
attcatgcggacctgcagcccttggtaaagacccgtgggtctgtggagaacatttggcccaacaaaatcgagtattcgatcagcactccaaccaaggccgtgattttcgggaccagcatccgagtggacttcaaactgattcccctcctcaaaggactcaagatcggacaaatcgtctcgcagctaatcgaaagtcatgaccttacccttaatcctgaagaccccgactctgtccgcaacacatacaaaaacaccaggacaattgtcaatgatgaacatgagttggatgaagaaggcaatctcgagatcatcgacgaagcagccgagggataccaattttctcgcttccttgacctaccaaagacgttaacacgctgtctgcaagataccgacacacgaggtatcaaaatcagacacaaattgaagttccgtgttcaattactgaatccagacggtcacattagcgaggtatgtactccacctctcaggaatgtgtaa

SEQ ID NO: 6598 - DNA, 864 bp, A.fumigatus
cattcacagctacgggctaccctccccgtttccatcttcatctcgccaaacctggcaattgacgacaacaacaaccttgtcgaccagacaccacagtccgctcaacgggcagtcaacgacctcgcacaacaggcgccccccttgtacggcgagcatcagttcgatcaattatatagcgaggtcgaccctagtggctaccgcacaccgggcccgggcagcggaccggggactccgtttggtactctcagccggaatttgtctgctgagaatcttgcatcgatgaacgccttgaccaacaccgatatctctgcttctgccttgcatagtcgactgtccaacttgcatgctagcaggttcagcaacccatcgccatctgatgctgacggccataccgacgtcgaataccgtcgtctgggagtctccaccgactcctttggcccctcttgtggttccaattcgcaaagtccggcgagtcccgaactttcccgcagaccttcggatgagggctaccatgaccatgattacattccgtctggaatggccacaccgttccacccacagttcgctgaagttgaaagcctcagtcgcgtcccaagctattcgactgcggtcagatctagtgtgggaccatgcgacagtgaactgccagattatcaggctgttgttgccgaggataccgccatgcctacactccagtcccctcaacaagcccacattcggagcgttggccgtggagtctcgacgggacacaccggcatcgatgtacatcacttgcgatccggcttcttcaactctcggacgtcagctcatcatgacgacgacgatcgcatactgcgtctcgtacaagcccgcgctcaggtgtaa

SEQ ID NO: 6599 - DNA, 210 bp, A.fumigatus
agtaacaccaacgctcacatcgcccgtggtattggctcacaaaccccccaatcctccatcgatgccttggtgcaacccgaaagcggtaaagctcagacacttatcgcgtacagcactgccacaatttgtattcaattcgggaattacctgagccacttaagtcatcgaccctatcaactgtttcttcagctgatctccaagaccagatga

SEQ ID NO: 6600 - DNA, 243 bp, A.fumigatus
gaatcgcctcgctttcgtaatgacggcactaacggcttaggctacctcatcccatacgagaaaatgcacgtctggttccgctggatcttctatctcaaccctggcgcgtacgccttcgaggccttcatggccaacgagttcgtgggcaaatcgcttcagtgcgtgcagccggactatattccctatggatctggatattccggctcggaatcgccgaaccggggggtgctcaaatcccggtag

SEQ ID NO: 6601 - DNA, 1512 bp, A.fumigatus
ctcgtcagttactggtcctcggtcggcccggatcagggtgtacctcgcttctgcgcgtgctttccaacgaccgcgaatccttcgacgaagtcatcggcgaaacccgatacggcagtatggacccatgttgttgcgagacgcttccgccagcagatcatgttcaacaatgaggacgacgtgcatttccccacgctgacggtcaaccgcaccatgaagttcgccctgcggaataaggtgccccgggaacggccagatggacaaggatcgaaggagtttgtgcaggagcagcgggataacatcctctcagcgctgggaatcaggcacacgacaaagacactggtgggaaatgagtttatccgcggtgtctccggtggtgaacgaaagcgggtgtctctcgccgaagtgattgccggacagagcccgatacaagtctgggataacccgaccaggggccttgactccaagacggcagttgagtttgctcgtctgctgcgccgggaggcggatatgaaccagaagacgatggttgctactatgtaccaggctggcaatggcatctacaatgaattcgaccaggtactggtgctggcagatggacgggtgacctactacggaccgcgccagctggcaaagagctactttgaggatatgggctttgtctgtccgaagggagccaacgttgctgattttctgacctccgtgacggtgctcactgagcgcattgtacggcccgggatggaggacaaggttcccagcaccgccgaggaattcgaggcccgctaccgccagagcgacatccaccagaaagcaatggaaggattcgacccaccggagaaactcacccacgaggtggacgagctgacggcggctgtggccagcgagaaacgcaagcggcatctgcctcgcagcccaagtgtgtacactacgagtctgtgggagcagatacaggcgtgcaccatccgccagttccagatcatggctggggatcgactgtctctcgtcattaaggtggtatcagctatcctgcaggccctggtatgcggaagtctattctacaacctcaaagacgacagctcgtccatcttcctgcgccccggcgccctcttcttcccagttctctacttccttctcgagtccatgtccgaaacgacggcctcgttcatgggccggcccattctctcgcgccagaagcggttcggattctaccggccaacggcattctgcatcgccaacgccatcaccgatatccccgtggtgctggtgcaggtctcttgcttctgcatcatcctatacttcatggcggcgctacagatggacgccggtcgattcttcacctattggatcatcgtcatcgccaacactctctgtttcatgcagatgttccgcgcggtaggcgccctctgcaagcgattcggcaatgcatccaagatcaccgggctgctgtcgaccattttcttcgtctacgggggtaagaatcgcctcgctttcgtaatgacggcactaacggcttag

SEQ ID NO: 6602 - DNA, 531 bp, A.fumigatus
cggcggctgtggccagcgagaaacgcaagcggcatctgcctcgcagcccaagtgtgtacactacgagtctgtgggagcagatacaggcgtgcaccatccgccagttccagatcatggctggggatcgactgtctctcgtcattaaggtggtatcagctatcctgcaggccctggtatgcggaagtctattctacaacctcaaagacgacagctcgtccatcttcctgcgccccggcgccctcttcttcccagttctctacttccttctcgagtccatgtccgaaacgacggcctcgttcatgggccggcccattctctcgcgccagaagcggttcggattctaccggccaacggcattctgcatcgccaacgccatcaccgatatccccgtggtgctggtgcaggtctcttgcttctgcatcatcctatacttcatggcggcgctacagatggacgccggtcgattcttcacctattggatcatcgtcatcgccaacactctctgtttcatgcagatgttccgcgcggtag

SEQ ID NO: 6603 - DNA, 768 bp, A.fumigatus
cgcctacacaactctcgccattcttcacttcatcatcaaacgaacatctacaagttgcgagacgcaatggccatcgagcaacacacgtccgggtgggacaacttcgtcgccaaacatggcaacgtcgaattcgtctggctacaattcatgtcctaccgcagtctagtctatacgcgcatgttccccatacagagattcaaagccatggtgcaaaagggcaaattcatcaccattccggaagtcgcactcctcctgggtcccggcgatgttatcgccgaaggatgtttcgcgtcgggtaaattctggttgcgaccggattttgagaccgtatattgccagcccggatccaatggaactcgagcggtcattatgtgcgactttgtagacgatgacggcacgcatagcttgcagtgcgcaaggtcgcgactgagatatctggaggagacactgttgagcgagctgaagtgctcagcattggtcggctttgaaatcgaggtgatgttcatgcaagctgagaagattaatggggctgtgcggttctccatggccaattacgagcattcgtggtccagtatgaccgccgacgacgagtcgatgctggagatgctggagaccattgcgcggacgctggctatggcagatgttcccttggagcagttccatgccgaagcggcaccgggacaatgggagtttgtcctgccgcctgcgaggcccatccaggccgccgatatcttcaccacggggctcgaaggtgccgcgctagcgtaa

SEQ ID NO: 6604 - DNA, 222 bp, A.fumigatus
cctcaatgcgctaaccgcaagcgcattcaggaactgagtcccagaagcagtacgaatgagttccgcaagttcattcggaagctgctcaaggatctgggactcactaagaagcctctcataggcaggtttttcattcattatgtaccctgccgccagaggaactccagtgatatggaacgaatggacaaaaaatctcgacacgccggaatgaaagatatgcgc

SEQ ID NO: 6605 - DNA, 1149 bp, A.fumigatus
agtctatgggttacccttcatctaaacgaacaaacagacgcgaagagtctcctcggaatgtactcgacatccccggctacaggttcctttgattggcagcccggtgtcttgaccaaagctgcaagggaaggtcgctggattttgatcgaggatattgaccgtgctccatctgaagtcatcggtctcatattaccgatcatcgagaagggcgagttgactatagctagtcgaaaggaacgtattaagtgcgccgagggtttcaagatcatcgcaactatgaagtcgacctataatattgcgggcgaagagattgcgccaaacgccaatctgttaggaagcagattgtggcagagagtacagatagactcgctttctatagaagaaattcgagaggtgatcatccgcaaattccctcttcttgaacctcgcgttcccgtcatcatggatgtctaccaaagggtttgctcctcattccacggaagccttgccattaaaagctcacaaggaaggaccccgggtcttcgcgatctgatcaagctttgcaccagattgcacatgcgactgcagcgactgggggtcaagactggctatgaagcgacacccgaagttgtcgaggatgagatatttctggacgttgtggatgtcttccttagatacattcccgagaaagctttggcggactcgctcgcattggttgtcgcggaagcactccagatatcgccacaacgggcgcaattctgtcttcatgaacggaccccagcctattcagaccatgggaacagcgtgacccttggaagggagatctgtcgaaagaataaagtacccagtggatcagcttcaaagcttgcagctgcttcctcgcgctttgcttcgactcgagcggccttgaagctgatggaacaggttgctgccgctgtgcaaatggccgagcctgttcttctcgtcggagagaccggtattgggaaaactacagtcgttcaacaacttgcaaatttgatgcggcagaagctcacggtagtgaacttgtcgcagcagagcgaaagtactgatctgctgggtggtttcaaacctgtcaatattcgtaccatggctgttcctatgctcgatgaatttaacacactcttcgaattgactcttcgccacgggtaa

SEQ ID NO: 6606 - DNA, 612 bp, A.fumigatus
gaagcatgtgcaggctgctacacctgtcgcctacgaagaaagaagtgtgatgaatctcatcctgcttgcaagaattgtaccaacctttgcgtccgttgtgagtacaagcggccggattggtgggcgagcgcagagcaacggcgggttcagaaagagcgaatcaaggcccggatcaggcaaacgaaagtgctggagaagcagaacaaccttcaaggtgggtgtgctccagtcagtttgagcgtccatcgactttgtctgaacctgctcactccagatttcatcgatcgccatctgccacctcgagtcactgtgggatatgatttcagtcaacctgtgcttgtcgacccgtatcaggcatacgactcatacaccagccaattttccgcttccaatttgatgtcgacggctaatgctaacgatcgacctgaagctgcctttgcgactgaaaacaagaacattttgaatggtgtgcctactccgggattctatggcatgccgcagcctcatgaagctctgttcaattctcccggctatgaatggccccaaatattagcttccataacgccgccgcactatgttcaaccacaatgttctgcccccaagttaacctga

SEQ ID NO: 6607 - DNA, 234 bp, A.fumigatus
ccaacatatccagcattcccagcatctaacaacctttcatcgaagcatctcatctgtattgtcatcgcaatcattagagtcccgactcgactcccctgcgcgccctgctttactggcacatttgctgtcgctgagtcggtccttgacaagcccttctcctctgatcccagtatcgatggaatgccattatatctacataattggagcaattattttcctcgctcaaaaatgtaa

SEQ ID NO: 6608 - DNA, 258 bp, A.fumigatus
ctaggggaataccaggcgggcatgtgcttcgtggatttagttcccgacgcttttaacagcgcatacgctttctctccattatcgcatagattgacccttaacctcagacagttatgtcaaggaaccggatttatgacggattgccttcgcggggaatggaagagactttccagccccatctacaggcagcagcagatctcatgggacaaatggacgtgtatgctgttatcacgtatggatctgtgtcggcgaagatga

SEQ ID NO: 6609 - DNA, 183 bp, A.fumigatus
gagaaacgggatgtactggtacgaatgagggtatataagggctctggcatcctgctctttcaatatccattccaggaaatccagtatctaacttcggtcaagaaccttccactactctcgtccatctcacgtcatcaatatgttgatcaaagacatcctcactgtgacagcccttctgtcttc

SEQ ID NO: 6610 - DNA, 264 bp, A.fumigatus
agacgtgaagcgcatggttatgggacgagtatcagcaatgctggctacacacaacccgcaatcaatgctctcgaaccgcagtttgcagaacttgcagattctatggcagatcttgaggcgaacttcatgcaccttcagctgatgcacgagagcttgacgcggttcagtgagagctttgccagcttcctctatggtttgaatatgaatgcgttctgtgtcgactttccggaggtatgttcaattatttccttacttctcaattag

SEQ ID NO: 6611 - DNA, 189 bp, A.fumigatus
ttatatatcctgaagctttccctcccagagtttcaagacttctttgattcttccaataccctatctatctttctgatatttctctacaacatccgtggaacggcttcttctcgtgctgtcaccttcggcatcatggctagcattacttcagcatccgtcttcaccagccgggctggaaagacaagcgct

SEQ ID NO: 6612 - DNA, 414 bp, A.fumigatus
tggctggacgcaggcgaagtcgccgcgaaactaaacgaactgggaatcccgcccaccgcgtacggtacccgctggtatctcacgctgttcaattactccatccccttccccgcgcagcttcgtgtatgggacgtcttcatgctcctcggcgatgcggaggaaccacccggcaaaggaaccaaccagtccgagccaccagtcacaagcgcgtttggcaggggcctggacgtcctccatgccacgtccgccgctctcatcgatggcatgcgagagatcattcttgagtcggacttcgagaatgccatgaaggtcctcactatctgggtccctatccaagacgtggaacttttcatgcgagtcgccaaggcggaatggaaagttcatcgtcgcaagaaaggggggatgaaagcgtga

SEQ ID NO: 6613 - DNA, 744 bp, A.fumigatus
cggctaaagcagaggaggatccgcagattacaagaggaggaaaagacccgccaggagtctctccgattagagcagcggaagatcgaacaaagcatgcttcgtgattcgcttcaatcgggagttccgcctcagatgattccgctcatcttcgccggaatcactggtggcagccttccccagtctgctatcgaattgatacagcagtatgcgtcccagaatcccggcacacacagtaatgcgcctcctcccccttcacgcccttcggctcctctgcaccagcaacagcaatccactctcgatatactaccgccgccacccacactctcccagcggcatccatctttggcaatccctgcagacattcgacgtgactcgcgcggccatccatcaaccacgtacgcgactcttccaccacatcaacaaccgattcctgggcctgctctgtctcagcctctcactacccatggacgttctcccaccatccagtctctcggacgtccgcccttgccaagcggtgctggaaaggccactgcctcatctttgtctcggatcaacggcgacacaccttcgcagcatgttccgctcacgctgagtgactcaaagtatgcaaccggctcttcacttcctccgtctcagccggtgggagtcaaacaagaacagacgccgcggcattctcctccatccttatacttttcaccaatggggtccacggggccagcccctcccagcaaagaaccaacatga

SEQ ID NO: 6614 - DNA, 315 bp, A.fumigatus
tctggacggacaagttctcgggagacgggtcggttttggtataaccttgcccgccgggatatcaagggatcccgatacgaatggggaccgcaaggccccaggtaccaaggggctgtggaaggctcgtgcacttatttccctgatctcgacggggatggccgtgccgacatgcatagcatttgggattccatcaacaacaccgcgcagacatggtacaaccaatgtgccatcaaagatcacacaggcgatgacggcccaatcactgaccccaatctacctgtatctcctgccagcatcgacgtcgtccctcactag

SEQ ID NO: 6615 - DNA, 1311 bp, A.fumigatus
tgcaaacggaacaaacaagcctatcaaaggtctatcaatcaatcaatcaatagtgatgaattattatcgcggggttcagaaattcttaatctcctcattcggtcttttccctcaatatcttccaccaaaatgcctccaacgctgtgtttcaactgcaaggaagccagagctgttattatccgtcccaagaaccggcacaagctatgccgcgcctgcttcctcgaagtttttgagactgaagtacacgagacaataacctcctcctccctcttttaccccggcgaacgggtcgccatcggcgccagtgggggcaaagatagtactgtgcttgcgtcagtcctcaaaactctcaatgagcgctacaactacggtctagaattatgtctgctctccattgacgagggtatcaagggctatcgcgacgatagtctggagacggtcaagcgcaacgcggtccagtacgatatgccgctggaaatcgtcgggtatagcgagttatacggttggacaatggatcaggtcgtcgagcaagtcgggaagaagggcaactgcacctactgcggggtgttccggcgacaagcgctcgaccggggcgctgcgcgactaggcatcaagcatgttgtcacgggacataacgcagacgatgtagcagagacggtgatgatgaatctactgcgaggagatctgccgcgtctgtcgcggggcactagtatcgtgacggactcggcggcgtcggatatcaagcgcagcaagccgctcaagtatgcgtacgaaaaggagatcgtgctatacgcgcaccacaagaagcttgattatttcagtaccgagtgtatctactcgcctgaagcgttcagaggcagcgcccggacgctgatcaaagacctggagaaaatccgccccagctcgatcttggatattgtcaagagcggagaggacatggctgcgctggtgccgttcgaggttagttcgagcgggaaaaagtgcggcggcactaatgttgctactgctactgcagaggacgatgaatcggcgggtggctgtggtaatcaaaacggtcgatcgagcggtggcgaaataacggagatggagaagaagcttgcagaagatgacgccgctcagttgagagagaccgagatcaagctcccggttgcccccaggagaaagagcggcaaggtgaataacccgagagcgatcaagaatccaccaatggggcaattgcgagcgctgcggatacatctcaagccagaagatctgcaaagcgtgtatgctcctggacgggttgaacaagaaccggcccaagaacgcgattga

SEQ ID NO: 6616 - DNA, 216 bp, A.fumigatus
  unsure (151): Identity of nucleotide sequences at the above locations are unknown.
ataacccgagagcgatcaagaatccaccaatggggcaattgcgagcgctgcggatacatctcaagccagaagatctgcaaagcgtgtatgctcctggacgggttgaacaagaaccggcccaagaacgcgattgaagtggccgtcggaatcnaggaggaagaaagcagctctacgctcatgagacagatggagagagtccagttgaacaccggctaa

SEQ ID NO: 6617 - DNA, 1191 bp, A.fumigatus
agacagattatctttgtgattgaccgcagtggaagtatgatggacaaaatcgacacgctcaagtcggccctcagagtcttcctcaagagtctcccggtaggagtgtgtttcaatatctgctcatttggcagcaggcactccttcctctggaaacagagccttttctacactgccgagagtcttcaggaagctctgagctttgtcgacggtgtccgtgcaaatatgggtggaacggagatgcaggaggccgtcgaggccacggtccgcagtcggatgaaggacaaggaattggaagtcctgatactgacggatgggcaaatctggaaccaacagacactcttcggattcattcgcgagactgcagctgacaacggtgcgcggttcttctcgcttggaatcggcaacggggcgtcgcattcgctcgtcgaggggatagcacgggcagggaatggcttctcgcagatggtggtgaactacgaagagctggacaggaaggtagtgcgcatgctcaagggagcgctgacgccacatattttcgactacaaactggaaatcgaacatgatgaccctgtcgaggagtttgaggtcgttctcccggagcggccaagggccatgcctgtcgacgaggcagaaatgaaacaacagccgatttctctctttgatgcagactacaaggaggacgagcaaaagacggacgaagaggccctgccggttcttacacctccccaaacccttcaagcgccgtacaaaatcccacctctctaccctttcatccgaaccacagcatacctcctaggttcagcaaacatgcagaatcccaaagccctcattttccgagccacctcaaagcaaggcccgcttgtcctgcgcattccaatcaacgacattggcacgggagagacaatccatcaacttgctgttcgaagagcaatgatcgagctcgaagaaggacacggctggctcgcggccgcaaccagcaacggaaactcattcgataatctccatcccacctcgaaagaacgcatcatcgcccgcgaatgcgagaaactcggaacccagttccaagtaacaggcaagcgctgctcgttcatcgctctcgagaaagacagcacctcggaccaggagaaagagacggatattggtcttctccacgggggtggaaggatcagcggctctggctatacaatatag

SEQ ID NO: 6618 - DNA, 1275 bp, A.fumigatus
accacacctgcaattgattccctgtcaacaatggaactgtttcgtctcctgctttcgcacccggtatcttcggccgtcgctctcggggcagtctatctgctctgggtggtcctcgaccggctgtatctgtctcccattgccggtttccctggacccaaactcgctgcgttgacccatctgtatgagttctactgggataccatttgctgcggacagttcacctttcagattggtcgtctccatgagaaatacggtaagcgtaatcctctgacctgtcggctgcgttctgaatgcaccccgtcaagttcgatagatcacttcttggcgtttatccttgtccgttatgacatttcgactgtccacttgtactcatgtcatacaggccccatcgtccgcatcagcccgaccgaactgcacatcaacgacccggactactacgaagtcctctactcgcgcgacagcccccgcaacaaatatgaatactaccagaagacgctcaacgccccgctggccctcctcaacaccatcgaccaccacctgcatcgccagctccgcgcccagctgaaccccttcttctccagcacgcgcatccgccgccaggaaccggccatcaaggccctcgtcaacaagctctgccgccgcctcgacgagctgaagaacaccggccagccgctcaacatcgagcacgcgctcacctgctacaccaccgatgtcatcaccgactacagcatgggcgatgggtaccactaccttgacgcgccggacttcatcccgcagtggcacgggaccctcaacggcaccgccaagacgatggtgtttatccgtccggtcgcgtgggcgctgccgctgctactcgccctgccggaggcagtcacggcgtggctgaaccccgggatggagctgtttttcgatttccagcgccggtgccgcaagatgatcaagcggattgtggcggctcacaacgagaagggcaaccagggggtgcagaacgaggggttcgtgaatatctttgacgatatcctgcggagtaatctgccggcgaagaacaagagcgagactcgactggcgcaggagatgcaggtgcttgtttcggctggggcggagaccacggccaaggcgattacctatattctgttctatctgctgaatgacccggagacgatggcgaagctcaaggctgagctggagacggtgggcgaggacccggcactcgttcaattggagcagttgccctacctggtgagtcatctggcaacatggccaaggccaggttga

SEQ ID NO: 6619 - DNA, 471 bp, A.fumigatus
gacctcctcagggtctatatgaggtgtacacttgtgacacatgtgatgtttatcagacactcagacaccctcaagtcggccgccaaaatggtcgcggcgcccatgatggagttctacaacaagaaccagactgaaggcatcccgggcaagctaacggacacctggtatgtggcgggcgccatgttcatgattctcatccagtactggtatgcctccagcgatgacacctataatactgttgtgtcacatgacctgatgttccagtcgggtgagaattatgacttcttctcaaaaaattacagtcactggttggtagggagacagatctgtccccatatcttatccatgttaacctctttcagggtaatgacgatcagatgttctggggacttgcctccatcactgcttcagagactgggttcccagagatcccagacaaacccacctggacctccctggcgcgggcagtct

SEQ ID NO: 6620 - DNA, 195 bp, A.fumigatus
tatctagtgcttgtgacagcaatactcaagtacaagcctgtcacagcgttgatcaatgagaccaacgcaatgatcggttctacccgcctgctagatttgcctagatatcagacagctcgcttaacagtcacactccaagacgaaaaaaaagtcgatcaaccgctgtgtttaccccaaaaggaaaacaagtgctaa

SEQ ID NO: 6621 - DNA, 1263 bp, A.fumigatus
ggccgaagacggtcagcgtctctgacccctccatcgtcttctggctggatgccgcctgccctcaaaggtcgaaggtattcatcacttcctctccgagcagatggattacatgctgagactcagaagtcgtttcttgatagctatgtggatgaaccagaagaagcgattgtcaattctcgactcaaaagcgatcatcgtatttacctagacgaacagacagacgatggacctcaacatcatgatgaaatcaagaacttggttctcaactttctcagagccatccgaagacaacataccatgaaactgactgtgtttcgtaacttcgcaacggacattgttggacgcatgtttgtgggcgaccttggagatgaccgagcagcacctataggtactcggtcaaaccatatagatagatgccgatttacaacatccctggatcatattatgttcaagagtccagttgctaagctaaagcgcaaacgcaacaagggcctaagatggatttcctgcgcagggacctattcccggtggaatgatgcgtctatcgtcgacgtcttgccggagacgggcagaaaaacaattctgcaggcagaaacccgtgaatatgatggtccgtacgactctctgattgtaaacggagcggactgcatggctgccgcattcgtttcaatgtttcgccatttgttcaagtgccctacggctatgtttcagctccaggacgaggtagacaacgcatttcgcaacttgactatatctgacgtccttcatcaagagacagagttacacgccctaccattcctggatgctgttatgaaggaatcgatgcgacttgccatgaaatttgattatcgaagagctgtccctgcgggtggtttagcagtcttaggacattatgttcctgaaagaacggtcgctcagttccattcagaggctttaagaaacaatcgtactaccttcggagaagacgtctctgattttcggcctcaaagatggctacaggcggacttggatcaatggcaacggacacgaatggaggaagcattgttgtttctgcgaccgaatatcccgaattctgcagaagctcgagcggcttggctagaattgaagcgagctgctgctttgatcatctggaagtttgatgtaagtacagtcggcagtcctgcagaagtcaaactaatatatttcagttgcatcctctcaactatgaggaagtgttcatccaagatgctgtctctccagagcaagaatacgagatcatggtga

SEQ ID NO: 6622 - DNA, 2484 bp, A.fumigatus
  unsure (36),(198): Identity of nucleotide sequences at the above locations are unknown.
ttgggaacctggcttccccaaggaggcctacccttntacggcaagggccgtccagtggattctcagaaatccgtttcgttcctaaaccgatacactttctcctgggcgtatagaaccctttccatcgcggcacagaatcaacgactcaacattgatgacctcccagttaccggagacgaagttcgtgcacagacgctntccagctctttctatgcagtcagcgcagcctcggcgcaatggaggaggtggcttaagctgtaccgggcagagatcacctatcaggtaatcctgcagctcgtcgccaatgcggtcaacttcctccctcagttcctcctccttaccatctttcgcatcattgaggaccgtgatgcgggagcaagcaaccagttgcaagtatggttggctgccataggtcttgggctatcgatggtggtcacctcatggtccatatccctgagagactttgtagctgatatgaagctttctctgccgatcaatgaacagctgctcgcggtcatatccaagaaagccatgagcttgaaggatgtcgtgatctctgccgacgatagcgagaatgaggatgctgcgagcgacaaagacgacgatgatgccgatgacgatgctccacccaggacaaaacattctgtcctcaatctcctcggcgtagacgtggaaagagtctccgagttcgtcgcctacagccatctgcttctcgactgcgtgcttgagcttagcatcgccatcgtcttcctcgtatacctgatgggatggaaacccatcgcggctggctgcgctatccctgtccttcttatacctttctactaccatttaacgaatcggtacagtgaacaggaacaagccctcatggaccgccgggacgacaaatcttcgaatctgacggtcatgatgcgcggcatacggcagatcaagttcagcgcgctggaaacacaatggtacgacaaaatcctgggattgcgcgaaaaagagctgcgtaaccagtacactgtcttccaactcgacgtcttcctgactgccatctggacgctcggcccgctgtgcataagctgtctctccttcgcgacgcatatctacctgaatggctcaattgccgtctcagttgcgttcaccgcgctgtcgctctttgaaaatctacagagcgtgctcagcatgttcccggagatgtttaccgaactactggatgccagggtcagccttcggagaatcgagggcttcctagatctggaagaacacgaggacaagagggtgcggggtgacgctatgtcatttcgcgacgcaaccattgcatggccgtcagctgggtcagaagacgcaacagggcagttccagctcacgggtctcaatctggacctccctccacgtgagctcacagttatttccggacggagtggtgttggcaagtcactactccttcaagcactcattggcgaagccgacatcgtaaaggggactgcaatcgtccctcactcatcagccaccaatcggccagctggcgaggaaaactggatagtggatggtctggttgcctatgtttcccaggatccatggattgagaacgcaacgatccgggatgccatcttgtttgggctgccgtttaaccccgagcgctatgacaaggtcattcacgcctgcgcgctctcgcatgatcttcagtcgtttcctgacggcgatagaacggatattggtgctaatgggatcaatctgagcggggggcagaagtggcgtctggcgttggcgagggcgctgtatagtcgtgcgagtattctcgttttggatgatatctttagtgcggttgattcgaatgttggacggcatctctatgaccatgctttgactggcagtcttgcgaaagagcgaactagggtcctggccactcaccatgttcgattgtgtcttggaggagctgcgtacctggtgaggctggagaatggcagagttgtgcaagcagggcatccatccagtcttctgcaagacgaaactcccgaccaaagactcgatgacagcacatcagacccgtcggatagcacacctacgacattgaagcctgttcagcgaacaaacgctactccgcgttcagatggccagcccaaaaagtactacgaggaagagaagcgagagcgtggtgtggtcagggccgaggtgtacaaggcttatatgaaagcctccgggggctactctcgctggattctcgtcgccgtcctttgcatcttaacgctgatcctgaacctggcagctccgtactgggtttcaatttggaccagagcatacaatgaaagtcctccgcggtcgatcctcacacagtctggtgatcatccagatttcaggactggtgggctgcatctggaccatcgccttgtctactatagctcgatttacttcgccttggcatttgcatcgtggatcctggacatcatcaggatccagcatgatcctcgtgtctacaagcagcgcgaaggtatgagacgg

SEQ ID NO: 6623 - DNA, 285 bp, A.fumigatus
cccgcgccccccatcacacttagcgctggtcctggcagccgtgtgagtgaacacgagccaagatatgacaggatcatgcaagactacgacaacattaagagaggtcatgttgaggacagcgtcaatgaagataagagcactgccgccaagatcttgcaagacatctacgcccaagtacttaacctcccttcaaacaaggtagaccccaagcggtcgtttgtgagcctaggtaagtggatcattgtccgtctcatgaagaagagaggaaaagaggctgactggtaa

SEQ ID NO: 6624 - DNA, 675 bp, A.fumigatus
agcgacacgctaatattagggtcagatttcgtcgacacgacaaaacgtgtgaaggacctaaggcggaagatcaaagacaacggccgatcttacttcgctcgcagccttctccaggccaacaataccgagccatcggacttcccagttccgttggaaatcgttttcaactatcttggtcgtttgcagcaactggagcgcgacgactcgcttttcaagcactatggggaggcgttcgacgaggagaagttcagattagccggagatatgggatcagataccccccggtttgccctcctggagatttccgcacttgtcgtcaacgacaagctgcaggtttcattcacgtacaaccggcaaatgcagcgtgaaagccagatcttccaatggatttcagagtgtagaagagtacttgagattgatgtgcttcgcttcaaggacaccgtgccggaacccaccctcagcgatttccccttgctccctataacgtatgatgggctcaagaagctcacgagcacaacgctgccaagggcaggggtcaagaccttcagccaagtagaggatatctatccttgctcatcagtgcaagagggtattctcctgagccagctccgggatcccagtgcgtacatgttccatgtgtgtcgtctacacgccgaagctggaaggacacgcgct

SEQ ID NO: 6625 - DNA, 435 bp, A.fumigatus
ctggtaaacacaggcggtgatagtattactggaatggctgtcatttcccgagctcgcaaacaagggctcaacctgacacttcacaagatccttcaaagcaagtctatcgttgagctgattcaagcagcggaagttgagacctcgagcattcaagtcgaggagaaggccaacaaatacttttccctttctcctatccaaaatttgtacttcaaatcagcacgcaccttcaaggaaacaggtcgcttcaatcagggtatgactgtgcgcgttactcgaaaggttgagccaaacgttgtcaaggatgcactcaaggcagttgccagccagcattccatgcttagggcaagattcagcagatctgcaaacggaaaatggcagcaacggattaccaatgtacgtgcaaaccaactcactgacgtggtcttaaggagctga

SEQ ID NO: 6626 - DNA, 708 bp, A.fumigatus
ccgatcacacaggatatcgagtcatctgttcgtgttggtattcactcagtcatgagctcccatgagatgctgggcaagattgccaatactcagtcgtctctggatatcgagaatgggccgatcattgcggccgatctgttcactgttaacggcgaacaagtccttttcctggtcgccaatcacctgtgtgtcgatatggtttcatggcgcattatccttcaagacatacaggaggtcatcgaagctggctcgctgtcttctgagaaacccttttcgttccagagctggtgcgaactgcaactcgaaaacagcagatcagaagcagacaaggccaagcttccgtttgccattgagcctccgaaccttagctactggggcatggagagcgtgcccaatcattacggacaaatcaggatggaatccttcgttgtgggcgaagacactacttcgtttattctgggtgactgccacgagatgctgcgcacagaaacaatcgatatcctgcttgctgcggttgcgcagtcattccgtcgggtctttacagatcgcagaatgccaaccatttataacgagggtcacggtcgtgaatcgtgggattcgaaccttgatctctcacggactgttgggtggttcaccacgttgtgtccactacaggtggacgaatgctcaggtaaatatcttctcgaaaattctagagcgacacgctaa

SEQ ID NO: 6627 - DNA, 825 bp, A.fumigatus
ggcgtcacggctaaccaagtggccgggaaataccaagccatcttcttctaccagctgtaccggctggaagtcgacgcccacggcttcgccaactcgcgcatggcgcccggctgcgcccaggccggcgtcgtctgcgacatggaggccttcatcagggaagtctgccgggtcaagaaagagccggagcgcgacgaaaacggcaaaatcatcaagccgcccaagggccaaaaaccgaagctcgtggatgtgcccgattttgacaaggttgactgggctcacatcggcgagggcgcggacctgaaggtcttcagcaccgagttcgacaagtctggcttcaagggcgactttctcaatgacaagatcttcaagggctgggaacagccggatacgttcaaaacggtcatgtcggaggccgaggatattggcaccaaggccattgccaagctccacgccgacggcaaaacgccggccgatgaccggatcaataagatgatagctgcgctccgggcccacgccgacgcccggcgctacgatcaggcacagaagatcaccaaggcgttcgcggagttcatggagaagaaggggttcaccgtcgcgtacacggatcccatcgagaggccgccagtgccggggtatcggaagattgacgcggacaagaccatcagcgataaccagggcaaacaggggtttgacaaggtggagcaggaggtgaaggactatgtcagcaaatttaatacggcgggacaatcgctgagccatgtcgaggcgattaccaagacgcagggcatgcatgaccatctagctgaggcgtgtaaagcagcatga

SEQ ID NO: 6628 - DNA, 564 bp, A.fumigatus
attagattacaatggcttcaaaaagtctttattcctgctactaccagtcgtacaactggtagatatcaactattaattcttgatggccatgggagccatctaacaccacagtttgatcaaatctgcactgagaatgatattattccaatctgcatgcctgcatattcatcacatctcctccagcctctagatattagctatttctctcctcttaagcgtgcgtatagccgcttgattgaggataagatacagcttagtttcaactatattgacaagtttgatttccttgaggcctatccacaagctcatacagcaatcttttcagcagataatattaaaagtggcttttcagcaactggattaataccactgaatccagatcaggtgcttagtcagcttaatatccagcttagaacacctacaccaccaggcagccgatcaactaattctatcccaaaaacaccttacaatctcaagcagctgaagaagcagggaaactacactttaagaagctacttagggagcgtacatacagccctcctacccctacaaaggctgtgctag

SEQ ID NO: 6629 - DNA, 444 bp, A.fumigatus
ttctatcccaaaaacaccttacaatctcaagcagctgaagaagcagggaaactacactttaagaagctacttagggagcgtacatacagccctcctacccctacaaaggctgtgctaggtcagattatcaaggggtgtgagatggcaatgaataacgctgcccttcttgcaaaggaaaattatgatctacgtgctgcacatgaaaagcaccttcaaaagcagaagcgatctaggcggcagatagaaactgcagtgggattatctatccaggaagggcaggagatcattcaacgcagggatcaggctgctgaagctatcccaactatccctccagagcaggtagtagatacagaacaacgccctcaacgggcacccccacgctgcagtgactgccatattctaggccataggcgattgcaatgtccgcagcgcaagaataactag

SEQ ID NO: 6630 - DNA, 1338 bp, A.fumigatus
tccgctcggttgcgtgatccgctcgcttaccgattacgttatctgctgccgcagctgagtcactccgaggccgggatccggcacgcagccatcgctctgggggccctccatcaacatctacatagagtcctctccaaaggtaaatgtgatccagcggcgagcaagattacgccccagaatgagtattttattattcagcagtacaactcggccatccggcatttggtggcacaactgtcctccacgacctcgcaccacgtaccgcatctgacgctgatcagctgctgtttatttgtctccctggagattctcagtggacatgttggtaaggctctcgatcatattgaagccggactgaagattctccagcgatgggagcatcgcacagatggaaaattaccgtcggaagcgattacacgagaactggcttatttcctgctccgctggaatacccagctctccacgcaaggtcggaagatgattcctctcaacctcagccagctcgatacagcggaatcagggggcaaccaagaatcctggtcggaaatctcagaagccagagaggccctcgttctactgagcaaccgcacgatgagtttcgtggaggccgtgggcaccgaccgaaagacgagagggtcgcctgggcaagtccgtcaacaacaagcgcttctccaagctcttgccgcatggctgagggcctttgaatgtctgatgaagcggtgtagccgacggctgaagaagaccgatcctcgaggaccggtcctgctgcgcatccagcaccgcaccaaccagattctggcatcggtcgccctgtcccgagacgagctcatatacgaccagctcgacgaggacttccgagctattgtttcctatgccgaggatctgatcgagctcaacgcgtccctggacaaagacagtgtgctgagcgtcttttccttggagagcggacttgtctcgtcgctcggctacaccgctaggaagtgtcgcaatccggtgctccggcgcaaggcaatccgtctgctctaccgctgcccccggaaggaaggactgtggggtgtgcagcagtatgcggttatcgcacgcatcattgtccaggcggaggaagcagcggtggctcatctgccgttagcgcagcggattccagaagatcggcatcgcgtgtatacagtgcacattcaaaacaggaattgcagctcatgtcgactagtattgatgtatctgcctgagaacggggatggagaatggcattgtcgggtcagggaggtggaatttgcggctgaggtgcacgcacatgatcccaacttttttgctgaatcggggatcaacttggaggcgtga

SEQ ID NO: 6631 - DNA, 567 bp, A.fumigatus
cggcgaggggtcttccatttcagcggtggcctgggactaccatcctcccgtgtcggtcttgcaacggcaattatcggggtcatcggcctcccgttgcagatcttcgtataccctcacgtccaatctcgtctagggaccttgagctctttccgcacatttttaccgttttcaccggttgcgtatactctgatgccgttcttggtgatcatccctcggtacccatggctagtctggtctgccttcacggctgtggttggacttcaggttatttctcggacgtttgctcttcctgctgctatcattcttgtgaataattgtgtcactgatccgtcgatccttgggacggtgcatggtgtcgctcagagtatagcgagtgcagcgcgtacactgggccccttcatcggtggttgggggctagggctggggttgaaaaataatcttgttggtggtatttggtgggcactagcgttggaagcattggttggatggctgctgctgtggacaatacatgagggaaaggggatcgagagaaggaaagatgcgagaagaggcacccaggaaagttga

SEQ ID NO: 6632 - DNA, 189 bp, A.fumigatus
cccccaaccaccgatgaaggggcccagtgtacgcgctgcactcgctatactctgagcgacaccatgcaccgtcccaaggatcgacggatcagtgacacaattattcacaagaatgatagcagcaggaagagcaaacgtccgagaaataacctgaagtccaaccacagccgtgaaggcagaccagactag

SEQ ID NO: 6633 - DNA, 306 bp, A.fumigatus
gccgccatcgtgctgttgccctattgccccgcgggtcacatgactctgatgcatttcctcgtccttgtctgttatttcgaaacccttttcttttttctcgacaacaaagccatggaggcctatagtttttgcgcccttcctttggaactcattgtgatggtcgcggactatttgggacctttggatctcctaaatttgattcaaggccttccccacattgccccccttctcaattcttggcatatccaggcccacgatgagaatgggcacaccatcctgcatcatattgtggaacaaagggcttga

SEQ ID NO: 6634 - DNA, 924 bp, A.fumigatus
tatctcatcaaacctctcgcgaaatggatccccgcgagctcaattgccgacaacgaaggctggacgcccctttttcaggcagtcaggaacagtgatgaatcgatgacaaaagcactggtttatgctggtgcagatgtatcagccaaggaccatacaggaaaaactgctcttcatcttgcctgctatgaggatgcagttggaattgtccagattctcctggaccacggtgcaaacccctccgcggcggattgcaacggacgcacgcccttgcatgacgcatttggacgaaacacagttatcctacagaagctgatcaaagctggcgcggaccttaacccccgacggatgccacgaggcctggctcccctttatcttgaagcttggcttggccgagaggatgctgttagaattctccttgaggctggagcagatccctccattcaaacagagaccggggaaaccatattacagaaagcaattgaagggtcccacactaaagtcgtgcagctcttacttgatgctggggttgatatcaatgtgcgagaattccaccatggcgtcaatgcgatactgacggctgcgtattggggagcagatgactgtattcgactgctccagagggctggggcagatgttttctcagtggattaccgtggatgtaacgcactgcatcgggcggctctggggggcaggctgtcgactgtcaagcttcttctgaaagaaggagttgacagctctgcagaagacaaccggggttacactccacaacgatatgcagttgaaggggtttatacacatggagggtcaagtgatattgactgggaagaactgattcgaatcctagaagatgtgcatactaaaagtccatttttgaggtttttgaattggatgcgagccaaatgctgctttacaaaaaagagctga

SEQ ID NO: 6635 - DNA, 183 bp, A.fumigatus
tctatgggcaaacacgtcctactgcgtagcattagtcagtggcaccactgtgacaactaccgcctcttcctcggccactccaacccgctcgtcaagcagcggctcgacgagcccctcgcccaccagctcgacagtggcgccaccagcgccaacacagcctggggccacttcctcctgctatga

SEQ ID NO: 6636 - DNA, 339 bp, A.fumigatus
actaatctatgggcaaacacgtcctactgcgtagcattagtcagtggcaccactgtgacaactaccgcctcttcctcggccactccaacccgctcgtcaagcagcggctcgacgagcccctcgcccaccagctcgacagtggcgccaccagcgccaacacagcctggggccacttcctcctgctatgagtggtatgttgcagtgcctggagatgattgctctaagattgatacccaatatggtatcacgttcgcacagctgagagcgtggaacccatacttggacagtacctgcagcaacctctggtcggactacgcttattgcgtgaagggagcgtaa

SEQ ID NO: 6637 - DNA, 567 bp, A.fumigatus
gcaatatcttcccggcctgtttttgctcctgctatctccaacttccaccacaataccactttactcactctaatgattatgggtacagttcgcgaaaaacacaagtgtatcatcaatggattcagccatctttttactctatttatcaaagcccattatatcgcccctactgatgtcctgtatcccccccatgacgctgatgttggacgccttcagagacttgggttcgaacctgaagtgattgatctcgtccaactcctgccagcgattagaaacgaagcagtctggagttacaacgacgaaggaatagaaatgatccctcgtgccaagctcgttaattatctgaaacagtcagaaacatctaatgctaatgacatgttggagaccctgcgctgggtcgaccatacggataaggatgcacaaggtctctttccgccatccatccttcgattgacattccctgccttttatggagtaaatgtgttgtatgatgtccacgaccgtaagttatttctctgcctcaatgtttactttattttccatcagccgaagaagccgaagctctag

SEQ ID NO: 6638 - DNA, 459 bp, A.fumigatus
atctgcgagttaaagagcattggatggagctattctaagattagagctaagcatcctgaggtgcctctttcaactattaaatcaactgttttgaatgaacgaaaacgcgttgataatcaatcaaaaccacgttctggacgacctcgccaggttactgaggtgcagagggatcatctctatgatctaagtcagtcttctcctcatctaaagatgctagatcttcttactgaggtatatggtgctgtgaaaaagagggcattacaatatcttcttcgtgaacttggtcttcgcaaatggagacagcttcatcgaccagctcttactggagagcaagccttagctcgtcttaactgggcaaatcaatatcaacattttacactggaagattgggcacgtgttaaatggagcgacgagtgcttagttgagagaggtgttggtatccgatggacattctgttga

SEQ ID NO: 6639 - DNA, 543 bp, A.fumigatus
ccaagagatcaactccgtgagcatgatgtctgcactcgacgaacagggaaaggtgttagacagatgttttgggcaggctttggtgaagagatacgtacaggcctagtccctctatatggtgatccagaagctccacgagggggggtatcaggccgggttataagagatctccatcaagcacagcttcctgagcttactgagcctggtgatatcttcatgcaggataatgctagagtccatactgcaaggattgtgagagaggtgcttaattccctacagattgaagttatgatttggcctccatactcccctgatctcaatccagttgagaacctctggtcgcttatgaaggagaagatctatatgctatatccagaactggaagatgcacctgatactgaggatacacgtcaattacttatccttgcagctaaggaggcatggcaagctatagatactagtattcttcaaaagctatcaaggaccatgcctaaccgggtgaaggcagttatcgaggcaaatggttggtatacaaaatattag

SEQ ID NO: 6640 - DNA, 318 bp, A.fumigatus
actgacgtctgcagcattcggtatgcatcgcctcctgtcgggcagctgcgatggcagcctccacggcctccagtcaagaataacagtcatatcatccctgccgtagacccacctcctatgtgtccccaatcgggtgctgcaggtactcctgccatctacggtttcaactcgggacctggggacgaggattgtctgttcttgaatgtctatgcgccccctggtgcatccaatctacctgtgttcgtttggatccgtgagttgcttctctcctccacctggccggcttgcaggtgttcgtccgctgattccggtgattga

SEQ ID NO: 6641 - DNA, 474 bp, A.fumigatus
ggcaatacttttctatcatcgtccgagttatatccggcattaaacccacagtctccgaaacccccgatcttcctcacccaaggaagacagggaatatttgatccgtgtccatgttttcccactccgtttctccgactaagcgatttctcatcatctgtgtcagcgcaggaagggaacccaatgaaaactgatgtttgcctgttgttggcggctactctggcccccatcgtcggtggttcctcttctggtctcattgtccacctcgattattcgtcttatcagggatatcatgaggcctctaccgggttgaatatctggaaggggtatgcggttactcctcaacctgcctggaacgcagcaaatgctaaactgacgtctgcagcattcggtatgcatcgcctcctgtcgggcagctgcgatggcagcctccacggcctccagtcaagaataacagtcatatcatccctgccgtag

SEQ ID NO: 6642 - DNA, 753 bp, A.fumigatus
atcgtaagtcagcgatgcaaaacaagaaaaccccagatttcattaaacaatgctaacaactcaattagtcttgtcgatgagatcgccaacaagatcgtcactgacgagggcctgacccccacgcccaatgtcattcttggccccttctggtctcccaacgctcccttccgcaatctcggcgacagcatcatccaggaccccaaccccaacggcaaggtcaccttcatgcacggtgtcttgacagacatggagaccggcaagcccatcgccggcgcggtccttgacatctggcaggcctccgccaacggccagtatgacttccaagaccccaaccagagtgagaacaacctccgcggcaagttccgatcgaacgagaagggcgagttctactggtactgctaccaccctaccccttactctctgcccaccgacggtccggccggtgtgcttctcaatctcatggatcgctctcccatgcggcccgcccacattcacctcatgatcacccaccccgactacgccaccatcatcaaccagatctaccccagtgacgacccacacctcaacatcgactcggtcttcgccgtcaaggatgaccttgtcgttgatttcaaacccaagaccgacgaccccaaggctgagctcgacctcgagtacaacgttaaaatggctctgaagaagcaccaccccaatcccaactcggcgccccctgtgtcgtccttcgagcgctacaacaagggccagaagctgtga

SEQ ID NO: 6643 - DNA, 384 bp, A.fumigatus
aatgattataagagcagtgatgtctctctctcatttctttgtcaatcatcctccgtagacaatttacttctccctcgcaactcttccagccgtgccatttcgactcatcttcatccacaccaatacacaatgtcgcccaagcgccaattcgaccccaactttactccctatgtgatcaactctatgggacccaagactcccgagcgtgctcgcgtcgtcttgggatctctgatcaagcacatccatgactttgctcgtgaggtcgagcttactcccgccgagtggatgctcggtgtcgagttcatcaactctatcggcaagatcagcactcctgtgcgcaacgagtgccaccggatttgcgatgttatcggccttgaatcgtaa

SEQ ID NO: 6644 - DNA, 714 bp, A.fumigatus
atcaattattcaaacgctccctcacagcttctggcccttgttgtagcgctcgaaggacgacacagggggcgccgagttgggattggggtggtgcttcttcagagccattttaacgttgtactcgaggtcgagctcagccttggggtcgtcggtcttgggtttgaaatcaacgacaaggtcatccttgacggcgaagaccgagtcgatgttgaggtgtgggtcgtcactggggtagatctggttgatgatggtggcgtagtcggggtgggtgatcatgaggtgaatgtgggcgggccgcatgggagagcgatccatgagattgagaagcacaccggccggaccgtcggtgggcagagagtaaggggtagggtggtagcagtaccagtagaactcgcccttctcgttcgatcggaacttgccgcggaggttgttctcactctggttggggtcttggaagtcatactggccgttggcggaggcctgccagatgtcaaggaccgcgccggcgatgggcttgccggtctccatgtctgtcaagacaccgtgcatgaaggtgaccttgccgttggggttggggtcctggatgatgctgtcgccgagattgcggaagggagcgttgggagaccagaaggggccaagaatgacattgggcgtgggggtcaggccctcgtcagtgacgatcttgttggcgatctcatcgacaagactaattga

SEQ ID NO: 6645 - DNA, 261 bp, A.fumigatus
aactcttcttctgcggctggtgagcacgctggcaatcaggcacggttcaagacggccgtgctggaaagcgactctccccttaggcttaacggagccgacacaaagatgaccgacacggccgagaatcccggtgcgcgcgtgcgtctgttgtcgattcccaagttcaaggacacgggggagttgattctcgtggacagcgagacattggaggtagagctggtcaaatttggtacttttgcaggaaagcaagagaaccaataa

SEQ ID NO: 6646 - DNA, 402 bp, A.fumigatus
aaagtatcaccatcgagactcggtctactcagaaagtcgacagtcaggcagaagaaaagaaggggggggggaaacaaagagaaaaatgcccgtccccataacaattataacgggcttcctcggctccggcaaaaccaccctcctgctcaatctcatcccccaactccccccaacctaccggctcgcactcctcaaaaacgaattcggcgacgtagccatcgactcgcagctcgcctcgacacagtccatctccggcgtgcgcgagctactgaacggatgcatttgctgcaatctcgtgggccagctcagcgacgcgctgaaccagctgcgcgaggaggttcagccagaccgcatcgtcatcgagacgagcgggagcgcgttccccgcgacgctggcgaatga

SEQ ID NO: 6647 - DNA, 642 bp, A.fumigatus
attagggcttccaaatcaggattagcgcctctgcccctccggtgtaaaaagtatcaccatcgagactcggtctactcagaaagtcgacagtcaggcagaagaaaagaaggggggggggaaacaaagagaaaaatgcccgtccccataacaattataacgggcttcctcggctccggcaaaaccaccctcctgctcaatctcatcccccaactccccccaacctaccggctcgcactcctcaaaaacgaattcggcgacgtagccatcgactcgcagctcgcctcgacacagtccatctccggcgtgcgcgagctactgaacggatgcatttgctgcaatctcgtgggccagctcagcgacgcgctgaaccagctgcgcgaggaggttcagccagaccgcatcgtcatcgagacgagcgggagcgcgttccccgcgacgctggcgaatgaagttaaaccgctcccccgccaacacccgggcaactttgtgctgcacggggtgatcagcgtgattgacgtggagaatgggaaggggtacgagtatacgtcgtatagggagaacttgcaggccatgtatccggatcaaacctttcaaaataatgggaaggcggtaccggaacaagcgtttcaaacctgggcctga

SEQ ID NO: 6648 - DNA, 411 bp, A.fumigatus
  unsure (359): Identity of nucleotide sequences at the above locations are unknown.
atttcaccaagggaagattgcgacccctaccgtgcctttctcgagagtaaactaggacaatttcaaccagtcattcagtctgttcaaataacaatgagagagaacatttatggatttcaaggaaatcaaaagagttattatctgaagatcaccgtcacggaaccgaagttcatcagcaaagtccgaagtgcgctggagaataatgcccaaagcttgaattataagggcttgtggaataaccctgatggtggtattctcaccttcgacaatatccagtatcttcttaagttcatgattgacacggacattgcgggtatgttctgggttgaaccaaaggccggaaaataccactggcccanccctccggagatttatcaattggccagattgaaacggttctcaataatctga

SEQ ID NO: 6649 - DNA, 741 bp, A.fumigatus
ctcaggctctaccttcacatctgccgtgtcaaagtcagctttcatatcgtacaggcagatgttaaggagattattcaggaagatggcagtgtgaacggtgtccgaactacatctggactagttaaagcagaaaaggtggttatcgccactggcatctggtcagaggatctctgcgactttggtgtgccgattccggtcattcctgttgcgcatccatacatgtatggagaacagtgccagccaaaaccccgcaagtcaccgtttgttcgatggcctgaattccacgtgtatgcccgtgatcatggcacagcctatggacttggcgcttatgatcacaagccgctctatcacaagcccaatgagactgcgattggtgactgggtcgacgcattcgacgcaacactggagcgcgcccgcagtttgatacctgctgagacgaatttgaccatcaaggagaaattcaatggtatcttctccatgacaccggacaatctgcctttggttggcaggatctcgtcaatcaaaggtctatatatggcgactgcagtgtgggtcactcatgcggctgggtcagctaaattcttgaccaagctgattcagggtgaagaagttgacgagtccttgaagaaagcactggacccaaaccggttccagggtaaggagatgcaagctttgaaggaggagtcgctggcaggttataacagcatctatagcactaatgagaacagacgatcgcgatag

SEQ ID NO: 6650 - DNA, 582 bp, A.fumigatus
tccgccaccatgcctgaagccgtcgcaatgccccagaagcgggttctgggtgatgcaacgaataatcctcgcagcatactgaacacccctggcacagtgaagaaacgaaagctcgatgcaggaccctccgccacagttaattcattatcgcagaatggcctgcggaaatccttcggctcaagtcaacctcagaagagccaattcgaagaggaagttctggaaaagttgacccaggacatcaacgggctgaaagatagcaactcggaaaaggaccaacaatgggagcggccacctttgggtgactttgatgagaccaaagataacatctgctttcagcagattgatgcagaagagggaacgattactggtggaaagacagctgttagacttttcggtgttacagaggtagatttgtcccctcactgccagtcggtttggtttgctaatgggtttaatgcaggccgggcaatcagttttgctccatgtcaccgggtttcagcactacctctatatcgcggcgccggtgaatttcaccaagggaagattgcgacccctaccgtgcctttctcgagagtaaactag

SEQ ID NO: 6651 - DNA, 192 bp, A.fumigatus
agtcaggctctggatcgatcgcttactctccctgcaggccaggtcggcaagatgctcggagagagatggaaggccctgagcgacagcgaacgccgaccctacgaggagaaggccgccgccgacaagaagcgttacgaagacgagaaggcgagctacaacgtatgtggttatacttattgtgccttgaaatga

SEQ ID NO: 6652 - DNA, 402 bp, A.fumigatus
acctctagaatatccaccccccggacgaccatgcaacgcctcttctccgatggcgacgacgacctcgtcacagcagacaccctcacaacgtggtacgtccatgtgccgctctcctccggctacgctcatgacaaggtcatccttttcgacgccatctgcagcgccatccaagccggccgctgcgagatctattcctcgcgtaacctagagaataacatttccgggttcatgattgaggtccaggctcgattctccgacctggggacagttcggcgtgcagcgtatcatattgctcaaaggcatctggattttcatagaatggagatgcagagtaggacgcagacgaggctggcagagaagtgcctggctagcttgagtttggaggatgcaagagggaagtaa

SEQ ID NO: 6653 - DNA, 465 bp, A.fumigatus
catcagcagtacattgcatctcaccagccctctacaaacccattgaaacccaactataccgaaccgagcggggcaacaagcaaaatgggcctcctcgaactcatccaacacctccgcggcgaagagcccacaggatacacctggtacgtccacttccccctacacggcgacccactgacccaaagcgaaatccttcatacagccgtccaggagctgcgccaaaagaaaataactctgtggcaatctcgaggcgcagcgcccgacaaggggatgctgatgaaagtaattgtggctgataacaaggccgcagaagtgctcaaggccgctgggacggtcctcgagcggcggttgcaggacgcgaagttgtcgcttgagcggattcttcagaaggataatgataagagggcggataattatgttaccaagttgaagagcgatttggctgcattgtctatggatgggtaa

SEQ ID NO: 6654 - DNA, 2028 bp, A.fumigatus
ctgaccgtgaagtttctagatcagttatctccggatgaaatacgagctaccacgcaattgatccgcgagataagcactggccagtatatcaagtttaattgtctgactctccgggagccgctcaaggctgaataccttgctttcaggcagggtaaaggaccccgtccggatcgccgcgcatttgccatcctaatagatcgtcactctcctgggggagtaatagaggccgtcataaaccttacgtcgggtgtcattgaggaatggaaacgtgtggaagatgtgatgcccattctcactcccaccgaccttggcttcatcgagcgagtggctcggtccgatcctcgtgtaatccaagcctgccaggatatcggtatttatgatatgtcacaagtatatttcgacgcttgggctatcgggatcgatgagcgctggggccgcgaccgtaagctccagcaaggcttgccttactaccgacatgagccggaagataatcagtacgctcatccactcgactttatcgtcattgcggacacagatactgaagagatcttgagtgtggatgttcgtacagtggatggagaacggacacgtccgccattgaaacagcaaaattatctacccacttctctccagcatgggtatccttacgatactctgaagcctatccatattacacagccggacggcgtttcctttcaattgcatggcaatatgctccattgggccggctataagatgcatatctgctttaattaccgggagggtattgtactctcagatatcagcatatatgatccggtggaaaagaggcagcgaccgctcttctaccggatcagtgttgcggaaatggtggttccttatggatgtcctgaaccacctcaccaccggaagcaagcattcgacgttggagaatacggcatggggctgatgactaattcattgagactgggatgcgattgcaaaggcgtcattcaataccttgacggagttatatctgaccagcaaggcattcccgtcgttgtgaagaatgctatctgcattcacgaggaggataatgggctgcttgtcaaacacactgacttccgtgatgctcgctcaatctcggcacgagaccggaaactgattatttctcagattatcacagccgcgaattacgactacgggttttatcatacgttcacactggacggtacctacaaactcgaggtcaggttgaccgggattctgaatacttactgcttacacccctcggagacggcaaacccgtacgggacggaggtcgctcgtggagtcaccgctcacaaccatcagcatatcttctccttgagaatcgatccggaaattgatggggtggaaaatgaagttcgagagtgcgatgctgtccccttccaatacacggatgacagcaaggctaacccttacggcaacggattcttttgccggcaacgggcagtggaaggtgccagtctcgcatcgttaggccgctcatgggacattgtcaacccaacgaaggtcaacccagtatgcaagaagccagttggttacaagatcttgaattctcagtatcctggtctcctggcgcaggaagggagcattgtacgccagcgcgcagcctttgccacaaagcctctgtgggtggtgccgttcaaggatttccggctttatccagctggtaactatgtctgtcagtcaacaggagaagcacaccaatctggcaatgaaacattggagggctgggtgtcagacgcaaagcacgcagacatcgtgtgctacgtgcagtttggccttacgcatatccctcgaactgaggattttccgattatgcctgccgagccagttagcgtaacactgcgcgcggccaacttcttccagagcagcccggctctgccatttcttacactgcctcaaaaccgcgacaccaactcacaactggcaggtctgggtcaaagtgcctgtgttagtcacactgtgacagtacgccaaggcagtcacgataatccaaggcttcaaaaaaagctctctttgtga

SEQ ID NO: 6655 - DNA, 315 bp, A.fumigatus
ggtcgaagcaaacgtcagcttcctgctcctagccgggacggagacgaccgcgacggcactgtcagggacaacgtactacctgctcaaaacccggaggcgctaagaaaagcaacggccgaagtgcgaagcgcgtacaacagcgaggatgagatcactttcgccaccaccgccgagcgcctcccctacatgcaggcctgtctgacagaggggctgcgcatctacccatctggccccattgccgcgccgcggcggaccccgcgaggcacggtgacgtggattgcaggccatccggtgccaggggggggggggggttag

SEQ ID NO: 6656 - DNA, 531 bp, A.fumigatus
  unsure (454),(502): Identity of nucleotide sequences at the above locations are unknown.
agaataggcttcaccgaagtgacagtgtgcagtatattgtatcagagctggttttcttgtttctattgtgtgtgcgttgtgttgtctgtcacctggtctcctcctctcttccccggcaatatggcttcaaacgggtgcttgactccctcggagctcaatggacagagcaatggccatatcaacggggccacaaacggatactcgaatggacatatcagtggactcacgaacggatataccgacggtcatgtcgacgacagacatggccacgccaatgggtataccgatggtcatatcgaggattacacacggcatgaagaccacagaccttcagctccagttgccatttgtggcatggggatgcgactgccccgcgggatccgtgacgaacagtccttctacgaatttctcatcaacaaaggcgacgctcgctcctctacgcgcaacgaccgcnataacgtggatgcatattacaggccctcatgggaagcacggcacaagngatcaccaaccatggttactttcctcaag

SEQ ID NO: 6657 - DNA, 393 bp, A.fumigatus
  unsure (105): Identity of nucleotide sequences at the above locations are unknown.
cgtggattgcaggccatccggtgccaggggggggggggggttagtgtgggcgtgcatgcatggacagcgtcgaatagtccgttgaatttccaccggcaggccganttcatcccggaacggtggctttcgccctcgacaatggacccggcctcgccgttccagcgcgataatcgtgccgcctcgcagccgttcagtgtggggccgcgtaattgtctgggaaaggcattcgcgctgaatgagatgcgggtcattctggcacggatgctgtggaattttgacatgaaattgttaccacagagtgacgggtgggagaggcagaggattttcaccctgtgggataagggaccgttgatggttgaattgaacgaggttcgatcaagcctccacaactaa

SEQ ID NO: 6658 - DNA, 609 bp, A.fumigatus
tctgcttgggataacacgaggctacccttccttcgtccgctggtctatcgcctcacccccgacgtccagcgtgtataccagcacaacgctcgtgccagggagctcgtaggatcgattgtgaagcagcgagagaaggatgaggcaacgataccaggatgcacaaagcccaacgatgccattgaatggatatgggatctagttccaaatgaagataagaagaaccacggctatcaaggcatagcgcagttagccattgcagccgtttcggtgccgacaaccagtcaactactcaccaatattgtactcaatctgatcgcgtatcccgagtacgttcccatcttgaaggaggagattgagaatgtgcttgcgtcgtgtgacggtcaatggacgttggacagcatgagcaagctggaaaagctggatagtttcatgaaggagtcgctgcgattcgacactccgctaacaggtcatcccccgtcccttctccaagacctctatagagagtctccgaggacacagtggctgactctgacacagctacgtttcaacgcaaggccgtgcaacgcatcaccctcagcgatggcacagttctgcaacctgggactttag

SEQ ID NO: 6659 - DNA, 357 bp, A.fumigatus
agagtctccgaggacacagtggctgactctgacacagctacgtttcaacgcaaggccgtgcaacgcatcaccctcagcgatggcacagttctgcaacctgggactttagccctagcaccctccaacgcgatcgccttcgacccgaatatctacccaaacccggagcagtttgacgggcgtcggttctacaaactacgacaccaaaacaattccaaggcgaaaaacatcatctatcagttcaccgcggcaagcaaaacacaggtgcggtttgggggagaacgacatgcctgtcccgggcgatggttcgccgcacatctgatcaaaatggtagtagcaggcgattctcttcaagtatga

SEQ ID NO: 6660 - DNA, 1068 bp, A.fumigatus
catcccgcaatgcgcgggtccttcggcccctgtggtgaagagcttttcgcagaggccggtgaggcttgggtcgtaatgattgcccgcctaccttccgagttccgcggtctagtggaagcggttcttgaatgctgcgcccgagactgggagcacgacgcagtttctcttacttttgttttctggtatgagctgaagcaatacgtcacactcgagcgatacggagacgctcgtgtcgcgttcaccgatgtattttcaaagctggtggacatcatggtcaaacaccttgaatacccccgtcccgaagagggcgaaaccgatctattcggtggtgatcgggaacaggaagagaaattccgtcattaccgtcactctatgggtgacgtacttaaagattgctgcgccgtcatcggtgtcactgagtgcttgtcaaatgccaacgcgttgatccaacagtgggtctccaagtacgcatctcaggcaagcgaccagcatgtccctcactggcaggaacttgaggcaccacttttcagtttgcgggcaatgggccgcatggtcgaccctgaggaaaatacagtgctttcgcagattatcccgttgattgttcaaatacccaatcaggagaaggtgcgattccaagctatcatggcgctggcgcgttacacggagtggaccgctcaacatcccgaaactctggaagcacaactcaactatgtcatctctggcttccagcataattctcccgaggtcgtgcaggctgccgccttagcatttaagttcttgggtacagactgtcagaaactactgggagggcacatcccgcaacttcattccttctatgaatcggtcatcgataagttgaagccggccagccaggaagaagtcacggagggcgtagctgctgttgttgctgttcaaccccttgacaagatctatgaaactatgaagttgttttgtgatcccatcatggcacggatcatgaatctggccaacaatgcgagtgatgagcaaggccagcgcgctgttgccggtatgtttaacgtgcatttttttcacctatattggagctga

SEQ ID NO: 6661 - DNA, 1167 bp, A.fumigatus
cgtgcatttttttcacctatattggagctgaccgattcctacacagaccacttgcaattgattacaatctttgtgcaagttgtaaatccatatgtcggcccgaatgaagacaacccggccgtcaagtattgcggcgagatcctgcccattatgacgacgattgttatgaatttcacttcgtccacccccatattggagcgtgtctgccgttgctggcggtacatgatcatctcgtaccgaactgcgatgattcctctgctgcccacgctggcccagagcatcgccaacgggtttgaaacttcacgggaaggatgcttcttgtgggccaccgatgctgttgtgcgcgagttcgctgaaggggccgagttcgtggaccggtcgacaagcaatgctgtcttccagttctacgaacaacaggcagttgcttttctacggatcctgaatgagctccacccagaaaacctgcccgatggtaagctctattcgtcttgtaagactatgttgtggtacgctaactccgatgcagtcatcgaggacttttaccggctttcttcagacgctgtccggttctaccccaaagagtgcatcagctcgtccctcgcagtacccatttttactgcggcgctcagcgccctcactctccagcagattgatcctttgattgcgacactgcactattaccatgatttattcagttttgcgttcgaaaagcccgctgtctcggagttcaccagctccgatggggattcgtatacgaatccacctgaggtcagagaggctgtcaagcagttgatccttgctcaggggcaagttcttacccaaagaattctgactgggatgatgttcacattccctggggactgctttgcggacgcttcgggcgttatgatgacactctttgacttagtgccccaagaagctggggcatgggtgcagtccacgctccagatgctcccggcagggaccatgaagccaggagaggcagagcggctgcttaaaggcatcgcagacaaagtgcagaccagggaaatccggaagatcagatctctactacaaggtgggaccgggccccaagactccacagtctctattatgactaacagcatcctacagactttacccactcatatcgccgtcttcaccacggggctggaaggatccgagcta

SEQ ID NO: 6662 - DNA, 183 bp, A.fumigatus
gttgaagaaacgtttggcgaagatccatacctttcgggagagatgggatacagctacgtcaagggcctccagagcctcaacgtctcctcgatggtcaagcactttataggattcagccagccagaacagggtatcaacacggctcctgttcacggaggcgagagatatctgcgcacaacgtaa

SEQ ID NO: 6663 - DNA, 243 bp, A.fumigatus
gaagctgctgacaacttgtttaggtatgacggcatccctgctgtttcggactaccatactctgaccgagatcctgagaggcgaatggggctacgactactttgtcatgagtgatgccggcggtacagatagattgtgctcggccttcaagctctgcagaagcaaccctattgacatggaagccgtcactctccaggttcttcctgccggtaacgacgtcgagatgggtggtggctctttgtga

SEQ ID NO: 6664 - DNA, 327 bp, A.fumigatus
cgtatgcaaagcaatttccagaaaatccctgaacttgtcaaggccggcaagcttgatatcaagactgtcgacaccgcggtctcaagagtgctgagagcgaagttcgagatgggcctctttgaaaacccctatcccgctgcccccaagtcccaatggaacaacctcatccacagcaaggaagccgtcaagcttgccagacagttagacaacgagtccatcgttttgctggaaaacccctaccataccctccctttgaagaagaagggtgacattgccgttatcggacccatggcccatggattcatgaatgtacgtgccactgcatag

SEQ ID NO: 6665 - DNA, 207 bp, A.fumigatus
gatggcccaattaatgcagggtccgtcagtgattcaattccttttggctttcaacgatcaatttcattgacaaagctgattgagtcggctacaggtgatattaccaattggatgaactccaccagcggagcattcaactacaccggtctcgtcgagaatatgaagatgaaggcgggatcgttctatggtagacaaaccggaccctga

SEQ ID NO: 6666 - DNA, 183 bp, A.fumigatus
tcattttgccggacactaacatcaaccctccagatcaaatactgggctcttggtaacgaagtgtggggaccatggcaggtcgcgcagatgaccaaggaggagtacgctcacaaggcttaccagtgggcaaagggtgagaattcattcgctgcgactccgaaagggaccaaccagtcaatctaa

SEQ ID NO: 6667 - DNA, 255 bp, A.fumigatus
tgcttaagacattgcaactctcgctactctgagtgtcgtgctaacctcgacctcaggcatatgggccgatgcatttatggaggcatctatgatccaggcaatccgttgtctgacgagaatggctttcgcaaagatgtactggaagccctcaaggagctgaacattcctgtcattcgttatcctggtggtaattttacggcaacctatcactggattgacggtgtatgccctaaagatcaacggcctgcgaggtaa

SEQ ID NO: 6668 - DNA, 957 bp, A.fumigatus
  unsure (151): Identity of nucleotide sequences at the above locations are unknown.
gaattcattcgctgcgactccgaaagggaccaaccagtcaatctaatatactttctagcgctgaagctgctcgacccttctctgaagttgatcctctgtggccaagacggcactgcctcatgggactactacacactgaagcagtgcctgnttcccgctcattcgcctctctctactagcaccgttcctctcatcgacatgcacagtattcacatgtacacctgtggttcaacccatctccccaacgttaccgccccactcgccgctgaacgcgctatcgagattacctcatcccttatcgaccttgccatgattgagaacggtatccctcctgaccagccgcggcccacaatctgctttgacgagtggaacgtgtgggaccccctgcgtgctgagggcagcaagggcgccgaggaaagctataccctctccgacgctttggccgtggccatctggctcaacgtctttgtgcgcaagagcaaagacgtcgggatggcctgtattgcacaaagcgtcaacgtcatttcccccttgatgaccactaaggatggtatcataaagcagactatctggtggcccttgtatctgttctcgaagtatatgcggggctggaccatcaatgcgcacgtctcttgcggtgcctatgagggcgagacgagtccgaagtggatccgcgccgtcaaggacactccctggctggacgtcagtgccaccttgggagaggacgggtatgctaatgttgctgtcgtcaacatcagcgacgaaaaggatatggagtgcaagttcgagggggcttctggcgatgtcactgtattcaccgtcactggggacagtgtctcagcctgcaacatgaagggaaaagaggaagttggtctgacggaaagcacttgggacggcaagggtgcctacaagttccccaggcactcgctcactctacttagatggaaggcggagtaa

SEQ ID NO: 6669 - DNA, 933 bp, A.fumigatus
tttcatgtacagggctatcataatcggaatgcgagcaaagcgtccctacctcaacacctgtcgcagccgccgatgccgaatcaccatcagcagcctctggtcgccccagtagccgcatccattccccggtactgctttgataacgacaagtattggtatatcattgaggccaagatggaggacggccgttgctgggagttgtcccgttattatcatgacttctacgatttccagattgcgcttctgacccaattcgaggaggaggccggaaaccgcggcaagccgcgcacattaccatttatgcccggacctgtgacgcatgtcaccgatgcgatctccaacggccgtcgccagaacttggacgaatacataaagaagctcctggccatgcctccccatatctcccgctgtcagctggtgcgtcagctattcgcacctcgcccaggtgactttgaaattgacccgagcgcgtttggagaagatgctcggtactccggtggctcgcaccattcctccacacaggagacctcgcgcaccgcgtcccgccagtcatctcaggctcagatgagctcgcatcccgaccgagcctcgcaccagcgcaatcagccctccgtctcgcatgcggccgacagaccagcgccgatgaaccgacaggccagctctctcacccaagtgtcaacaacctcaagcgggggcgccatgaaagtcaaggttttcttccaggacgacttgattgccattcgcgtccctagcgacatcagtttccagcagctccgggagaagctattagatcgcctcaagctcaatgaggaaatcgtggtgcaatataaggacgaaccatctggcgcgtacatggacctaaacaatgacagtgaccttgacaccgccatgcagcggaattccaagctcaccctacacgtcgggcttgcataa

SEQ ID NO: 6670 - DNA, 798 bp, A.fumigatus
aattacccacagttcagcgattcctatttatatgagccaccctttatcctttctaaggtgaatgaggaggttggtcataccgtcgtgcacttcttgtgcactggtaattatgaaacgctccggacggcattcgagccaggtgcgtccaagataggaattgaatttagaaggagcatgcttgtctatcaagcagccaaagaatatgatttatatgacctggagacgtacgcgaagaagtacatcgaagtgttcggcgagtcgatgtctattttcgatataatggaggctgcaagagagatatattctaaacttcccaaggatgagatttggcttaccggctacatctacaaacaacttcaaattgctttctcactggacagaaacatatttcagcgcgttgacttatatgacggtgttgggaaagaccctaattttgacaaagacgtgatgagaatggttgtgaacatctactctgaggtactgtctagacaggtcaatgagactgcccttgaggggagcattgctgaagagggcgctgcggaggattgtgctgcggaggacggtgctgtggaagagggtgctgtggaagatggtgtggtggaagagggtgctgtggaagagggtgctgtggaggatggtgctgtggaggatggtgctgtggaggatggtgctgtggaggatggtgctgtggaggatggtgctgtagagaatggtgttgcagatgacagcgcccttaaagaggctgttaacctcggtattcccttacaagcttcaggcacagcactctgctttgaatag

SEQ ID NO: 6671 - DNA, 360 bp, A.fumigatus
gggaataccgaggttaacagcctctttaagggcgctgtcatctgcaacaccattctctacagcaccatcctccacagcaccatcctccacagcaccatcctccacagcaccatcctccacagcaccatcctccacagcaccctcttccacagcaccctcttccaccacaccatcttccacagcaccctcttccacagcaccgtcctccgcagcacaatcctccgcagcgccctcttcagcaatgctcccctcaagggcagtctcattgacctgtctagacagtacctcagagtagatgttcacaaccattctcatcacgtctttgtcaaaattagggtctttcccaacaccgtcatataa

SEQ ID NO: 6672 - DNA, 1815 bp, A.fumigatus
cttgcacacgagctaatcctgaaaaggaagctcactgcacgaaaacgaggggcattgtatcagcatatcatcagactctgtccaacacgagcttacaatctcactgcccatacgactgcgcgcctaaccacgatgactcgaacgacaagtgacctattggatgacaggctatcaacactctggcagtcagcctgtgatgactacgctaaagaaacggggattgcgcttaccgatggcgacttccccaagatccacggtcccgaggatctgtcgcgtcatctcgacgccgaaagggaccatttcgaggactttcgaatgaaaaaacgaccactcttgcatgctatgcagataatcctggcgccgttcgagcactggggggatctgcttgcgggggtcgcatccgcagcttttcccccggcgtcgtcgatcatgggcgccatgatgcttctcgttcgaggggctcgcagagtcagtgaatcgttcgacatgctcatggacctgtttcacaaactcggtcattttgccctccgtctggactcgtacaagggggtttctctgagtgaagggatgaagaccatcattgtccaggtcttggtcaatttccttcgtgtctgtgcggcgtcgcagaaattactccgtcgggggtcgctccgagcaagacttacgaaatggacaaagaacgtcctggttgaggatacgtcgatcaggtcgctcctggacgagctggaggagttgacgagccaggagcacaagatggtgtctgcgcatgcgctcgatctcactcaccaggcgctcagaagcaccgcggaattactcgagcgagacgacaacaggaacgagcgcgacagactggacaaagtgaagaaagcattagatcccgtttccgcgtccggccgcgtcttctcctccctcaacgagaaccgcatacccggatcgggcagctggattgaagacaggatccggtcctggtggcagagtcctgatcctttactctggatccatggaggctctggtgtgggcaaatcctacttggcgtcgaagatcatcagcgatctcgcgacagcagactcatccgctccatctacgccgcccatcgtcgcctcttttttcttcaagaacaacgatgtcgacctacgctcatttaacaaagcgttgcggaccctggcatggcaagtggtcgtacagcgatcgagatttgcggcgcatgcagaggatttctgtctgaaggaagacccagccaacagctatgttgtctggaggaagctcttgcttgacttcttcgtcaagtctccaccggacgccggaacgtgctttgtcattgacggtatcgacgaggccgatccagaggagcaagaaatcctctttcgtctgctcgagagcacatatgcgacagaggaccagacaggcccaagcgcaccaatccgcgtcgtacttctgggcagggattccgtgcgcggcatcctcgaggaacactccctcggcgggattccagagatcgagatcaccaataaccagaatcaggacgacctgcacagatacgtctctcagaagctgcagaagaccaagttgtttcgcggctatccagacttcctcgacgaagttgtccaggacatatgtggacaagcggaaggcctctgggagtgggcgaacctggtcatcaaatctgttctacgctgccggtccaaggaacagattcgacgagtggtgcggacgatgccgcgaggaatcagtgcaatgctacatgcagaactgcagcgtttggctagagagttgtcggcctcggatgcaatgtcgcctgagttgtccgatggagaa

SEQ ID NO: 6673 - DNA, 255 bp, A.fumigatus
caggcagccgtacataagcgcctctactggcccacagttacagccttgccgatcccgtacagcctcaacgcaacgcctccatccaaggtccagtccgcagatgacattggccaaccagtctcacttagtgctgcttccaagcctccaagcctcgtattgcaaacgctcatcttctgccacaacgacaaggcaaacggcgatccaaaagcgccccatgagtccatgaccttccggaacatgggcgagggcgattga

SEQ ID NO: 6674 - DNA, 822 bp, A.fumigatus
gacgattttgagtgggttcatcccgccaacacctacggggatgaccagcttccccagccgccagggcgattcaaatcgcgcgaacaggcggagaaggaccggatctttgggtacccgccgcggctgggggagcgtaatctcccgcggcaaacaaatctccctttccgactggaggacgttgacgaggaaaaggctaaggtcaaagcacgagaggcagcccggctgaggggcattccggttgatcggacgatgtcggccgcggatatcgaggccttgatcgcgcagcatgacaacgctgggcagagtgagccagcgaaggaggagaagcctgccagtggttcgcggaagagaaggcgcactgagcccgtcaatgctacccctgagtcgactgtggggaccaagagacggcgacagaatccgagtgctccaagtcccgctgccgccgccgctggtgccaccgccgagaagtcaagtcttatggtgaagtttaagttctccaatcccgagaaagcggcggcggtggcagggttttttggggcaatgccatccagcccatcgaagaaacgccttctcgccgacgtggagaatgaagatgagggcagtccgcctaagagaggcaagccatcgccagagacagccagtcccgccgatcagaaccagacgcccaatggtcgtccgcggcgccgtgcggcaacggctctgatggccgattttcagtcccatgccgaggagagggcgcgccgggccgctcgaaagaaggccgctactccttcgaaacagggaggcgggagtgctgagggtgtgcctataaaaagcgcatga

SEQ ID NO: 6675 - DNA, 282 bp, A.fumigatus
tcctgccgctctaacttaacaaattctagacaactaacaatctgtagcgccaaccaacgacccgagatgcacctttccatgctggctgtcactttgcaaaaccaaaatacgagaacccataattccaccgactatcctgccgttccaaactcaaccgaacatggcaccccaacatgcgtactggaatgctgtgatccccaggacaaaaaggacctgaacatgactaacacagatgcaagtgcagcttacctgccggattcaatgctcgtgacgttgtcgtga

SEQ ID NO: 6676 - DNA, 246 bp, A.fumigatus
acccattcctgtgccgccgcctgcaccgcccaattctttaaagacgccgcagccgcccggacatgtagtaaagccaacgactcccccgtcgcctatgcaggcaagcatagatgcggcaagtactcgaccaccctgacaatgggcgcggacggcattaagagtacagacctttcgcaagcatcgtccgacggattccatgtccaaaggctgctcggatggcgtccgagtgtaccttttaccttgtga

SEQ ID NO: 6677 - DNA, 966 bp, A.fumigatus
atcaacactttcggagggtttttcgtttcctcgctgcagcctgtcttcgacaagagagcccaagaagttggttcgactctggaatggaatttttacaacgcctctcatgcatttatcacggctcttttgccgatgctgaggcagaaattatcgactgtgctccctagcatttctggacatccacagttactcagccatctcatccacgagctgatgaattttgacaacgagattcgggaggcttggaattatctgcctgatccatactccaaggagaattggaagggaataacgtgggaggttcttactaaggaggggtggtttgatcgctggcttcaggttgagaaggactttgcactggcccgctataaggaaatcattgatgcaacggacagcggtgagattgactacgaaggagtcgagttttcggcaaccaaacccaccaaagccgcgattcgcgtaaatgatctgcttgaaacgatcactgaactgtatcggcctctgtcatctttcggtcaaaaactgcggttccttattgacattcagatcacgatcttcgaccagtttcacgagcgcctccattccgcacttgaagcttaccttgcaatgacgtctacgatcggccgcacggtacaaggcgcagatggacaggccagcgtggaaggtgtggctggactggagcgtctttgcagggtttttgggagctccgagtacttggagaagaagatggaggactggagcaatgatgtgttcttcgtcgaactgtggtctgagctccaagaacgagtcagacagaacaaaaactcaggtaggaatgtggccgcccccatgtctgtagcagacgttgcttcacgtacttctcagatggttgcaaatggccaccatagcagcggccaagctagctcggatggagctctgttcgacgaaacagcatccggcctaccgtcatctcaggctacgttctga

SEQ ID NO: 6678 - DNA, 234 bp, A.fumigatus
aagaccctcgttgagcttcgcaagaactctagtcgagcctccttccagaccagccggtcccaaagcgacatcgacaacattgcagaggtggtcaatatcgctggcaaattgcgccgctccggcagcggaaaaggtatgcctcatgaggacgttactccaaagattagtttgaacggagaggagtacctggcgaatgattcgacgcaacggtgctatgcccagtgcgcgggatag

SEQ ID NO: 6679 - DNA, 1137 bp, A.fumigatus
atcatagttaatgacatgggtgacgtttggaatatcaagaccacgagcagcgacagcagtagcaaccaaaatagggcaacgtccggagcggaacatctccaaagcacgttcacgctcacgctgggtgcgatcaccgtgaatagcagttgcagggaagcgctggttcagcaggaagtcggaaagagcatccgccatacgcttggtctccacgaagatgagagtaagaccgctcgtgccatgggtgtggaggatatcaagaaggacggaacgcttgtcgtgatcctcgacatactcgaccttctgagtaatgttctcagaggtggagccaacacgaccgacggagaggaacacgtaatccttcaggaagtcccgggcaagcatctgaatatcacgagggaaagtggccgagaacatcagagtttggcgctcattgacgttaggcatgtcttcaccctctacgatgcggcgaatctgaggctcgaaacccatgtccaacatacgatcagcctcgtcgagaaccaggtacttgatgttaaccagagagatgcggccacgctcgatcaggtcaaccagacgaccaggggtagcgaccaggagatcacagccacgctcgatctgacggagctgagagccaatatcggcaccaccgtagacgacacaggggcgaacccaagagcggtaagcgaacttgcgggcttcgtcaaagatctgagaaacgagctcacgagtgggggcgaggatcagggaagtagggtacgccttgcgttgacgaccatagccgaactggccggaggcctgagcaggcacaggggaagggcctgtctggaaggcctgagagagaatgggaaacaggaaaccaccagtctttccggaaccagtctgagcacacgccatgagatcgcgaccgttcatcacaatgggaatggagtacttctggacgggagtaggggtttgatagcgagcgagcttgatgttagaaatcaagtggtcatccagcggggggttcgtgaaggcattgacaggctcgggaacgtcgtgaccggatgcttcgacggggatatcgtcgtagttggcgaagttgataccagtgctctgcttggtgggatcgttgggaacaccgaaaagctcacgctctag

SEQ ID NO: 6680 - DNA, 1695 bp, A.fumigatus
ccttggcgtacttcttgcagaaacgctcctcgcggtggcaactgggctaatgccaatgcctctgacttcagccctcgtggtcccaacgtccccaatggtaacatcagctggactcccacggaaactcaacgtcggccctttaacccacatgcttacggacacccaggacacggaggctcctacggcggttctcatggttctgccaaaggctctggagacggccagtggcgcgacggcaagcacatccccggtcccgcaaacgcccgactagagcgtgagcttttcggtgttcccaacgatcccaccaagcagagcactggtatcaacttcgccaactacgacgatatccccgtcgaagcatccggtcacgacgttcccgagcctgtcaatgccttcacgaaccccccgctggatgaccacttgatttctaacatcaagctcgctcgctatcaaacccctactcccgtccagaagtactccattcccattgtgatgaacggtcgcgatctcatggcgtgtgctcagactggttccggaaagactggtggtttcctgtttcccattctctctcaggccttccagacaggcccttcccctgtgcctgctcaggcctccggccagttcggctatggtcgtcaacgcaaggcgtaccctacttccctgatcctcgcccccactcgtgagctcgtttctcagatctttgacgaagcccgcaagttcgcttaccgctcttgggttcgcccctgtgtcgtctacggtggtgccgatattggctctcagctccgtcagatcgagcgtggctgtgatctcctggtcgctacccctggtcgtctggttgacctgatcgagcgtggccgcatctctctggttaacatcaagtacctggttctcgacgaggctgatcgtatgttggacatgggtttcgagcctcagattcgccgcatcgtagagggtgaagacatgcctaacgtcaatgagcgccaaactctgatgttctcggccactttccctcgtgatattcagatgcttgcccgggacttcctgaaggattacgtgttcctctccgtcggtcgtgttggctccacctctgagaacattactcagaaggtcgagtatgtcgaggatcacgacaagcgttccgtccttcttgatatcctccacacccatggcacgagcggtcttactctcatcttcgtggagaccaagcgtatggcggatgctctttccgacttcctgctgaaccagcgcttccctgcaactgctattcacggtgatcgcacccagcgtgagcgtgaacgtgctttggagatgttccgctccggacgttgccctattttggttgctactgctgtcgctgctcgtggtcttgatattccaaacgtcacccatgtcattaactatgatctacccaccgacattgatgactacgttcatcgcattggtcgtaccggtcgtgcgggtaacactggtatcgctactgccttcttcaaccgtggcaaccgtggtgttgtccgtgagctgattgaccttctcaaggaggctcatcaagaagttccttccttcctggagagcattgctcgcgaaggcagcggatatggtggacgcggaggccgtggaggccgcggtcgtggtggcaattccactcgcgatctgcgtcttcactcacgagagtcgaacatgccgcatccgaagaat

SEQ ID NO: 6681 - DNA, 1254 bp, A.fumigatus
tggaggctcagtctctcttccagagaagccaataagacacgtagtataatatatatttctcctacggctgtttgtctaatcggacggaagattcagtacagtagtttgatgttcaaacacttaaacatggtaaccagtgaaaatgatctgatatctgcagtgctcagcattgcttttcagatttacctcacttgtagtcttatcacttggttttctctaagagaattcactaccagcgaatgtcctggatccacaaataatttcaacgtcgccattataagtgcttcccagcaagagctcacggcagtcaaggctctgttcgatgaagattacggcattgtcggtgatatttcgggcgtccaccccttggacacaaacgcctacgtagctgggcgaattggcaatcacaaagtgattcttacgcagatctctaagtacggcaaggtatttgcagcgaagacatccttctggctctcgatcagttttccgcaaatccgcatttgccttgttgttagcactggcgctggagtcccgtgcacaaaggacggacaagagatacggctcggcgatgtcctggttagcgagggaataattgaatatgatttgggcaagcttctacctggaggcgtcttcctgcgcaagacaggtcccctgtacgatttccctccgcctacagggcacatcgcgaggctcctgaatagcgttcgtcggcgacaagctagagatatgttgaaagaacggatgtcgcagcatctgaactatctccaagctaccatctccgacctgaaagcgactaattatcccagcggagaggggaataagctcctacctcaactgtctttaccctgttttccggggtcgaattcttgtgtcttcaatttggaagccacaaacaagaacgctttgttcgtggctaaatgcgcctcattagactcggagcctcgggtaggagcatgggcatggttagatatacctgcgatcgaatacttcagaccaaacatccatttgggatggcttgcatctggggacaggatcatgaggtccgctgagagccgtgatcagatagctactcaagaaggagtcattggatttgaatgggccggggtcggggcatggaggcagcttccgacagtggtgatcacaggcgtcggcaattacggcgacggttatgggacggatccatggcctgcttatgcttctgcgagtgcggcatcgtgcgcgaaggcgatgctggaagtgtataacaccctctga

SEQ ID NO: 6682 - DNA, 204 bp, A.fumigatus
  unsure (25),(78),(83): Identity of nucleotide sequences at the above locations are unknown.
cttacatccagcgcgtattacgacnccgagcataatgatttctcgacgagtcacaaggcgttcaagcgcatgatgcgnacgtntgcgtgggaggtcctggaggtgtatagtgggcctccggttgtgatcttcaagtggaggcattgggggtacatgaagaatgattatgtcgggtataacaagtatggctgcgttcctggataa

SEQ ID NO: 6683 - DNA, 312 bp, A.fumigatus
agaatgattatgtcgggtataacaagtatggctgcgttcctggataaagaaagatggatactaaatcagtgttccagtcgaggagaaaaggtcactgtcaaagcgcatggtggtctgattgatatccaaggcatcgtcattgccaaggtcaacagttcgttgcagcttgaaaagattgacgtttggtttgatcctatggacatgttccgccagatcgcacgcgaggagaaaatcgagtgtgagaacaaggagggagtggatgcagctggggccgctgcaggctgtccagtcatgggccacagaagcgcataa

SEQ ID NO: 6684 - DNA, 255 bp, A.fumigatus
  unsure (111): Identity of nucleotide sequences at the above locations are unknown.
caccctgtccgcaggtccggcctcaggcaacaccgcatcgtcaaggtcatcggcggaatctgcgccttcagcttcctcctcatcgagatcctcttcttcgccgtctggtgnccgcccttctcagcatactggtccgtcccacccaagagcgcccaatgctccgtctacaccaaccacgtcatcatcaccctcgtcttcaacgtcgccaccgacgtgctgatcatggccatccccctcccgctgctcatccgggcc

SEQ ID NO: 6685 - DNA, 345 bp, A.fumigatus
gtgttcttgctcccagcacagatggcgcagaggagtcgcgcacacaaatccaagcaagattgcgcgagtttgtattggagttccaacttgacaacgcatttatttaccggtatcttgccagatggacatccaaatcttgtacaaactaaccgaatttacagtgatcaactgcggcagaatgttctcgtgaagcaatacttctgtgacattgatattgcccatttaatatcgtacaacgaggagcttgctcacaagctcacaactgaacctgccgatattatcccccttgtgagtattgtcttccgactcgcagtggctgactctaacgatcgtacgcctctctag

SEQ ID NO: 6686 - DNA, 987 bp, A.fumigatus
ttcgaggcagctctccaacaatgcactcagcgaattgtctatccctcccagagagatatcgtccttccatcccaccagctcctacttcactcatctgcatcacacatctccatccgggacctgaatgctacaaacatctcccaccttgttcgtattcctgggattgtgattggcgcgtttacaatatcatccaaggccaccgttgtccacattcggtgcaagggctgcgaccatagcgaaaacatccgcgtagaaggcggtttctccggtttaacgcttccccgacgatgcggtcgtcaaaagctaccgggcgaagagcccggcgagcaatgccccctcgacccttacgtgatcgcccacgagaaatgccagttcgttgatcagcaagttctcaaacttcaggaagcgcccgaccaggtgccggtgggtgagcttcccagacacgttcttatctcggccgatcgataccttgccaaccgagttgtgcctgggtctcgatgcacagtgatgggtattttctctatttattccaagggaggcaagaaagatggagctgtggctattcgcaacccatatctgcgggcggttggcatcagtaccgatctggatcatacggcaaaaggcaacgccatcttcaccgaagaagaggaacaggagtttctggagcttagtcgccgggaggatctgtatgaagctctcgccaggagtattgccccctctatttggggtaatctggacatcaaaaaggcaatcgtgtgccttctgatgggcggttccaagaagatcctacccgacgggatgaagcttcgtggagacatcaacgtgttgctccttggtgacccgggacttgccagaccgcattcgctgaagttaactgaaaaagtatcccttatcgttctacacattccggaaaggttcgtcaacggctgggttgaccgcatcagttcacagagacccgccgacacgcgcaatttatatgggaagggg

SEQ ID NO: 6687 - DNA, 2115 bp, A.fumigatus
  unsure (37): Identity of nucleotide sequences at the above locations are unknown.
cgcgccctttatgagcacgacctatccatgtctgctntccaacgcttgagacttaaggaaaaggaggagcgcgagatcgaagagaatcagcacgaatctctagcccaagactcggaggatggtctatcaagcatctccatgaagcggacagcatcgtcctcaaccgcatcgggccctactgccaatcgtcgcacgtcaacggcagctacctcgatcgacggagaatcatttccctcggggactgggggttctagcgaaaattcgaagtcaggattcataggggccatggcctcagaacgtggctctttcaaatctcgacgtctctatggacaaggtctggcacagtctgcacagaaccagcagaacacgacgctgcaccgcctggaaagtctgagccgccaacgtgcgggtacgcttgagtcgcctcctcttacccgggcgtactccaggagcgcgaccaatctgcgtgaccgactccagaaactcgcgattgctgagccaacacccgagtcttcccgtgcgaccagccctccatcttcagccgtgtcaccaaaattgccgagtaatgagagtgatcccaaggaaccaaagtcgcaactgaccccaggctatggagtaccgccactgagcccacctgtcagcgagaatgaagacctaggaacattggcggccgccttgcaaccggaagatcttggaaaagctacagcgatgggcctctttaacaagcctcaaactgctttcgatgagagtcagtttacgcgacggcaactgcagatgcaccagggcaggagcacaccgcccctccgacgagctccatcacctcccagtcggatgactccacaggaacgcattggacgttctcggggcctttcaaacacgagcggttctgagtctgtctcctctcattacagtgagcctcatcatgcagcgaatcattcgactgccccgagcatcgacgcttctcgcgctggccctgcaaatggcacatttttctcaaaccccagttctgatgcatccgacgatgaaggtgatgagttcaatgcgagggacgttgcggctgctattgacgccgtccatcctgccttccggcctagcacaccacccaagcctgcaactccccctgaagaacctcaaagcgttctgcctgaagttcggttctccgacctcgggcatttgaagcctattgctgagatcgaagcatcggaaggaacaagcgttgcggatgacagcactgttctcccggagaagcccgactcgcctacactcggaccctcgggccttggactgagtggtctaattcgcacccatcttcgacgtgacagcgatcgctcgtcgttccacgtgccgcactctccagtattcccaccgaaacccaacgatgaagaggttgatggatccgtggccaacggatcagatacggccaatgggtcctctcagcgcgcgtccacagatggaaacagttcaagagactcacaggacaactccaaggtaccttcttgggatgacgagttgaagtcgaagcatagacgtcaagaaagcacggagacccagcgggagcgggaagaattcgagatggagctcgcggagcggcggaggagagtgcaggaaaagctgagagggttcgctgaaagcgagagtcgatcagctagcccgatctccgggtatcgaacaccagactacccccagcaaacaaagcctggcaacgcatttgccattttgaagagcaagaatcccaaacatcccttcttcagcagacaagagccgaagaattccagggcggtcggtctcgccagcgcgtccactccatctttggtaccggacgacccctggcgggaggaggacgagaagataccattcagcttcggcaagcactccaacaccagctcaccgcaaattgccggagagaagtcgattcgatccagagtagcagcctttggccgcggcagtcacgaaggctcccgcgaatcgagccgcagccgtggcgcctccccgcattcaagtatgaggtctcagagagatcgttcgagctcggacgcctccggccgctccaagagccgcacacgataccgcgtcttcaccacggggctggaaggatcagcggtggcgcatggggga

SEQ ID NO: 6688 - DNA, 315 bp, A.fumigatus
  unsure (20): Identity of nucleotide sequences at the above locations are unknown.
cactacgaattttactattntatagcaaatcaagtacccagcttctcaagtgctggtgggctattgtttgactactccaacaagcctcctccagcagcttctagtgataatccactttcacggcctgataatgaccacttggaaggagcggacaaagatgcgacgttgacgaaagtggtcgacagacggtggtatgaacgaaacaagcacatctttccggcgagcttgtggcgggagtacgagccggggcctgagtttgaacagaaaatgcgctccacgcggcgagacgctgaaggaaacacttttttcttctga

SEQ ID NO: 6689 - DNA, 327 bp, A.fumigatus
gagacccatcatatcagaatggctacccagcgttaccagcatgctgctctccctatcaatgtgccatcaaaagcaccggctccggccagcctctttccaatcagtcggatctctggatcgcccccagacatttctgacactagcaccaccacgggaagccgtgtctctggtttcagttacggcagcggtgctctcagcggcgactatgagtcaagctcggcgtcttactcaggtattgacgtcgtggaagttctgagtgaccgtatgcaggatgttttcgacccgaccccattggatcgaggacttgcaaagcaagcgcaaacgtga

SEQ ID NO: 6690 - DNA, 372 bp, A.fumigatus
gtgttatggctgtcgtgtgcaatagccaactggtatgtctctctcatccatccagcagcctgcaagtcgatgtctgtgtccgtttccgtagctaacgccgaatccatcacacagcattacggaatctggggtgacaccaacggtggcgtttctaccggtgaagcctccatttctttggccgacctttgcttccccaacgagcatctcgatggcaaccatggtcacgatcccaatgatgtcctcttcattggcttcactagcaaggacgccgtgcctggagcgactgccaagtggaaggcaaagaatgcgaaagaattcgaggacagtatcaagtcgattggtgacaagctggttgctggtttgaaagcatag

SEQ ID NO: 6691 - DNA, 276 bp, A.fumigatus
ccgaaccaacaagcccaggacttcttagatattaaggcaattgctcttcctgacaatcaatccggcacgatgcgtctctctgaaattcttactgttgctttggtcactggggccactgcttataatttgcccaacaacttgaaacagatctacgacaaacacaaggtatactgcacacatctcaaggtttgtattatagccagccagctaatatctctttttgcgccgtcagggaaaatgttccaaggtactggcaaaagggttcaccaatggtga

SEQ ID NO: 6692 - DNA, 447 bp, A.fumigatus
tatctctttttgcgccgtcagggaaaatgttccaaggtactggcaaaagggttcaccaatggtgatgctagccaaggcaagtctttcagttactgcggcgacatcccgggtgccattttcatctcctcctccaaggggtacaccaatatggacattgactgcgacggcgccaacaactccgccggcaagtgcgccaacgacccgtccggccagggcgagactgccttcaagtccgacgtgaagaagtttggcatctccgacctggacgccaacatccacccctatgtggtgtttggaaacgaggaccactctcccaagttcaagccccagtcacatggcatgcagccattgagtgttatggctgtcgtgtgcaatagccaactggtatgtctctctcatccatccagcagcctgcaagtcgatgtctgtgtccgtttccgtagctaa

SEQ ID NO: 6693 - DNA, 1548 bp, A.fumigatus
cttgagcttggatccgccagcgccgtgttgaagactatttatgaacaaaagttgggggttgtacgtgaggttgaacgcgatgcagtcgtccttcttcaaaaccagaaagttgtgtcaccactggatccctctgctctggaaattcctatgactgttggtaccgacaacgtcgtatcatggccaagcaaccaggatgctatgaggtcatatcctctgccaaacggcgagtacctgtggaccgtggaatcagagtttgtctttcctgggcaatttaccctgacatcctcgaagaacttggatcgaggagactggtctttggaaatgggctcaaagtcacaaccagaaggtcatgttctagcgactcctgccatgaatattcacgtggagtggctctgccccaatgtctatggtgcaggaccaccatatggcgggagtcccagtgaagttatccgagcaactatgctgcaagggaccgccatgaagtgcgacttcggcaagctacccaccgagggcttcagcgaaaagacagtcaggtcggacacgtgggttgaggtgggcccgggcgatagggttcgctttcgcaacccagctgatgcaaggaagtacaatcacaagcagataccaaccgaccagtcctttggttacgacataaatctcttccgcgtgttatccacccgaactgaggtgaaggtccagtggcaggatttgagtgtcactaccgaggccgctacctctttgcacaagttcaatggtggtgacgatgaagtctggcctggaagtcttgttgtcttgagcgaaagtcttgagactatccgcaagtcctgttgccgcactgagtcccatcgcgctcgaaaggttggcatagtacaggccgtggacagcggagaaagagtagcatccgttcgctggtacaaagatcccgacatcgagctgctccataaagggaacatgctgaaaccgggttccagattgggtgaactgggtgatattgttactcaagtgtccgtctacgagttaagcttgtttccggggttaggaaaggcattgggtgatctagtgctcctggtaccggaaaaggtccatcggtcggtctttccaccgacacctcgcgatccgcccgcagtcactgggccttccttgtacagctttctctttccgatgaacttcttcgagatgacgatgtatcttgaatccatgaagctggcactcttcaagtcggaagcgttcaaaaatggaatcacgatcgattcttcccctctaccttcccgctatgtcattcatcacgataagtacaacggacagtccccatgtgactttcttggtaggatcgtctcagtggacatcgagggcaacatcaccgttcgacaagtcggtcgcaccagctgtcgtgatatttgcattcctttggacagaatactcatggtgattgatgacgattacgacatgcccgctttgcccatcccaccccttgacatgttcggcttaccaggcttctctccctggatgtcaaatcccttcatatccaatcgaacatatgaatatgaaggt

SEQ ID NO: 6694 - DNA, 261 bp, A.fumigatus
cgggaaggtagaggggaagaatcgatcgtgattccatttttgaacgcttccgacttgaagagtgccagcttcatggattcaagatacatcgtcatctcgaagaagttcatcggaaagagaaagctgtacaaggaaggcccagtgactgcgggcggatcgcgaggtgtcggtggaaagaccgaccgatggaccttttccggtaccaggagcactagatcacccaatgcctttcctaaccccggaaacaagcttaactcgtag

SEQ ID NO: 6695 - DNA, 588 bp, A.fumigatus
ttggattatgacattgccatcttgaatctgagtgagcggggactgactgacgatcgattgaatcacctgctcactattgtgccgaaccggaccctcgtcctattggaggatgtggatgctgctttctcgaatcggcgtcaaactgatacggatgggtaccggggcgccaatgtgaccttttccggcctgctaaatgccttggatggtgttgcaagtgctgaggagcgtatcattttcctcacaacaaatcatgtcgagcgactggatgaagccttgattcggcccggtcgggttgacatgaccgtccgcctaggcgaagtcactcgctaccaagtccgctgtctatgggacaggttctatggtgacctcgacacaaccggattttacaggcaagcattcctcgaccggctacaggagttaggcctcatagaagacgagaaaggcttcaaagccgatcggtctagaagtacaagtgctgctgctctgcagggcttgtttctgtataacaaggggaacatggagggggcagtcgcaatggccgaggcactcacacatacagtgcatgattcagccgagggcgaccattaa

SEQ ID NO: 6696 - DNA, 510 bp, A.fumigatus
aaacaagcggcattcagtataaatagctgcccagcagacatattatacttagtgttccagtttctatcatctgctgaactgcatgcactatgtcttgttaataaaacatgcggcacaattgctgagaaattcctctactcaaaaatccagatgacttggctaaaagctgaccgtcctccaccaatcattcaactcttacggacactcttatccaggccacagctagctgcttacattacaactgtacatcttgacagcaatttctacgattactggaactttcaattcaaaattcctaaccttccggtctctggcgctgaactggaccaaccgatcgcattcatccggggcactggagccccctatagcaacctttggatacaggaattgcgccaaggttctctagacgcttttgttgctcttctattagcacagctctcaaatgtgagatatctgtaccttgccaacgactttactcgacagagtgcacttgtcggtatggttctctga

SEQ ID NO: 6697 - DNA, 255 bp, A.fumigatus
gaacagattttgaggtctttctactttttactgttctcactgaatattaacattcattattctggtgctgtgctcaactggaacgaggcagatgtgaaaatgtgggcggaatttagtgcgagagtttatcaccgcatcagtaccataccaaccatacacattatatccctcatactcatcagcatcagagccaaccatgtaacagatcaaaatcatctctaccactatggaaaggatattgtaactgaggaatag

SEQ ID NO: 6698 - DNA, 195 bp, A.fumigatus
ttttacaattcttccttcggccgcctttgcggtttagaggaaacggtcatactgacttttgtgtgctggcaacagctcatgaagtacatgagcctcgaccaacggggtcatgtccaggctgagtatgtctggatcgacgctgtcggtaactgccgctgcaagaccaaggtatgcaacttttccccctcactttga

SEQ ID NO: 6699 - DNA, 1647 bp, A.fumigatus
  unsure (1444),(1610): Identity of nucleotide sequences at the above locations are unknown.
gatgccatcctgaagctcagagaagagcacaaggacgatattggcagcgtcgttcagctggtactgtcccacagctgtattggcgcgaagaacaacctcattttggccatcctggccatgtaccgccccaaccagcctggtgctggcaatgtcgcaaagtacttcaagcccgtcctgaagaagctcactgaacttgagtcgcggcccgccgccaaggtcaccctcaaggcccgtgaggtcctcatccagtgtgcgcttccctccatggaggagcgtatgtctcagatggaactcattctgcgctcctctgttgtcgaatcccgatacggagagaccggttgggaccaccgggagcccgaattctccgtcctcaaggaagtggtggactccaagtacaccgtcttcgacgtcctgacccgattcttcgttcatccggacccttgggtcaccctggctgctctcgaggtctacattcgccgtgcctacagggcctatacactgaagggtattcagtactaccccgatggagaagtccccctggtctcctgggactttacgctaggcaagcttggacaaccggagttcggttccgttcactccaaccagatgtctacgcccagcacacctactacggagtccaaccccttcagaagactcaactccattagtgatatgtcataccttgtcaacgacagcagcaatgagcccctcagaaagggtgtcattgttccggttcagtacctggaagacgccgaggagcagctgcctaaggccttggaggcactccctcgtgccgggtcgaagaggaagccgggcgagaacgggctgattgcagacctggagggcaagcgtcgaccagcccctcgcattgagtccgacaatgaattgaccggtgtctgcaacgtggctgtccgtgacctcgaagatcttgacgacaaccagatcgttgcccagatcaacaccattcttgccggcctcagggacgagttgctcgctcgccgcgtccgccgcgtgaccttcatttgcggcaaggacggcagctaccctggctacttcaccttccgtggacctacctacgaggaagatgagagcatccgtcacagcgaacctgcgctcgccttccagcttgaactcggacgtctgtccaaattcaagatcaagcccgtcttcaccgagaaccggaacatccacgtctacgaggccatcggcaagggccccgagaacgacaacgctgtcgacaagcgttacttcgtccgtgctgtggtgcgcccgggccgtctccgtgacgatattcccaccgcggagtacctcatctccgaggctgaccgtctcatgaatgacattctggatgccctggagatcatcggcaacaacaattctgatctgaaccacatcttcatcaacttctcgccggtgttcaacctgcagccccaggatgtggaanaaggcttggccggtttccttgagcgcttcggtcgccgtctctggcgtctccgtgtcaccggtgccgagatccgtattctatgcaccgatcctgccactggcatgccttatcctctgcgtgtgatcatcacccacacctacggcttcatcatccaggttgagctgtnctttgagaaaaagtccgaaaaaggcaaatggctcctc

SEQ ID NO: 6700 - DNA, 1182 bp, A.fumigatus
  unsure (71): Identity of nucleotide sequences at the above locations are unknown.
cataaggaggaaaacggagccgggtttttgccactgcccaacggcatcggagggacgaaccattttttcgntcaaaccgtacaattttaccccttccaaccaggaaactcagctctttattcggccttcgttaggaatcctccccgtctgatcccagcagccgagtacatgtactccaccggcgtcttccacggctgctggtcacccgcccaccaacagcccgcatcgcaggaagccaccatcgagcacaactttgaccttttattcagccactaccagaaacagatagagcaacaccgctggtacggcttctgggaccacggcgacgtgcagcacacctacgacccctaccggcacgcctggcgctacgacgtgggcggcttcgcctgggacaactcggagctctcgaccgatctctggctgtggctgtacttcctgcataccaggcgcgcggacgtcttcaagatggccgaggcaatgacccgacacaccagcgaggtagacacctaccacaccggccggttcaagggtttcggcacgcggcacggcgtccagcatttcagcgatagctcgaagcagctgcgtatatccaacgtgctctataaacggatatactattacctcactggcgacgagcgcatcggcgatttgatctccgagcagcaggattgccaattcgctctgctgactctcgactcgcaccgaaaggtgcaagcgcacgccgatatccccgacggcttcgccatgacgaacatcggtcttgactgcggcgcactcgcggcagcatggttgacggcctgggaacgacggactgagggctgggagcactgccgcgatcacttgatcaagttgctagacggcatcgcgcgcctcaaacacggcatcggcaacaatgctatcctgctgaaccccaccacgggggagatccgcgaatgccccccgccaacgcccgagtacgccatctcccacctctctatgctcttcgggttcccggagatatttgcagagcttcttgactacgcgcgcgacgtggacccggccactgtagataggttcatggcggtatggctttcctattgcaaagcgtataatggcggcgcggaagtccagcgccgggcagtccggtttgcgttcaactgtctgacagacaggagaaggaagagtagcgttccccagtataat

SEQ ID NO: 6701 - DNA, 249 bp, A.fumigatus
gttaagttattgggacattacgagaatgagacctatagtcaaaactttgttcacagatacaacggcctaaaatgccgcatcagaagtgccctttttgttgtggaagattctgggcagcttctgcgaacaatgatcatcaccttgcttgaagctcgtggacatgactactcactagtaagtacaagtgcgtctctaattctccgggttaggactatgcgtcggagaactcctatgcagatactagtatag

SEQ ID NO: 6702 - DNA, 1362 bp, A.fumigatus
ttgcagccaatcgcactgtggcacggccttggacccccccccttcttctttttggccactgcatctcacctcgttccttcgtgtccttacaaggttcttctcccgtctggatggtgcttttcgcatgggttcaccttcagaggctgcctcaacctgccagcgaatctatccatagcttatgccggcaccccggactctgatccgcgttgctccctggatgcaattcggctggccacaaccatggcgcgttcattcgacacggcccaaacccccttgagcggctattttccgggcaacatgcatttccaggacccaaaccagatccctgcttattctatcttcggtgctagtcagtatcccgacagtgtagctttttggcacaacctgcccccacaacccccgcagcctggcattcctgcggcggcaacgccatattcctctcctccgcccaaacaacaccaccagccgcccttgttgcagcctgtctccgatcagaaaaagcacaagcgcaccaggagtggttgcttcacctgccgctcccgtcgcatcaaatgcgacgaggcccgtccggtctgtgagagatgtcggaaaggtaatcgcgaatgtgtctatccgtcaccgactgcgactggtacttcatccaaggcagcgtcgcggcttggagccaaggccagagcccaacgcccgccatcgcaagggagtgactcttcgggccatgttggaccggatgagtttcacgcgctggagccgattctggacgaggaagaggtggacgaaggcagcgtggattcggcaactctcttgtcgtcctccacaacatcactggcagcccgtgtcaagccgggcccggctacaaaacaaagcatgcagtcgctgaggaagcgcgggacgaagctaacagctccagatgcgacaccccccaatacagaaggcagttcaccctccactgaagcttcctctagattcgaatctatgagtgcgcggtcggccagtgtcggactgtccaaccaggaatctcttggcgccgacagcttctcacatctgccagaagatttgcgatcttaccttacttttcatcaagagtacatgacgtatcgtcattattttatgaggccgtcttccgatcagtttgttcatcacaacatcatcaaattcgccctgcaatacgagccgcttctctatgcgattgtcggtctctctgcttaccaccattccatacatagcggcacggggaaactctatacttttcttcggtattatgacaaggccttgaagttgttgcggaaatctttggcatcgggagagccccattctgaagcaacgctcattaccgtcctcgcgcttacaactttcgaggtatga

SEQ ID NO: 6703 - DNA, 555 bp, A.fumigatus
ttgtcatcgaccccaagttcgagttttgcacgctttccattttcaaccttcccttactctcacccttgtttaatcgtcatggccgccagtcggtcctttgctcgctctctccccgttctccgcgctgcttctccccgcacggccgtagccaccgtctcatccgccaggatagcagcttcatccgcagcgcggtcgctgtcgacttcctcaggttcctcttcttcagtactgtcttctcagcggacttctgcagcaatgtcaacaacatcgtcgtcctttgttgctacccgcagactacacgccacggcgcaacagctcgcccccgcaaccacttccgcggctacaaccgccaccgaatacccgacggaccacacgccgatcgccaaccccattgataccaccaatttcattgacaacgagtttgtgtcttcaaaggcaaccacatggattgacctccatgatcccgctaccaataatctcgtcacccgcgtgcctcaaagcaccgatgaggagctacgtgccgccgttgcctccgcggaaaaggcgttccctggc

SEQ ID NO: 6704 - DNA, 615 bp, A.fumigatus
cctactttagaggaccaaagctcccttcgaaatttaaaagcctatagggcggctgtaaagtttcttgaatttggcggttgccagtttgtgggccccgtttctgacaagcgagcaaggtttggtttcgagatctggaccatgcagaacgacattcttttcgacaacatgtacattggtcactccattgaagatggtgagaagctccgcaaggagacctttgatctcaagcaccccgtggaagttgctttggaggaagcctccaagcccaagcttgaggagaaggccgccactcccagcgtcagcttcaaggaggccccagtgacatacgttcgtgaaaaggttgagtacttcgtgggtgtggccaagcaagatcccatcaacgctgtcaagcaagttcctgaggtcgccggtggtctgggagctctccttctgaccatgatcctcgtcattgtgggcgctgttggagccagcagccctgcccctgccgccgccgctaagaagggcaaggaggccgcctctgccgccaaggagaaggccagtgaagccgtcagctctgcggccgacactgccaagggcgcagctaccaagcgtaacacccggtcgtctgcccagtaa

SEQ ID NO: 6705 - DNA, 1158 bp, A.fumigatus
aagaccatggggtggaatggacgtttgagcgatgacaaggagatggggaatctcgaggcagacattcttcctgagattgggcggttggaggccacaagctggattgttaacttggaacaacaggaaggcaaagtagaccaactggcaaggttgattgacaagaccattgaagagtgcgaagagctggacggcctactaactctttactcccatgaactcaacgtaagtttttcgccgggaatcttgtctcttccaccttctaatcgaatggcacagacattgcacgaagatgtgtcgtatatcgagacacaatctcaaggtttgcaggtacagaccgccaaccagaagttgcttcataatgagcttcaaaatcttctgaagacgctctctatctctgccgttgacttgcagcctctcagagagtcatcgctcagtaatccagatgggttgagagagaccgaggcggctctatcaacgctatataaagccatgctgatgattgatcccgatatatggcagaataaaaaacggttgggagatgctgctggggagcaagggagcgtgggggtgtatgccgacacggaaatagggcagatgcgcgccatcagagagaagaaggaagaataccgagcacagtctcgaatgttcctgcaacgacttcggcagttcatggctattgcctataaagtggctgaacagaagagggtggatgctgcagcaaatggccccaaggatcctctcaagctggacagcgaagctcgagcgtatttccgtcaggagttatggatgtacaacgctttgatgcttttcgccagagaggtcagcggatctgagtggcatggactgatcagtctctacgaacaacaagccaaactgccttatcagaacgaattccgggacaacaacttggcgtggaagagagccggcaggaaacctagtggggaagaacaggagctcctcttcacccaccaggagaaagaaaaggaaagcgaaggcattacaatggcagcacgtaagttgacggtgcgacgaggcaaaaccatcagggccgcagctggtctgcggcttacgccgggtgagaagcggcatgggagactggatccctgcgaagtctttgccggcacacttcaagaaaccctgaatatgatatctgaatag

SEQ ID NO: 6706 - DNA, 249 bp, A.fumigatus
cagaactttatcgttcatttctttcacctgagctccttgagtaacaccgagttttccgacttcgtggcctctggcaatcccgatgagcgaccacttcctgatttcagcgccaggcatccgcatgatcctgatcggggcatggctataaaggtggaccaaattatggacgagctctactcgttctggtcgacggacatgcaaaaccttgtggattgggccatcccaccggatcctctgtatgccacatga

SEQ ID NO: 6707 - DNA, 306 bp, A.fumigatus
ctccaccctagattcattattcgctgcctgcaaaaactgcattccccactgaatggcctgtttaaccgcttccttgacgaacaaatccggggaatcgatgaccccaatgtctatgtcaacaaccgcaaaggggtcatctctttcatccccgttctccccaacttctctgccggggttgagaatttctctctcctccccatcaatgagttctttgactttccggttcgtgttcatgacccttatgaatcgattacccaacctttttgggagtctcttaaattctattccacgggaagcccccaatcg

SEQ ID NO: 6708 - DNA, 552 bp, A.fumigatus
tgctctatttgcacgtcatttacccgcctagagcccggccagcaggtcaccatcggaaacgccgttcgcaccgcgcgcatgtacatcctggacccggatctccagcccgtgtcggacggccaaaccggagaggtcttcctggccggacaacaggtgatgcgaggctacgtgggagacgatgccaagacggcctacagcgtgctgccggatccctggcatcctggtgagcggatgtatcgcaccggcgactacggctactggaacgcggacagacagattgtctacatcggacgactggaccggcaggtcaaaatccgtggcttccgcgtcgagctcgcggcggtcgagcagaagatgtaccaagaggagccgcggcttacccaagcggcggctctcgttgtcaacgatactctggtggcctttgtcatgccgcttgacgtggatgtcagccgtctggagcagcgactgcgcgagtccctccaacccagctgggtgcctcaggtgattaccgcgctggaggagttcccttgggacggccaaccgcaaggttga

SEQ ID NO: 6709 - DNA, 819 bp, A.fumigatus
attacctgcaggcctggtgaaaacgtagacggacgagcaggcacgttaccctaccgggaactggatcaaaagtcgaacgcggtggcctcgcatattgccaaacacttcagcagggctcaagtcatcgccatccacgccgatggaaccctcaactgggttgtcggcatcctgggtatcctgaaagccggctgcgcatactgcccactcgatcctgcgtatcccatcgcgagacgggtcgctgtgtacgaacaaagcggtgccagcgcgctcctcatccctaatgcctgctcatcgtccgcggccctcctgccgataaccgatcttcgcgtcttcacgattcaagaaaccgagacaagcgacacaagcagacagccatcgctgctcgcaaacgcaaatgaggatgccctcatcgtcttcacctccggcacgaccggccgccccaagggggtccccatcagtcacaggggccttctggctttgcagtcgaatcccgaagccaccatgttcagccgtcccggtcgtcgtatagctcagttcatgtcgcctgcgttcgactactgtgccaacgagattttctctgcgttgctgcatggcggaaccttggtgcttcgggacccgtccgacccccttgcccatctcgcgaaggtcgatgtgtcgacaattactccttctgtgctcagcgtgctgaatccagacgactatcctaatctcgacatggtctatgcaacaggagaacccgtcacgcccggcttgctcgctcgatggggcgagggccgggcattctacaatgcctatggtcctgcagaggtaggcccctag

SEQ ID NO: 6710 - DNA, 525 bp, A.fumigatus
tcaaccttgcggttggccgtcccaagggaactcctccagcgcggtaatcacctgaggcacccagctgggttggagggactcgcgcagtcgctgctccagacggctgacatccacgtcaagcggcatgacaaaggccaccagagtatcgttgacaacgagagccgccgcttgggtaagccgcggctcctcttggtacatcttctgctcgaccgccgcgagctcgacgcggaagccacggattttgacctgccggtccagtcgtccgatgtagacaatctgtctgtccgcgttccagtagccgtagtcgccggtgcgatacatccgctcaccaggatgccagggatccggcagcacgctgtaggccgtcttggcatcgtctcccacgtagcctcgcatcacctgttgtccggccaggaagacctctccggtttggccgtccgacacgggctggagatccgggtccaggatgtacatgcgcgcggtgcgaacggcgtttccgatggtgacctgctggccgggctctag

SEQ ID NO: 6711 - DNA, 240 bp, A.fumigatus
ttgatgacgccatcttctgcaaaatgctcgatgcggtgcggaggaaactatgagagattgcggaagagtcgaagtatagatagacaccgaccaagatttgattatataatcaccgcaatcatcagtcaccgagcgatcgccgagcagttactgagcgctaacacaatgcatcaaggtctcttcgtaatctgtatgcaactgtatctaggttcagactctattgcctgtatagctacatga

SEQ ID NO: 6712 - DNA, 561 bp, A.fumigatus
aatcaggaacttcccctgaaccacttccttgaccttgcatacaatacgccattgtggtcctcgcctgatagcactcttacgtggctcaatcactgggctacccgagaatttggaacacaagtgtccagcaaagttgctgatataatggaccgctacggaatgtatgctgcgcggagaaagtatgagctcattgacagctcaacgtttagcgtgatcaactataacgaagcggaccgggttcaggaggagtggcgggcgctcgtaaacgatgcccagaacgtatatcaggagttgaaagactcagcccgtcctgcattcttcgagctcgttttgcagccttgcatggctggccaaattgtcaccaatatccatattactgtggcaagaaacaatctgtacgcaggccagcgccggacgagcaccaacactttagcggatcaagccctgaagctgttcaatgatgaccacgctttgacacagaggtaccacaaactccttgatggcaagtggaatcatataatggaccagacacatcttggttatgattactggtatgtctga

SEQ ID NO: 6713 - DNA, 594 bp, A.fumigatus
tggaccagacacatcttggttatgattactggtatgtctgattcgtctctgtgcatctttgatatggtactcaccaagggccaacaggcagcagcccatgaggacacattaccccctctggcttatactcaagtacttgaggagagtctagcaggaagcatgggtgtgtctgtcgaagcaagtaatgcatcggtaccgggtgacgacgtctggcattcgttatcatctaattcgctgacgctgcctcccatggatccttacggaccaagcactcgctggatggacatttactctcgcggaacacatgaattcacctttacagtatcgccatatgattcctgggtcaaggcgaccccgtcgtccggcaaaatctcagtatctggaaataacacagatgcaaggattcatctctcagtcgactgggaaaaagtgccttccggatcccacatggctttgatcaacgtcaccatctcatcggatgactacggcaactttggaatgccaacagtccaacttcctgtcagcaagacgtcagtcccagcagattttcacgggctttgtggagtcggatggcacggtcagcatcgaagctga

SEQ ID NO: 6714 - DNA, 594 bp, A.fumigatus
acctcaaaccaaaaaaacatcacccagttcttcaaggagggcgccatcagaagcaaggactgggaagtgctctggacccttggaatgagaggaaaacatgatactgcgaatccaaccaatacaaagcaaacactgggagatattgtgaacacgcagcagcagattctgtcagacgtcctcaacatgacaaacatctcatccatcccacagatgtggtgtttgtacaaggaggttggccaattctatgaggaaggactgcgtgctccggatgacgttactcttctctgggcagatgacaactggggaaatatccaacgtctgccgcttggcaatgagacggctaggtctggcggtgcaggagtgtactaccattttgactacgtcggcgatccccgggactacaagtggatcaatacgatttccctccagaaaacctgggaacagatgcatcttgcatacgagcgccaggcaaggcagatctggattgtgaatattggagaccttaagggagtggtgagtaccgagtcgatcgccggacttgactgttcgaagcctaacctgaaatcaggaacttcccctgaaccacttccttga

SEQ ID NO: 6715 - DNA, 633 bp, A.fumigatus
tcaacgtcaccatctcatcggatgactacggcaactttggaatgccaacagtccaacttcctgtcagcaagacgtcagtcccagcagattttcacgggctttgtggagtcggatggcacggtcagcatcgaagctgatcatgccacccgtaacacgtcgtcaactgatgtctcgtacgccgtcattccaagatatggccatacgctgtcgggagtaacgttgctaccagtcacgatcgaaacacagcagcctccatcctctcctcgactcgagtatgatatgtacttgttttccaatgtgtccaccgtcaaagctacggtctacctggggccatcgctgaacaccgatcattcccgtcccctcaaatacgccatttccatcaatgacgctgacccccaagtggtgcagtttgttccctccactcccttgggatccttgccatcgaattgggagactacggttcgtaacgccgtgtggaccaatactaccagtcatgcaattcaaggcggcggtagaaagaacacactgaagctttgggccatagaacccggagtcgtgtttcaaaagattgtggtcgacctgggaggagtcaggccgagctacttgggacctccggagagtatgattgtctag

SEQ ID NO: 6716 - DNA, 669 bp, A.fumigatus
  unsure (487): Identity of nucleotide sequences at the above locations are unknown.
ccccgatgcctttctggcggtcggcggcggctcggtcatcgacacggccaagctgatgaatctgtatactgtcttccccgaggccgactttctcgactttgtcaacgcccccctgggcaaaggcctccccgtcaccaaggccctccggccactggtcgccgtcccaaccacagcaggcaccggttccgagaccacaggaaccgccatcttcgacctcgtgtcgaaaaaagccaagaccggcatcgcccaccgcaatctcaaacccacgctgggcatctgcgacccgctcaacacccgcaccatgccctcggccgtccatgcctcgtcaggtctggacgtcctctgccactcgctcgagtcctggaccgccatcccttacaacgagcgcaccccgcgccccaccaaccccatcaaccggcccgcctaccagggagccaacccgaatttccgacattttctcgctgcaagcccctgcgcagcaccgtcnaataccttgccccgcgccgtcccggacccggacgacttcgaaggcccaatccccaaatgctcctggccccggacttctggccgcggtcgggtttcggcaaacgcccgccgtccatctattcccatctgcatggacttacccccattttccaacccagaacccggggcttacaagcattgccg

SEQ ID NO: 6717 - DNA, 540 bp, A.fumigatus
ataagtacttggagatcccattccctttccccttccccgcactgggccatctccggactcccttcttcttggccttcttcttcttcgtcctcttcatcaacaacatcatcatcatcaactcgactctctattgcaatgacttcaatacgtgttgcgccctctgccgccaagagagccctcaatctcctccgcacagtgcaatatacccatcctccctcctgtccctgccactccaaccccaatcaccaccatcacctgcaatccaaccatgtccgccgtctggccactccggttgacccctcgcgccagaaagagtacgcctttgaaatggccgcctcgagcattcgcttcggccccggcgcgaccagggaggtcggcatggatttcgccaacatgaaggccaagcgcgtgtgtatcgtgaccgaccagaacgtggccaaactggatgccatgaaacaagccgtggagggtctgtcaaaagaggggattgagtttacggtttatgacaaggtgcgggtcgagccaaaggatagctcgtaa

SEQ ID NO: 6718 - DNA, 768 bp, A.fumigatus
  unsure (585): Identity of nucleotide sequences at the above locations are unknown.
gtgcagcacgcacccagcctgccagtttctcgaccggtgcggactgctaaaactccccgcagagtgaaagacgccattgcgttcgcaaagccatataaccccgatgcctttctggcggtcggcggcggctcggtcatcgacacggccaagctgatgaatctgtatactgtcttccccgaggccgactttctcgactttgtcaacgcccccctgggcaaaggcctccccgtcaccaaggccctccggccactggtcgccgtcccaaccacagcaggcaccggttccgagaccacaggaaccgccatcttcgacctcgtgtcgaaaaaagccaagaccggcatcgcccaccgcaatctcaaacccacgctgggcatctgcgacccgctcaacacccgcaccatgccctcggccgtccatgcctcgtcaggtctggacgtcctctgccactcgctcgagtcctggaccgccatcccttacaacgagcgcaccccgcgccccaccaaccccatcaaccggcccgcctaccagggagccaacccgaatttccgacattttctcgctgcaagcccctgcgcagcaccgtcnaataccttgccccgcgccgtcccggacccggacgacttcgaaggcccaatccccaaatgctcctggccccggacttctggccgcggtcgggtttcggcaaacgcccgccgtccatctattcccatctgcatggacttacccccattttccaacccagaacccggggcttacaagcattgccgg

SEQ ID NO: 6719 - DNA, 612 bp, A.fumigatus
  unsure (428): Identity of nucleotide sequences at the above locations are unknown.
atctgtatactgtcttccccgaggccgactttctcgactttgtcaacgcccccctgggcaaaggcctccccgtcaccaaggccctccggccactggtcgccgtcccaaccacagcaggcaccggttccgagaccacaggaaccgccatcttcgacctcgtgtcgaaaaaagccaagaccggcatcgcccaccgcaatctcaaacccacgctgggcatctgcgacccgctcaacacccgcaccatgccctcggccgtccatgcctcgtcaggtctggacgtcctctgccactcgctcgagtcctggaccgccatcccttacaacgagcgcaccccgcgccccaccaaccccatcaaccggcccgcctaccagggagccaacccgaatttccgacattttctcgctgcaagcccctgcgcagcaccgtcnaataccttgccccgcgccgtcccggacccggacgacttcgaaggcccaatccccaaatgctcctggccccggacttctggccgcggtcgggtttcggcaaacgcccgccgtccatctattcccatctgcatggacttacccccattttccaacccagaacccggggcttacaagcattgccggc

SEQ ID NO: 6720 - DNA, 657 bp, A.fumigatus
cgctctcgtaaaaacaggatggggtctacacattgcccccttcgtctccggcacagtatcgaaccaaggcagttgcccggccgcagtgctcgctcgtatacccgcgaacaacgtttccaggccatcgcagatgtcctgaagccaggcgactatgtagtcatcgaattcgggcacaacgacggcggcagcctccgcaccgataatggtcgtacagactgtcccggatcgggcgacgagacctgcactaccactttcaatggtgtcacggaaacggtgttcaccttccccaagtacttacaggatgcggcgaagatgtttcagtccaagcaagccaaggtggtgatatccagtcagacgcccaacaatccgtgggagaccggcaccttttcctatactccgtcgcgtttcgtcgagctcgccaaattggctgcacagagagctggtgtggattatgtggaccacggcgcctatgtggccgatatgtacaaatctctaggcaagacgaccgttgactcatttttcccaaatgaccacacccataccagctctacaggagctgaagtagttgcacaagctttcctcaaagctgtagtgtgcagcggcgctcgtttgaaggaggtcttgacaacaacgaatttcccgggcaaatgcctgtaa

SEQ ID NO: 6721 - DNA, 369 bp, A.fumigatus
ggaacagagctttcaagtacaatcagacactctggaattggccctcaaacctataaacctcgattcagaatgaaatgcttcgcttttctatccgcgcttgccctctttcccggcaccttgagtgcaaccatctacatggcgggtgattcgaccatggccaagggcgggggcggatctggcactgacggtaagtctcaaggcaagagcccatttgcaaggtacatctataacgctctcgtaaaaacaggatggggtctacacattgcccccttcgtctccggcacagtatcgaaccaaggcagttgcccggccgcagtgctcgctcgtatacccgcgaacaacgtttccaggccatcgcagatgtcctga

SEQ ID NO: 6722 - DNA, 198 bp, A.fumigatus
  unsure (10),(11),(12): Identity of nucleotide sequences at the above locations are unknown.
gcgggccccnnntatttttacctagcgcggtccttcgcccctgtggtgaagaacgagcttgtgactaaggcagcatttagcgacggccgtactgtgtattttccccctaggttatactttgaccgtcgttcgttgactgactttctggggcatttatgtttcaatatgtactgcggcactaatacatttttgagttaa

SEQ ID NO: 6723 - DNA, 672 bp, A.fumigatus
gtgataacttcatttaagctgccagtgccagtctttgaatccaacccagcttctccaactatggccaagaaagtgacatgcaagcagtgcgatgagaaaaagccgacctgcaccaactgtcgccagcatgcagtcatctgtgattatgccaccgagtcgactgcaccatcacgaccttcgcgtggacaatatcgcttcagacagtccaaatacgaaatccagatagacccatcaaccccagacaccacgagcatacagtcatctaacccgggtccgactccccctccccctctggagagcatctccctcgcagacctgcaccttttccatcactacgtcaccgccatggccagcacattaaccgacggacaagaccccaaacacctttgggacgtccacgtcccacaatggggcttcgtctttccatccatcctgcatctcatccttgcgctctcggctctacacctggcgcaccagcacccggctctgcgcgcccagtaccggaaccaggcagatgcccacttcaccttcggtgtccgctccgtgaccaccgtgctggccagcctgaacgaagacaattgccagtacatctacatctcagcggtgctgatctgcttcgtgtactttgcgcatggtccgcgcacaggtgagttcctcgttttcagcgagaca

SEQ ID NO: 6724 - DNA, 777 bp, A.fumigatus
atgtccgaacaggcggaactcaacaaaaatggttctcaagagggaaaagacgtcaggccgccggaacgggcccatctagcccaggatacacttgcggatcggcagggatcgttgggaccgttgcatgaggatcgtccacgccatattccgtcacagatttctttgcgttcacagtcgcaaattgcctcgattccatcaaacacaggcgcgccaccgaccggcggcgaggctgatgtcgctgaggagttggcatggggccccgcgcatccttgctaccctcatctgaatccacatgttcccatcgggtcgcaagagtatctcacgactcgaattattcgaatacgacgcgactggatggtgaagggagatctggcgccgacgttctcgaacctctatcctgagattttggacccgttactaccagaacaggagtttcggcgggtgattgcgacggtgaatgaggaactcatcaaggcctttgatccgttcagtttccgcaatctgcttgatggcgcgctgggtctggtcacaggttggctgtgggaagatatcggtgccgctggtatcaagagccatctgcaacaagtggaggactggcttgacaagtggaatcgcgaggtcggcgcgaaggacggggtacatatatggagtctgcgacggacggcatacctgtctttggacatccaaattccagatcccaaggttggcatcgtccacagcgagggcatgtcattgccggggacgagaccaaacagtggcgttgggcttggattctaa

SEQ ID NO: 6725 - DNA, 201 bp, A.fumigatus
ccgacttccccacctacggcccccatttatcctgagagcttctccggcagaatccccaatttcatccctcccttctgccagggcgcccattccaacgccctctttcccctttttgagagaccccatattcaaaatgctctccggcattctcgtcttcaaccaaaaaggcgagaatctcatcttccgcgcctttcgcagtga

SEQ ID NO: 6726 - DNA, 510 bp, A.fumigatus
actgaccgacttccccacctacggcccccatttatcctgagagcttctccggcagaatccccaatttcatccctcccttctgccagggcgcccattccaacgccctctttcccctttttgagagaccccatattcaaaatgctctccggcattctcgtcttcaaccaaaaaggcgagaatctcatcttccgcgcctttcgcagtgattgccggccgcgcctggccgacatcttccgcatccaagtcatttccaacccccaagtgcgctcgcccattctgacgctgggatcgacgacgttcagccatgttaagcacgagaatatctatctggtggcggtgactaagagcaatgccaacgcagcattggtgtttgaatttctataccggctggtgttgctggggaagagctactttgggaagtttgacgaggaggccgtcaagaataattttgttttgatttatgagttgctggatggtgagtattccctcaaacaggggggtctagagtag

SEQ ID NO: 6727 - DNA, 486 bp, A.fumigatus
aggataatcgttttagaaatcctcgactttggctatccccaaaacaccgacccggacacgctcaagatgtacatcacaacggagggcgtcaagtctgccatcgtcaacaaccccacggactcgagccggatcacaatgcaagcaacaggcgcgctctcctggcgccgtgcagacgtcaaagtaccgcaagaacgaagccttcgtagacgtcatcgaagacgtgaacctgctcatgtccgccacgggcaccgtgctccgcgccgacgtcaccggccagatcgtcatgcgcgcctacctctccggcaccccggagtgcaagttcgggctgaacgaccgccttctcctcgacagcgacagcggcggcggtgctggcccatcctcgtcctcgcacgcccactttggcagcaaagcaacccgcgcggctgccggctccgtcacgctggaagactgccagttccaccagtgcgtgaaactgggccgctttga

SEQ ID NO: 6728 - DNA, 813 bp, A.fumigatus
aaatcctcgactttggctatccccaaaacaccgacccggacacgctcaagatgtacatcacaacggagggcgtcaagtctgccatcgtcaacaaccccacggactcgagccggatcacaatgcaagcaacaggcgcgctctcctggcgccgtgcagacgtcaaagtaccgcaagaacgaagccttcgtagacgtcatcgaagacgtgaacctgctcatgtccgccacgggcaccgtgctccgcgccgacgtcaccggccagatcgtcatgcgcgcctacctctccggcaccccggagtgcaagttcgggctgaacgaccgccttctcctcgacagcgacagcggcggcggtgctggcccatcctcgtcctcgcacgcccactttggcagcaaagcaacccgcgcggctgccggctccgtcacgctggaagactgccagttccaccagtgcgtgaaactgggccgctttgacgcggaccgcatcatctcgtttgtgccgccggacggcgagttcgagctgatgcggtaccgcgccacggagaacgtcaatctccccttcaaggtgcacccgatcgtgcgggaggtcggcaccaccaaggtggagtacagcgtcgccatcaaggcgaactacagctcgaagctgttcgcgacgaatgtcgtcatccgcatcccgacaccgctgaacacggccaagacgaccgagcggacgagccaggggcgcgccaagtacgagccggagcataacaatatcgtctggaagattgcacggttatcccggcggcagcgagtatgtgcctccggtcttcaccactag

SEQ ID NO: 6729 - DNA, 276 bp, A.fumigatus
tttgactttcattgctctcccatctctagctctatcatgattggagctactagacgctggttccgacgcaatcgcaaaggtctcgcgatcggggctggcattattggagctggctatctcgcaggacaatatgtgctttccaaaatcacagaagcccgggagcagatgagcagcgatcgaattgcccgagaaaagtacgttacctttggattcaccttgatcttttggccgaatgagatggacaaaacatccatccactcgtgtgctcggctttga

SEQ ID NO: 6730 - DNA, 393 bp, A.fumigatus
ctgattgatctgtctagtttacggcgacgtttcgaacaaaatcagacggactgtacctatactgtgctggctctcttaccaaccgcagcggaaggtatcgtcgaagcccttcccgtggaggaattgaccaaagaattgcagaagaagcgggcggagagattggctcgactccaggctggggagggaaccgtgtcggacctgagctcggtgtcaccgagtgcagccgatgatgatcgaagaagcctctcaagcttccagagcgatgggtttgtccgtacaagtcaagtaggagaatcgtccttcgacggcgaagggccggcacgggtaaagcgcaacaaaactcaactctggaacgaggttaagatcacttgtacgttgccttcactcgtataa

SEQ ID NO: 6731 - DNA, 294 bp, A.fumigatus
aactgctcagacgggatagctaacgtcgcaactgcagctgtcaccagatcgtttactctcatctacaccttgtccttactaactattttcacccgaatccaactcaatctgcttggtcgccgaaattatctatccagcgtgatctccctggctactcctccggcaaatacctccacgatcaaacttgaggaccatgatgacgatgatctgactcagaccttgggaaatgatttcgagacaaacccgagatatcttgcattccgctggtggttgctcccccgtggctgggaatga

SEQ ID NO: 6732 - DNA, 522 bp, A.fumigatus
ataggtcaactatgcaaaacagaatggcaagaaggtccgcggacacaccttaggtattcatgcgccctcacggcatttcgaggatacagccaagctgacagtgtagtctggcactcccaactcccgtcctgggtgtcggctatcagcgacaaaaacaccctgacctcggtgctgaagaaccacatcaccaccgtcatgacccggtacaagggccagatctacgcctgggtattttgccctctatcccacacaatgccagccccagctaatagctgcaaaggacgtcgtcaacgagatcttcaacgaggacggctccctccgcgacagcgtcttctcccgcgtgctgggcgaggactttgtgcggattgccttcgagacggcgcgctctgtggatccctcggcgaagctgtacatcaacgattacaagtaagcttgtggttttgtcgagagatgtactccgtcctggatctgaccatcacagtctcgactcggctagctatggcaaaacccaggggatggtga

SEQ ID NO: 6733 - DNA, 399 bp, A.fumigatus
acgacagagcctggaccctgtggagggtctgtactacttctggcagtgctttgcaactataatactgctgtagagactctctttcagcaaacacttcaacagacaagaatccaatctcactctatcatactcacgatggtcgtcctcagcaagctcgtcagcagcattctctttgtctccctggtttcggcgggcgtgatcgacgaacgccaggcagccggcatcaaccaggcgtttacctcccatggcaagaagtactttggcaccgccagtgaccaagctctgctccagaagtcgcagaatgaggccattgtgcgcaaagactttggccagctgacgccggagaatagcatgaagtgggatgcgactgagcgtaggtctctcggccactgtggctga

SEQ ID NO: 6734 - DNA, 231 bp, A.fumigatus
cccggtacaagggccagatctacgcctgggtattttgccctctatcccacacaatgccagccccagctaatagctgcaaaggacgtcgtcaacgagatcttcaacgaggacggctccctccgcgacagcgtcttctcccgcgtgctgggcgaggactttgtgcggattgccttcgagacggcgcgctctgtggatccctcggcgaagctgtacatcaacgattacaagtaa

SEQ ID NO: 6735 - DNA, 525 bp, A.fumigatus
ctcttcctgaaggcactcaaacccaccttggtgcgggtgcttcgtccagcgtcaaaggataagtctccttggttttcttgcctacgtaacgctgaccccccgtgtacagcattgactgctcttgcgtcttccggcgtctctgaggtcgccattaccgagctggatatcgcgggtgcgagctcccaggactacgtcaatgtatgtctcctgattgccaatggcagggtcatcgatactaatagaaacaggtcgtcaaggcatgcctggatgtccccaaatgtgtgggaatccaccgtctgggggggtgtcggacaaggactcctggcgctcccgggtcctctccgctgctggttcgacagcaactaccaccccaaggcgcggataatgccatcattgctgctctctgatctgggatcgggtgcgtatgatctgccattaatgtggggaggctggatgtacttagggtgcgctgcgggactggacaccattcgaaatcatccctggcataaaacgggaacgctttga

SEQ ID NO: 6736 - DNA, 237 bp, A.fumigatus
  unsure (53),(63): Identity of nucleotide sequences at the above locations are unknown.
ccttgcagcatggcggaccttcctttcattaccaacaggggttacacggggcncggtggcgtnccgaccaagggccaccgggctgtacaggttccctccccccccacaagaaacgttaattgtcccaagccggtgttgcagagtagtggatacagagcagcgggcatggttaatacaggctattttcatatgcctgtcgtgcaaaccaaggggcatgtgacgatgcagggtctgtag

SEQ ID NO: 6737 - DNA, 327 bp, A.fumigatus
ctgcaaaggacgtcgtcaacgagatcttcaacgaggacggctccctccgcgacagcgtcttctcccgcgtgctgggcgaggactttgtgcggattgccttcgagacggcgcgctctgtggatccctcggcgaagctgtacatcaacgattacaagtaagcttgtggttttgtcgagagatgtactccgtcctggatctgaccatcacagtctcgactcggctagctatggcaaaacccaggggatggtgagatatgtcaagaagtggctggctgcgggcattcctatcgatggaatcggtgagcacaggtcgcggagctgtgtgtga

SEQ ID NO: 6738 - DNA, 582 bp, A.fumigatus
atcaatatggcgcagccacaggcaggttactggacgcttcctattattgcgtcttacctctccgaggtaaaccctgcgaataacccttatcaggagaggatcgatcacttgtggtcgaatatcctcaaccactacttcccactgcgcgatggttttggtaccgagagggaagcacttgttaaacccccaaggagatttgcgactaacgttgctatcaccaacgtgcgccctttgggtatgcacaaagtggttctcgtcgaggctaagaccttcccacggaacacggacattggctggttcagcgtgtatccgtgggccgatgttgagagcatactccagtccttcatgaagaaggcccctgatacctttgggaatgtgcagactatgtacggaattgttgcggttggagatagggttcgtttctacacgatgaactcgcaaaacaacacgggcggcatccttacgccgtttccagtaggaggacctcagcccctgctgagcgttcacactgatgcgcacagtatccatgacatcctgactgccatttcgctggagattcggacggggtggaatacatattaa

SEQ ID NO: 6739 - DNA, 1125 bp, A.fumigatus
gaagaaggggtgttagagtcctgtctaacgcatgtcgatggtcgcagtttactcttcgtcgcttcacttttcgaagaccaaccagtcctcgtggatatttcgtcccccaaaccgatcaagcgaatactcccctccgctccatttcgtcctccgccatccgcctcagaagaagtcgacccagccatggccgccaagcaagctgcgcaagatgcaaagcactcgacatgcgtcacaatattctcggcatttggaaatcacatcatagcaggcacatccaaggggtggatcaatatcatcgagacacagacctgcacgaccatccactcgacccggctgtgttacggcgtggtcattctcctccgtttggcaagcaatggccgggacctactcatcaacagttctgatcgcgtaattcggaccatcatcatgcctgacctgtcacaactagggatcgacctcgagcccgcgaacatcaaactacaagtggaacataagttccaggacgtggtcacccgactaagctggaagcacgtcaccttctcctctaccggtgaatttgtcactgcctcgacctttatgaatccggacatctacgtctgggagcgaagccacggttccctcgtcaagatcctcgagggtccccgtgaagagctcggcgttgtcgaatggcacccgtcgcgccccatggtagtcgcctgtggcctagaatccggctgcatatacacgtggtccatcgtcacgccacagaagtggtctgcccttgcgccggatttcggcgaagtcgaagaaaatgtcgagtacatggaacgggaggatgaattcgacattcacccggcggaggaaatccaccaacggcgtctcgaccaggaagatgaagttcccgatgtcctcaccatcgaaccgctaaagagtggcgcggacggtgagatggaagccttccgcatgccggtcctcctggacatttctgacagcgaaagtgaggaggacatagtggcggtagggccggggacgatgcgtcgccggagtcccggtgcaggtcgggagtggatgaactccaatggagacggagacaaagaaagtgggaagcccggtgctggtagaggtcaaaggggccggcggaaataa

SEQ ID NO: 6740 - DNA, 228 bp, A.fumigatus
cgaaaatgtatggaaaagttcggagacggcccgaaaacatacggcaacacaccttacaacccaacaatatccaccttttcggtcgccaattcttatgaccgggcacctttcttcgttcaataccagattcatgctcacgcggagacctctgaaagctcgcatgaaaatactggaacgaaggcttatcccgtttcctgcgcgttagaaagcctgactgttggcttttag

SEQ ID NO: 6741 - DNA, 183 bp, A.fumigatus
acactcctggccgagaggctgtttaagaaatcaacccctaagttccgttccctgccgcgaaacccctttgggctcaaaaccggaaacccccctctcctccaattctcggtgaaacacccttctcagggatctgtgttttccacattgttgttcccccccggaactatctctgatattttctaa

SEQ ID NO: 6742 - DNA, 1992 bp, A.fumigatus
tatctcagaaggagaaaattccccgattgggtagtcggtgcgcctggctgcctgaggcttcaattatgcagcaatcggtctccaaaaagagttgatattatattttcatgcctctcagatcaggaattgtcgttaatacaagatactgctcttcaagataaaagcgcattgcgcttctttcaaatgagcgaatgttctaagcgattagagcagcccctaaggtataagcttctcaccgcccactggtgctctatctcctccgtatctggatcggatgaatctccgcgctgtcaacaatacaatatacagacacattgcaactaccacccacgctcctgtcgacctaggggtccggacacgatgtccaggacagaacactccatcaccaacgggcatgcggtctcgtctgcacaaaatggagaacgcccgaacgcccacctcccaattgacgtgttcaacgccagttccgttgcggagatcaaggccgccctgtcacacctccatgatcaagaggtcgccgtcaccgctcggttggacgcccttgtcgcatcacagaaagatttctcccgggagctagggcggctagatcttcttcgcgcccatttgggttcccagaccagcaccacccacgcaatcagccatggcatgttgtccgacgctgcggcgaccgcagatcgcatctcgagcgccgtccgtcagctcgacctggagcagtcaagagtgaaagcgacgctggaagtggtagagcaggtttcggaactgaaggcttgcgttctgggggttgcaggctccatgggggccccgcaggactgggaaacggcggccagttatttgaaccgggcgtccaaggtacctccggaggtggttcacggtacttttgcagcagagatggtgccgaccgctgaggttcctgacccgccaaatgtcactgtggacaatgcgggtgtatcgctttgcggcttattcgtgcgcgagttagacaaggccgtcaaagagaacgatggcgccaagattacgcggttcttcaagatatttcctcttattggccgctccgaggttggtctggatgtgtatgggcgctatgtatgccagggagtggcatcgcgggcgcgagcgaacctcaatgccagcacgggaggtgctcaaagcaaagatggcttcttatacgcaaatgcgctgacgaaactgtttgagcatatcgcccagctcatcgacggacatggagggcttgtggagcgccattacggcccgcggaagatgaccagggtcattgaacgtctacagctcgaggcggatctccagggtgggattattctggacacctggagcgacgagcggcacatcgatcgcaagcttacagacatcaaatcgtatgcttttactttcttggtacagagttttcttcccgctcaacgcagtgcaacgcctcggtcgaattccccggcgactcgcgatgggctccccgctgaagacgagggtgtagacatgaaggagatcgacgggctactaaacgaaatggcagtcatgctgagccgctggtctctctactgtcgattcatcgctgaaacttgcaatgtacgttatctgactgcctcaacaagcctttgcatggacgtattcggaaagctaacactgtgcaaggccaccgaggacgagagtcaaaagtttacgccacccaagtttctacaggaagcgagtctttccaagaaaatcactgaccgtctgatcaatccattcaatactatgacgacttttttctttcgtcgctcggttgaaaaggcgtttcaattggatgaacagccttctggtctgacactacaccctcaaaagccattgaaagcagatcctcctcatatcacatctgcagtggacgacattatgtatatggtccaccaggttctgcaacagttcctggccccctcacaaatctcggtagtgactaatgtcgtccccacattgggacgagtcttggatcggacttcatcggaatga

SEQ ID NO: 6743 - DNA, 549 bp, A.fumigatus
  unsure (531): Identity of nucleotide sequences at the above locations are unknown.
tggcaggtaggggctggaatcagtacctcggcgggcattcccgattttcgctccccggacacaggtctttactccaatctagcctttctagatctgccagagccggaagatgtgttcgacatcagttactttcgagagaatcctcgaccgttctacgccttggcgcgtgagttggcgcctggccggtatcgaccaactattgcgcattcgtttgtcaagttactacatgataagggactgctgttgaaacactttacacagaacattgattgcttggagcgcctggcgggcgtcccaggcgagaaaattgtcgaggctcatggtagcttcgcgtcgcaacactgtattgactgcaaggcggcgtacccgggacctcaaatgaaagaggcaattgccaaaggagaggtgcctcattgtcctcattgcaatggttttgtgaagccggacattgtcttcttcggagaagccctgcccgaaggaattccatgcaaaccgaagtctgccaagaacaagcagatttatgtattgttnatgggggaccagtctcac

SEQ ID NO: 6744 - DNA, 768 bp, A.fumigatus
tgtcaggtgacaggaccgggggttccatctttgaggacgtcctcttctccatccgctttcccctccctccttgatccctccatctggatagaaacctttctctgcatcatcatgacaatgtccaaggctcgaggacttgctagagtgtcctcaatggctaatttccgcactgatgcgactggaagcactgttgacaatgccagtcccgcgccctcaccctctttacccgctgagtctctgcgtcccagcaccacaaccattgcctggaccatgatgtcgctttgtctgtcagtactcctctctgctcttgacttaacaattgtcactcctgcaattcccactatagtcggcgcgttcaagactgccgctggttatatttgggtgggaagcgcctataccctggcctacgcagccattacgccagtatggggctcggtctccgacatctggggtcggaaacctattatgctcattgcggtggcggtatttcttgtcggcagtcttgtctgcgcccttgcgcggaatatggatgctctgatcgcgggacgggcgcttcagggattgggcggctccggaatggggattatggtcaacattgttgtcagcgatatgttttcgctgcgagatcggggtttatatctcgcaatcacttcgcttgtttgggcggttggcagtgccatagggcccgttctcggtggcgttttcaccacgaggcttagctggagatggtgtttttggattaactgtgaggcattccatctaacctga

SEQ ID NO: 6745 - DNA, 846 bp, A.fumigatus
  unsure (823),(829),(830): Identity of nucleotide sequences at the above locations are unknown.
gcttactccatcaaccgtctagtaccggttggagccgtctcctttcttgtcttgctcttctttatgagagtccccagtcctcgaacacccatcgccgccggtctaaaagtcatcgactggacgggcagtcttttgattgtagggggtgctctgatggtcctcctcgctcttgagtttggtgatgtcggctactccttgtcctctgcaacggtcatctgtcttggtagttttggaacagcagtcatggcgctgttcgtggtgaacgaatggaagatggccagaaccccattatcccattttgctgttcacctgcccgacaagatagcgccctacgttgccttccatgtaatcataccgggttatggacaggcatattacctgcccttatatgcacaatccgtcctgaccgcaagcgcgctgacttcgggtctctacctcctcccgctcatcgtctcatgttccctggccgcggctgcagcagggatcctcatgcagcaaaccgggaaatatctctccgtgatgtacgtcgcccagggatttttggtcctcggctctggcctattgattagtctcgagtttgaagccagcatcaccaaactcgtcatcttccagatcctggtcggattcggggtggggatgaacatcgaagcgccgattcttgctgctcaggccgcgaccagtgtcctggatacggcagccgtcactgcgacaatggggtttgttcggtctctctctacggctatttcggttgttgttgggggtgtggtgtttcagaacgagatgtcttcaccacgagggggatctatcaacagttgtcgatatnaaaatnncccccgggcgctgtga

SEQ ID NO: 6746 - DNA, 225 bp, A.fumigatus
gtcacttccaaaacaggagcacccagcaggagaagcatgcctgtaatgcttatggcgatagcgggactcgaaaaggacatcactggccctgggatgactccacttcggccctctctgttggagaacatgcaggtgttgctgcgtctggttctgaaggtgtctgcgggcattctcgacgcgaaggctattgaggatagtccgaatttctcgactgagcctgcctag

SEQ ID NO: 6747 - DNA, 1104 bp, A.fumigatus
ttatctttgatagatccgagcagtaatcgccacctaatgatacccttcgcgagaaacccgcatttcgtgggccgccagaaagagatccaggaaatagaggattcaatttatgcgccagacggactaaaaaaacttgctattaccggactgggcggtgtaggaaagactcagattgcgctggagctagcgtaccgcatgcgagacagagagcctgaatgttcgatcttctggatcccctgcaccagctacgaggctgttgagcaggcttatattagcatcgcacaaatggtggggctccatactgtggagccgggcgagatgaaagagcgtctccagacttatttcagccagaccgacgagaaatggattcttatcttcgacaatgcagatgaaatggccatgtgggttaagggcagccctgcagcaccatcactcaagaatatcatccctcggagcgagaatggccatgtactcttcacatcgcgcaaccgccagcttgcattaaagctggcagcatcaaacgtggtctctgtccctgatgtggatcaaaatattgccaaggagatattcaggaaattgctgattcggaaggatttgctgcaagatgattatgtgacaagcgcgctccttgagcagcttgcttttctgcctctggcaattagccaagccgcggcttgcatcaaccaaaacgacatatccttagcaagatatatgtcattgctgggtgagcaagaggcaagcacgatggaactgctcggcggggagtttgaagatgatggacgctacgcagggatccagaacacggtggccacaacctggctgatctccttcttgcagatccagcaagtagatgaggtagcaggcgactatctgtcgtttatggcttgcattaatccacgggatataccagagtcgattcttcctcccacaacttcaacaaaacgaaaggtggaagcattaggtcttctcaaagcatattcctttgtcaatgcacaggttaatgacagtattttgagtcttcatcgactagtacatcttgctactcgaaattggctaaggaacacagactcttcaccacgggatgaccgacccgcgcttatgtat

SEQ ID NO: 6748 - DNA, 960 bp, A.fumigatus
atcgagtacacctatggcatggtagtcaccaccctcgctgcggttgaagacagcaaccccgatatctatgtccgcatcgacggtgacatggatcccatcaagcccggtgatgatgtcgaacccaatttggcagctgtgcctcccaagcccatcactagcaagctccgtaccgccatcaagcaccttcgcgcccgtgccggtccctggtctcgattccgtggcatgagcatgttcctgacataccttttcgctcggggcttcttgcttagtatgatgcccttcgaattggaccagtttgttttccagttcatcttccaaatggttgttggggttctcttggcgaatttgcagttggcttgggtccacattgtcatctcggagccttcccctaagcgcttctaccagcgtattcctggctaccaggcctggctgaagattgcacccgttgtggcctttgagcatgctgttgctggtcttgcattctatgttcctctcattgtgatgaatgcttacggcctcttggagaaattggcctccgctcccgatgatggtgttcctcccgccgagaccgtccgccaggcgctcaccgttgtcgctcttccttctctgctttcactgatcgcgtccattcctgctcgcgtagtcttcatccgtgtcgccgcttcaatgttgcccgaggaggacgagtctatcgtgcctttcgatcgctctttcggcggaaaggtggctcctgcgattcttgggggcagcggtaagctcagcatcaccgatgcttggaagacctttgaccgggctgctgctcggattcgtttcctcaaggtggtcggaaaagtcatggcccttgagtccggcgtgtttgtctttttctcgctggcgctcgcaggcgaaatttatatgggagcggaggctctcatgaagatcattgcggatatgatcgctcgcagcggcggcagcgcttaa

SEQ ID NO: 6749 - DNA, 870 bp, A.fumigatus
  unsure (249): Identity of nucleotide sequences at the above locations are unknown.
ctatatcttagcgcggatgcctcgaccccctgtggtgaagacaccacgagtcatccggattacatccgtttttacaacagcttgtggctcgttgccaatgatgtgatcatcggtattgcgctgggatcatacatcatcgacaacgccaattgggtggctttccaaatcaacagtgtcctcactggctggacagtaaaaggcttgcagaggacgatatcgtggttgatggactggccggccggcttgaancttaataacgaacttgctgcattcttgggtgacctctttctctgggtcattgaaaattgggccggtatgcattttcttctactagacctattgttctctttcgctaattttggtgcagcttgcattgcgaatctacagccttacctcccgcatgtcatatacgtcgttgggtgctcgagtttcgccggagcgagcatgccgatcgcccttttttccgatctcgtctccattctaaccgtgcatatttactcgttctacgttgcgtccgcccgcatattcaattggcagcttactatcatcatatctctctttcatctcttccgcggcaagaagcgcaacgtccttcggcatcgaatatactcgtgtgattacgaccttgatcagcttctgcttggcactattctcttcacagtcctcttcttccttctgccgactgtgattgtattctatctaacgtttgcctctgcgagaatgttgatcatctcgctaaaagcggcactcgacacatgtttggcttttctcaaccatttccctctatttgcgttgatgttgcgcgtgaaggattcccgacggttgccaagtatgttggttttactaatctgtttgatcagcagtcactga

SEQ ID NO: 6750 - DNA, 246 bp, A.fumigatus
ctcttcactggacgttttgtgcctcctatccaccgccgtaacctatacagtatgcagtacagcatgctccctgcgcatcgggccggtatggccgaggtgtggtctctgctgacccagccccgaaaaacaagcagtggtagcagtggctcttcttcgatgggaggggtcacggctgccaatgggttagttaggattccatcggggtttggtcaaggagatgtcagacgacggggttaccgctattaa

SEQ ID NO: 6751 - DNA, 183 bp, A.fumigatus
aacaccctgcctgacctgacttcctcagccggaactaaccacatcaaagcaatcctctacaaatcccttggcatcgactcgcgcaccatcctggccttagccgccgtctacggcacagtcgccttcctcacaaactgcctcacaaccaagtaccttactgaccaatggggacgccgaaagtaa

SEQ ID NO: 6752 - DNA, 222 bp, A.fumigatus
agtaatggggctagcggccgcgtcgcatttcattgtcaatgtagcaggtctgttccctcgactctccccgctgggtacatggcaatggagctaagattatccgaatgtgcagtcaccgaagcaggacccagtgcatttgcgaacatccacgagaactactactatgttttcgtggcgtgcacggcattctttttcgtggtggcttatttctatttcccgtga

SEQ ID NO: 6753 - DNA, 189 bp, A.fumigatus
gctaatccacatctgcgtcacagaatgatcctcaccggcctaggcggcataatcctcatcgaaatctacgccgcggtcatgcaacgcgaattccagaacacaaataaccgcgtcggtaagggtttcgccatattgggtatctacatgtttgtcgtgatatattgtacgtcctttctctccctttcctaa

SEQ ID NO: 6754 - DNA, 297 bp, A.fumigatus
gggtcgcttgagccttgttactttgaaccggtcggatccttccagccccgtggtgaagacgtgatcatgttcgctggactggtcacattcatgcccaactcgccgcggcatctgatccgcaaaggcaagatcgagcaggcgcgcagcgagttcgtgcggatccggagggatctccgctcggacgatgtgcatcgagagtttgagcttatgctcgcgcagattaagtacgagaaggagcgggagatcacttcctaccgggagatctttcggctgttccggcatcgtgtgttggtgtaa

SEQ ID NO: 6755 - DNA, 195 bp, A.fumigatus
tgtactgctagtgagacgaagcagaagactcttgaggagattgctgcgtcttttggtgataaggtgattctacctgaggatcagggtgatcagcaaggcgagaacgacgaggatgaggatgaggatgtgaagaaggtgaagcccaactctcagcaaattgaggtggctgtagctggaagagatggttcagtctaa

SEQ ID NO: 6756 - DNA, 204 bp, A.fumigatus
tacgtgcttaccctcgtcccacgtactcacgctcccagctccttggtagttggcgtactccgtaagaaaaccaaatacccaccacccaaggctcgtccactccccatccgcatcgctcagctgttgctgcagaccgaaaaaaagggcgccaaagcgatctcctacttcctcttagttcaacttcctaggtctaacggctcatag

SEQ ID NO: 6757 - DNA, 258 bp, A.fumigatus
caaaggcactgtaaactggcctcagacaccaccctcgacaacaacttagggtggagtctacctcagggggtctgcgctgctgctgatgatgaggatggtgatgaggctgccagtgccgtgatgacgacgatgaccacttggcctgttgagacagactacccttccgactatctgtctagttggtcattatgggccggcctgacacccataaccacaaccacagcagcagcagctactataactatatctggactataa

SEQ ID NO: 6758 - DNA, 264 bp, A.fumigatus
gacttggtgtacgggacattcttcatcgaaaaccttaccaagctactttgggattattggtcctaccttggtaccttaggtacctttatcttggatggatccgaggtgggtattatgggtacgtattattgttacctggctggatatggtttattaactatcttattttacggggtatttacccatggttttacggatcccttgcagcattcactgtttagccggctgagcggagccagtcacagagctcgaacagccagctga

SEQ ID NO: 6759 - DNA, 219 bp, A.fumigatus
agcacaggcaagtggaccattcaaaacactgatagtttgactttgtatgcttttgctaagtatgtccagaacgcgctgggcaacatctacccacacctccccttggcgccaccgcctccaaccagcgcgactattctattcaagattggcgaccttttcacactctataacaaaggcactgtaaactggcctcagacaccaccctcgacaacaacttag

SEQ ID NO: 6760 - DNA, 366 bp, A.fumigatus
ctgacggctttcatagatatcgttcccattgtcatggctggtatcattggtatctatggactggtcgtatccgtcttgatcgcaaacgacttgggtcagagcgttccgttgtacacagggttcattcagttgggtgcaggcctggccgtcggtctcgccggtatggcagctgggtatgttccaccatcacgaactccctcctcaaattctgtgagtaatcaactgaccttggtctcctgcagctttgccatcggtattgtcggtgacgctggtgtccgtggaaccgcccagcaacccagactttatgtcggtatgatttcgatcctgattttcgctgaagtcttgggtgagtaccatgatatgtga

SEQ ID NO: 6761 - DNA, 396 bp, A.fumigatus
cccttcttcggtgctctcggctgcacttctgccattgtatttacctgtttcggagctgcctatggaactgccaaggctggtgtcggtgtctgcgggatggccgtcctccggcccgacctgatcgttaaaagtatgtttacagcatcataccgattcggaagacccgatgatgtattaactgacggctttcatagatatcgttcccattgtcatggctggtatcattggtatctatggactggtcgtatccgtcttgatcgcaaacgacttgggtcagagcgttccgttgtacacagggttcattcagttgggtgcaggcctggccgtcggtctcgccggtatggcagctgggtatgttccaccatcacgaactccctcctcaaattctgtgagtaa

SEQ ID NO: 6762 - DNA, 252 bp, A.fumigatus
tatctatcagacattatggcgcctatgtccattgcagaccttgtggctgccctccccgctgaggacacctggggccccgccactccctccgacaacatgctcgatggcgttccctacgctcccttctcaaagggtgacaagcttggccgtatggctgactggaccggtgatggcaatgaccgtgacaggagtggtcgtcaggcctacaatcggaattacagaggtgagcccaatcgtcctgcacgtcgttga

SEQ ID NO: 6763 - DNA, 1512 bp, A.fumigatus
gatttattgattgggctgagaaatgttatgatggcctcgccgaattctctttcctccgcatatacgagtggtctgcgccgacaaccatcactgcggcaaatgtctacgctttctcgctcgaattctagacacacttcaccagctctcgactatcatacaacgtcgcggaatgagggagtttcgatttcgagacagtattcagccggtgacagctccgatgatgaggttccggagcccaagttcagcgcttccgtcaaggctctcctcgacgaggacggacttgggtcttcccctcatctcaagtacagcagcaacgagcgtccctcttcaactgaacgcgcaatgtcagctgcgacaagtcaatcgaggcagtcccgaacatcgtcaccccttgatcgatcaaccggaagccccgctcctcgggtagtacgcatagctccagctctcgccaacaacaataggcatgcacgagaaggctcccctctagcacagagtgagagcgcaggctctagcgcgaactatagctcaaaagaactcatcacgccggcccccagaccgcgcagtgttcgcatcactgggtcgcggagtcatacacggtctcctacttcagagtccccctcccaaaagcggtcggctgataggagctccgttcatgaacattcgagtgcagagcgttcggaaaatgggaggacggtgaattacgaggacgactatgcccctcggtttagcactgcatctgttctccgctcgcgccatggggatgatgtgggcatgcagagttcccttcgcgtgaaaagagtcggaaggctcacaggaacatttctaaatggacctgcgaggaggggtgttctgcggcggcagagcgaggagaaccatgaccctcaaagctattccgccgagcgacatagagaatcgagtctcgaccccaacgacgacaacgccgaatatcgctataatgctaaaacacgaacctcctcatcgcccaaggtaacatgggcagaccccagcccgtctcaggaagctgagcgaccccgagcatatgatcccgctagtgcttcctctggggagggcccattctccaggtcttcatcgccgaggtcctccggatcacactccaaatcgacacctggttccgcctcggaaatgtcctcgaagccttcaagtgctcatgaggagcctgtcttcaaggtcccaccgcttcctcaactcccggccacccgagaccaagagaatgagcctccaccaacgttcaaacgggataagccccacgggcttagtctcctaagtaaaccggagaagctctctgtggtgtacggggacgacaagaaagacaatgaagagacgccagctggacattcccctcgcaagattctagcaacacggagtagcaatacccctcaccggccagcgccccatcctccgaagatgtcgatgcttgagaccgccacggcgacgggaggagcggccacggcatgtccatgtctacacgccaaggctggaaggaaacgcgtt

SEQ ID NO: 6764 - DNA, 219 bp, A.fumigatus
atgtccgacttacctaccgtcctaccctaccaattagatgacgacggactcctctacatgacgaaacatcgcttaattagcgagggaatcactgaggaaccttggatctacattccgcgtccccttgcgaaggacatgttccggttgatccatgacaaatggaatcatcaaggcattgataagtgcctggcttcacttaatgggtttacgctgtactaa

SEQ ID NO: 6765 - DNA, 237 bp, A.fumigatus
ggccgctgtatactatgtcagtacattgaacactatccagtttgtttgcagaacaagatccgccattacaagctatatagaagcctccaacccctgcaggtcccgcctgctctatttaagattattactatagatttcatcgtgggcttacctgacgacaatggctatgatcaactgttagtcatcattaataaattcagtaaacgcgttagtcttatccctggtaaatcaacatag

SEQ ID NO: 6766 - DNA, 255 bp, A.fumigatus
aaaggctatttcactgtgctgaaagcacgctggctatactcagcagcattccacccacagactaatggtcagactgaacgtgttatccaagtcattaaagtcatgttgcgccattcctacactaccgctgaacaacctgatctgttccgctggacaatagatctaccgagtatcatctccacaatcaatgggtcactgaatgaatctacaaacgccactccgcaccaactactcttcagtattaacctctgctaa

SEQ ID NO: 6767 - DNA, 549 bp, A.fumigatus
cttgatgctgaagaatccataaagtacacatccatacgcatgaaagagatctacgatcggaatcataaaccaattaaattccgcgttggtgatcaggtctatgtccgactgtaccgtggctattccctaccaactaagcaagccaattataagctccaattgcagaatgctggaccattccgcgtattggaacgcgttggaagactcgcctactatatcaaactaccctctacatggaagatccatccggttttgtccgtcgcccaccttgaacctgcgccggccacccccgatccgttccaccatgagttaccgaagcctcccgcggtcatcgacgccgaggtctaccccggtgaggatgacatatacaaagtcaaacgcttgctggacaagcgtaccgttcagcgtggacgcaaacataccccttatgtggaataccttgtgcggtggaagggatacggaccggaagacgaccaatgggttcataaagatgatcttcaaggttctctcaaactcattgaggcattcgaacataaccgtcctatgtaa

SEQ ID NO: 6768 - DNA, 891 bp, A.fumigatus
  unsure (83),(272),(461): Identity of nucleotide sequences at the above locations are unknown.
tacccgacaaaccactttctttataaaggaacactcgcagtgaatcgcttggatttcaaatatcatcctgtcgcaatggctcntatcttcaagtcccttgcgctcgttagcgctcttttcgctgccatcagctcggccgcccctgtcaaccttgacaagcgtgaagtggacgtagtgtggacaacggtcaccactgtcgtctggaccaccatcgatgtgaccactaccatctaccctactccgcaggctcccactccccctgtcgttgagtntactccgaccccaactccatcagctgctcccgagcaggccgagccgatcgagacctcaacgcagcccgagaccaccaagtctcagcccactcaaccttctgtcggtacgttcattcctgtcgccgccgccgccgctgctgctgctgattctgctgctcccatccctgaagagccggctcctcagcctgntaccaccgcagctccttccacttctactactacccaggctgccccgtccgctccgccagccgctaacagcggtagcactgaaaaggcggccagcagcggatacagtggcccctgctccaagggctcaccctgcgttggccagctcacgtactatgacacggctacttccgccagcgctcccagcagctgcggcctgaccaacgacggcttttctgagaacgtggtcgcgcttcccgtgggcatcatgactgacgctgactgcggcaagaccgtgaccatcacctacaacggtatcaccaagaccgctactgtcgtggacaagtgcatgggttgcaagcccaccgatctcgacgcgtcccggcacttgttcggcgagctggctgatttcagtgcgggccgtatcgacggcatgtcgtggtacttcaactaa

SEQ ID NO: 6769 - DNA, 396 bp, A.fumigatus
gtggccttgttctcggctcgattggcgccggtgctaagtaagctgtccggacctgcagccgaagtgaaatccatctgcttgaccatggtctctgccggcctggataccgtccctggcaacctgatcatgggcatcgcctacctggcctcggaggccggccagcgcatccagcaaaaggcctacgaggagattctaaaggtctacccgaatggagacgcgtgggaaaagtgcctcgtcgaggagaaagtgccctacatcacggccctcgtcaaggaaaccctgagattttggaccgtcatccccatctgcctgccccgcgagagcaccaaggacattgtctacaacggcgccaccattccggcgggaacgacctttttcatggtaagtcgttattga

SEQ ID NO: 6770 - DNA, 195 bp, A.fumigatus
aagacgaatcgcgaggccgagggattccgggtgcgtcgcgacaagtacctgacgttcttgctggatatgctcaaggagcggatcgccaagggcaccgacaagccatgcattaccggcaacattctcaaagatcccgaagccaagctcaacgagggtaagtggccttgttctcggctcgattggcgccggtgctaa

SEQ ID NO: 6771 - DNA, 219 bp, A.fumigatus
ttccgccctcgagcggaatccccgcatttcccgtctgcattcgtatttcgtcctccaccgcgtccacttgaatcccttcatcatttctataacatcatcctgttcacgacgatggaccatactcagacccccctagtcccagattcatggccaaacgcccgggatgaggacgcccgtccccgtaaacgacggctgaaatacatcaccaaagcatggtga

SEQ ID NO: 6772 - DNA, 207 bp, A.fumigatus
gcctccggctaccacggaccaccaccaacaatcagaactaactcaccgcgtagcaatgaatgcaaacgccgcaagatcaaatgcaacggccaatcgccctgccaacgctgcggccggcaacagatcgaatgcgtctacgcggggaggacgcggccccccgactcgagtgaccaacagtacgtgcatgcattgattcattccatatga

SEQ ID NO: 6773 - DNA, 375 bp, A.fumigatus
aacgcatacgccgccgactacgacgacgagcacttcaagatgcccgacaagttcattcccgaacggtacctcgacgtcagcgaaggctcgggcacccctcactacggctacggcgctggatcgcgcatgtgcgccggctcccacctggccaaccgggaactgtacacggcgtacatccgcctgatcacggcctttacgatgcatccggcacgcgatcccgctgaccagccaatcttggatgcgatcgagtgcaatgccattccgaccgcgttgacgacggagcccaagccattcaaggtgggattcaagccccgggacgcgtccaagctgcagcaatggattgccgagagtgatgagcggaccaaggagttgtag

SEQ ID NO: 6774 - DNA, 363 bp, A.fumigatus
gtagaaggatctgcctatctgctgaacttcccgtttcagcccgcatccacgtttgataccgaaggagccttcagctcgccatctcctttcttcatcacctacagcgacaagctgcttgactctacctcacctcaacccacaatagatgctacgacgctggacttgttatcgccgcattccacgcacgcgagcctcatcaagcatgccttttctccgtccggtcagaaggccagacccttgcggttcgacgtcaatggacgaaaaggtcgtcgggcgatctgcgtcttgtacggcgatgggttgcggtatgaagtcctagacatggatgctgaattggccgatgaggatgaagagagtgaatag

SEQ ID NO: 6775 - DNA, 201 bp, A.fumigatus
tccgtcgacccctgtggtgaagaccatcggcagtggctacaagccggagcaggcgttacgagttactcaaagccggagcgggagtttgccgaaacatgcgagaagctggaaagtgtggccccgtttgtgatcccccagcgtgattcacttgggcttaagtccagagtcaggagagctcatttaaggtcccaaaggtgctag

SEQ ID NO: 6776 - DNA, 504 bp, A.fumigatus
tacaaatatttgcggatccgtcgactcctgaaaggtgaagacagtggccgccatctgaaaatgaaaactctctcgagcacagccttcatctctctcctagcctttacgacagcagcagaggcaatcttcgacaatgtcactgtctttgcgccgccatccaactggccttcccacagaacctcgtacggccgcacccttctactagaccacaccaagaccgaccctgttctcctatcgacctggtcgttttccccgccggatgggacatacctcccaatataccggtcaaccgacggcggtcaaacgtggtctgatttttcaaaggtccacttctccaacaacggaggctatgtgggtggttctatctggcaaccgtttctctatgagctccctcggcaggtaggccagtaccctcgaggaaccatcctcgcctccggcaacgctatcccgcacgatttctcatcgacgaacattgaggtgtatgccagtctggatagagggtga

SEQ ID NO: 6777 - DNA, 705 bp, A.fumigatus
aggttctcctgggaattcgtctccgtcgtcgcgactggcggtccaccaaacacgaccaacggcgcaaccccggtgtgggagcccttcatatccatgtacgaagacgagttgacggtctactactccgatcaacgggatccgctccacggccagaaactcgcccaccagtcgacgcgggacctcgtccactggggccccgtcgtcaacgacgcagcctatgcgaactacaccctgcgtcccggcatgacgacggttgctcggatcggaaacgggaaatacctcctctcgtacgagctgggcaacgcccccgatgtcccgtatgcagtccactaccgtatcgccgacaatccgctcaagttcgacgaagcgacgccttaccttctccagtctcgagatgggacgatcccgtccgcatgcccgtacaccgtctggacgcctgttggtgggccgcacggcaccatcgtcatgagtgacggcacctactcggaagtcttcatcaaccgggacaacggcaacccccacgcctggatcaaggtgcctactggcaagggcgtggcgtattccagagcgttgacggtcatgccggacccgagtgtgatattgttcttcaatggcggtttgtatggtgaaaacaatactaccgttacggcgggagagtggattgtcccgaggcatcagagatcggctcgccaggtggccaggtaa

SEQ ID NO: 6778 - DNA, 237 bp, A.fumigatus
gcaccctgtcccctgaaaattccccggggaattactaacgacaattcctcctcagctcatgcgcttcatgctgggtggaactctcgcaactcgaacagcgtgcggactcggacaatcgcagctgcattatataacatgtcgtcgcagacgtctcaaatcattggctcgaacatataccatgactgtgagtgtggccagatcccatccatgagggccctttgttccttggctaattag

SEQ ID NO: 6779 - DNA, 237 bp, A.fumigatus
gcatccacttttgtcaaaatagcggatgctcctcgttatattgctggaaacaggacgctactcatcatcatttgcactaacatcgtcctctatgccctgacgaaactatactatgtgatgcagaatcgccgccgggatatgaagtggcaggcaatgacagaggaccaacgagttgactacgttgcgacaacacaggaccaggggaatagaagactggacttcagatttgcgcattga

SEQ ID NO: 6780 - DNA, 204 bp, A.fumigatus
  unsure (11): Identity of nucleotide sequences at the above locations are unknown.
ggtcctctaantcaaggtttctgttacacagcagcttcttttgcggacatcctcgctggttttctcgcttttgggattctgcacctacggggagttggtgggcacgccggttggcgctggctgttcttgattgaggtttgtacgaggccgagtccctttgttttgatgctcattatttacacaaataggggctgctcacattga

SEQ ID NO: 6781 - DNA, 315 bp, A.fumigatus
gaccccagcaagggcactatgcataatcgccagccgttgaccctcaaacttatttggcagagtttcaaagactaccatatttggcccttgtatatcatacgacttttgttcctgatacctagtagtgagtacaacacaagattcgacggattgtatcttccgccaaagtcagctaatgccaacagcaacaatatcgcaatactttaccttgctgttgaaagattttggattcagcactttccataccattctgctatccattccatgcacgttacgcaatttcgaaaacagccacaaatctttgctgaatactga

SEQ ID NO: 6782 - DNA, 642 bp, A.fumigatus
ctgatcaggtccaatatttctcccctgatcgccgagcaataccgcgaagaagtcccctacatcaagactctcaagaacggcaaccgcgtgattgtcgatcccgcggccaccatctctcgcatctacctgtacttctacatgatgatcaacattggctcgatcctgggccaggtcagcatggtgtatgcggagaaatacgtcggtttctggctgtcttacttcctgcccaccgtcatgtacctgggctgcccgattgtgctgttcttctgccgcaacaagtatcacctcgtcaagccgaccggctcggtctacacccaggccatccgtctgtggaaactggccatgaagggccggtggtctctcaaccctgccagaatgtatgtctctcctttcgcggtggtctgttggtggcattttactgaccctcgcagctggaagaagaacccgaagcccttctgggactcggtcaagccctctgctctgggacgcgaccgtccccagtggatgacctttgacgacgaatgggtcgacgaagtcagccgtggtctcaaggcctgcaaggttttcctctggtaccccctgtactgtacgttggtttccctcactcggcagagtcgccgctccagtccaacactaatttga

SEQ ID NO: 6783 - DNA, 198 bp, A.fumigatus
cgggtagggctcgcctacaaccaaatgatcaacaacctcacttcccaagcagccaccatgcgtctcggcggcgtccccaacgacatcatcaacaacctcaaccccctctccctcatcatcttcatcccgatcatggacaaactcatctacccgggcctccgccgcatggggcatcaagttcaacccactcaagcgcat

SEQ ID NO: 6784 - DNA, 444 bp, A.fumigatus
tccacggggctctttcttcttctaatccctcttcttctccatagcccagtgtctgtggaacaattccgctgtatctgtctttgcttttttatctttgttgccatgaacgtctcggaccccgtcgaggtggcggaagtcgcccgagccagggcttctgcccaagatgctcaaatcgacgagaagacggaccacaaattgtcgctcacgcctagcattgaggaggttcctccggcgtcaaaagaagcgggagtctcgtctgcggcttacgaggacgatcattcccatctacagaggcaattcccctctgatgacgacttcaagcacctccgccggatagcgggcgatatcccttggactgcgtacacggtggcgtttgtcgagttgtgcgagcgtttctcttactacggcacgactgcagtttgtatgtgttctgatcttcactga

SEQ ID NO: 6785 - DNA, 237 bp, A.fumigatus
cccatggtagtcaacgcgttctggtcttacgtgatgcccctggccggtgcctacatggctgaccagtactggggtcgattccggaccatcatgttctccattgccgcggcccttctgggccatatcatcctgatcgtctcggctctgcctccggttattgcgcaccccaatggtgccattgcctgcttctcgatcggtttgcttatcatgggtgtgggtaccggtggtttcaagtag

SEQ ID NO: 6786 - DNA, 312 bp, A.fumigatus
tttgggaagggccccaatcatgccgtcacgacggcctgcacgaccggagcgcattcgattggtgatgcagctcgttttatcacgtgtggtgatgcggacgtgatgctcgctggcggtgcggagtcatgcattcatccattggccattggcggctttgctcgagcaagaagtctcgccaccgatttcaatgatgctccggaaaaggcatcgcgaccctttgatgcagaccggaaagggtttgtggttggtgaaggagcggccatgctagttctagaggtgggtggcttcttcggcgacattaattggtgctga

SEQ ID NO: 6787 - DNA, 186 bp, A.fumigatus
ttgttgtcgtctcttcctgactttggggtattagtgctgagggtaatggacttggcttggcaggacgagcggaagatggctcggttcgctcagtatgccatggctgcctctgaggaagcgctggaagatgcctgttggaagcctacgtcgttcgaggagagggaagctacagtacgtgactgttga

SEQ ID NO: 6788 - DNA, 246 bp, A.fumigatus
caatgtctcgtgcaggggtacagaaaagtatctccattgtttgtcccaaagctcttgatcaatttgggcgccggtcatctgtctatgaggtatggatttatggtgagttatcaacctggatcaatcactgaattagatgctgatttgggaagggccccaatcatgccgtcacgacggcctgcacgaccggagcgcattcgattggtgatgcagctcgttttatcacgtgtggtgatgcggacgtga

SEQ ID NO: 6789 - DNA, 636 bp, A.fumigatus
catctccagtgtgatgaaatcaaacccacatgcgggaactgtgccttgagaggagaaccctgtgactggcccgccgaaactgactcgcaagggcattgtacgccgcggccacagactgactccctccgtgcgaaagcacccaaggatcaatctaagcgctgggcaccgcatccagacacagcgtcaccacgcccgctgcagtttgatatcgcatcagatgccgccggtggccgctcgactctcctccccggggagttgaacatggttgatctgcaactctactcgcaattcatgctgcacacctccaagcacatgacgctgaacttgcgccggcaacacatctggcaaaccgtcatcccccgcttcgccatgcggagcgaggccctcatgcatctcctcctggccctggcggggctggactacgccgcggctgggacggccgatgagcatttaggactcgtatctccagacatacagagccagccctcgccagcccacggcgaccacgaccaccgccaccgccacaacgacaccctggacgccacgtatcttcggatcattatcgagcaccaccaacgcggcctggaagcgttcaggacggaggtcttcaccacggggctggaagggtccgcccat

SEQ ID NO: 6790 - DNA, 534 bp, A.fumigatus
catcaatcacagacagaggccctgatggtgctatatctagctggtggccatgatgaagagtgctttgagactgcaagtactgctcatctgcggccactaacttctattacagtgcttgtggttatgcaggccgtacttctactagcaggaattgccttgctagcctctttcacacctgccacccttgcaagtcagcatgtgcttggcctggaagcagcgtccggtgtcaacaatgacatggtcatcactggggtctacaaagacgaaaagattaaacatcctatgattattatccacgatatcaatggcaagattgtctggaactggtcagtctccgacgtcggtgaaactgtaccgcatgagctcctcacttgtattgccacacatcgcgcggcgactgaggtcaagttcgctgccaaggggagtaaagtcactgcgatcattggcagcgctgctctggtgatcaattatccgggaaagcaagttctgagtggcatctgtcttcaccacccggggctggaaggtatcgcgctg

SEQ ID NO: 6791 - DNA, 867 bp, A.fumigatus
ttttcctcttatctcaaagtgagcaatttcgccagtttccactccctgtatagcagcacatgtgctgaataccatctttcagcccttgccaacggagctttattagctactgcccctgtcaatcgggcgttgccgaatgctcccgacggatacacccctcaaggcgagacctgcccctcgaaaaggccatctatccgcaatgccactgcactatcgagcgccgagacatcgtggctgaaagcgcgaagaaacaataccaaggatgccctgaaagcatttctcagcggagttgacctcggttctttcaatgggtctgactatattgctaatcattcagctaatgcatctgcgttgcccaatatcggaattgcagtatctggcggtggctatcgcgccttgatgaatggcggaggtgcactgcaggcgtttgataatcggaccacgaactcaacccacagcggccaactgggcgggatcctacagtcagcgacttatctttcgggactcagtggcgggagttggctggttgggtcgatatatatgaataatttctcggatgtatcgtcgctgcaagacaatggttctgtgtggcagtttcaggattctatcttcagtggtccgactcagagcaccacatgggatatcggcacggtggagtattattctcagctgttgggtgcggtggacgggaaatcgaatgccggctacgaggtctctatcacagattactggtatgttttttgttcccctgccccctggagagagaaaggaatactcactatacacacaggggacgttctctctcttaccagctcatcaacgcgtccgaaggtggcgtcggttatacctggtcgtcgattgctctaa

SEQ ID NO: 6792 - DNA, 831 bp, A.fumigatus
tttctcggatgtatcgtcgctgcaagacaatggttctgtgtggcagtttcaggattctatcttcagtggtccgactcagagcaccacatgggatatcggcacggtggagtattattctcagctgttgggtgcggtggacgggaaatcgaatgccggctacgaggtctctatcacagattactggtatgttttttgttcccctgccccctggagagagaaaggaatactcactatacacacaggggacgttctctctcttaccagctcatcaacgcgtccgaaggtggcgtcggttatacctggtcgtcgattgctctaagcaaggatttccaagccgggacgatgcctatgcccttggtcatcgctgatggtcgagctccgggcgagatcctagtacccgcgaacactacagtcttcgagtttaacccttgggaattcggaagctgggacagatctctatccgcctttgtttccctagaattcctggggtcgaatttctccaaaggaacactagcgacaggtgaaaagtgtgttcgaggattcgataacgcagggttcatcatgggcacgtcatcatccctgttcaatcaggcatttctgcagatgaacaataccgatgcgccatccgtcgtgaaggacgccatcagtgcgattctggggaaaatcgggtccgagaacaatgatatcgccgtgtacaagccgaacccgttctatcgctatgcgagccagtccaaatacacatcatcgccctcgttgaccctggtggatggaggagaagacctccagaacatcccgtattcaccacgggggcagaaaatccgcgcaagcgta

SEQ ID NO: 6793 - DNA, 228 bp, A.fumigatus
aggaattgtgaaatttcaaaaattcaaaattgtcgaaatttaaaattaaataactttaagcttccacctttggtggacaagttcaaagtttttttcccccccaagccttttcccttggattttaaatgggtcaaaacctccgacacacttccctctttattgctttttgggccagggccttttgagggaacggaccgtcctttatgccacccacggttcaataagtaa

SEQ ID NO: 6794 - DNA, 192 bp, A.fumigatus
  unsure (149): Identity of nucleotide sequences at the above locations are unknown.
ccggccgacactctccgtatcgtttcggaacttaaggatcgcatggtcaagatctgggatcccaggaccggcaaatgcgagcgcacatttactggccattcaggaccagtgacttgcatcggccttggcgacagccgcttcgctacagncaacgaagattgcaaagtgcgcatgtacagtttccagacctga

SEQ ID NO: 6795 - DNA, 405 bp, A.fumigatus
actaaacaattttcaaatgcaggcactcaacttctctccggatacgagacagctacccgtcctcctcgccaccaccaactctcccctccctatcctcctcctcctcacctgcctcccctccctcctcctagcagcccactacatccgcaaagactaccacgccttcctcgccctcgggccaggcggcactccctcaacaccaaccggctacgctcgcatctgcatcctccgcctcttcaccgtccgcgatcccctctctcccccctccaccccgccatccctccaccccaagcacgggcagctcccctcctctttccccacccgggcagggccccgcccaaccgtcgcagggatagctcccccacagacagacgacccagcgcgccagcaaaacaatgtacgtga

SEQ ID NO: 6796 - DNA, 462 bp, A.fumigatus
cttccgtccagcacagtcagaccacgcgaacctgaactaaacaattttcaaatgcaggcactcaacttctctccggatacgagacagctacccgtcctcctcgccaccaccaactctcccctccctatcctcctcctcctcacctgcctcccctccctcctcctagcagcccactacatccgcaaagactaccacgccttcctcgccctcgggccaggcggcactccctcaacaccaaccggctacgctcgcatctgcatcctccgcctcttcaccgtccgcgatcccctctctcccccctccaccccgccatccctccaccccaagcacgggcagctcccctcctctttccccacccgggcagggccccgcccaaccgtcgcagggatagctcccccacagacagacgacccagcgcgccagcaaaacaatgtacgtgacgctgtcgaaccggatccgtga

SEQ ID NO: 6797 - DNA, 273 bp, A.fumigatus
  unsure (155): Identity of nucleotide sequences at the above locations are unknown.
gttatgttagttaatggtttaaaaggttcgagacatttcgagaataagtacattcagttcaccggtgtgagaaattcggtggtcaagacaagatccctcttgtgtggagaacagtacttccagaacacccagggtatcatattcgtcgtcgatancaacgatcgcgaccgtattgtcgagacccgggaagatttgcagcgcatgttgaacgaagacgaactccgtgacgctttactccttgttttcgccaacaagcaagatctgcctgtatga

SEQ ID NO: 6798 - DNA, 228 bp, A.fumigatus
tggttgggggaccagggccggcaaagacaccttgcatacaaaagggatttgcttcttggtggtatttgtatgttctctaacggctcttcattcctctatgctattagcttttatttcttctttcgtcccggcgtcgattccaacaaatactcctttgtgcctttgaaaaaccattttttcatctgttgttcatgtcctcgagagttaaggctggctcgacgtttatga

SEQ ID NO: 6799 - DNA, 516 bp, A.fumigatus
acagatggagaactcctctcaaaagtgagtattggcgtctgcgcctgtcggtgccgttgttggaatttaaccaagtgtagtcctcaatccggcccgaaaaagtctccaatcctttccaagattcctattcctactcacgagaacatttacaccgttcccaatatcctcacattttcccgtctagttgcagctcccttggtgggctacttcctcgttcatgatcatcatgcagctgcactatcgttatttgtctatgctggtctcactgatcttgtggacggttatattgcccggcggtataacctgcaaactgtcgtcggtaccattattgatccaatggcggataaactgctgatgaccattggtgttgcttgcttggctgtcaatggctctattcctggtgggtctcctcgtccatccaatgatgctgaccttgtggtctcatcgaatatcgaacaaggggatcttccctatttcctgggagtcactgattgggaacagtatggcttgccgtaa

SEQ ID NO: 6800 - DNA, 279 bp, A.fumigatus
ttgggaacagtatggcttgccgtaatcatcctcggccgcgatgttggccttgcattgtccgcaatctactatcgctggatatctctacccccgccaaagaccatggcacgatactgggatttctccctcccctctgcagaagtcaagccaacgggcatctccaaagtcaacacggctttgcagcttgtgcttgtgggctctgcgatcgcattacctgtgattccagaggcagttctcgacgcatggaatctccaagatggaatgacagcgttgcagtaa

SEQ ID NO: 6801 - DNA, 222 bp, A.fumigatus
gtaaaggggccacttattctgacccggttaaaaggtattaaacttggtttgcagttccggtcaaaggttctaattgcggccttcacccgatcggtgcgagatcctttcgtccatgcccgaaatgcaggtttgcttgcgctggctgcaacaatcgagtttttcaacgaggaggattgcgcaggaaagattcttccccgctatttgtccctctttgctagataa

SEQ ID NO: 6802 - DNA, 795 bp, A.fumigatus
ttgttggccctaaccgaatatcctatgctggtgagagaccaagcgaacaaaactctagacttgtatctacagcgcattcgcaatttcagcagctcaatggccgatacggcaataacagccactgctagcgcagaaacacctaaggatgctgcacgaatcggaacatcaaatgataagtcctgggctgggtgggcaatctcctcgtttaccaacaaacttgcgacagcgaacggtgagatacagccaagtacgggaactagtaaactggccgagacggaggcaactcgctcagtatctgtacctcgccccacacaatcatcacaccccacgcagctggatctacctaagaaagaattacgtgccgaagctcaacctcttggacgatctctatccgatcagccagtttcaacctccataacggcgaatggaacggacgatgtctacgaagcttggggtgctgttgatgacgatgaggaggagaatggattgaaagacgacgacccgttcagtgctccagttgtcaccagctccccagtgccaaagtccgccactgttccattcgacgatggaggtgagcctgattttgcggggtggttagccgcacaatccaaggccaaagcgaagaaacccttgcccaagggtttgagcaagcccgccgcaaccacaaccggtactcgaaactccggccataccaacctttctaaaccaaagacggtggtggctcccaccaaaaaaattgatacgaagcctaaggatgagggcgaagatgatggttggggtgacgcctgggattaa

SEQ ID NO: 6803 - DNA, 246 bp, A.fumigatus
acagctgcttctgggggctgtacattcaccaacaccatcgtcgatatctttgtcatccttttgttagtatgcagaagaggaaacctctcgctcatcttccaaccccggacttggactcttcccactgcatggctcggcatttccctgggccttctaatgtcccatgagggattctggtgggagtttgcgtatgctgcgggcgggatgagtaactgtccttgcagcgtacttcccgtgtctggttga

SEQ ID NO: 6804 - DNA, 186 bp, A.fumigatus
caactagcccgacagcttaagtaccctcaacccaatcaggatcgacttatccaacgaatagcacccaactatctatacatctcttcccgcgcagaggaacacgatgctgtttgttcaacagcccagccaccgacagtcaatacttcacaaggaaatcaacatggctgggcctgccacatcccttaa

SEQ ID NO: 6805 - DNA, 261 bp, A.fumigatus
  unsure (226),(242),(251): Identity of nucleotide sequences at the above locations are unknown.
tcatgtttaccgattatgtcgacacgatcacgatcacgatcttcctcctatgctgtgcatgactttatgcattacgatttgaataccaatatactacgccatgtctttatgaatcacgccgtcttgctcgataacaatgagagtccccatgtggacgactatcaggcttgtcacgcctttcgctcgaacactctctatttttggaaattgatgggctatggccaanccaagaaacgaacaanccacctttntataccctga

SEQ ID NO: 6806 - DNA, 387 bp, A.fumigatus
tttagtcctgaagaattcctggcaacgtctgtcctgcgcaaccccaaggcgcaggagaagctcaaattatggctgtccgccgctcggagcgcctacgtcctgaacttcaagtttgcacgtcgtccgaagatctggatgctgtctggactatatcttcttgaagacgcgtgtacaatggtctctcgccatagctctagtaagatatccgccggggtctcgggctccctcgtcggtgcgctctcaagcgtacctgtgggcggctttttgaatctcggcgagggcaattcctgggaaatgactatggaactgaccgagcagcatgtttgggccgctcagtaccgtttactagatgctcgatttatcaaggtggacaagagggcgccgtat

SEQ ID NO: 6807 - DNA, 471 bp, A.fumigatus
ggcgcttacgctcgggtcactggtcctggaaagatactgggaaccactggttgcaagacattatacccacgaattactgaggtatgtgccccctactctctggtccagtcgtcatttaacttcctcgatagccaggaagcactccaggagcatgcctatgtcagcaatgtgtccaacgtgatcttccacggacgctctcgcctgacaccgggcatcagcctcagcggtggggacatcatcgatctcaccctggcttggaataaggactccgaacgcatcgtggtagcaaaaaagggagtgcgaataatcctgaaggagtacgttttctggcccatccatggcatccattatgcatcctcctcacatgatttagtcctgaagaattcctggcaacgtctgtcctgcgcaaccccaaggcgcaggagaagctcaaattatggctgtccgccgctcggagcgcctacgtcctga

SEQ ID NO: 6808 - DNA, 225 bp, A.fumigatus
cgagccacccgcggatccttccagccccgtggtgaagacagctgcgatccgcaactcgccagcctgttcagcgctttcacggcatttaatcaagccggcagcatgttgcgcgattatagcatccgtatctgcgtctgtaccatggaacaagcggccaggaaacaaagggtccagctcagcattcagctttctcgccagcatggggaaccacatgaccacgcatag

SEQ ID NO: 6809 - DNA, 2106 bp, A.fumigatus
tgggggttctctcatgcaggttgtctcatagttaaagtggtggatcacaagtcagtgtcggcccaagccagaaagtcgactgcgccatcaaccaatgggaacaacactcctttctctatacacaactacaatgaacacatcactccgtcggcttacgtgccatatccggagcaaaaccaattaacctccgaggccactgttactaagacagatgcagcaaccggtagccaatcagacgagaatggcaaagtagagcaaacaggcgattcggacagttctaacaaggagaatgagtctgatgcattacaaaagcagaccccggcgaagccacgcgtgttcacgaccgttcttcaccctactcctcgctcattacaggcggaacttacgttgcttgctaccacgcctgatcctcgtgctgcgaaacagtccgccacacactcgagcacccgcccgcagcccacctcatcctctacagccccacagtctccagtggtggcttcaaatccaccggaccgaggccatgttgcaaagcgacagaagatgctagtggaaccgcaggatctattggaatgtgaatctaaactaacgcgagcattggcaccgccccttttcttggatccagtgaacagtttggaagcagcgcaagatctactaaaatatttggaaagtccccttcattgcgctccacccccgtctccgaagagaagaaagcgtaccgtggcagagctcgctgccgatgaagccctcgcggcggaggaggagcgatttatgctcatcatggacgaaagattggagccggccacgtcaggcgctgctggtggacccaaatccgctgttgatgacaccggtggtggtgcgccattcgaaccgcgcttctcaaggttcaagacactggagaatatccgtatgcagcatgaggagaaggccaaacgggaacacgagatcaaagttaagcaagagatggccaagcgacagcaacaggaacaagaaagagagaggcgtcggctgttggagcagcgtcaagcagaggagcatgccaaggaggaagctcgaaggcaacatctggccgcgcaacaggcccaggcacagcttgctgcacagcagcagaatcgacatgtcatgacacaggcaaacggggtcagccaggctccccaatcgtcaccagtggttcgaaatcagacacccctcaacgcctcgtcaccgctggttggcaatacgatggtcacacaagccggtgttcccatgagcatgacatcttctgcgcagggtgcaggaagcccacagcgacccccgtcggccttacagcacggccatccgaatatgatgagccatccaatggcgccctcgaggagccagcagggtcagagtcggcacggcactcctcagatgactcagggaacaccggccatgtctcatgcaactccgatcatgcgcaacgttacacctactcagcgcctgagccatggcagcccaagccagtcgaccatggctccaacaccggtaatgagcccaggccatgatgaacaccccgcagatgggaggcggtatgggtcttacgccgcaacaacagcaaatgatactgcaaaggcagcagttgctcgcgcaacacggacaactcggacccgctcagttcacaccgcagcagcttgctcaattacaagcgaacgcacatgctcagcaaaatatccagtcgcaccagcagcagatgatgcaagctcagcagcagaaccatcaggcgcagcaacagaagctggggaatcagcaaacgtatcaagcttcactgctgcgaaaccagtggacccagatgcagatggctcagcagcagcagcagacgcaaggccaacagccacaggctcaacaatcccaggtccatcagggcagcccgcaaatgactcctcaacaacagcagcagatgatgatggcggcagctgctcaggccaatgctggacacatgccgcagaatttccagggcgtcaatatggcgcagcggtacagccaactctaccaacagcgccttttgcgtctccggcaggagatgtctactcggtttatggctcaatatgggcccccaacgcaatatccgcctcatattgcacagcagtatag

SEQ ID NO: 6810 - DNA, 762 bp, A.fumigatus
gcccaggccatgatgaacaccccgcagatgggaggcggtatgggtcttacgccgcaacaacagcaaatgatactgcaaaggcagcagttgctcgcgcaacacggacaactcggacccgctcagttcacaccgcagcagcttgctcaattacaagcgaacgcacatgctcagcaaaatatccagtcgcaccagcagcagatgatgcaagctcagcagcagaaccatcaggcgcagcaacagaagctggggaatcagcaaacgtatcaagcttcactgctgcgaaaccagtggacccagatgcagatggctcagcagcagcagcagacgcaaggccaacagccacaggctcaacaatcccaggtccatcagggcagcccgcaaatgactcctcaacaacagcagcagatgatgatggcggcagctgctcaggccaatgctggacacatgccgcagaatttccagggcgtcaatatggcgcagcggtacagccaactctaccaacagcgccttttgcgtctccggcaggagatgtctactcggtttatggctcaatatgggcccccaacgcaatatccgcctcatattgcacagcagtatagcattggactcgagcggagcgccaaagcctgggtgcaagaaattatacggcgcgaacgtgaagcggctcagcagcaacgtgcctcgcaagtggcggctgttcaggcgcaagtcatgcagcagcaacaacagcagaatatgatgcacaatgccatggggaagtag

SEQ ID NO: 6811 - DNA, 567 bp, A.fumigatus
gcaagagatggccaagcgacagcaacaggaacaagaaagagagaggcgtcggctgttggagcagcgtcaagcagaggagcatgccaaggaggaagctcgaaggcaacatctggccgcgcaacaggcccaggcacagcttgctgcacagcagcagaatcgacatgtcatgacacaggcaaacggggtcagccaggctccccaatcgtcaccagtggttcgaaatcagacacccctcaacgcctcgtcaccgctggttggcaatacgatggtcacacaagccggtgttcccatgagcatgacatcttctgcgcagggtgcaggaagcccacagcgacccccgtcggccttacagcacggccatccgaatatgatgagccatccaatggcgccctcgaggagccagcagggtcagagtcggcacggcactcctcagatgactcagggaacaccggccatgtctcatgcaactccgatcatgcgcaacgttacacctactcagcgcctgagccatggcagcccaagccagtcgaccatggctccaacaccggtaatgagcccaggccatga

SEQ ID NO: 6812 - DNA, 948 bp, A.fumigatus
gacgccaagccgttggcagagccactttggaagcaattaacgcatacgggggcgtattgggtttttgtcagccctaagtttgcaaaagtggccaacaaacgacagttcccagcgttgacatacgtctggaacggagtcaagtacgcctcctatgcgcagataatctcatcgagcctccagatgttggcccacgcagctacaggcgcctaccagcagatcaacggcaccaaggccatgggcgccgtcgacacactcaacccggccattgcgcacactctgctcaaccccatcgccgcatcgtcgatcgacatcaagccgacgaaccaaggcgtccggttctactacaacaccgtgtcgatggtgatgccgatcctgcagcagttcttcttcataatggctttgaacggcctcaccgccgagtttggggtggtcctccgaacaatgtctcttcgcggcagtatcgtcctccgcctcaccctctccgtcttgtatactttcatcgcggccctctgcatgacgggctacatctgggggttccgcgaagcttgggctgtcacgggcggccagttcgccctgacgtggatggcgatctggctggtcatgcacctgaacttcttactgatcgacgctgtgaccagcgtgcttccgatgaagttcatgccgttcgccatcctcacctggatcatcataaatgtctccagcaccatcgggccgtttgatctttcgccaggcttctaccggctcggatacgccctgcctgcgtatgagctctatcaactgctcttggatatctggacggagggttgtaacccgcctctataccgggagctgccgatcctgttcgcgtggtgggtggttggatttgttgcattcttggctggaatgcggaagcgcgttctcgcagcgagggcaggttacgtcgaaacccgtaggacagacaaggcctga

SEQ ID NO: 6813 - DNA, 717 bp, A.fumigatus
atgtcaaggcgaccgctttggatgatgatggctgctagagatgcgcctgctagacgtgctgctcggcgcacaatggacgaggccagcagtcgtatagcctggacatcgacttggctaacattttctacagacaatgtgtcctggatgaacctgctggagccgtcaacgtcgttggcatcgactaatgcaagccccgacagaaagggacagtcgatgccgcctggctggaacaccttggagatctcttcagccttcatgtcgaacacatctattcgcagcagttggacaatcgccagccgaagaagctccccgaggtacaagcccgacaccctcttttcaaacatctgcgagcccggatcgaccgacgctgcgtcgagggcatcgtcgaatggtgttcgcggtaagacttccatcttgttgtccagacagccccattccgtattcatcaccatgatctcatcctcgcgtgccttgacacccagtcgacgcacgtcagccagcttctcaacatatgcggcgttggtccccgttccgacgatgaccgcgccgagtgttgaaacctgctggcccgagctatacgctcgcgtcaagagcgtaccaacactatcgtttgccagaacggtcaccacaaccggcagccccagctcatcgatggcctcttgcaacataacgcacgggtctcggccaacggcgtcggggatatcccagcctttgtcc

SEQ ID NO: 6814 - DNA, 261 bp, A.fumigatus
tccacacagatgcccgcgcaactctatctgatcgacgtatttggttcccaggctgctgcctctgcgcttggcgccaataatctcttgcgttacattttcagtacctttctgccgctggcggggccaagcatgtacgaggctttgaactacggctggggaaataccctgctcggattccttgctcttgcgtttgtccccggacctcttctcttctacagatatggcgaacatcttcgtgctagaacatctgtcacactttga

SEQ ID NO: 6815 - DNA, 1080 bp, A.fumigatus
gacaaaggctgggatatccccgacgccgttggccgagacccgtgcgttatgttgcaagaggccatcgatgagctggggctgccggttgtggtgaccgttctggcaaacgatagtgttggtacgctcttgacgcgagcgtatagctcgggccagcaggtttcaacactcggcgcggtcatcgtcggaacggggaccaacgccgcatatgttgagaagctggctgacgtgcgtcgactgggtgtcaaggcacgcgaggatgagatcatggtgatgaatacggaatggggctgtctggacaacaagatggaagtcttaccgcgaacaccattcgacgatgccctcgacgcagcgtcggtcgatccgggctcgcagatgtttgaaaagagggtgtcgggcttgtacctcggggagcttcttcggctggcgattgtccaactgctgcgaatagatgtgttcgacatgaaggctgaagagatctccaaggtgttccagccaggcggcatcgactgtccctttctgtcggggcttgcattagtcgatgccaacgacgttgacggctccagcaggttcatccaggacacattgtctgtagaaaatgttagccaagtcgatgtccaggctatacgactgctggcctcgtccattgtgcgccgagcagcacgtctagcaggcgcatctctagcagccatcatcatccaaagcggtcgccttgacattcaataccaacactcaaaacagacagcctcactccccatcggcaggaccaaccgcttcgagcacactgtgactccccgctggcgccgattgctgagccgccttagattgagctcgctacctagtagacatctaccacggcacacacacctcccgacctgtttggacgaggacatcatcgacatcggagccgacggctcactgatcgaattctacccggacttcgaggccgagatgcgtggtgcaatgcgggatgtacccgagattggagaggctggcgagcagaggatccgcatagggctcgcaaaggatgggtctggcgttggagcggccttgatggctcaggctgcatgtcagagtgagtag

SEQ ID NO: 6816 - DNA, 633 bp, A.fumigatus
gtcggaggagcggacggcttcgtcggtattgctcttgcccaggcatatgccaacctcactgtgtttgtacaagatagcatcaatctcaagaaagaggcggacgcgaagattcccccagctttgaagtcgagggtgtttttccaaccacactcgttcttcgaaccgcaatctcgcctcgccgggatggctgatgtcttgctactccggcatattcttcatgactgggatgataatgactgtctggtaattttgcgccatcttgctgccgtcttgcaacccggggcttccatcatcgtggcagagcaggtgctgggccaatcgggaacctatgactggcagacggaacgggtcatgcgggcgctagatatgcaggtgatgacgccgtttggaagcaaagagcgaacattcgatgactgggagacgctatttccaggcggcagatccgacattgcaagtggtaggaatggttcagcctgcgggaagtgcggacacactgatggagttgaagaaagttgcttgattcgctttatcttaaggatctgcttggtaactagcatgttgttcattccatttcgacgaaaaacagtttcgctggagaatagtgacttattgtctatcccgaccagtaactga

SEQ ID NO: 6817 - DNA, 348 bp, A.fumigatus
  unsure (328): Identity of nucleotide sequences at the above locations are unknown.
tccgtccattccatccacttcacaatgaagcctcagactgctgctttcctgctcagccttctcggctctaccctggctgcccccatccagcacgccgacaaagggtccgatgtaaagcccactcctaccggacggggcgctcctggcggattcttcactggcttcccctctggtgtcccctctggcctgccatccggtttccctggtggtccagtacctggaggatttggtggcgatggcccgaacggccccattccatccggccctgttcccactggcgctgccccatccggcttcctttcgttcgggaccggtcctgctccgtttnctacaaggcggccgaaataa

SEQ ID NO: 6818 - DNA, 690 bp, A.fumigatus
  unsure (311): Identity of nucleotide sequences at the above locations are unknown.
tcaacgagggaggccggttttacaaagccgcaagagtccgacaccgcagcgtatgcgaaatatgacaacgatcttttccaaaccggccggcttgtgacatgcggcctctacgtcaacatcattctgaaggattatgttcgcaccattttgaatattaacagaacagacagcatctggagcctggacccccgttctgaaatgaaggatggattacttggcagggcagctgctcaagcgacgggcaatcaagttgctgctgagtttaatctcgtgtaccgctggcattcttgtatctcccagcgagatcaganatggactgaagatatgtaccaagaattgttccctgggcaggatcccagcaaaatctccctgcaggacttcttgcgaggacttggtcggtgggaggctaagctgccaggagagcctcgggagcgtccgtttgctggactgcagcgcaaggcagatggatcgtacgacgacaatgacttagtcaaaattttcgaggaaagcgttgaagactgcgcgggtgctttcggtgctttgcatgttcccacagtcttcaggagcatcgaggcgcttgggattcagcaagcccgctcctggaacctggctaccctaaacgaattcaggaaatacctcaatttcgctccctatcatcagcccaggggtcgaaggaccgcgcatgcgcta

SEQ ID NO: 6819 - DNA, 717 bp, A.fumigatus
  unsure (173),(338),(362): Identity of nucleotide sequences at the above locations are unknown.
atcctggccggccaaggactgtccccatgtttgcctcgactgtacgcgtcttcgttctccgtttccagccgtctggctttgactaatttgattgcagccatccccgaccactgggcgaacctctactcgtgccccaattcctcgacgaatgtgttcacatgcgggtatgcggngtgggcgacggacgtctgcagcgcgaatctggggcagtggctgtgggtgagtggggatgtggaggttgcgaagaacggaaacacgagcccgtccgcctctgcttctgcttcgacagtgctggacattgtcacgaccacgtcgtcgggttctggattgtctacggngacgccgagggggacgattacggnggagatcgtcacgacgaccgagtccgcgactgctacgggctcggggacagggacggagaccagtagtccacggccggtaaatacttctatctctgcaaggacacttcgggcggggactagggggttggaacctggagttccgctactcgtggtatcggggttactgatcttttttatgcgaatgagaaggcgagcgccggcagcgccagcaccgccagtcagtgaaaaggtctaccccggcgctgtctacgatccaggcgcagcggagattgccacgcagagacacaatatggttacggagctggaggggtcggggcgcaatctaccggatcgaccggagttatatggtagttag

SEQ ID NO: 6820 - DNA, 363 bp, A.fumigatus
ataaatgtctttaaggagttccctcgacacatttcccatcctcgcacctcgaacgctgtctcaagcagcacaatgtctctctcagcaatatgtctcatgctcctcgtcaccctcacgccagtcacagcaacatgctactggcccaacggcgacacagacaacaactacaccccgtgccccaatagcaaatcctgctgtctcaagggcgaagcctgcctctccaacggcctctgctacggcgcaaaactcaacatcgcctatcgcggtgcctgttccgataaatcctggccggccaaggactgtccccatgtttgcctcgactgtacgcgtcttcgttctccgtttccagccgtctggctttga

SEQ ID NO: 6821 - DNA, 909 bp, A.fumigatus
aacccattcatcatgcggcgtcacggcagggctggcggaggaaccaaggccgtcacgcccgtctccgataccgtctcgttgatacactcattcgactcggtcacaaatccaaatcgacctgcacgaccgtccccgttggcatcctcgcatatccaagcattacccctggacttgattgatcgactacgttcctttcccctgttccaatccactcccgaatcgtttctggtggaggtcgcacagcatctccgcccccaactcagtgcgccgaacgattatatcctgacagagggtgacgaggccaaggcgatatactggttggttcggggcgctgtctcagccacttctcgcgatggcgaaagtatctatgccgatttggaaccgggcgcgttctttggcgagattggggtcttgatggaccggccccgaacagccaccatcatcgctcgaacgcgatgtctcctggtcgttctgtccaaggaggacttcaggaacattcttccccgatttccagaggtggagcaagcgatacgggatgaggcccaggaacgattgatgatactggagaagaagaagaaggaaacatcaaccccttcggctgacctcactagccctgtacgcagaggctcgaagagactaagagattcgtcttctggggacctatcacctatcgaacgtgaaggcacatccttgaaggcgggcaacaaaaagcgcaagtcgccaagtcctggagtcggtgttgcagacgcttcgtcaagcgcgctggcgaacgggtcggtcaatgtccgcctattgcttaaggagttgcctctcttctctagcctaccccccgacatactccactttctagggctcaatgctcaaccacgatcgtaccctccattccccgacattatccgaccagaatcc

SEQ ID NO: 6822 - DNA, 618 bp, A.fumigatus
  unsure (231),(294): Identity of nucleotide sequences at the above locations are unknown.
tcgtgttttaggatcgccggctacaagacaacagagacatccctctccgcgcttttctaccgactgctgtcgaccccaggagtgctcaagaagctccagagcgaacttttccgcaactttccgagcattgacgagatcacggggaagaagctgctctcgctgccctatctgaacgggtgtgtcaacgagtcgctccgtctcacgcccccagtggcgggcaagttcgcgtcncgtcggtctccgggagcaatcatcgaaaggttctacgtcccgaaagggacaaaagtgtttacngagacgtacaccatgcagcggagtccccagtactggcacgccccggacgagtaccgtccggagcgctgggtggaacggggcgagggtagtccctatgcgcaggatgtgcacgaggccttcaagccatttagctcgggccctcgagcgtgccttggaagggaaatggccctccagactctccgattgacaacagcgctgctggtataccgcttccatatgaagatagtcgacgagaaacggtttgtgtgggagcaggatactgactccagaatgatatactctcaatatcagataaaggccattctgcaagaccgcctgacttag

SEQ ID NO: 6823 - DNA, 549 bp, A.fumigatus
tactgcgtcaacaccgggtatgcgggctgctcggtgctgagcatcatccgcaagatgcgcgagatcagccagtaccagaccccggggcactggctggacatggacatgctggagattggggacggtgagatgacgctgtaccagcagcagacccattttgcgttttgggcggcgctcaagtctccgctgattattggggccgatttgtcgaagctgtcggacgagagcgtggcagttctgaagaataaggacataattgcggtcaaccaggactcgctgggccaggcggtgcattatatcgagtctgcgagcaaagagggagcatggcaagtctgggcgggcccggtgaacggtggattcgtggttcttctgttgaatgagaagagctatccccaggctctgtcggtctcgtttgcggatctgagattgggccttgatgggcccgtccaggtcaccgaactgtggtctcacaagtcattggggaaggtggatggttataaaggcgtactgcagccctatcagacgctggtgtttagactacgcttttag

SEQ ID NO: 6824 - DNA, 267 bp, A.fumigatus
gcgacatccctagcgtctacggccccattcctcatgtcggcgacttctcccggcgtcgactcaaccaaatatctcaagagacgtcccggagactttgtccatccgggtatttggcacacacacgaggacttggagcgcatccggaccaacgtcatatccaagaaggacccttgggcctcggcctacgagaaattcagcgccgacgaatactcccaagccaactctcgtcttccacgcccgagggctggaaggtaccgcgctcgcaaa

SEQ ID NO: 6825 - DNA, 327 bp, A.fumigatus
  unsure (120): Identity of nucleotide sequences at the above locations are unknown.
gatcgctacagccccgagctacagcaaagaatccgtgatctcgccaaataccccatgaacaaacatgaggtatgtgaggtctggactgagatcctcaaattccacttccccatctcccanattggcaagcccggcaacaacgagtatgccacccaggccacacccggcaacgtcttccccttcgttcaactgtccgtccgcccacagctaagtacgtttgaaaaccacccggttccctgtttccccactgcagaaacctctcccgagaccaggcacaaggaccgcccttcccccccggtggcgaaggatcgtctgaatattgccgcc

SEQ ID NO: 6826 - DNA, 255 bp, A.fumigatus
acgaggcagaacatgattctggccctccattcttctcactttgatggctgcagtccagtgtttctctgccgagaacagccttcacttggccagctgggacaatggctctctttttatgcctatttacggacacctggcagtggttatgctaagaccctcagagagtatcatgggtggcttgcaactccgccgtgtcaatctagtcatggcgcggtctatgacgagactgtttactcttataagggctcgcgctga

SEQ ID NO: 6827 - DNA, 249 bp, A.fumigatus
ccgctctgcgcggattttcgcctctgtggtgaagactgcaacccgatcggcaatacaggggcaagagcacttgccaaatggctgcaacagaatcagacgctgcaacgtctttctttgcaatcggttggcctcacggacgacggggccactgcattgatatcgtcgctgcgaggtcatcctgcattggagactctcgatatcagtcagtcctattccacgcaggacttgaacgccaggtatgtcttttga

SEQ ID NO: 6828 - DNA, 228 bp, A.fumigatus
atagcgactccatttcaacaactcttaccaacattctaccaacaggacgtcgcttatcattatggagccaacaagccctcaacctgtatttcccatgagcccgttgatatccaatacccgtgccggttacgctgtttgtttgggcacccagcaacgaatgcacgaatgcaaggtgacatgtccatgcagtcctcgcagctttcatccgaccaaatcaatagctcatga

SEQ ID NO: 6829 - DNA, 747 bp, A.fumigatus
agttgctgtgcaagctcgaggtgttgggtacctgggatggggagcgccacagtccatgatgctgccattagctactttctgggtctctgctcggcttatgtctacaacatgcggcgatgtcggatgtaccttgccgagtgccgtacgatgttgcatgtgtacgatctttgccgccagtcgacgatgcagtcatcctatgggccaacaagcccgatatcttcgtcgtcggccacatcacaggatcgactcagtggacccactgagcgcccagtggacatgatcgagcaggagctcgcgcggcgactgttctatgtaacgctagtcggttaccgatcaatacagcagctaggctccgctgacaccccaatctatcttgctccagagacgccgacggagcgctacccaccattaccccttgaagtggacgacgagtttattttcagtacacatgtcgaacctcagccgaccaaccgggtttcgcaactggtgggtttcaacgccaacgtccgggtctataactcgtacaacgccctatccgcttgggaggttgcgtttggcagtgggcgaattgttgattggcagcggcaacggtctctattattcgaatgtttgcagaattccaaaacggctttggccaacgtgccaccagagctctcactccaccctcaccgggacgattctgcagatgcggcggaggacccctggatgcgcgaacgtcgccatatccaatacgagattcagaaagcc

SEQ ID NO: 6830 - DNA, 864 bp, A.fumigatus
tcagatctatataggtctgatctgatctcaattagaaccgccaggctaattcatcggctaaagtgtgatacaagtggaccaccctgtcggtcatgtgcaagcctggacatcccttgtacctatgacagaccaagcagacgtcgtggccccccaaatcgccatgcagaggcgctgaagagactgagactaggaacttcacctagtgctcctactgcaaactctcccagtccgtcagatttctctcccccaacgcttccaccaatatccacggttaaccagaatctcacatccgcttcaaatccatcttcggtagagtccatctgcccttttcccacagcgcggctgttggtggatgatttcttcacgtatattcacccactggtccccatccctcatgagccctcgttccgcgtcgcctttgagcgacgggaggacaccaccaatccgacattcctggctcttctggccgcaatgatcgggaccctggtggcatccttcccgaggagaccaaagcttcatcttaagaccgaggcagaaaaagctgcctttccccactctcttgccttggtcaagcgctgccatgaagttgctgtgcaagctcgaggtgttgggtacctgggatggggagcgccacagtccatgatgctgccattagctactttctgggtctctgctcggcttatgtctacaacatgcggcgatgtcggatgtaccttgccgagtgccgtacgatgttgcatgtgtacgatctttgccgccagtcgacgatgcagtcatcctatgggccaacaagcccgatatcttcgtcgtcggccacatcacaggatcgactcagtggacccactgagcgcccagtggacatga

SEQ ID NO: 6831 - DNA, 1425 bp, A.fumigatus
atggtctttttccccttaattcgtcaaaaagaagccatgcgagataaaaggcgctgcagggtgctgacgattctcgtaccaagcagaccgcaactgtgccgttctgaatctcaacaatcaattgctgcgtcggatgattactactccctgtcggatcgtacgacaacgtcaagttctagatctccaagcggggagagtcgtctcaccgtccagcggtatgctacgccgaattcccaccctgtctccagcacatcatctcccgcgttatcgcgaacgcatctaggcgccaatatggctggttctcgatcacaacattccatcccggagcagtcccgaaatagaaacgttcctccctccggccccaatcaagctcggttcgagcatggcagactgatccccgtcagtggcatgtccaacgagtccattcgacaggtaccaaacgacaggtatgccgaccgctcaccgactcccgggacggacgacttgccatacattcgatttgccattaatcaactcacgcgggaagacgagcagccgagcttatcgaggcagtcctcggccgcaagtgtcgattatccaccacagcctctcgtatgggatgcagctctgggccaatttacccgtccctcgaaacctaaaggaagttcattacggcctccagaggagcgattacaccatgactgtctgccagacaggtcgccacagaactcggtagatccggaggcattcgttgcggttgaccctccggaaaataacctgctatatcccccattgaattttgtgcctattgttctacgaccatgggcactggctctgaccattctttcttgcctgctcatgattgccgcggttgtcttctgcaatgtctggtcccagcgacaccaagggatctgggattacaatggactgggaggctcacggtatttcgtggttcaatttttaccacagattctggccgctatcatcaccatctggacatttgtaatccaggcggctgtataccgcgtcatcccatttgctatcatggcaacgcaaacgctccaggatcaagtgatacagaagctgccaattctgtctcgaaacttcttgctacctgactggtcgtattttaggcatggagagcccttagttgggtttgctctgcttacgatttggatctcgaacctcattatgatcccacttctcagctgtttcttccaagcaaagtggcacctgatccatggcgaagggcagtggcgatggaatgctgtcctagctgtcgggtggacaatcgtggccgtttacgcgttacttgctcttggactgatgacgcttctcattcgcttcatgcggacacggtctgggctgatgtgggatcctgtcagtctggctgacctgattcctgtcatacagcgagtcttcacaacggggaggaagtatgcgtcg

SEQ ID NO: 6832 - DNA, 231 bp, A.fumigatus
ccattttctgtccttcgcccctgcggtgaagacatcccatatgtcgctatgcgcttgcttccagccgtattgggtgtccttactgttcctttgatgtttctgaccctgaaggcgagtggttgccgaactataactgctgtccttggggccggagtcgtaatctttggtaagactgatactgatatatttgaccaacccatggtcgctgaccatctgcagaaaatggtctaa

SEQ ID NO: 6833 - DNA, 855 bp, A.fumigatus
ttgctccagcgcttatggttcaaacatttctttgcccgggttttctgtctcatcatcgttccccttggcatttactgtggaatgttcgcaattcatttcctatgcttggtcaacccgggagacggagatggattcatgtcctcggaatttcaggccacattaaactccaagggaatgcaagatgttcctgcagatgttgttttcggttcacgtgtgagcattcgtcacctaaacactcagggtggctaccttcactcccatgcccatatgtatcccacaggaagcaaacaacagcagatcactctctatcctcacaaagacgagaacaatgtcttcattcttgagaaccagacccagccccttggtccctttggacaagtggaaggcccttacgcttgggacaatatcactaccgagtacatccaagatggtgcggtggtaagactctaccatgcgatgacacataggagacttcactcgcacgacgagcgacctcctgtgacagacgtcgattggcaatttgaagtgtctgcgtatggctatgagggattcccgggagacgcaaacgatctcttccgtgttgagattgtcaagtcgaagtccgacggcgaggaagcgaagaaaaggctgagaaccatcgaatctaaattccggcttgtccatgtcatgactggctgtgttctattctctcacaaggtgaagcttcctgagtggggtttcgatcagcaggaagtgacttgcgccagaggaggcaccctgccgaacagtctttggtacatcgagtcaaaccaccatccgatgttacccgaggatgcagaaaaggtcaattaccgaaaccctggattctttgggtag

SEQ ID NO: 6834 - DNA, 687 bp, A.fumigatus
ccatctgcagaaaatggtctaatcactcaatcccgtctaatcctattggactcgccgttggtcttcttcacagcactcacggcactggcgtttactagttttacaaaccagcaagagcttggaccttctcatgccttccgtggaccctggtggttctggttggcagcaacgggtctatccttgggcgccacattgagcgttaaatgggtcgggcttttcacagtcgcgtgggtcggttctctcactgtcctgcaactgtgggtgctttggggcgacgcccaaaacgtcacaccggtatgtcttcggtatcgcttagatcttcctcactctacgtcaaagctaattgctccagcgcttatggttcaaacatttctttgcccgggttttctgtctcatcatcgttccccttggcatttactgtggaatgttcgcaattcatttcctatgcttggtcaacccgggagacggagatggattcatgtcctcggaatttcaggccacattaaactccaagggaatgcaagatgttcctgcagatgttgttttcggttcacgtgtgagcattcgtcacctaaacactcagggtggctaccttcactcccatgcccatatgtatcccacaggaagcaaacaacagcagatcactctctatcctcacaaagacgagaacaatgtcttcattcttga

SEQ ID NO: 6835 - DNA, 513 bp, A.fumigatus
  unsure (501): Identity of nucleotide sequences at the above locations are unknown.
gctgtctcgattcttcatcgttccgcctgtcttccaagttccatccaggttgcgagctgcgactgtggttgtggtcactcttgcgctatcacgtcacttcattcaatcatgaccttcttgatcgggactcccctgaactgggccattacggctacagcgggctcgggcttccttctgttcggctatgaccaaggggtgatgtccggacttctaaccggccacgcttttacccgcgtattccctgagatcgataccacaaagcacggctctgggagcgcgtcccttcagggaaccgtggtagccatctacgaaatcggttgcttctttggtgccattatttgcatgatccttggagaacgacttggccgccgaaagtgtatcgcgatcgggtcaattgtgctgagcatcggagcggctctccaagccagcgcgtacagcatccctcagatgatcactggtcggattatcgccggcctgggaaacgggatgaacacgagcacnattcgtgagtga

SEQ ID NO: 6836 - DNA, 291 bp, A.fumigatus
gtgaagactacgggtcaataccttatcaccgggtgtaagtccaactcatccctgcttctaccttcatttccgcgactgacacgataccagtacataatgaccgacatgacaaaccagcttctccaggctgagcctgaggtggaaaagacgtggatggctggggcgctcctcggcagactctcgacaccggttgagttcaaggccccggcagttttcttactgtcagaaggcagttctttcatgacgggagctgacttgagggttgatggcggccattgtgcctctgcatga

SEQ ID NO: 6837 - DNA, 570 bp, A.fumigatus
aggttgacactttcgcagaacagcagcagcaaggtcaaagaaatcaccacctccccatcccaaggcaaccttggtctcaactcactacctttctcatcactacctcactggtgcgctttgcacagtagcctacatcgaacagactggtcgatctcaaaacaatacaagccttgcaggcacccgatatacacctcgcagatctcgtcgagagcatttgaacgtgtctggcaattgcaagtgtccataatgccgtccaaaggctgtcactccaactctcttcccgaagcacgaggcctcaagtacgacgagtcggatatggcactgttccacgccaaattgtcctaccactccaccatcgaggagcgcatggcttcgaaagataccaacctggcatccatatctgagcatcaggcccggattctcaagcgctgggagatgctcaaacaggtggagaaggagatggcggacaaagggaaatgtttgtcaccggcggagaagaagcagttggcacaatatgaatggcgatacaagcgacttgaggaactggcgaccaagacgacaggaggctga

SEQ ID NO: 6838 - DNA, 249 bp, A.fumigatus
catatgccacaaactttcaacagttgccagggcctgacactagaccatgtcatgctcgaccttaccatgccagtatttgcacatggccagctctacactagcctgtctcgtgtccggcgtggagctgacatctgcatcctccggaacccttgcgagaacgacaagccaacgctctcactatcgcgacctactccttcccatatgagtcgtccttctactgagtcaaggagattgccgtacatcacatga

SEQ ID NO: 6839 - DNA, 1035 bp, A.fumigatus
  unsure (147): Identity of nucleotide sequences at the above locations are unknown.
caggtccgaaatcacatccacctttttggcggtgatggtcccaacgtaacaattgccggagagtcggctggggcgtggtcagtcctcgctcatctgcgatcagaccagccactttttcagcgcgccatcatacaatcggccccatcntggaccatgattctgcccgaagaggcccagttgaagttcaataagctcctgcagtgggccggagtccctcagggtgcaactgccgatgagaagatcgccgctttacggtcggtttcagccgagcagttaatcgcatggaacgatctgttaatgtctccaatttgggaccctaaatggttcgttggccatggctcgcccacgtcaccactggacagcgcagagccctttcccaactgggtacagggaatagtcgttggaaccatgcgagatgagttgtccatctttgggctcgaaaggttttggcaaacgaaagcaatggttaagagcagcctgaatcattctctatcgctccctagcgatcctgacttcagcactgaggttctgaacgaatacggcatcctggaagctggttccgacacggaagcagtgcgtggatttatcagggtcgccacagatgcttgcttttcccgcttgccttacaatctcgccagggcctgtgatagccctgactcaccatacctgtatgtctaccgctttgatcaggttgacgaagaacgcaacagtcccctccgaggaaaagcctttcatgtgctcgacaacacgtacctgtgtcgctatctcgcggtagctggtcctgcagcaccacggtcctgtcaagccactgccgacgccttctcccggatgatattgtgccatacatacggcgaggctccatgggagccatacaatatcaggaggcttcagaatgtgtttgatggaacggacacgagacttgaggaagtgcgccttgatgaccagtgctggaggaagttcctgaccacagaggagagagtgagcatattcgggaggttgtttgctgcgctcatgaataatggaccgaagcactga

SEQ ID NO: 6840 - DNA, 204 bp, A.fumigatus
ctctttggagaactacttcctgccggctgcgtgttaatgactttctccgggggcattgcgctgggttacaacgatacgtggccggctccgggcgaggagtacttcatcgcggtttgtcggtcgacttcggcaacgggaggattcgtaagtcgcaagcaccctaccttgatttgtcttttgatatcagaggctgatcgtgagtag

SEQ ID NO: 6841 - DNA, 309 bp, A.fumigatus
ttgtcaacatctcgcgttccaaaccccgctcttcaactcatcaatcttctactaaactactctcaccttcggacacaatggtcctcaagctccacggatcgccctggtcgacgtgcacggcccgcgtgcgcctcgccgctcattgagaagggcgtcgatgccgaggtagtcaacgtggacctggccaagggagaacacctggcagagtcctacctggaaatgcagccctttggcaaagtgcccgtcctgcaggacaccgagacaggcgtccaggtcttcggtgcgttcccagccagacatcgtacatag

SEQ ID NO: 6842 - DNA, 210 bp, A.fumigatus
ttttgtctacggtcccggcggacagtaagtcgccctcgaggaaagaaaaagaatgaactaacttctgggcgcaggggcatcctccaggactcaagcaaggggtttgtcttgtactaccactatgcggacacgcgcatcggcaaggccgtcgaggactatcagtttggatggaaccagttgaagtgggagaacgactggcctagtgtttga

SEQ ID NO: 6843 - DNA, 666 bp, A.fumigatus
  unsure (666): Identity of nucleotide sequences at the above locations are unknown.
tggtcgctattacaaccccgaggttatccagaagattgccaagatcagtgctgcctacggcgtcaagaagctcctgatcggccagaatggcattctcagtacccccgccgccagcaacctgatccgtgtgcgaaaggctaccggtggtattctgctgacggccagtcacaatcctggtggtacgtggagcttttcttctgtgaaatccgagtgctaatttttcaaggacccaatgccgatttcggtatcaagtacaacttgtgcaatggtgcccccgctcccgagtccgtcaccaacaagatctacgaaacctccaagtcactcacttcctataagatcgccgaaattcccgatgtcgacacctccaccattggcaccaagacctatggtcccttggaggtcgagatcgttcactccacctccgattacctcaagatgctgaaggagatctttgactctgatctgatcaaggagtttctcagcacccacaaagacttcaaggtgctgtttgacggtatgcaccgtgtgactggtcccttatgtgtggacaatcttgtcaaagagctgggtcttgccccaagacagcaccatgaacttggttcccagcccttacttcaacggagggcacccctgaccccaacctggtctacgcccatgagctggtan

SEQ ID NO: 6844 - DNA, 357 bp, A.fumigatus
ttatcctttgattgtagctctggtcttcgcaagaaggtcaaggtcttccagcagccccactactccgaagctttcgtcaccagcatcctgctctccatccctgagggtgctgagggagctttccttgtcatcggtggtgatggtcgctattacaaccccgaggttatccagaagattgccaagatcagtgctgcctacggcgtcaagaagctcctgatcggccagaatggcattctcagtacccccgccgccagcaacctgatccgtgtgcgaaaggctaccggtggtattctgctgacggccagtcacaatcctggtggtacgtggagcttttcttctgtgaaatccgagtgctaa

SEQ ID NO: 6845 - DNA, 225 bp, A.fumigatus
tttttcaaggacccaatgccgatttcggtatcaagtacaacttgtgcaatggtgcccccgctcccgagtccgtcaccaacaagatctacgaaacctccaagtcactcacttcctataagatcgccgaaattcccgatgtcgacacctccaccattggcaccaagacctatggtcccttggaggtcgagatcgttcactccacctccgattacctcaagatgctga

SEQ ID NO: 6846 - DNA, 498 bp, A.fumigatus
gaagagcagggtaccttatctactgataatgagcgctcgagttcgatgcacacagcgcgcagaccagcggcgatccccttggcttgcatcttggctcaaccctctttcctgctgcgtctgtcgacaggatctactcagaagggtggaccacggaagtactggggagggcagtctgtatgggatattttgtcatggctatcggcactcaataaggctttatcattgcaactgtggcagaccgatgatgacattattccatttgttgcttgcggatggatcaacggctacaccgagtcaagatgtattcttgctcaggctaagtcatatgccttacgggctagtgtttcttgcagccaaagggatgtagtactagccagtcatacgcagaccagcacatctaatcaacgatacaagtgtcggaacataaccccttccaacgaccagatgagtatggtgcaatcaatatacctcaagggtgatgatgttatattactctga

SEQ ID NO: 6847 - DNA, 249 bp, A.fumigatus
ggacatcaatacgccaatcactcgacaccgaattactatgacgagtatactagtgacgcccggccatcaatgcaggttggccgggccggaagaggccccaacgttctacagaagaacaataggaagtttgccgatgcttacgagtacgaacgagacccctctcatcactccggcagctccggtgcagccaggaaagtcatggattttttccgtcgaagagccaaatccagggccggtgatgaccgttga

SEQ ID NO: 6848 - DNA, 327 bp, A.fumigatus
gctgacccacttcaaaccatcaagtccggcacatcggtcgaacacaacgtcctctacgagtaccagttcgtctcaacccagaatgtgtacatgggccagatccaaacagagaccgcgtgcgtcttccaccacttcctcaaacacaatcctctcgtgtctcgacttcagatgctgatacgagtctcgcaaacaggtactaccagagcaaccccaacgctctcatccccttcacgccgaaagccgcaatccatgatccagactttgcctccagctgcaagagctccagcgacggaaactgcgaggtcggctggggcctccgtgtggtag

SEQ ID NO: 6849 - DNA, 204 bp, A.fumigatus
atcacaggatgctccacttacggcggagaacagaattgccagaactccatcttcagcatcgagggcgattcggcgattactgtgtacaacctgaatacgcttggcacccggagcatggtagatcgggacgggcagagtctggcgagcttcagtgataatattagtgttttcacaaacaatattgtgctttttaggagccagtga

SEQ ID NO: 6850 - DNA, 390 bp, A.fumigatus
cccacttcaaaccatcaagtccggcacatcggtcgaacacaacgtcctctacgagtaccagttcgtctcaacccagaatgtgtacatgggccagatccaaacagagaccgcgtgcgtcttccaccacttcctcaaacacaatcctctcgtgtctcgacttcagatgctgatacgagtctcgcaaacaggtactaccagagcaaccccaacgctctcatccccttcacgccgaaagccgcaatccatgatccagactttgcctccagctgcaagagctccagcgacggaaactgcgaggtcggctggggcctccgtgtggtagattcgcacgacctctacgtgtacggcgccggcctctactcctttttcaacaactatgatgcaggttag

SEQ ID NO: 6851 - DNA, 201 bp, A.fumigatus
catgtaactgctctaacaatagccagaggtatagcggattcgacggttctgtccacacaagctgacttgcacaataactacagcgatcctgctattaccccttgctgtaccctcactgtgaacctaatggatgagtacatacaagtcctatctggagaagtagcagcaggaaagtgcagcaccagtaacacgtgcaggtga

SEQ ID NO: 6852 - DNA, 462 bp, A.fumigatus
aagtgtctagcagttgcttcagggatgtggctaggtaaagaaggtcctctggtgcatgttgcatgctgttgcgccaacgtcatgatgaagttcttcgatagtttgaaccataatgaaggtatgtggtcaagccggcatcagcgggtcatactaagtattatagcgagaaaacgtgaagtgctctccgcagccgcggctgcaggaatatctgtcgcgtttggtgcacccattggaggtgttttgttcagtctcgaggtatgcctctcagatttatattccatatcacctcgtctaacgaatgatagcaattgtcgtactactttccagataaaaccatgtggcagagttttgtctgtgcaatggttgctgctgtcactcttcaggcgcttaacccatttcgaacaggaaacattgtgctctacgaagttaagtatacacgtggatggcatcgcttcgaaatga

SEQ ID NO: 6853 - DNA, 723 bp, A.fumigatus
accgtgagtcttagacctcttcaacccttacatattctgactggcccgatttgtagaatttctttcaagcgcaagcaaaaacggcctgcgagattcagtttttcgcgactgttttccggtgatgaacccgaatctacaatccatttccgggcgtcggccacaacgaatgagccgacgccagaggttgattcgtctctgagccagctgagatcgcgaaatgggaacgaaaatcttaacacatcaaaaagtggagggttcttggattggtatgtggaaggtccagggcgtcgagtaggctacgacgatcttacagccatcgattggatcttcgaatatacgaaagagcgacaaagaaagaggctgctctactccaaggcgccgggtctttcgggatatgcccgcaggctactggaggccagtaacgtttgggtggttttgatagcgacaggcgttctcgttggtattattgcggcatgcatcgacatcacaagcgactggctcggagatttaaaaacgggctattgcaagaatggaccaggaggtggcaagttttatctgaatcgaagtttttgttgctggggccatgacggtaagatatccgtcctcaacaatgctcgtctgcaactgacttggcatattcatcagacatatctgagtgcttggattggacaccttggcgtaaagctcttggagtcagctcttccagcggaggctatacggtag

SEQ ID NO: 6854 - DNA, 216 bp, A.fumigatus
gtggtcttcgctgtctgtgcgagttttctggtcagaacatacgcaatatatgcaagacacagtggtattccagaaatcaagacagtccttggtggctttgtcattagacattttatgggaccgtggacgctcgcgatcaaatctctgggcttagtaggtgtcccgtgcattctctatgtcccgtttcttggatgcttattgagtaaaagtgtctag

SEQ ID NO: 6855 - DNA, 339 bp, A.fumigatus
caattgtcgtactactttccagataaaaccatgtggcagagttttgtctgtgcaatggttgctgctgtcactcttcaggcgcttaacccatttcgaacaggaaacattgtgctctacgaagttaagtatacacgtggatggcatcgcttcgaaatgatgcctttcatcctcctgggtatccttggtggcctgtacggggcatttctgatccgcttgaatatgaaagttgcgaaatggcgacgatcccgaacttggtctcgcccaatattggaagttacggtcattactcttctatctgtcctcaccacagggagacgaaggatgccggcatgcgctcaa

SEQ ID NO: 6856 - DNA, 750 bp, A.fumigatus
  unsure (628): Identity of nucleotide sequences at the above locations are unknown.
caaagtatgtcccacaacaacgatgaggattactttcttcccctggaagaccagcgcgttttcggcgccggaatccgtcgcaagcgcgtacagttcgtccgctcctcagaacatgaacttaacactacaaccacaaccaccacaaccagaaccacaaccccatccacaacctccggcttaagtcccgccgacaaatacctttcaatcgtcctaccgaaagaaaaattacacacccaaacaacagaacccgccaccacgcgcaacgaaacagtttccgcgccgccttcgcccgaagccgtacccgctccggtccaacggtgcgaggtatgcaatctcccgcttgacgggtcgaaggcaggtacagatgaggaagggtctgctcggccacacgaagcatcgctcgcccatcagctgtgtctatctcactcgcatccaccgtctcatcttgaccgttcccgtcacggactccgatatttgtccgcttatggctgggatccggacagtagactgggtctcggggctcctgggcgtgagggaatcagggaacccctcaaggggagattgaaggttgatactgtcgggctaggggctgaggttgagccgagtgcgaacgggaaaaaaaaggtanctgctgctgctgctgttccgtccaaggtgcaaaggttgaatgcgaagcaagtacgaaagggtcattttgatgccaaaaagataagggagatgtggcggggagattttctatccgaaagatga

SEQ ID NO: 6857 - DNA, 660 bp, A.fumigatus
  unsure (482): Identity of nucleotide sequences at the above locations are unknown.
ggagggacatcaggcattggcgccagcgttgcctatgagcttgcattacgcggcgcccagatcatcctcctcacccaccactccccttccgacatcttcctgatcgattacatcgaagacctgcgcaagtcaacaggcaaccaactcatcttcgccgaacaagtcgacctctcctccttacattctatccggacctttgcgaccaagtggatcgacaactatcccccccgacgtctcgacatggtcatcttgtgtgctagcgccgctctgcctgcttccagccgggggcaactgacaacagatggtctgaatgaggagtggcaggtcaattacctgggtaacttccacctgctgagcattctgagcccggctctcaaagcgcagcctgctcaccgagacgtgcgggtcattttcaccacatgctcgagctacattggcgcgaaactggacatgaagcaattagaggcagcaaccagcggttntaagccggccgggccaacagcggcgaagaagaacggaaagccgcagaagcaggcatccacggagaaggaagccagcctattcggcctgagcaaactcgatatgatgatattcgcaaactccttccagagacacttcaactcgtgttcaccacagggagtcgacggagccacgcgagca

SEQ ID NO: 6858 - DNA, 273 bp, A.fumigatus
acctgttcactctttcactctttcattttgttttttttttttatttttagccattcgctcattttttcacctggttacacaatgcccatccccattattgttcaggggataagagagggtatagactcaattccatatgcctacacagtgctcaagattgcgccatgggtgctgctcgtagctgccctcaagtactactttgggggagctcggaatggctcagagcgggtaatgcactcgaaaattatcatgataactgtgaatttaccatga

SEQ ID NO: 6859 - DNA, 210 bp, A.fumigatus
gggacggatgcgtatcttccaccccgtggtgaagacccagtatcgccatcggtagctggtcagatcatgaaggtcaaggaacttgtggaggttcaagaagttgacaggcggctcacaaaggaagaagttcgtgctgaacggcggccggacccggggtactatatcgagaaggcatcaattgaagaattcagcgagaatcggtcggcatag

SEQ ID NO: 6860 - DNA, 210 bp, A.fumigatus
ttaaatgatatagctacggcagtggcgttcaaggcgttcaagcaggctactcttaatgcattctataataaaacagattgttcttatcagaccttcgatgaaatcagtaacatagcaccaagacaacaaaaaattgaagtttttatttttaaaaaaaatttgacatcctggtataaaaaaatgctggcacaagatatgtatgatacatga

SEQ ID NO: 6861 - DNA, 885 bp, A.fumigatus
aatcccaatactgttcttctggttggctccgcgcctaatttccctcatgggattgtcgatgatatccctgctctatcccgacttgcaactaaatacaagattcctcttcatgtcgactgttgtctgggctccttcgttattgcattccttaagaaggccggctttccctccccttatgaggaagaaggaggcttcgatttccgccttccgggcgtaaccagtattagtgtggacacacacaagtacggtttcgcacccaaaggcaattcggtgctcctttaccgcaacaagacataccgcagctatcagtactttatttaccctgattggtctggtggtgtgtatgcatctccctccgtggcaggatctcggccaggtgctctaatcgcaggctgctgggccagtctgatgagcgttggtgagactggctacatcaacagttgtcttgaaatcataggcgcggcgaagaagtttgaagcatcaatcaaagaacatccagttctgtccaaaaatctcggtattgttgggaagcccatggtcagcgtggtcgcgttccagagtcaaaacggtgctgttgatatctacgacgttgcagatggtctgtcagccaaaggctggcacctaaatgctctccagtctccccctgcaatccacgtggcatttacaattcctacggcggctgcagtcgagaaattgaccactgacttggtcgagacggtggagaaagagctagagaaagccgaggagaggaagcggcagggcaagtcgtatgtgctcaagcgtggcgacacatccgccctgtatggtgttgctggtagccttccagataagagcattgtcagccgtcttgctgaaggcttcctggacaccctgtataaagcctga

SEQ ID NO: 6862 - DNA, 1854 bp, A.fumigatus
cagccagcggctcaacaagattcagatacaattgaaataataccccagcagcaacctggcctaccgaaacatttcaaaagcaacgcgtcccgattcagctttgacatgaacggagtcgaatcatcagcgcaggagaagctactggaagagaagcacaaggagaaagaagcggcacgcagggccaaagctcagctcgaagatagagaatacagtgacgtcgaagacgattatgacaacgaccttttggatgactttgacggcttggaagaaagaatccctggggtcaacaccgacgctgaagaagatgaattcagtggattctccggcccgggggccgcgttgactacctcatggcatgcacctggcctctcaccggtcgtcgcgagccccatgagcgccccgggtcttggtccggcagttgacataaacctgcaattggaccaaggcggcgctcctcacgtatccgatatctctgtcactgaagatgcagtcgctgcatttcccccgacgacaaacctttcagaaacagcagcggtaggatgcgcaatgcaggcgggagctcgttcttctacatcgcaactaatcgacgaagacgacgacttgtactttgacgacggggaatttggcgacctggctgttgatgcaggcggcgagacgtttgacgaatcgatattcgatgacgaatccagtcatttgtatgctcgcaagacggcagtagtacccgctccgccggttgaaccaggcacgacggaccagatggaagacaagtctagatcaggtgaagcatctgaaccccccagcctaagtcccaaactggatcagacggatggtcttaagcacgcaccgagcgctgctagtgatttccgagaccgagcagttaccagatatggtggacttgaccctgaaatgacccataacctgacaacaacaaagtctcatggtggggtcttatccgagcataatctggaggtcttgcacaacgcgctggagaaggccgctaatgagacggctcacatggacagatttaagcggaccacaagcgcgagcgagaggtccctaggccaggacagcactgccagaacgaaccagactatggactcttactcagggctcgtctcagacgacagccatctgagccaggctatggatgcaatgggctttgaagaggtttttgacgatttcaactacgacgacgatgatgccttttacgatgatcctatcatcgccgctgccaatgcggaggcactggaaaacgacgatgaaggtttctatgggcaagagttcggattctacgcccacgctcatggaggctgcagctcagaacttacaaatgggggatattttggccctcgcggtgtcgaaggcatttcgcgtaaccacagcagccgaggcaaattcagagaacccagtttgacacctattactgaacgaagtgaatggagcacgcggaactcggtcatttcattgacagcgcacggggcggctcactccaattctgccatctctggcccagggctggcgcaacttgttgatatgggtaccatggacgacgaaatgtccctgagcgcgttgttgaaactgcgacgcggtgcctggggtggcagtaacggaagtctacgtagcagcagcggaagcccaccgcctcatcatcactcatcatcgaatcgcgcgagcttcacggccttttctgacgtgagcccgactgtatatacggttcctccggattacctctttggaggaccaagcgcggctgaatcgccaaccatgataccgacaaatggagatgccacccaccagtcgttatctggagaggcggaatcgcaaatatatcctgaagaaactgttcccaaatga

SEQ ID NO: 6863 - DNA, 219 bp, A.fumigatus
ggaatcctcgaatttgaggtggtccaggaatgtgcctataagacaaagaatgatgacagtctgtacaaagcagcaacggaacaatgtgcattaggcgaggcaaccaaggccatgaaagtcgacttcggtctaaaaaatgcttcgaatctcaattttggctctctctctctctctctctcatttacgagattaagtggtatagctggcgaaacaacatga

SEQ ID NO: 6864 - DNA, 300 bp, A.fumigatus
tcatctgtctcagtcctcttctgctcgtacgaatggttcgtccaaatctcatctgacattgtctcgacatacctgagtcttaatacgatggatgacaacaaccgctcggcggtcgaccaaggtatagacgcagcagagccgtataagattggagttgagaaagaggcaaaggatgttgctcaagaaactgagagcccggaatcaccaggctctcaaccggataatgctgaatatgtcaagggacatcccgtcattcgaaagggtgagcctccatctaccgcgctgccagcaattgtctaa

SEQ ID NO: 6865 - DNA, 819 bp, A.fumigatus
gagacaattgagcatgaatctgcaggtattgggaaggtgggagtcgtctatccacctggaaagcttggattcaagctgacggtgaccagtttcaatgaccttgatattcagaatcggctggatagtatccatgatgctgtgtcgattatcagggacagtagtcaaaaacttcatcactcgcatcccgatgacaagcctttggctgggtcagagaaaggtcaacccttgtctaacttttcgcagtctctcgatgctatcgacgcgctcatggcacagctcacggctatgaaaatacgcatcgaaaagcaggatgacaagacagaatctcccatggacagctgggacaactttgaagatgttaaacgcgcttctctgcctctgatgttgctccaatccaaggtccgagaagcattacagttgttgtcaacgccccagccgggacatgaaaagctggccgatatagatgtgcagtgggttcggactgagctggagagtctgcttgcgagtagccatgagaaagccgcggccgtcatcaaggcgagctcgcagaaaagcgacgatgtcacccgtggttgtaggcggcatagcgcaggcagtactcttgacaaacgaagaaagagattgcaacctactcagcagatcgtatcatcgcaggttgtgcttcaagattctcccgcaggcaaggtctccatccgggtccagtggaccaaagatgctgactcaaaatccgcccgcgcatccgatattcttcttctcctggcgcccaatccacagggtggcccaagacggtcttcttgtttcgctttcgaggctccatga

SEQ ID NO: 6866 - DNA, 276 bp, A.fumigatus
gtttattgtctggacaaaaattcccccggatatcgcactcttggtgagacccaaacaggcaatttgaggcttggcggaattctgccggaccggatcaacctccgcatgcgagaattgtggtcttaccaagattctatcacaatcacggagccgaccatcacgctcaacttctacactgatggcgaccttttcacccatattgaggcagctgggctgctcgaggacttttacgaaggcagatggattgctgcgaccccagttcagccgttccattag

SEQ ID NO: 6867 - DNA, 747 bp, A.fumigatus
  unsure (47),(75): Identity of nucleotide sequences at the above locations are unknown.
ttgagtcaattctccagctttccaccgttttcatcgtgtctaatatntaagacaggacgcaagaagctcaagatntacccaccacccccgtcacctcgagcaaaatgcaaagaccctatcgcagcattgacagagtctcaactagccgctcttgaccccacaggcgagcgtagggctctgtttgactaccgccgaaacccccgaagcgtgaaagtgggcgacattctgcgtgtgacatttaagaacggagacccattctcgggtgtgtgtcttagcatccgtttgcggggcattgatacttctttccttctccgaaatgagctcacgagggttggtgtggagatggccgtgaaggtcttcagtccaaatgtcgagagtgtggaaattgtacagaggacggagaagaggaagagaagagcaagactgtactacatgaggtatgtactagcatctggtgaccggcaccaccaggaagaatgttcctcctgtgcagtgaagctaaaattttgctctctcgaattcacaggaagcccaagcacgatatgggaagcgtcgagaacattgtgtcgaactacctgcggcagaagtcggtccttactggtcagcgttcagccggtgcacggagacagaaacggtgaattggagcaattcctattctgtctgtattatgactttggcgaaatgtactatactactatacttgcacatggatattcgggaatcgacagtttttggcgcacacattga

SEQ ID NO: 6868 - DNA, 186 bp, A.fumigatus
tcccaaatagtcctacaaaaacgagagatcatgatcggtgatcggtactctattctcccgttcccgcgagcttgtccctcagcaatgtctctcggaaaggagtcgccaatcctaccgtccaacctgatttatgaaacactatgctacccggataagtggacagacggaacaatcttgcaattgtag

SEQ ID NO: 6869 - DNA, 528 bp, A.fumigatus
  unsure (405): Identity of nucleotide sequences at the above locations are unknown.
gatgcgactcaatacgtttaccagccaatcttgttttgccaagttaattccagaatgttgcacatccaatacttggcgcacgtcgatgacatcacgacatttcggcctggtataggtgacatcatcttgccgaacctcttatatagaacctcctgttcggtcctctgttcgatcctctcaacaagcaacaatcaaacagtcaaacaatcaatctctactactcaattcgatttaatccattctacaatccaaaacaacaaccacaatggagtccatcaagcagggtgtcaactacgtcagcgagagcgtgcagcaggccgtgcacggcacctccaaggaagccaacaagcaggtcgccaaggactccgatgctcccattggcactcggtaagttccttattgttntacaagaacctgcagcagtctctaatattgtgcagcgcctccgccgccaaggatgccctcaccgacaaggcccacgagtccaagcatgacgccaaggccgaggctcacaagcagcagatctaa

SEQ ID NO: 6870 - DNA, 717 bp, A.fumigatus
  unsure (573): Identity of nucleotide sequences at the above locations are unknown.
agtggtcactcccagccccgcacacaccgtggtcacgatgccaagttccccggtatggccatcacgtacgctctcatgcagcggttagaagagctcagcgagaaggagcctgaacgcgtacaaatcatcaagaaggctcgtgtcaccaaggtcaacaagtcgggagacacaatcaccggtgtcacttacgagctgaacggcgagaccaagaccgcagacggggttgtcatcctcgctactggtggttacgctgctgactttggcgacggctctctcctgaaacagcaccgccccgacaccttcggcctgtccagcaccaacggcactcacgctaccggtgatggtcagaagatgctgatggctatcggcgcgaacggtattgacatggacaaggttcaggtgcaccctaccggtctggtcgaccctaaggatcccaccgctaagttcaagttcctcgctgctgaagctcttcgtggtgagggtggtatcctgctcaactcagacggacagcgcttctctgacgagctcggccaccgtgattacgtctccggccagatgtggaaagagaaaganaagggcaagtggcccatccgcctggtcctcaacagcaaaggctccaatgttctggaacttccacacccgtccctactctggccgtggttcgatgaaaaatatgaccgggcaaggaattgggccaaggacaaccggtgtgggtga

SEQ ID NO: 6871 - DNA, 252 bp, A.fumigatus
tttgaaccagctttcttcggtggcaactccaccaaggctacttccggtatcaacggtgccctcacccgcacgcaggtcgaactgggcattcaggacagcgtcaaaactttctacgaagatactcttaaatccgccagagacaaggctcgtccagagctgatcaaggtccttacatacaagtcagctgctgcggtcgaatggctgcaggatgttttcaacctcgacctcactcttgtttctcgtcttgggtaa

SEQ ID NO: 6872 - DNA, 207 bp, A.fumigatus
atagtctggactgccctctgctccgaaggcctcggtgccaatctccagcactacagccctctgatcgacgagcaggtgcagaagacctggaacatccctgcctcgtggaagctggatgcccagctcgtctttggtactcctaccggcgacgctggtgagaagaccttcttgcccattgaggaccgcttcaaggtttttggaaagtag

SEQ ID NO: 6873 - DNA, 975 bp, A.fumigatus
  unsure (76): Identity of nucleotide sequences at the above locations are unknown.
caccgatcaagccagcatggacttcacattccacaatggaaccaatggctcgtcgccatgggtcgaattctacccntacaccccctcggccacagcaggatacaccttcatgtccatcttcggcatggcaacagtcgcgcacatcattctcatgttcccataccgcgcagcctacttcatccccctcgtgctgggaggaatctgtccgttcccccgtctcatccccatcccacgataccaaatacaccgctgacttctccaggcgaaaccttcggctactacggccgcgcatggtcccacaaagaaggcagagctgcaatcggcccctgggccctccaggagatgctcatcctttgcgcaccgcccttcgtcgcagcaagcatctacatggtcctcggacggatcatctgcgccttcgacgcagagcaccactccagcatccggaccaagtggctgacaaccatcttcgtcctcaacgatgtggtctgcttcctgacgcagcttgctggcgcaggggtgcagattaccggtgatccgcacgtcatggcgattggtaagaaggccgtcctagcgggattgatctttgcgctggtagtgtttggggtgtttgtgtgggtggcggcggcgttccatcggaggttggatgcggagccgacggctgtggtaagggagtgtccgcggctgcggtggaagaagtatatgtgggtgatttatgtctcgtgtgggatgttgatggtgaggaatctggtgaggacggtccagtttgggtcgcggaaagggtctgcactgaacacggaagaggcgtttatatatgtctttgatgcggcgttgatggctgggtcgattttggtattgatagtttggcatccggggaggttggtgcggagggctcagaaggcgaccaaggcgagtcagatgtgtgtgcagatggaggatgcgcctgatatcccattgacgggatatagagagggttag

SEQ ID NO: 6874 - DNA, 252 bp, A.fumigatus
  unsure (75): Identity of nucleotide sequences at the above locations are unknown.
accgatcaagccagcatggacttcacattccacaatggaaccaatggctcgtcgccatgggtcgaattctacccntacaccccctcggccacagcaggatacaccttcatgtccatcttcggcatggcaacagtcgcgcacatcattctcatgttcccataccgcgcagcctacttcatccccctcgtgctgggaggaatctgtccgttcccccgtctcatccccatcccacgataccaaatacaccgctga

SEQ ID NO: 6875 - DNA, 198 bp, A.fumigatus
ctacgcggatcttccgccccgtgggcaagatggaacagccgggcgaagaaaatccccaatgaagagcgcaagacaactccgtacatgaccaaatacgaaagggctcgagttctgggtaccagagctttgcagatcaggttcgtcatctgcgacatgtggcatatgaagaccgtcgaactgacatttgtcacagtatga

SEQ ID NO: 6876 - DNA, 291 bp, A.fumigatus
agagcgcaagacaactccgtacatgaccaaatacgaaagggctcgagttctgggtaccagagctttgcagatcaggttcgtcatctgcgacatgtggcatatgaagaccgtcgaactgacatttgtcacagtatgaatgctcccgtgcttgtagatcttgagggagagacagatcctttgcagatcgccatcaaggagctgaaccagaagaagatcccactcattgtgaggagatatctgccggatggaacgttagttatcccttcacctcgtgtatggacgcatgtctaa

SEQ ID NO: 6877 - DNA, 750 bp, A.fumigatus
tgtgaaaacaatgacccgtcacttacaaaccacggggttggcgctgggacctcgccttacctggtggcggtcaagaggagcggcattcctgttctgccagtggtggtgaccgcgttgatcttcctgtcgtctgtcgcatcaggccgttcttttctcttcacctcttcacgcacgctgcattcattggccgaagctgggcatgctcctgaacttttcaggcggcgcaaccgatgggacgtgccgtatgtagccgtcataacgtcggcatttttctccagtctcgcatatttctcggcgatgatatccagctcgattgtcttcaattcgttgatgtattttatcaccacctgcggatgcatctcctgggtgggcacgtgtgtcgtctatcttcacttccgcaggcagacagaagctttaggctttacctctgtacaccgagccagaatacaaccctatggggtgtactttggcattgtcacatgtacactgttgcctattgttaacactttcatcatagcgactccatcgcagctggccgcgagcaagttgcttcctgtgtacttcggaatatcctcctttttcctactctatattggccatcgtgtgggatatgctgttatccggagacggactaggatgaagaaaagcagtattgaggaacctggagattggtctatagagctacctcctaccacatccaacggcaggacaggaggagcagattcatccttacataacacggccctttga

SEQ ID NO: 6878 - DNA, 300 bp, A.fumigatus
gctcgtgtttcagctaacgattattcttctagggttgatgaatataagcaagatgcccagccaaccgagcgggtcatcgatgagtacttccccccccccttggcatttcccttttgtccctcgctgtgggaagctttcaatttaacatattctaggcttgaaaaccccttggctcggatcccaaaggataggctgcttcgagacgtggaggagtacgctcaatcgtacgacctgaatgatatccttcccgagctgaagaagggcgttttcaccacggcgtgggcggaccaaagcttcaat

SEQ ID NO: 6879 - DNA, 186 bp, A.fumigatus
aaacctttttatgagcttgccaactggtcaatggcctccgttaaggtcttcaaggatctgagtgggactctgacctccggcttctcccgcctgccccttcccttcccttgccatgtcgttccatccaacgacctcagaaaggtgagacgtcaaccgatctctctagctcaacaagtgcgcaagtag

SEQ ID NO: 6880 - DNA, 489 bp, A.fumigatus
agcatctcaattgtatcgagtaggaaggatgattcaggaaactgtatagccctctcggaatttggtgacgcccgaactaattcttctccgcaggtcgacattgatcgttcagaagaccaaggtagaacagtcgtgaagccaggtttagaccgagaacttgaccggatgaaggacacctatgacggtttgaacgatctcttgaaagaagttgcgacagagatagcagcgacgatccccgaaagcctcgatattgacgtgaacgtgatatacttcccccagctggggttcaatattgcagtcccactaaacgacatgggtgaggcagcttacagcggcactgctgatgactgggagcttatttttgttactgagaatcgagcatactttaaggacttcaggatgagggagatggaccaaagcttgggtgatatatatgggctgatttgcggtattccacagagaatctcttttgctgtgaccatgacctaa

SEQ ID NO: 6881 - DNA, 489 bp, A.fumigatus
aagagggtcgacaagacgacaatagagaaacgaagtaggcctgcatgggaaaaggcttttatgtttgccaagctatttggggagcaattagaggatctcggtctaccagagaatcagaatcccgctgcccactggcagaagatggttgccctgcattctcgggaagtgctgtcggctatgtctggccctctccgtaaactcaaagacgcaaaacagaccgaacgagctccccggccgaacctcagccgtgacgatttcgacttcgttgaccatgacagttctgaccctattgaagaacacgaaatttttgctgcgaagaagacgacgcgggaggaacttgacattctgagatcggaggtgcgggatttgaaggaaatggtttacaaactacgtcccaggtttcggcggaaccgtgtggcttccaccgacaacggtatagaaaccccagagggaacacaagacaacctacagagcgccacggttcactga

SEQ ID NO: 6882 - DNA, 927 bp, A.fumigatus
  unsure (188),(295): Identity of nucleotide sequences at the above locations are unknown.
tggttgtccgggttggaccccccccggaaaaagcttccgtctaaacacaaagggtgcttcaagacggaattgattgatcagacctatcccgaaattctccgatttaacctttcttcgaccgtgctagagttgagaagttgggaaatcgatgatctggtacattttgacctgatgacccttcaagcccncgagactctcatgagagctttggaagagttgaattatctggcttgccttgatgatgacggcaacctgacaccgctgggccgccttgcctccgagtttcctcttgacnccgcgcttgccgtcatgctgatcagctctcccgagttctactgctcaaacgagatcctgtcaatcacagctctgctttcggttccccaaattttcgtgaggccggcctcgcagagaaagcgcgccgacgagatgaagaatcttttcgctcatcccgatggtgaccatctcactcttctgaacgcctatcatgccttcaagagtccagaagcccaggagaatccaaagcagtggtgtcacgatcattttctctccctcagatctctccaatcggcagacaacgttcgtatgcagctcctgaggatcatggagcgcgaggagctggaaatgatctcgactccttttgaagacaagaaatactacgagaacatccggcgtgcgctgtgcgcgggattcttcatgcaggtcgcaaaaaaggaaccacagggaaagagtgtctatacgaccgtcaaggacaaccagaatgtccttctgcatccgtcaaccgtcctcggctacgatgccgagtgggtcctttataacgaattcgtcctcaccactaagaattacattcggactgtgaccgccgtcaaacccgaatggctccttgtatgtcattctcgtcccagtactatgattaagtactatgattaa

SEQ ID NO: 6883 - DNA, 315 bp, A.fumigatus
ctaacgaatgctctagaaatggacggcatgacgtcgaagaagaatgtgttcgtcatcggtgctaccaacagacctgagcagcttgatgctgccctggttcgtcctggtcgtctcgataccctggtctacgtacctctgcccgatcaggcttctcgtgagagcattctcagggctcagctccgcaaaacccctgtcgcccccgacgttgatatccccttcattgccagcaagactcatggattctctggtgccgatcttggatttgtcacccagcgcgccgtcaagctggccatcaaggaatccattgggcgctga

SEQ ID NO: 6884 - DNA, 1233 bp, A.fumigatus
agctttacgcggatcgcgccctgtggtgaagaccctctgcgtcatcctcagctgttcaagtccatcggtatcaagccaccccgtggtattctgatgtacggtccccctggtaccggtaagacactgatggctcgtgccgtggcgaacgagactggtgccttcttcttcctgatcaatggtcccgaaatcatgtccaagatggccggtgaatccgagtcgaatttgcgcaaggcgttcgaggaggctgagaaaaactctcccgccattatcttcattgacgaaatcgactccatcgcgcctaagcgtgagaagaccaacggagaggtcgagcgccgtgtcgtctctcaactcctgactctgatggacggcatgaaggctcgttccaacgtcgtcgtcatggctgctactaaccgccccaactccatcgaccctgcccttcgtcgtttcggccgtttcgaccgtgaagtggatatcggtatcccagaccccactggccgtctcgagatcctgtccattcacaccaagaacatgaaacttgctgaggacgtcgatctggagaccattgcggccgagactcacggctatgtcggttccgatcttgcctctctctgctctgaggccgctatgcagcagattcgtgagaagatggatctgatcgatcttgacgaggacactatcgacgcagaggtgcttgactcccttggtgttacaatggagaacttccgttacgccctcggcgtttccaacccctctgctcttcgcgaggttgctgttgtcgaggttcccaatgtccgttgggaggatattggtggtctggaggaggtcaagcgcgagctcatcgagagcgtccaataccctgtggatcaccccgaaaagttccagaagttcggcctttcgccatcccgtggtgttctgttctatggtcctcctggtactggtaagaccatgcttgccaaggccgtggcgaacgagtgtgctgccaacttcatctcagtcaagggacctgagcttctgagcatgtggttcggtgagtctgagagcaacatccgggacattttcgacaaggcccgtgctgctgcgccttgcgtcgttttccttgacgagttggattcgatcgccaagtcccgtggtggctccgtcggtgacgctggtggtgcatctgaccgtgtggtcaaccagcttcttactggtaggtttgacaaaaccctgcgatatctaaatacctgtgactaa

SEQ ID NO: 6885 - DNA, 282 bp, A.fumigatus
aggcgccagaagcagcgtgagggggctggagaggatatcaagatggatgatgagggcgaggaggaggcccgggtgccccagctcacccgtgctcatttgagggaggctaagaagtcggctcgccgctccgtaagcgatgtggagattcgccgttacgaggctttcgctcagagcctgaagaactccggtggcagcagcttcttccgcttcccctcttcgggtgagatccaaaataacgacacgttcggtgatgccggcaatgatgacagcctctacgactaa

SEQ ID NO: 6886 - DNA, 225 bp, A.fumigatus
atatcgcagggttttgtcaaacctaccagtaagaagctggttgaccacacggtcagatgcaccaccagcgtcaccgacggagccaccacgggacttggcgatcgaatccaactcgtcaaggaaaacgacgcaaggcgcagcagcacgggccttgtcgaaaatgtcccggatgttgctctcagactcaccgaaccacatgctcagaagctcaggtcccttgactga

SEQ ID NO: 6887 - DNA, 990 bp, A.fumigatus
gatgaagttggcagcacactcgttcgccacggccttggcaagcatggtcttaccagtaccaggaggaccatagaacagaacaccacgggatggcgaaaggccgaacttctggaacttttcggggtgatccacagggtattggacgctctcgatgagctcgcgcttgacctcctccagaccaccaatatcctcccaacggacattgggaacctcgacaacagcaacctcgcgaagagcagaggggttggaaacgccgagggcgtaacggaagttctccattgtaacaccaagggagtcaagcacctctgcgtcgatagtgtcctcgtcaagatcgatcagatccatcttctcacgaatctgctgcatagcggcctcagagcagagagaggcaagatcggaaccgacatagccgtgagtctcggccgcaatggtctccagatcgacgtcctcagcaagtttcatgttcttggtgtgaatggacaggatctcgagacggccagtggggtctgggataccgatatccacttcacggtcgaaacggccgaaacgacgaagggcagggtcgatggagttggggcggttagtagcagccatgacgacgacgttggaacgagccttcatgccgtccatcagagtcaggagttgagagacgacacggcgctcgacctctccgttggtcttctcacgcttaggcgcgatggagtcgatttcgtcaatgaagataatggcgggagagtttttctcagcctcctcgaacgccttgcgcaaattcgactcggattcaccggccatcttggacatgatttcgggaccattgatcaggaagaagaaggcaccagtctcgttcgccacggcacgagccatcagtgtcttaccggtaccagggggaccgtacatcagaataccacggggtggcttgataccgatggacttgaacagctgaggatgacgcagagggtcttcaccacagggcgcgatccgcgtaaagct

SEQ ID NO: 6888 - DNA, 423 bp, A.fumigatus
ttgcctcaacagctgcttcattcttcctttcgaatttcgtcctcctgccggtctcatcggcaaactatcccggcgctcgcgcgctcaccaccctccacacccacgccaacaacaccaaacccgtcatcaacgtctacctcggcaacctcgcctgccagacaggcgtcaccaggtttctggagatgcctcccccccagatgcccgcaaaaacggcccaaaacagcgagctcgccaccgtcgagagcgcgggctcagctccgggttcaggttcagtctggcgatacgacaagacggaagatgagaccaccaaggcctttcctcccttctggaaacggttcgactacgtgctcattgagccgagcgaggagaagaaagttcggagggcatcgggccggccgcatagctgggaggaggtcgaggtga

SEQ ID NO: 6889 - DNA, 342 bp, A.fumigatus
  unsure (58): Identity of nucleotide sequences at the above locations are unknown.
ttgctgatgtcttgtttagtgttcctgttgttgatcgtgttgcttccggtcttcgttngtctccacctgctcgttgctccctacaccaaggtcgaggagtcgttccatatacaggctatacacgatatcctgaaatatggtattcctacgggtgatgtctctggcatcctagcccgttatgatcattcgacgtttccaggagcggtgcctcggacctttgttggggctgttgttttgtctgggctgtcgcagccgttcatctggttgaacgagagtattgataagcaagctctcggtatgctcttcctagcttgcgctttgattcgcgaatctattagctga

SEQ ID NO: 6890 - DNA, 1473 bp, A.fumigatus
ttcgcgaatctattagctgatgttattcttcatgtagctcgaggtatcctaggcctgttcaattccgtgtcgctgatctcgttcgcgctcggcgtacggcgagcgttcggaaagactacggccatttggtatctactgttccaagcgagccaattccatatcatctactatgcctcgaggactctctccaacatgtttgcctttggcattactacattggcaatgcgagctctgctcccggaacctgtagctcccgctgtctataggaagagatgccgagtgggattgttcttgttgacgatagccggtatcattttccggtctgagttggccctattgctggctgcgcatacgctgtgtctgttttctacgggtcgaatccgaatcgtacaggagatcatcccagccggagctctaggacttgtggttggactggccatcaccgtgtcagtggattcgttcttctggcagcagttcccgttgtggccagagctcgctgcattcaagttcaatgttctcgcagggcaagcctccgcatggggaacgcacccgtggcacttttatttcagcagcgccatcccgcgcctgttgctgaaccccttgacctatctcctcgcactcccattcgccctcacgcatccatccacccgatcttccacagcatacatcattatcccatcgcttgtctttgtcgtcatctacagcgctcagccgcacaaggaatggcgttttatcgcatacataatcccacccttaacagccgccgctgcccaaggcgctgcctacatctggacgcaccgcgcaaaatctatcatctaccgtcttctctccctcgcgctaattgcctcaacagctgcttcattcttcctttcgaatttcgtcctcctgccggtctcatcggcaaactatcccggcgctcgcgcgctcaccaccctccacacccacgccaacaacaccaaacccgtcatcaacgtctacctcggcaacctcgcctgccagacaggcgtcaccaggtttctggagatgcctcccccccagatgcccgcaaaaacggcccaaaacagcgagctcgccaccgtcgagagcgcgggctcagctccgggttcaggttcagtctggcgatacgacaagacggaagatgagaccaccaaggcctttcctcccttctggaaacggttcgactacgtgctcattgagccgagcgaggagaagaaagttcggagggcatcgggccggccgcatagctgggaggaggtcgaggtgatccatggattcgcggggctgagggtcctgcgtccggacgatgaggctactgggcagttggaggagcgggtgtttagcatcgtgcttggtcccgagggtgctcggtactggacgatggttagggattatgctcggaaacatgtcacacgcggatggtgggcggagttgaagatggagcctaagatcaagatcctgcggcgtattaggtga

SEQ ID NO: 6891 - DNA, 1119 bp, A.fumigatus
tatgcttcgtcgctttgcatagacttcctcgaccattactttgacctactcagttacgttcacaatcgccagacccgctattcccaattccgtgccgcctaccccgatcctcctgcgaccccaatcgatgattacgagccagccctcctcaagtatctaggtcgcgagcgtgctcatcttcgcaagcgtcgcacccgtctgcgtcagcacgacttccagattctgacccaagtcggccagggtggctatggacaggtctatctggctcaaaagaaggatactcgagaggtgtgcgcgttgaaggtcatgagcaagaagctcctatttaagctggatgaaatccgtcacattctgacggagagagacatcttaacggcggccaagagtgaatggctcgtcaaattgctctacgctttccaggatgatgagcagatttacctcgcaatggagtatgtgccgggcggtgacttccgtaccctgctcaacaatactggcgtcttgcacaatcgccatgcccgattctacattgcggagatgttcagctgtatcgatgcactccatgcgctggggtacattcaccgcgacctcaagccagagaactttttgattgattcaactggccatgtgaagctaacggactttggcttggcggcgggcatgctgaacccaggaaagatcgagtccatgcgtgtgaagttggaggaagtcggcaatacccccgttccgtttggtcgcccgatggagcaacgaactgcagccgagcgccgacagggataccgttctcttcgagagcgtcaggtcaactacgccaaatcgatcgttggttcgcctgattacatggcgcccgaggtactgaagggtgaggaatatgactttacggttgactactggagcttggggtgcatgctcttcgaagctttggctggatatccgccctttgcgggggccacggttgatgagacgtggcagaatctgaagaattggcagaaggtcctcccggagcctgtatacgaagaccccaactatttcctttcgcggcggacctggggtctcatcaccaaacttgtggcggccaaagagaaccgagcccaaaaccttccaggagatccatgcgcatga

SEQ ID NO: 6892 - DNA, 210 bp, A.fumigatus
aggagaagcatgctaattggtgccatctaccagcttacacaacttgaacacattatcaaacgtcctgatacgtatatcgggtccgtcgaacgaactactcagtttatgtgggtgtacgattcggaaacggagggaatgaaatacaaggaggtctcttatgtgcccggtctctaccagaattttgatgaaaatcgtcgtcaacgctgctga

SEQ ID NO: 6893 - DNA, 393 bp, A.fumigatus
aaacccagggcaaaggccgcccccaagaaagcggcaccaaaaaaattgacccaaacaaaactcacagctaagccagcggcgaaggcgaccgcttcaaaaaagcgatccaaacccgatagtgaggatgatctgtctgacgacatgggaatgtccgacgacgactcggactcctctctttcccagacacctcccaagaaggtcaaaaaggctcccgctagcaagaaaggaggctcaaaccctcttgcagacgtggagaatgaatcatttggaggggatattggcgatcaacctgcaacgtccaccaatgcgtcagagaagtaccagaaggtgagtctactgttgactttacgccactctttttgcacgccagtatgtagaggagaagcatgctaa

SEQ ID NO: 6894 - DNA, 201 bp, A.fumigatus
  unsure (44),(150): Identity of nucleotide sequences at the above locations are unknown.
tctatgcacactgtgcccgtactctctataactaggactcttancatggctcaaaaagtgatgaagctcttccacatccagcctcgttactcccccggaaaagcggggtgctcaagtctcatgctccaatatggaattcaggctgcgtcngctgccacttcttactccaaattctttttctcctaccacaccattgcctga

SEQ ID NO: 6895 - DNA, 822 bp, A.fumigatus
gcctcagggtccaaatctgtgtctattctgggatcacgtttcaccaacgtgatggcttcacaggagatgttccctgagttggggcagtctcctgcacccggcattaaaagccgcggcgtcagccgctctccccatcctcatcagcagcagcaacagcaacagcatcaacaacatcaaggacaatttacaggaacagtcactggcttagatctcgattcttcgatcgctacagctagttcatttgccaattcgtccttcgatcccaatagcaacaacgttagcccttccgccgaatcgtatggttatactgccgctggctatctctcaggcactcctgcatcgcagaccgaccagaactacgcaaatagtcttcagattccgcaatcgtacggcaccggtctggttcctcagttcaatgagtctcgcggcttgccaatacagcagcagtcgcaacaacagcaccaccagcagccctccctcgatgataacttctccgatcttttgaactccaatgccaccgagtacgacttcaacaccgtctaccagactcacagtcccagtagtaatactgctcctgagtacgactcctcccttctgcttgaccctcaggtccaccagcagtcgcatccgacccagataccctcctcccattcctcgacttctccgcagatctcccctctcgagcaacagcagcactcctcaccgggtccaatgtcaacccaaggttcgacaaccgtggcttactatacccctcagcattcccgtcatgcatccttggaccccgccacgtcttcaccacggggctggaaggagccgcgccat

SEQ ID NO: 6896 - DNA, 312 bp, A.fumigatus
ttcgcaaggtgcactccaaagtctcgcaactccaagtttcatccagccctgatcgctgcggatgctttcctcttctggccctccttctctccgcacccgcattggttatcctctctgcgctcgttgatccccttgtcccctttcaccgcccctctcttcccgcctatacagacatactacggcggcgcttctctatcgacccccccccccccgcgcgctcggtcgcttgtccctgttttcacgaccatcttcattgctaagcctcagggtccaaatctgtgtctattctgggatcacgtttcaccaacgtga

SEQ ID NO: 6897 - DNA, 480 bp, A.fumigatus
caccaccgcggatccttccagccccgtggtgaagaccacgagcgcatttcgattcaggcagccctgctcatctccggcgtcacccccctcgtcataattgcggtgtatacgctgttcattgacggtctgttctcgcatcacaaaccgtacaatcctgcatccgggaagaggaagcttaccgggccgtaccggtggaaggatcgcctgtgggagttcaactgtggcttcctgggtcttctgctatctcagggactcgcatttctcatcacccaggtgctgaagaccgcatgtgggaagcccagacctgatttgatcgatcggtgcaaaccgagaccaggaagcgaagatctgattcccggattgtccaattcgactatctgtacaggagaccccgcaataatcaaggatggattccgttcttggccttctggtaagttttaccctggccttctgatctttgtcttgggctatgctgattga

SEQ ID NO: 6898 - DNA, 705 bp, A.fumigatus
tctcgaaatatagcatcttttgccggtttattctacttgactctttggctgtgcggaaaacttcactttatggacaacagaggcgaagtttggaaggccatcatcgtcataatcccttgcctcgcagcaacacttattgccgtttcacgaattatggatgcgaggcatcatccttttgacgtgatcagtggatcattactgggcattatttgcgcctacatctcctaccgccagtatttcccacccatttccgagccgtggaagaaagggcgcgcgtatccgattcgaagctggggtacagaccctgtggcacctagcaagacctcgcctctgtctgactgtgcgagcacatcagctcttcggaacccgggggaagacaggataaacgcttctagtgctcctgagatgggtccggcgcgaatttctccgacttacatgggttcagctaacccgtacacctcgaacttgcgcaatcgcagatcccatgacaatgatggagattggtcatcctccagtgaagatcttgcagatggatatgagatgcagcatggctatgctcgtacacagaatccggcaatcggcgggcttccaagatacgaagctgacacatcataccattctcagacacaaaatgtactaccaggcgtcactgctgctcatgtacccccggatccaatagccacccgtccagccagggactcatag

SEQ ID NO: 6899 - DNA, 183 bp, A.fumigatus
gtactccttctgagagccaacacagctacaaccttcttgaacatcatctattgcacgtgcgtatacctcccccagcgcaagggatgggatgttggagcgcagaatattctccgccccttctttctcctagtcctgcatcagcatggcacacgtatcatgatctctctgcttgtgaatggctga

SEQ ID NO: 6900 - DNA, 579 bp, A.fumigatus
tattttctcttcgcctctaccaacccagccatggcttctacaggaggcggcaactccgccttccggaactataacaatgagttggctcacgtggaggatgccagagagcgccgtcgtcaggctctggccgagattgacaatgccaagttcagctggtaccacgttcgcgctgttgtcgttgccggtgtaggtttcttcacggactcctacgatatcttcgccatcaacctggcctccagcatgttgggtgttgtcttctggcaggatgccaaatccagccccggcaagattccctcgagtgcagatacggccatcaaggtgtctacctctggtggtacggtgattggacagttgtttttcggttggcttgcggatcgcattggtcgtaagcgtatgtacggtattgaattgatggtcatcatcatggccactctggctcaggctctctcctcggactcgcgtgctatctccatcgttggtattctcatcttctggcgtgtgattatgggtattggtatcggtggagattaccctctgtcttctatcattacttctgagtggtcttcaccacggggctga

SEQ ID NO: 6901 - DNA, 204 bp, A.fumigatus
ggatctatctgctatttatctatagctatatatttaatagctataatattctctcctcttttagatttagcaagattaggcacttttaaaccttttaaactaattaccttcctagatttgccttcgccaggctggaagctatatttattaaagttatatactaactatactagtatatcctttttaaccacccctgtaagctaa

SEQ ID NO: 6902 - DNA, 219 bp, A.fumigatus
ggctgtaccgactacctttacctagataagtatagcgagtctaggggtgactaccagcttgccactgccacagttccactgcctggcgtacccacttactacatatctgtgactaaggctccccctcaccgctccgcgttgagggtgagccacagtgaaaccactaaccacaccaaatccaccatttttcaatattttgactatttgaagctattctaa

SEQ ID NO: 6903 - DNA, 213 bp, A.fumigatus
gcgcacttcagccccgtggtgaagaccttcaagagggagatgcacatgtgcaacactgctggacttcccttctgcccggtgcggagatgcgcttctggttccgatatttccctacctcaagctggagctgccgttcgtctagattttccttcatctcatccatcggataattcagatcgcatgcagggtatctacacgctctctagaatgtga

SEQ ID NO: 6904 - DNA, 663 bp, A.fumigatus
cttccgaagctgaacagaatcatgtccaacatgtccaccaatcggccttttctgtccaactttctggcggcgtttcgggcccagtcgacgtacaaggcctcgacagccggcagtcagtccgccgcaggtccatcgtcctcactctctgccgctcagatctctcaaggggcccgagcaatagccaccaagaccggtgccggctcgaatgcgagcacttcagcagagcaatcatcctcctctaccactactgccgtgcacgcagcatcgaaccaccactatcatcaccactcgtcctctgccgctgccgcatcttcacatgctagacctcattcccaccctcgaccgtcgctgaatcagacttccccgagtacagaatcccctgcttcttccatctcgacccctctagctccgtcttccccgcctacacctgcctcgtcaaatcccatacccatcgcggatggtcctgaccgccaacggcgagggagtgacagttccagtggatctggaggcttccgggatgcccttggcccggagaagtggtatattggcggtcgaacggcgacaggagaggagcgcttctaccggttagggatggtgaccaaaggtggcggacgactgggaggcagtggacgagtcgggagcattgatcagttgagcctttga

SEQ ID NO: 6905 - DNA, 261 bp, A.fumigatus
  unsure (77): Identity of nucleotide sequences at the above locations are unknown.
gcgaccactctggtcagcgtgctatgtacaaccactcacactatgcgatctggcaagaagtcccgacgagtaactgntatgtccctgttccttttccgctgcaatccacataccatgtcggcgccacctattcatcaaggcttgcagactttaggggatagccgcgatacttgggattctatcaacaatgagaccagttttgatgcttccaatggcgaatttgaacactggatcaactctcaagcatctggatatgcctga

SEQ ID NO: 6906 - DNA, 846 bp, A.fumigatus
  unsure (846): Identity of nucleotide sequences at the above locations are unknown.
aaatgttctctttgggaaacaaggaccagtggggaacatcggccccaaaggggtgcgccaaggcgggagttgcccaaaaagaatggcaaagtcgccagacccatgaattcgttcatgctttaccggtccgcatacgccgagcggaccaaggagtggtttgcacagaataaccaccaggtcgtttcagaggtcgccggcgacagctggcgcattgaaacgccagagattcgcgagaagtacgaggttctcgcgaacgtcgaaaaggccaatcatctcaaagcacacccagggtacaagttctctccgtcgaaggaaaagaagaagagatcagaaacggatgacgaccagctgactgtggatggtggcgagatgacctctggatctagcccggcgttcctccaagttcgtgctgtgggttcgtctgaggtcgacagcaatggctgggccagccgcgactcgacacccttcgactttccagagcatgggctgcccacaacgacatattacgattcttcgtggcagaccagtcatcccagcatgtcagctcccaagcctttttcatacctccagcagccaatacatccaaacctcatcggccctcctactgaagattctcggttcaagcacgttggactccagaacattcagttcacctcgtcgactgcgctggccgggctgcctggagccgcccaccacgaccttcttcagccccagaacaattttggagctggacccgatggacagctggatcctcagttgctgtcattaagcgaccactctggtcagcgtgctatgtacaaccactcacactatgcgatctggcaagaagtcccgacgagtaactgn

SEQ ID NO: 6907 - DNA, 381 bp, A.fumigatus
atagttctgaggtcaccttcgctcccttttagggcctctcatacggcgacccgtcaccagttcacagtcgcccgtcgcggcaaagtagccccaatcttctacaggcccaaagagaacccctacatgttggatctgcctccaaagcgttctcgggacgttcttaaggccccagcggcggatacttctgaggccaagacgatctcctttgcatgcaagacggatcaaaaaggcaagacggcgcctgttgactgtactgtcctgttcgagggcatacagaataacgatctagagattccgaaggtccagtcggcgatatacgctagcatgcctcgcgttgcagttttcactcacgtgaggagaccagaccccgcgcttatgtaa

SEQ ID NO: 6908 - DNA, 657 bp, A.fumigatus
gatatctcgcctcgagactgtggatgcgcactgaaacagattctcaccgacggctttcataagggacgaacagcaagcgagggtggccaaactcctcgcagtgccaccatgaatcagatgaatgtgacggggatgaaccctggggctgggggcccagttggtggtgttcctatgatgaataacggttccacggctcctcgtaacgatggaaatgtgaacaacatacctgagacgatgatcaacaacctcaacacctacatctacgactattttctgaaacgtggctatcatgaatgtgcaagggctctcgtgaaagacgagtcgatcaaattgaacactgaaccccctacaaaaacgagtccgggtcaccgtcgtgaagacatgaatggcgtcgaaggcgatgcgataatgaccgatagcaaggacggtgacaagattaagattcctgatgaccttcctcgacctaatctcgcgagcgaaagtcaacaatcctctttcctcctggattggttcagtctgttctgggatttcttctgggctcagcgcaagaaaggcaacagcaacgacgtgagacagtatcttcaacacactcaggtaattccccacctctcctgctgcggatggaatgggcctaattggtattctggtagaatatga

SEQ ID NO: 6909 - DNA, 204 bp, A.fumigatus
gtccgattcttgtctctaccttatggttgccacattgcaatccagactgatgtggttgagcaaaatgttgattggatttccaaggtgctgtactcactttcgtgcgttggtctagatctaccagatttgggctccaacaaccatgataagggacattcttcctactttttcagagtacggggatgttctccacctcgcacctaa

SEQ ID NO: 6910 - DNA, 291 bp, A.fumigatus
actaccagctggcttatcttcatgcaggagaattcaatcccacggctgtcagaaaacgaatcagaaagactgggcagccgaaagatggctattccaagactgaccgaaggaactgaatctgcgttcacatcacctggcagatttcatcgccgtcacgtacggcgggcatgcgaatcttgcaggcaaagaaagacaaaatgtacaggagataaatccggatgccggaattgccgcgaggcggggatcatctgctgctatacagatggtaaaagggaaaagtcaaaaaggtga

SEQ ID NO: 6911 - DNA, 573 bp, A.fumigatus
cacacatccgccacccattaccgagatagcccatacaatatggcctacgagctatctacccttcagcttagctgcgtggcctttgtggccttcatggccgttctggtattccggactcgtaccagaaacctcaaacagaacgtcccgcctgggccaaggccattgccaattattgggaatttctttgatctcccccccaaggggcagcccgagtatctgcactggttcaagcacaaagatgcctatggtcccgtcagttcgatcaatgtcatggggacaacgctcgtcatcttccatgacaaggacgcggcccacgcggtgatgggaaaaaaggcccaaaagacatccgcgagaccccagctcaactttgcccagctatgtgggttcgagaactttctcattacccatcagtacaatgacaagtaccgcctgcaccggaaaatggtgcaccaggagattgggacgaaagggctctctgctggtttccgccccgttcaggagcaagaatccattcggttcatcctacagacgttcaaccggccggacgacatcttgcagcacctgaaaacgtaa

SEQ ID NO: 6912 - DNA, 774 bp, A.fumigatus
gtgccctacgacgtggtaatatgtcttctacactgtctcatgggttgtaggttggctgccgccatcgttttgaaaattacctatggatactccattgagcgaaagggccaggacccgttggtcgagttgatcgaacacgccatggaaaacctgtcccaagcatttgtgcctctcgcttgggccgtggactccgtacctgcgatcaagtaccttccagactggttccccggcatgtcgtaccggaagacggcgcggaaatggagggctatcaatgaggccgctgcggaactcccttacgattttgttaaacgccagatggcgcacaaagcccaccagccgtcatacgtgtccaatcttctcgagaagcacatgatcaagtcggaggacaacaagatcaacgtttccgcggctgacgaagaggcgatcaagtggaccgccgtgagcctgtacgccgccggctcggacagtaccgtcgccatcatccacagcgtcatctgtggtcttgtcatgttccccgaggttgtgacaagggcgcaggaagaaatcgaccgagttgtcggctccgatcggctccccaactttgacgatcgaaccaacctgccttatgtcgacggcattatcaaggaagcctggcgatggaatcccgtgggacccatgggattgacgcacaagtccgaggaagatttagtgtgcggagaatatctcatccccaagggttcctatcttctgccttttctatggtggttcctgaacgaacccaaaaaagtccccaga

SEQ ID NO: 6913 - DNA, 606 bp, A.fumigatus
  unsure (597): Identity of nucleotide sequences at the above locations are unknown.
tatagcggcctaactcctatagctctctccggttctcccgctaacctgtatgccatctccgccgtcctcaacacacatgaccgtctgatgggcctggatctgccccatggtggccacctgtcacacggttaccaaacgcccaccaagaagatctctttcatctccaagtacttcgagaccctgccttaccgcttggatgaatccaccggcctcattgactacgatggagcggagaagctggctctgctctaccgacccaagctgatcatcgctgggacttcggcctacagccggcttatcgattacccccgcatgcgccagatcgctgatgccgctggtgcgtacttgttgagcgatatggcccacatttcgggcttagtagccgccggtgtgctgccgtcgcccttcccccactccgacattgtgacaaccacaacccacaagtctttgcgcggtcctcgcggtgccatgatcttctaccccaagggcgtccgccggacagacaagaagggcaacaaggagatgtacgacctcgagaatctcatcaacgcgtcggtcttccctggtgtcttcaccacggggctggaaggatgcacngctactcca

SEQ ID NO: 6914 - DNA, 270 bp, A.fumigatus
cgtgtacacatgattgcagaagctgggaaacctcacaatttggtctgctcagagtgtcgaagtccagatgatttgatgctctgcgagacttgttgtaggtcgtaccatgcgcgatgtctgccagatcctgctagacctgcttctacaggcaatttttattgtccttcttgcagagacaagcgatgggatctgacgccgcctctcatcaactcattggcggcttcaccagggtctctcggagcagcacacctgttccacccccgcctataa

SEQ ID NO: 6915 - DNA, 585 bp, A.fumigatus
tatcgcaggcgtcacaacgattcagtcgtcgtcttcgaccgagactcccagcagctggtactgcggaacgcttctgacagccatgcgggccttgaattgaccgactgtccgtattgccatcgaccgcttcgcgagagcaatgcaggtcaagaagggcaccatgctagtcctcagccagaatttgtcaacccggactactttcgcatgcttcataatagcttgcctagctccgcggactcgtcaacacccccatctcctcgtcggcgtttggttcaacctgctcttgccgatgggtccacgagcgagccaactccgtccataagtggaacgcaggggatatcctccgccgcatttacccagaattacttcaaaaagtttttcgttgaggagagaattctagggaaaggtggaaagggtgtggtgcttctcgtgaagcatgtgcttgatggtgtatcgttgggacactacgcttgcaaacgtgttccagttggtgacgatcacgaatggttggaaaaggttctgggcgaggtccaactattacatcttcagcccgtggcggcaaggtaccgcgctgaaccgcgctgc

SEQ ID NO: 6916 - DNA, 201 bp, A.fumigatus
atcgggcgtgacactcgtcaacacttctttcagttaggccatcgtgacaacgcaatggtcactgagttgatgctcaatgcatcgcggtccgatattattgatacccacaccctatataaatggaaattaacaaagcagatgagctatttccgtttactgtaccttggtaaagactgtagaagccaaatgggcagtacctaa

SEQ ID NO: 6917 - DNA, 204 bp, A.fumigatus
agctttaaccctgcagcacagggcaattacctaccattgtctctcacatacatgagaggcagaaaatgcaaaggtcaattcaatgtctatatgaacttgctgtatcccgcctctcttaatgacattctgtgccccgaatacctcgaaaccacctcgcaatctcacataggaaacatacacataagtgatatatccaggacatga

SEQ ID NO: 6918 - DNA, 1020 bp, A.fumigatus
  unsure (122),(124): Identity of nucleotide sequences at the above locations are unknown.
gaccgcgttcttcggtcgttcattggttgttacgttattatctgcccacttgccaagggtggagatcgctggatcctcaatttccggtggcccctgatctattcaaaagagacttgccgctntntcgggaccctgagaaaattgcgtcagtccaacatgtctctcttccgcaaatacagggctgccacggcgcaagtccgcagcttctcctcttccacctgccgtcgagtcggaccagagtctccaaatttcgtcgacgtccctcaaaccattcagcccgatttacgagtgaaaccccgagttaagggtacgctgcccgtccctcgagagctcttccctgcccgccgagtagacaagccctccgaagaatacattgctgctgcgacaccacttccgttgaaggatatcaaaatcgaccccaacgacccacacgctgaatacaaggattggaagcggcgaatggccgacatgaggcggcagaatcttcgggaaggtctcctcgaattgcacagccggaagcagcgtacggacaagttgatggcgtaccgcagcattcagagacagagaagacgcgaacaagttcttcggcagccggaaagagacgatgagcgcttgactcgtccctctattgtccaggagatgctgcctaaacgtactccggtgctgcccgatcccgacagagaagagcgccttgctcaagctcgcgcaaagttggagagcaagaaggttcgggatgagttagaacggcaggactcgttacaaacactctacatgaatgctcgtacttttatcaccaccgaggctcagcttgccgccgagatcgagaaggtgttccccgacggcgagaacgaggcgtggcgtagtgatcaccagcagggtgaaaatatttggaatcttggtgtgcctccgacagtgcaaaacattgtcaacgattcgaagaagagcgaagcagctcgttgggatcttatccagggaagagtcaagaagctgggagagcagattactggaggcaagatataa

SEQ ID NO: 6919 - DNA, 660 bp, A.fumigatus
ggcgcggtaacttactctgattcaatggaacagacatttgatcttcctgactctacagactggctggaaacgccgttgtcgctcgtctcgccgctggaatcctctctccgttgtcaagtctgcaaggactttttcgacaaccccgtcatcacctcgtgcagccatacgttctgttcgttatgtatacgacgatgtctaagtactgaaggcaaatgtccagcctgtcggagctcggatcaggagctcaagctgcggcgtaattgggcggttcaggagttagtggaagccttccaaaacgctcgtccgagcatgctcgagcttgcaaggaaggccgctaactcgcgtctggatggggggtatgttacgggtcaacctgcagcgaagaaacgtaaggtggatcaggaggatggtccggatgcgtctgggtctgaggggatacggacaaggtcacaaagcagaagagggaacagccaagctgagcctgttgtggtggatgcgatcgaagacgaccaggacagggaatatatcccgggtacgttatttactccacttaaacaagttcggctcggggtaagaagagccatggcgcctaatatgaacgtatttaaaaggacggtctggttgcatgccctaattggcggccggagaatggaaaacgaa

SEQ ID NO: 6920 - DNA, 999 bp, A.fumigatus
cccagcatgcgtttctcaacagtcctctcagctcttttgctatcaagcaccgcgctcgcaactccagcgcaggtatcctcacccgtagatgcttcatcacaggggagtgtagcagacgaacagtcggtagcgcagacaacagcagtagccgaggccactccggttgcacaacaaagtccgagccccaaccagcagaatgccaacgctgccaaccaggagcagagcgccaacgtcaacacccaggcagcaccagctcccccaaccagctccggccctcagcccactgaaaatgctgaaccctcgcccagcccttctgccagtcagaaggacagcaacccgctgaatatcctgtccaacctggttccaacgaacactgctggtgagcaagcccaaagtgtctctacagccatcactccaactgctgcttctgcggagagctcctctaactctgagaccgccacaaaagcagctgcgccaaccgctgccggtagtactggttcaggctcatcgtctggaggtgcgtcagacgggttttccggaaacatcttccaagatctgcagaatctgttacaaggcgtttcgggcctcttgtctcccaccttgctgaaggatatcgaatccttcttccaccacttcgcatacctgtttgacgacaagaccaccgaccagaccaagtctttgatcgataccggatacaacctcctcacccctgagctgaccaaggaagtgctgggcctcttgagtaacgccaacgccttgctcacgcccagcttcgtgaacgagacgcaagaactgatcggcgcagtcggcccgctacttacacctcaactgttcaagcagatctcgaccctgctgaacaatggcaacaacttgctgaccgctgacttcgtcaaggaagtcaatggtctgattggcaacgccaatactttgttgactcctgatttcgtcaaggagactcgcgtcttcaccacggggctggaaggatccgcggtggatcta

SEQ ID NO: 6921 - DNA, 345 bp, A.fumigatus
gaaacccgaaccataactgaaactgactctcacaggtatgatcgcacgccgccgtgctccgcaatcaaagccgtcactcagtgcagccaattcttccacgaggtcagcctcgacaagctcgaatcaggaacaacgtactattaccagattcctgccgccaacggcaccactcaatcggaagtgctgagcttcaagaccgctcatcgtgcgggagatcgccgtcccttcagtgtggccgtcctcaatgatatggggtacaccaatgcaggcggctcgttcaaacagcttgtcaaggccgccaacgagggtaccgcgtttgcctggcacggcggtgacctgaggtaa

SEQ ID NO: 6922 - DNA, 483 bp, A.fumigatus
tattttctcccttcgatcaatttgtcaacggtaactaaaaataatgatcaaatcagctacgccgatgattggtattcgggtatcctgccttgtgcagacgactggcccgtctgctacaatggcactagcacggagcttccagggggagggcctgtccccgatgagtacagaaagcctctgccagcgggtgagatccccaaccagggcggtccccagggaggcgatatgagtgtcctctacgagtccaactgggatctgtggcagcagtggctgggaaatgtcacgcggaagatcccctacatggttctccccggtaaccacgaggctgcatgcgccgagtttgatggccccggcaacgtgttgaccgcatatctaaacaacggcgtctccaacggcactgctcctaaggccaacttgacctactacacatgccctccgtcccaacggtatgatccaccccccgctgtctcccgcaccagctaa

SEQ ID NO: 6923 - DNA, 555 bp, A.fumigatus
cctactacacatgccctccgtcccaacggtatgatccaccccccgctgtctcccgcaccagctaacccggacaggaacttcaccgcgtaccagcaccgcttccgcatgcctgggcccgaaaccggtggcgtcggcaacttctggtactcgttcgactatggcctcgctcacttcatctccatggacggcgagaccgacttcgccaacagcccccagtggccgttcgcggcggatatcaagggcaacgagacacacccgacagcctcagagacccacatcaccgacagcggcccttttggcgccgtcgacggcagctacaaggagaccaagtcctacgcgcaatacaagtggctgaagaaagatctcgccagcgtcgaccgcaagaagaccccctgggtgtttgtcatgagccaccggcccatgtacagctccgcgtactcgagctaccagaagaacctccgtgctgcgttcgagcgattgttcctgcagttcggtgttgatgcttatctctctgggtatggtgcatgtttccttcgccgggaacgcagatactaa

SEQ ID NO: 6924 - DNA, 228 bp, A.fumigatus
  unsure (9): Identity of nucleotide sequences at the above locations are unknown.
catcctgcngtgaagcctgcgacggcgaaccccaagaacaatgtcaatgtaatctcgctgtcctatttgccggatggcatgcacgttcacttccagacaccgttcggattgggtgtgaggccttccgttaaatggggcaaggatcccaagcacttcgatcgagtcgctcatgggtatacccacacgtatgttcttgcctcggaattaggaaacccgaaccataactga

SEQ ID NO: 6925 - DNA, 342 bp, A.fumigatus
tgcagtcacatccactggtacgagcgcctgtatcccctcggcgccaacggcaccatcgattcggcgtcgattgtcaacaatcacacctaccgcaccaacccgggcaaatccatcacccacatcatcaacggaatggctggtaacattgagagccacagtgagttcggcaagggccagggcctccagaatatcactgctttgctggacaccacgcactttggtatcagtaagcttactgtgctgagtgagaaggaggttaagtgggagtttatccgcggtgatgggtctgttggtgactatttgaccctgcgtaaggagaagacacaatctaaggaaaaatag

SEQ ID NO: 6926 - DNA, 708 bp, A.fumigatus
  unsure (9),(41),(69),(78),(91): Identity of nucleotide sequences at the above locations are unknown.
ttcaggggngaggatgttcatcgccacaatatcactttcgnacagcgacccctgagcttgtcattttcntatgtgccncaggcaccgatcntgccccagacccagcaactgaccccggcttatgattcgggcgacatggctttaggccctgcccttacttttttcaccttgtttgataagctggtgattgtccctcagggaaccttctcttcgaatgctgcatcgaagcgttccgtctcagagcgggacgtgatggctgaatcgttccatcggaaacaggcagtgcaagcaggcgatcgaccctggttttgttggtggaatggcactatgatggaattctttttgtatacgaatcagacatccaagcatgctcggcagacctcgacagcttcatccgcaccaaccgaaacgtcgccgccacagaatgggaagagaggcctggcacctcttgattccttatttgactatccccgccggatcaaaatccaggagaagcgaaaccaccctggctcccgaccgccctactgccagcagatgaaagtgttggacgacggatcgatagcaacggcttcccccgagacaattgagattaaagaagtggaaccgacaccgacaaccaccctcaagggctctggcagtgccactcaaacttacacagccaaggcacaatatgaaagcgtgtgctactgcgcatcattgaccgattag

SEQ ID NO: 6927 - DNA, 1326 bp, A.fumigatus
accaccgaacagccagagctcgaagccatgatttcagacatcgccatgcgaatcaactcgatgcactcaacgcttgctcatcaaccactagtattcctcaaacaagatcttgctttcccgcaatacttggctttgatctcagtggcggatgccttgatgatcaccagtttgcgtgaagggatgaatctgaccagtcatgaattcgtgtactgccaagacggaaaatacggaaacaagaagtatggatctctcattctgagcgagttcactggaagtgcgtcggtttttggcaaccacgcgctgcttgtcaacccctgggactaccggcaatgtgcggaggccgtccatactgcgctgaccaggagcgaggcggatcgtcaacgggtgtgggagcagcttcgccgggctgtccttcagaactctacaggaaattgggtgaaatccttcaatgagagattgcaacgtgtctggaatgaacagtcttcgcgcgagatcatggctgttccacgcttgcctgttaataaagtggaggagatgtaccgaaaagccgctcgccgattgatcattgtagactacgagggcactcttgcgtcatggggttctcccaagagcatcattgtcacgactccacagcgagcgattgtcacgttgacggatttgactgaggacagtaagaatgtggtttatgtcatgagttcacgaatgcccgaagagatggaacgtctgttccgacgcgttcctggcctcgggctgatcgcagagaatggttgcttcgtgcgagagccgaacactgaagaatggctcaagttgaccaacaaggagcggacagatgcctggaaggaaggcgtcagccagattctcagctactatcaggaacgagcggagggcagctggattgagaaacgccactgttccctcgtgttccactatggctcggcggaagacaacgaagctgcctctcggctggcatctgagtgtgcaggtcatatcaacgatgcatgcgccagtcagggggtacatgccgttctcattgaccgtgcactcgtggtaggaccagcaaatacgaacaaggcctcggcggcggaattagtatggcgggactgcctcaatgcgagccaaaaggacgagcagattgctcgaccggactttctgttggccattggagacggtcgagacgacgagccagtgttccgatgggctaacaagctggaaagtgcaaaggcagttggctatgcgatgacagtcactctggggtctcgcagcacagaggccaaagccactttgacgcagggagtgactggtaagttgtttgtcgtgccatactag

SEQ ID NO: 6928 - DNA, 600 bp, A.fumigatus
  unsure (587): Identity of nucleotide sequences at the above locations are unknown.
actgggataccgcctatcgcatcgcctctcatgggtcatcttttgcaacatggaagggcgactgtgaggcggttgagcagacgaacaagtcggtcacaacgattacaattaagacaccactccaaggcatcacctaatcctgtccctgagaagaacagcacatcagcaaacgcttcccgatcgggtgctacaccctcatgcacatcgccatgctccccaaataccagttcgcccacaaacacacctttagctgcctccacccccgcccgatcaagtccgagaacgttcttccaggccatccaggcaggaccaattggcagattggcagactcatacgccagagtacaacaaaggagaccttatgcgacgcaggttgtcagctctattgtggtatatctctgcggcgacctaagtgcgcagttgctgttcccctccgagagcccggcgcaaacttcacgggttgcgtctgaagagaagcctgcggactcggctgaagatggtgagggtaaggctgcttcgagtgggggttatgatcctttgagaactatgcgacatttgacggttggcgtgggatccgccattccgtncctacactggtga

SEQ ID NO: 6929 - DNA, 195 bp, A.fumigatus
gcacagctatcctgtttgtcattatcacggcatctgttattatatatatactctaagaaatatggtagattgaacgccatcagaatgcaattagtctaccagcgtaccggcatattcggtctccctcatgcccctccaagcctgttttcctgccagatcaggccattgcacgagaaatcgatcagcaaaaggtaa

SEQ ID NO: 6930 - DNA, 183 bp, A.fumigatus
cgggtatttagaggattgggagctctagtggctcaaaagtacgctgctgaagggtgtaacgttgcgatcaactacctatcgagtaaagacgttgcggaggagcttgcatccagcctacggactcagtacggcgtcaacgcggtcactgttcaaggtgtaagtcatgctcgcctgctgtggtag

SEQ ID NO: 6931 - DNA, 855 bp, A.fumigatus
gagaacacttctctttccttccttctggcggcgtgctcaagacctacttttcagctcggcactggtgctctatcaatatcgcaaaacttcagagttcggaagtggcgacgaaagaatagcccaactcatcttctcgttgttttaggcagcggcggacatactgcggagatgttctccatgttgcggcgtatgaaactcgacccctcgacatatacgtaccgcacctacgtcgtcagctcgggagacaattttagcgctgcgagggctgtggagtttgagacagaatggctgaagcaaagtccaaaactatcatttcctgccaatggcagcaactccacagagtcctacgcagtcgtcacggttcctcgcgcgcgccgtgtgcaccagtcttacctgactgctcctctttcaacccttcaatgtttctatgcttgctttcttgtactctgcggccgtcatcccgagcaaaagtcgccgcttccgacaacgaactcgccatacccggacgttatccttaccaacggtccagcgactgcagtctgtatggttttggctgccaaatctttgcgactgtttcactatctgaagtcacttttttatatcaaggaccaccaagacagggatagctcgagatcatctcaagtgaagagatcagaggatgccccggcaccagttcacttccagctgcgtaccatttacgtagagtcatgggcacgggtcacaacatttagtctaagcgggaaactgttgttaccttttgctgatcgatttctcgtgcaatggcctgatctggcaggaaaacaggcttggaggggcatgagggagaccgaatatgccggtacgctggtagactaa

SEQ ID NO: 6932 - DNA, 216 bp, A.fumigatus
cgcctcgtcggccaaacgagcacacccagcgtcctctttcacaacaacttgagtttgggaaaccttctcctctcggcccatatcaacgtccaaacccgccccaccagcaacagccgaaccatcctttcaatatcccaaaaccgaaccgggctcgacctgaacatcacagacctgcaccgcagtcaaggtcatacaatgctcctcaccctggtataa

SEQ ID NO: 6933 - DNA, 1200 bp, A.fumigatus
caactgctatttacatctgacggaattcagagagacattcatagataccactcgatggctaaagaaagcgacgcgccgccgtcgtatccaatgacgcctcgtcggccaaacgagcacacccagcgtcctctttcacaacaacttgagtttgggaaaccttctcctctcggcccatatcaacgtccaaacccgccccaccagcaacagccgaaccatcctttcaatatcccaaaaccgaaccgggctcgacctgaacatcacagacctgcaccgcagtcaaggtcatacaatgctcctcaccctggtataagccatcagggtcacagaccaactggtggctcgagtagccttgtagcatccacaccgaagcgcagcgagccgttcgatcctttcaagcctgttcgaccttcggcgtataacaactaccgaaactcccgtccggtcaacaacgatgttgtggagattcgccgtccggagaatgtcaccttcaccacgccgcgagctccgaagactttctatgcatcttcagccataaaaatggacaaagcatccaaaaatctcagcaacttcgttgatcttacccgcgaaggagggttcacacccagcactaggcctcgcaatgccgggttcgggtcaatggacgccaacggctatgttgatcctgtcaaagccaacgaaaacataaaagctctgcttgaaggggcttttacaagtgacgatgacaaacaaggatcaagggcaaagaaccggaagaagagtaagaaccggaggaagaagaagaaggaggccaaggaaaaaaagaagcagggcacttctgaaattgacgacctagcctctcagcttgaagaagtcacagtcaacgagtcaagcgctgctactgagaaaagtgaactggacgagctgaaggcagaaggcaatgttggggaaaccaaggatgacgagaagtcatctgaagatgaagtcgaagacgatgagaatgactatgaagaagatgatgaggaagtagaagagggggaagacgaggaagaagatgatgggacagtcgaaggcttgaaagtcaagctactccctcaccaaagggaaggagtgaattggatgtgtgacaaagagagaggctcaggtaacgccaaaggagtgcttcctaaggggcactcgtcttcaccaagagccggaaggaccgcgcaagcgttaccgccgcac

SEQ ID NO: 6934 - DNA, 252 bp, A.fumigatus
gcacaggcggtattgctgtgtttcctgaagtatatactcctgatcaatatgtcggagtgtcaatgtgtgactgagggtcttctgtatatagcatccgctccgtttaccactttccataaagcccaacctgtttctaatcaaagcaacattggcttgactagcggactagatagtctgcttggtagtttgcttgcagttgagacagaaggatggaccggccccttttccatcagatccaggcctaatgattag

SEQ ID NO: 6935 - DNA, 411 bp, A.fumigatus
gctcaattcaggaaagagaccgagcacatgttctaccatggattcgagaattatatgaaatacgcgtttccagaagacgaattgcgtcccttatcctgtcgtccgcttgttcgcgatcgtgataacccctcgaatgctgagctcaacgacgtcctgggaaattactcccttaccctgatcgacagcctgtcctcgttggcgatattgtcgtctagtccggatgaaggcgagagagcttggaaccacttccaagacggggtgagggatttcgttaagctatacggggacggctcggatggccctgctggtcagggtgaacgggcacggggattcgatcttgacagcaaagtacaagtcttcgaaactgtcattcgagggctaggtacgcggcttcttttctgtcaatgttga

SEQ ID NO: 6936 - DNA, 804 bp, A.fumigatus
gttgaatacacactgtcgaactctttgcaatatattgcactttccaacttgcaggccgcaaacttccaggtgatgtaccagttgaaactcctcgtcggctccatttgtggccttgttctcctgaagagagctataccgctgcgtaaatggggtttcctgattcttcttctcgtcggcgtctatcttgtgcaaatgccagatggagccaccgatgaaatctcacttgatcacgaggccgtgcatcactctttcccccgctcattcgcagaatggaaagctgttataggaaaacgagccaatttgcacaagcgttcagcaacctacgagggcatcgaagaggacctattgacggctatgccgcgattgaacagcacagttggtctgctggccacgattggggcctgcgtcgcttcggggctcgccggggtatactttgaaaaagtactaaaagacagcgtaaattccacctctttgtgggtgcgtaatgtgcagttgtccgtatattctttgttcccagccctcttcatcggtgtcgtcttcctcgatggggaaaaggtcgccgcaaacggcttctttgagggctataattgggttgtttggtccactatcatggttcaggctattgggggaatcacgacctctttctgtatcagccatgcatacaaggacgcaagaaacgtggccactgctattagcattgttctcagcactttggggagtatgtggttgtttggtttcgaactcacagggaacgtatgtatctcactcaatcacgaacttctgcacatggttactgatgtttga

SEQ ID NO: 6937 - DNA, 207 bp, A.fumigatus
tctatagtacctatttatattatagatattcttagaaatatttatataggtactagttatagttatatttcctatagtacagccctagtagcctttttcctaatacctttcttaacttatagtagtatttattcatctattattgacacttctaataatatactgcgtagatcttatagtgtattatatattatttctataacttag

SEQ ID NO: 6938 - DNA, 279 bp, A.fumigatus
ctcaatcaggcctttgagaagctggaccaggagaagaacaacaccccagaaaaggcctcgccttctcatggagccactgtgaaggaggcaaccccaacgtcgcagcccatcccatcaggcactcgcaccacggtgcagacccccgcctctgccagcagctctaccgctgctgctccgaagaaaaagcagagcagcactaacatgctctcgcacattcccatcattggcggtgtgctgggaggtggtgagggtctgggaagccttctgccaagtcggtag

SEQ ID NO: 6939 - DNA, 306 bp, A.fumigatus
tcagaataccaccacttctcatccaaaatggctcgtttcaacttgtctttccttgctctctgcttcttcctggcccttgtggtctcggcgttgcccgccaagcctggcgacgatgacttggatgctggtgatgccgttgcagcagctctcagcgctctcaaggttcgtatttctgctcctaacatcattctctgcaagctgttcaagtcagacgcacaaactaactcaatcaggcctttgagaagctggaccaggagaagaacaacaccccagaaaaggcctcgccttctcatggagccactgtga

SEQ ID NO: 6940 - DNA, 183 bp, A.fumigatus
gacacgggaacgagctcacaagaagagtatacgccccgcagtagactgcagaaatggttctacgagactacgcagaatggtatggtcgggtatgcatatatctccacatgtgagcctgcgtatttcggagcgactggatcaatctgcgggcaacctaagcaggatgaagacaagaaagggtga

SEQ ID NO: 6941 - DNA, 795 bp, A.fumigatus
  unsure (167): Identity of nucleotide sequences at the above locations are unknown.
agtcactatagatgtgtgcttgtgaatcaactattctccttgaagagtctaccctggatcgccttctcaaacaagctaggatacttgagtgaaggaaaggataccgatggaatactgtccatattgcaaagcaaattcatgtttgcttgctatatttccacgactcntatagtgggttggctggtcaattttgtggctgggttcataggaccacgcttagattccattttcccaaaagctgcacaggaactgcagtcgcgccgtcacaacgaaaaagcctcacaccgggatttccttgctcactttatggatgcctctcaaaagaacccggagactctcgaggagagaggagttctgggagcaaccatatcaactatcttcgctggcactgacacgactggtacaagcctaactttcttcatgtactatctcatcaaacatccagccgcccttgcacgtttacgggaagagctggactcggccgtccgctctggcaacctcagctatccacccaaatgggcagaggtgtccacccttaaatatcttcaggcggtattcaaggaaaccctaagattacacagcactgcacgcatgtctctgtaccgtgttgtcggccccgaggggctggacttgtgtggtgagcgtcttccttctgggaccaatctcggatgctttggttatacagcacaccgcaatgaacccatctacggacgtgatgcggcgctgttccgaccagaaagatggattgaggcatcgaatgatgcactgctttccatggaacgggcgagcctttga

SEQ ID NO: 6942 - DNA, 240 bp, A.fumigatus
gtgttgaatgagaatactgagccggcaacagctgcacgatggaactttatcaacttccagaccccgtcatactctgctgtgatgatggaatacaccacaccgccatcgtacggctcgacggtcgtcaatgttcgtggcatcgtgaaagacgatgagattatctatgccggcgcaacgaactcggctacccacaccgcgtcgggccatgacgccgacagccactggcctgctccgacttcc

SEQ ID NO: 6943 - DNA, 261 bp, A.fumigatus
tgtatagtgtcgaccgtactgattgaccatgctttaattagccttgcaagtgttgcgggcactcaggagcccatctatggccccgaggccattcagtctgtcgcccaacaagctcagcagaccccttataccgagttgaccaaggacgacctgcggtggcgtgcctatcagtataccaatgttgagactgagaccttctacgtgatggccgacaatggcactgtggtgatggtgcaggtcatctactccaacatcgcgtga

SEQ ID NO: 6944 - DNA, 468 bp, A.fumigatus
cacttgtgtagaggaatccacactactgcgcaattcaactcaaagatctttaacctcaaaggcgatcaacctcacatctggcactccgaccccctgtacaacttcatgttcgatgagaacatgctctcctttggagctgacaacctcgccttgacactgaacgaggagggaactgcgtacaccatcaaatccgccgtcaacgaggacagcctggtgaatctgacgttcacccgcaccgcccccggttttgtcgtaggaaaggacggtacatcttacttcgggaccgaccccgcgaacccctgggggtctatgatgcatgccttctggcctcggtgccgtgttgagggcaccatcacgacgaaagagaagacctatgacctcactggtcggggaatgttcattcatgctatccagggcatgaagccccatcacgctggtgggtttccttcaccgagtattaagtgttga

SEQ ID NO: 6945 - DNA, 279 bp, A.fumigatus
  unsure (59),(194),(197),(227): Identity of nucleotide sequences at the above locations are unknown.
gagttcaatgccagaaccgcgcacatcaaccccggagtccccattcccgcacgagtcancgttcgtcctgaccgatcctttactttcgatattcgaacccccacgacgacatatctcctcctgcaggctgcgaacgtggagcctcgcaagaaccgcatccgggggagccatgagaacaggccacgagatcatcngcnaaagtgtcccctgaagcatgttgtaccaanatcccccaagatccagccgttccgagaacgagattatcggggggttgagttt

SEQ ID NO: 6946 - DNA, 537 bp, A.fumigatus
  unsure (385),(520),(523): Identity of nucleotide sequences at the above locations are unknown.
atccgaacaaaactcgggccgcaaatagttggcagatcacttcatttgtgtatacagacataccatattttcgtctctttgcagacacaccttacaatggcgaagaaggcattggccaaagatcagattgttaagctcattgtcggagctggacaggccagtcccagtcccccagtcggtccagccctgggtagcaagggtgtcaagagtatggatttctgcaaggtacgctcctctcttcaacatctgttttctgctttaagacggatctggaccgaaaggttgagctcgataatcttgctaaaccattacgcgccccaatataggagttcaatgccagaaccgcgcacatcaaccccggagtccccattcccgcacgagtcancgttcgtcctgaccgatcctttactttcgatattcgaacccccacgacgacatatctcctcctgcaggctgcgaacgtggagcctcgcaagaaccgcatccgggggagccatgagaacaggccacgagatcatcngcnaaagtgtcccctga

SEQ ID NO: 6947 - DNA, 258 bp, A.fumigatus
cgagttgtctttctggtatatcatatggctgacgcgattcaagagtcgccgaagagctatctcagcaaggaaataccacagttcctcgcggcctaccgagccctccaccaagctgctttgacgatcttcattgtcagcttcatcatcttcttcgtcctcctcctcctcgaagccaccgggaaggtcgacaacttcttcgaagtgcacaatgcccgagtgaggcagatccaactctgccagcaagtcgctctcatataa

SEQ ID NO: 6948 - DNA, 195 bp, A.fumigatus
tggtgttcgagcctcaccgtattttactgcttgttcaccatccactgcctcagccctccagctcgtgctattttaactcccctgccctctgatgtcctcctttctacactgaaacacctctctcatattaagttctcattagaatttcaaatggaactgtccctccccttccccgctgaagtcactaatgcatga

SEQ ID NO: 6949 - DNA, 216 bp, A.fumigatus
actcgatcaatctctaaccactatcatcttgttctcctcgtgcatcacgccgcaatagaaggaaattttactggtcattggaatcgtacttccaaccacatccaaaccagctacgttaggaagcctgcgtcatctctaacagagcgccttcccctacatcaatatatcaatatgagcctatcatacacgtatataccgaaaagtgcgaccatgtag

SEQ ID NO: 6950 - DNA, 204 bp, A.fumigatus
  unsure (150),(186),(194): Identity of nucleotide sequences at the above locations are unknown.
aggggaggggaaggtttcatgaagatcagtggcagaagtgcgggtgacttggctatcaacacaggcctacgggtgatgcaagcgaaagctactccccgccatccaagatcatctcaattctatctctaccacgaaggccgcacgactganacgaagagttataatagacatggctggataggactngttactangggttcttga

SEQ ID NO: 6951 - DNA, 249 bp, A.fumigatus
tttgatccttccgcgtgcgcccgcgagggccctgcggattttgatatatacaacatggagacgatctccaggatttcctctatgctggaaacaggtaacattctctccgacgttatcttccgccctccattactgatcgttgtctggaacagctcgagaactaaccatggaggcagctcagtcggcagcttttacgagagggtcgagtacaggctttgtgtcgcgcaatcacagtacttctcacactaa

SEQ ID NO: 6952 - DNA, 789 bp, A.fumigatus
ttgatgtattcgtccgagccttcccttccgttcttctcatatgtcgtcaagaacgtcgcaaacacgaatatcgaagtgaagaaattggtttacatatacctggttcatcatgcggagaccgagccagaccttgcgcttctgtcaatcaacacgatccaaaaatcgcttacagatcaaaatcctcaagtgcgagcaatggctttgcgtacaatgtctgggatcagagtgccggtcatcagccagatcgtctcgcttgcgatcaaacgaggttgtggtgacatgagcccgcatgtccgtaaagctgccgcattagccatacctaagtgttatcgccttgacccaaatacgctacctcagctggtcggctatttgtctactttactaggtgacactcagtactttgttgctgggcccgctgtggccgcatttctcgagatttgtcccgatcggattgatctcattcataagcactatcggagcttggtcaagaagcttgtggatatggatgaatggggccagctagcgacgttgcgtcttttgacgttttacgcgcgaaaatgcttcccccggaagactcagaagatgaagagcgcagtctccagaggattctacgacgacgaacaaggtggtgaaactcagggtgatggcgaggaatacgagatgcctgtgatagaccccgatttggagcttctattccggtcttgcaggttgcttttacataaccgcaattccgccgttatcgtcagcgttgtccgttgtcttcaccagcggggtcgaaggacaagcgta

SEQ ID NO: 6953 - DNA, 966 bp, A.fumigatus
  unsure (383),(384),(500): Identity of nucleotide sequences at the above locations are unknown.
aacgagaaagggagggtggaatggtatcgcacgctccacccgcagagaagaaaaaaaagaatgaaggcatccgcgaagatagaactgaagagggggtgttttttgctcccatctgaaatatttttgccggaggcgcagaaaatatcccggacggacagggagagagttattataagggaagttcttttccggagggagattttttattgtggcattggatatgggggattcccgacccaagaaaacaaacagttttttaagggggagagggtgtccacacttgttttttggacgctcaattcgggttggaaaagaaaagtgtttttggaaggaagtatgcgggagtcatcagagaggttgaagatggacgtgatcggtttgtnngaatctgacacccagcgcattatcatgggtaatcgtgacattagtcaagttttggctgaagaattgggcatgtatgcagattttggacctgttcccaacaagcatacatggggcgntgttatactttcaaagttccccatcgtcaactcaacccaccatcttcttccctcgcccgtcggcgaacttgcacccgctattcacgcaactctggatatgtatggtgagctggtggacgtcgttgtcttccattctggacaggaggaagaccccgaagaccggcgcctacagtcccagtatctggcaaaactcatgggcgaatcgcctcgtccgatggttttgctgagttatctggtcaccaaaccccttgaaggcaactacaacacgtatgtcagcgagctcagtggcatgaaggacatagaccctaccgactgggaccggtggtgcgaatacattctctacaagagattgaagcggacaggctacgcgcgaatcagccgggatagtattactgatactgaaattcaggtgagtatctatgataatagtccatcaggctatgtatatgctgatctgctcaattag

SEQ ID NO: 6954 - DNA, 351 bp, A.fumigatus
aaaatctccctccggaaaagaacttcccttataataactctctccctgtccgtccgggatattttctgcgcctccggcaaaaatatttcagatgggagcaaaaaacaccccctcttcagttctatcttcgcggatgccttcattcttttttttcttctctgcgggtggagcgtgcgataccattccaccctccctttctcgttctataaacactctctgtttctttctgcgcccccttttctcttctttgcttggcatacgtcaatattccatgtcgccgtccctgctacatctacttatatctctcccatccctatgtctcatcgtctctcttctcttacattatactac

SEQ ID NO: 6955 - DNA, 288 bp, A.fumigatus
aggtattatggtccttttttgtctcagagcaagctctctgtagctaatctaatgataatagcatttcctttctcaacatacctgtcgattattgacaaaaagacctcacttcccgtccgatccgtcttcacgaccagtgggtttctcgtcctcctcggtttgatcaacattggttcgaccaccgctttcaacgcaatcctgtcactcgcggtgcttggcctgcacatgtcttatttgatcccgaccggattcatgctctggcgtcggcattgtcaccagggcgacgtt

SEQ ID NO: 6956 - DNA, 411 bp, A.fumigatus
ttcaaaattgccctgttaccaggtacatttggatgggtggccttcacagccagtgcaccatttctagccgcaacaatgatccagggattggtcgtgcttaactatgaagaatatcaggccaaaagatggcatggtacgctcatctattgggcacttctggccatatcagccgttgttaatatctggggtgcccggctgatatccctgatcgagaatgcatcttcactcatccatcttgcggcatttattgctgagttcgttgtgatttgggtctgcgcaccgacgaagcactccgctagtttcgtctttactcttttccggaatgagtcaggatggtctagcaacggggtggcatggtctataggtatgctctcgagctgctatgtcttggccggtgagtactcctcctaa

SEQ ID NO: 6957 - DNA, 363 bp, A.fumigatus
ggctatgatggggccattcacctttccgaagaaatgacgaacgctgaggtggcggttccgtggtgcatgctgggctcgctagcaatcaatggaatgctcggcttcgcattcctgcttaccgtcttattctgtatgggagacttcgaagcggcactcaacactgccacagggttcccgatcatccagatattctacaatattactggaagtgccgcgggcagtgcagcgatgaccagcatgctaataatcatggcgggattggccaccatcccattgacagcgtcaacggcgcggatgttatggtctctcactcgtgatagaggtattatggtccttttttgtctcagagcaagctctctgtag

SEQ ID NO: 6958 - DNA, 300 bp, A.fumigatus
accatcggacacgacgagtatggcagcaccatcgccatccattctctcgctgtacttccggaataccagggcaagcaagtcggaagcactttgatgaagtcatatatccagcggattagggaagccgcgatcgcagagcgcatctccatcattgcgcatgaccatctggtgcccttttaccagtcttttgggttcgagaaccgtggtcccagcaagtgtcagtttggcggtggcggatggactgacctggtgagttccttcttgaccgattacaaggtgtatggcctcctcggactgtga

SEQ ID NO: 6959 - DNA, 342 bp, A.fumigatus
atcccacctgtgccaacgaaccaggagttcttggatatcgttctcagtcgcacgcagagacagctccctacacagatccgtgcgggtttcaagatcagtcgtattagaggtatggccgatgccgccgagttttgcgtggatttgcgaacggataccatgtccgttcaatttcctgccctcttaagaagagcagtgacactaaccaaaattctctgtgcaacaacaggtttctacactcggaaggtcaaatacacccaggaaacattctgcgaaaagttccaggcaattctcgatggattccccagattgcaggatattcatcctttccgtatgctcttttga

SEQ ID NO: 6960 - DNA, 414 bp, A.fumigatus
catccctcagacaaggatttgatgaacaccctttatgacgccgaccacttcagaatcgctctcggccaggtgtcgaccgccaagcatctcatcgaaaccgtgtctcgcgactatgtccgtctcatcaagtatgctcagtctctgtttcagtgcaagcagctcaagcgtgccgccttgggtcgtatggccaccatttgcagacgtctgaaggatccccttgtctatctggagcaggttcggcagcatctgggccgtctcccctccattgaccccaacacccgtactcttctgatctgtggataccccaatgtcggaaagtccagcttcttgcgcagcatcacccgtgccgatgttgatgtccagccttatgctttcaccacgaagagtttgttcgtcggccatttcgagtcttaa

SEQ ID NO: 6961 - DNA, 789 bp, A.fumigatus
cttctcggacatggactcaactccaaccaatttcatgtccgctgtgcggacgtctgcgtaagaatgttttctgcctttttggtttctggacggtactcatttgatcatagtctctacttcatatacattggtgtcatccgtctcctggcgacctacctctatgccgctctctttacctacgtcgcataccatctaacccgcaatatccgacggaactacctacgtgctgcattcagtcaggaaatcagctattacgatcagggcaccagcggctctatatctcagcaagcaaccacaaacggcaaccttatccaatctggcattgccgagaaacttggtattgtcatccaagccgtctccacctttgtggcggctttggtgatcgcgttcgtcacacaatggaagctgacattaatcctgatttttatggtgccgactctgcttatagtgcttggaacagctggtggaattgacgccatgattgagaccaagatcttgcagatccatgcccaagccgggagctatgctgagagtgtcctcgggggcgtccggacagttcaggcctttagccttcgacccagagtgatagccaaatttgactcttacctacaggaggcatactcccaggggatgagaaagaataaattgtacggtatcgtgtttggagggcagtacttcgttgtccacgctggcatggggcttgccttctggcagggcatcgccatgctcgaccgtggtgagattcccgatttacgaacagtctttgtgtcagtatcacatactcgagag

SEQ ID NO: 6962 - DNA, 228 bp, A.fumigatus
tggctgatgagcagggacgacctctcgcagagagttttcacctttggcgatactaaactctatcttctcgaatgcattgccttcatagcggctattgcatctggtacagctctcgccatggtcaacctggtcatgggacagttcttgacactgctgagcgattttagcttctcggacatggactcaactccaaccaatttcatgtccgctgtgcggacgtctgcgtaa

SEQ ID NO: 6963 - DNA, 525 bp, A.fumigatus
agttcatcatccgatgttttgaattatattatcccgagtcgttgggtgttttacttatccacaatgccccccgtatttttgcaggtgtgtttgccctattcgtgtcctctgtcgctcactactaactgtacggatgcaggaatatggaagattatcaagggttggattaacccagacatggtgacaaaaatccacttcaccaagtcggtggcagatctcgcacagttcattcatcccagtcagattgtgagcgagctcggaggtgacgaggactgggagtatgaatattctcagcctgaaatggatgagaacggattgatggaggacgacgaagctcggaataccttgctgagtgagcgacagcagatcagcgaggaatttctttcccttacgtcccagtggatcgaggcgacaagacacaactatcctgaggaggttgcgatggttcagtcgcgccgtttcaacgttatggaaaaacttcgcgtaaattactggaaactggaaccttttgtccgagcccggtaa

SEQ ID NO: 6964 - DNA, 870 bp, A.fumigatus
ttgttctgccctcaaatggttcccgacccaaacaatatccctctggggtttctgggaaatctgtcgacggaacaggagcgatgcttgcagcaactctggtccttggttctgtaccttgaaaatgccgcctcttttaacgacctcgaacatctcttcggggtcaacagcgtcgaaaggaataaatcaatttccatttcgtcgtttgcgcgccgaaactcgctgctgacccggacggattccatcctgttgcgccgcagcagcacagcgtccttcccggcaccttccaacccgctactccagaccctgagcaatatcggaatgaccgcatctgagatccgctctgtagcaaagtccttgacctacctgagtccagacgatgtccgctggggcatactcaccgcgagcaaacaggaatatccggatcgctggatgcttcgatacctgcgtttctgcaagtggaatgtcaacaaggctttcattctgattctgaacgcgttgcagtggcgaatcaaggacatgcatgtggatgaccgtctactgccagagggtgagctcggtgcgattcaccagtcacaggcacccttgaatgctgccgaagcgcaacaatcacggggctttctcagtcagttacaaatgggaaaatgttatgtgcatggagtcgaccgactgaatcggccattgtgtgtgatacgggtgcggctgcatcgacccgaggatcaatcggaagaggcgatgaaccgatacatcacacatattatggagtcggtccggcttctcattgcaccccctgtagagacagcagtatgtactcctcgcaggcggagaaggtggatcgcgttactgactcccgctgtagactgtcatttttga

SEQ ID NO: 6965 - DNA, 234 bp, A.fumigatus
actgtcatttttgatatgactgggttttctctcgcaaatatggtgagttcagtttatggttggggaggttacctgctgatgttttatatacaggactatgccctcgtaaagttcatcatccgatgttttgaattatattatcccgagtcgttgggtgttttacttatccacaatgccccccgtatttttgcaggtgtgtttgccctattcgtgtcctctgtcgctcactactaa

SEQ ID NO: 6966 - DNA, 219 bp, A.fumigatus
tactcaagtactgctgcccactccacaataatatttattaagaaactccaaaacctgagctgcattgtcaatacatacacttctttccgtgatttactaggtcagactgtcaatcccttatgggccaatctcaatctacaaattcccaggataatgcacattccactgaacctttgtccaaagggaggaaagaagattattatgaactcctggggatag

SEQ ID NO: 6967 - DNA, 762 bp, A.fumigatus
cattattctcttcgaatctcattaagaataaggaaagcatacaaaagaaaagctctcgagctgcacccagataaaaactatggaaatgtcgaagctgcaacgaaaatgttcgcagaaatccaaactgcatatcaagttctttcagatcctcaggagcgctcatggtatgatactcacaaagatgcgtttttgagtcgcgatgagcaaccaagtagtagcgaatactgctatgatagccgtatgacaacctctggtgacattttaaaactgttctccaagttcagtcctcgaatggaattctcagattctccatctggattcttcggcggccttcgagagatatttgcccggcttgctctcgaggaagaaatggcatgtcgcgcagacatgttggagtttgttggctacccaacctttgggtcacaatgtgacacttttgaagacgtcgtacgccccttctatagtgtctggagtagcttttcaaccaagaaatctttcgcctggaaagatatttaccggtattccgatgctccagatcgtcgcgtgcgcagattgatggagaaagaaaataagcggttgagagaggaaggtatccgcgaattcaacgaagctgtcagatcgcttgtagcctttgttaaaaagaaggacccgcgctataagagaggcacccaaagcgaagcgcagcgccggggagctcctccgtccaactgccgctgcacaagctgctatatcaagaacagtaaatcaagcaaagctgcgtga

SEQ ID NO: 6968 - DNA, 459 bp, A.fumigatus
tcaaataggtacttcgtcaagatcaccggtaaggaaggtttccacctgcgtgtgcgtgtgcaccccttccacgtcatccgtatcaacaagatgttgtcctgcgccggagccgatcgtctccagactggtatgcgtggtgccttcggtaagccccagggtaccgttgcccgtgtgaacatcggccagatcatcctgtccgtccgcacccgtgactccaaccgcgccgccgccatcgaggctctgcgccgtgccatgtacaagttccccggccgccaaaagatcatcgtctccaagaactggggcttcacccccgtccgtcgcgaggactacatccagctccgcaacgagggcaagctcaagcaggatggtgcctacgttcagttcctgcgtggccacggtctgatcgaggagaacatgaagcgcttccctagcgcctacgagaacctgtctcaggcttag

SEQ ID NO: 6969 - DNA, 267 bp, A.fumigatus
  unsure (29),(56),(69),(70),(75),(89),(92),(109),(135),(143),(206),(264): Identity of nucleotide sequences at the above locations are unknown.
cccctacccttaagtcccgggttcaaccngtttttttccccgacccccaaaatccnttatgtaaaattnngaaanttaagaaggccagnttngatgacttcccttttgngcgtgaacatggtttccaaggagtangagcagtnttcttccgaggcctttgaagccgcttgtatctgtgccaacaagtacgttgatccgccatccgntccgcacccgcagccgcagcagcagcagcagcatcaccacaccaccacttcagtccantaa

SEQ ID NO: 6970 - DNA, 528 bp, A.fumigatus
catgaaaacggggaactgaaaattgggttgtcttttttcatcttttctctaacgctactgggaaatcatctaagcctgagacaggttctcgtaggcgctagggaagcgcttcatgttctcctcgatcagaccgtggccacgcaggaactgaacgtaggcaccatcctgcttgagcttgccctcgttgcggagctggatgtagtcctcgcgacggacgggggtgaagccccagttcttggagacgatgatcttttggcggccggggaacttgtacatggcacggcgcagagcctcgatggcggcggcgcggttggagtcacgggtgcggacggacaggatgatctggccgatgttcacacgggcaacggtaccctggggcttaccgaaggcaccacgcataccagtctggagacgatcggctccggcgcaggacaacatcttgttgatacggatgacgtggaaggggtgcacacgcacacgcaggtggaaaccttccttaccggtgatcttgacgaagtacctatttga

SEQ ID NO: 6971 - DNA, 540 bp, A.fumigatus
tacaccctatgtccaccaatggcacactgctccgtcagtggccttacatatcggccatcgaaaatcgacggccttacagtgggtcccagagggacttaccatcccatacaaaaatgtatggttaaagaagtatcggcctacggccatcaaaacacagaaggaatcataggggacggctgccaagccggcagcctatgtgttttgaataacctcaccaaccaactattcatcaacgcctcccattcggtcgtctaccaaactatatccaaagaccacaccttcgctccttcgtcgcttcggcacagggcttcgccctgtaaccctgaaactcatctatacacctctactttactctactttacattactacatactacaaactcacttaattaccgcccaaccgcaaatatatatatttctcctaaacaactaaaaacaacacaactcaaaaaggtcccctgtagttcactttcaccagaatacgctccaaacgcccagccagcacaggatcctgagatgcaacccccgtcttcagcctag

SEQ ID NO: 6972 - DNA, 426 bp, A.fumigatus
actcattcgcggaccttcgagggcgtggtgaagaccattctcaccactcgactgattacatcgaaaagaccccatccttcgaatccatcaaaaccttctcaccaaccttcaacacattcatcggtccactcgaagtcaccattccagtctcctccaacatcaaaaaacgaccctgaacctcagtcgccgccttcctccgcttcgacttctgcccaacaagctccacctcatcctcctccatcttatgtccaccatccccaggcactgaaatcccattctcaaagaaattcccatccacaggcacatccacacaaccagaccccgctaaaacctcacgcgtcttcggatgcaccgccggcgccgacatcagcaacttcctatccgggcccccaagataagcaaaagccatcacctccacacccataa

SEQ ID NO: 6973 - DNA, 195 bp, A.fumigatus
acagacccatttaaaacaaaattaggcacaaacttcccaaccccgatcacctgccgaggatttcccatcgcctgcaacttcaactccttcttcatcaccgctttcaccatctcaaccccattgcgcgtaccatacttgccccgtttaccacccatacccttcttacctcccgttccccaacgacgtcgaccgtaa

SEQ ID NO: 6974 - DNA, 264 bp, A.fumigatus
actgcacatgctaagttaagttacttaggacattataaaaacaagacctatagtcaaaactttgttcacaaataccacggccccaaatgccgcatcagaagttgcctttttattatagaagattctgggcagcctctgcgaataatgatcatcaccttgcttaaagctcatggacataactactcactagtaagtacaagtgcgtctccaattctccaggttaggactatgcatcggagaactcctatgcagatactagtatag

SEQ ID NO: 6975 - DNA, 2256 bp, A.fumigatus
ggcccatttctaccatattggcggttcccggctcttcgtggtgaagacggtaaacgtcctccatccacacccaaagaagcaaccatccgaagtctgtatagcaatgtgctgaacctacccatcgacttgataggcatggacgacactttcctgcgcctcgggggggattcactccaagccattcgcctcgttgcagcggccagggcggccgggcttatactacacgccaaggatatcctttcgtcgcagagtacgctggctgagcaatcaaaacgtgcatgtttgatccaaacaatataccgtacatgggaatcttcacctccgtttgccctcttgcatgggccgacgaggcatgctattgtcgacctggcgcagaagcagtgccgtgtgccttcgaatctcattgaagatatctacccttgtactgcactgcaggagggcatgttcataacgtctttaaaacacccaggcatgtataccgggcagataatatttgatattcccgacagaatggagttaccccgtttgagggccgcgtggctgtcggtggtgtccgagaatgctgctttgcgaacacgtgtcattgaaacccacgagggactcatgcaagcggtgatcgtcgatgacttcgtgtgggaggaagaaaccgacgagatgctcctctctagcgacggggaagcactcgagatcaccaagatcggtgtgcctttggttcggtttcgctatcgccctcgacatcggcagctgatgatgacaatccaccactcaatctgggatggctggtcgctccgcttggttcatgagcaactacatcgtgcctacattgggcgggatctgttaccgagcacctcataccgctctttcattcaatacacgcaagagctacaaggggcagacgagttctgggcctccgagctcgccggcgtgaatgcaccgatattcccgaccttgccatctggtaactatcggccgcgcgtaaacgcatcgcatcgccatgtggtgagaaacttggcctcaaccggaaaggaggagcataccgccgctacctatattcaccttgcctggtcgttactcgttgcccactatacagacgcggacgagaccgtatacggggtgacagtcaacgggcgtagtgctgacgtaccgggggttgagaatatcgtgggtccaacaattgcaaccgtcccgacgcgcattcgagtcaacgaggaagataccgtggagatggcgctggaccatgtccaggacgctctcgcacgcatgattccctacgaacaggctggcctgcagcgcatcagccggtgtagtagagatgcctccgaagcttgccgcttccagactttgcttatcattgaagctcccacagatagtgacgtggattgtgagaagaacgaagctggaaacttttccattatcgggggaacgacacagactgggatggactacaccgcgttctcgtcatacgcgatgatgctcgtctttcgtactagcgctaacaagagcgcgatttcgttcgatattacatatgacgcgcaagtaataggccacgatgaggtggagcgaatggctcatcagttcgagcatgtcttgcgacacatctatacgcttgcaacaggacggattggagatattagctttatcgggccacgggacatcgagcaagtacaacaatggaacagtaccatgcccccagccgacaatcgcttcttgcaggagttgatttttgctcagtgctcccgtcgacctcaggcgtctgctattatttcctgggatggctcatggacgtatcgggaactctgggcacactcatcgttctttgcgcggcaactacagaggtatggggtgacccgaggaactcctgtagctgtctgcctggaccgcagcaggtggagcattgcagtcatcctgggcgttctcctcgctagaggcacatgcgtgctgatcgatttactggctccgcgacaaagggtgcgagatatccttcagatcgccggcacaggtatcttggtccacagtcatgcaactgccacgctgacgtccggtctctgtcccactgttgtcaatgtatccttccttgcggcccagagcgactcttcgcagccggaatttcccttcactttggagacctggggcggaaccccggaagacctcgcatttatcatctttacgtccggtagtaccggtcatcccaaaggcattgagatgccccatcgtcttcacacacgggcctggaagagcccgcgaatgcgtataaaa

SEQ ID NO: 6976 - DNA, 570 bp, A.fumigatus
tcgatacctgcttcaccagtcatgcggcctgaaattgaacaagagctcgcccacaccttactggttgagcttctagcttaccagtttgcgtccccggtgcgatggatcgaaactcaggatgtcattcttgcagaaaagcgaacagaacggattgtggaaatcggtcccgccgatacattggggggaatggcaaggaggacgctcgcgtccaagtatgaagcgtatgacgctgccacttcggtgcagcggcaaattctctgctacaacaaagatgcgaaggaaatctactacgacgtggatcctgtcgaagaagaagcagaggctccagctgcctcgcctgcagctcctactgccccagttgcagctgcagctccagctcctaccgcagttacccctgctcccagcgccggaccagcggcagcagtcgatgatattccggtcactgcggtagatgtgctccggacactagtcgcacaaaagttgaagaagggcttatccgacgttcctctcagcaaagccatcaaagacctggttggaggtacgttacaatccctcgttcgaaactcgtga

SEQ ID NO: 6977 - DNA, 189 bp, A.fumigatus
cagatcttgtcgatcatccgtcataaatgtatccacggctgcatctggggcaacattgattacagtatgaagactcggtatactgatgtcaagtgcggggtcaggttgagcgacatcgccggtggcatttatctcgaaatcgtagctgtttcctgcggaatcatctgcactgacggacttgccatgtag

SEQ ID NO: 6978 - DNA, 189 bp, A.fumigatus
gtcgtccagatgcttacggactttagaggcaaggcttggtttgctcctttcccacttcaggtttctaacttgtcaaccaggccatttgaccagccatcgctccacttctttaacctcgttacattaaacaacactagcaaggtgaatactctcttgcgcatgcttttacgcccgccatccttttggtaa

SEQ ID NO: 6979 - DNA, 1053 bp, A.fumigatus
acaaactaccgtaccgacacccagctcgtgacgtttgacatcatgagtgcgctggcgttcgggcgcaacttcaaagccatctcccgcggtagctcgtcaatcatgaaatgggccgggctgatcatggagatgttggagtcgcccgccgtcctgggcctactgtcgctcctgccattctcgcttatcatgcggccgtggaaaattatgtatcgcgagctggcggcgttcagcagcgacgctgtcgagatgcgcaagcagttgctggctgaggactccacggacaagcccttggacctgctgcaagcgtttatcgatgcggaggaaccggagtccaaaatcaagatgagcccgcatgaggtgcaggctgagagtattatgatgatgctggcagggagtgagaccacctcatctgccatcatgtggacattccacctgctgctgctctacccagagactctcaggcgcgctgtccatgaggtgcgcagcgccttttccttaaaccatttggtgacgtacaaggacgtgcgcagcagcttgccgtatgtcgaagcctgcgtgtacgaagctcttcggcactcgcccaccacggctggactgactccgcgaatctcccattctacgggcatcaccctgcagggatattacattccgccagggacagaaatctacgtcaatctacgctcgccaagcatgcatcctagtctttgggatgatccagcgcggttcaacccggatcggtttctcgatagcgacaacaacaagcggttgctctttaccttctcctatggtccgcggaactgccttgggcgtaatctcgcctgggtggaaatgctcaccattgtcgccaatgtcctcaaggactacgacattgcgctaaccgaagatagcctatttgggccgcattgtacagatgagaatgggctgccggttctcatgcccgccaagtgcttcattgcgtccttcccggccaagccggagagggactgtcgaatggtgattaccaaaaggatggcgggcgtaaaagcatgcgcaagagagtattcaccttgctag

SEQ ID NO: 6980 - DNA, 627 bp, A.fumigatus
aaagacgagtttggtaatacagagtatttgcagtcttgccatggtacagattgttcagtgtataaagtcctgctcataaggcccacattggtagtcacagagctcttgcctttaactatggcgacagacagcagcatgcctgggacagtcattggcaaggccgaattctccgacaccaaagccgccagcgaatttggtaccgatctatcgcgatggcggctcaacgtcgacaacggccggcacatgtgggaatatctagagtccgaggacgaagccagaaaacgaccgcaaagtttcctggaaaagtactggctcggtctaccgtatgagctccccgcgcggcctcgcgctacctgcgccctagaggccgtggaaaacggatgggaattcttcaaacgcctgcagacagccgatggacactggggatgcaacgatgacggccccctgttcgtcaccagcgggatggtcattgcgaggtacatcgtgggaatcccgatagactcccacatgaaacaggagatgtgccggtacttactcaatgtggtcaacgaggacggcggatggggtctcttcatccagtccccgtcgaccgtcttcaccgaccgaggctggaagaaaacgcgctgg

SEQ ID NO: 6981 - DNA, 300 bp, A.fumigatus
ccgaaggtgcagatggctaggactcaaaagaacaaggcgacagcgtttcacttgggtatgtgcaggacaaagataaaaattcatgtatcttgggagaggataactgacggttgtgaaggtcaactcaaagcgaagcttgcaaagttaaaacgagagcttttgaccccatccggcggtggcggcggaggtggtggtaagtggaaaggtgtcgcgattgtcttttataggaggctaacaaggaggttcagttggtttcgatgtcgctcgtaccggtgttgccagtgtgtatgtatcgactga

SEQ ID NO: 6982 - DNA, 204 bp, A.fumigatus
  unsure (64),(153): Identity of nucleotide sequences at the above locations are unknown.
acgtcaacaagccgctgctcgacaaaaagattatcgagaacgaattggaagggtgtggtatcanaatcaacaaacaacccgcccaactttgttttcaaaaaaaaagacagaggtggtattgccatcactaccaccgtccccctaacacatatngaccatgatgtatgtgctcctgatgtgtggctctctcaggctcgaagctga

SEQ ID NO: 6983 - DNA, 378 bp, A.fumigatus
  unsure (281),(370): Identity of nucleotide sequences at the above locations are unknown.
ccacgtagagctgaacggaaactgaccttcggattcgcagccgccgcatacgagttcacaaccttgacaaccgttcccggccaggtgctgtacaacggtgcgaaaattcagattctcgatctccccggtatcattcagggtgccaaagatggtaaaggtcgtggtcgtcaggtcatcgcagtggccaagacttgccatctcattttcattgtcctagacgtcaacaagccgctgctcgacaaaaagattatcgagaacgaattggaagggtgtggtatcanaatcaacaaacaacccgcccaactttgttttcaaaaaaaaagacagaggtggtattgccatcactaccaccgtccccctaacacatatngaccatga

SEQ ID NO: 6984 - DNA, 273 bp, A.fumigatus
agcaatcccatttctactctatcagaggagaacggtgctagttcaggtctgcatttcggctgcatcgctttctgcccgctgttctgtgatattgagctagttgctcagcacgcacaagatgcctctgtgtctatttcctgcatgggacgtgaatcgagtatgctacccaggatatccatattagccttacatctaggtttactcattaataaattatgtggtgacttgcatacagcagagttttcaccgccgggcccgaaggtcaagcgtaag

SEQ ID NO: 6985 - DNA, 270 bp, A.fumigatus
tctggtaggtcgcaggtcgatcccctcggtactataaacttcagcggcgctgtgatgatatggccgtacctgcatgtagccgagaccaatgcccatatgtaccgcgccatactgagtcagggttcgcatgctaataatgtactctggcagctaatattggtctggagccctggtagagggagtgcaatacatgatcatgccaatgcacattgtgtcatgaaggtatcattagctacccgactacaccctcgctcggggcgaaattgctga

SEQ ID NO: 6986 - DNA, 315 bp, A.fumigatus
aggatcctcacaacaatgccatatctcgactccacaacatcattaccaccttcacaaagcaaataccctgataatgcgttcgagaatctcgtcctagacctcagcgcagcgttgggtccgagctcaggcctggattctgacgatgtcaatcccctcgacatccagcgcctgatggagcaatatgtctccaatccggaggaatggcgcccttttgccctgggcgataacagcaggggatacacaaggaatcttattgatcaagggaatggtaaaagtaatctggtaggtcgcaggtcgatcccctcggtactataa

SEQ ID NO: 6987 - DNA, 219 bp, A.fumigatus
gtcctcaaaggctctctgcaagagactctatatacatggccagatcaagataaactccgaaacgggcagccctcatcgccgcaaatcatcaagaaaaccacctacaccgagaaccaggtaacctatatgtctgacaaagtctgtaaattcccgcctaggtacttcactcaggcgtatgataattcgaaactgacgatttgccaagctgggcctccataa

SEQ ID NO: 6988 - DNA, 747 bp, A.fumigatus
tgcgcacatgctatcttaaccagagcacttgatttcccagaacaagaagactgcattttcgccaaaatgaaccaaatttcaaagtacctataccatatagttctaacaatctctcatctcaccaaaaatcccaacaacctcgttgaaaaagtgcgcgttcttgggagctatacaactctgccagcggccaaagtcgcggcacacagctgcctgttcgacgccggctacgagcgagagttcttcactaagtacgaagtcgattcgactgatttcgaaaaacaagatcttgttcagcgccctggcctggcagtgcttgctgtagccgcagatgggactacatttcgggtgcggattgacacgacccccaataacatgcgccttacgacagagcttgaggatggtagaatatcaatcccgttgtactatgtaattcagactactgtcgtgtataacgggcaaaaggaggcaaccaatgtccgagacctgaacattgaggggacgttcaaaacatatgatgaagctcgggcttttgcaaagcaggttctactgtccacggaggacaatgtcaccaaagacagtttcgcggagtatgatgaggccgcacctgatgagaaagattgcggatatggagaaaacgtgattgtgcatgcggctagtaattatggggaaaatttcttgattagtgtcattcagactcaagaactgaaaaatgttgctttaacagaggcagcgatgagaattgcttga

SEQ ID NO: 6989 - DNA, 234 bp, A.fumigatus
  unsure (196): Identity of nucleotide sequences at the above locations are unknown.
ctgtctctgcaacaggattgcgggcaaattgtggcatctaagttctttcctgtcgacgctgaggacggaagcggacagtatccactgtgtgagacagattactttcggcgattggacctcctctgccacgaatgtggcggcgctttgcgtggttcctatatcaccgccttagaccacaagtatcacatcgaacatntcacttgctccgtttgcccgacagtttttggcgcccaa

SEQ ID NO: 6990 - DNA, 750 bp, A.fumigatus
cggtatttcattgacgtacttttgaagagcagccgtcagggattacagaaaagagtgctccttgcggatatgcctcccggcgatgtcccactgccggatagcctagtgccgggcaacggggctgtccgtccgactttaaataccagtgggcagggcggtagttttcagaaacaaactcccacttcgccggccgatagcaataggactttcgactcaccgcgtgcaagatctggtgggcggaatgggtctgctgtcacaagcccggtggatgggatgcaaaatccagacggtcgcacgggccgaagattggactcgaacaaccctggccagcgggatccatcaactccgcgtgatcgagctggttattgggagaagtcagcgcaacgtgacagaccttctcagagcggccgtctgcccacaaaatcccccggtagttcgcgtatttgcaaaaagtgcggcgagcctctgacgggccaatttgtacgcgcacttggcgcaacgtatcatcttgagtgtttcaagtgtgaggttagtttagtcgtccacctcaacgaaacccgccgtgtcctgttagctaactgtctctgcaacaggattgcgggcaaattgtggcatctaagttctttcctgtcgacgctgaggacggaagcggacagtatccactgtgtgagacagattactttcggcgattggacctcctctgccacgaatgtggcggcgctttgcgtggttcctatatcaccgccttag

SEQ ID NO: 6991 - DNA, 264 bp, A.fumigatus
aacactcaagatgatacgttgcgccaagtgcgcgtacaaattggcccgtcagaggctcgccgcactttttgcaaatacgcgaactaccgggggattttgtgggcagacggccgctctgagaaggtctgtcacgttgcgctgacttctcccaataaccagctcgatcacgcggagttgatggatcccgctggccagggttgttcgagtccaatcttcggcccgtgcgaccgtctggattttgcatcccatccaccgggcttgtga

SEQ ID NO: 6992 - DNA, 423 bp, A.fumigatus
cccgcttcaataatagccgccgcattgaatgtcaccgagccttcatcgaccgggattggtggtgacatgttctgtctcttctacgatgcaaaatcaaagaaggtccactcactcaacggttctggtcgatatcccgccaacgcgacgcttgagaagattaggaaggatctgaacctcggtgccaatgagaaggggagcattccaatgaccagtgtcctatcggtaactacccccggcgcaactgctggatgggtagacacagtggagagattcggcagtggcaagctgtctttggaacagattcttacgccaacaattgaactgggagagcaagggttcgcgggttcagaattatcttcgtactttgaaggtttatcctttttcgatcgttccagcatttgcagcatattgtgccattcttaa

SEQ ID NO: 6993 - DNA, 1017 bp, A.fumigatus
  unsure (920),(946): Identity of nucleotide sequences at the above locations are unknown.
cagcttttcaagtggcgtgaaagtgaagacttgttacggaatgcatctccaaatttccgggagatgctcaagcttgatccgaaagccagagacggtgttagaagcccacgtcctggtgaaatcatgaagaatccgacattggcgaagaccttccgaagacttgctgcagagggtaagaaggggttttatgaaggggaagttgcacaggagctagtcaaggtcatccaggacctgggtggctacatgaccctggacgatctcaagtatcatgctgagaccggaacacagaacactgaagctatctcactcaaattcactggccaagatattgtcaaaaaacagaccgctggaacagacggtgaagaaaaccaaggcgtggaaatatgggagcatccgcccaacggccagggcattgttgctctcatggccctggggattcttgaggaactcgagcggacaggaaagattcctgtctttactgaggatcagcacaactcgacagagtaccttcacgctgttatcgaaagtcttcggattgctttcgccgatgcctcatggtgggtcacggatccagatgtggaaaaggtaccgtcgaaagagctgatctccagggagtatctggccgaacgggcgaagctgttcaacccggagaaagcggtagacatcatcgatcatggtagtccagctcacaatcactgcgatacagtctacttcgctgtgactgatgaggagggcaacggtatttcctttattaacagtaactatgctggattcggtagtgggatcattccgaaagggtgtggctttacgctccagaaccgcggtgccaatttctctctggacccaggtcatcctaatgcgttggcttcacgaaagcggccgtaccacaccatcattcctgcgctgattaccaactgctncgatggctctcttcacttctgttacngagtcatgggtgggttcatgcacccgccaggccatgttcaagttctttttaacatgcctgcgtttaactaa

SEQ ID NO: 6994 - DNA, 228 bp, A.fumigatus
ccagtctataatgcctcgacacccaaagggggtgatccgaccaaagttgatgtgaatgcacagtatgccggattcgagtatcactacgtttatatcgtggcctgcagctttgttgtctggcttatcttgcctggaatcggtctactttacagtggtttagcacgccggaaatctgccttggctctgcttttccagtcctggatggtccttgcagtgtatgttccctga

SEQ ID NO: 6995 - DNA, 261 bp, A.fumigatus
gaccatactacttcgatgatactgagcatgagtagaacgacgtttcaatggatgttctggggttactctcttacttactccagggacggtggcccattcattggtactctcaagaactttggaatgagggatgtccttgttgcaccgtccccgggttctgcagtacttcctgaaattgtgttttgcctgtaccagctgcttttctgcgcctgcacggtgagagcctctgcacacttgcgacaaatgagacccgtacgctga

SEQ ID NO: 6996 - DNA, 438 bp, A.fumigatus
caagcaaggcaggccggtatcgcatacactatctacgaacagcacgatgacgaggcctacgcccgtcgggcaggacaatggaccatggccctgcactcttccctgccgtatctcgactcaatcctcccctcggacctccgtgcgaaactgaactccacaacgacgaatccttgggccgagcccgatcctaccattgcggctgctatcccgtttgtgaatggtgccactggcgagctgatggcgaagattccgatgccgagcccgaagcgggttatccgggggaagttgcgtgatcttctgcggacaggagtggaagtgagatttgggaggcggttgactgacatccgcgtggaggatgatggggtgattgcggttttcgatggggaggaagtcagagggaatgtgcttgtgggagcggacggaggtaggtattcttga

SEQ ID NO: 6997 - DNA, 216 bp, A.fumigatus
ccctaccagccgctagtctatgacacctctcaagtcatgaccaaaggttgttacacctgccgtcgccgccgcattatctgcgacaatggcctccccacgtgtcgaaaatgtcgcgatgcggggaaggagtgcctgggatatcgtaaacctcttgtctgggtcaagggtggtgttgctagtcgagggaagatgatgggacgcagctttgatgatgtc

SEQ ID NO: 6998 - DNA, 318 bp, A.fumigatus
gaagacgagttttttgaagatcgactccaggcgaagactgagaagctacgcacgcttatcagagacaatgaagacagatttcaaggcgagtttctttcctttccccttgcgaccgcaattctgactcaatcgcagttctccaaccttctggggacggtatatcgcaaaggaaatcttctcttcactcccgatggaaactgcttgctttccccagtaggcaatagggtcacagttttcgaccttgtccagtatgttcggtctcttacatgctatggtatactcgtcggatcttttgagctgattgaatggccctgctga

SEQ ID NO: 6999 - DNA, 600 bp, A.fumigatus
aggaacacatcatacacacttccattctcccatcgcaccaatatcgatcgtttagatctttcgccccgcggcaaccttctgctctccgttgacgagaatggtcgtgctatcttgacgaatttcgttcgcaggattgtaattcaccacttctcctttaaaggtcgagtcactgcgctcaaattttcgtcaacgggtcgtcatttcgctgtcggagtgggaagaaggttgcagatctggcacacaccatcgaccccgggtaccgataataacggagagatcgaattcgcaccctttgttctgcaccgagatcttgccgcccattttgatgtcattcaggatattgagtggtccagagactcacgcttcctccttaccgcatccaaagacctcacagcacggatatggagtttagatccggaagagggcttcgaacccaccaccctggccggccaccgtcaaggcgtgaaggcagcctatttcacagcggatcaagaatccgtaagtcgaatcgaaatatttacaatttcccttgctgacatcgtccaagatctacacaatcagttcggatggagctcttttcaggtgggagtacgtgactaa

SEQ ID NO: 7000 - DNA, 336 bp, A.fumigatus
gtcgaatcgaaatatttacaatttcccttgctgacatcgtccaagatctacacaatcagttcggatggagctcttttcaggtgggagtacgtgactaagaaagatccggatacgatggaagatattgccgaagctcgttggcggattgtcaaaaaggattacttcatgcagaacgatgccaaggttaactgtgctactttccacgccccctcgaatctcttggttgtaggtttctccaacggccttttcggcctgtacgatctgccggacttcaacccgatccatcaactgaggtatgaatcttgctacctgattgtgaactgtgaggctgactag

SEQ ID NO: 7001 - DNA, 675 bp, A.fumigatus
  unsure (634),(644): Identity of nucleotide sequences at the above locations are unknown.
ccattgctgacctgcgctaggccgcaaccttacgagcatttaatgattgtgttcttcgacattctgcttctcgatgacgacatctgccttaggaagccacatcgtgagcggcggctgcttctaaagaatgttgtaaaagtaatagatggatatgcggacatcgcagagcaacatattgtcgaattttcccaccccagcggtcgatctcgcctcgaaacaatattctcgaaggccgttacggaaagatgggaaggactcgtcctaaaaggttgtgaagatccctacgtttcaatatttcctggttctgagaacggctccggtggtcgctggatcaagctcaagaaggactatataccagggttgggtgacaccgtggacctgacattaatcggcgctagatatgactctcgtgatgctgctgcattgaattcatccacgaagatattttggacacatttttacatcggctgtctggtcaacaaagatgcggtcttacagtccgcagctgagccaaggtttctcgttatggatgtcattgactgtaactccatgagcctgaaaaatatgcaaattctcaatcattttgggcagtttggtgcctgccgtctggattcaggccatgggttccggatanatttttgganagggatatctctccgacttgaataccctgtt

SEQ ID NO: 7002 - DNA, 231 bp, A.fumigatus
  unsure (141): Identity of nucleotide sequences at the above locations are unknown.
ggatgtaaaattacgccaagaccctcttctcctcgcactgttgatacgaagatcttcccgtcattttgtatcacgatcggctctgctcctaccaatcaaacaattggtgcattctcacctctatgccatttgactgattantctttcatgagtatgatctgttcccacttcaaaagatctgatatcgttaaaagaatgggccacctctcctttacttttggtgaatactga

SEQ ID NO: 7003 - DNA, 981 bp, A.fumigatus
ctccacaaggaccatccaacacgtcaatggatcaagcccaagctgactgaagaaaaggcccccaagctagtcgctttcgagttcaccacctccacatcccgaaaaccacacagtctcatcttcatcggcggtctgacagacggcctttgcaccgtgccctacgtagcacccctcgccgccgccctcgaaccaaccgactggtccgtcttccaagcccagctctcctcatccttcggcggctggggtatcggcagtcttgacaaggatgtcgaggagattgcaaaatgcattgacttcgtccgcagcctcaaggcctcctccgcctcgggatcggcatcggcgccagggaagattgtcatcatgggccattcgaccggaagccaggacgtgttgcactacctctatactcagggagaccgtcctgtagtagacggtgcgatcctgcaagcgccagtgtccgatcgtgaagccatgctcgctgaaatgcgcaagccacgcgatgtgggtgccgaagcaaagggctcgtgggagcagctggtttcgctggcacggcaggctcccgtaggtgatatcattctaccgctgaatctcagcagcaaggttggcttgccgcctgatcctgtcagtgcacggcggttcctgagtctggcgagcccggatagtcctgacaggccggcggaggatgatctgtttagctcagatttgacggatcagcgcctgcgcgagacgtttggggccgtggcgacgcgggggctattaaggtccaagctgctggtgctgtactcggggaatgacgagtttgcggcaccttgggtggacaagaaggcgctgatggcgcggtggagagaggcgactgaggctctgaagcctgggacgtgggatcagaatagcggggtcataccgggggccagccacaatgtcaaggaccaggggcaggctgatcttactgagcgcgttactcgctatctgaagagtatctag

SEQ ID NO: 7004 - DNA, 531 bp, A.fumigatus
agaaaagggatagagaggatcaccatgacccttctactctctctcctttttctcttcttttcttttcacttctctttctcttctggctttctttttttacctctttcctgccctcttctctcttcctactcctcttttccttcttctcctccttcttcccctcttcttttctccttttctttttctctctttatcttctccctctcttttcttcttcttctctcctttccccttcttccctctcttctcgtcttttctctccttttcctttctttctttatttttcccctcctttccttctcttttcttcttttctttctcgtctttctcctctctcctcccgtctttctcctcttatctcatttcttgctcttcgttgcttatctctcttcttcctccctccttctgtcttcttctatatctcctttctttcttcctgtttccttgccttctctctctcttcgcctcccttcttttgttttactttctttctatcttccttctctgttttcgtttctctctctctctctt

SEQ ID NO: 7005 - DNA, 504 bp, A.fumigatus
cccttctactctctctcctttttctcttcttttcttttcacttctctttctcttctggctttctttttttacctctttcctgccctcttctctcttcctactcctcttttccttcttctcctccttcttcccctcttcttttctccttttctttttctctctttatcttctccctctcttttcttcttcttctctcctttccccttcttccctctcttctcgtcttttctctccttttcctttctttctttatttttcccctcctttccttctcttttcttcttttctttctcgtctttctcctctctcctcccgtctttctcctcttatctcatttcttgctcttcgttgcttatctctcttcttcctccctccttctgtcttcttctatatctcctttctttcttcctgtttccttgccttctctctctcttcgcctcccttcttttgttttactttctttctatcttccttctctgttttcgtttctctctctctctcttt

SEQ ID NO: 7006 - DNA, 540 bp, A.fumigatus
gaattgaagaaaagggatagagaggatcaccatgacccttctactctctctcctttttctcttcttttcttttcacttctctttctcttctggctttctttttttacctctttcctgccctcttctctcttcctactcctcttttccttcttctcctccttcttcccctcttcttttctccttttctttttctctctttatcttctccctctcttttcttcttcttctctcctttccccttcttccctctcttctcgtcttttctctccttttcctttctttctttatttttcccctcctttccttctcttttcttcttttctttctcgtctttctcctctctcctcccgtctttctcctcttatctcatttcttgctcttcgttgcttatctctcttcttcctccctccttctgtcttcttctatatctcctttctttcttcctgtttccttgccttctctctctcttcgcctcccttcttttgttttactttctttctatcttccttctctgttttcgtttctctctctctctctttc

SEQ ID NO: 7007 - DNA, 444 bp, A.fumigatus
aattgtctgcctctgtgctggttcagatctctgactgggacccttgaacggcagacttgcaccgggcgacaagtggctacgacagcgtcgcatttacaaccagtgacatcgctcgtggttgatcccacttccaacttcattctttcgggatcgtctgatgctagtatccatgtctggtcactcgttgatatcctttcattcacgaaacctccctcgggtcgggaccgtcagcagccaaactcgcccgtccgtacattctcaaaccatcgcgctgccatcacatccatcgctgtgggccatagcagcggtcgctataacatcgctgtgtccgcctccaaagataacaccgccattgcttgggattatcacacgggacgcctccttcgaaccttcctattgcctggttctgcaacctgtttgatcctcgatccggtcgttttctaa

SEQ ID NO: 7008 - DNA, 351 bp, A.fumigatus
gactttgtggatggcatgatggagggtttctcggggctggtcacccagccgatcaaaggtggcaaagaggagggagcgctgggcgttgtcaagggtttggcaaagggtacagcaggacttgtgactaaagttccttccgctggactagggctcgtcgcgtatccatttcagggtattgtgaagagtatcgagtcgtcggtcaggtccaagacgaggaaggccattatcacggcccgactacgggatgggtatgagctgagtcgacgggaggaagtttcgcaggaggagagacgctttgtcctgcagaagtttcaaagtcttctgtgcggtccaactgctactcctacatag

SEQ ID NO: 7009 - DNA, 672 bp, A.fumigatus
tttagcgacgcactaggcataccactttactacgcactgttaactcttcgtaccctagcgcagcgtcggctgtggcataccttgccgcacagtctgcacttttgcgagttaccgcaacatggcccacaggtgctagacatagttactgtccatatatatttcccttacattttgagatatgttaagcatccaagtgctagccggatagtcatggaagccaatccccaagccgtcccgcgccttgttccaattgctctcgcgccagctagggcatcatctgttgacatgcagaatgactccaacgcagacttgacgacaatgcgcttcaactgccaaggctgcgtgcgcaaaaagggcaaatgcaatagggttgtgccgacatgctcgaactgcagtaaatcaaaacttcaatgcgtctaccaggctcccctgccgcggaagaggaagcgaagccaggtcgaagaagacgtgtatgagcgtctcgcacggtatgagcgcatcttgcgggagaacaatcttctccctacggcctctgcattagccccatgcagcaaggcgatggacacgtcggtggtcagcacacgggatccaagcccagcgccaaacatgcaacccgctacgtctggtaaacttctttccgccgggggcaagtctcgatatatcgacagtgtc

SEQ ID NO: 7010 - DNA, 1608 bp, A.fumigatus
gacgggatcgaagagatcctgaaggcgagaatccttgcgtcggcgcgtcacaaagcctttgttgtttccgcggacgagcgtgaaggatgtctgcgcaaccttctaaactggggtcactcaatcggtcacgctattgaggctattcttactcctcaaatcctccacggagagtgcgttgccattggtatggtcaaggaagcggagttggcgagacatcttggtatcttgaagggtgttgccgtggcccgcattgtcaagtgtattgccgcctacggcttgcctacatctctgaaggactcgcgaattcgcaaactgaccgccggtaagcactgctctgttgaccagattctttttaacatggctttggacaagaagaacgacggtcccaagaaaaaaatcgttcttctgtcagcaatcggtcgcacttacgaaccacgggctagtgttgtgccgaatgaggatattggtgtcgttcttgcccctagtattgaggtgcaccctggcgtatcaacgacctcagaagtggtttgtgcgcctccgggctcgaagagcatctccaaccgagctctggtacttgccgctctcggttcgggcactgtccgtatcaaaaacctgctgcattccgatgacaccgaggtcatgctgaacgccttggaacgccttggcgctgccaccttctcatgggaagaggaaggcgaagtccttgttgtcaatggcaaaggaggtgctcttcaagctcatccttctccgctctacctgggcaacgcgggtacagcatcgcgtttcttgaccactgtcgcaacccttgccactgccagcagcgtcgactcgagcgttcttaccggcaataaccgcatgaagcagagacctattggcgacttggtggatgccctgaccgcaaatggtgcgcagattgagtacgtcgagaacaagggcagtctgccgctcaagatcgccgcctcaggcgggttcaccggtggccaaatcaacctcgccgctaaagtgtcgtcgcaatatgtgtcctccctgctcatgtgcgccccatacgctaaggagcctgtgaccttgaagctggtgggcggtaagcccatctcgcagccttacattgacatgacgacggctatgatgagatctttcggcattgatgtgaagaaatctaccactgaggagcatacctatcacattcctcagggacgttacatcaaccctgcagagtacgttgtggagagcgacgcgagctccgccacctaccccttggcgattgcagcagtcactggcaccacgtgcactattccgaacattggatctaagtctcttcaaggcgacgctcgtttcgccgttgatgttctgagacccatgggttgcactgtggaacagaccgacacgtcgaccaccgttaccggtcccgccgatggtgtcttgcggcctttgcccaacgtcgatatggagcctatgactgatgcattccttggggcgtcggttcttgcggccattgccagaggcaaggactcgaaccacacaactcgcatctatggtatcgcgaaccagcctgtcgttttctaccacaaggcgacgagacatccgcgtattggatccccccccggttaa

SEQ ID NO: 7011 - DNA, 306 bp, A.fumigatus
agagcacctcctttgccattgacaacaaggacttcgccttcctcttcccatgagaaggtggcagcgccaaggcgttccaaggcgttcagcatgacctcggtgtcatcggaatgcagcaggtttttgatacggacagtgcccgaaccgagagcggcaagtaccagagctcggttggagatgctcttcgagcccggaggcgcacaaaccacttctgaggtcgttgatacgccagggtgcacctcaatactaggggcaagaacgacaccaatatcctcattcggcacaacactagcccgtggttcgtaa

SEQ ID NO: 7012 - DNA, 183 bp, A.fumigatus
  unsure (43),(68),(84),(101): Identity of nucleotide sequences at the above locations are unknown.
gctcaagtgcaaggaacagacaatttatacggcacaagggatngcctgtcgcggaatgaaaaactacnaacgtctgggtcccanaaattagaagaaccccnaaatggaaacgcccgggcaatcctttccggggatcctgggctgtacctccctaatggcccccagagaaccatcctcccaatt

SEQ ID NO: 7013 - DNA, 300 bp, A.fumigatus
ccagtcgcaacatccgtcttccccgcggtcacttcccccatccgccctcagtatcctgtcgatcttcacattcactctggggcagaagacacccagtcatcgacaatgcaagccgtccctgaatcgcgacaacaaacattcgaggagatctacggacctcccgagaactttctcgagattgaggtatgcagcaataacttccatcacgaaactaccccacccaatcaactcaccgacaagtccgatatcatactcgcagtccaagtcaagactaacctctcatcgtattcaggtccgtaa

SEQ ID NO: 7014 - DNA, 228 bp, A.fumigatus
gaccatgataacggatcaatgataatgcgagctgtcacccgtcactttacccagaatagtctagaagacaaggatgatcccatgaatagcccagctatccctctgccatcatcagtcattcttaacgcaatcgtagaaaactctttctcatacttgtctgctataatcctccatatcatcctaacggccaagaaatccacctttttcaagagtccgcgccccctgtga

SEQ ID NO: 7015 - DNA, 687 bp, A.fumigatus
cgatcgcgcttttaccttactgaccagtcgcaacatccgtcttccccgcggtcacttcccccatccgccctcagtatcctgtcgatcttcacattcactctggggcagaagacacccagtcatcgacaatgcaagccgtccctgaatcgcgacaacaaacattcgaggagatctacggacctcccgagaactttctcgagattgaggtatgcagcaataacttccatcacgaaactaccccacccaatcaactcaccgacaagtccgatatcatactcgcagtccaagtcaagactaacctctcatcgtattcaggtccgtaatccccagacccatggcacatcccgcaacatgtacacctcgtacgagatcgtctgccgaacaaacatccccgccttcaaactgaagcactcggtcgtgcgccgacggtactccgactttgaatacttccgcgacatcctggagcgcgaaagcacgagagtcactatcccgcccttgccggggaaagtattcacgaaccggttcagcgacgacgtaatcgagcaccgtcgcgagggtttacagcggttcttgcagatcgttgccggtcatccgcttcttcagacggggagtaaggtgttagccagcttcatacagggtgagttatcttctcttggtctggtggtatatcaagaagagaaggactaa

SEQ ID NO: 7016 - DNA, 507 bp, A.fumigatus
  unsure (480),(484),(501): Identity of nucleotide sequences at the above locations are unknown.
ctattgccgtatatcgcacttagttcacatatcctatttgctattgattcgcgccaaatggattgccgtcttgacagcatggagaacgtcgtcattccgctaattcagcgtcagtttcatttccccaatatgaactttgctactcaaggctctaattccttctctgagtcaagtaagggttgctgtgataatcgcatacgtctacgaagtctgcgaggccttagaaagatctttctgagaggtaaagaggaagcatctcgattgcggagagttatcaccgtctcgttctctctcgtctccggtagaagtttagtctcttctagtatcttctatttttcctttccttctccgtttcttgatccctctgctgccaacgctgagccggaatggatgaaggcgtgtttcaaaattttaataagcaaaaccatcgtttactgcagggtattggtttggacaaaaacagagcgattacgatgtccnaacnaggaacgagatgatgcnaattga

SEQ ID NO: 7017 - DNA, 1533 bp, A.fumigatus
  unsure (1231): Identity of nucleotide sequences at the above locations are unknown.
aatgtcgggtgctgctcaagcgggaggacttgctccctgtattcagcttcaagctccgtggagcttacaacaagatggcgcatttatcccccgagcagcggtggaagggagttattgcatgctccgcaggtcagagcctttcaatgtggtacaccactcgtctcgaggagagctgacaggtatataggtaaccacgcacaaggcgttgcattttccgcccgcaagctcaagatccccgcgaccatcgtcatgccctcgggtacccctgccatcaagcatttgaatgttgcgcgtcttggcggcagtgttatccttcacggaaacgacttcgacgctgccaaggaggaagctcatcgactggagaagcagcacggcctgaccagcattcctccctttgatgatccgtacgtgattgcaggacagggtaccattggaatggaaattctgcgtcaggcaaacttggagaaactcgaagctgttttctgtgctgtcggcggagggggtctggttgccggtatcggggtttatctgaagcgcattgcgccgcatgtgaaggtcatcggagttgaggcctacgatgccaacgccatggcccggtcgttgggcgaaggatctcgagtcttccttcgggaggttggactgtttgcggacggagcggctgtgaagactgtgggagaggaaacatatcgtcttgctcgtgaggtaattgacgatgtcatcttggtttcaaccgatgagacctgtgccgccattaaggatgcgtttgaggacacaagatctattatcgagcccgctggtgccctggcactcgcaggtctcaagaagtacgtctcccagaaccctagccccgacaccagccgggagctggtcgccatcacatctggcgcaaacatggacttcgatcgcttgcgttttgtggctgagcgtgctgctctgggagagcgaaaggaggcgctgctaagcgtcaaaattcccgagaagcctggcgctttcgcaaacctcgtcgaggtgatccttcctcaagccgtaaccgccttcagttaccgttatgctcgggccgagtccgccgatgtcctgatgggcatctccttgtctgcgctgacaggtcgcgaagacttggcgaagattatggatcagctcgaaaaggccggcatgcccgccaaggatttgagcgacgacgagcttgccaagcgacacgtgcgcttcctggttggaggacgctgcgacgtcnaggatgaacgtctcttcatgtttgaatttccagagcgtccaggaccctggccaatttcctcccgacgctccggcccaaccagaacatctcccggttccactaccgcaattatggtggtgatgtccgaaaggtactggccggcattcagtgtccaattgaacaaaaaaaagatttcgaggccttcctcaacgacctccggttatccgttcaagcaaagcaaaccgaatctccccccctaccagaaattcccaacgttgttaaaaaaaaattgttgttatcccaccccccggttatttttggcg

SEQ ID NO: 7018 - DNA, 207 bp, A.fumigatus
gcccccattatgcccgatcaatctgccacgaacggtacaacaactccggtcactgcgaagctgagcaacctcgctctgactgagtacaccgccgctcccactcccccctcagagaaggaccaagacaccgcgctgggcgtatcccgagactggggtatcccaaatgcattcctgctccccaatggctacccagatgtaagctcctaa

SEQ ID NO: 7019 - DNA, 318 bp, A.fumigatus
cccaatggatttgttttcccgaatataatcagccaaccgttacttgcgacgcagtatctccgccttattttgacgtcacgggtctacgatgttattcaggagacacctctccatcacgccatcaatcttagcaaccgtctagaatgtcgggtgctgctcaagcgggaggacttgctccctgtattcagcttcaagctccgtggagcttacaacaagatggcgcatttatcccccgagcagcggtggaagggagttattgcatgctccgcaggtcagagcctttcaatgtggtacaccactcgtctcgaggagagctga

SEQ ID NO: 7020 - DNA, 276 bp, A.fumigatus
atttccagagcgtccaggaccctggccaatttcctcccgacgctccggcccaaccagaacatctcccggttccactaccgcaattatggtggtgatgtccgaaaggtactggccggcattcagtgtccaattgaacaaaaaaaagatttcgaggccttcctcaacgacctccggttatccgttcaagcaaagcaaaccgaatctccccccctaccagaaattcccaacgttgttaaaaaaaaattgttgttatcccaccccccggttatttttggc

SEQ ID NO: 7021 - DNA, 615 bp, A.fumigatus
aaccaagatgacatcgtcaattacctcacgagcaagacgatatgtttcctctcccacagtcttcacagccgctccgtccgcaaacagtccaacctcccgaaggaagactcgagatccttcgcccaacgaccgggccatggcgttggcatcgtaggcctcaactccgatgaccttcacatgcggcgcaatgcgcttcagataaaccccgataccggcaaccagaccccctccgccgacagcacagaaaacagcttcgagtttctccaagtttgcctgacgcagaatttccattccaatggtaccctgtcctgcaatcacgtacggatcatcaaagggaggaatgctggtcaggccgtgctgcttctccagtcgatgagcttcctccttggcagcgtcgaagtcgtttccgtgaaggataacactgccgccaagacgcgcaacattcaaatgcttgatggcaggggtacccgagggcatgacgatggtcgcggggatcttgagcttgcgggcggaaaatgcaacgccttgtgcgtggttacctatatacctgtcagctctcctcgagacgagtggtgtaccacattgaaaggctctgacctgcggagcatgcaataa

SEQ ID NO: 7022 - DNA, 447 bp, A.fumigatus
ggaaggatcacctcgacgaggtttgcgaaagcgccaggcttctcgggaattttgacgcttagcagcgcctcctttcgctctcccagagcagcacgctcagccacaaaacgcaagcgatcgaagtccatgtttgcgccagatgtgatggcgaccagctcccggctggtgtcggggctagggttctgggagacgtacttcttgagacctgcgagtgccagggcaccagcgggctcgataatagatcttgtgtcctcaaacgcatccttaatggcggcacaggtctcatcggttgaaaccaagatgacatcgtcaattacctcacgagcaagacgatatgtttcctctcccacagtcttcacagccgctccgtccgcaaacagtccaacctcccgaaggaagactcgagatccttcgcccaacgaccgggccatggcgttggcatcgtag

SEQ ID NO: 7023 - DNA, 570 bp, A.fumigatus
ttcatcaccaacgacggcaccaccaccggcaccctgtccgaaatccgccgacagtacatccagaacggcaaggtgatcgccaatgccgtttcctccactggcgtcaactccattaccgaggactggtgcacgtccgtcgacggctcggccgccacctttggcggactgaccaccatgggcaaggcgctgggccgcgggatggtcctcatcttcagcatctggaacgatgccagcggctttatgaactggctcgacagcggcaacgcaggcccttgcagcagcaccgagggaaacccggacttgatcaaggcgcagaatcccacgacccacgtggtcttctcgaatatccgctggggagatatcggatcgactttcaagggttctgatggctcggtgacgacgactacgtccaccacgtcgaccaagaccaccactagcaccgcgcctgggccaacgcagactcactatggacagtgcggtggacaaggctggactggacccacggcttgtgcatcgccctacacctgccaggttctgaatccgtggtactctcaatgtctgtacccatag

SEQ ID NO: 7024 - DNA, 387 bp, A.fumigatus
tatagggtggaagaggtggaaacccctgctttgctagatgcatggaagaagaccatcgcacttattgctgctctccagcccgtcaaggtcattccaggccatttggagcctggctgggaactggacgcccaagcagacattgcgcacacgcagaaatacttggatctcttcgccgaaaaggtcacctatgcgccgacgaaaccgcaggtccaggaactctatgacttctttcagggtgcctttcctcagtgccaacagaatttggactttttcttgggccatctgtccaatcaatttggagagggtggcaaggtctgggaggagaaccggcaccacgatgtcggcaagaggaccattgagggactgactgggtattggttcaagtga

SEQ ID NO: 7025 - DNA, 459 bp, A.fumigatus
tcctcaacacatgggcaaagcctgccgggaatggaaaatatgaacagtctaatggattacaatacaaagcggaagtctggtgatcctgacagtgataataaggtcagccctgctcttaaacggcggaaggtttttggaccagtgttaccatcatcgcctgattccgaggacaccgaaactgaacggcgtgctgagggtgccagaacagttgagagtaccagaactgatggcctcaatcaggaggacgaagatcaagatcaagatgaagatgaagatgacgaggctgatgatgattatggtcccagcctcccccctttaggtggtgaagttactgcaaattccaatatggacaagatatacgatgagtcacatattcagccaggaaagccagatgcccataacaacaattctcaacgtgatgcatggatgcgtcttcaccacgaactggaaaacccgcgt

SEQ ID NO: 7026 - DNA, 294 bp, A.fumigatus
cgtaaaatcgggttgaaatacatcgtgatgtgttctctactccttgctgcgtcagtttgctggacagtctacagttccaccttggtcactcacattgacaatgcccaacagggagggctttgtcttaagacggcacaggtcgttaaggtcgagctagaaggcctttgtaagttcaagaagtccgttaacaggagatatgacgttattggtgctgctgaccctcctattccccggactgggggcctcagtagacgctgtcctagaagacattgtatagagagtgatagatcatga

SEQ ID NO: 7027 - DNA, 297 bp, A.fumigatus
agaggggcatctgaaatttggcgcaatctacggctctgggagatacagacgagctgtaaggctgataatgataagcacctcaacacatcaatgaggcatccatctcaccgctcagaaattatctgcaagttgattgacgacttcttcctcaactttaatggtcgcctcatctcattcgctttgacgtacaaagatattccttggctgcctctccgcagaactgaatttgcttccagaaccttaaacgtcatcttttgcgcaaaagttccaacacctgcaccttacatcagaaattga

SEQ ID NO: 7028 - DNA, 354 bp, A.fumigatus
ttactaccaaaaccacacccttgcttggatcctatcgcagtttatcattcaaccatgtcagagccaggccccgagtccatccctacaagcgcagatccgcgcagcaagagacccgtcaaacgtcgcgcagtcaccccgctcagcgagcaagcatcgcaaatcgagcatctcttccgcgaccccaataaagaaattaaactccccgaaccgtcgaagcaacgaaccgcagattcacttgctccgccgccagagattgttgcgaatgtccagggttcttcggcgggtgcgggctccggggaattccccttctacaaggcgagtcgcaagaagggaatacgatcgtctgcgccttaa

SEQ ID NO: 7029 - DNA, 378 bp, A.fumigatus
acggtttacctaacacacaaattacactcccattcctttctgtgtccagtacgacacccctacactccttttccccacgtcagcatgcggcatcatgggctgcctcttctccccaatccgacccaggatgagcgtgatccgctgcgttggcccgtctggctgaagcgttgtgctatcgtcacgacctccatgacaaacttcgtgaccaacatggccggagcggggctgtcggtggccgtccctgagttgattcaggagtatcacaagcccgagtctgctgtggtgcagctgcttactgtaggttcaccctttaatcagagcgactacagctcgttgctgatggtcaggcgacttggtagtataacttcctgtttttaa

SEQ ID NO: 7030 - DNA, 354 bp, A.fumigatus
atccaaagacgacgtacaaaaatcaatcgaagactcaacaaaatgatccctaccacctatctgctgctcgctgtctccatctttctgtggctccaactactccccagtatacacgcgagcaacacagccggaaccacggtcatagtcacagtaacacccacaatctcccatccagcttcctacacttccctcgagatattcaaagatacagttctctcaaccagtaacgcctatcgccgagagcacaacgcaagccacctaacctggaacgagacattaacaaaatacgccaaacgctgggcagagggatgtaaatggaagcactcagtgagccacgctctccttatccgatag

SEQ ID NO: 7031 - DNA, 537 bp, A.fumigatus
caagtacatgtagcaaccgaactaataaacaagggtggtccatacggcgagaacctcgcctttggctaccaggatccggcagccgccgtcgcggcctggggcgacgagggccagaaatacgattacaagttaccgacaggattcagcgaggaaacggggcacttcacgcagttggtgtggagggcgacgagggaagtcggatgcgcggcgttcaattgcgggtatcaaaatgggaatgatgcgaaaaacaaagagggtcggtatacgagggcgcagggctggtatgtggtgtgtgagtactcgcctgcggggaacgtggttggaaaccaaaatgctttcttcagggtgaatgtgcagccgacgagtacatattctgggccggagacggcgggttctgccactgggaccagtgcgagtgcgagtgggagcgcgacggctacggcgaccagtggtgttgaggaattgtatgatgggcggttgagagaccagtatcagaatgcttttgttgggctcatagtttttataaatttagtatga

SEQ ID NO: 7032 - DNA, 414 bp, A.fumigatus
  unsure (17): Identity of nucleotide sequences at the above locations are unknown.
aacctgcacactttcgntggtcagaccttctccgaaaaccccacagacaagttcaagcaattcttctggcgccctcgcccacccactcttctcagcaaggaggagcagaaacaagtgcgcaagaaccttcgagaatactccaaggagttcgacgaggaggacagatacgccgtcgatattgccaatacagccgttgtcgagaagcgcaagcgggttctcaacgagtggattgcctggatccgccgggagaaggagctccttgccgaagagaaagacgcttacggtctccccgaggaggccgacgaccccaagttggccaaggacgccgctgcaaccacacaagagcaaggcgagactgttgtggaggagattgtcgaagagatcatcgaggaaagcgaggaggttatcggttaa

SEQ ID NO: 7033 - DNA, 990 bp, A.fumigatus
acatgtctccggtatcacaacagcggccgctccaactggacacttcacggcctcaccactcgcgccgcccaatccatcggccttcatcgcgacggacggcacttcaatctctcgccactggaatgcgaactccgccgccgactgtggtggcacattgtgacgtgcgaccaacgcgccgcggaggatcacggcctctccatcatcgcgcacaatgaaccttgcgacacgaacctgccgtccaacctcgacgaccaggatctctccgcaacggcgacagttcccccggcacctcagccgcgctggacggagatgactttccccctgcttacgatccaaatcaaccgccatttgcatgagatctcacgaaagacctcgcagggtgtctcgccagatccgctcgttagggaactcaaggactacattcagcggaattacctgcaatacggggacgccaatattccgatccaacagcagggccttgttctcgcagacgtcctcaccacgaaagtcgcagtctacgtgaggcagaaagcactacagattcacagccagggccagagccagtgcccaccgcaggaaagtgcgacggcgcaggagacgctggcgatggcttgccatggccttgaacgtgcactggaactgcagacgaacgacctgctccgtggcttccgctggcttaccgccacgtacacccagtatcacctcctgtgttacatcctgtggcatctgtgtgtgtatccagcgagcgtacatgttgagcgggcatggcgcagcgtcgaggcgatctttgaggtggtggaaagggatcccacgtggcctgacccggggcccaaatgggcggttatgtcccaattgagagccaaggcgatgagagcgagggaaggattgaccaatcggcaggccgatgtgcaggaaaagggaccagagaatgtcttggactgggggaattgggatctggagttgttcgggtttggggagtggactatttga

SEQ ID NO: 7034 - DNA, 207 bp, A.fumigatus
tatttccgtttctcaagatacgagacaagaatctggatgtcctacacttggctttccagcaccgccacaaatcccatgccaaccagcagcatcatccctgagaactccttcatctctgtacgcggcgccgcgacgaacttttgtccttggaattgttgtctgcgaaggaggagggctattgacatggaccctcgctcggcgcggtga

SEQ ID NO: 7035 - DNA, 1815 bp, A.fumigatus
tcaggcctttcatctgcgaatgagtatataatcctacctcaaagcccaagacattcctccgaagggctttcggaaaagcttcgaaggaggctttctcgcgagtcaaagagattgaacgtggtttcacgaagatctgacagaagatccggcacctccttgttctcgatctcttcgaagtctgcgaagtacaacggcgccgtcgtcacaccacatgagtttggaagtggcttaatgagcgaaagaggctatgacagtgatgcgcagttcatttccactccgacccacattgcggacaatgtaaaggctgcagccagtattggtcgtgagggtgtacttcctgcgcaaccctaccccaacgaagggaacagtttcttggcaaaggacggcaagtgtccagtttatcagcacacagaagtgtctctcagctcaccagagcatgaaagctggagtccgcaggcaatgcatggctttttcaaatcccacgaacccaatgtccaaagtcctaaagccagagggagtcctcgtccttccgcgagccttaacaatcgagcttcttccggtgagaacaatgcgaactgcggccttgtcccagctgcttcggcttcagcagcatccctgaacatcttcgaaggcaaggacatcatcactcctacccttcaagaacagtcagggtctcctggtcgtggctctggcacactactccatactttcaatctggttagcccgtccacagagcgctattcagaacttctcatcacaaaaagaagacaacgacacccgacatgcgaagaccagtcgatccacctcgcagaccttggcatctcgaagatgcttgcgtctgcgtcaacttcacctgttatcttatcacctagtcaatcaagctacgaggacccacacagcagcacctccggtattgggactacgcaataccaaggcggtggcattggtcgtcccgctaggatactaacaccggtctgggacggaggagtattaaagctgggggtgcaagatgcaaggcaagcgtcttcatgctactctcccaggacaagctctgcgtccgcggacgttccagcgaatcttgagaagagagaagtcagctgtagcaggacacctttcgctgctctttcctctaattcttcatctcgaagcgtatcactcctggaaaagcatgttccgtccttggattgtggctctcttggcaacacagatgctttgaagagcagatttaccgaacagtttgatttgaaccggtccataacctccctgggatccgttgcaatgcgcagtggagtgacgtcgccgcgcaaagtcagtattggatggatgtcgggagggcgacgtcttggctatggatatactgtggtagatggagacacgtacgaaactgctgagaaagactccggcaaagcatcgtccacacgatgggagtcgccgaacaaaccccctattgcgcatattattgatcgtttgagagtttcccgctggtctggcgcaactgctctcatcaggccttcaaatgccagcgactctgcgagttgcgactctgtcgtcaattctcgctcctggcgcaggttcgcagttcgaagaaagaatctcgccgacgctcaaatgtctgataaccgaagagttccatggagtcagaagcctacaaattgctcgagcgactgtgcgggtgagcgtcaagcatcggggcactatgcgcaagccttcaatgagagtctccgggatagttcgatggaatctgcgagagaactacagtcatcacacagtctgtcttcaccatcaggggggcgaaggatccgcgctaacgtataa

SEQ ID NO: 7036 - DNA, 1260 bp, A.fumigatus
  unsure (110),(220),(230): Identity of nucleotide sequences at the above locations are unknown.
cggtgttccgttcccgggattccgccaagccaaaggtttcgaaaaggttggacctttaagggccagccaagattttcccaaacgcgggaccccgggcaggcaagttgtcnacggcgcccagatcgggccatatttgaaccatgggtatctagggcgcatgaaggggtggattatgaagtacagcgtgttgccattaagagaaagtgggatcgactattgnagaagagtgncggacagcaggttacggtcaattaccgcgatcatacgcagtatgcaacgtttgatacgatcggggccctggcattcggaagggagttcaatgcgctgacgaatgatgatcgaacggttatccggtggattgaggctaccgggttgtacctggggattcggaagaattttcctctcctcaagctgtggccattttccagggtgttgcgccagtatcgcgagcggtacgagcgatttattgcttatagcaaggaatcagtgacgaggcgaaagaacctgttatccactgtgggggaaagaccaatggatctcctgcaggcattcattgatgcggaagatccagagaatccccacgtgaagatgacggcagatgaggtgatgacagagagcatcgcgatgcagctcgccggcagcgagtctacctcctttgtgacctcatgggtaatccatctcctcacgctgtatcctcagcacctggccaaagtcaccgaggagattcgcagccagttctctccctctcacctgatcacattcgccgagtgccgcgacaaactcccctacctggaggcatgcgtctatgaaaccttgcgatactccccgatcacctcaggctttttgcctcgcatctcctacacaaagggcctcaccatccagggacactacatcccccccggggtggagattgctatcaacctccatggggcgcacatcaacaaagacgtatggacgaatccgcatctctatgaccccacgcggtttctaggcgatgaccaagccaagcggaatgtatttgctttttcctacggtcaccgcaactgcattgggcgtaatcttgcaatgatggagattatgatcatcattgcgaatatcctcaaggagtatgacattgcactacctgaggatagcgtgcatgggccgtggaatgtggatgccctgggcaggccaaggatcatgcccacgcgcagtgcgttgttcacaacgcccaagtatccagagcgggattgtcggttggtcgtgtctcgcaggcagtaa

SEQ ID NO: 7037 - DNA, 1221 bp, A.fumigatus
agatcttcaaacagtaatttacacaagccattacgcagcagcagcttgtgtagatcaagcaggctaataagcaaggagactaatctgcgcgtcagtctagatgagggggaatacgaagcataccctaatgaatacaagatagccgctaagaatacagatgaatacaatagtgaaaggattggtcttgtatttggaatttcagctgtattatatcattctcccacccagagctatagcaaaagtgcagcagaaaacaagatggaaggcctcaacatatcaaaccaggtctttgatctctctcctcttgacattatccctagtcacctctacatcaccaatgcctttttctacgagaacaagacccctggccccaggccattcatgcaaccctctctcctcaaggaatcgttgtatcgtgccttgcagaacttcccaattcttcttggccatgtgcgccgtcaccgccgcaatgcaatgcagattgttgttgactgcgataatctaaacctcccgctctacgaagagcagacacacccgcagcttcacttccggcatctgaaggaccaccagttccatcgtgatgtgtggcccaaagacgccaatgtaattgatccgcgagcgtctcccaatggagaattgctccaagtgcatatccatcggctggctgaggagagcggcgtggtgatggtggtgcgtatagcccattgcgcggtggacgccaaggggtatgtagactttatgcagtcttggggatggtttgccaggaaccacagtcaccccgagggcgacagttggcctcgtctgctggcggaccgtcgggtgatgtacgagtaccttcctccggatgtacagccagctgctcctcgctcgatgtggcatcctgcatcatggcttctaaggctgttatcaacgctagttgtcctcttccttggactctataaacgcctcctcggcgacaaaactcccccggacgagatcgagagccatctcttctccgtccccccacacactttggaccgtctgcgctatgcagctacctgcatcgactcgtcctctcgcgtgtcagatcatgatatcatcagcgcgctcttcactctcgccttcgcacacaccaagctactgctcacttgccggacgcagaccgtcaacgacaagcgtcgcctgcgactttcgccaccgcattggtgtaccgagcatcttcacatgcaattgcgcaatcgg

SEQ ID NO: 7038 - DNA, 276 bp, A.fumigatus
tcaaatctaggctactgccttactccacgcaccatgaagctgtccgtcgctcttctctcttgcgctagcttactccctggcgccctgtccttttcggatgcatgcagacagggtctgctatactgtggctccaccttggagaagtataatggtacgtgcacacctgtggactcccagggaaagctgtcttgtccacttgctaaatctacgctcaacaggatactcatcaatggagctcctatcggccaccaacggcaatctggacgcctatcttag

SEQ ID NO: 7039 - DNA, 852 bp, A.fumigatus
ccgatatgcaagatgcgctacccctttgatcaaggcgaccaggagacatggactcaggtaggacagctactagtagccacaggactgtcatccatcatcgggatcgagcgagaatggagacacaaaagcgcaggattgcgcacgaatacactcgtcgggataggcgcagccctgttcatgctgatctcgaaactggggtcctttgacgtcctggcccgcggcctggtcgtgctggatccaagccggatcgcagcccagatcgtgtccggcattggcttcataggcggcgggatcatcttcaagcagcgcaacgagattcgaggcctgacgactgccgctggtgtttggctgagtgccgcagttggggctgcatgtggcgctggactgctcagattagcgagcgttgccaccgcgctgtacttcgttgcggtgctcgtctatccgactgtgctgcgggttctgcggcaataccttgatcggaaggatacgacggagatctcgcctgtgatacgctaccggattggagcggatgggctgcaaactctgctcatgaatatcatgcaagcagggtttcgtgtacggatgataacccgactagaagaagtgtttgtgaatcaggccgcgagtaaaggccctgcggggggcgatggataccagtcgatctcgagtatctccaggtcaccaatgacacctgcggcgcaaattgagagactcgagcggatctttgacattcgcctgacggtgaatggcacgagaggcccagatagtctgatgcatgctctttcccagctggaatcgatcatttcggtttccattgaggatgacgaaggagaattcgtccagagagtttga

SEQ ID NO: 7040 - DNA, 381 bp, A.fumigatus
  unsure (356),(368): Identity of nucleotide sequences at the above locations are unknown.
gagtctgaaatcaggatggcttcgcagcagctctctcccgtccctaagccacttgctctctttgaccgattcattgctcaacaaactgagacgatggctctaaaggagaaagtcttatccatctctggggatagtttcgatgtgaaacttgcaaatggccagcccatattccagattaaagccaagcatatgagcctctctggtcgcaagtctgtcttagacatggcgggtaatcatctgtttgatattgttaaggaacatctgcatatccatactactttcgcggccgtggatccccatgggaagaaactactcgaagtcaagagcagcttttcctggtcatgtgttttctaccngaccggggacgnagaccaagcgtaa

SEQ ID NO: 7041 - DNA, 420 bp, A.fumigatus
  unsure (56): Identity of nucleotide sequences at the above locations are unknown.
ttgggtactggagaatcaaactgtcccaggtatattctcgatagtcgtccgatttntaccgtctacgagctccaaggagttgctttgattcccgtcaaccggcgttcttctccccgcagtatggccgacgaacactcccactcaagggtcgagctatacgactcgggtctgacggatccgtcagactcggagatatactctgccaatcatgaagtttcatcacctatgtcggcatgtagttcgcccctgattctgtacaagcctccgtcgatctggggcatcttgcggggagcagcgatcaatttgatcctcccttttgtcaacgggttgatgctgggatttggggaattgttcgcacatgaggctgcttttcgtcttggctggtctaacacaaaggtacgttccatgaaatcgctgtga

SEQ ID NO: 7042 - DNA, 612 bp, A.fumigatus
ctcgctatactgcagatctcttcgttcagaccacaaagctcgagattccctgtgcgctatggcggccctacccagacactttccgggaaaatatcatggaagcccgcctcctccattcccggtgtcatgtccgcaagattcaattcaacatcctctgtaacggatgccgccgcgagtgagcatttgtcgggcgctcctaccgatacaggtgtacctgacctttctgatttatctgccgctgatcttagctcaatccctgagcacatcggatacctcaaagacctaggactcgactacggctggggcccgttctcaatcattcaattttcattgagcatatccacatatggggagggcttgccttggtgggcaagtgtcgtgggaaccggtattctccttccgatagcactcctgtatcctacgctgggcgctgtggacacctcgaccaaaatgctcaatatcaaacccgtcacggaaccttttgcgcagcagataataatccttggaaggaaagcaattcaaatagaaatgttgaaactaccaacccgaaattcagaagcttcaccaggagcaaggtatcgtggcatggaaagcattaattcccatgcttaa

SEQ ID NO: 7043 - DNA, 237 bp, A.fumigatus
tcaaggaagctgtaccttctacacctgaccccaaagggttatgtaagcaagaatagtaaccttatcaacccccgaacccccgcttcccgcgattatcttcaaatccttggaaccttcttattccccaacgctaataatttcattaacctaattttttttgtatatacccttttgctagggccaatcccgtatggtttttccaataattccaaccacccctgcccgcgtggtggaacc

SEQ ID NO: 7044 - DNA, 351 bp, A.fumigatus
tcgttgcccaggagaaacaatagaatacagaggtttaatgtcccttgctcaccaactcctccaacttcttcctcgtctcgccgatcttttcctccatcatctgccgggccatgccgctgtgcgccacacctgtgtaccacaggtactccgccctctcacggagagccaggtgcttctccgccacgacaggtaccttcttctcatactcccacaccaggtcggagacattgcgcatcgtcaccggaagcaaggtccaagcggcgacgataccaaaggccagcggcgagagcgagcggaggaagatgccacggttccgggagacgatggagccggccatggcggcgacgatga

SEQ ID NO: 7045 - DNA, 933 bp, A.fumigatus
gcgccctcggcccgtagacagcacaggcgagctgatcgttgcccaggagaaacaatagaatacagaggtttaatgtcccttgctcaccaactcctccaacttcttcctcgtctcgccgatcttttcctccatcatctgccgggccatgccgctgtgcgccacacctgtgtaccacaggtactccgccctctcacggagagccaggtgcttctccgccacgacaggtaccttcttctcatactcccacaccaggtcggagacattgcgcatcgtcaccggaagcaaggtccaagcggcgacgataccaaaggccagcggcgagagcgagcggaggaagatgccacggttccgggagacgatggagccggccatggcggcgacgatgacgtagacgccgccggggaggaggcgctcgccggattcgggcgagggggccagcgaggcgacggtgttggtgaaggcgttctcgatgtgcagggcgcgggagaggaagtcgttgaagctgttctcaacggcgagggagtggttgtagaggaagagacgggcctggcggacctgggccgtcaggatgtcagttggggtaggcgaggaggaggaggaagaggaagtttgtctgcgggtgggagggagctcgacgggggccctggtaggttcggggatgtcggttgggaggtcatcatagatgggttttttctgaagacgttagtcaagtcgaagatctgcaggcgtctctggtatcggaacagcctggaacatacgttgcccagaggctcttcggcgtatgcagtccgcctgggatacagggctacacctccagccagaagagtggctgcgattggagcaacagctcgctggacgagtcagcaaagcagcaagagagaaacggaaaaagggcactcacctgctggaacattggccggaatgacatcctga

SEQ ID NO: 7046 - DNA, 864 bp, A.fumigatus
tctatcgatgatagtttacaggtttttctgcctggtcgactcgccatgaaagaccaactcctggtgcctctacggcgtaggccatggacctgccaaaagtgcctacaacgcctccagctaccccggcaccagactcgtcgctcctttgagacggcagcatccccgtttcctcgaccgctagattctcttccagcggattacgcacggacaaagaccgtcgacgatgatacgcttcgccgagtgttcgactcccagcagttctggcgcgagttctcgcagcagcgggcggcccagcccaaactgacgggattggtccagaaccaatacctgacgagtccggatggcttccggacgttcgccaacgtatcgctgcagaaatgccaggcgattgtgtccaaggtcctggcggcctcgaccctcgaagaataccggacgatggcgcgggacctggaccggctgagcgacctgctgtgtcgcgtcatcgacctatctgacttcatccgggtgatccatcccgacccacaggtgcaagaagcggcgacgctggcatacgcgctcatgttcgagtacatgaatgttctcaacacgacgacggggctcaacgaccagctgaacaaaggcggggcgatccccgatgtgacctcccaatggtccaacaaggagaatatcgtggggcagattctgatcaacgattttcccaattcggcgaatcatatgccgccgcatgaacgggcacggttcgtgaaactgttcaacgaatttccccacctgggctccagtttggtcaatggtgccgaaccgggccaatttccagttcagtgttggcgaccaaaagcttggcgcggattatattcgatcctaatg

SEQ ID NO: 7047 - DNA, 207 bp, A.fumigatus
gcagcggacgatgacggagaggatcgggccagccgaacagccgcgaaaagaaaaaggcttggcagctccaacgtcaaccaacctcgatacttcttcctgttcatcagcaccaccactcgctttctctccttgtcctcccccccaccattggcattgattgacctctctccgtcaggatgtcattccggccaatgttccagcaggtga

SEQ ID NO: 7048 - DNA, 633 bp, A.fumigatus
cgtcttcagaaaaaacccatctatgatgacctcccaaccgacatccccgaacctaccagggcccccgtcgagctccctcccacccgcagacaaacttcctcttcctcctcctcctcgcctaccccaactgacatcctgacggcccaggtccgccaggcccgtctcttcctctacaaccactccctcgccgttgagaacagcttcaacgacttcctctcccgcgccctgcacatcgagaacgccttcaccaacaccgtcgcctcgctggccccctcgcccgaatccggcgagcgcctcctccccggcggcgtctacgtcatcgtcgccgccatggccggctccatcgtctcccggaaccgtggcatcttcctccgctcgctctcgccgctggcctttggtatcgtcgccgcttggaccttgcttccggtgacgatgcgcaatgtctccgacctggtgtgggagtatgagaagaaggtacctgtcgtggcggagaagcacctggctctccgtgagagggcggagtacctgtggtacacaggtgtggcgcacagcggcatggcccggcagatgatggaggaaaagatcggcgagacgaggaagaagttggaggagttggtgagcaagggacattaa

SEQ ID NO: 7049 - DNA, 810 bp, A.fumigatus
cgtggctccttccagccgccgtggttgaaaacgaccaccccctctcaccatccgtccactcatacactgcttcccacgggcggagaagggggtaagcctactcacaccggtggcactggcactggcactggcactggcactggtcatccgcagcctacaacgaccgtcgtccctggcggcgactctggctccgtctcaaccgtgaccgagaccatcaccaagacgaccttccagccatgctcgactcctatccacacccagagcggcaccacctactacagcacctggttgacgacgtctacctacgagacaaccacgtgctacacgacccatatccccacaacgatcccagcgtccccccagactacaaccgtcaccctgcccggtccaggaaacagctgtccccctccatccacagtcacggtaaccgtcacggtaagcagcggcggggatacaggaccgcacactcaagcaccagcacccggtggagacagcggaagtggtcctaatcctggtactggcactggtactggctccggaccctgcaagcactgcgagaccatcacctacaccaacacctacggctacacgaccactatcgtgatccccccgatttctgaacccacgagcagtgctaccacgcgcaccacgggaaccggaacaactactaccaagcctacgccccctgtgggaacgggcactgctcccggtcacagtcatactcggggatcaccaactgggaccggggttggacaggctcctactgagacgaagacgtggcattttgagaggagaatagtgcgggtgtag

SEQ ID NO: 7050 - DNA, 420 bp, A.fumigatus
  unsure (396): Identity of nucleotide sequences at the above locations are unknown.
ttccctccggagatagactgcacaatgaatgcagcagaccatgaaatcgagcgcgccgaggaggatgcgattccggtctcctcgcgtacgagtctcgactcctcgctcagttccagcagcgatggatcccagccgcggctgcgaacaatgtactcgcgacgcaccgagaccgacctcgagcggtatcagacctcgtcgcaggtcatagatcggatcgaaacccagcgtctgcagcatgcgctcaccgtcggagagagtatcaaaacacagagtcgatcgtcgggccgcgggcctctccccgcgttcggcgcgggcaagccgtatcccccccacttgcccaatcgggaaaaatatgtggtggagttcgacggggaggacgaatcgttgtttcctcanaaatggagcacccgccgaaagtga

SEQ ID NO: 7051 - DNA, 699 bp, A.fumigatus
gttatccctactagtggtctcgcgatggcagcacgcttgaaagttcttggcatggaaaacctgattatcgaacgcagcgaggaagtcggagatgtctggaagaatcgttacgaatacctctcactgcacttcccacattggcccgatgccctaccgtacttcaaataccctcagcactggcccacatataccccggctcagaagcaggggctctacatgaagtggtatgcctccgctctggagctcaatgtctggaccaaatcagaggttgtgaaggccgagcaggatgccgagggcaggtggaccgttgtcatcaacaaggagggcaaggagactcgtacgctgcatcctcagcaactcatcatggccacctcgctatgcggtgtcccttccatcccggccgtgcctggcatggctgtcttccgcggagtgatccgtcactccatcgcccacaagagtgcccgggactttgtcgggaagaaggtctgcgtcgtcggtacctcatcctcaggcttcgacaccgcttacaaatgcgcccgtctgggcatcgatgtgaccctcctccagcggtcaccgacgtacgtcatgtcgttgacccattcggttcctcgcctgctgggatggtactcgcccgacaaggatggcaacctccccaatctcgatgtgcaggatcctcttatgttctcgacgccattctga

SEQ ID NO: 7052 - DNA, 555 bp, A.fumigatus
gagacaatggcaacttatgttcaagaatccgctggcaccgattcagcctttccggctagcctccagtctaagggggcggtgctcaaccacgaccaggtcccaaagcccgtcgcagacgatttcatgtacgccttcaagtacaaccatagtctccccactaccgacgtcttaggcgttgagatccccgccgactgcgatgctcagaaggaggccgagggcattgtcgcccgtctctctacagccacatcacagggagatgcgcacgctttcgctgggctgttcctcgattatggtgagactctttcaaaaacacggcccgaaatcccgactttcgctgacttccaatgtacaggggtgtggcgtgacaagctctcattcacctgggacttccgcacattcaacttcagagcgggccatcctcaaaggccgctaccgatctttttgcttcagaccagggctacaaatttcacctttctcgagcctgcgcccttcggtgggctcgcccttttacccggacttctcgcagctacaattcgttgtgtccttcgagactga

SEQ ID NO: 7053 - DNA, 1389 bp, A.fumigatus
  unsure (1301): Identity of nucleotide sequences at the above locations are unknown.
tcttctccagcccttttatcttcttttaccttctctctactgctcccaggcttcatcatgataggtgccacgtccttcttgaaccactccgggcctcgaccgccgcgatatcgcactccgtctcctccgcgacgcgccgtggagcctatctctcctttcaccaccaccaccgactttcgtgcctcgtggattgaccgcggagactcgcaagctgcgagctatgatcgcgatcgggtcacatcgaataacgatgtctattcgagcacaaatcggggatctcatgggcgaaccagccatggtcgctccagctccacaattgacactctcgcgacaatcgccttagcgaccagccctacttttgcgcctctttcctacagacctccttctcaagacccaacgcctgccatgccactatttccttctcagtccattgaaagtacagaacgtccagccaagcgaccgcggtcggagaaaagtccgtctcccttacatcaaccacagacaaccgtcgcgccggatgcaaatccttcctccaccttcgacagcatgaaaaccgatgctgagcttcttctaaacttcgcgagaccaagcaacttccaacctgccgctttctacccctcgaagcgagtgagcattgatgagtcgtaccatcctcactacggcgaggaaccgaagagccactttcgggctggtctcggaagcacatatatccttccagatggcgagaaatctgcgtatcacacttccgcaaatactgcatttccagcatctcgaatgagatctcagtcggacggttcggccttcatttctcgaccggtcattcagggagtacggcccaacacaagctcttctacgcttcctccaattgtctggcaagaggaagaaggcaatgccaaaacgggcccaggacctccaagcacgaaattccccggggctgagacacgatacgagaattcagtcttcacagggatagataccggtgctgatcgggcatcattggatgtgcctccccggggagatgacgatacagaatccgacgagaacaaccaagcgaactgcgccgcctgtaatctggtccgaataccggtggattcagaagaacaaggggatgtcacatggatcagttgtgacgggtgcaagcaatggtttcatatcgtttgtgccggtttcaagaatgatcgcgaaatacggacagttgacaagttcatctgtcgccggtgtcggccgatccacggacagacaacgtttgttcgaaagtcttctcgagcccgcactgccattgattatgctggtctcaaccnaagtcttgtcaaggccgccagccattctctggaacatcattatattgaacccattcgagaaggcaagattcgctttctcccggaataa

SEQ ID NO: 7054 - DNA, 225 bp, A.fumigatus
ttgcttgtagcaagcacagaaactgctccttatgatatgagtgcaagtggtactttgagagctaatactaacccccaaatgaggaaacatgacagcgccatcccggaatctggagtggtggtgtctatcattataaattcaaaccctgaggctctaatttcaaggcagaacatgctgtcagattattctgacactaagaaaggttgcaaattgctctgtcactag

SEQ ID NO: 7055 - DNA, 198 bp, A.fumigatus
tgccatgaggcccagaccaacaccgtcgccaatgtcagtggcaccgtgataacccaatacagccagaaattccctgacatgatccacgacttcgccccaccatcattcgacaaatcgaagaagttcgtcccgaacagaccctacatcctcaaatatcagccattgtccgccaccaaagttcgacgaggcttgcattga

SEQ ID NO: 7056 - DNA, 264 bp, A.fumigatus
ttctattgtatgtcttctcctgctttgaccagcataatctcacgcccggaaaacagatacgccaattaccccgagggaagcatcgacgactcgcctgttctaagacagaaaaatccaaatgtctttttccctcccgaattcttccccgtcatcagggcagacctgaacgggacttttttctgcgactatgatatcgacggcgacggaaacgtcaccaagcatagtctgtccaaccccctgccctcgagctcaagcccatactga

SEQ ID NO: 7057 - DNA, 201 bp, A.fumigatus
cttcttcaggctggagtcacacatgcgttcgtcaacttgggttccgatcatccatcgatcctggaggccatggttaagggccagaaggagaagccagaccaattccccaagatcatcacctgccccaatgaggtatttctagagattcgcctctcccataccctgtcgcattcggagacaggtccgacttcaacctgctga

SEQ ID NO: 7058 - DNA, 291 bp, A.fumigatus
atggttgctctctccatggcagatggctacgctcgacttaccggaaagcctcagtgcgtgattgttcacgtagatgtcggaacacaaggcttagccgccgctgtacacaacgcttcctgcggccgtgctccggttctgatcttcgccggcctctccccattcacaatcgaaggagagatgcgcggctctcgcaccgaatatatacactggatccaagacgttcccgaccagaaacagatcgtgtccaatactgtcgttatacggccgaaatcaaatccggcaagaacataa

SEQ ID NO: 7059 - DNA, 651 bp, A.fumigatus
tccgaaggacccgtttacctgaccggtgctcgagaggttatggaagaggagatagagccctacacactagctcaaggcgtctggggaccggttgcgccatcggctttgacaccagaggccgttgagctgatcacctctcatttggctgccgccaaagagcctctagcgatcgtaggctactcaggtcgctctgctcgaggggtaaaagagctggtcacactcgcggatacgttcaagggacttcgggttttggacacgggcgggagtgacatgtgctttccgggcgaccatcctgcatcgttaggactccgttacggggttcatgacgctatcaagaccgccgacttcatcctagtcgccgattgcgacgtaccatggatcccaacacagtgcaaaccgtcggactcagccaagatcatccacattgatgttgatccgctcaagcagcaaatccctgtcttctacattccctcactagcgacttttcgcgcggagtctgcgacggcattcaagcagatcaacgacttcatcgcgtctagcaaggctctacaggaggtggtccattctgaagaacaagtcgcattcggacagcgccgggaagaagtctgccacaccgggccggaaggacacgcgaatggcgctacccgaccc

SEQ ID NO: 7060 - DNA, 234 bp, A.fumigatus
acatcaacaccagaacttcaatatacagcagtcttctacagcagtttctacaataaaattaacttgaaccgtacaaataaggaaacttatgccacataccagtacccaatatcaatcggactttaccccgcagcggagatactgcgatggcttcacgataatccccgggcatccccctctgttggggtactgttgacctttggaagctgccgaaatagtgagccagatacctga

SEQ ID NO: 7061 - DNA, 261 bp, A.fumigatus
tctggacaacacatttgggcctattgtcgtgtgcattggtctggcgattgccttggtgctgaatttcgccttcaaggtaagtctgatcggttcggagattcgattactggggctgacatgaagcagtattcggctactatgaagaagatcagggagcagcagcccggcgttgacacaccccctatgttcaacgtttcatttactccagtggaacatccggacacctggcgcttggtcaaccagggtggacaaggaatgtaa

SEQ ID NO: 7062 - DNA, 1188 bp, A.fumigatus
  unsure (95): Identity of nucleotide sequences at the above locations are unknown.
acccggggtgggaggggtctccccattacaaccccggaatggcatttccaaaaacccccgggggatgatcgcatttcgaatttccctttgacaantaacctgcggctcattagggaagacgcgctagacgaagaacgccgtgttcgtgacccgaccgattggcatcggagggatatcgacgatagcggaatgcagtaccccttcgacggcatcagaaccggcgaggtcaaccggttcccgcacgctttgctggagatcaagctgcggggcagcgcacatcatatcgagtgggtcaacgagctcatggtctcccacctggtcaaggaggcaccgcgtttctcgaagttcgttcacggtgtcgctcagctgtttgaggaccatgtcaatagcttccccttctggttgagcgaactggagaatgacattcgacgcgatcccgaaacagcgtttcgagaagaacaggaacggcttgcaaagcgtgccgaggatgatatggccgtcggaagcttcctgggcaaccgagcaagtcctaccgtgcgcccaatggttggatccccggttaccatgttctcggaactgggctcctcagcgcgggcaagacagccatcgcagcctgggccacagccgagtaggcctaccatacaggaaggagaaggccgcacatttcccgaggagagtgctccgggagaaacgcagccgataacgtcatcccgcttggccgcactcttcccgtctttccccatctcgcgatctagccgctcgcatcgacagtcggttgtcctgccacccggtgtgcgtgaacccctcacctggatcaaggattcgggccctgtccgtgtggagagcaaggtatatcttgccaaccaacgaacctttatcaagtggctgcacatcagcatcctgctttcttctctgtctctcggtttgtacaatgctgcgggcaaacacaacgatattgctcgcgccttgtccattgtctacacttttttcgccttgttcgccgccgcttggggatggtacatgtatgaaaagcggtcccggctcatccggcagcggagcggacgtgatctggacaacacatttgggcctattgtcgtgtgcattggtctggcgattgccttggtgctgaatttcgccttcaaggtaagtctgatcggttcggagattcgattactggggctgacatga

SEQ ID NO: 7063 - DNA, 798 bp, A.fumigatus
caagtttgccctgggcgcggtcggtccggacgattacatgagggaggtgtcgaaatatgcgtcagtcatctgcacatccaagcgaggataacggctaacatgaccagcctatacttggtatatctgtttatagccaaattcgtcctggtctacattcacactgcggccgcatcgatcgcggccattcgcgcaacgaaagcgctgcggctggactttctgcacagtctcatgcgccaggacatgagttactttgattcgaacgccgccgggtcaccgtcggtcaaggtcaccacgaacggcaatctggtcaccaacggcctttcggaaaagctgtccgtctttgtgcaaagctgcgctacttttatagcggcgtttgtagtcgcctttgccgtgcagtggaagctcacgctcattaccgtctgcatcgtcccgaccatcgtcatcgtcaccggaatctgcatgggtatcgacgtgaagaatgaggacaagctgatggggatctactcgcgcgctagtctggtcgccgaagaggtcttctcgagtatctcgacggttcatgctttctggctgcaaccggtgatggccaagcggtacgaggatcacctggccgaattggagcgcgtcggcatgaagaaatcacccaattatggcgtgttgttctcaaccgaattcttctgcgtttacgcgggatacggtcttgccttttggcagggcatccggatgtacgctcgtggcgaggtccatgagccgggggatatcgtaacgtgcgtctgctgcctgctagatggatgttcttag

SEQ ID NO: 7064 - DNA, 276 bp, A.fumigatus
ctgaggccagatgaggtcgaggaagcgccaaagccctctggccttaggagctacatgcgcatattcaactacgcggacagaacgagcatgattttgtacgccatcgctatggtcgccgccatcgccgctggctcggcccttccgttgatggatctggtgtttggcaagttcgtgacgacgtttaacaagtttgccctgggcgcggtcggtccggacgattacatgagggaggtgtcgaaatatgcgtcagtcatctgcacatccaagcgaggataa

SEQ ID NO: 7065 - DNA, 624 bp, A.fumigatus
  unsure (621): Identity of nucleotide sequences at the above locations are unknown.
ttctctgtcagtgtcattttcgctgtcgtcgttgctgctacagctctgacccaggtcgcgcctcaaataatcaccatcactaaagcagccgctgctgcggatgagctcttccgcgtcatcgacaagcagtctgccatagactccctctcaatctcaggactggcgcctgagacatgtgtcggcgagatcgagataaaggctctcgacttcgcctacccttcgcgcccggatacacaggtcctcaacggtctgaacctgagcgtccccgcgggtaagacaaccgccctggtcggtgccagtggttcggggaagagtaccatagtcgggcttctcgagcgctggtatgaccccgcggccggtacaatcctactcgacggcatcgaaatccagaaactcaacattgcctggctacgcacgcaggtccgcctcgtgcagcaggaaccggttctctttagtgggacgatcttcgacaacgttgctttcggcttggaagggacatcgtacgcagaggccccgtacgagcagaagcttgctcttgtgaaagaagcttgtcgtgatgcttacgcgcatgagttcatgtcttcaccacggggctggaagaatcagggtcctcattggggntca

SEQ ID NO: 7066 - DNA, 207 bp, A.fumigatus
gcgtcgagttattgtcttcctgggagcacaacaactcgactaccagcaagccagaagtctcaacgggttctcgggatacaagacgttcatcgacttgcattagatacaatcgaacgcatcactgagttcgagaaacttaaaggatcccctgtgtttaacgcgagacacaacaactgctgcgcattgctcaagcatcacatcgtccac

SEQ ID NO: 7067 - DNA, 867 bp, A.fumigatus
actacgccattcggcacgtcccgcgtggatcctgcaggaaagaaaaagtacggaatcgccaaagtaaactaccgtatctcaaaactgcagaggcataccacatctattcaggtcctcaaacacaaaatgaaaccatccttaccgctgcgacgcatttgtcgcgggacaaacatcacaatccgcccgccaacctcgccagcactcgtcccacgcattttacatgagcaacgaacaccacctgctccaagcactcgctcaacacctctcacagccacaacccgccgatccttcaacctctcgtcgctttcctccttcttcccccccagcaacggcaatggcaacgacaacaataaaagccgcgtcctaaccgccacccgcaccctcccctaccaacctagcgcgctcttcaaggtcatttcctcggtcgaatcctactcgcaatttctcccattcctcacagcctcgaccgtcacccaccgcgacccggaaacggggtacccgactcgcgccttcctaacagtcggctacgggcctctcagcgagaccttcacgtcgcgcgtggactgcaaccgggacaagtggactgtcgaggcgcgcagcggggccaagttcggggtggactcgaaggatgggcaggagggggggatctttcccggcgcgaacgaggggatttttgagtatttgagtacaaagtgggagttggtgccggtccctgggggaagtgtgcagacacgggtgcagctggagattcagtttgagtttcggaaccagtttcatgcggcgatgatgagcgctgttgaggggcagatggcgggcgttatgattgaggcatttgagaagaggattagggaggtggaagggaggtaa

SEQ ID NO: 7068 - DNA, 225 bp, A.fumigatus
atctccagctgcacccgtgtctgcacacttcccccagggaccggcaccaactcccactttgtactcaaatactcaaaaatcccctcgttcgcgccgggaaagatccccccctcctgcccatccttcgagtccaccccgaacttggccccgctgcgcgcctcgacagtccacttgtcccggttgcagtccacgcgcgacgtgaaggtctcgctgagaggcccgtag

SEQ ID NO: 7069 - DNA, 270 bp, A.fumigatus
cgcccgccatctgcccctcaacagcgctcatcatcgccgcatgaaactggttccgaaactcaaactgaatctccagctgcacccgtgtctgcacacttcccccagggaccggcaccaactcccactttgtactcaaatactcaaaaatcccctcgttcgcgccgggaaagatccccccctcctgcccatccttcgagtccaccccgaacttggccccgctgcgcgcctcgacagtccacttgtcccggttgcagtccacgcgcgacgtga

SEQ ID NO: 7070 - DNA, 393 bp, A.fumigatus
atgattgatgaagacgaggaagacgatgagggctccggagaagaagagtccggtaagcgcaggaagtcgaagaaacgcagacagaggagggtttgggtgaaccagcttcttggtcgacgaatgcgcatggagttcgcggaggatgcgacaacacggtacaagaagcggtttggtaaagatggggaaggcaagaagaaagatgaatcggtcattactgaagtggaagatgggcctcttgagcgggagtccaccggagacaggccgcaacagtcacatcctgagaagcccaagagaaacaacaagcctgaatactcaagatacgccaaagaaaccgtgcagaagcttagcggtgctattgtcgaaccccaaggaaagaaaatcacttttgactga

SEQ ID NO: 7071 - DNA, 747 bp, A.fumigatus
cacgaagaaacatcgcatcctgtgttcacttatatcctttttttccatcgcctacgccaaccaaaaatggcttcacgtcgtcgcaacatcggtgctagtcggcggaggagaagaagagatgaggaaggcgaggatgaaggttccctagaggaggagttggaggatgattcgttaagcgagggctcggtcatcagtcatcccggtgatgatgatgatgatgacgacgacgacgatgctgatggcgagggaagcgacgagagcgacggggaggcttcttcgtccccgcacttggacagaaccaacagacctcaggtcaacggtctcgtgcctgaaatcaaccagcggtctggacgacgccattcctcatctcccggaaaacgacacatagctaccgctgtgtcagatactgaggcaatgatgaatggattgacgctgtctgatcaagcaagtgaagtggcagaaatccactttgatgatatgaagggagagtctggttcactgacaggaaggacaccatctgcacctcctacagaagcgaagagagggacttttgcggagcgaaaacgccgcgagcacgaacggtatgcaaaggagcgggatgagaatccagccttcgtacctactcgaggacgctttttccttcacgataagcgttccaccgagcctggtccgaatggccacaggccgttcagcaaatcaaagtcgagaccttatggcctcattgtggatggaaatgttcgcaggtaa

SEQ ID NO: 7072 - DNA, 1713 bp, A.fumigatus
ccagaaagtagcaacggaattcgcttctccatcaccgacctttccccacccacagcccggctcctgccaacaatctaccaagaccgggtggggatctccctctacgatgcccaattctcgcagacggagaatgggcagagggtgcgggggcctgtctcgcaagagatcattgagcaagttgtggaccgcctcgtccggttcaaaatcacctgcgatgacttttgcgtacccccgggcaacatccacgtcctcgctacagaggccacacgcacggcaccaaactctgacgagttccgggcgcggatcaaggcccgcacgggctgggaggtgcgcatgctctctaaagaggaggaggggcgcatcggggcgttgggaatcgctagcagctcgcattctgttgcgggacttgcgatggatcttggtggggggagtacgcagattacctgggtgatggaggaggatggggtggtgagcacaagtcccctgggttcgtttagtttcccgtacggggcggcagcgttgaagctgcgctgggaagaggcgaagaggcaaggcggggacgccgaggcaaagttgaaggagcagatgacgaagaattttcaggatgcgtacgcgcgtatacagcttcctgaacgtctcgttgaggctgctaagcgcagtggaacatttgacttgtatctctgtggtggagggtttaggggctggggttacatgctcatgaaccagtctaaggtcaatccgtacccgatcccgattatcaatggctaccgagcgcgcagggaggatttccacgatacggtatctgttctagagacggtctcggattctgaagtcagcgtgtttggagtgtcgaagcggcgggcatcacagatccccgcggtggctgttctagtcaatgtgatcatggacgctctacctcccattacgcatatacagttctgtcagggaggagtacgtgagggctttttatttgatcggcttccacaagaggttcgggcagaacacccgcttctatctgcgacatcgccatacgcgcctccatctgcagaggcaatcaaggaccttcttctacaggccttgccaacttcctcatcaccaaaagcatctttgcaagcaccagaatccttcgatgcttgtttgataagtgctctcgccaacatgctgtacgcacatgctcaagtgcaccgggctagccgatccgctgctgcgcttcatagcacaaccactgggattctggcgtcaatcaataatcttacacatattgatcgcgctctgcttgctctgatcctctgcgagcgatgggagggcgacctccctccagcagaccagacgttccactaccagcttagcagatgtgtgtcggcgcaagaggcatggtggtgtcagtaccttggccgagttgccgctctcattggagacgtgtatccggcaggccgggtcccggagacgggcgatagaatccaattagagacaacttggacgtctacagtgaagaagaaggaatcgtgcgatatgttgtgccttcggataattttcggcgacgatgctgctgctgctgctgctactgggcggcatatgctgcaggaacgggcggaggagattgagaaggccgggaagaaaaaaaactggatcaacgagtatggcgtgcgagtgggcactcacatcttctaccaatctcccagtacagccaggatatcgcaaaggaatttttga

SEQ ID NO: 7073 - DNA, 981 bp, A.fumigatus
accacttgccactctatcatgactgaacaagtccgatttgtcactttggacgtcttcacatcacggccgtatgctggcaatccactagccgtggtgttcctcccggactcaaacaagccggctgtgacacaacagcagaagcagtcgattgcgcgcgagttcaacttgtcagagaccatttttgtccattctgaaaagggagaaaaacgcattatcgacatcttcacccctgacagtgaactcccattcgcaggccatcccaccataggagctgcctgctggtttctatatctttccccggacgaaggagacaagggagtcgtcaagaccctgaccaccaagtcgggggatatccccatatcgctgcaattgggacagccctggcctgcagtaactgctagaatcgcgcataatacacggctgcaccagtccagatttccgctccagcaactgctccgattgcaccctttcttgtctggctttttccgtataaccggtaccgtggagccagctttccccatcttctctatcgtcaatgggatgagccaggtccatgtcgagctgccctccctcgaggctctcgctgctgttaccacggcctcgggtggtgaggttatctctgggggctctggctatctggatgaaggttgggatgcaggtctctgtgtgacgtacttctacgtacgcaatgtcaaggacccacagactggtgcaaatactattcggaccagggcgattttcggaaacctagaagatccagcaacaggaagtgcggccagcggtctcgcggcttatctgtctttgatggaaaggaaacctggtcagtataaatacaacattgtgcaaggggtggagattggcagacgcagtgagattggggtagaggttgtggtcaaccaggataacaagatcgacactgttgagcttcagggaggcgctgtgaaggtatccgaaggaaacattctactgcctccgaaatga

SEQ ID NO: 7074 - DNA, 708 bp, A.fumigatus
tccctacaacactccttcgaggatcagtcttcggtcgtcaacaggatgagctcaacacaagcacccgtcgagccacccaagagacgccgcattggagtcctcacctcgggtggtgatgcccccggtatgaacggagccgtacgggccgttgtccgtatggccatttactccgactgcgaagcgtacgcagtgttcgaaggttatgagggattagttcatggtggccatatgattcgtcagctgcactgggaagatgttcgtggctggctgtccaagggtggtacactgatcggatctgctcggagcatggcttttcgtgaacgtgctggacgtctcaaggctgctaagaacatggtgctccgtggaatcgatgctctggttgtctgcggtggtgacggaagtctgaccggggcagacgtcttccgttcggaatggcccggtttgctggaggagctggtcaagaatggtgaattgacggaggaacagatcgaaccgtacaaggttttgaacattgttggcttggttggttcaattgacaacgacatgtccggcactgacgccacgatcggctgctattcctctctgacacgaatttgcgatgccgtcgatgatgttttcgatactgcgttttcccaccagcgaggtttcgttatcgaggttatggggcgacactgcggttggttagcttttcttccaccacggggatga

SEQ ID NO: 7075 - DNA, 390 bp, A.fumigatus
gctctggctgtcacgtgcctcggcgtcacttccatcttcatttccagccttgagaaatctttcagcgctgctcacaagtcgttgacgcagggcgcgtctgtagccgtcaccatggctgatgatagatttactcttcccttgcgccccctgatcgaaaagcgcgaccgtccggatccattgcctctcgagatcgcccaaattaatgctcagtggggatcgttccgcgatgtgagccaggagagtctacgtgcgaagatcgaggaggagaagagcaaggagtacacaattgaagaggaggagggcgagggagcaggtgctgagctggacacaacagagcgcttggatcaattatacaaacgacgagcagagatcattcagtttgcgatgtaa

SEQ ID NO: 7076 - DNA, 474 bp, A.fumigatus
  unsure (289),(380): Identity of nucleotide sequences at the above locations are unknown.
atagcagccagaagtggtgcatccgccgatgaagggatccgtggtggggttctcccagtctcgggcggtcttcttgataatacgccccaagccagcaactcagcgattattccgttcgtcccccaatcgatgagtttcggtatccttctgctttggatcaccttatggatgtctccagcggcccgttggcacatcatttgccggctttgtcaggggctgctccaaccgtccgcggaccagatggtgtataaaatgaccgccatggacccgtcaccggcctcatcttctnttctcttggagttccataataaatcaccccactactctagcttaccgtttgttcttcatctgtacttcacacagttttttctccagtacantactcttttcacacacatcctcacaatccaatccatcaacatgtatggactcaaggccggtgacagcttcccctctgacgttgtattctcgtaa

SEQ ID NO: 7077 - DNA, 405 bp, A.fumigatus
ctctcatttagttacatcccctggtccgaggacaagggtgagatcactgcttgcggtatccccatcaactacaacgcctccaaggagtgggccgacaagaaggtcatcctcttcgctcttcccggtgccttcactcccgtctgctctgctcgccacgttcccgagtacatcgagaagctccccgagatccgtgccaagggcgttgacgttgttgccgtcctcgcatacaacgatgcctatgtcatgagcgcatggggcaaggccaaccaggtcactggggacgacactgtatgttcacatccgaagaaagaaattctgcgatttcactatttggtagtcgttactaatgctctgattctctacttttctaccaccgggggacgaaggacaagcgtacggtcttaa

SEQ ID NO: 7078 - DNA, 939 bp, A.fumigatus
tctcccagttgtagcccctcttgcacccccggtgaagacttcctactagcaatagcgttgtgccacacatgcataccggagaagaacgagtctggaagtgtttcattccaggcagcatcccctgatgaactagctctggtgatggctgcgcaggaccttggctatctcgtcattgatcgccaaccaaacaccctgactattcgaacttaccccaatggtccagaagaagagcaccaagatgaggtctatgaaattttggatgtgatcgagttcacaagcactcggaaacgcatgtctgttgtggttcgaatgccggaccaccgcatctgtctcttctgcaagggtgctgatagcacgttgatgcggttgctcaaacgttcctcccttgctcacgaaaaggcagtcgagattgagcggcgtgccagcaaacgtaaagcagccgaggcaaatgaggtaatgagacgaaatagcgagcaccagagtcggaaggatagtggggtcagggccagcttcagccggccaagcttcagtcgtcccagcttcggtcgacctagcatgacaaagaacaggcgctccagtgtttctgggcagaacgtctctgtgttgagagagagcatcgatgtctggcttcgtgatcgtgagactgatggtggtcttttgacaagggagtatgatgatgagtactacagcccgcgtccgtctgctcaacttggcaggcagtccacatctttctcggactctggaagctctgtcaatgaggaggaccaagatgatctggtcgaggaggctctggtcgtgaacgaatcggcagtctttgagaggtgcttccagcatctaaatgattttgctacggagggcttacggacgctcatgtatggccatcgtttcctagacgattccacgtatcacgagtgggaaggcgggctatcacgaagctag

SEQ ID NO: 7079 - DNA, 1683 bp, A.fumigatus
acgattccacgtatcacgagtgggaaggcgggctatcacgaagctagcaccagtctcattgaccggcagggaaagatcgagaaggttggtgctcaaattgaagaacagctcgaactgaccggcgctaccgcgattgaggataaattgcaaaagggagtccccgaggccattgacaaattgagacgcgccaatatcaagttgtggatgctcacgggcgacaaacgtgaaactgccattaacgtcggccattcttgccgtctggttaaagactactctactcttgttattctcgaccatgaaactggagatgttgaacgctcaatcttgaagatgactgcggatatcagtcgaggttctgtggctcactctgtcgtcgtcattgatggacagactctatcgatcatcgaatccgacgagactctccgggctcaattcttcaagctggccatcctagttgattctgtcatctgctgccgtgcaagtccaaaacaaaaggcattccttgtcaaatccatacggcttcaagtcaaggattctgttacccttgctattggagatggagccaacgatattgccatgatccaggaggctcatgttggaattgggatcactggcaaggaaggcctacaggcagctcggatctccgattactcgattgcccagttcagattcttgctgaagctactacttgttcacgggcggtggaattacatccgagcctgcaaatacacgcttggtacgttctggaaggagatgctcttttacttgacccaggcactatatcagcgctggaacggctacactggaaccagcttgtacgagccatggagtttgagtatgtttaacactctgttcacatctctcgctgtcatctttcttggtattttcaccaaagacttgtctgcctctacgctgctggctgtcccggagttatacaccaaaggtcagcgacatggcgggttcaacatcaggatctaccttggatggacgttcatggccacctgcgaagctatgattgtgtttttcgtcatgtatgggcttttcggaaacgtcctctttacaaacaccggaagcgacatcttctcggccgggcttgtcacctactcggcttgcgtcatcatcatcaacacaaaactacaggccttggaggtgcataataagacctatctttctttgatcgtcattgtgatttcagttggaggatggttcttgtggaacctgattctctcccgccggtatcagatcgaatctggtgatggcatttatcacgtgccgtgcaacttcatcttgcagtccggccgcgacctggctttctgggcagttctcttcgttacggttgtcgctgttgttgtcttcgaggtgtctgtcagcgcgatcagagcgaacctcttccccacagacgtggacatcttccaggagtacgagcaggacttggatatccggaagagattcgaagaggcagccgcgtccgaattacagcaaggctgggatcgcggcaagaagaaatcgagcttcgagctggctcgagaggcggcggaaatggaagcgcgtgagaaacaggtccaagagcttctggcgcggcccagagtcatgaccaagactggctctggccagattgaaatgcaagaaatcgatctgagcgagctaaacggttccagcagggatgtctctggacaggtgacg

SEQ ID NO: 7080 - DNA, 1869 bp, A.fumigatus
ccttccctgggccgacctgggtcacggtcgcaccccgcagccatgttggaaggcttggtcgcaaacctgctcaatcgctttttgggctattatgtcaagaatttcgatgcaaaacaattgaacatcggtatctggtccggcgatgtcaagcttcgcaacctggagctgcgacgggaggctcttgatcaactacatcttccgttaaatgtcgtcgaaggccacctcggcgagctcaccctgtctataccctggtctaatctgagagggaaaccggtcaaagttgaaatcgaagatgtgtttctcctagcagccccgaaggaagatgcggactatgacccggaggaagaggaacgcagagcttataacctcaagatggaaaagattgagagtgcggaaatcttgagagagcggaatacagaaggtatgagccaggaggagcagcgacggaaccagagcttcacccagagcctcgtcaccgccgttgttgacaacctccaaatatccatcaagaacgtgcactttcgatacgaggactcgattgcttcaccaggtcaccctttcgccgtcgttctaacactgaaggaacttagcgctgtgagcactgactccgagtggaaccctactttcatccaatcgacatccactaccacccacaaactagctacactgggtgcgctatcagtatattggaacactgatgccgagcttctgggcacagggcgaggctctgacctaggggcagaagcacaaggcattagtcacgcggagctgattgagaaactaagaacttttatcgagagcgaagagagccagcagtttatgcttcgccccgtcagtggccgtgctggcttggagttggataagtcaggaaagcatgaccggccagccatcaagacacgattactgtttgatgagcttagtttcgttctggacgatgatcaataccgcgatgctctaatgctagtcgatcttttccattactttcttcgtcatcaggaatacaagaagctccagccgaaatgcagaccgaaagaggacccccgggcgtggttcagattcgccggagaagcggttctcagcaaaattcacgatcgaaacaggcgctggtcgtgggactatatcaaagaacgacgggacgaccgtatagcctacatccatctgttcaagaagaaaaagcgggaggaacccttgtctccacaggaggcagaggattttgaacgtctagaacgaaagctgagttacgaggatattcgattctggaggtcattggcgagaaatcaactgcgaaaggaaaatattggcctcaagaagcccgcgcgccagcaaacttggtcggaatggatatggggcaccaagaaggaggaatctgaagagaccacgatgaccgaagagcaacggcaagaactctataatgccattgactgggatgagaagaaagcgatcgccgagagtgtcgaagtgccgagagagtgggtaaagcttcaggtcaactccggtctcagagccggaagcttcacattgaggcgtgatccccacggaaagtgcagtgaagtcatgaaattggtgtttgacaatctacgagcgaaggctttgcagcgcccggattccttcttcattgaagttgacctgggtggactcagagtgtatgacggaacaaccgagggtagtctctttccacagatagtcaaggtcaaggattctctcccacagtccgaggacagtcaaacgcagccccctgacggcggcgagttgcatccggaagccaacgaggagtacgaggaggctgaggataacctgtttcaattccagcttgagaagaacccactggagggtgacgccgatgctcacgccggggtagggggtacgccc

SEQ ID NO: 7081 - DNA, 1338 bp, A.fumigatus
aagcgcgggtccttccagcccctgtgggtgaagacgcaatgccgcgtcgctgatcacaagtacatacaggagtcgtacattgagctcccgcatgacggcatcagaactagagatgatctctcaggctatctgtcgctggagggtccaggctaccattatagtcagagagacatgcgtggagcggccctcccaattgagaatgcgtattccaaccaagcccagctaaattatacctgccacgactccgttcaagccgatgcagaagttttgaaggtcgtccgtcaaaagcttctgagaaatatctccagttcaactcgggcagaggctttaggcgatgctgaagctcaggctcccaattctatccgggtttccttaccgtctcatgacaggaagccaagctctgctgagagcgattcgtccaaagctagcagcaaacgatcgatcaaagaagaggcaactgcattccttcagagcgtcgttgagaactctcacttggatgccaaaggaaccaggtccctggctgtgacggtgcagtccgaggagtctgctgttgcgcggctccaacaaggaagtcaggaaacagaatatgtgaaatcagagcctgttagcatgtgtgaccgtaatgcaagcctggaagacacgcgcctaatcaatgaacagatcaaccttggagacaaaggtaccatttcgcttttaaacgcgggcactaatgaataccttctccgcaacacgaatcatcatcttgttcatagggcagatataataaaggacaaccaaggaaacacttaccataagctgtttatagctaacagcaaggctgtcccacctccaccggggcttcctataccattggagcaacagaaggatgctgattccttgttcttcgataccttagcaccaaacagagctaggctcgaggaagcgaattcttggttccataccgataacaggggtgccagtgagctccgacagctggtttcgtccatcgcttatgataacgttgaaagagaagcattgcttcacggtaattctcgccctacttcagagactacaactgcatggcagacgactctgcttctgggaaatgttattgccaatcttcaattgcatgcatccagtgatcttacccaacaggcagactacttttcagattacgcagtggtcgattcggcttgttgcgagcctagccacggcgggcgccgcagttatttctttcaggaccctgcagttacccattggaaacttccagccgatcgagctaccccgggaactgcaaaagagtcagaatatgaacttgccgggcctcaaatctacagtcagccttctggtacttggtag

SEQ ID NO: 7082 - DNA, 1185 bp, A.fumigatus
agaggtctcctccaagtcctctccttcctattccttcttctcgcatcacaggtagtgacagaacacacttcaaactgggctgttctcgtttccacgtctcgattctggttcaactaccgccatcttgcaaatgtactctcactatatcgcaccgtcaagcggctggggattcccgattcgcagatcatcctaatgctacccgatgacatggcctgtaatccccgaaacgcgtttccagggacggtctacagcaatgccgatcgcgcagtcgacttatacggagataacatcgaggtcgactaccgaggctacgaggtcaccgtggagaactttatccgtctcttgaccgaccgactggacgaggacgtgccgcggagcaaacgcctgggatccgacgctggaagcaatgtgctcgtttatatgactggtcacggaggcgatcagttcctcaagttccaagactcggaggagattggagcctgggacctggcggatgcgtttggccagatgtgggagaagaagcgctatcatgagctgctattcatgattgacacttgccaggctaatactatgtacacccacttctactcgccaaatattattgcgacaggatccagtgcgctggatcagtcctcctactctcatcatgcggataacgatgtcggtgtggcggtgatcgaccgttggacatactatgtgctggagttcttagaaactcaggtgacaagtgccaattcaaaggcaacgctgggagatttgttcgactcgtacgacgagtcgaagattcattcgcaaccaggcgttcggtgggacctctttcccggcggggagcaggagggccgcctgagaactgtggtggacttcttcggtaatgttcaaaatgtcgaagttgagcatgcaaatgccactgagcccggatctttgaaggaggatctcattgagatcgctcgactggttgaaaaatggcgcaagcgtgatcgggactttgcgtctctcagagagccgcttcatgaaaacaaaactgatgcacctccctcctctcaattcacaaaggcccgaaatgtcgcgcctgtacgcatggcagctgaatcttcatgggaaaagcggctcgttggagcatcagttctgggcgcatgcgctgctgtctggctcgctggatcgatattgggcaggccctcagtctaa

SEQ ID NO: 7083 - DNA, 258 bp, A.fumigatus
cgtttcttcatcagtccaaagtatcactctgctaactgcaccgcatcagcctgcaaaccctttggtccgtccatcaactacttcgaatgtgaccgcctgtccatccttcagaaatacaaagccatgtccctggattggtcgaaaatgcacaaagacatcttcaccattgctccggcttataaagcaatattccttttcctcattgaaccatttaacaattcccgcttctctttagcccatttggctcagctagggtaa

SEQ ID NO: 7084 - DNA, 186 bp, A.fumigatus
agagaagcgggaattgttaaatggttcaatgaggaaaaggaatattgctttataagccggagcaatggtgaagatgtctttgtgcattttcgaccaatccagggacatggctttgtatttctgaaggatggacaggcggtcacattcgaagtagttgatggacggaccaaagggtttgcaggctga

SEQ ID NO: 7085 - DNA, 732 bp, A.fumigatus
  unsure (684): Identity of nucleotide sequences at the above locations are unknown.
aacctatcgcggacctttcggctctgtggtgaacacgagaggatccgcagaaaatccacaacagatccgaatgcggtagactttggtgatgtacctttcgatatacccatcacccgctcactcactgctgcaaatacaagtggcgtgccggctactttctgcctcgagaggcccgatcatggcagtgaacaaaagacaccgtcatggctggaatacaaaattgaagcacccactcaccatgaggaagataagaaaaggaaaacaaacgaacgtactctgtttcccggggagctcgccaacattgatataaccgcacatgttcgagatatcgagcatgttcgtttgctgaacaatggtcaactcaagcttgaggacatccttgtccttcgcgtgaccggcggtcgcgatcatttcatctctgcttatgggcagtggttgcctacatgttttgggcgcagcgtggaagaacttactatgatgcccgaagccggtgcgcgaagcctattgaaaagggataaatcagaaaaagagcgtagtcatgttgaaactggccgcctatccgcccctcgtgagcttttccgcctgactgaggctatttcaaaacagtctgaacgtgccattgctgagtggggaatgacaaaaaatgattccgacgaaaaattgcccccatgggcaaaggaacangggtgcggatggccatttgacccaaaaacgtggaccttgaaaggataa

SEQ ID NO: 7086 - DNA, 300 bp, A.fumigatus
gcttcgcgcaccggcttcgggcatcatagtaagttcttccacgctgcgcccaaaacatgtaggcaaccactgcccataagcagagatgaaatgatcgcgaccgccggtcacgcgaaggacaaggatgtcctcaagcttgagttgaccattgttcagcaaacgaacatgctcgatatctcgaacatgtgcggttatatcaatgttggcgagctccccgggaaacagagtacgttcgtttgttttccttttcttatcttcctcatggtgagtgggtgcttcaattttgtattccagccatga

SEQ ID NO: 7087 - DNA, 1653 bp, A.fumigatus
  unsure (51): Identity of nucleotide sequences at the above locations are unknown.
ccactcccttcactgcacatgactccgcaatttgtttcacctgtaccttcntcagtctcatccgcggcagcatcacatacttcgaatgatcctcgagatggagagtctcaggtaacacgagctctagcgggcatgaatctgtccgccgcgaacggggatgtactccccgtacatccccagcccgtaaaggcgacaactacaagagctactgtggcaaatcgcctcacccgcatgttctcaaatactgggaaaatgccgtcaaaggaacccaaggagagcagagaaccagatcccgctcgagactcttcagacagcagtacggaaagcataaacgctcctacaaatggtagcgcagcgccatctagacccacatcaagaccttcatctcgagctccctcgcgacagacgtcgacgaaaggtgacaacgaaaaagaaaagaagacgaagcctacaaatggaaaagaccaaagggaaggttctatcgttcacaagcgatttgaaatgttcccagatggcacacactgtcatcatctcaagagtgcaagacggcaggagaagctgaccgaccttctgcgagacatgctgggtggtggtagtagaaaaaaggacgaccacgtagatgaccagcaattgtcactaatgtctacttggatcgaccaattcaaaactgagcgtgacaaattggccgccgacaagaagggagggcccaacgccacggcctctctcgttgacaaatatggcaaatgtcaagagatcgttggacgtggcgcctttggcattgtccggatttctcataaagtggacccgaaggactccagagttgagcagctctatgctgtcaaagaatttcgccgtcggccgcaggagactgccaaaaaataccagaaacggttgacctcagaattctgcatttcttcgtccctccgccaccccaatgttattcacaccctcgatctgttacaggacgccaaaggcgactattgtgaggtcatggaatactgtgccggcggagatctctacacactcgtgttggccgctggcaagctggaagttgccgaggccgattgtttcttcaaacagctcatgcgtggtgtagaatacatgcacgaaatgggcgtcgctcatcgtgacctcaaaccagagaatcttctcctgaccactcacggggcactcaaaattacagacttcgggaatggcgagtgtttccgtatggcgtgggaaaaggaagcgcacatgactgcgggtctctgcgggtctgctccatacattgcgcctgaggaatacgttgaaaaggaatttgatccgagggctgttgatgtctgggctacaggtgtcatctacatggctatgaggacaggaaggcacctgtggagagtcgcccgcaaggatgaggacgaattttaccagcgttatctggaaggccgcaagcacgaggatggttatgctcccattgaaactttgcatcgggtaagaactcatcgaggttgcctcagagggtctccagcgcttacattttctcaggcccgttgtcgcaatgtgatctattccatccttgaccccaacccttcccgccgtatcaacgcctcacaggtccttaaatctgagtgggtccgcgagattaagctgtgtaaggccggcgaggaagggttctga

SEQ ID NO: 7088 - DNA, 879 bp, A.fumigatus
tcctgtctcgtcaattcttgcgtcacctgcgaaatagccctccggtatacgatcatgatcgacttcaacgtcgacaccgaggcgggccctgctgtcgtgcgcttcggtttgccgcccacctcacttttcaaattccctccgagcgaacttccggagcctcttcctgctcctctgatctctgagccgacatggaaccagccattcaacattccccctgagttgtacaaacagctcctggacgttcgcgtgcccattaccattgccagcgtctacgcagtcaccgtcgtcatcatcaatcgcatcaacaagagtcgtgggtacaagccctggggtttcagccaaacgcggctcttcaagcttttcgtcatcctccacaatgtcttcctggccatatattccgcatggacgttcgtcggcatgttccaggctttccgcaactcctggcctcaccgcgaggacccgcacggcgtcgtaggcgtgctcgattctctttgcaagatcaatggcccgcgcggctacggaaatgctgccatctacgactccgttaccgaccagtggaaactgccgaacccggaattccagttggctgcgggtggtgtcccggacccgacggacgttggccgtatgtggaaccaaggattggcctacctgggctggatcttctatctatccaagttctacgaggtgttggacactgctatcatcctggcgaagggcaagaagagctcgactttacagacctaccaccatgcaggtgcgatgatgtgcatgtgggcgggtatccgctacatcgctcctcccatccttatcttcactctggtcaactctggtatccatgctctgatggtatgcaaatatcgctcttataatcgtctgtag

SEQ ID NO: 7089 - DNA, 225 bp, A.fumigatus
tacacgtactatactctgacggcacttcatattcgagttcccggcgtcatcaagcgctctttgaccaccatgcagatcacgcagtttgtggttgggaccacctgggccgcttcgtatctcttcgtcagctacactcttcccggcaaagttccgactgcaagcgctgctgctggctctgctacttccgttattgaagctgcggctgccaacggcctcggctgttag

SEQ ID NO: 7090 - DNA, 1179 bp, A.fumigatus
agattctttatagaaacagccatcatgcagtcccaaagtcaacagcattctgcttctgccgattctggtcaagctcctcaggcccagtctggccaatttgctcgagattctcgtgccccctttgctgctggctaccagcagaacggtcatcccagccagccggaaggttatcatgacggttctgctcctctccaagcagatcagaactttcagaaccagcgttcctgctccaagtacagcactatcaagggcagcatgccgttcacgatgtccccaaactttgacctatccggggccaatcgtgcaccctacaatggccagtttgtcctcctccccagcgggccaatgctgaacggcattcctcctatttcgtctttcaatcccacttctgtacttggaaccaaccagctgggttcaacttcgtatcttccagccatgtatccaagtgccagtcccaactttcctatggggccagcaacaatgcagggatattcatttcctttcgtggcagacaacaacctgcagaatctggctggccagaagcggaacggctgggtcgctagcgagaaccagaaggtaactgggcaatccacctctgaaactcctggcaaccaatgtgagttctatcctggacctgctgtctccaccattgatggaccctctattccactattgaactacaacggccctccgcaaccatgtctcccttaccaagtgatgaagacgcccaatggctacatgctccaggacttggagagtatcactcaacaggaacctccgatcccaagggcggttcccgccatgtggactaacccttcggaagtgacgctcgcaaaatgcctcgagaaccgcgaaggtattaccaacgtctacatcagaggatttttgccacagaccacggacgaaatgctgcattcctatgctgcccgctttgggaagattgatcgttgcaaggctattgtggatctggacacggggctttgcaaagggtatgtcaaagcagcttctagtatgtcggcctgtcagctaatttcgcttccagattcggttttgtccagttttacaactttgagtcatgcgagaactgcatccggggctttttctatcttggatatcaagcaagttttgcacaagtactgtgaatcaatgccaaccagagattcgcaaacgctgacatag

SEQ ID NO: 7091 - DNA, 639 bp, A.fumigatus
agggtgtacaaagggttccaagggaacaacgatgctcgtttatcaatcgaggatcccaacaacccggataacgatgtgtcgggtgggactcgggaaatccatctgatcttcaggtcattctcaagggcattccaactgcttaaggaacgtatggtctcctcggcggtgtctggcgacacaaaagccagcattctgcaaagcatcatcgctgcaaattatgaggagtacacacagcagcgtgcacatctacgtgcggtgtttgagacccatcccagattcgcacagtatcgtcgagctcccacacctcccccacctccctcagagagtcctcctccacctcctgccgaccttgctcctctgccacctaatttgcctgctaaacctccttcggcgaaatactccaaagctcctccggcaccagcatccaaggactccaagggctcgaaggagaagatgaccaagatgcaaagaaagcagcaagcatcgcgagaacgggccgctcgtcttagacgtttgcgtcccgatatacctgccattccaaactccatcagtaatgagcaagccttgagtctaggtggttataaaacccaatctgagatggacagagatctcgcaagtcgagaaaaagaaaccaaatga

SEQ ID NO: 7092 - DNA, 351 bp, A.fumigatus
aacgaaagggtacaagatggtcaccttgccggcgttggggctttaaattggatttacattcccataatgcttcactcgtatcagtgtatacctagaacatcccctccatatccagatccaaaaactccgggttcccaaccgccatatctgccgcgttcagtacatcatcgatactcgtatcgagccccgtccccgacgaatccagccccgctgccgccgccgcattgtcgatcatgcgatggatattctccgcatcgtcgggcccgaccccatggtcggcagcccccgtggcatccagctccatctggcccgcgcccacaccaacaccccccagctgcatgttctggatga

SEQ ID NO: 7093 - DNA, 330 bp, A.fumigatus
tgcttcactcgtatcagtgtatacctagaacatcccctccatatccagatccaaaaactccgggttcccaaccgccatatctgccgcgttcagtacatcatcgatactcgtatcgagccccgtccccgacgaatccagccccgctgccgccgccgcattgtcgatcatgcgatggatattctccgcatcgtcgggcccgaccccatggtcggcagcccccgtggcatccagctccatctggcccgcgcccacaccaacaccccccagctgcatgttctggatgatgttgttgacgtccaggttggggacctgcgacggcggcgccagtag

SEQ ID NO: 7094 - DNA, 231 bp, A.fumigatus
ttcgcctgtgcctcgcacaaactgatacctgaatccagcatagaacgcttgctgggtgagaatcccatgcaaactcttcctgtgggctataataaggacgaactggtgtcgcagatcaacgccaatcctgaacgtgcggagcagttgatcaacgagattgagtctatggagggaaatgcaggagcgatcattggggcaatcacagaggtttgtctctgtgtcaggaattga

SEQ ID NO: 7095 - DNA, 579 bp, A.fumigatus
cgaaaacaggtcatgcataatctctgcaaccaaaaggagaccatgacactgaagaacatatgcaattcgctatccaggcggcctcaggcgctggacgtggttttaattttccgaaacccaaagcaggttttgcagccgctctgcgctttactggactcgtggcactgggacgaggaccagggcgagtaccaaccggtgtacgatgagtttggaagcattctcctgctggtgctggccttcaagtaccggtttgatctgcgaccagcggatctagggatctcaagcagtgattcctttgttctgagactgctcgagcgaggatcctgcagccagaaactcgatgctctcgatgaaaaacagaacaaaaacctgggctcctggattgcggctctgttcatcgccgaaggcatcagtgaggagaccatgtcagcgtgcagtccacaggagttctacctgcttgtggcgacgctgttcagtcagagcctagaagcatgtgagaccggaaagctcgagtttgatactttgaaagggggctttgaatgtatgtcacttggtctggatctactggaaagatactga

SEQ ID NO: 7096 - DNA, 825 bp, A.fumigatus
acatcgctgctcgcacgctggaagagcagctcaaagatgtgcgcgcgcgacacccgacgcgcaccgacatcaaaccgatcctcgactacctggagccgtgcctatcgttccagctggtgggcagcagccaccgttccgaactggagggttggacgacacattccagcggcggctgctgggcagcatccgcagcacgttccagtcgttggtgatatggagcacaaacccagaggtcagcatggcacatcttccgtacacccatcgccagatgatcgcaggcgtgcggatgttgggggcgtcgcgcgtgctacatgcgctgatcgaggagctgaagctccagaccgaggcaggcaacggccccctggcgctggacttggccgcgacgctgatctgcgcgcccatggcggagaccttttctgtggagcagaacagccaccagcccgtggacccgaacaaggaggcgctgccgcggtgcgggatcctgaccctccgcgacgtgctggcgctccagcacgagaacgtgcccaagatctcggaaaaggaccccctgcgcgcggaggtgctcgtgcggttgtaccggcgggtcaacgccctactggcgccgccgtcgcaggtccccaacctggacgtcaacaacatcatccagaacatgcagctggggggtgttggtgtgggcgcgggccagatggagctggatgccacgggggctgccgaccatggggtcgggcccgacgatgcggagaatatccatcgcatgatcgacaatgcggcggcggcagcggggctggattcgtcggggacggggctcgatacgagtatcgatga

SEQ ID NO: 7097 - DNA, 186 bp, A.fumigatus
cgccgtgcggacgacaatgttacaatagtaacctacactcccattaccaaggatagaccggctcgggagcccaacatgatcgtgacctttgacatcgggagcaacaagtatctcccctttacaccaacaataccctggacaagcgtaccggtatcacaaccgtcgtcgcggcagcaaccattgtga

SEQ ID NO: 7098 - DNA, 678 bp, A.fumigatus
  unsure (676): Identity of nucleotide sequences at the above locations are unknown.
agttaccaatcggccaatatgcgagtgacggttatgtttatttctttggcagctatccagctagtggtgtgtcaattcagtttcaatggagcagggaactctaacctgtcaacggctacaaggagcacccattcgaaagacggaaaacctgatggtagtcatcttgcgaggccggaaatccgatttggagaatggatagtaaagcgcgataccacgacaattgcggacgcagttacatcgaccaccgctattgagactgtgacctccgcgacgactagagattcccatgcaacgacgacctcagactccaggactacaagcagctcagaaacctcttcatctttcacgacaaccactgcagcagctacgacaacctcaactacaacttccagtacctctagcagcacagccacgtcatcgtcatccgcatccatcgctgcctcaaccacaacaaccacagcaacaaggacaaccataacctcaaccaccacgccaacgcctaccgaatctgctgaattgaaagaatggaaccaccgcgggactatcgccgccatcgtcaccttcagcatcctcggttccgtcttcgtaggagcctgcatcgcccgatgtttccgcaattgggcgaagaaacggcatatgtcttcaccacggggctggaaggagcagctgaccattnaa

SEQ ID NO: 7099 - DNA, 339 bp, A.fumigatus
catcgggagcaacaagtatctcccctttacaccaacaataccctggacaagcgtaccggtatcacaaccgtcgtcgcggcagcaaccattgtgaaatcaatatcaaatgttattcttgcggcgaacgcaggtcttgagatctatgaggatattgccgctatgactaaaagcgaatcaaatcagaattcttgctccctcgtgtatggcaccgactccgaccggacctacgtcgaaggatatgcgtacgaggccacaacgagtggtgagaactgcgacacaactgctaagaaaaagactatcattgcagcagtcaagtgtgccaaacagctgaacacctag

SEQ ID NO: 7100 - DNA, 516 bp, A.fumigatus
atggtcagctgctccttccagccccgtggtgaagacatatgccgtttcttcgcccaattgcggaaacatcgggcgatgcaggctcctacgaagacggaaccgaggatgctgaaggtgacgatggcggcgatagtcccgcggtggttccattctttcaattcagcagattcggtaggcgttggcgtggtggttgaggttatggttgtccttgttgctgtggttgttgtggttgaggcagcgatggatgcggatgacgatgacgtggctgtgctgctagaggtactggaagttgtagttgaggttgtcgtagctgctgcagtggttgtcgtgaaagatgaagaggtttctgagctgcttgtagtcctggagtctgaggtcgtcgttgcatgggaatctctagtcgtcgcggaggtcacagtctcaatagcggtggtcgatgtaactgcgtccgcaattgtcgtggtatcgcgctttactatccattctccaaatcggatttccggcctcgcaagatga

SEQ ID NO: 7101 - DNA, 465 bp, A.fumigatus
agacttgatgttctcctcacggttaccagtgtcaccaccctcgatgtagtgcttgaacttgcgggtgcggaagccaccagtggggttggagagcttgaagggccagaggaagttgttggcctgcttgaagttggggccaacagtgtagatctcgtggatcagatcctccatgcagacaatgccgtacttgccgagggcctcctcaatgacctggttgtcggtaagagggacacgctgcttgttgacctttccgtaaccacgcttgtagatgagctcacggacactcttgaggttggggtaaccgtaagcgatgtatgggttgatgatggtcaacatctcctgggtggccttggtgagacggacgaaggtaccgttgttgatctggaccaaacggagaagctgcaggatcttgcgaggctgaggagcaatcttgttgatactgcggattcattagcaccagggtaa

SEQ ID NO: 7102 - DNA, 213 bp, A.fumigatus
caggccaacaagaagaagcgtgaggctatcttcaagcgtgctgaggcctacgtcaaggagtaccgcgatgctgagcgtgagaagatccgccttgctcgcgttgctcgccagcagggtaacttctacgtccctgacgagcccaagctggccttcgttatccgtatcaaggggtacgtttcacttgaacattcagttagcttaccctggtgctaa

SEQ ID NO: 7103 - DNA, 474 bp, A.fumigatus
atccgcagtatcaacaagattgctcctcagcctcgcaagatcctgcagcttctccgtttggtccagatcaacaacggtaccttcgtccgtctcaccaaggccacccaggagatgttgaccatcatcaacccatacatcgcttacggttaccccaacctcaagagtgtccgtgagctcatctacaagcgtggttacggaaaggtcaacaagcagcgtgtccctcttaccgacaaccaggtcattgaggaggccctcggcaagtacggcattgtctgcatggaggatctgatccacgagatctacactgttggccccaacttcaagcaggccaacaacttcctctggcccttcaagctctccaaccccactggtggcttccgcacccgcaagttcaagcactacatcgagggtggtgacactggtaaccgtgaggagaacatcaagtcttcaccacggggatggacggactcgcgc

SEQ ID NO: 7104 - DNA, 459 bp, A.fumigatus
  unsure (304): Identity of nucleotide sequences at the above locations are unknown.
cattatctcgatatttatatctctgctccagctacgatcgcatctcttctacaccatactccaatcagtactccaatcgaacccccatcacctgccatggcatacaacaacaggcctgatgcctccacggcattcacttttgacaatgatgaccgctttgtcaaccaacagcccaaaggccccgatccattgtcggccaattggagttatgacagcgccatcgatttgttttcgctgaacaccatgcttcccgagaccttccctctcgatatccccaatgatatgctgctcgatcccaaggatntccctacggatctgtttgctccgccggctgatatcagcgggtttgcaatctcccactctggcgaagattctctctcatcggtatgtttggtatccctcctcttctatgtgttttacttcattactgacaaggactctccaggatcaggaaagtga

SEQ ID NO: 7105 - DNA, 477 bp, A.fumigatus
agccctgcggacaacatcagcagttgtatatattctacagaaaaaagggaacacactggtggtaagccagagattataactccacgagggcaccaagctcggcctccccgtcagcgccgtatacctgcccacgatctccttgggcgtcttcccgtacacaacaaagtactccagctcctcgccaggaatggagatattgactcgcgtggtgcgctccgactgcaactccagactgaccttgccggggttgttcacaaacacaccgtaccccttcgagctgatataaaagggaatgttcttgtacgccagctcagacgaggtcccgccgtcctcgttccagatgtcgacgcgctgcccgttcttaacgaaggggccaaaccgctctccgagtccgtacagcttctcgccgacgccgaggtccagttcggcgagcatgtatccctggcgctcgaagaagatgccgtcgtcccagcgtga

SEQ ID NO: 7106 - DNA, 189 bp, A.fumigatus
ggtgagatggtttgtcctgtagttttgttcatgtggctaatttgcttgtatatacaggagggcattcgcatcgactggatgagcaatgttgaacgactacacattcaggatgagacggtcgatctccttctgaacaagttccagagacatcgcggtgacacactaaactcgcgtgagttacaattctaa

SEQ ID NO: 7107 - DNA, 861 bp, A.fumigatus
cgaggtcctgcccagcgactgtttctgcgcgggttacgtcgcccctcgagggcatcattggagtcaaacttgtgcactggtgggtctctctgcctctgtagtcactcgagagctctcgttgatataatcagggccggcggactcgacaaggggccccattacaggctcaacacctcttccggccacgccaagatcgaccacgtcgcgaagcagaaactgagctacaccagcggcgaccttgagctcaacatcaacaccgcccccaacgaactcgactttgtcttttccagcgctgacaagggcaaattgaccggacactcatggcgctcgatcggctacgtcggcgaccagacgaccgacaggtcacgctgggacgacggcatcttcttcgagcgccagggatacatgctcgccgaactggacctcggcgtcggcgagaagctgtacggactcggagagcggtttggccccttcgttaagaacgggcagcgcgtcgacatctggaacgaggacggcgggacctcgtctgagctggcgtacaagaacattcccttttatatcagctcgaaggggtacggtgtgtttgtgaacaaccccggcaaggtcagtctggagttgcagtcggagcgcaccacgcgagtcaatatctccattcctggcgaggagctggagtactttgttgtgtacgggaagacgcccaaggagatcgtgggcaggtatacggcgctgacggggaggccgagcttggtgccctcgtggagttataatctctggcttaccaccagtgtgttcccttttttctgtagaatatatacaactgctgatgttgtccgcagggcttcaggacctattaagacggac

SEQ ID NO: 7108 - DNA, 609 bp, A.fumigatus
gaagcaccggaatacggagttggcgccagcaattcgtcagcaaagcgatgggcaagagacatgagtgggcctgttaaacgatctgaccagatgtcttggatgcttctggggtccgcattgtctctcgcgcatgagttgggcatctacgagaccggagataaagcacgcgatgctttcgtcgcctacgaacggttcatgacaaaggatcaaatgcgcctccgacggcagcgggcgcaacggttgttgtacgtatatatcaatcagttagcgtggcggataggatgcgtatcgctcatgccgcaaggcttgagccattcaattctcaaccgacagacatctagagaattaagccaatatggagaagaatggctcacattcatggactcatggatggacctgacgaaactcgccaaatctgtcacggacatgttctttccatctgttactttcgcacgacagcagcttcagagtggacgatatattgacctcctggaccatttccgtccactgcttgacaagtggaaagagagatatctccagccgcaatgtaagttgccatacctccggatgttcaggcttttttttggggggtttcatgaagacagctga

SEQ ID NO: 7109 - DNA, 186 bp, A.fumigatus
cactttcgttgcacagttacctcggtgaaagacggtgatgcaatgtcagctgaaagcggcagtgctctgtgcaaggcccctgggaatttagatatcagctcggcaaacctccaaaagacgtggctcggacttgaggtgtacagtaagacgatggggtcaagcatgaagcgactctttgaacagtga

SEQ ID NO: 7110 - DNA, 783 bp, A.fumigatus
cttgccaatcaaagtatcctaaacgcctatttacttctttggattatctctgggctgctgctcgtaacaagcatgttgtcctggattcgaccaagtgcacggctttcttttttccattccaaggataacaaactcctgttgaccaagaagcccggcgaatccggtgttaagcagcaggttgcgttggcggatgtctgtcgctctgcgacgccgacgaaatgccatctgaatccgttccttttcaatggacatttgcagactgcctggaccgccgttaaattcgatgatgttcctgtgtattataagcgtaggatgtttgaggccgacaattcgatgtataaagggcactttgcagtggattttgtcgtcgagccgtacgaaacgcccagggacaacgccgaagctactgatgaagcgaggagatacactttgccttcaggtcttccggaacgaacgtctttcttctcggaagaggagttccaagctttgccttcggacgacaccaagcccatgcttgtgcttcttcatggtttaagcggtggctcacacgagatctatctgcgtcatgtactcgctccactcattgcagacgggaattgggaagcatgtgtggtcaattccagaggctgttctcaaaccaaaattactactggtgtgctctacaatgcccgggccacgtgggatgttcgtcaaactgtaaaatggctccgcaaagcgtttttccaaatcgacccttgttcggaattgggttctctcttggcgcaaatattcttgccaatgtag

SEQ ID NO: 7111 - DNA, 390 bp, A.fumigatus
tcggtaagacctcgtacattctctcagaacaacttttatatcattctgttattgatcattccgtcagggcactgcaatgtccaacctggggataccctacggaaggggcatactatcgagacgcagcatcgatcgattccatgcttgccattcgaatcccattcttcacggtgcaggctgaagatgatccggttggtcctgcaattaactctaaggtttaatgtcgaactaatcgctttgcagatcgcttcggtcgatgcgcttcctttccaagaaatgacgcagacaccttatggtgtcatgttaactacgtcctggggcggtcacctcggttggtttgaacttggtggagacaggtggtttgtgaagccggtgtgtatcttcctatag

SEQ ID NO: 7112 - DNA, 321 bp, A.fumigatus
ctgagttgcagcggagccctttgctctgcctggggcatagtcatgttcattttccttccagattctcccgtctctgcaccgggtcttacccccagggaacggcgaattgccgttgaacggttgagagagaaccagacaggtgttgagaacaagcatctcaagccataccaggtcctagaagcgtttatggactacaagctttacattttctttatgctaggctgtgtctgtgagtattactgtatcctctgctcacacagttcagcactaatttgcaaggcaacatccccaatggcggcatctccaacttcggcacattga

SEQ ID NO: 7113 - DNA, 228 bp, A.fumigatus
ctttgttgcagaccaacctactcccttggcatctggtccatgatcgtctcgcatctgattgaggttgttctcatctccactcttggccttcttctccgatgggagaacaagaagcgggatcggatacaatctcagatgcagggtggacttgagggacgagacctgggctctactgcgttcctggacttgacggatcgagagaatctcaagtatgtttttcatccttga

SEQ ID NO: 7114 - DNA, 282 bp, A.fumigatus
attccctacggcgtcctcatcgcactctccatccttctctgcgtctacctcaacgaccgcttcgagaaccgccgctgcgtgttcatcctcttattcctgctccccaatatcgcgggcgcctttggcctgcgctttgtcccacttgaccagcaagtcggccgtctgatctgctactacctcacgggcccgtacaacgcagcctttgttttgattctgagcatgcagatcgcgaatactgcaggtactgcccattctatctgccgatcttcctcggagccgtga

SEQ ID NO: 7115 - DNA, 297 bp, A.fumigatus
ttcttccgtaccttgccgtctgctatgcatttttctacattgataaggtatgttggcgtgatagtaatcctccattgggctagactgatgtgtgatttcaatgttcagacaaccctgagctatgcagctatcttcggaatcgtggaggacctcaagctccatggaacgcagtatagctggctcagcagtttattctactttggtttccttgcctgggcgttcccgaccgactttctcctgcagcgtttgccaatcggtatgtgttccatacagacatgtcggaggataggattgtaa

SEQ ID NO: 7116 - DNA, 375 bp, A.fumigatus
agggaagtacctgggcgccaacatcttcatgtggtacgtacagcaagcacaccgggcaattcctctcctttcttccctaaaagcattatactcatgtatattaggggagtcttcttcatgatccaggcagcatgccataacttcaccacgcttgctttttttcgagcgttaggaggcgccgatgaagcctgtgcagaccttgcctttatgttgattaccagcatgttttacacaagaaaagagcagcctgtccggatcggtttgtggtataccgcgaatggttttggtatcgcgcttggaggcctgttgggttatgggattggcaatctgaagggtgcgcttccatcttggaagtacgaattcctcgtcatgtaa

SEQ ID NO: 7117 - DNA, 546 bp, A.fumigatus
  unsure (59): Identity of nucleotide sequences at the above locations are unknown.
cgagaccgctttcctccgaaacaaggatacgagagaggtgagctccgaagcaaaagtcngacccacgcacccatggcaaccgaagtccggaccttctacaccccttccgccacgacgcacatctcctcccatgctccggccgctgtcgacgagctcattagcaagtattcatccacaatggtgacagcttcgagcatacactcggcaagccatctgacgctgaagaatccgcgtcgcaacatcctgcaacgtgttgttgatcatattcaactgggatactaccgctatgaggttactttcggactgtatgtgatgacaccaggcgaaaagctcgtcgccaatactttcgtcattgtggtgctctctcttctcttctgggcgttggtgctctacttcccgtctttgctgtaccagaagctgagccgcctggtgtggctgctcaccggccatagcggtgaagagatgggcgctgccttcggcattcttgattcgcatgtcagccctgcgtcttcggcattctccgctgcggcgagtccgtccttatga

SEQ ID NO: 7118 - DNA, 219 bp, A.fumigatus
atcacaccccttcctttcctctccttgtcgggtttttcttccttcctttactcccctctcctgtatcgaaacgctacgctctccttgttctttgcctgttacataaaaaagcattcgcgctccttcagcgtcgttctattcaagcgattggattctagtgtgttagctttcagcctcttccggttatcccggcacccgttttgccagcccatcacttag

SEQ ID NO: 7119 - DNA, 273 bp, A.fumigatus
atacttcatcctaatacagtgcatgcctcaaagatcgttatctatttccttggtggcttccaaacccaggctaagcacgtctctagtctgccaagtatctacatactccataattccacctacaatctctcagccaaactgcgtcagccatggctttcaggttgcaatactttccttcagaaccacgtgattacggggatcattcggaatcctctttctgtatggagtaacaaatcatgtcttcaccacggggctggaagggtccgttccatt

SEQ ID NO: 7120 - DNA, 231 bp, A.fumigatus
ctttcttcatctcaagctcatctggactgcggattaattcgtaacacctcacctaatgtctcaaaaaagtgccaggcgctcctagcctcccatgtgaaggtagactggaagccctataaatgcgcgtgtggtggacaaaggcaagctgcaccaaagctgaagttaggagagacagtgtctccttacacaggcggcgtgtattcagtgacaagcacattcagtcagtggtga

SEQ ID NO: 7121 - DNA, 582 bp, A.fumigatus
gagcctcggaatctactgcaaacatttgtcgaagaccagacattcgatccccattatcagtctgtcactatgtggtcaagcattgcggcgttccccgttcttgttcctgtcgctttggcatgtctgggctacgagggaggagttcctacccccaccgctcatcattcgaatagcgctgtgattgaggttgcggcggggcaagtcttcgacgctgggtgggccaagtacgaccggggctctggcgcctgtaaaggccagtccgagggcgattggaaggatgccgtattctaccttcactctggtgctactctgaagaacgtcatcatcggcgccaaccaggctgagggggtgcactgtgacggtccgtgcacgttgcagttcgtctggtttgaggatgtgtgcgaagacgccatcaccattgtgagtctgcaggcacatatacatatttactcggtcaggtttgatgatagggtagaaaaacgacaaggcgggccaggagacttggatcatcggcggtggtgcctatcatgcctcggacaagatcgtccagcacaacggttgtggtactgtcaatgtgagtga

SEQ ID NO: 7122 - DNA, 228 bp, A.fumigatus
atcatcaacttctatgccgaagactatggcaaagtctatcgctcctgcggtaactgtgacaagcaatgcaaacggaatgtctatgttgagggtactactgctcgcaacggcggcgaagtagttggcatcaacctcaactacggtgacacggccactctaaagaatgtgtgcgccgactcggcccatccttgtgtatttaagcatgcgccgctagaaggtaaggcgctc

SEQ ID NO: 7123 - DNA, 456 bp, A.fumigatus
aggcacgataacacaatagacagtacgtttgagatgaattgtcctatttgctctcgagtctcaagctcgcgcctacgcttttactgccccacctgtgcctgtaatcaaatctacacactacgtatcgataatgccagggctctcctggagaaggaaaccctaggacggcaggtcgagaaagcacttctgcatcagacatctcctactctctcttatcatcgcttcgaagaatgctcgacgcagtcgccagataaggtgcccagtcctcaggatgttctgcaaattataaccgcaaaggccgagtcttccattaggaagaaagaccttgcgcttcagatccagcaactgaaatcagagatcagagaccgacaacttggcatttctcgacgggagctgacattagcccgacgaacttcagatgctgaatcgtccaaatttccactgggaaaatcttga

SEQ ID NO: 7124 - DNA, 1515 bp, A.fumigatus
tcggcaattagatttgcaatggcagcgccccttccacccgcggtgaagacgagttcgaattgcgatctcagcttacccaagtggaaagaatttctggatttggttcaatctcgcctatctcaaatgctcactaagccccgtcactgggccgctgcctttccacttcacgtactgctattgtgtgtgtcttcaaaggaggtgttcttgtctcaatggctctcggttattcagagtcttcctgcaaggctgaaagaccgtccaacaaggggcccggccctccaagctatgtgccgcctgttgtggacatacttctttcgctacacagactccccaaccgtgaccctccgaaaagttgaggaggttgccaggatagccttgccagctggtaaaaggtcgtacttgagtacagatcctgcagttgccgagcccctcatacagctggttcgcatgatcggcttcaaacaccccgatgtctgcttccgcaacatcatttttcccttgataaactctgacctttttctttccggaagagagctcaaaattgaacagatggagcccgagaaaatggtcatcggtatcagatcttttctggcgatagtgacggaccttgagaactgtgatcagctctgccctccatttcctactggctcaatccccaacccattcactgatatctctgctccgactcatttacatcgaccccagcttctcacagatccgcgcctgcccggttctatggagagtaaagatacagcactatcgttacctgtcaatacatccagactaagcgataatgtcaaggaatattatactcgtttttgtgatatccttggcaagatcactctgttatgcgacaacacattcggtggccaagcaacactagatgagaagttcggcgggacaactcctaagacaccaatctccgaggcgtttagcttcggaaggcgtgatgaccatccaagtattggggatcaaaggcagggtttctacgatttatttcatgtggcggtacaggcgctcccccgctgcttatcagatcgcatcccattcaactcgctaattaatttactttgtaccgggactgcacacgttcagtcgaacatagcttcttcttccgccgaatccttgaaggcaatcgcgcgacagtcgcacgctcaacaagtcactattggtttcgcgagatttattttcaactttgacgcaagatattccaccatgtcagacgaaggcatgctcggaccaggccacatcgagtccacgttgaggttgtacgtgcaattactgcagatctggatagaagaaatcaaacaaaagaccaaaggtgcaactacagatcccgtggacaaatcgggcactggaagtcgagctctgcagttggacctctctactgtcctcgcacacgttgaggagatcgagtctcatggccttttctttctttgctcccagtcgagacgggtccgtgcatttgcaatcactgtgcttcggctgatcaccgaattcgaccgcgctcttggc

SEQ ID NO: 7125 - DNA, 504 bp, A.fumigatus
ttggctgtgagaaaccctgtattctgcaatgacatcctcacaactaacttgcccaggtggccaagagtggcagataccacggtcgaagaaaccaaagcccacatgatgaagaaggtgttcaaagatcccgacgcagccggtgctgttgggcggttattcttctttgtcattattcccaaaaacgagcctgatcgtattattgggtcccttggtgttaactctctgtcgcccgctccctcggtgggatacgccatgcatccgtcgtactgggggaggggatacgccagcgaagccttacgaggggtgatcgacgcgtggtggaagctgcctcgggtcgacggcttgggacatgaggagaaattgttcgcggcggttaatatagctaataaagggagtgtgaaggttttgcagcgaaatgggttcaagatttacaaggaagtcgtgcttgagggggacacggtggcttgtatggagttagagagcgcttgccgagcgattccttga

SEQ ID NO: 7126 - DNA, 309 bp, A.fumigatus
tccatcttaggctacgatcaaggagtatttagcggtatcgtcgagaacgaagacttcctctatactatgcatcatccaggagatagccttatgggaatcattgtctccatatataaccttggctgcttcacagggtgtatcttcaactttgttgtcgcggaatggctgggacggcggcgggccatgtgggttgcaatgacatggataattgtgcgttgctgtgataactcgagcttgcgacgattgtctgaccagacgagcagattggtgcctcgttgcaaacatcagcattttctgttgcccacctga

SEQ ID NO: 7127 - DNA, 213 bp, A.fumigatus
  unsure (140): Identity of nucleotide sequences at the above locations are unknown.
ctggatcagaaacatattcaagcgcgacccagtttcgacaggccatcgggtgtaagtatcgtcaatccttatatgtactcggctaattcgcgggatagccttctagcctatggtatgtcttcgccaggggctggaaggtncgacgggagtgcaatgcaacctaccgccgccctctctgggggagaaaaggcagagatattcgacgtcaactaa

SEQ ID NO: 7128 - DNA, 327 bp, A.fumigatus
ccagacgagcagattggtgcctcgttgcaaacatcagcattttctgttgcccacctgatggtagggaggtttgtcacgggcattggcacgggcattgagacctccaccgttcccatgtatcaagccgagttatgcgaggcttcgaagcgcggcaaactggtgtgcagtgagcctttgcttgtcggcgtgggaattgtcatcagctatttcttcgactacggaatgagctttgttggtggtcagattgcctggcgactgcccattgcgtgtcagttgatcttcgctttcgtaagtcgcatattgcggcaagcgagaggtgccatctaa

SEQ ID NO: 7129 - DNA, 210 bp, A.fumigatus
caatgtgtcaaggttgtgattattctggtctttgggctgccggagtctccccgatactgttataaggaacagcgcaacgacgaagcgctccagattctaagcgatgtcaatggtcttccaaaggacgatcccaagatcgtggcagaacagaaagagattcttgaggcgctcgaacttgagacaaaacatggggggtataagtggaggtag

SEQ ID NO: 7130 - DNA, 1128 bp, A.fumigatus
ccaggaattacttcatacaagcctatcatcgataagcacgtgggaattctgttgacacggctgccgtcacagtcgaagggtccactgccagaggcaaagaataatggtactactgcggtgaatatggcgccaattgtgcatcaatgcactctggacgcaatgcttgagttggtcttcggccccaggctatcggaacacccgtatagtgatacccctgctggcgaaggggtatgttcaaacctgcgcatcatgaccaaaatggcctggagtttctcactttggccggcctttgggtggctcatgaacacacgtcctgttaatgcaatgttacgtcgaccgacttacagcaagcaaggtgaactcactggtatggccggcctcatgggcgtagccatgccgagactcctgcggaacccgcaacaagtggttgcgtcttcccagcccagtatcgtcaagggctggctagaagtccctccggacgatgcgacccgtatgactccagccgaagtcgcgtcggaggcgtccaacttgatcatagcaggaccaggaagcacagcggctgctctgacagcagttatattctatctgggcacgaaagacggtcaaggttggcaggaaagaattcgagagcaaattcgcgcttcccagagccatgatttagggccatcatcgctggaactccaggcggtgattaaagaaacattgagactaagcgccccattcccgactgctttcccccgagtgattaggcctggcgctgagatggccatacctagccttgccgctccgctgcctgtcggaaccacggtctctgcgaatacatttgtgctcggtcggtcgcgagaactctggggcaatgacgctgatagatgggaaccacggcgctggctggggagtgagcaacaccgtcgagagatggagaccaaatttgtagcattcagcaaaggctcgcggagctgtatcggacgcgagttggccttgcttcttcttgcgcaggcagtgattgggatcgtccagcaatggaaattccgcagtagggggcagttgcaaggcaaaagcttccttgagatgcagtatgacgagtgctggattaaattcgagccgttggacctgtcgttgagcgcatga

SEQ ID NO: 7131 - DNA, 576 bp, A.fumigatus
ccaaccataggtaggttgcagttaacagaggttttctgccatagcgcaatagttgacaatattttgtgtctccatagttatttcaacctcggcaacggtcctaccattgaaggcaccaaggcccaattgtccaccgccgactacctgcccctcgactccaccggtatcccgcttggtaacattgacaaattccctctggacgtgtccaagccatttgtactcggcgcggccgagcccgacattgacgatgtgttcctgatggagactgatccatccaaggtcgttttggatacgcgcagtcagcccttgaaactgctggcgcagttcagtcacccagacacgggcctgcacctcgaggtacacagcaccgagcccgcgttccagttctacacgggcaagtacatcaacgtgcctgcgatggacgggctgccagcgcgtgtagctagagccggcttctgcgtggaacccagccgatatgtcaatgcgcccaacgagcctggatggcggtcgatggtgcttttgacaaagggacagatcttcggatgcaagaccgtgtacaaggcctggaaggcatga

SEQ ID NO: 7132 - DNA, 645 bp, A.fumigatus
ttactactccgtaccgggacatctacccctcctcgatatcgaaatccgcttttctataacaactcgcatgcccaattgaactacttaaccccattaagtccatttccaaccagtgacaagatcccaaacaagataggaagacgacctgatatcatgtctggagaatctgaattcgcctttctgcctctcggagccatcatccaggagttccgcgtcggagggaagaacattgttcttggcttcaacacccaggagcaatatgataaatacaactcggctcactttggcgcaacaataggtcgcgtggccaacagaatcaaggatgccgtcatccacaacctgaatgatcgggactacatcttggccaaaaacaacgggcccaactcactacatggcggggggaaaggctggggcaagtgcgtctttgacggtcctcagaccgtgaagcacgatggcaaggatgctctgctgttcaagtacctcagcaaggacggcgaggaaggcttccccggcacagtggaagtgcgagtctggtacaccgccagcaaggaagactccaagacagttctaactaccgagtatgaagttgagtttgtgggtaacgagtgtgaggagacggttgtgaacatgaccaaccataggtag

SEQ ID NO: 7133 - DNA, 342 bp, A.fumigatus
actgtaagccccaaactgaagatccgacagacggcaaacaacttcggcctgatcaaccgcacctacgccacagacccggacaacgagaataccaaactcacgcaatggcaacgcttctaccaccacatccacgcactgaacaagcacgcgccccataaaacggaatacaaggttttcttcttcggccgccacggcgaaggatggcataatgccgcggagagtctctaccggactcctgcttggaatgtatgccatacccccttagcacaacccttcttcttcttcttcttcttcttcttcttcttcttcctcttcttcttcttcttcttcctctttctcctc

SEQ ID NO: 7134 - DNA, 186 bp, A.fumigatus
attgcaaacaagagcaaaatgaagtgcgccttgagtcttctcactcttggcctcgccgcgacaacacaagcagcttactacgagtacaccacggcaacggggtacttccttcaagatgaggccagcaccgacccatcgacctttgactacgtacgtcccccttccctcatctaccctaaactgtaa

SEQ ID NO: 7135 - DNA, 678 bp, A.fumigatus
ggaaagttgaaaatgccggtgccatggatcaaagggcctggccaagtttggacatacccaagtttgtgcggaaaaattcatcccaaggggaaattgtccaaccgttcaggcccattggaatggccgccgcgattgtcccgtggaattttccaggggttcatggcaatcggaaaggttgtttcggcgctgattacggaaaccagtatcattgtgaagccgtcaccctttactccctatacagcgctgaatttacccgagttggcaatcccgttcgtccctccgggggtcttccaggctcttagcggggatgatcaactcgggccttggatgacgagacacccaggaatcctgaaagtcagcttcaccggctcaacattgacgggaaaacggattgctctcgcgggtgccgagaccttcaagcaatgtaccctcgagctcgggggcaacgatcctgcaatcatctgcaaagatgtggatctcgacgccctagtccccaaggtaggttccccattggtgcatgggatagggggatcagaaccttgggcaagtcgaagacaagttgctgatgttggatccgaccagggtcgctcctctttgctttttgaactccagccaggtatgcatgatgatcaaacggctctatgtacacgagagcatgtacgaggcattccgagataa

SEQ ID NO: 7136 - DNA, 657 bp, A.fumigatus
ggggatcagaaccttgggcaagtcgaagacaagttgctgatgttggatccgaccagggtcgctcctctttgctttttgaactccagccaggtatgcatgatgatcaaacggctctatgtacacgagagcatgtacgaggcattccgagataaactagcggcccatgtaaaaacgcttcctgtcggcaatggggtccagccagatgtgtttctcgggccggttcagactgaaatgcaatacaacaaagctcgggacttgctcagctccatctctgcagagggcctccgtccagcgcttggcggcactgtggaggagtccgccggctccttcattcatccgaccattgtcgacaacccgcccgatacggcccgggttgttactgaggaggcatttgctcccattctaccgctgttgaagtggcagacggaggaggaggtcattgccagggcaaacgctgatccggccgggctaggcggttccgtctggagtcgagatctcgatcaagctcagcgtttagcgtctcgtctcgagtgcggctctgtctggatcaactcgcatttcgctgtcgccccgcacgtcccctttggtggtcggaaggaaagtggcagtggcgtagaatggggagtggatggcctcaaggcctactgcaacccctag

SEQ ID NO: 7137 - DNA, 1401 bp, A.fumigatus
cgcgttcctccaacccatcaatttccacatgtactgcagccggtagtctccggtctcgattgtgaacaaagattgtctacgggaagctcggtaggcaccggcgttcgagatgcttcgtgtttcggaatatgggcaatttctcgcaaatacacaacccaggaactgttgaccttggacacgcaaactataagcaccgcgtcgcgtcaagatgaaaagagcgtcttgcagatgctggcaacagaattagtttgtgccgcttgtatggatccttcaggaaatatccgaagaggcgcttctgctgctctgcaggagctgattggccgccatcccaacaccattactgaggggattccattggttcaggtggtggattatcatgcagttgcgagacgatcacgagcgatgattgacgttgcgaaagccaccgctgcactaagtcaccattactggagtccccttgtggaatctctcttgggctggcgaggaatcgggtctcctgatgctgagtccagaagacaggctgcaaaagcaatcggagaactcagtatccaccaatcgtgcaggacgattagcgtagtgcttcaccgattacggcataagctatcgagtcttcctcgtggagacgttgaagcgagacatggctgtttgctgtctatttccgctacagtagatgcctttaatgcgcacaaagccacagcggcggccagcaaggagaaatccgaagccattctcgttgcccggcaagttactgacctctgggacatttttagctctgcagtcggccctaccaaggatgacctaacactccagatttctcgaccggagttgacagctgaagccacatcgtgcttgattcgttcgctttcccaatcagttacccaaggaattgaacctacttgttctcagccatcatctactgcactggacagagcacacgggaccctcttgctatgtttatcccgcagtgaagatattgctatagaaacatcatctgaagctgtatccgagttcttccctcttctaccatcatctcaacaggaggaaacgatacaagattggttcgcacacattcgtgctacctggaagctgccaacgggcagagggcagatctcggctctaggggcggtgttcaggcagcttgaacctgacaatattttcagacagtttgtgattgagacgttgcttcgctgcactgataaagaggagctgatcgagaagagggtagcagcggtcaagggcttgactacaggggttctgccctatatctgtgagtttaacatatatcaaatgaaacaatatgctgacttcagggcagctatcacggaggacattgcgaatcatatcattagctttctgaatgactacacaacagacaggcgaggcgatttgggtccttgctga

SEQ ID NO: 7138 - DNA, 726 bp, A.fumigatus
gccctcgaggaggaagatccactgccagcccttcataccgcggaggccgctcatctgctggatggcggctgcgaggaggcccgagaaggcaccgctcagggaagcggcggagaagaagagggcgatgcgaacctggagttcgtggcggcggtagaagttcgacaagaagagaacaatgcccggaaagagtccaccttcaagcaagccgaggaagaaccgacatgcgaggaggccggagtagttatgcacttgagactggagcgtcgtcacgaggccccagagtgtgcagagagtgggcaggaggatacgggggccgatgatcttcagcaggaggttggagggaagttcagacaggacgtaggggacataggtgacggtaatcgctgcgcagtcagaaccaggccaccagcaatcgaggacggtgcacacaacatacctgtcttgtattgcagatcggtcaaatggaggtccttttccagaccggcctatgctcggcttagcaacagatctggaggtgacggggagatgactcaccactcgtgcgtttccaacatttgcacgatccaaccaagccagcaggtacagcatcagggtcatgggcataagcaaaaggtccagccggagaagagtctggcggtcgagcttcaatgtctcctcgtccaaaacaacctcctcatcggcgacctccttcttggcctcaggatcttcaacatgatcgcaaaatga

SEQ ID NO: 7139 - DNA, 957 bp, A.fumigatus
gtggagagttctagagcgaccgttgccgacaaattcttggctatatctacaaaaaggcgccgtctcgtatccaagctatacaaaatcttttcgtgcccgagagcattggccagttgccgcatctccacaatgaccgatcagaagtcattttgcgatcatgttgaagatcctgaggccaagaaggaggtcgccgatgaggaggttgttttggacgaggagacattgaagctcgaccgccagactcttctccggctggaccttttgcttatgcccatgaccctgatgctgtacctgctggcttggttggatcgtgcaaatgttggaaacgcacgagtggtgagtcatctccccgtcacctccagatctgttgctaagccgagcataggccggtctggaaaaggacctccatttgaccgatctgcaatacaagacaggtatgttgtgtgcaccgtcctcgattgctggtggcctggttctgactgcgcagcgattaccgtcacctatgtcccctacgtcctgtctgaacttccctccaacctcctgctgaagatcatcggcccccgtatcctcctgcccactctctgcacactctggggcctcgtgacgacgctccagtctcaagtgcataactactccggcctcctcgcatgtcggttcttcctcggcttgcttgaaggtggactctttccgggcattgttctcttcttgtcgaacttctaccgccgccacgaactccaggttcgcatcgccctcttcttctccgccgcttccctgagcggtgccttctcgggcctcctcgcagccgccatccagcagatgagcggcctccgcggtatgaagggctggcagtggatcttcctcctcgagggcttattcaccgtctgcttcggtattttctcctttctcgtgctccccaacggcccagttttcaccaggcggtggcaggaacagcgtcaa

SEQ ID NO: 7140 - DNA, 528 bp, A.fumigatus
tttcaagacctcaatatgtctctcgtcaatctcgctcacgtctgctcgcatctgaacaatgcatccaaggcccgtcttggtctcacatcaattcctcatagcaacctacacctgaaattatgtctcgctcttcagaactccggttacctgtcctccgtcgtccgcggagggccgacccctcctccgcctcatatccttcttggccatcctgcgccgaacgatgaagttgaaggcatcgagccattgacgcaggccaacattgcctcgagacgactgtggctgggattgaagtactggcagagtgaaccggtgctgggaaaaatgagcatggtcagcaagcctacgagaagaatcacaatcgatgttgctggactccgacgtgtgatccgcggcgagaaaagcgattatgtggaagggttacggacacccggcgaaagcttgtacctttcgactgatcgaggcatcctggagtcgagggagtgtgtcgaaaagaagattgggggattggttctctgcagggtccgctag

SEQ ID NO: 7141 - DNA, 252 bp, A.fumigatus
tattcagctgcgggaatatacaaatatctgattcgaggaattggcagcttcgccgatatccactcttacttcacagctcctactcccaagcctcaatatcatcggttcgataagggctcatatctctacctctataagaatgcgtctcagcagaagctaaggatcgaagttgccaacaatcctgggagttcggatcaggatgcattcaacggatgtcagttctctgattgtattctccagtcaaagcgctaa

SEQ ID NO: 7142 - DNA, 1164 bp, A.fumigatus
ggacttctttttcatttcattctttgcatcggcatagatactctgaatgcaaccgtgtatatcatcattttctgccatacctacttctctggacactccggctcaggacccagatacccgctgcgaaaggctgcacctgctgtcagtttccccatgttcgttttccggctgctgttactcacctccaggaatcaacgctgcggcatacatgatccgggtgatgggccgcagatcatctggcgtcacgtcggatgcgagagacagctccatgtacggatcccaggccgcgatgatggcatcggcatacaccttgaggtcgaccgagcggtctttctcagtggtctgttcctcctggcactggatgcccatacacgtcccgaactcgcgaaacgccaaccggtacttgatattgcgttcaaggtagcggttgatctcaaacagatcatctgtagtccatcagcttcatcctccaaaacaaacaaagacacgaaatacaaatctgctcgaagcaccgccccgccaaccttgccgcccagtcctccttctccgagaaccaatgcgccgtccacagcgtcatccccaggtccagcggatcactcgacacaaaatgctgccccttccgttccatcgcgcgcttgtagtccgcgatctcctcggccagcaccgcccctctacccacctgcttcgccgccccctgcagcagccgaaacaccacatacccatcgatgggatccagattcccctcggaagccaccagcggcgccgacaaatccatcgccatcttccagaccatgcgcgggcgcgtcgactcgcgatgcacaaagaaccgcgggtggatcgccttggccagcgccaccgcctgctcgttgtacgccgggtcccccgtcgccagcgacagccggttcagcgcaaacatccacaccgtcaggtaatggtggtactggccgtccgcgtccgggccgtgctcgtccatcttcccgatgcgcagcccgccgccgagcgggttcgccgccgttgcgccgggcatccgcgccttgccgtcgcgcgtggagcccagcacttcatgcacggtcgccacgacgcgccgcgcgaggacaaagtaccgatcgtcgggcgcttgggccgccttcgccagcgccttctcgtattcgcggtgcatggtga

SEQ ID NO: 7143 - DNA, 330 bp, A.fumigatus
accggctgtcgctggcgacgggggacccggcgtacaacgagcaggcggtggcgctggccaaggcgatccacccgcggttctttgtgcatcgcgagtcgacgcgcccgcgcatggtctggaagatggcgatggatttgtcggcgccgctggtggcttccgaggggaatctggatcccatcgatgggtatgtggtgtttcggctgctgcagggggcggcgaagcaggtgggtagaggggcggtgctggccgaggagatcgcggactacaagcgcgcgatggaacggaaggggcagcattttgtgtcgagtgatccgctggacctggggatga

SEQ ID NO: 7144 - DNA, 282 bp, A.fumigatus
tggactacagatgatctgtttgagatcaaccgctaccttgaacgcaatatcaagtaccggttggcgtttcgcgagttcgggacgtgtatgggcatccagtgccaggaggaacagaccactgagaaagaccgctcggtcgacctcaaggtgtatgccgatgccatcatcgcggcctgggatccgtacatggagctgtctctcgcatccgacgtgacgccagatgatctgcggcccatcacccggatcatgtatgccgcagcgttgattcctggaggtgagtaa

SEQ ID NO: 7145 - DNA, 291 bp, A.fumigatus
aaatatagagatgttatctacaagctgctaggattcacagccgccatggttgttggtcctatcggcatgtactttgtcacagtaaactccggcggtatgtctttcttccatcagaccagtaatttctctttattcgagacgctgactcggatagcgagtccaactgtggccggtatcaccgccgcaatcactgcgaatctggtcttatttggttatatctacgtggcgtggctagatgatagagaagagagggaagcagcatcaaagaggaatgagaaaaaggcccagtga

SEQ ID NO: 7146 - DNA, 780 bp, A.fumigatus
tcccgacgttgtgctcttccggcggtgaagactccgcaatctacggatcggatcggttggatcaaggaacttactacttgctcatatctcatggtgatctacactccgcgcttgtgcaatgatgtcgcatttctgccgcctcagcaggacgaggctcacgcgatcgaatgccgcgagattctctccgaggaagaggtttccgactgggaagcaaaccgggaatatcatttggctcagcagctcgtcgaatcagcgattacacccgagtttcctgttgtcggggatatcgaggtcggggcgcacaagtgggtgggatcggaaggcaagcagatcgagaagggtcgagtggcatccattggagaagagaagatcgaggtagttgccaagcgccaaaatggagagatcacaaggttgtccaaggaggagttgaagaaatacggtcttgatcctgagaagattgagacgctgaaaagccgcctcgaggagcttgccaagggtaaggactggacactggagattgtcgagtctaacggcgagcgtggcttagtcggaactgtcgactccaacgacgatgagaaagaggatcacgccgcacagggctctatatcgcagccggcacagggaactacagctgacaagggggaatccaatgcagagacaggagaggaaaagaagaaggcagacgagaagatagaccattacgagccagaaaaatcagggccgaccactgatgatgccgacgacggcagcgaggaaatcttcttcaaggatgagctctag

SEQ ID NO: 7147 - DNA, 525 bp, A.fumigatus
cgcagctggtgctattcaaagtgccatagaaggtattacagcctcctcaaaattctaagcagagcaccgaatgctgaaatccagacagcgggggcatccaacggtcccaagcgcaatgctcggagcatgggcacaactggtcaaccagcaattgtgtatcttcccagcggcacttatctgatgaaaagcagtgtgcagttttttgtgggtacggtcctggtcggggacccgacaaatccaccagtcttgaaagcagcaccggatttccgcgatgaccatattgttttcgcgaaagatccaaatgtcgagggcacaaacaacttctatatcggcctcaagaatgtaatcttggattcaaccagtgtcgatacggcacgaaccatcgcgctggttgactggacagtgagtcaggcgacgcagttgacgaatgtggtgttcaacatgccgactggttccaatgcacacgtcgggctgaccactcagtacgactacaacagtaacattattgtggtgggtactctttga

SEQ ID NO: 7148 - DNA, 555 bp, A.fumigatus
gagctcattcaatctaggaatagggcggttgaactaacaaatttcaagtactccgctggcaacgccaataaaaaccacgtggaaggccaaactgtggtgaccaaacgagtaaccgaccttctggtgggtgggaagaactatttcataatgcctccgccgacatatagcgaatttcctgtcgaacaagtcctcaatatcaaaaccgtttctgataaaccagtatatggcgatggcgtgaccgatgacacacagaacatcaacgatattctggctcaaaatcgtgactgcaaagttatttactttccggccggcacctatatcgtcacagacaccatcttcgttcctgctaacattcgcattgttggggacccttacgcctcggccattagcgcgtccggcagcaagttcaccgatattaacgcagtccgccctatgattcgctttgggtatccgggggatattggagtactccatgtgagcgatatgatgtttacagtagctgacgttttgcctggatgccaagtggtgcgtatgcctcctgacactcgttcatga

SEQ ID NO: 7149 - DNA, 1023 bp, A.fumigatus
cagaccgatgtgagtctttgtaaactagttgatttgcctcgcatggtaacagatgctaatcttttagactcgatcatcaagcttctaggacaaggtacattcggtaaagtggttgaggcgtatgacaggcagcgcaagactcgctgcgcagtcaagatcattcggtcaatacaaaaataccgtgacgcgtccagaattgaacttcgggttctgtcaacgttggcctcgaatgataagacgaaccgaaacaagtgcattcacctacgtgattgcttcgatttccgaaaccatatctgcattgtcacagatcttttgggccagagtgtctttgatttcctcaaaggcaacggctttgtgccctttcccagtagtcagattcagaacttcgctcggcagctattcaccagcgtagcctgtgagtcaccctacggttttctctggtcgctggctagtttcatactgataattccagtccttcatgaccttaacctcatccataccgatctgaaacccgagaacatcctcctcgtcagcaacgcataccagacattcacctacaaccgaacaattccatcctcttcacacgcagtttcgcggaatgcccgtcagcgacgtgtgctgttggacagcgaaatccgtctcatcgatttcgggtcggccacttttgatgatgagtaccactcgtcggtggtatccacgagacattatcgtgctcccgaaattattttgaatctgggctggagtttcccctgtgatatctggagtatcggttgcattctggttgagttcttcacgggggatgcccttttccagacgcacgacaacctagaacacctggccatgatggaggcggttattggctctaaaatcgatacaaagttggtcaagcaagcgacccagggaggtcgaaacggaactcagaaccaggcggccaagtacgttctgaaccattacgcttctgtgaggacattgatgctgacttcagcccagatacttcaaccgaaacaagctggattatcctaa

SEQ ID NO: 7150 - DNA, 534 bp, A.fumigatus
aaaaatggcattcccaaagaggtcattgtgatcgatgacacgcatcctccagaacagtccaaaggcaagtccggtaccatggcggcagcagccccgaacggcggcatggctcaacctgccggcaagaaaaggcgcactggaattgaatcagcctatgatctgggatactacgatcgtccatcattttccaccaatcctcagcaatacggtgaagagtcctccgcagcctccatttgtacagaccgcacgacttccctacacacaaccgctcccacatccctgggttcacagggcagtacgggggctaccaacggtgtattttatgaagacgccaatgttggccagaagcggaagcgtgtgacaacccgcaggtcagcccgcgaagaacagaaacggcgggaattggaaactgccggtgatgcattcctgagctacatcccccctcccaagccaccgatcaaggcgaaggaagtcccagtgcctgttgttcgagatgtgagtattgacggttcagtatctggatgcactatctaa

SEQ ID NO: 7151 - DNA, 192 bp, A.fumigatus
gctaagtgggtgctagtcggtgagaacatcaaagattggagaggtaaaaagacagataatacgtggctgactatgtttgggtactgctacctatgtcgatattgtcttggacgtttctatgataacccacctacgaacctgaaggctaggcagaaggggtctgttcggagactggggcttattcggagataa

SEQ ID NO: 7152 - DNA, 1530 bp, A.fumigatus
tttgggcgctcttcgcggctccttggccccttgtggagaagagcaatcggggatgatctctaccataccattcgacaaggactattgaaacggattcgagacaaggagccctcagtgagggtccaagcggtgctgggactcgggcgcctggcagggaacgaagaagaagatgacgatgataacgacgatagctccaaagccctcctcgaaaagctcatcgacattatgcagaatgacacaagtgctgaagtgcggaagaccttgttgctcaatctgcctctagtgcccgcgactctcccttatctgctcgaacgtgctcgagatctcgaagcaaccacccgacgagccttatactcccgcttactccccaccctgggtgacttccgtcatttgtcgctttcaatgagagagaaacttcttcgctggggccttcgagaccgagatgaaagtgttcgaaaggccactggaaagctgttctacgaccgctggattgaagactgcgctggcacaaacaacgattccgaaaatggtccttccacccagcgctctcccccaaacatcccggcactgctggagttgttggaaagaattgacgtcgtgagctctgggatggattccggaattgcgcacgaggccatgggcagcttctgggagggccgccccgactatcgagaggcggttgtctttgatgagccgttctgggaatccttgacggccgagtcagcctttcttctacgatcctttaacgacttctgccgtgtcgagaacgaaggaaagtttgataggcttgccgacgagaagatacctgaggtgacagccttcgcgcattttttgaaaaaatacatgaccgagcttctgcagaggaagaaaatggccaaggatactagtgaagcaaacgatgacgacactgttgagaatgaatttatcgttgaacaactattgcatatcgccatcacgctggactacagtgacgaggtcggccgccggaaaatgttctctctccttcgcgagtccctagccgtgcccgagctacctgaagagtgcaccaaactcactgtcgagactttgagatgtgtgtgcggaccagcggctgcagccgagagcgaattctgcagcgtcgttctcgaagctattgccgaagtccacgacactattgcgaccgaagatagttttgtttcggctaagtctgaaatcagcgatgcaacctccagccgccaacggtctgtaaccccggcagacagtgaagctgaagtgcccttcaataaggaggaggcaaaggccaaagttctgcgcgagatcgtggtcaatatgaaatgtctgcatattgctcaatgtatgttgcaaaatgtggaaggcaatctgcaacagaacatgaacctggttactatgctcaacaatttggtcgttccagctgttcgaagccacgaggccccgatccgcgaaagaggtatagtgtgccttggtctctgctgcttgttggacaaggtgagttttctacacatcaacatatttccccagcaaagtggctga

SEQ ID NO: 7153 - DNA, 1029 bp, A.fumigatus
tcaaagttattgctcacgaacacttttacgccgtttggagcaaacattccacaagccattcaggagtataacgagtccgctgtggagaccctcttgcaatcgctcattgtgtctttcttccacccacgtactcgggagaacccggcctttagacaggcgttggcctatttcttccctgtttactgccattcccgcttggagaatacccagcacatgcgaaaggtgaccgttcccgttatccgtgcggtcctcaatgcggcggaggagtactactccctagaagccgaggaagatagtgatggcgagattgatgagactgttggacagagggagctgaaggctctgatggcaggcgtcgtaggcatgcttgcggaatggaccgatgagcgcagagtggtgggcctgggaggagagaagattcttgcaggcgttccgacgagctccagcccctgtggattcgtacacttggccctagtgaaagatattttggagcgtgttctgggaatcagcaccggtcccaaccggtgctccaaggaagaaaagaagcttctcttctcattgttgagtaagctttatatctcgcctcctgtggtaccatcgcgctctgggtctcggatgccggaaggcgatgatcaattccgctccagcatccagagtgccagtgggggcgaaatttcccctgagaatgtggctcttgcccaggaagtcaaggaattactggacgaaaccatccaagaaggtgtcgcggccgaagcagcgggtcgaaatgcgcttgtgaaggtcaagaatgctgtcctcaagcttctcgcagctgcgcagggcatcaggtccgacagtgtcaggccgcgcgaaggcaccgaggaacccgaaagtgatgccatgagcatccgctctggcagtgtccagccatccatagagcacccaggcaaacgccggcggatgttctcagtagagcccagcattatggaggaggatgagaacgatgacagtcgaggaacaatcatcaagtctgaagctcacgacgactga

SEQ ID NO: 7154 - DNA, 762 bp, A.fumigatus
ccccaactcctcctgcacacaacccccacaccgataaagctgccttacagctacctatcactgaaaacaacatctcaccaacaaccacacctacctagtcccccaagtcacaaccaaaaaaaaaaaaaaaaaaaaatgacatccaaaaaacccccctcgccagccgacttccccaccaacctcacagtaaccatcacccctccccaaagcccgccccgcgcaacccaccccgcaccaccaaacatcctcctcctcctacacggcctcggcgacacagccgcagccttcacctccttcgcgcgagccctcaacctccccgaaacaaccattgtgacaatccaagcgccaacgtccgctccccttcgacctgggcggcttccactggggcgacgacgtctccttcgacccggcgaccggcgcgctagatatggacgccgggttcaagcgctcgacgggcctgctcgtcgacgaggtcatccagggtgtgctggtgcggaaatgcggatatcggccgcgggagatcctgatcctggggttcggccagggcgggatggcggccttggttgctgcgagggagatgggcgaggggaagacgcagggcgcgagtgcgagtgcgagtgctggtggtgctgcggaggatacgtctctgtccggggcgatttcgatcggggcgccgtatcccctgtctggaagtacggttggagcgaagaaccggacgccggtgttgctggtgggtgggcgggagccgacggctgtgagtga

SEQ ID NO: 7155 - DNA, 183 bp, A.fumigatus
acgcccatctctagattaacgtactgtacaataccattttctactatttatatcactcatgtaatctccacacttccctcaggtacaccctgccaactgcgcaaccgccgcgcaaagaactgcatcacgggcatcatctcctcccggttccgcggcatcccatcccccttgcgcgcgtactga

SEQ ID NO: 7156 - DNA, 285 bp, A.fumigatus
cttattactccgcggaagatctacttttccgtccgcctacctcactccttgaatttcgaccttcctacaatgcttgagatcatcaccagtgtcaacctgcaagtcacaacaatgtcagatattctttctgacatgtgggaatctaaggtagaggtctatcgtccggacgctctccgtccagccgtccatgggaggcgcaatgccacggacacccaaacctctaaattaattcaattgggatcgttacggctgatgtttcacacggccagtctcactccgccctag

SEQ ID NO: 7157 - DNA, 2826 bp, A.fumigatus
aggataactctgtcaaccgtttggacccgggggaggtttaacaacccacaaatacatgcttcgcttagtgtcagagattctctcttcgcgggcgagaggtcgagaacaaatccaaggcgatcgaggtgctggagagaaagcttggacgagtcccggactgagaacgagggtctaactgaccgtctctcaagaagcacaaaagagacccgttctttgaagcatcaattgcagctcttggagggtggtacctcatcggccttgaccgagctggcaaaagagcgagacgaagctctagagaacatctcagatgtacgaagaaagctggaacaggcgcaaaagaaggcccgcagccgagaagaggagctcgagcgaacccaaggtctcttagaccgtgaaagagagtcctgggaaggagagcgtagaaacctcgagcgcaaggtccatgtggtggagggccggctgaaagtcgtcctgaatgaggttgccgcggcgcaagcagcagcttccgctccccctgtatcgtcaaagtcgggtaccccagaacccgtcagaccatccaccaccgagagatggagcgattcggcaagtgtgcattccagcagccaaggacggcgtcggacgagcgtcaccagtgtgagctccgaggatgacgctgactttcataatgtgcgctattctactgccagccttgcgaatgcccgagacagtaagcctaacggagtgagtctggcgcaagaactggcattcgacgaggaggaagagtttgacaatgagcatgatgattcaattctggattcgcccgaggcgctaccagaggaacggccgacttcggtccactcccacatgtccctgtcgatgagcctgaaggctcgaaagattcttggtctctccattgacagcagcatagactgtcatacagtttttgacagaggcctaaacagtcccgccaaagtttcctcgcccacatgcgaataccgagacactggtatccagtactccccgccgccatctccccaattaccccctgaaagtccacttgagcatagttcgcaggcattgccactcgcttaccaggcgaaggacagcggtacttcgaccttgactatcgacatgaaatcgacatcttgtcagacggtcggcaacctgcccagtcctccgtggacaccccaggttgccgaaacaccaataactgcaggcccacaaccggctgcaacagcttcaacatcgacgcagaccgatctcgttccagcccctgcggcaagcgaacaggatgcggttgcaaatcctacaaagtcagttcctacagcgattgaagtccccatgatcgccatccatccaccgcattccgagccttcttcgcctcgaggaagcgtggttctgccacctcagacaaaaaccgtctcctgtcaaacaaccttcaagaccatcatcgacagtcgatcggttgccatccagaccgaagagattcgtattgacaagcgaccggtcaagttgccggctagcttgcttccctctgccatccctgacgtgccgcttaatgtgtcgcgtgctgagagcaattcagattcgcccatccagccatatcgacccccgtcacgaaggctggagcacggagaatccaaaccgcctccactgcctgccaaggctccgtcgagaagcaaaccgcccgccacggtgcaggcctatcctgggaacaacgacaacgggccgttatcggcggattccaaatctgacttgaggcggcccttcagatcaagcagtctttttgctggcttcgaggatgaaaatgacgagccgcgggaggcaactcgagatatctttacagatgacgagctgcttaatcggccgtttgcttcatacaaactgaaaaagggaaagctgatctcggcgcaggaaaggtcgagtctggacgataccctactggcagaacttgatgattctcaagtccatgggaatctggagccgtccgaatcgtcgccgcaggggcagaggcgaggtgtgacaggttcagggaacgagcgggatgcccggacggccacaagggtccctaacgccgcagcagggcatcggcgaagagcacgcagcccaagcgagccgagtattgacagtggcagcggggcatcaagcattgctcctccgttccctgtcccaattcgcctcagttcaagaaaattccccggcaacgggagcgatggacggcagagcccaactccctccaacccacgcaacttctctgatcgcggacgggcgcccattgtgcggagacctacactgcgtcgagtacgttcagcagcggccatgtctcaatcggagcatccagagcggcctccgagccagtcgtctccgtcctcctatgggctggaaagtcctcagtatccgccgctgccatttgatgacattacggcgcctcgggacaggatggctgtcgaaagacggtcgatgcagcgtccctctatcactcgaccgtttgcccatgaacggcaagactcgaatgcaacgacgtcagtgcagccaaccagcgtggtcgacgccattgcgcagacaatgatcggagaatggatgtacaagtacgttcggcggaggagatctttcggcggcgtcggtgaacccaaggacagctgggagggcaaaaacgccgatgaggtgtcggccaatatcaccaacagcggagtgcgacacaggcgatgggtttggctcgcgccatacgagcgagcggttatgtggagcagcaggcagcccaccagcggtcctgcgatgttaggcaaaagtggccgcaagcgtaagtttccgtcattttttttagaaagagtgatgagtccgcgctga

SEQ ID NO: 7158 - DNA, 264 bp, A.fumigatus
gaacactgcattggaggaggatctcaccgaaagcttggagaaggccatggaccagtacccggacacgtacgctgtcctggtgaggagacacggaatgtgagtcgtacaccttcatgttatactgagcccttcaagctgatgaatgtttatagttatgtctggggtgatgacgttgccaaagccaagacacagtgcgagagcttggattatctcttccagctggctgttgaaatgcacaagcttggccttccatgggtcaaatga

SEQ ID NO: 7159 - DNA, 294 bp, A.fumigatus
gttgtggcattttacaggacatttcccagtggggacagtgttggggacaactttctggttcgggcggggagaagggttccaggacgctggtttcgaaattcagccaacattgagcagatcaagggtatccctggagggcaaggggaagggcatgctgggtttcttcgacacaatttaggattcctatcaattgagaacactgcattggaggaggatctcaccgaaagcttggagaaggccatggaccagtacccggacacgtacgctgtcctggtgaggagacacggaatgtga

SEQ ID NO: 7160 - DNA, 228 bp, A.fumigatus
aatccgctgccaaatctattcttaagcatcttcgacaaaccattctccgatttcaactcgctcttcggccaaggcttctacctcaaagtgatcttctacctggcctccaggacctccaatcctttccaggacaatccacacaccacggctgtcttcaaggcaaggatgcaggtcgaagtcttcaatacgtactccagatatcgcatcgctatgatcgccgtcttctga

SEQ ID NO: 7161 - DNA, 438 bp, A.fumigatus
agccccctttcgtccgaagcagcgggacggcgagcagtgctatcagatattggtgtcttgccaccaggaagagacaggatgctggcgcctttgcaggtcccgcgacttacccgaatcaagcttattgcgcgcagtcgccgttctatgatcgggagtcatcccgttggcccttcaccagtgctgatgacagttgaattgggccaaggcccctacaaggaggttctggcgacttcagaagacggcgatcatagcgatgcgatatctggagtacgtattgaagacttcgacctgcatccttgccttgaagacagccgtggtgtgtggattgtcctggaaaggattggaggtcctggaggccaggtagaagatcactttgaggtagaagccttggccgaagagcgagttgaaatcggagaatggtttgtcgaagatgcttaa

SEQ ID NO: 7162 - DNA, 186 bp, A.fumigatus
agtcctacttctctctacctaccttacttactagtaactttaacctatactactatagatagcagcccttactctaatatatacctactacctttacagaattattcacagaatagcttgacaggcttagactactacttacctctgagattaatatccctatatataataaaggtaatatcctag

SEQ ID NO: 7163 - DNA, 378 bp, A.fumigatus
ttccactcgcaaaagaacaaagaaaagatgggcagcggcatccctctcacagacgcagaccgctgggactggctcatctcgctccgcaatgcagccatcaaggccctctcgccctcggaagcaaacaacttccaccccccgtcgggcgtggtggttgcctgctcggccctgaagcaaaagtaccgtgatgtcatgcgtgtggctgcttacggcacgccatccgtgcagatccacttcgtttacctgaagttggatgagaatgcccttctgcaacgtgtcgccgcccgccaggctcattacatgaagagcacaatggtccagtcgcagctgcaggatctcgaggagcccaagggcgaatgggaatgcgctgaccattga

SEQ ID NO: 7164 - DNA, 273 bp, A.fumigatus
ggcagcccacgcagcgctggagtatttccatcctgcctcatcccgccttttgctctgctgcagaaaacgcgacagcaccatatacctgttgtccgactcgatcgctcttttgtcctcaagatggcggccgattggcagcacaccgagcatgatatgaaggacgagggctcgactctacagagtcctgggtttgatcttgatttcaccgacaccgcgggcgatggcccacaagaggaggatgttcgcgaccagaaaggtgacaatctttggtga

SEQ ID NO: 7165 - DNA, 234 bp, A.fumigatus
tcgaatgaccagacccctctaggactcttcttgactagcggaaaatgtcttgctgctgctggtcctggaggcgtagtggtcgcctacgtgatcatgggcacggtgatttcgtcggtgatctcctccttgggcgagatgaccgctctgatgccggtcaacgccccgatgatggaatttccacggcggtttctggatcggggtgtcggtcttgctgttggctggatatactggtaa

SEQ ID NO: 7166 - DNA, 213 bp, A.fumigatus
agcgtgaatgtgtttgagctacgatttcccggtcgtccgttacaggcatgccatgatacagccccgaatcaaggcggtactacagtcaagccggttgggaccaaaagtaagcaccccttttcaggtaaaggctttttaacgcttattggcttggattctgaatgggaattccccgtcctcctttttaaacttggactaaccggtgtaaggatt

SEQ ID NO: 7167 - DNA, 594 bp, A.fumigatus
atcggcacaggctacacggctgtgactggcgagttcgtcgtccctacccccagcgtcccaagcggtggctcttccagcaagcagtactgcgcctccgcttgggtcggtatcgacggtgacacctgcagctctgccatcctgcaaaccggcgtcgacttctgcatccagggcagctctgtctccttcgacgcctggtacgagtggtaccccgactacgcgtacgacttcagcggcatctccatctccgctggcgacacgatcagggtcaccgttgatgcaaccagcaagaccgctggcacggccactgtcgagaatgtgaccaagggcaagactgtcacccacaccttcaccggcggcgtggacggcaatctgtgcgagtacaatgccgagtggatcgttgaagactttgagtccaacgggtctctggtgccgtttgctaactttggcactgtcaccttcaccggggctcaggctaccgatggcggttccactgttgggccttctggcgccactctgattgatatccagcagagcggcaaggttttgacttcggtttctacctctagcagctctgtcactgttaagtatgtctaa

SEQ ID NO: 7168 - DNA, 192 bp, A.fumigatus
gttgccattaaccgctgttcgacacatcaaggtagtacgccggtgattcagcgtgaacgccagattgctcatgaactgatcgtcagctatcgattctctttcgcggagatatactcttatattttctatctgctttgcaagggaatgatcatcaaatccggagagcataaagagacgcgtccgtatgggtga

SEQ ID NO: 7169 - DNA, 669 bp, A.fumigatus
tttcagattcaacttgatccggaaccatgggaaagctcaacgcctcaccgcgtgtcggtaaacagcttcggatacgggggaagcaacgcacatgttatcctcgaagacacctatggatacctacaatcacacggtctacaagcactggttggcaaacctcgtacacctttcctgaaggaggctcttgagccatcgcaaaagccccacagccgccatgatgaatcacccatacggacgcgtctctttatgctctccggatttgatgatcattcccttgcaaagcagatagaaaatataagagtatatctccgcgaaagagaatcgatagctgacgatcagttcatgagcaatctggcgttcacgctgaatcaccggcgtactaccttgatgtgtcgaacagcggttaatggcaactcagcttcaagcgtgatcaaggccttaggaggtagtatcagggtcagaaaggccacacgcaagccagtggttggctttgttttcacaggccagggagcgcaatggtgcggaatgggacgggagctggtgaaagcatatcccgtttttcgccagtcaatggaacgaattgatgcacacttgattcgactccaggctccattttccgccttaggtgagagacgaatcagagacattgaatcaaaggtcatggcctga

SEQ ID NO: 7170 - DNA, 360 bp, A.fumigatus
gaatcacatctgtcagccggtatacctctgcccgagatcatgggaagccaaacatcctgtttcgtaggttcattcaatgcggattacacggatctccttctgcgcgaccccgatgctatccccatgtatcaatgcaccaatgctggccagtcgcgcgccatgatggctaatcgagtgtcatacttcttcgaccttaagggccccagtgtcacagtcgataccgcttgctcggggagtttagtcgcactgcatttggcgtgtcaatctttacgcactggggatgctgcgatggcaattgcggccggagtaaacgtgattcttagccacgaattcatgtccaccatgaccatgatgaagtag

SEQ ID NO: 7171 - DNA, 399 bp, A.fumigatus
agaaactctgctaatcatggtgcaacaggtgagattcttgagaatcaagacgcatcacggctcaaccatccactacacagtcaaacaatctgcacagcgcttcagatagcacttgtcgaccttctaagctcctggggcatagagccagattccgttactggtcattccagtggcgaaatagccgcagcgtacacgatcggagcgttaactatggaggacgccatatccgttgcatactataggggtgttgctgcaagcaaacttttgcacaacgatgaagttaaaggaggaatgctcgctgtcggagtgtcacccgcccagatagcaccgtttctggacacattgaaatctgtcttcaccacggggctggaaggatcgacggaggtcagtacattatgc

SEQ ID NO: 7172 - DNA, 564 bp, A.fumigatus
atactatccaggtttctgtcaccggaaggacgctgctacacattcgacgagaagagcaatggatatgctcgtggcgaagggattgggtgtttgattctgaagccactcacagtcgccatcagagataaagaccctatccgagctgttatcaggggttctgggtcaaatcaagatggcagaactcccggcatcactctcccgagtggagcgtcacaagaagcgttgattcgccatgtttacaacatggcaggtcttcatccacatgatacagaattcgtcgaaacgcatggcacaggaactcaagcaggagatcccatcgagacaggagcgctcgccagagtgttttgcgtcggtagaaactcagacaaaccactgcgcatcgggtccatcaaaacaaacgtggggcatctggagggagcaagcggagtcgcaggcgtgatcaaggcagtgctgatgcttgagaaccgcattttcctccccaaccgcaacttcacttccctcaactcacgcatcctgttggacgaatggaagcttaaggcatgtatcccatattacccttcctga

SEQ ID NO: 7173 - DNA, 417 bp, A.fumigatus
tactggttcccctgcgacattggctacgccatcgcatccattctctgcaaaatatccgtcgccatcttcttgctgcgtgtcatggttcatccgtttcacaggcggatcatgtacgcagttaccgcgctcacagtcatcgttggcatcatcttcttcgtctacatgatgatccaatgctcgccggtgtcctatttctggacccggatgctcggcaatacctctggcaaatgcggatacgtggatgcgatcatcatcctgctgtaccttttcagcgcgtcatctgcgcttttcgacctgactgtgggcctgctgccgatcttgctcgtgcgcaatctgcagatgaaccagcggaccaagattgcggttgcgggtctcctgggcatggcatgcatgtacgtcaactgtacctttacgtga

SEQ ID NO: 7174 - DNA, 192 bp, A.fumigatus
tcgccttccagattgtgcggtcaaagcagcttccgctaccccggagtggtgatcatccccagttgtcaactcccaccaggaagcaagctaaagcccacagccggtgtcacaacagagaagactactggcccatggttcgcattctcaaagctcctaagccaggacactattggccacgggtatggctcctaa

SEQ ID NO: 7175 - DNA, 219 bp, A.fumigatus
atcgcaatctggtccaacatcgaaactggccttggcatcacagccggcagtgtcgccactgcccgccctctcttccgtatcctccacagtcgcaatggctcttcctaccgcatcttcgcctcctctggtttccagagcaggagacgccagcaccagtttcccctgggtgatctcgaaagcaacacctggcggtccccctacgacccgaccaagagcaac

SEQ ID NO: 7176 - DNA, 471 bp, A.fumigatus
agaacgaagaacaccagtatacttcgtgacgaggccggaaaggaagtggtatgtgatattgattacattcctaaggctcgaatgggcctcaaatgcctcttctgccgcgaggtccgcggtgcctgcttccaatgcaactttggaaagtgtacacggtcctaccatgccacatgtgctttactggccggcgtccaagtcgaacacggctccatcgctgtgatcgccgacgatggcaatcagtactcagttccaagtgtcgaccttaagtgcaaataccatcgccaaaagaggccaacttggatgaccaacgacgcagctgactatgaccgcaaagttaatgcgaccgcacagcggctggtagtaggagatctggtgcaattccaggcagacaaggaaattaacggtgcagtggtcctgcaaaatcgacctgaagaacgaactctattggtgaagattcttccacgagggtaa

SEQ ID NO: 7177 - DNA, 1437 bp, A.fumigatus
cccgactcccctcttacccccaccatttccctcagtatgcatctgcgtctgcgtctgccgttgttgccccttcttcctcgccagcacaaccaccacctttctcctgctgtagccggtaaccgctgccgccgccagtgctgctgctgctgctgcccaatcgcccttcccttcatgcagggacctcctcttgcccctcctcctactgctgctgcccctcgttcctcctcttcctcgactgttgtttctgctgctgctgcttctgcgatgccgtcggcctatcgaaccttacccactcagtccgctcgccatgctccgtacccgcaagtcatcaaagcacataacaaccaccaccaccaccaacaacatcccttctaccattctccgcaacccctccaacctcctcagcagcagcagcagaacaacaccaacaacaacaccaccaccaccaataccgccagcaccaatgggctccccgccaataccttcgccaatgttcgtgagctcattgctcgccgtcgcctggcgcaaattaccgaccatgccaatgtcttcgccgggtataccatcgtcagccctgagctggtagttgagacgctgctgggtcccatgggctcggtcccaccacctaatggtctggaaaagctcgagcttgccatggcccagcagcgtgtacagcctagggctcctgatgggaccttgctaccattgcaaccgctgaacatgcgatcggaggaagtcaccagacttttgcagatgctccgattctcacttgtcagtcaccgcgagcggttggatgtcttgcagaagagggagtcggagaatatcaagcaggaggctaccgccaaaggcagtgctgcctcggccaaactggccggcaagtatgcttaccttgaccagcagcgtgctcaggctccgaccgtctaccagtctccctacgatatgccatccgggttcaccgagtacgccaagaagacttatgaacttatcccctgcgcgccagagctgcccaagccttccgtggcaaacgactactttgccagcctgtcaaccgaagatcaagagaagatccttaagacttgtggcagcttcgtgcagcgagcgatcgagcgttcggcaccccacagccgccagaattcggcttcgaaccttcgacttacgtcggcgctggctcaacaaacggagaatccgactatcgacattaccacggtggaggatctgccattatctggtctcgacttacccctccacgcagactctccgtgctccagtttcagtcggtcgcatctgaggttccagtcgcccaatgatttcaccagtcacgggcccgaagctcaccacgatcatcatgaccttttcggtgaccaacaggcgaacacacggttctggcagcacggccgttttcactcacggaggcggcaaggatccgcgataggtcta

SEQ ID NO: 7178 - DNA, 474 bp, A.fumigatus
ccggtaaccgctgccgccgccagtgctgctgctgctgctgcccaatcgcccttcccttcatgcagggacctcctcttgcccctcctcctactgctgctgcccctcgttcctcctcttcctcgactgttgtttctgctgctgctgcttctgcgatgccgtcggcctatcgaaccttacccactcagtccgctcgccatgctccgtacccgcaagtcatcaaagcacataacaaccaccaccaccaccaacaacatcccttctaccattctccgcaacccctccaacctcctcagcagcagcagcagaacaacaccaacaacaacaccaccaccaccaataccgccagcaccaatgggctccccgccaataccttcgccaatgttcgtgagctcattgctcgccgtcgcctggcgcaaattaccgaccatgccaatgtcttcgccgggtataccatcgtcagccctgagctggtag

SEQ ID NO: 7179 - DNA, 366 bp, A.fumigatus
tcgcagcgcggttcctgccagccccgtggcgaagaccaaattcgacagggaaatatgtccggcaacccatttgaagagccacctcggcgaatcagcgagtatacggcgcaggaaattgctacactccaagcacgtctggataagaaactgggccctgaatacatctcctcgaggcctggcgcagcgggacagaaggtgcactatctatccgcagacaaatgcatcaatcttgccaacgaggtatttggcttcaacggctggtcgagttcgatacagaatattcagattgattttgtatgtttgatgaaacatatcagaatgcgtccgggcggcggtagggcgaagttgctaatggatgctccgtga

SEQ ID NO: 7180 - DNA, 312 bp, A.fumigatus
aggatggtacttaccatgaagtatgttttcaatggttgcttccatttagtcgttcttactaattcgtctggattaactcaggatatcggttacggtcatattgagaattgcaaaggaaaggctgctgcttttgaaaaggccaagaaagaagggactactgatgcacttaaacgtgcgttgaggaattttggaaacgtcctgggtaactgcatatacgacaaggattatgttgcgaaagttaccaaagtgaaagccacacctgtatgttgcaaacctcagcttgatactcaaacactgtcttgttctgactaa

SEQ ID NO: 7181 - DNA, 1044 bp, A.fumigatus
gtaaaacagaccttgtttatttcttgtggccactcatggctaatggatctaggtgatctctttgacgaggccgattttggagttacggcttctgggaaccccgatgagatagtactgggaccagaaacacaagcaaaaccacagccaccaactcctgtaaagacaggccctcaggggaattttcaccgcccaaaccctgcagtcctaacaccttccaggccagaaaagccattcaaccaaacagtcaacaacagacagccttccgtcctgccctctctcaatcaaagacataatcctgcgctgcaaaaccaatatgccggacaaaggcaacctgtcccgcaaggacaacagcagaactttcaaaacagcagaatggcgcccccagatcaaccaagaactagccaagattcaaacttgccaagcgcagcagggcaaatgcctgtcaagcgagaaatcgatgctaaagctcaggacacagctccccccgccagttcaccctctgttctgcctgcctcattcttttcagctcgagcagtagatttgttgcgggaaaacccacatactgccgtgaatgctccccaatttgatcctcacgccgaaagtccctcgatccgcaagacagcaggcgtcgatcatagcaagagtgtcccgatatcgaagccaatgcttgcggcagcctcaccagcttcaaacaatacgcgcgactttatcaatccttccacggacatgcatcggaaaattggcgcccctggtggtattggcagtccaatgatgaaccgtggtcagacgacttcatcataccgcccactgactcggcaaaatctcgatccaaaacaagctataagcaacgcagctgcagacagagccggttttggaccacccaatgttaatgggaaacgaccacctttaagtgacgtgacgaatgcatctgtctctggcagcagcgggcctgcttcagcagtcaatgccaatgatcccaaaagacccaagattgatgggaattcgacgccatccttaccgccgcagcagcaacagcagcaatag

SEQ ID NO: 7182 - DNA, 786 bp, A.fumigatus
  unsure (26),(307): Identity of nucleotide sequences at the above locations are unknown.
ggaacccccgccaggcgccgaccggnaaaggccccttttgttcgggcattttccattgagcaaattgcccgtttgttttggggacccggttccggggcggaatccgattccttttggccgccccccgcccggtccaatgccgctgggctttctccccaagggcgggcatttcttggcgcggtacgtcgaacggtgcaacgaccccgcccgtccgcaaccttgtcacctttcggcagccagcacaatggattcgccgagtttcaggagtgcgcgtggagtgattggatctgccggggggcggaggcgntgctacgcgcaggccggtggtcgagtctcgcgcagtcacggttcgtgcctgcgcagtacttccgcgatccggaggagctggatgcgtacctcgagcatagcaatttccttgcagacataaacaacgagcgtgtgctgaagaataaaaggtacgcagagaatctggcggggttgaatcgctttgcgatgtatatgtttgaggacgataccatggtgaatccgaaggagagtgcgtggtttgcggaggtgaataggacgaacggcgaggtgacgccgctcaaggagaggcggttgtataaggaggactggctggggttaaaggcgctggatgaacagggaaagctggactttaggactgttcccggtggccatatgcagctagctgaggagaccctcgagaaggtgttcaaggagtattttgggccggttgaggtggagattcctccggttaatactctgctcaagcagactggcttgtag

SEQ ID NO: 7183 - DNA, 270 bp, A.fumigatus
ctcgatacagatacgatcgttttgcctccgataagaactataaacgtcccacgctgctttacatcactggcggtagcaacatcgaagtctccggcctccgccagaaaaacccccccaacgtgttcaactcggtcaaaggcgacacgcagcacgttaccttcaagaacctctgcatggacgcaacctccaactcccaaaatcctccgaagaatactgacggattcgacatcggcgccagcacgcatgtcaccatctcgtccgtcagtgtga

SEQ ID NO: 7184 - DNA, 426 bp, A.fumigatus
atgcacaagatgctgtatcctcgcaatctcgctcttttctctcttttaagcctcagcagtgctgctccctcgcaggttgagcgctctcccgatgcagtgctcaagcctcgcgccgtctgcacgcccacggctggtggaagtccttcgatcgacgatgtaccagccatcaggaaggccattgcctcgtgcggcaatggaggcacgatagtgttccccgctgggtcgacctactatctgaacagtgtgctggatcttgctgggtgttcgaactgcgatattcaagtcgaaggggttctcaagttcagtggctctaccgagtactggggtggcaagaccgctatgctcaacatcgatatgatcaatggcttgaggctccgatcgttgacggggtctggtgtcatcgatggcaatggacagaatgcgtaa

SEQ ID NO: 7185 - DNA, 456 bp, A.fumigatus
cggggtctggtgtcatcgatggcaatggacagaatgcgtaaggtgcatctatctgtgaggttgatgccggagctgactcgatacagatacgatcgttttgcctccgataagaactataaacgtcccacgctgctttacatcactggcggtagcaacatcgaagtctccggcctccgccagaaaaacccccccaacgtgttcaactcggtcaaaggcgacacgcagcacgttaccttcaagaacctctgcatggacgcaacctccaactcccaaaatcctccgaagaatactgacggattcgacatcggcgccagcacgcatgtcaccatctcgtccgtcagtgtgacaaacgatgacgactgtgtggctttcaaacccggctccaactacgtgacagtcgaagacgtcacctgcaccgggtcgcatggtatctccgtcggctcgctgggcaaaagc

SEQ ID NO: 7186 - DNA, 747 bp, A.fumigatus
gtggctaaaaagagattcagatggcattatattctcactggtcctcctggaacaccttacgagaatggccaatactggggcacattgatgtttcctccggagtatccgtttgcaccccctgcaatccgtatgcacactccaagtggccggttccaaccgtcgtctcgactgtgcctcagcatcagtgactttcatcccaaatccttcaatccagcctgggaggtttccaccattttgatcgggctgctatccttcatgactagtgaagaaatgaccaccggtagtgtcagtgcttcggaggcagaacggagagtgttggctgcgcgctcaaggtggtggaactctacaggtggaggttctcacatcagcgcaaccccaggagtgactcctacggcgaggggaattaacaatgtgaaggctggagatggcggcctcaagttccgcagcgaatggccagaactggatcaggagaattggcaatggatgagagaaaaccgcattgatacaaacactgggcagctgataccggaccctaactcttcagtcacaaagtgctctccagagacaagcgcactccgcaggcgtccaaacgcaagcgcacctggactcggttgcgtaatggaaggtggccaggtcgcacgagaagcatgtcagagctgggctcgtcgaaacaagatctggattggtctcgccctcatatttggctacgcacttcttaccaggctggtcaacgatgtccaaggttga

SEQ ID NO: 7187 - DNA, 243 bp, A.fumigatus
tatgaaatattgtattggacagtctctgatatgctcacagatatctttcagcaaccgatttcagtgtatatcgaccagtcacaagatgcgaagtcgcaaaacggaatacccaacatcgatgtctttttctctgaaaaggaaaagtcccgggtactccagaagacgggaacagacggggaaaacgggggggttcgccaaaggaattttgatgggggggaggtgaggggggggagaagagactta

SEQ ID NO: 7188 - DNA, 240 bp, A.fumigatus
cctgagagcgctgtaacttccatccccgtggtgaagacgaagccgaagtattctccaaaggaccagaaagcacccagagctgatcctccaagaggttcagataaactagaagatctgtacatcacagccattaatactaataatcgatatgctggtgatatcaccttgcaagcataccttttgacattgtatataattatttcagtcacatgtgaccgcgcttacaacaatcacatttaa

SEQ ID NO: 7189 - DNA, 411 bp, A.fumigatus
gcttgcgtatcttccaggccgtgtcgaataatttgcaactgtctgcgtttcgcgaccggcaggtccgagtcttcgacttcgcgacgggcaagctctaccggaaatacgatgaatccatcaccactatcaccgaaatgcagcaagccggcacagccctctacccactcgatgaggtggaattcggccgccgcctcgccattgaacgtgaactcgagaatcccatcacccagcccaaaatcaacgtcatcttcgacgagtcaggccacttcgtgctctacggctccctctacggcgccaagtgcatcaacacctacaccaaccgcgtggtccgcgtctacacaaaggacgaacccttccgccccctcaacctggccctgtatcagggccaaccacaaaagaaaggcgtcatga

SEQ ID NO: 7190 - DNA, 1077 bp, A.fumigatus
ttgcgtatcttccaggccgtgtcgaataatttgcaactgtctgcgtttcgcgaccggcaggtccgagtcttcgacttcgcgacgggcaagctctaccggaaatacgatgaatccatcaccactatcaccgaaatgcagcaagccggcacagccctctacccactcgatgaggtggaattcggccgccgcctcgccattgaacgtgaactcgagaatcccatcacccagcccaaaatcaacgtcatcttcgacgagtcaggccacttcgtgctctacggctccctctacggcgccaagtgcatcaacacctacaccaaccgcgtggtccgcgtctacacaaaggacgaacccttccgccccctcaacctggccctgtatcagggccaaccacaaaagaaaggcgtcatgacagtttccatggccgcaagcgccaaccccctcctgcaggaatctgaagaacgagaccccatcctcgtctcgacaggcttcgcaaagatccgcttttacctcttcaccaacgaaaccgaaatctccaaatccagccgggacgtgcagaacgaacggcccacgcacgccgacgcccgcgagacaaccgccaaaaaggccgccgagacgggcacctctgccatcctccacaccaccatgggggacatccacctgcgacttttcccgcaggcggcgcccaaggctgttgagaatttcgtcacccatgcgcgtaatggatactacaacaatactatcttccaccgggtaatccgcaaattcatgatccagggcggtgatccgctcggggacgggacgggcggcgagtctatctggggtggagagttcgaggatgagttttcaagcctgaagcatgacaagccgtatacactctccatggcgaatgcgggacccaacaccaacggcagtcaattcttcatcacgacggagaagacaccttggctggacggtaaacatactatttttggacgtgcggtgcaggggttggacgtcatacacaagatcgaaaacaccaagacgtacaaagagaagccggagcaggacattaagatcgtgagcattactgtgacttga

SEQ ID NO: 7191 - DNA, 1260 bp, A.fumigatus
gatcatgtaaacaaacaagcccaaaggtgtttatctttgctaaccgggccctctgttgcccaacagctcgactctccattccagcttcaagaacatctgaaagcgctctacaaccacttcacccgtccggaggggtccgagaccgtcgtgcctatcagtcgagatgttgcgatacagcttgcgggaccgcccgagggggtggacaagtccctgtggctctacgaactctgtcgtttcctcaccatgaaagtaaataacctgatcgttgctttcttcgccgaaaatccgccatgctccgcgcaaacgtgtcctgagatgcgtgcatccgagtggcagtatctgtgcgccgtccatgaccccccgaaatcctgctgcgcgattgactactgctgccatacgctcgattgggccaccaacatcctcacatctccaaagcattttccaagtcgccttacgctgggttccgaggcaggcggtggcgcgcaggcaagcctgaggtacctgaccaacatattccgtcgactgtatcgcatcttcgcccatgcctggttccagcaccgggatgtgttctggcaggttgaggggaatgatgggctgtacatatttttcaagacggtgtgcgatatgtacaagcttatccctgaagacaattatacagtgcctgctgaagcggagggactcgatgccaatcagtcaatgcaggagcaggcgggcaaccgtcggatgacgatcctacgaaaggacagtgagggcccgttggagaacattgagccttcgtccataagcactggtgcaaccacccggcgccacaagaatagcgcgtccatcagttcccacgttacgacgatcagtgagggtgcggaggaatcagaagagcaaccgaaggcggagcctgtgataaagtcaaaggatgaaaaatctactgaggctgtaccaaaggttgagtctgaaccacagcctgcagaagaggttgtaagtgaggagcaaaaggaagctgccgatgcacccgtacaagacccggccgagtctcaggataccgttgaagaggtgcaagaggacgaagaggggaagccttcaaatacgaatacagaaacggcagcaaaggatgagccggaagccgtccagccgcctgaggagccagaagcaaccaaggccgaggagtcgcgagcagacacgcaagccagcgcagaagacagcccagaagccaagcgaagagaagacccaacaggagcctggagctcagtcaacaaccgagcctga

SEQ ID NO: 7192 - DNA, 195 bp, A.fumigatus
aggtccctcccatcccttcaccagaagatcatcagtctgacagtccgcaaggtcttccacctcacaccgctctccttcgcccttgtaaacctcaaacccatcctcccgggccacgtcctcgtttccccgcgccggcgcgttccccgcgttgcggacctgaccgccgccgaaacgagcgatctcttccttaccgtg

SEQ ID NO: 7193 - DNA, 216 bp, A.fumigatus
  unsure (24): Identity of nucleotide sequences at the above locations are unknown.
agcgagcgcaaccacaaaaacggngttttctctgttagacagactgtctgggccttctcagccaagtctcactacccgttcttagagtgcgcactattccattacaaggctagtgcatccacaactagctcgcagagatccacaggcttactctgcctgtcggcctgcagcctgcaacctgcagcactggcctgtccactcgtttgctttcgctaa

SEQ ID NO: 7194 - DNA, 405 bp, A.fumigatus
acctcattcttcttcgttttgtcgcctcttttattttcatttttattatttccccccccccttttcctttttcatttttccttttttcctctctttttttttaccctccgttttgtggtcaatttgtttttcctttttttcattacccttttcttttactccatacctcccccgaattacggaggaattattattactattattattatttttatcgcacttgaccctttccagagcagcacccaaaatttcccgcccgaaattcctcccccgcgctggctagacccaggtcggtcgctggttttgactgtggagtggtctggatactcacgcttcttgggtttgggtttggtttggttgttgtgcttgttcttgttcagttcatttattatttggtctgtctga

SEQ ID NO: 7195 - DNA, 228 bp, A.fumigatus
ttatcctctcttccttatattattcttcttattattatcactggcgctggctctgcctcttcgtttcttcctctcctctcttccactctgactgttctacctatcagtgccatcagtgtcctccgaataataccacaatccgatcactttcatcggttgccatcaccaccaccatcgcagcacaacagtcttcaccacggggctggaaggatccgacggtggttctag

SEQ ID NO: 7196 - DNA, 189 bp, A.fumigatus
atgcattgtgacgcctttttttcctggattttctattttttctggacgggcccctctcatgtctccgtcacatcgcctaaggaaggcacaatccagtgggtcgagggagaaaaaagcgtcattgtggagcttaccatacgctttaccatacgtgacaacagtacagtaccgccattttcgccgagctag

SEQ ID NO: 7197 - DNA, 396 bp, A.fumigatus
  unsure (201),(227),(257),(370): Identity of nucleotide sequences at the above locations are unknown.
ctccaatgttcatccataggctcaaacctttggtatatacggagtattgtcccttgccaaggtatataccccacaatctgcaacaacaccaagaatgcagatgctatggtgcgtcgggaaattcgtggatgcttcccacgctacgatcaagcctgcagagtaaacataagcagacaaagtgccatgcgtaatgagtcacanaacgtggataggttggcggatatcanaccaggaataacgtcaaacggcttcctttntgcgctagacttgagtgagtcggtagcccgaaccatggtagatcttgatagccttgtggaagacaacacttatgaggacacttttctagacatacagactatgaaggtctcanagcaatatacaattgtctcagcttga

SEQ ID NO: 7198 - DNA, 198 bp, A.fumigatus
acggtcatggtcttgaaatatctgatcaagcagtacccgttgccgaccttgtattttggaatcgctaatgtcatcgctaacggcctggtcatgctaaggtttgtcgatgtatctcctgcagctatacatctgtcacggttgctgactggtttgctacagtactattgttctatggatctcgcagaacatagaggatga

SEQ ID NO: 7199 - DNA, 1593 bp, A.fumigatus
tacaggagaccaactctcggaagaggaggcggtaccaagaattgcaagatatccgggggcccagattctcctgtcggtctctcgcacttgcatgttccatcctctctacgcaatgaggatcttcgtacaacctcgaaaagcccattgtcgtcgagagcacggagtgagaagcgatccggggtctcgatggcctctgagccatcaccgaagaggccaatacctagggcaggactatccggcgtacaagggcaagatgaagaaccgagcccgtttgttagccatggtgctccttggctgaggaaggatcgggtctggatcaattcccggaatgttgatcctcccacatcccctacaactactgtcttcaatcgccaatccgatatgagagctcgtgcgactatagttcgctcatccaaacggcgatttccgggcaacacaactccgcctcaacgatattccagcatagattcgtccactagcgcggaatctccagtccacatggtcacccgccaaggattcattgctagcgaggatagatcgaaggggaatgcaacggagtcgatgcataatcaatcagtaaacggtttggacagacagtgcactgtttctaacgaaagaatgagcagctcacttcagatcctttcgtcgtcgtcacaactgcctaagtttgagtaccgtcggcggaaggtgcgtgctgcttctggacaggaacataccagttccccgatggtcctggacaagagaaagccatcagtagtagctgaggtagagaaggcgcccaatatcacggccgatcgtccgactcaagcgcttgcactgcgaaacgtctcattcgcagatgcagcggacctatgccaaacggaaagctcgcaggcatcacatcttctggcaaaggatgagaccacggtttccaatcctcccgatatggaaacagtccacaattccaaggcagccagatcgatgcagggcagtactagcgaaaggttacattctgcccaacgagtacctggaaactcggccatgatggattgcgttacgtcactgcatactatcgctgtgtcgaaagaacatacagagtatgatggtgatactatcccagaggcccaattttccacgcaggcagctgttctactcgctcagaggtctttccagaaggacttggaaagcccggaacccgaggagcttcctttgcgccggacccctagcctaagtacatctcctgcacatgaaatcacaccgttctgtcaagtgaatactcccggcgaggtgaagatcacaaataagttatcaggacctgcggggaccggattaccattgatgagcacgcaatgcatcatcgatgcagtcactcctttcacttttagtacagataagaagagtaactaccgtgttatctcatcggcaaagagtcggtcagggagaaggaaatcagagggtgtcaactttcctactggcatagcgccatccatgcaccgatcaccatcgccgagcataagggatcactcagagctcagaaatccagatgccgacaggaacatcgacgatgactccagggtcttcaccacgggggtggaaggatccagcggtggtgca

SEQ ID NO: 7200 - DNA, 1236 bp, A.fumigatus
aagtacgcgcttcgcttgatcaaagccccgcagagcctcgtcagtctcgtcagcttccttcttattcgcgaaatccacacattcaatagttgcattcaagcaagcgatttcgccatgttcctctctaaactcccaaatgaagtcgtccttctaatcgccgcccatctggtctgctacagggatctcagggccctcgtgctgtcctctcgtaaacttcatcatctcctgaaagcacgtctgagcaaacacagctaccaagcctgccatggagatgcactatgctgcgccgcagcccagggtgatgagggtctcgccagggaatgtctaaagaggatgacaatcgccgccgagtctttccaaggtccccgtgtgagcaatccgtacaaacaccctctatgcaccaccaactggagagtcgaggattcggtacttattcagcgtgcgctgctggtagccgtgcaagctggttcaaaacgcgtagtcaatcttcttctcgaccacggcgcgcagaccatgttccggggtccgatgggctacatcaacaacatcccaccgctttatctcgccgtgcagaacagtcacgaggaccttgtggactttctatgtgagaggggagatccatgctacagagagaatacgtgtccgctcctttgggcaatcgagcataatcagcgccggatcattcgcaccctcctgcgccacgaatcgtgcgatcattgctggtatgtgctgcctatggccatgaatcgcggagatacggacgtgttgcacttcctgctggaaaatggtctccatggaacaaattacgcgcgtgatgcgctgtttgctgcaattttcaaaggggacctagaaatggttagatttttcatcgcccacggcgcggatccgaaccggctgggcgactgctacgacaagaggtgggagacaagtcacgtccagcttcgtcagaagattgatagtcggtcccttctggagcttggcggtatagaggatgacttttcgacgtggtgcaacggcgtgtgtgttgacgaggagccgatgttctgtaccaccacttacgttgcgatttattacgaccagatgccgatactgaggtttctgctcgagtacggggtacatcctgagccggaggacattcaactggcgcggaagaaggggaatgaagaggccgtcggtttgctttctcgatcttctaatgaagatgtaccacggaagaaatcttgtttccaagagtga

SEQ ID NO: 7201 - DNA, 549 bp, A.fumigatus
attatcttgaacaattctaatctattcttacttcctaaaggcaacggtatcttcatggagagttggttcaacgaaagcgaggccttaccatcgaatacaacaatagctactcaagctaatggctggatatctgatgaactagcccttcaatggcttcaaagctttattaaggcgacaaatgagcgtacaaagaggggagagaaacggatacttatctttgatggccatggctcccatcttaccattgatttcttgcaaacatgcgaagataatggtatcattccctttggattccttcctcatacaacgcacctttgccagccattagatgggaagccattcctaagctataaacagcactttcgacgtatcaataatgagcatgctttctgggctggtgagccagtagggaagtcagaattcttacgggtgattggcccagtacgggagaaggcttttaaccagcggattatccgtgaggcattcaaagattatagaatctggccagttaatagtaagatagctaatgatcttgctatcttactatag

SEQ ID NO: 7202 - DNA, 375 bp, A.fumigatus
gggtaccaaggacgctcgtatgcccaggtatgcacactccgcctctgtcaacggttgaggaggatattcgatcggttgccacactccgtgcagtcatatgggggaaagagaatgaagcaaagagcctttattgatggacgtctgcgtatgacagccagctcctatggatgcgccgcatgcgtgttctccgtcgcctcctcgtcctgctaccgtgccgccggcaagatcgacaagcacgtttaccacgagctctaccacctgagcaagggtaacaccttcaagcacaagcgcgctctgattgagcacgtaagtcttcctctcgattcatatccttttttcatcgggatgcaaagatggcgactacgaggcgaatag

SEQ ID NO: 7203 - DNA, 804 bp, A.fumigatus
acgcatatctcagtctcaagtctgtggggccccatagaacatggccacccgtcttcacggcgtcactgcttccatatgataccatcgttgagattaatgctacgtataatctctggggtggaatatctgcacgccaaaagcataattcatcgtgatctgaagccggcaaatatcttcctctcaccatccgagaatggcgaactcgatgggtgcccttcctgcatggcgaattacgggtccacacctgattactgtcatcccagaataggagactttggtcttgtcgcagatgtatcacatctgaatgactgtcctaccccctctttcgaggagaatccaaagctcgagcgtgtcgttggcacggagttttaccgcccacccttgaccactaatggagagaattactctaatggcatgttccaaaccggaaatcatcaattcagttacatcatcgacgagacccttgatgtttacgctcttggagttatactttttgagcttctttatcgtctgaacactaagatggaacgacaaatggttctgactgacttaacaaagggcacgaatcgacagtcaccgaccagaatttgcattagaaacactgtattcccagcagactttgcacagaaactcgacatggggtcgatcatactagaggatagtgtgtctgtagctgactcgttgatgaggtgtatcagcggcatgctagagcccaaccctcatcgacgcttgcgctgtgcagatgtcaagagagctctggaaaatattctggacgctactgccacacaggatcgttcctgttga

SEQ ID NO: 7204 - DNA, 363 bp, A.fumigatus
gtacgcccccccagaaaaagaaatccaggtactgatattgtcaaagattttaaccccgagcgtcttactcttgcatgtgccgctttgcggttggctcgtgtctgcgcagaggatgccttccactacgcagtgcagcgagagaccttcggcgcgcctctcatccaaagacaggcaatacaatccaaaatcttccggttcggcctcatgatcgagcctgcgtatgcacttatggagcagctcgtcaacatcatcgagctcacaaaagatcgacctgctgacgacgtgaagattggtggcatgacggccttgctgaaggtaatgtctactagagctcttgagaagagtgttcgtgaagcgcagcag

SEQ ID NO: 7205 - DNA, 603 bp, A.fumigatus
ctctcaattcactttgagggtcatcatctatacctctttctctcttctccccaaaagctcttatcccaattgtcagaaaagatgactcgtaaagatccccccccgacagctccctacagcgaaccccttcttccccaactagacatcaaaaacccctactacacagacctccaccacgaactccgcgcctacgtccgcaattacgtagaaacatccatcgtcccctacgctcaagactgggaaacagcgggtcaagtccccgaggaagtccgacggcgccattgcgacctggggttcggaattgtccatcctctaacctctgaggaagacgcggcaggaatctcattacccggtaacgtgccccgtgagaaatgggatacgtggtgtaacctcattgttacggacgagcttacccgggtcggatatgtgggtgttatatggggcctggggggtggaaatagtatcgggtgtccgcctatcgccaggttcggaaccccggagcagaggcgaagatggttacctaaggttgcgaggggggatatcaggttttgcttggggattacagagcctgatggtacaatttatgatttttacatcatttaa

SEQ ID NO: 7206 - DNA, 579 bp, A.fumigatus
cctctgaggaagacgcggcaggaatctcattacccggtaacgtgccccgtgagaaatgggatacgtggtgtaacctcattgttacggacgagcttacccgggtcggatatgtgggtgttatatggggcctggggggtggaaatagtatcgggtgtccgcctatcgccaggttcggaaccccggagcagaggcgaagatggttacctaaggttgcgaggggggatatcaggttttgcttggggattacagagcctgatggtacaatttatgatttttacatcatttaaagggggcgatagtctcgctgacgggatactagctggttcagatgttgcgaatatccagacgactgcaagattagatggtgatcattacgttgtcaatggggcgaagaaatggatcacgaatggtatctgggctgattattgcactgctgctgtgaggacggggggaccgggaaggaacggcatcagtctgcttgtgattcctttgactgcgcctggggtgactcgccggcggatgcacaattcaggcgtcaatgccagtggtatgacctgcctgcaaaagaaattcccatga

SEQ ID NO: 7207 - DNA, 939 bp, A.fumigatus
cagccaagaagccagagcgaagagctaatccgtcatcctttgattcaggtgcagtcagtaagactgctgggtcatgagatggccagttgcaagtcaagcttcgtttccatcttgaacaatgatgaccacccatcatttgcagttcgatcaagtcatggggtctcgagacagccatccacttcttcatcatattcgcttcagtcagagcaacagccacggaccttgttacccgactacagttatggagctccctacacagagtctactgcacgatctcctggcagagtaaaacgacaaccgtttgatccagtttcggaagcgatgcagcccgcgtcacctggttcctccgattgctcctcctacgattacatcactcaaaacagcgcaatcagttactatccctctggccgacaagactcttacgcttatccccctcccacgattgcacccgccgagaagcgattgagcggccactcggcgtctgaccccccatccccgccgcgatccattggcggatctaaagatggagccggtgccaaagggaccaaaaagaacaaatacccttgcccgttcgcagccagccatggatgttcagcgactttcaccacatccggccacgccgcacgccacggcaaaaaacacacgggagagaagagtgtgcattgccccatatgcaacaaggcctttactcgaaaggacaatatgaaacaacatatccgaactcaccgcacgcattcagaagacatgccctcgggaacaggcgaccgcgatggcgaggctgccagcagccggtgggcaccagggcgaaccagcccacctgataaccattcgcggtcgacgagtcagtcgcagacggatggaaatgtctatcaccgcagcacgagtaccatgaatatgacaacgtctagcggaagtcaacgtcggcattcaccttactga

SEQ ID NO: 7208 - DNA, 1287 bp, A.fumigatus
  unsure (120),(167): Identity of nucleotide sequences at the above locations are unknown.
gtcgtacggtctctcttccactctttctcttcttacattgtttccattttttttttttttcttttcttttttttccttttcttcttttttctcgcattttgtttcttttcggcgcaacanggggcgtgggtggacagatgtccagatcgcgctcgaccgcctcgctngatccatgcgtcgatgaatatgggccgtatcggctcggcgtcggcctgggccaatgcgaacgttccgccgccggagatcaaaagcggcagcaagggcaacaagaagaaaaagaagaacgacgacgaggtgaagctgcggtaccacatcgcggacatcatcgtccgtcaacgctacatcatgcaactgtgccgggcgtttatgcgatacggtgccccgactcaccgactggaagagtacatgcagatgacggctcgcgtgctggacatcgaggcgcagttcatgtaccttcccggctgcatgatcatgtcctttgacgacccgtacactcgcactgccgaggtcaagctggtgcgtgtgccacaggggctggacctgggccgtttggaaaaagtgcacgggtgctacaagcgcgtgacgcacgacatgacggacatgcagacggccatcggcgagctgacggagatcatggaccgcaagccgcggtatccgcgctggctggtgatcttgctttacggcgttgggctcggccgcggtgggtccgtttggtttctcagcgcgcccgatcgatatgcccatcatttttgtgctgggatgctgtgtcgggttcatgcagctggttctcgcgccactttcggccctgtactcgaacgtcttcgaggtcacggcggccatcctggtctccttcctggcccgcgcctttggcagcatccgataccccggcacctcggacccggtcttctgctacgccaccatcactcagtcctcgatcgccctgatcctgcccggtttctccgtgctgacgagcagcctggagctccagtcgcatcagatgatcgccggatcgatccgtctcgtgtacaccatcctctactccctcttcctgggttacggcgtcacagtcggcaccaccatctacggcgccatcgaccccgacgcaaccagcgacaccacctgcgcccggcagagcgtctggcgcagcccgtacgcctctcacttccccttcgtcgcggcatactgcgtcatcgcggcactgatcaaccaggccaaattccgacagatccccatgatggtcctgatcgggacctcgggttacgtcaccaactatttcagcacccataa

SEQ ID NO: 7209 - DNA, 348 bp, A.fumigatus
  unsure (321),(338): Identity of nucleotide sequences at the above locations are unknown.
aaggaaatggacaacctcaccctctacatcctcaccttcaattgcgctcgcaaccccgtcgatatcgacctcttcgcgtcgcacttcttccacgcccttccccacaccgtcccctccgcaccgcacctcattgccctcagtctccaggaactcgcgcctatcgcctacgccttccttggcggctcttatttgacaccgtactttacctccttccggcaggtggtcgcccgcgccgccgcaagtcgctgggaggatgtgcagtacgccactgttgtggaggaccatgtcgggatgacggggttgatggtattcgcgcgtgtnttcaagcaggcggcggnagatccaacc

SEQ ID NO: 7210 - DNA, 972 bp, A.fumigatus
tcttgctttacggcgttgggctcggccgcggtgggtccgtttggtttctcagcgcgcccgatcgatatgcccatcatttttgtgctgggatgctgtgtcgggttcatgcagctggttctcgcgccactttcggccctgtactcgaacgtcttcgaggtcacggcggccatcctggtctccttcctggcccgcgcctttggcagcatccgataccccggcacctcggacccggtcttctgctacgccaccatcactcagtcctcgatcgccctgatcctgcccggtttctccgtgctgacgagcagcctggagctccagtcgcatcagatgatcgccggatcgatccgtctcgtgtacaccatcctctactccctcttcctgggttacggcgtcacagtcggcaccaccatctacggcgccatcgaccccgacgcaaccagcgacaccacctgcgcccggcagagcgtctggcgcagcccgtacgcctctcacttccccttcgtcgcggcatactgcgtcatcgcggcactgatcaaccaggccaaattccgacagatccccatgatggtcctgatcgggacctcgggttacgtcaccaactatttcagcacccataagctgggctcctcgtcgcaggtcgccaataccgtcggcgcgttcaccatcggcctgctggcgaacctgtacagtcgcctctggcacggcaacgcggtgagctccaccatccccggtatcttcaccatggtgccgtcgggtctggcctcgtccggctcgatcctgtcggcgattgagtactcggatgcggtccggaatggaacggcggatacgtcgggtggtacgtcgggaacatccttgaccagtctgggctatggtatgatccagacggcgattggcattactgttgggttgttcattgcggcgttgatagtttatccttctggcaagcggaggactgggttgttttcgttgtag

SEQ ID NO: 7211 - DNA, 462 bp, A.fumigatus
cgacccgtacactcgcactgccgaggtcaagctggtgcgtgtgccacaggggctggacctgggccgtttggaaaaagtgcacgggtgctacaagcgcgtgacgcacgacatgacggacatgcagacggccatcggcgagctgacggagatcatggaccgcaagccgcggtatccgcgctggctggtgatcttgctttacggcgttgggctcggccgcggtgggtccgtttggtttctcagcgcgcccgatcgatatgcccatcatttttgtgctgggatgctgtgtcgggttcatgcagctggttctcgcgccactttcggccctgtactcgaacgtcttcgaggtcacggcggccatcctggtctccttcctggcccgcgcctttggcagcatccgataccccggcacctcggacccggtcttctgctacgccaccatcactcagtcctcgatcgccctga

SEQ ID NO: 7212 - DNA, 738 bp, A.fumigatus
ctcccatatccaagcctaacgcaaatatgtggtggcatatccatccagtcgtccttcctcgtcgccttcaagcaactcgttcccgagcatacggttaccatcttcaaaggcctggtcaagatgcgcgtgaaacatttccccgccctgtttttgttgctcaataccattagcggtttggttttcggaacgcaagtcgcagcgctcctcgcgtggctggggctgttggccagctggtcctacctgcgattctacaagcggcaaccagacctcacgggcacatcgacagacggacaaggaatcaagggtgatgcgagcgagactttcgcattcgcttgcctcttcccggacgttatgcagccgccaattgcatttgtttctgatcagatttatacgctcctcgtggcgctcaaaatttgcacgccattctcggaagaagatattgcatctgggaaccagcaagtcctcgcaagaggtgaggccggtctacccagcctgctcagtaaccaacgaggcggaggaatacgtggtataggcaaacgtgaagaggctgaacgaaggcgggcgctggcactcaaagcgctggaccagagactccaagccgccgccgcaggaagagttcaatcccagtcgtctacattgagtcagcccggatccagccatgctcaccacgcgacaccgacggtctcgacaggacagaatatgctgggggaaacgagctacacgcctgatcatgcgtaa

SEQ ID NO: 7213 - DNA, 492 bp, A.fumigatus
gcagccgtgagtgctctcctcgtcaagatgccgtaccgaatcaacattccccctgcgactcgtacttgtctcgtcagcctcgtcacactctccctgctgtacaacatcgcccgatggcgacaaattgacacgagggggaagacacccacaacgacacctattgttccctacttgaccgttgtcccatcgcaattcttcttttacccctggaccctacttacggcgacatttgtggagcagaatatcttcacagtactcctcaacgctgctactctgttctatggtgggaaatacctggagcgcgcttggggttccagagagttcgcgaaatttatcgtcattatcgcagtcattcccaacctggtggtagccctggtacacttactatgcgccgccataggggcgagctcagtgagcgggtacgagatctccccccagcacagttgcataagctcttgcgctctatctgctgactcccatatccaagcctaa

SEQ ID NO: 7214 - DNA, 240 bp, A.fumigatus
aacattgatacctcgtattggggacagatgacttctttcttaatctcatccgtctacactgtcacaaacgctggcttcagcaattaccgcctatgtagtggaatttcacgggaaggacaaaaacgctttcttcgaaagctgccggcgctccccgactatgttcttgttatgttggcactttgtgtgatgaaaactgctatgatgtataagggtgtgaagttgaattgccaccccaagtaa

SEQ ID NO: 7215 - DNA, 612 bp, A.fumigatus
  unsure (60),(81),(118),(157): Identity of nucleotide sequences at the above locations are unknown.
atgtgcgttccgggattgcccctgccttattatgcaaggacaagcaatggggccaatggngcttcttcttcgcttcccccngagttcaaagacttgcagttgagttttttcaagccanattttttctcgccttttgtttgttcccctgctgcggagntgattaaacagtaccgcagaaccggcgagcagggtacctttcgtctgatcctgtcagaggatgcacccgtcgggatcatcgaccctgacgaggctggtgtcattgcagctcatcttttgtcccaagatgatccttccgtgcacaacagggccaaatacattctgaacgggccccaggacataactggaaagcagattgttgacatggttaagcaacacatcggtgtacctgtcaaagacgtcagttaccgagacgtctctttcatcgaccagctgtatgagtaccaatatgcggcagccaagccatcgaagaacgtcatctactcgatcaagcgggcccccgagacagcttgggaagggaaatgctcgacttctacaaccagcaacgtgattctggagcttgctgctccgaaacggacacctgctgataccttaaaaaccttactagaggagtaa

SEQ ID NO: 7216 - DNA, 642 bp, A.fumigatus
  unsure (23),(64),(92): Identity of nucleotide sequences at the above locations are unknown.
gtggccatggggataacggttantttgaaggaaggaggcccttttttccccacccaaggcaatnattgcgtgtttttcccgggcgccgcttncggggccatcttcgcattgttagcaatgtacctcatgaggcgacggaagaataacctacccccttctgtgaagatcgcacagcacactcagagaacatcaagcggaacactcattggcatctccgaccccattccctccgaagagaacgcctaccgaaccgacttccttctacgaagatctctgaaacgtaactcggaaggcgcacgctcaatgctccaacgcacagggacccgcgtcaagagcctgttcggctccacacccaaaccgagccagatggtgtcaaagcagcccccgttgccgctgacccctccgcagcaggctcgcatgcccagtacggagagcatcaaggtctatacgccgccagggacgttcgcctcgacaggtgttctcaggccagagccgtacccgactatcgtcgtgggaaatggttccaccttcactgagatgattgatcaggcaggatctaacaatagcaagggtgatccgagctacagcgtcgatgaggcccctaggtcacggagcaaaagtcctctccgtcgcctttgttga

SEQ ID NO: 7217 - DNA, 696 bp, A.fumigatus
tgtcgccagcttatccacactaaaatgagtctcaggcttgtatcttcggttcgagacgacctgtttgcagcagtagcctcagacactcaagccgcacaagataactgttttgccttctcgccagaccaactaaaccagctcttcaaccccaaatccccccccgcactctatgctctcggtggactctacggccttgagtatggcctgcgcaccgatctcagcgctggtctgtcggccaacgagaggatccttcctggtgccgtcacacttgaagaggcgagacaggcagcgctatgccagacggaaagcaaacggccgctcctggcgaacgcagccaggccccatcccaaccaggaaccctcagtgccattctccgatcgaacccgcgtgttcgggcggaacgtgctgcccgacgcgaagaggaaaggctttggaaggctcctctgggacgcgtataacgataagattatcatccttctgaccatcgcggcagtcgtctcgctggcgctggggatatatgaagctgttagcgggcagtcgcaggtggattggatcgagggcgtcgcggtctgcgtcgcgattgtgatcgttgttgctgccactgccgggaacgactggcagaaggagcggcagtttgcgagactgaatcagctggtgggtttcgagcttctgcccggagcggggaaacaaacctaa

SEQ ID NO: 7218 - DNA, 501 bp, A.fumigatus
cactccattgtcttttgtatctatacaattaccacaaaggcttcaatcatgcccctcgcgccccaggaaaccaccctcgtcgacaccgccacatcaattataacccgcatccccgtctccgacacccacagcgtcgccagcgccgcgcgatctaccgacggacggatcttcaccggcgtcaacgtctaccactttaccggcggaccctgcgccgagctcgtcgtcctggggtctgcggctgccgctggcgccacgcatctaacgcatattgttgccgtcgggaatgagaaacgaggcgtcatcagcccgtgcggacgctgtcggcaaacgttgattgatttgcatcctgggattcacgtgattgtgcctgaacaaggggaacccatgcctgtgcgcgtggaagatttgctggcatttgcgttatctcgtgggattaactgtcgaaaatcgcgggttgaaaccgtccaagcatccaaggtcgttggtgaaaaccgtccaact

SEQ ID NO: 7219 - DNA, 216 bp, A.fumigatus
ggtcagccggacccaactactagactcttcctaggcaagactaacaggactaacaggactagcaggggggctaaagcagccaagagtcagttcttcattaacgaggtatcacaagcagaggagagtcaaggcccactacagagtattattcttatgactgtctttcctccagtcagtatcaaaatatacctgttttgtgaagagttcttgctatag

SEQ ID NO: 7220 - DNA, 792 bp, A.fumigatus
tacaacaaatggatgttctcagaagaccgcgttgtgtttccttttcctctctttacgacgagcttgcatatgctcgtgcagttcagtctcgcgtccgtcattctttggttgattccagccctgcgcccgcgacaccgttcatccgcctcgtccggttcaccgttcagaaacagtcatgatgcctccgaatcgactcccattctcaccaaacgcttctacctcacccgactcgttccctgcggtgcagcgacgtccctcgacatcgggctgggcaatatgtccctcaagtttatttccctcaccttcctcactatgtgcaaatcctccgctcttgccttcgtccttctcttcgctttcatcttccgattggagacgccctccgtcaaattgatctttatcatagccaccatgaccgtcggcgtggtcatgatggtcgccggagaaacagccttcaatgctgtcggcttcgctctagtcatcgcctccgccttcttttcgggtttccgctggggactgactcagattctactcctgaggcatccggcaacatccaaccccttctccaccctcttcttcctcactcctgtcatgtttgtctcgctgattatcatctctctgactgttgaaggccctgtcaagatcgccgacggctttgctgctctgtcaggcactcatggcggcgtctttgccgtcttcctgctaatcttccccggtgtgctggccttttgcatgatctccgctgagttcgctctggtcttcaccacggggctgcaaggagccgctgctagccat

SEQ ID NO: 7221 - DNA, 273 bp, A.fumigatus
acagcagccatgacgtcccgcaaaacgcagcaagagatcgacaagaccttcaagaaggtcgcggaaggcatacagacatttgagggcatctatgaaaagatccgctccacatcgaatcctacccagcgagataagctggaggagaacctgaaacgagagatcaagaagttgcagcgattccgtgatcagattaagtcatgggcttccggtaatgaggtcaaagacaaaggaccgctgctcgagcagcgcagagcaatcgaaactgtgggctaa

SEQ ID NO: 7222 - DNA, 186 bp, A.fumigatus
cattcccggccttttctggcatcatctcccagcgcgtcgactttcgcattgtcgcccaacatccttctcctcctttccaactggaaccgcagcttccaactcgccgacacctttccatatctccctaaatctacgggaattccctttcttcccacggcgatctgtccatgtgaacagcagccatga

SEQ ID NO: 7223 - DNA, 483 bp, A.fumigatus
cagaggttgcagtgtatggagcagttcaaagccgtggaaaaggagatgaagaccaaagcgtactccaaggaaggcctttcggctgcgtcgcgactcgatcccaaagaaaaagaaaaactcgaagcgtgcgacttcctatcgacctgcgtggacgaacttcaactgaagatcgaggcgatggaggccgaagaagagaccctccacgtgcagatgaagaaaggcaagaaggatatcaccaagaacaatcgtttatcggacctctcgcggatactggagcgacataagtggcacgtcaacaaactcgagttgctgctacgagcccttcagaacggcgcggtcgaaaccagccaggtgatggatctgaaagagaatatcaagtactacttggatgatggaccccatgtcgattattggcgtgaagacaagacactctttgacgatctcaatctgggtgaaatatcccaaagcccaatttggaaatga

SEQ ID NO: 7224 - DNA, 198 bp, A.fumigatus
gtagcggtcatccagagagttaaatctgcgtcagtcacagtagacgagaaactcgtgtcgtcaatcggccgcggcttgcttgttcttgctggtgtaggcaaggaggataccgaaaaggacgcagacactctcattcagcgggtattgaaggccaaattatggcctgccgaagaaggcggccaagtgagtagtctgtaa

SEQ ID NO: 7225 - DNA, 381 bp, A.fumigatus
ctatggctttttattcagtggaaaaggaacgtgcaggacattgagggagaggtgctctgtggtgggtttggctgttctgagatcctcgaatgcgcccctttaacagttgacgcagtatcacaatttacgctctacggtcaattgaagaaaggcagcaaaccagattttcacgatgcagccgatgcggagacagcacggaaactatacgaatacttcttccgccggctgggcgaagcatacaaacccgaccgggtcaagaacggtgtcttccaggccatgatggatgtcgaactgaagaatgatgggccggtgggtgtagattaccgcagtgaggatgcggcggttagcttttgctcctcctcgtacctcgtctccgactga

SEQ ID NO: 7226 - DNA, 330 bp, A.fumigatus
  unsure (283): Identity of nucleotide sequences at the above locations are unknown.
ttaaccaacaatgagccagtggggtgcataatgcttgtcaaggacgtcgactcgcccgatacagccagactacgcttactccttgtggacccgagtgctcgaggaacgggagtcggaagatccttgattaagcagtgtattgaatttgccagagaggttggatataggcgggtagtcctctggacccagagtatcttagggtcggcaaggaggctttacaaggctgagggatttcggttggtcaaggaggaggagcatgaagggtttgggatggcgttggtangagagttatgggagctggagctagagaacaagtctcagggtgaatga

SEQ ID NO: 7227 - DNA, 213 bp, A.fumigatus
  unsure (172): Identity of nucleotide sequences at the above locations are unknown.
agtggcctatacgttaccacattgctcaattatcgtcatgataagtataacaattgcagttgcaatcaagtgaattactcccacgcaggaattgactgcagcagttacactattagccagtgcatcattcaccctgagacttgttctctagctccagctcccataactctcntaccaacgccatcccaaacccttcatgctcctcctccttga

SEQ ID NO: 7228 - DNA, 198 bp, A.fumigatus
actcagtacttgatctcttcctaccgaactgcaagcatggcctccaccggcgccctatccgatccccaggagtatcagaagatattccattgggcagaaactcaaaaggacggtaccattccttccttcagcacgagacggaacgatccctaccaggtaagctcttattctatttgttcgtttcttcgtgatagctga

SEQ ID NO: 7229 - DNA, 201 bp, A.fumigatus
tgtagggatatctacagatttgtctccgaggctgtccctggtaccattccacagggccagaacagtcctcgtaatgtgagattcggcttgtatgctgagcagatcaccgcgactgcttttgtcgccccacggcattgcaacaagaaggcatggctgtaccgtgctcgtccggcggttgcccaccaaggatttgtacgttga

SEQ ID NO: 7230 - DNA, 243 bp, A.fumigatus
gtcccgtacaagtatgacctgaccaagttcgtcaatgtcggctcaatctccgtggatcatatcgaaccatccattttctgtgtacttacagccaagtctcgcgacctcacggcgcctttggccgatttctcatcttctctccccgctgggatggaacggcttcgtagttgttttgtccacaaaggatatgccgtgagcctactaacgatttctagacaccttccggaccactttactatcacc

SEQ ID NO: 7231 - DNA, 810 bp, A.fumigatus
gattcggcttgtatgctgagcagatcaccgcgactgcttttgtcgccccacggcattgcaacaagaaggcatggctgtaccgtgctcgtccggcggttgcccaccaaggatttgtacgttgacgccattcggagcattggacgtgtgctgatgatgctacagaccgatcttcctgacaacaaagacacagagtcgaatttcctgccgataaatcctcgagtgcgagtctctccaactcagttagcatggcatccatttgagattccgactggggaggaggtagactttatctccggtctcaagactgtagcaggatcaggagacccaacccttcgtgagggcctcgctacacacgtctatacggccaataccagcatgaagaagaaagcctttgtgaattccgatggtgaattcctcatcattcctcagcagggtgccctggacatccaaaccgaatttggtcccttgtttgttcagcccggagaaatcgtagtcatccagcgaggtatccgcttccgcgttgagcttcctgatggcccttctcgtgggtatatcctcgaagtttggggatcttactttgagttgcccgagctgggaccgctcggagcaaatggtttggctaacgctcgagatttccttgctccccatgccaagtatgagatttcacaggagccctgggagattatttacaagcttggagggaaattcttcaagagcacacagaatcacagtccttttgatgttgttgcctggcatggtaactacgtatgtttaataccttacggtttccactatacaaggcgaagctaa

SEQ ID NO: 7232 - DNA, 687 bp, A.fumigatus
gctgaaaaggcctgttgctgtcggtgttgtcggttacatcgagacccccgtggtctccgctcgctcaccactgtctgggctgagcacctgagcgacgaagtcaagcgccgcttctacaagaactggtacaagagcaagaagaaggccttcaccaagtacgccaagaagcacgctgaggagaacggtgcctccatcacccgtgagcttgagcgcatcaagaagtactgcaccgtcgtccgtgtcctcgcccacacccagatccgcaagacccctctcaagcagaagatagcccacctgatggagattcaggtcaacggtggctccgttgccgacaaggttgactttgcccgcaacctgttcgagaagcccattgagatcgacagtatcttcgagaaggacgagatgatcgatgtcattgccgtcaccaagggtcacggtttccagggtgtcaccagccgttggggcaccaagaagctgccccgtaagactcacaagggtctgcgtaaggttgcttgtatcggtgcttggcaccctagtcacgtccagtggactgttgcccgtgccggtcagatgggttaccaccaccgtacctcttgcaaccacaaggtcttccgcattggcaagggctctgatgagggtaacgcctccactgattttgatatctccaagaagcagattactccgtaa

SEQ ID NO: 7233 - DNA, 279 bp, A.fumigatus
tcgctaatgaaatatccttacagcatgggtggtttcgtccgctatggtgaggtcaagaacgactatatcatggtcaagggctccgttcctggtgtcaagaagcgtgttatgactctgcgcaagaccctgtacccccagaccagccggagagccaccgagaaggttgagctcaagtggatcgatacctcctccaagttcggccatggtgctttccagactcccgaggagaagcgtgcattcatgggtaccctcaagaaggaccttgttacttctgcttaa

SEQ ID NO: 7234 - DNA, 912 bp, A.fumigatus
gaggcactggtcgttcgtgaagcatccatgcgtcggtggcagctgagccgcagggtatattgcgtcattaatcgcaacctggtttgggcttcgacttccactgcatcatcaagtcgggctgccctctctccccaatccttaattttaaagtctcagagtttttccatttcctttcaacgtcgcttatattccaacctgtgcatccgaacttctccgcagacacagacgcttctagtttcgacccaccaaacccactacaccatcccatcaccgaaccctcgccgtagtcccatcatctctcgagccatgtcagacgacgcttacatgtccttccttgataaggccaacgccgacctcaataacgcccgagcacaacaaccccagcaatcgtccggcgtgcgcacggaaaccgtcgacgttggtgttcagatccccgctccactcagatcagtggatgcatactacatttccgagacagacgagccctttgagccggtagctttgaaatgggagggcgcggataacggaacttggcccggccctggttcgtgtagcccgatgggagcatcatgttgcctgaaaagacaaaaagcatttgctaacgatgccttatccgctcagccgaattctcgagactcatctccccctaacgctgacatctcctcctccattgagacattgacgccttcgaccttcgatcccaagaaccagtactcggctgcgctgcgcgcggtgcgagccgcggtcgcgcagacttttggaggtggtgagcctggcatcgatgaatcggatgtagagactaaggtgtaccgggtggaagttggtaaatcacgcgtcgagtattatattttgggactagatgctgtgggaggaactattgtgggattgagggcgaaggcaatcgagtcttag

SEQ ID NO: 7235 - DNA, 192 bp, A.fumigatus
tataccgagaaagaaagattacacagagctaagtgtcggctattcaaagtagaggaacatggcaaaatttatatgctgcagtataagcatgcatctaacatgaacgggacgatgagcaacgtaatcacgattgacaacctcgtgagtgacagcctgccagaacacacttcaagtacgctgactagtttttga

SEQ ID NO: 7236 - DNA, 216 bp, A.fumigatus
tcgcaacctggtttgggcttcgacttccactgcatcatcaagtcgggctgccctctctccccaatccttaattttaaagtctcagagtttttccatttcctttcaacgtcgcttatattccaacctgtgcatccgaacttctccgcagacacagacgcttctagtttcgacccaccaaacccactacaccatcccatcaccgaaccctcgccgtag

SEQ ID NO: 7237 - DNA, 1884 bp, A.fumigatus
attcaaggtctccccttggtaaaaacaaaaaaccacagcctgtttctcttaccagcttgtgaatcttctaactgcaatcccactggatctctgctacctaagagacactttgatagcaaagataatataaatatgtcggcaatccaattcccccccgtcccttcgccagtttcagcaaccgagaagtattttgacctgggagcccacggtttccccattactactaaaaaccgagacgctcaggtatggtttgaccgcggcttgatctggtcatatgcatttaaccatgaagagagttaccggtgctttcagcaggtccttgcccatgatcctacttgtgcaatggcatactgggggctgatctatgcaatgggacccaattataataaaacctggcagttgttcgatcctacagacctcgagcataccttcaaattttgtcaccatgcagctcaaatagccgagaagctcgcacacgacaatcagaatattaaacctgtggagcgagccttgatcaaagcaattcaacaccgcttcccagtcgatcatccagtctcggacttctcaacccttgatagacactacgccgttgctatggaagaggtttttcgggaatacggaaacaaggacatggacatcacaactctgtatatcgacgcaatcatgcataccgctatacgaatgatgtacgaggtcaatagcggtgctcctgtcgaagggtctcctgttcataaactccgcgcaatctttgacgaggccctggcgaaacctgcttcagattcccaccccggtctccttcatttctggatccatttcatggaaatgtcctctacgccaggtgttgcactccccggggctgataaacttcgccgcctggtcccggatgccggacataatcaccatatgccgacgcatattgatgttcttgttggcgactaccggcgctcaattgattccaacactgcagcggttactgcagatgagaagtacctggccaaggaaggaggaaagaacttctatagtttctatcgacttcataactatcattccctgatatacgctgcaatgctatctgggcagcgtaggattgctcttgatgctactactcggatggaagcatctattactgatgagctgttgcgcgttgaagccccacccttggcagactggatggaattcttcaaggccgtccgagtccacgtctacatcagattcggcatgtggaaagagactatagatctccctttaccagaaaaccaagctttgtactgtgtgaccaccaccatgattcactacggtaaggccatcgccttcgccgcaacagggaacctcgtccaagcggaaaagggacgcggcgtataccacgcagccgcaagaacagtaccccctactcgcaaggactttccaaacctaatctccgatatcttgaagatctcagatgcaatgctcgacggcgaaatagaataccgacgtggtaactatctggtagcttttgagaacctccggaaagccgttcatttcgatgactctctccgatacactgagccctggggctggatggtacctaccagacatgcatatgcggccttaatgctggagcaaggacatgtggaggaggctgctcaagcttacgctgaggatcttggtcttgatagctcgcttactcgcgctcatcagcatcctaataatgtttgggcgttgcatgggtatcatgaatgccttgtacgcctgggtcgagagtcggaggcccgcattatcaagcaggatcttgaccttgcgctgcaggtggctgatgtacctataaaatgttcctgtttttgtcgccttggggctcttgagtccgacgagaacggcgggagctgctgccaaggcgcataccaatag

SEQ ID NO: 7238 - DNA, 231 bp, A.fumigatus
gagtcgatcggatctgagatcgtcacaaagttactattaccattattgccccgagtcccctctataattgtgttcggccttatcgtttgcgtcatatacgtacatccttctaccttgaatattccgtttattttcgaatatttcgtccgatttacaatctactctactctcctccttctccccttctctaagcatctatatttccccaaaactactgcctcagcccactga

SEQ ID NO: 7239 - DNA, 1674 bp, A.fumigatus
ggtccgcgaaggaccgtgtgtcccctaccagaacgagacacaatcaattcccgtcttccgcggcgcacccttggccatcggagctgccatgtatgtggatcgagatcccgtacagaaactaccaccaccatccatctcaccccgctgacatctcataacagcattcactctgtcggatttgttcaaagcttcttctggcgcaatgcagggtttgaagtaattcgcaaaatcccacagctgcgcgactatgctcctcgctacaatccaactgtgattcctgtcgcggactcgaagcgtgcagccacagaggagcttccaccatcgccaaaaagccgaaaaggttctgcaaactaccacacttctgcggactaccatgcgctgtataagtccgggaaattgactccgactgctgtcgtggaggcactgttacccctgatccggcgtgatgttcgaccgcccgggaagcactcggtcgcctttgtggagtcgcaggtagagcggattcgcgcggcggcggaagcttcgactcagagatacaagcaagggcagcccctggggcctcttgacggggtgccggttgcggtcaaagacgaggtgcacgtcgaagggtaccgacgaaacctcggaagcaacctggacttcaagggagggtttgagggcacctcttggtgcgtgcagaagtgggaagaagctggtgctatcattattgggaagactaccatgcatgaacttggtctgggtaagaatcgaacatctccattactcctgaagtccagaatctcacaagcacacccggaggcagacaccacaaacaacaacccgaactacgggacacccagaaaccctcacaaccaggactactactgcggtggctcctcaggagggtctggctatgcggtcggagcaggcctggtgcccatcgcgctcggcgcggacggcggaggctcaattcgcatcccctcttccttttgcgggatctggggcctgaaacccacccataatcgcgtcagcggcttcccgacagcttcgctagctccaaccgtcggcgtctacggaccgatggcagccagcatcgatgacctggctctggcctaccgcctcatggcagcccctgcgccggcaaccgaagaccccgtctccgccaccttcccagaccccatgtcgagcatctcatctacagctcaaagaccccggagcaagacaatcggtatcgtcccctcctggatcgaccgcgccgagccacccgtccgagccgtattcgacgccgccctcgacttctaccgcaagcaaggctacaccgtcgtcgacatcgccatcccctacctccccgagggccagcgcgcacacgtgctaacgattatgtcagaaatctcgtccggcctgacaccagcacagatcggcgccctcacggcccccaacaaggtcctcgtcagcatgggcatgtggcagatcaccgcacaggatctcatcgccgcccagcgcctccgcaacctcctcatgtcccacctcgcctacctcttccgccaacaccccggtctactcattctgaccccgacatctcccattcccggctggaggatcgaaagcgagacggatcttgcccgcggcgtgtccgacggcaaggcctctgtcgggcatatgtcttcacgccggggctggaaggaaccgcgaacg

SEQ ID NO: 7240 - DNA, 321 bp, A.fumigatus
ctccaaccgtcggcgtctacggaccgatggcagccagcatcgatgacctggctctggcctaccgcctcatggcagcccctgcgccggcaaccgaagaccccgtctccgccaccttcccagaccccatgtcgagcatctcatctacagctcaaagaccccggagcaagacaatcggtatcgtcccctcctggatcgaccgcgccgagccacccgtccgagccgtattcgacgccgccctcgacttctaccgcaagcaaggctacaccgtcgtcgacatcgccatcccctacctccccgagggccagcgcgcacacgtgctaa

SEQ ID NO: 7241 - DNA, 594 bp, A.fumigatus
cctggctctggcctaccgcctcatggcagcccctgcgccggcaaccgaagaccccgtctccgccaccttcccagaccccatgtcgagcatctcatctacagctcaaagaccccggagcaagacaatcggtatcgtcccctcctggatcgaccgcgccgagccacccgtccgagccgtattcgacgccgccctcgacttctaccgcaagcaaggctacaccgtcgtcgacatcgccatcccctacctccccgagggccagcgcgcacacgtgctaacgattatgtcagaaatctcgtccggcctgacaccagcacagatcggcgccctcacggcccccaacaaggtcctcgtcagcatgggcatgtggcagatcaccgcacaggatctcatcgccgcccagcgcctccgcaacctcctcatgtcccacctcgcctacctcttccgccaacaccccggtctactcattctgaccccgacatctcccattcccggctggaggatcgaaagcgagacggatcttgcccgcggcgtgtccgacggcaaggcctctgtcgggcatatgtcttcacgccggggctggaaggaaccgcgaac

SEQ ID NO: 7242 - DNA, 390 bp, A.fumigatus
tgtttgatggtctatagtccgatcggacccaagtcaaaactgtccagcggccgtacggtgatgaatcttggctctctcaacttctataattttaatacaaacgagggtctcaaggaaaaggcaatccagacgctccgcaattatggggttggcccctgtggtccccgaggattttacggcacacaagacgtgcacatgaagaccgaagctgatgttgctgcctatctcggcacagcggcttgcatcatctactcccaggcattctctaccatatcgagcgtcatcccagcattttcaaaacgtggagatattatcgttgctgacaaggggtgtcaatttcgccattcggaaaggcatcaagatttcgcgcagcatggtccggtggtatga

SEQ ID NO: 7243 - DNA, 426 bp, A.fumigatus
ccccgcagcgcgtgtccttccagcccggtggtgaagatctttccattcaccatggatatccaggagacccaacgccttctttcggaatacctccatgagctcgcgaatctatttcaccgtctaccaggatctgcgattttcctgcggtacgtgaaatcgagctatcaaaatgatccgatccgatccgccgtcgaattattccttttcctattcgcagttcgctatctgctcgcaccaaagtactcaacgaaacccggagttgttaaactttccgaggatgagattgatgaccttgtggatgaatggacgccggagcctcttgtgggacaacccacagctctggaagaaatggaggtcgagaagcggacggtaatcgttgggtatttctattctcattccaattgttactgcgacgctgatgtttga

SEQ ID NO: 7244 - DNA, 390 bp, A.fumigatus
agaccgaagctgatgttgctgcctatctcggcacagcggcttgcatcatctactcccaggcattctctaccatatcgagcgtcatcccagcattttcaaaacgtggagatattatcgttgctgacaaggggtgtcaatttcgccattcggaaaggcatcaagatttcgcgcagcatggtccggtggtatgagcataacgatttggaagacttgaaaagagttcttgccaaggatcaccaaagagcaagcgagaaagccccctcacgagaagggttcatcatcacgaggggccttttcgaatcgtatggtgacatggtcgatcttcccaaaatcgtatgtaattcttccattccctccggctctgagaatgcataccatggcacggtctga

SEQ ID NO: 7245 - DNA, 555 bp, A.fumigatus
cacacaggcaagattgaactgaaactcaagtacaaattccgactcatcctcgacgaaacttggtcatttggcgtcttgggaaggaccggccgaggcgtcactgagcaccaaaacgtcgatgcggctgaagttgatatgattgtgggctcgctggccggcccactcgtcgctggaggcggtttctgtgctggttctgaggaaattgtccatcatcaacgtatctctgccgcggcatatacattttcagcggcattgcctgcccttctatcgacgacagccagtgccacgatcaacttgcttcagaatggccctgaactagtatcgcagctcagggagcacaccaaagctatgtgggcacaattggatcctcgcagtgattgggtgtattgtaccagcgctcctgagaatcccgtcatgatccttgttttgaaacccgaggtggtggccgcgaagagacttactgcggaagaccagcaatatttgctgcaggatgtggttgacgaggtatgcaatctcggatctgagcgcttccacgttgtcatgggagttcaatga

SEQ ID NO: 7246 - DNA, 183 bp, A.fumigatus
tgccttgcgaatggtgtccttattagccgtctcaagtctctggatgataactttgagccgaagcaaattgttcctccagcgctcaaggtgtgtatcaccatcggcttgacgaaaaaggaaatcgaaaaggccggaacgattattcgccatgctatcacgaaggttgtgagcaagagaaagtag

SEQ ID NO: 7247 - DNA, 210 bp, A.fumigatus
cagagcggccattcagccttctgcgacaccatcttcaagttcttgcatcccatcaggcacaccttccgtgactccgtccacaactccatgcccgtcgagaggccccaagcccacaggagcttttccttggcgctcttccacgttcagccatcatccgagcgcgagctgcataccgagtggaaggccaccgcatggagggcctcacagtga

SEQ ID NO: 7248 - DNA, 198 bp, A.fumigatus
gaacagctcacacttcgggctaatgcgttacgagaggaacttcataccaatgtggaaagcatgctgaacgacgtgattcgattcaaggtgcatattcaaaaaggtctagaagactacgaaagcttcgtcgtcgatgaggtggagcaggagcttggaggcgacttgcctgcgacaaaggatgtcaccagtcagacttga

SEQ ID NO: 7249 - DNA, 552 bp, A.fumigatus
tattcttccggtgatctctcggaagctcgtggagggcgctgccagaatcctgaattgtatgctgggttttcgagcatctctgcctcccgctgtcttctccgttcccgtcgttctgcagctttagcttcggcgcgagcttctgcttccctggccgcttgttcctccttggcacgctgtgcttcgcgagccgctcgtcgggctcttctttcctctcgacgtctagcttctcgctcttcctcttctcgcatttggctctcgtacagctcacgctctctccgcctggcacgtctttcttcggctgccttagcctcatccccccgaaatcgatctgaaggcgcatggcgtgatgtgcggtgtgatcggtgtgccgttctcctagcctcagcttcgtccgcttcggcgtctaggatgcctctgacagggccgccatcagtaacgaaaccttcatcatctatatcaggtttcatggagcggcgtctcctttcttgcctcaatcgtcgagcctcgtctcgctctggctccgtcatgtacctgacatcttcatcacggtaa

SEQ ID NO: 7250 - DNA, 1356 bp, A.fumigatus
tgtaccgtccaaaattctaaaatactctcgtcacaccagtcgcggcccagagcgtatgaagatgacgcggttatcgtcgagccagatcaacactaccaagggccagatgtaatgtcgggtccggatgatctggcatttgtggaagcaccgagggaacgacgcgtaaagcgttctaataccttgccgaagaaacaagacactggcggtctcatgggtctcattggctcactgcgaaggaacacgcgccctgaaatgccagaccgtcggaaatctcggtcttaccgtgatgaagatgtcaggtacatgacggagccagagcgagacgaggctcgacgattgaggcaagaaaggagacgccgctccatgaaacctgatatagatgatgaaggtttcgttactgatggcggccctgtcagaggcatcctagacgccgaagcggacgaagctgaggctaggagaacggcacaccgatcacaccgcacatcacgccatgcgccttcagatcgatttcggggggatgaggctaaggcagccgaagaaagacgtgccaggcggagagagcgtgagctgtacgagagccaaatgcgagaagaggaagagcgagaagctagacgtcgagaggaaagaagagcccgacgagcggctcgcgaagcacagcgtgccaaggaggaacaagcggccagggaagcagaagctcgcgccgaagctaaagctgcagaacgacgggaacggagaagacagcgggaggcagagatgctcgaaaacccagcatacaattcaggattctggcagcgccctccacgagcttccgagagatcaccggaagaatactaccttgatcaccgtcataacgtggaacaaagacatcgacggtctcatcgatcaatcgacgaacgtgagaaatcaagacgtcgaggatcgagaacccgggagccggtcagacctccccctatgatgtctggtgctcggagggataagactacgtcctgggtcgattcgcaggcggctgatcctcccgagccccctccaatcgtgcccacggtgctcgatgtaccacttcctccaggcgaccaaaacgcacactctatctcgtcggacgaggaggcgcgacgtgctttgcgccgccgggctcgccgccgggccagatacccgggccttaacgatgaagagatcgaagagcttcgcgcgcggagacgtgaagctcgacggtccgaccgtgcgaaaagcagctccggcagtggagattatgagcgggaccggggaatgaggtcgtacgacggccggtatcctgctgtgccgcccccgacctctggcgcaaagatgtccagttggttcaagaaactgaccaatctatga

SEQ ID NO: 7251 - DNA, 234 bp, A.fumigatus
gatgattggagagcctactccgtatggtctccatgcgagcatgttcttggtacgttagcctctgcgcgatacggctggactgaggctgatggtgtggtgttccaggtgactctccgcgaacaatgtaccccggaacagaagaagctcttccttgaacccgccgaaaagtatcagatcatcggttgctacgcgtcttcacacggggctggaaggatgcgcggtcagcgaatttca

SEQ ID NO: 7252 - DNA, 516 bp, A.fumigatus
ttcactcccccgtcatccactttccccgtggagaaaagaaaggcagttataagggtcattgtccattcgttcatccgctgcctcatttgcttaatctcctacttacctcccccagattattctgtacctcccatcttcgcaatgccttctcctcctcccgaatgggtcaaggcgctgacgcctgcgagcccgcagggcaccgacctgctcaagcaggagcgtgcccagtccaatgttgaagtcgacaagcttgcagagttcctacatacgaaagccttcctggagaagcagcagcgctttgttgagcttctctcgtccgagaaggtcttcgacaagtcccagatgcactcccagggtcgttctgagcggatccagcgggcattggccaagggtaagcgactgcagcagttgaaggagaaatacaactggtcgaccgaggatttccactttgccagtgagatgattggagagcctactccgtatggtctccatgcgagcatgttcttggtacgttag

SEQ ID NO: 7253 - DNA, 189 bp, A.fumigatus
gatagagggagactctcctgtctcgcgactattgacagcaccctgttctctaccatgtatcgaggatgctccgtggttcacctaggcccagtctccacggcccattatgttcaggaattatgctgggcctctcatattgtggactcttccaattcctcagggaacttgctctcggtccttcgattgtag

SEQ ID NO: 7254 - DNA, 192 bp, A.fumigatus
atgcatttagccccgatccgacagacaattcctcacggactgattctgcccttgatttctccaccaatcaccagaaagcatcaagttatcaacctccgctatataacaatcccccgctataccatacctaagatatctaccatcaccggcagctcgatgaacgattattcagagcagccactagtagtgtag

SEQ ID NO: 7255 - DNA, 483 bp, A.fumigatus
cctttgaacatcgcgagactaaaactgagagaccagctcttctgggacgacgacggaacggtgtacctatcatcgacataccgcaagctcgtccgcacccccggcgccacccttaaggacttcgcaatccacatcgcaaccgttgacctcgagacgggcaactccacctatgagcccaggctgatccgcgaatcggcctccggtgtggcggagggctcgcatatcttcaagcggggcaagtactactatctcttcacggccgaggggggcaccgagagcgggcactgcgagtgggtttgtcggagcgaggtcagcccgtttggaccgtgggaggttgggccgtgtaatcccctctggaggaatggggtggacgacgaggtgcagaacaccgggcatgcggatctggtcgaggatgcggaggggaactggtgggcagtgtttctgattcttgcaccacggggggctggaagagatcccgcgcta

SEQ ID NO: 7256 - DNA, 435 bp, A.fumigatus
tgtagaatgtacaacaatcccatcatccccgggttcaacccggatccctccatcatccgcgtcaatcatgactacttcctcgtcacctcatccttcgagtacttccccggtgccccaatctaccatagcacggatctgatccgctggtccttgatcggacatgccttgacaagacccagccagctgcagatccacactcccgagccaggaggcggcatctgggccacaaccctgcgctaccacaaggggaccttttacatcatcgccgccagtttcgagcggtaccgtccgcaagaggacgaccgtgtctggccgcggggcttctacgtcaagacagagaacatctgggactcggacccatggtctgatcccgtgtatttcgatcaggtcgggttcgaccaggatgtaagcccagccctggaatctagcctttga

SEQ ID NO: 7257 - DNA, 258 bp, A.fumigatus
ataggaatcattttttggttgtttgcccagctatcgtaccaacaagcatcaggcgtcctctccatcatcacagtcagctctgatgtccatagtcattatgtctcagaaagttacactacactacataacatatgccatatttgcggctcccataaaacaattatgcgttctgcactcctaaccctgttatattacctttatccccggtgcagaaatggaacaaattctaaccatccaataatttcaatcctcctttga

SEQ ID NO: 7258 - DNA, 234 bp, A.fumigatus
gccattcctaatcctgaagcatttgatcaagtgatcagctattccaaaatcaaaatcgggttgtttagtgacctagtcttctgctcgcaggtttcacagcgttcagtcttgttgtatggcctagagttgttccatgagaaactgctctatctgacatgttttaaaggcgtgctagtgacaagtagcctctacctaggtctgcgtatttctttcacccattggaaccaattataa

SEQ ID NO: 7259 - DNA, 1530 bp, A.fumigatus
  unsure (30): Identity of nucleotide sequences at the above locations are unknown.
atgggttgtcagactttgctaccgtccgtngaaagacaaaagaaagggacctcgagtctggatcggacgagtgtctggttggcggcgcagcagacctatcttgctgcactccgcgaaactaaccctgtcaactccttggagagtgaagagtctgacgctctcgaagggtatcacgataattgtgagcagaacgcccctgggttatgtcgcaaaaagtctgtccgctctgccgagtctgtatctgaagcagccagaccaccttctgccctggcaagtaaagactcgatttattggcgaggcttccaatcggtgcttgggctttcgactcgtcgagacagcttcattcatcggaacacacgctttgacgctgtacagtcaattcgatcaggtttgctcagcatgcatatcaattgtgtgctgggacattatgagcttgtgcgccccgaacgacctccctacaagggtccattctcacaagctccccgcaattctgtacgtacgtcggcattggcagaaaaggcacaattctccatcctggagaaggagcaattggtcttatctcagcttcgaccgcccatgtgggccatggatgctctcaggtacttgaatggcggccacctggtcactagtcctgccaggagtcgactttccatggccactgcacaacaagcacctccccaaaagcctaaaggacaccgggtgagggttttggatctgggcggacacgcctcctgcgaatgggcatggcaacttgcccacgattatcccaacgtaaaagtctacaccgtgtttaccgagcaccaagcagtaaaccatggcatcaaaggcccacctaaccattgccagatttccgtggcacaactgtggaaattacccttcccggacaacaagttcgacctgatctcggctcggtcacttcctgccttgctgaagaacgagcgcccagtcggggagatgcacgacgagtacgacctttgcctacaggaatgccgccgctgcctcaagcctgggggttatctggagttcttcgtgatggacgccgagatttctcgcgcgggaccgtatgccactgctgcgtcggttgagtttgctttcaacctcaaaactagaggatatgacccgttaccaacaaagagattcctcgggcgcttgcgaagcgcaggcttcgtaggtgtgaagagggcatggacgtttctgcctatgggcaatgagcctgtacaagcacaacttcccagagagacgccagaccctcgagtaaagagctgggtcgacgaatatgaagctgtgcacggacccgtaggcagcacggccgacatcgccagcgtaacaggtctctttggaggctggatgtgggaacaatggctgctcaaattgcaagtggagatgggtcgtgagcgacaccggttgctcgaaggcatcggcagcgtttttgatgagggccgcaagaacggcgcaggctggacctgcctatctggatgggcgatgaagccaaaacgcaagatgccgccctcgcgtcttcggaccggctaa

SEQ ID NO: 7260 - DNA, 1698 bp, A.fumigatus
  unsure (1568),(1691),(1693): Identity of nucleotide sequences at the above locations are unknown.
taccagtcgctcctcgtaggtataatgaccgattcggcgattgctgcctcagcgttgagggactcggaaaacatttcgaatcgtctcgatcccaaaggaccagatcttctgacagtggctagcggtgtcaagctcggttcacccttcctctcccagtcggaaaacgaacgctcggcctctcattttagggacggcaaagctgatcctacggacgagcgacgaattgcagatgatgcccaatcaataaaggagaatgttaatcatgccaacgaaggaggtggaaaacctcgatcagagaaggccggtggattgaaggacgcgtggaatgatggccagggggagcaaccggttttgccaagtcttcgacggccaaatgaatcgcttgacagtcctcaacagtcgccggaccataagcagcatcagtccacaactcccggagcggcggtttcgccgcgtcgtcccagcgtccagttcacccatgagacctctgacatcgatgccgccccggaagtaactgggtcaagacccccgtctgtcctggatgatgagccagactccggactgaaggggaaacagtcgatctttaccaagctcaagtcccttgcttcgccctcatttacctctcattcccgttcagctagtggggcaaccattagtgatatgagacagaccaacaccgatctggcaacacccggttctgagcgaggggcatttcgttttcccgatactttggaagaagaagggagtgatatcgatgctgatgctgaggaaagcgccggggagcaagaggttcgtcagcgcaggaagaagaaaatttcacggcggcagccagagcctcagtcagcacctcagactgaaccaaacacaccgaaaaccaccaggaggccgtcattccacctcccggcttcgtttggtccatttgagaactaccgcgccaatctctttgcgcgcagagtgagcaccggagacttcgcccagcagcgggagggtgtatcggaggatgagggtcgagatcgcctgaatagagatgcttggagacggagaatagccaacgctcgtgcacttacgtatggcagtcgacaggcggatacccccggcaatcaggaggagagacgaccgagcaatttcaagcgttttactgggctgggggggccatctgagaacgcagaaggaaacgccccgcattggaggcgccatagagctgaacgcggctcgagtctgagcgctcagaagtggcggcagataaaagctgggttcaagtttatgcgtcgcaagcctgagagcacagtagaccatgcaaagtccgccgagctactagctgagttgacttcaggggtgccggccgccttgatattggctagcatgtttcaacgggatgaacacggcagcaaacggatcccaatccttctggagcagttgaaagttcgggtcactgatagcaagttcgagcctcattccggtgaccgtcatcttgtattcaggatcgagctggaatacggcagcgggatgacgcggatgaaatggatcatccatcgtaccctgcgagattttgcgaatctgcccctganatataagctacacttccggaacgcaaaagtactttcagctggcaaataccgaagggcggcccagaaccttccccgtttccctcgaaacgcctttccatatcttccaaggagtccgaggtcccnanagtga

SEQ ID NO: 7261 - DNA, 246 bp, A.fumigatus
  unsure (8): Identity of nucleotide sequences at the above locations are unknown.
cttatatntcaggggcagattcgcaaaatctcgcagggtacgatggatgatccatttcatccgcgtcatcccgctgccgtattccagctcgatcctgaatacaagatgacggtcaccggaatgaggctcgaacttgctatcagtgacccgaactttcaactgctccagaaggattgggatccgtttgctgccgtgttcatcccgttgaaacatgctagccaatatcaaggcggccggcacccctga

SEQ ID NO: 7262 - DNA, 231 bp, A.fumigatus
tatatgctagtctataactttctcctatctattagttttaaatatatatatactaattattctgtctttattaaacacagtattactatactactctatatagataatattcttatacttttaaattctaataattttattaataacttccttaagcagctaggaaaattatttaaatatactaataatagtaaggtttctgtctacctagggattaatatactatattaa

SEQ ID NO: 7263 - DNA, 189 bp, A.fumigatus
  unsure (94): Identity of nucleotide sequences at the above locations are unknown.
cttatactaggaacctatctagatattacttttactatatctaagcttgcttacttcactaggaatcctagccttaattactttattatagtanagtatatattctactatctagcagagatgcttttactcttattattttatccttttatatttagtaatcttaatagttttattaatactaattag

SEQ ID NO: 7264 - DNA, 1281 bp, A.fumigatus
agacctttggccctcccagccaacttcgcatccgctacggcttatttcatagagcgacctccggcaaattttggcgaggaacggcctactctctcgcaccttctcaccatctaccctcggacccaatctaaagactttccccggcgtcctcggtgttggagccctcggacggcggagattacccagcaggactgggacatgtttctgaaatatctctttcctccggatctgggccttgcagcatcgtcagctcacttgcctcggcagctgagagccgaaatacaaagggatcgaaaagatcgccctcaagagaccgatgagcaacgcaggctgcgcattgcagctgtgattgaggaatggaacgaatgcttttttgagcctcgtgcaactcgtatcgaattcatttatgtgacagaatcggagaatgcgcctgtctctccattatgtcctcgttgttaccctgccgcaactagggcaacacgggcaaaccggtcaacgcatgcacaagaagctggggaaagtccctcgtcagtccccgcgagcatgttgccaaccgtcgcagggcaaccgacagcaccaccagcaagcggtacatacgcacctggaatgttcccgtacccacctccgcagatgcctcctgctccctacccgccatatgttccccctgccttctttccccccggtatggttcctaatactcctccgcctcctcctgcccctcatgcatatacttaccctcctcaaccgccttcacaatatcagcagcctccctcgtggggctggaacaatactccgtatgggccacagtaccagtactcgagcacctccaaaggtggccctcttagctggttatcatcgctggcatcgcatgcgcagaagtacagtgagcgcattacggagcaagcgcaacattatggacggcaggtcgaagagcaagccatggctcatggacgctggatagaggagaaggccggacttcacagtcgaaagctcgaggacgtttttggcggcttctccagcccgccccgtgtggaatatcctacgaacaatccgcaagcgcaaggcttctacgcccatggctacggttacccgccagtcaatgtggtgtcaactcaacccgtggctccgccgatcactcagcctacccagcctgctcgtagaacatcagtcagctctgtttcatctgagtcatccttttcatcgattgattcaatatcgacgacgtctgaccttagctcaaccgatttggcgaccgttcgaaacgcagcttcaatcgcttaa

SEQ ID NO: 7265 - DNA, 276 bp, A.fumigatus
caacaccaacggctgcacctccgctggtcctcactgtatgtcctcttcccagtggtcactctgagaaccagaactgaccgacctccagtcaacccctatggcaagacccatggagctcctgaggactccgagcgccatgtcggtgaccttggtaacttcgagaccgatgctgagggtaacgccgtcggctccaagcaggacaagcttattaagctgattggtgccgagagcgttctgggcgtaagtttttttttttctgcagatggtaatgcatag

SEQ ID NO: 7266 - DNA, 225 bp, A.fumigatus
ctaactctcccatcagttgctgtcctccgtggtgactccaagatcaccggcactgtcaccttcgagcaggccgacgagaactctcccaccaccgtctcttggaacatcaagggcaacgaccccaacgccaagcgtggcttccatgtccaccagttcggtgacaacaccaacggctgcacctccgctggtcctcactgtatgtcctcttcccagtggtcactctga

SEQ ID NO: 7267 - DNA, 186 bp, A.fumigatus
cggaccttggtcgttcacgccggtaccgacgacctcggaaggggtggcaacgaggagtccaagaagactggtaacgctggtgctcgtcccgcctgtggtaagtgcatctcggtctatggacacaaaaggaggatgtacgttaacttgttgtctctttcgacaggtgtcattggtatcgccgcttaa

SEQ ID NO: 7268 - DNA, 1116 bp, A.fumigatus
aaccgaatacttgcatggcaaatggttcggcagattgcggagcattcgcactacgttcaaggaatggcctgggatcctctgaacgaattcgttgctactcagtcatcggatcgatctgtccatatctacagcttgaagacaaaggatggccaatttacgttaacgtctcacgggaagttcctcaaaatggatcttccagccaaacgtatctcgtccagcagccctgctccgcctgaactttctatccgatcccagcccgcatcaggcaattccattgccattgcttctcccgctacctcgactccgggtacaccattgacctctcatttgcctatggatcctcctccggtatctcatagtcgccgttcttcatttggctcatccccgtcgattcgccgctctgcgtctccggcaccctccctgccgttaccagctgttaagcctttagaagtagcgtcgccaaacgtcttgggtggtctcacgatcaagaacgccaacatctatgccaatgagaccttcacatcattcttcaggcggctgactttcactcctgatggaagtctgctgttcaccccagctggccagtacaagaccacgcatgttcccgccacagaccccacaaaaaccacggatgagattattaacacagtatacatctacacccgtgcaggcttcaacaagccccctatctctcatctgccgggccataagaagccctccgttgcagtcaagtgttctccaatcttgtatacgttgcgcaaggctcctcagcctgcccgacatattacactggatacctcctcgggggaggaatcctttgcgtctcttcctgaaccggtagtttccacgaagccgacgcctgacaagccttccatggagcctccttcgactccttctgcgagcgagtcgtctaagaccaacacagtgtccaaaaacgccgagaatgaaggagcttctgctggccagaatccgagtccggttttctcgttaccttataggattgtgtacgcggtggctacgcaggacgcggttctggtatacgacacgcaacaacaaactcccctgtgtgttgtgagcaacttgcattttgcgacatttacagatctcacatggtga

SEQ ID NO: 7269 - DNA, 681 bp, A.fumigatus
tgtgttcggtacgctgacaaaaacaggtcggatgacggcttgactttgataatgagctcctctgacggcttctgctcaacgttgtcatttgctcccggagagctgggccagccgtatacacctccagcgggaacagcccagcatcctgcgagcgctagcaccacgtccgcgaatcaagcaccacaaccatccccggccaataatccctcgccgctcaagttgagtcaaccttctctgagctcgtcaccggcccagccagccgaagtacctccagcgagtcccgcacgatccaactctgtctgctcaatgaccacacaatctcccattcaacaggtaactgctcagcaatcgggggattttgtggtcaacaatccaacacccactctaggatcagtgccgcttgtgactgctgccaactcggctcaacccccaattctgccatttactacaccacctcagacaccgatgtctgcagtcgcgcaaagtggagcaaactctgtgagcaacagtgttttggggaaaagagacatcagcgagtcagagaaggaggactcaaaggaccagagttcggtcccgcaagtacaacagccgaagaagagacgcgtggccccgactcttatttcggccggcacaaactccaatcctccctcctcttcatctccgaaccatgaagtctcataa

SEQ ID NO: 7270 - DNA, 1992 bp, A.fumigatus
tcatcccattttcctcgacttgctcctgtttgttgcaatctgtatcgtttcatccctgttccctgccatacaactgcttactttgcgcaatttgtttctacatttagttctagcacccatcctcaacagttcactctacttacaaccacaatgagctcgccggcggagcattcgtccagtgaatcttcgcatggccacaactggccgaaccctgcccttcgccaccccaggttcaatctcgccgagatgcctgatccacccccaagctggaagttccttggggagtctgcagacgttgtcctccgtacgcgcaagtatgtacgcgagcaaatggtagctatgcttgacttttacagctggggaatcgacacgggaatgccatcgcggttgaccaatctgagaattctgcaagctctatggaagatcttctattacacagcagactatcaccgacctcgctctttcagagaccttctagactttgaaggcaaagatgggggcccgagactgttgtcttgcgagatcgaccatccctctctcctgcccatcagcagatactaccctgatcccccagccctggacggcaccacgcagcccgactttgtcagaccggagaatgccgcagcgaatattcccgatatctatcttgagcgaatgagcaagtccagccgtgacttgaacatgtccgaagcagaaacactagggtcaagcccgccggcggtgggcacgttgaacattggaggtaatggtaatactgctgcatttcagagcaacaaccagacaacggctgtggttactgcagcagctgggtcgctcgcaaacccaagccttacagcccctgcgaaccccacgggcgtctttatacctgcacccgctccttctgcggtcgtccgtgtgcctgctcacatggctcgagcaatcatcgaagacgttgagagagtcgtcatgaaatatgcctacatggagcttgagcgagacgccagcgctgctcctcagaccgttgcccggccaaatcttaccgcttttcatgaaggagacatatcaaaatccattgttggactgtaccatgcaaatgcccaagtgcggctctcgttggacccgcacgaccctaccaggacgatcattgatcccaccggcaatgactatccctgccgaggcagaggccctatctggaaaaacaactcgagcaccatcgacagtctaattgttgtaggcaaattgctcaatgctgggtccacggtcattgatcgtaagaagactggatgggagacccgctttagttcactagaacgagcctttatcgaggcgactgatgtcaattgggatgtgctctctctggacgaaagtacagaaatgagagaccacttttgggatgtcgttcaggaacatgtagcaggcatccagcctggagtgctcagccctttgtggactgtctggtctgattgcgcggggcactttgaccagttccatttcacgtaccgggaagcagttgcgccttgtcaatgtaccgggcagggtgccactattcaagcacataccaaaaccttcgtcgcccccgaccggcatgctcgggatatgcatggggtgtgcatgagcgaggtgatggctcgtccgttcgctcctcttctttatgcggattgtacagcatgcaatgcaccacaatgtgtgaccatcgagagaaggtttgacactcttcccctacgcatggtggtaggtctcgacgagcaggtttcaatcaagaatcacaccaaggacatcaccttcgacttttgcgatggcgacggtcagctgcaaaaggccacgtatcgttggttgggaaggatctattataaggattaccgttatcgcgtgttctggacggacactaagagaggcgagaccgaccatggcttcctcaagatgtatgacagcacgatgaactcgggcctgatcatcggcgatattccaccggcccataaggatgagagagtacctccggaatggtggagaaac

SEQ ID NO: 7271 - DNA, 342 bp, A.fumigatus
acaatcatcatggcctccaaaacctggaacgtcggtatcgtaggctatggcttcagtgccaaaatcttccacattcccttcgtcacagaagttcctcaattcaaactctatgctattgtgcagcgcacacccaagcccgaggacgatgccgagaaagaccaccctggaatcaagtcttatcgcaccgctgaggacatgatcaaggatgctgcggtcgacgttgtgatcatcaccactgccccagactcgcattatgccctagcgaggctagctctggagaacggcaaacacggtgaatatcctttcatcgactatcttgatggcacatgcgctgatctatga

SEQ ID NO: 7272 - DNA, 717 bp, A.fumigatus
tctatgaccaatttcaatctagttgtttgcgaaaagcccttcacacccacctcggaggaggcgaatgacctcgttacccttgcgcagcagcggaacaggctgttggccgtatatcagagtacgttagaccaaaccaaattcagtcgaagaatccacttccaggaactgacttcgagattgacagaccgccgattcgatgccgactttgtcacattaaccaagctggtgaagaacggctcgcttggccgagttgtcgaatttgagactcactttgaccgtcatcggcccgaggagccacccgccgatgtttcgaaatggaagaacaaggtcatcccgggtggcagcgccatctacgatctcgggagccatctactcgatcaggctgttcagctgatgggaatgccggatcggatcacaggcttcgttggctcacagagggctgtgaacacaaccggttttgaggactcgttcactgttctgttgcactacaacaatggacttcttgtaaccgccaaggcgggcgttgtgagccccgaggagaagcagttgcggtactgggttcgaggagagaagggtagcttcaaaaaggtaagaaatctgatcacttttcctcggcctaacgctgacacggtctccatagttccacctcgacattcaggaggatcagctcaaggctggaatgagaccgggagacaacggatacgctcgggagcctag

SEQ ID NO: 7273 - DNA, 267 bp, A.fumigatus
gccgcatccgcattggaaggtttgggagtcatatggctaacgatgctttgcacaggaaccctgaccaccatccaagacggcaagcctgtcgctgagatcttcccaacagtggaaccacctacgtacaccgaatattatcggaagtttgcccgtgctcttgccggagaaggcgatctcccggccagtggtgcagaggccgccaaagtcatcagattgattgaactggcgaaggaaagctcgaagcttggcaagacaattgacgtttga

SEQ ID NO: 7274 - DNA, 1323 bp, A.fumigatus
aaagtaaaggtttgggatgtcaagtccggcttttgcattgtcacattcaccgagcattcgagcggagtcaccgcgtgcaagtttgccaagaaaggaagcgttctatttaccgcatccctggatggctcagtgagggcatgggatctcattcgctatcgcaacttccgaaccttcactgcaccatcccggacgtctttcacctctctcgccgtcgacccaagtggtgaggtcatttgtgcggggtcaccggattctttcgatatccatgtgtggtcagtacagacaggacagctccttgaccagttgtccggtcatgaagggccggtgtcgtctctcgcgttcgcggcagacggcaaccatctagctagcggcagctgggaccgtactgtccgagtatggagcattttcggaaggacgcagactagcgaacctttgcagctcatgtcagatattctggatgtggcattccggcctgacgggaagcaggttgccgcatctactcttgacggtcagttgaccttttggtctgtggataacgcagtccaggaaggaggcattgatggtcgtcgcgatgtgtccggcggccgcaagatgggcgatcgtgtgacagccgcgaactcagcagcaaccaaacatttcaactgcatcacatacagcgctgacggctcttgtatcctggctggaggcaacagcaagcacatttgcctgtacgatgtgaggtcgggcgcactgctgaagaaatacacagtcagtgtcaacacttctctagacggcacccaggaattcctgaacagtcgtgatttgacagaggctggccctcgaggtctcattgacgagacaggcgaagcctcagatctggaagatcgcattgaccgcagccttcccggcgcgaaacgtggcgatgctggaacgcgtaaaactcgaccagaagtgcgtgtcactgcagtcgacttctccccaaccgggcgtgcattttgtgccgcttcgacggaaggtcttctagtgtacagtctcgacaccgaatttgtcttcgatccgtttgaccttgatctcgatatcactcccaccactatccttgccacccttgatgctgctaagaaggcgcactccatgaacacagcagacgatgacaatacgtttttgaaagcactagtcatggctttccgtcttaacgagtcgaaactgattcgcgctgtctatgaggctattccaccctcagagattcctcttgtggtgcgcgcactgccaactgtctacctttctcgcttcctgcgattcgtagcccagtcttcacccacggggctagacagcatccgcgcttaa

SEQ ID NO: 7275 - DNA, 765 bp, A.fumigatus
  unsure (23): Identity of nucleotide sequences at the above locations are unknown.
gggggacggggtgctggattggntgggagagccagaggcacccgacgaagagccggcagagttgttaggaacagatacaaccacagtcgaggtgggcacgttggcggtgctgctctgggtgacgagggtagtggcgggggtctccgaggcggtagtggtggagtcggcactggccgagccagaagtcgcggtagtcgtaggaggagtagtagtcgtcgtcgtctcgggcttgccagtggtcgaggacttcgaagaagaggactccgtcgcggaagaagacttggtctcggtggcggtcgggctggtcgaagacgactgggaagtcgagccagtgtagccagggttggagataccaaactgggtcgagtactggtactggccggtgccttcgaccacgagcagcagaccgtagtgggtggtgtcgggctcgagcgaggtgctgggagtccaggaaaagctgccggagttggggatgctgtcggccagcgtctcaatgggcaccacattggtgctgggaccgcgcaggagcaccagcgagaccggcccggtggtagtgggatcccatgtgattgtgtacggcttgccagccgggaccaattcgttcaggccgggcttgaggatggcatttcccgtggggtcctgggtgtagtcgggcttggtcgcggccatggcgagagccgccaggcaggagacgacagacgcaatggagagacgcattttattcgtaaccgaaggaaggactgtaagatggtgctgctagagtaa

SEQ ID NO: 7276 - DNA, 252 bp, A.fumigatus
  unsure (166): Identity of nucleotide sequences at the above locations are unknown.
acctcttccacgggcaggattcaggagcacgacaacgtccagtccatgtcacatcctacttggcaaaccgactcccctctggtcatttaccggccaatccggcgccagtccgccagtcttccgggaaatgaggttacatctcaggcgccgcaaacgaaccaattanccgtgaatgctgtcaaaaacgttggtcctgtttctgcactaaaacccggaggaaacacggcgaaaaactcagacttagtccaatag

SEQ ID NO: 7277 - DNA, 756 bp, A.fumigatus
  unsure (734): Identity of nucleotide sequences at the above locations are unknown.
cagcaccatcttacagtccttccttcggttacgaataaaatgcgtctctccattgcgtctgtcgtctcctgcctggcggctctcgccatggccgcgaccaagcccgactacacccaggaccccacgggaaatgccatcctcaagcccggcctgaacgaattggtcccggctggcaagccgtacacaatcacatgggatcccactaccaccgggccggtctcgctggtgctcctgcgcggtcccagcaccaatgtggtgcccattgagacgctggccgacagcatccccaactccggcagcttttcctggactcccagcacctcgctcgagcccgacaccacccactacggtctgctgctcgtggtcgaaggcaccggccagtaccagtactcgacccagtttggtatctccaaccctggctacactggctcgacttcccagtcgtcttcgaccagcccgaccgccaccgagaccaagtcttcttccgcgacggagtcctcttcttcgaagtcctcgaccactggcaagcccgagacgacgacgactactactcctcctacgactaccgcgacttctggctcggccagtgccgactccaccactaccgcctcggagacccccgccactaccctcgtcacccagagcagcaccgccaacgtgcccacctcgactgtggttgtatctgttcctaacaactctgccggctcttcgtcgggtgcctctggctctcccanccaatccagcaccccgtccccc

SEQ ID NO: 7278 - DNA, 600 bp, A.fumigatus
  unsure (580): Identity of nucleotide sequences at the above locations are unknown.
acgaattggtcccggctggcaagccgtacacaatcacatgggatcccactaccaccgggccggtctcgctggtgctcctgcgcggtcccagcaccaatgtggtgcccattgagacgctggccgacagcatccccaactccggcagcttttcctggactcccagcacctcgctcgagcccgacaccacccactacggtctgctgctcgtggtcgaaggcaccggccagtaccagtactcgacccagtttggtatctccaaccctggctacactggctcgacttcccagtcgtcttcgaccagcccgaccgccaccgagaccaagtcttcttccgcgacggagtcctcttcttcgaagtcctcgaccactggcaagcccgagacgacgacgactactactcctcctacgactaccgcgacttctggctcggccagtgccgactccaccactaccgcctcggagacccccgccactaccctcgtcacccagagcagcaccgccaacgtgcccacctcgactgtggttgtatctgttcctaacaactctgccggctcttcgtcgggtgcctctggctctcccanccaatccagcaccccgtccc

SEQ ID NO: 7279 - DNA, 1347 bp, A.fumigatus
ccaaatgtgacagatggtacgtacatgattaactaccagcggaagcagctgcctaattatgtggcgcctcccccggacatctatatgttgcatccggactatggcacgtacttcagtcatgaccaggtctcgacgatactggacaacttggacactcctgaccagagctaccagcagtatctggaccgcgttctagtcgagaacgccgacgatgtcattcatgtactctctttcgaaggggagctgttgtacatatctccatcttgtcggaaggttctcgagtacgacccaaacgagttgattggaaagacactgtcgacgatctgccatcccagtgatatcggtcctgtcatccgcgatctccgatcctgcaccaactccgacccggtcagtgtcatgtaccgcgttcggacaaagtatagcgggtacatgtggtttgaaagtcacggctcgtggcacattggcgaccgcggccggcaatatttggtcatgaccggccgagtctgtcccgtgtaccacctggaccagctcgcaaacattggcaatggcgggttagccgagaacgatctgtgggccaagctctcgatctctggcatcatcctcttcatgtcctcgaaggctcgaccagtacttggccgagtgtccgatgatctggtcggtaaaggcattcaagacctgatcccagctgatgcccgggaagatgcaaaacaggctttagaggtggctcgcaccggccagcagacgagttttagccataaaatacggcacaaaaagggccacatgttgcaggcccaaaccacattgtaccctggagacacaaaagaaggggagaaaccatcatttttggtcgcgcagctgcgatttcccaaatcgccgcaaactacccccggaactgaagaggtcgtacctttcaatatcactgctacattttcgagggacgctagcgtaacaggaagaagaaacgtcactgcggcaggccaaccaacttccgataagtcggcaaggggttcatccggtgatcaatacgtgccggctcccgatgaaccaacacttttcgccgaactgaacacggcccgaggttcaagctggcaatttgagctccgcgaactagagaaacagaaccgcgccctgtccgacgaggtccaacgcctgcttgcgcggaggaagaagcgcaagagaaagcagagcattgttcccgtcgaaaaggcgtgcgccatgtgccagacccggaccacgcccgaatggcgcagagggcccagtggcaaccgcgatctttgcaacagctgtgggctacgatgggctaagcaggtccgcaatgcgatacagaaaaaggccccaaccacttaa

SEQ ID NO: 7280 - DNA, 588 bp, A.fumigatus
gacaggctctcgacatggcccgagatctggaccgtggtgtaccacgaaagccccagcatcggcggactcaactacctctccatcgccatcgggtcgttcgccggcctcttcttcaacctcaagtttgtcgaccgcatctacaaaaccctcaaagcgcggaacaacaacaacaacaacaacggtcagcccgagttccgcatgccgtcgttagctgtcggctccgtcctcagcactattggcctcttctggtacggctggagcatcgggaacacgcactggatcatgcccaacatcggtgctctgatgtacaccgcaggcaccatttcgtgcttgcaaggcatgcagacatatatcgtcgacagctaccaaacctacgcggccagcgccatggcggcctgcgcggtccttcgcagtctggctgggtttggctttccactcttcgccccgtacatttaccagtctctgggctatggatgggggaccagcgtgctggcattcgtcaccgtgggtattggctgcgtggcgccttttgcgttttggcggtttggacccaggctgcgcgcaatttccaggtacgctgctggctag

SEQ ID NO: 7281 - DNA, 189 bp, A.fumigatus
gaatggggtagagctacgtccatcatcatgaaggccaacacttttggtgcctttgctcggtctttcagcaacgcttgcgctgcggccgtggcttcgttcagcaataccctttttgggtccgctttggcttccaggaatccttggccaacttggaggataagatggagaatggtcggggattcttcttga

SEQ ID NO: 7282 - DNA, 588 bp, A.fumigatus
ataattcgaccgttctgcggggtcaacgtaatcgcctattattccaccaccatcttcgtcgaatccgggtacggcatccaagaagccctcctcgcatccatgggcaccggcatcctcaactgggtcttcgctctccccgcctttttcaccatcgacacctggggccgccgcaacctcctgctcttcaccttccccctcctggccatctgcctcttctggtccggcttctccttctggatcgaacccgacgaccccttgagcaagaagcgtgtcgccatggtcacgacaggcatgtatctgttcgaggtcttctactcgcccggcgagggtcccgtgccgttcacgtactcggcggaggcattcccgctgcacgtgcgggaagtggggatgtcgtgggccacggcgaccacctggtgtttcaacttcattctctcgtttacgtggccgatgctgctggacacgttcaagccgcagggtgcgtttgggtggtatgcggcgtggtgtctggtcggttgggtgctgatcttgctttttgtcccggagaccaagggtgagtctgtttccccctgtcactcgtctggacgctga

SEQ ID NO: 7283 - DNA, 723 bp, A.fumigatus
tacgcggcatgcctcctcgtcgacacagaaaacacctggtccagttcctccaacgtaagagctgcaatcataagcacatcagcgtccagacgagtgacagggggaaacagactcacccttggtctccgggacaaaaagcaagatcagcacccaaccgaccagacaccacgccgcataccacccaaacgcaccctgcggcttgaacgtgtccagcagcatcggccacgtaaacgagagaatgaagttgaaacaccaggtggtcgccgtggcccacgacatccccacttcccgcacgtgcagcgggaatgcctccgccgagtacgtgaacggcacgggaccctcgccgggcgagtagaagacctcgaacagatacatgcctgtcgtgaccatggcgacacgcttcttgctcaaggggtcgtcgggttcgatccagaaggagaagccggaccagaagaggcagatggccaggagggggaaggtgaagagcaggaggttgcggcggccccaggtgtcgatggtgaaaaaggcggggagagcgaagacccagttgaggatgccggtgcccatggatgcgaggagggcttcttggatgccgtacccggattcgacgaagatggtggtggaataataggcgattacgttgaccccgcagaacggtcgaattatttagcccagtgccgtttccaagtccaatggaatcaaacactcgtacctgttgcatga

SEQ ID NO: 7284 - DNA, 918 bp, A.fumigatus
atcagctataccatgaacctggcacaagcgacacaggcagtccttgaggaacttaaactgattccctcggaggagaccccccttcaaagaccgctgccctggcggccgtcactcgcgctcaaccgccgcggggaggacgtccgtcccattttctggcgcaacaggaactcctcctacattgcccgtacacagacatgggatgaattccccaacggccgttggaccgactctcggtcccctgcctttggtgagcttgacgcttatggcatcggccttaaaggcacaaacgagcagaacatcaaactgtggggcgagcccaagtctattcgcgatataacgcagattttcgttcgctacctggaagggaagctggatcgcctgccatggagcgactcgccaatcagtggcgaagccaatgccatcaaggacaacctagtccaactgaatagcaggggtctactcacagtcaactcgcaacctgccgtgaacggcgtgaggtcgtctcaccctgtgtttggctggggtcctaagaatggcttcgtctaccaaaaggcatacctcgagctcttcgtacccccctatctgcttgacgagctgatcgctcggatcgagaagaaccccgacttgacctaccatgccgtggccaagaatcgcgaattgcgcaccaatactcgtgacagcccaaatgctctgacttggggtatcttcgccggacgagaaatcgtccagccgaccattgtggatacgatcagtttcttagcttggaaggatgaggcataccgcctgggtgaagactgggccaagtgtcatgatgccagcagcccgagtcgaaagttgatccaggacattatggacaactggtacctggtcaacatcggtaagtttgcgtttgctccctgcatgtgttcgaattgctaa

SEQ ID NO: 7285 - DNA, 204 bp, A.fumigatus
gtttgcgtttgctccctgcatgtgttcgaattgctaaccctggataacctagttaacaacgacttccacaacacgtatgacctcttcgacctgttcaatggtctggaagtgaaagaccttgacctggaggtcggcccggacacagccgagacgaagtcccagccaaacggagcagcccccgaagaagtcgccataaaaaactaa

SEQ ID NO: 7286 - DNA, 189 bp, A.fumigatus
tcacataatactgttgcatggatggcgcgaggggttcttgactggtttcttcagctgtctatcattactacgcgaaagtgtgggcctccacactttaagactgggactattcttacgcgggcggagaaatatgactcctactttggcaactttgtgatggagcaaacaagaggtgatgtactactgtag

SEQ ID NO: 7287 - DNA, 204 bp, A.fumigatus
aggacaaggccaagaatcctccgagcattccttcacggagaaccgaagtcaagtccgttatcgcctgttccttcaagacgcctccccaaccgcttcctctcctcgcaaaagaggggttactccgactaccactcccttcaaatgattatttactactttcaatatatcaccctcccttcatctaattctactgtctctatataa

SEQ ID NO: 7288 - DNA, 384 bp, A.fumigatus
atggtcgccgctgcgaagctggagcgtgaggcggtcgaaaagaaaaatgaacaattacgagctcaggtgaaggacacagaattactgcttgcatctcatcaagaacagctagccgagcttaagtctgtgatgcaaggaatgaatattgccaaggacgatgtcgaagtccgcaccaccatttctacagtgccatcttcgccagatgggcatcaacaattacctggtatatttccgaggagcctggagactgctgatcctcccgaacaatcgccgcacgtggaggagatcgtcccaggcccctcgaccagttttcctcatctgttcaaatcagtatgtcggacggatattcaggcttttgaagatttccgagaactgttcagtcta

SEQ ID NO: 7289 - DNA, 816 bp, A.fumigatus
cacctgaactgggtcaccgcgcctcttcagttctctgaattcgttgccgctctctccagtccgccatggcagagtatgtgcccattgcctcacgcaaacctgagtatggtgactattgaagttactaacttcatgagcagtttaattgcattccaaacctatcatctccggcatagctttctttcaccttccaatatgattccccgttccagcaatcacaagcggtccctctcttccggtcccaggtcactttctcctgatagaacagtgaccaaaaccaagtccaccaatgatctcgcagcgactgccaccgagaagccttctcttgcaactcgttccaatagtgctggggatatccctgatagcggtttcagtactttgagagacccaagactcgtgaataactctgaggcatccgacacatcgtcaacgccgtcccatcatccggatttgagcagtgaggttgctgctttgagtgtgaaattgatacaggcgatcaataatcagactacgctcgatgacaacctggttgccacccgacaggagttggaacaggctcagaatcggatcaagtcattggagtcggaaaatgagaagtaccgacatgatattgagcaggcggttcttatcaagaaagccgatgcggaccgtgagatctcgcagttgaaggctgctcttgcggaggagaaggctcagcgcgccattgtcgagaaaagtaaaaagaccattgaacaggaactggagactctaactgcggcactcttcgaggaggcgaataaggtatgtcgatatcaatttttgactagacattattaa

SEQ ID NO: 7290 - DNA, 198 bp, A.fumigatus
gctgtaccgactctttcgttcaggatgaaactacacgcccttatcccgctcctttttgcccctcttgcagcttcggctgctctttctggagtcctcaatggagtggtcgacaccaacagtgagctctcctgctataatacagaaattcgaacatctaacaaagctagacgatgctactctcgccaacggagctcttga

SEQ ID NO: 7291 - DNA, 1218 bp, A.fumigatus
cacgtgaatctccaggttcgcgcaacaaaaatcgtgcttgaaagctttgagaaagaagaattacccccagacccgttccccctttctactttgagtggtgccgttcgcaaaccgtcgatcagcgaattccaacaggtgcgcgactttgagcatctggccaaatgtgccgaacagatctttgtcgaagaagggcgaggcttgaaggatgaaatacgaaatgaccagccggacggcgctacactgtgggttcgatggagagagcgattccacagttctatctaccgcgtcctcctggcgggcgccattctctctcgtgcataccaggaaccgatgtattttgcggcagagtggggactaccgaattttctggagaagtacgtggaggcattggcatctggtggcatgtcgggcgagcctgtgggtggagacgagctcgattatctcgtgacctttgccccctacaatcttggagagagtggacgcattcatgggagcttcagggctcttggagagttttttgttcagcaaggcaagacgcgcgcgcaccagtctaaccttcacgagcaaaccaccgcgatccttccccctttcgcagcgccgcaagcccttagtcgctcggaggcggctgttgtgttcgtcgaactgggtcagctgttttttgccttggaggttttgacgggcattcaggacaggcaaccaatcattgtcaatggggacggctccgatgaacatgggagaactagaattgccccggatcttctctacaagcctgccagaacgactcctgttgtgctatttgggaccttctttccggagtatatctctatgccagcaaaggccgctgatgcagtcgactctcatcttgtcgctactcccctttcgcgtacatcactgacaagatcaggggtagggtttcagcatatctaccagttcctgtatgatctgtaccgaatggcgggccgtgacaatgaattctcatcccaaaaccctgcgcggtatcctcaccatcaattcttcgagtacatgtttagagagtacctgggtctccagttcgttgacagagagtttgactgtcattatgatgagttcatgggggatggcttcatcttcgcggaacgcgatgatcttctcgctgcctctgattttatcgaaacaagtgatatgacagccctagctgcattatttgagccagcagcttcagttactaggaaagcttga

SEQ ID NO: 7292 - DNA, 1584 bp, A.fumigatus
attcaacaatggatgaagtgttctggcaaggacatacagagttcgacagtcatatgcgaaccacctttgctgttggcagttgaaagactgagtagcttgacacttcaacatccgaatcctgggcttgtcaagagacttgtgtatcccattcttctaccactctgggggttggcttgtttttccctggagcaacaaagacccaagctccatgagaaagtcatggcaatcttacagacatattttggcatatcggtcggtatccaacctttgaagaagctggtcgataatctcctctgggatggtggtgcgacgtggacttatggcctggattccaacaacctcttggtgttagaaaagcgtaaaagcacgggatcggaaagatcgaatattgtacgactggttgataccctacaatcccgggccaagctctttgttactttactgggagctgacccgagtagcgaagaacggactggcgatatctttctatatgtgagccagagttggctcgtccaaccagcacaagagcgctccttgggccgactgcagttgcctttggataatgatgattcaaccaatattattcaaaaattagtaagcgcgaagctggcagaagtgctcctggaaaacttcaaggataccctttcacggcggccacttcgagtgcttgagctcataaagcaagttatcgaaggcgaattgaacagggtcagggtatctcagaagatcaaacctcaagactccaaaggggtgtcactttcgctcctagcaaacatcgttgcgaatgaaaatcacgggcaggaggaagcggtgaccgaaactgacgcagcagagtcactgccggctgtgttcagtttactttccaccgtgctggcgtcccccgatttttctgtgacacaggagacgttgcccgtccttcaagagctgaaactagtgctcgatgatctgataccgcatctaccatcatctcttgccaagccaggcacaacctcgtcgatgctgttggagatccatatcacctcacccgacgaaggtggccaggcaaaatcgcctgttcagatctcggactttgaaacacatcgccgagcattgaccaatctcaattctgatcttccacccgtacaagctgaagggttctcgctcctatctgatcttatcaaaagatcctcaccagttctggacataccttccacattaaccctgcttttgtcggttattaccgatcaatccggatcggccgccgacgacgaattcatatatctaaacgcaatcaaattgataggcacgctagcatcgaggcacccacgcacagtcgtgaaaacactggtagaccgctacatcgacagagccgaaactgttggtctcgaccagagactcagaatcggagagtccttattgcgaacagttcaggatcttggagaggccttgacaggtgaaacagcaaaaattctcggtgagggtatgattactgttgctggacggcgagcacgcaaagcgaaaacgcacaagcgtcggaaggaagagctcgagaaggagaaacgagcaagagagcgcgaagagcgccgaaataaggagcctgctatg

SEQ ID NO: 7293 - DNA, 285 bp, A.fumigatus
catgccgacggatcatacaccaccgcgcccacctcctcgtcctccttgcgcccactgctcactatccgtcccaggtccgcattcccactccacagatccccatgcaccaccactggcgtgatcccctcccccttcccctcgcggtcataccccaggtgcccatccctcagcagcgccggcaccacactgcgcaccgtccgctccaccatctcgcgcaaccccacatccttcccattccgcttctccgacgtctccagtaccgtcaacagccgttcctgcgcgtag

SEQ ID NO: 7294 - DNA, 429 bp, A.fumigatus
agcttcatgcggggtggttttgttcgtgagctctttgaccgttctattttcactgtacagacgctgaacccgcgcagtttagtccccacgctcgcttgtcctacgggacagagcgacggaaatgacctcaagctcaagtcattcatcctggagtactatgaagaagcttatcccgatcatcagccgcgtctgcttcctggagacccctacgagaaagcccgcgcaaaggtctggatggattttgtaacgacctgggtgattcccgcgctccattgcttcctgcagtaccagcctcagtccaaggacgaggacgtggctactgagactgacaaggtccgccaggagtttctggcccgtctgaaggagtcgaccaaagagatgcatcccgggggaccaacttttcttggggaatcggatttcaatgcctga

SEQ ID NO: 7295 - DNA, 783 bp, A.fumigatus
atgcccttttgccggaaatttgggtccccgggggtttatgccctcttggggcaatttagccctgggaggccccgttgggaacgcgcccaagaccagccaagaaccaaggacccaagggcttttttttctttggggccggattttctttggaagttgggtgctggtgctggcgggcccggagccgggcggaccggggcgagttctctcggcgcagcggctgggccaagtttacactctacgccttgcgccggcggaccccggagacgggcaagcgggcggtttgggttccccgtaccgacgttctgcggggacacaaagcagccgaaccgatggcgggattcgtgggcggaattctacgcgcaggaacggctgttgacggtactggagacgtcggagaagcggaatgggaaggatgtggggttgcgcgagatggtggagcggacggtgcgcagtgtggtgccggcgctgctgagggatgggcacctggggtatgaccgcgaggggaagggggaggggatcacgccagtggtggtgcatggggatctgtggagtgggaatgcggacctgggacggatagtgagcagtgggcgcaaggaggacgaggaggtgggcgcggtggtgtatgatccgtcggcatgctacgcacacagcgagtatgagctggggattatgaagatgtttggggggtttgggccggcgttcttcgaggcgtatcatcgcattgtgcccaagaccgagccagtggaggaatatgaggaccgcgtgaggttgtatgagctgtaa

SEQ ID NO: 7296 - DNA, 252 bp, A.fumigatus
gtcagcagatctccatcacagaatcaacgaatgcaaagacctaatgccgtgttcctgtcccaaaccctgccacaaagtctctggttgatctgcaaataccaggaacccgctagaaataaccaggtcactacgatgccttccgttccagacgccgagatctatcccgaagccagcggaccagcaaaagcgctggtcgacaggcatcaggcggagcagcctttgaagcttcatgcggggtggttttgttcgtga

SEQ ID NO: 7297 - DNA, 186 bp, A.fumigatus
ggcaaggggtattgtgaagccctgccggtgatggccgcgaggctgcttaagccggcggctgatacgaagatcttcctgtgtgggccgccagggatgatcaatgcggcgaagaaggggcttgtctcgctgggcttcgaggcgccgggcgctgtgggcaagatgactgatcagattttttgtttctag

SEQ ID NO: 7298 - DNA, 468 bp, A.fumigatus
cttgtaccagcatgcgtctgggcctcagcaggttacaatgtccatgtccgcgatccgagtccccaacagcgcgaagactgcctcgcctacgtcagggataacgtggccgcatacgccgagagcacaggacagaagccaggaacagtcgggactaccgaaagcctcgaggaagcagtggataatgcctggctggtcatcgaggccgtgccggagaagatcctgctcaagatcgatgcgtttgctgaactcgatgcccgcgcgccgagtgactgtatcctcgcgtccaactcgtcgtcgtacaagtcttcggagatgcttgagaaggtgtcagaggcgacgaaatcccggatcctgaatatgcactactacatgccgccgcagtgcatgatagtcgagctcatgacggatgggcacacctcggccgacatcttcccgtttatggttgaccggtccaaggaggcggcgacg

SEQ ID NO: 7299 - DNA, 531 bp, A.fumigatus
  unsure (153): Identity of nucleotide sequences at the above locations are unknown.
tttctgaatttttcaggctggggcggccactggcgcggcgcgaacgccacctccgaaaccgtcatctgtgatcgcagctacaccacccgccgctggcttgtctccatgtgctcccagggctacaccgtcgccggctccgagaccaacactttntgggcttcggacctgatgcaccgtctgtaccatgtgcctgctgtgggtcaaggctgggtcgaccacttcgccgacggctacgacgaggtgattgccctggccaagagcaacggcactgagtccacgcatgactcggaggcgttgcagtatttcgcccccgaggcgtatgcgtttgatattgccgctcccggtgtcggatgtgctggcgagagtcacggccctgaccagggacatgacaccgggtctgcctcggcgcctgcgtctacctccacctctagctccagctcgggctcgggctcgggcgccacgactaccccgacggattctcccagtgccactattgatgtgccgtcggtaaggacagtccggatctcgtaa

SEQ ID NO: 7300 - DNA, 507 bp, A.fumigatus
ggatgttctacctctggctacaatgcaagagtcacgcaccatccaaccttgaagaaagaaaatgtactcacaaatggctgctctcttcacgcattgcagttatcctccccctggccgcgccggcttgtggccaccctccctacctcccccgtccccatcgcggcgcgagcaaccccccacgaacccgtcttcttctcctgggacgctggcgcggtgacctcgttccccatccactccagctgcaatgcgacccagcgccggcagatcgaggccggcctgaacgaggcggtcgagctcgcccggcacgccaaggcccacatcctccgctggggcaacgagagcgagatctaccggaagtactttggcaaccggcccaccatggaggccgtcggtgcctacgatgtcatcgtgaacggggacaaggccaacgtgctcttccggtgtgacaaccccgacggcaactgtgctttggaaggtaaggatcccccctccattctcccgaagtga

SEQ ID NO: 7301 - DNA, 345 bp, A.fumigatus
  unsure (107),(219),(298): Identity of nucleotide sequences at the above locations are unknown.
ttctggattcggtgtaacagatccaacgacgacatagtcagccaagctgtagtggaggtttccgatcggaagttcttcgatctcgaacatgacagagcggtggttcnccacggtcctctcgatgggcgcatgggtatctcaagcaagaccgccacttgccaaacatgcggtggctctcttcaagtctgcaacgggcatttcggccatgtgagactcgtntttacttgccttccatgtcggatacttcaaacgtgttatcagcattctgcaggaaatttgcaaggagtgttcgcgcatnttgctgcccgaagcagagcgacgtgcttttcttcgccaagatgcgtt

SEQ ID NO: 7302 - DNA, 675 bp, A.fumigatus
agggagtttcattccgggccccggcccaattttctggaaagacggaggaattgccgttcccgaggggggggaggattcaaggagcccatacgttcctgggtaacaatgactttcccccggaggagtacattggcaaagtccattgagctttgcggggcaaacagaggcgagcagaagagtttagagtatttcacaccaaggcaggtcattcttaagtatgaactgcatgttgctcaactcgttgatgacttcttcggcaagctcaaggggtctaccaaaggctacgccagcctggactatgaggagtccgcttggcaaacagggaacatcgtcaagctgcaacttttggtaaataaggcgcctgtcgatgctgttgctcgcatcgtccactcaagtcaagtggaaaggctcggacgacaatgggtgacaaaattcaaggagcatgtcgatcgacaactgttcgaggttgtgatccaggctgctgttggtaaaaagatcatcgcccgagagacagtcaaaccctaccgaaaagatgtcttggccaagctccatgctagcgatgtcagtcggcgccggaaactgctggagaagcagaaagaaggacgaaagagactgagagctgttggaaacgtggtgattgagcacaaggcattccaggccttcctcgccaaataa

SEQ ID NO: 7303 - DNA, 450 bp, A.fumigatus
  unsure (55): Identity of nucleotide sequences at the above locations are unknown.
agagccataatttcttcatgggcggctgaaactgacatttgtataagcttgttcntccaacttatctcccttgccggtctgcacagcaacgccacgatcacgaccgagctttcacgcgccttcaaggatgagggaatgctcgcttacgtgcgactgatccagtcccgcgagaaggaactcggggtcgaggtcctcacccaccagaaatggagcggtgcaccatacatggacggcatcttaggcgccatccagagcggcagtagcagcagcaagagcatgggagagggaaacactgagaagggtaagctgtctatccacttcgacttgctagcaataaatgctaacaatccaaaattacaggcttctaagcaaatcccccgtcatggccggattataataatgccaagcgtcttgcttgacaggtgtagagataaaaaaaaatccccatag

SEQ ID NO: 7304 - DNA, 345 bp, A.fumigatus
cccggaggacaggactcgcagatcgtgaccaaggagtctgttacccacatgcggtcgaactatgtgctccagaccgcagatgatccaccagccttcatcattgtcaagactgaaggatggctgacaggcgccaaagacgttctggataaggtcaacgaccctaatattgcggacacaatcaatcccaacacctacaagtatcgccttaatctttccatggaaactggagatgagcgttatgctttcctgaacactctcatgtgggttgccagtggttgccgcaggggccatgaaggtcggtcgagatactcttgtagtttacggagtcatgctaacaacctatag

SEQ ID NO: 7305 - DNA, 1029 bp, A.fumigatus
tttttattctcttgtcgcagaaccatatctgatcgaccacgaggatgcctaatattaattaaaatactcctatgcaaactccgcgtggtctatcttgtcacacagccaatcttccgattctcctatcatattttcatccatagcgtccatccttcccccatctgcccgaggcggggtggcagggacgagagcctggatagaccgcactccgggacacacacaatgcccacatatcctatccggcgcaggccccgcgagtgcaagacctgcctaccgtgtcgtgcgagtaaggtccgttgtgatcgcaatgtaccatgcggcaattgcgtcaagcgcaacttcaactgctcctacggccgcccgcctcccaaggacccatatccactacctacaccgacagccacgactgcgacgacatctctgcctaaaaccccgcactcctcctctctaccggcatacactccgacttaccaccaaacgacaaatatctcgggtcacgatgcttcctttggaacggggacaggtaccgattccactcccgatcaggagccattgtcggataccgtggtgatcacacagggagaatgggatgagattaacgccaaaatgcgcgcaatggaacagatcctgggcagtttgcacacattattcgatacacgcgcacggaggaaacccgataatcaggtcacggacatctctcccgaagcagaaggctctccgccgtccgaaggcatctatgagcctgacgcgctccggacgggctccgtccatatagggtcgaggtcggcactagttgacattttgaacaggtcgaaagttgccgagggcactgcgcaggcgctgcccaaggatgaccttctcgcagagctggcgatgggaaacgagtcggccgcgtatccgttcgtcgacctatggtcgtcggatccgtatacattcaacatcgctggcgtttgtggagtattaccccatgatgaccaatgtcgacggtatgggaattggtttcgatggtcgattgttttgccttactaa

SEQ ID NO: 7306 - DNA, 858 bp, A.fumigatus
ccgaggttcgtagctgctgttggacacatcgaccaggcactttttttgtggatacatttcctacctgcttgtccatctcaccttcgattatctctttcctcatatacaacccctctaaaaatggctgaaaaagaccaagaccaccctccctccgctcctccgcccacttcctacatgagtgataccacctccgatcccgccctacttgatccctttcgcgccatcgcctggtccaactccctcctcaactcccccgactactatcccatccgcacctggtcccgactcttcaagccacacacaggcgaagatggctacttcgccatcaccttggtcacatcctccaccatcccgcactgtctgactctccgccggcgcaacctcctccctcccccgcaggagcctcccgtctggcccagtcccaccgcaaccccgtcgtcggcgccctcgccaattcccccggatatcattatgatggttgacctcgcgacgcccggcgtgagtggccacccgtccaccgctcatggcggcgtcgtggccacgctgattgacgaggccatgtccttggcagtcgccatccatgctccgtcctccggggaccatccgcggggtgccatctacactgcgcagctggacgtccgatacaagaaacccctccgtgtgcctggcttagttgtcatccgcgcgaaagtcgtggctagggtcggaaggaagtactgggtgcgtgcgcaagcggtgcaggaagaaagtgacgagaacaacggccgcgggctcgggggtcctctggaatgggcgaaaaagaaaaccgtggtgaccgatgccatggcgttttggatacaaactgctccttcgttgtga

SEQ ID NO: 7307 - DNA, 462 bp, A.fumigatus
agtcgatgttcagcgtcacggtcgggtaccagtacttggccagtttcccctttgccgattccgtttctgcagcgtcgtctgtggtgcctccctccttcgtcaccttgcccatgctgtcaaacccatccagcgccatcgggaacatgtccaccagaaacgccacggcctcattcgtccaccgcgcctccgtgttcccaccaggccggaaccgtgcccactggtcgacaaccggcggcttgcccagcgcaggatccggtccgtacagttcaacctgctgcgacgcccggcggaacttgggaaacggcgcaaccagccggacccattgcccatcacgaccggtctcccgcaatgctgcaaggttcacacgaccctgaggccccgacccgcgaattgcctcgggtagcaaggtccagctcgagggcgccgatacgcccacttcagctgtcgcggggctcaccgtga

SEQ ID NO: 7308 - DNA, 234 bp, A.fumigatus
gcacatgagcaacaacgggcattcctttgtttttggatggtatggtatgactctgatcctttagtattattccttgtgccaccagtcctgaataataattacaataacaataacaataacaacaacaacaaagataataagaatagttacacctactgtgtaaagtgccggtcgttccttgatttcgacgatacggagtcaactacgggagtactactctgtagcactctgtaa

SEQ ID NO: 7309 - DNA, 411 bp, A.fumigatus
ggacagcccaacatcgtgcaatacattgatcaccatgaacatgacagatggatttatattatcatggaatatgtgcctggcggcgagctttctacttatctttcaattcatggcaaaattcctgaagacatggtcaaaacattggcccggcagctcctgcatgcattgcaatatcttcacaaacgcaggattacgcatcgtgacataaagccagataacatcctgatcgcttcgcttgaaccgttaagagtgaaactgtcagactttggattgtcgaaagtcgctcaagaggagacctttttgaagacattttgtggcactttgttgtactgcgcgcccgaggtgtatccggaatatgagaactaccgacgaggtgaaatcagaaaaagacgtcgattgggtgatccgtaa

SEQ ID NO: 7310 - DNA, 903 bp, A.fumigatus
cttatattgatttgtagtcctccgaaaacgtccccttacgatcagtccgtcgatatgtggtcattcggtgcggtactattccatatccttagtggtacacctccgtacacgggtcgaggcgacgacagaggatctcagatgttgcggaatatcatgactaccgagcctgattatgacgtactgcgtagagaaggtgtatcggaggccggtgtcgattttgttaggcgcctcctgaaccgcgaccctcattcacggccgaaggaaagtgaatgctttcaacatccatggatacgtgatgtgccagatgttgacgagtacgatgataatgatatccaacccgcggacttcggggccctatctgatatcggtgaagatctggagaatgagcttgacgcgtcacagatctcgctcaatgacaatcaagaaccggtcattaccggtgacgaaagccacgattccaacaacttggcacaatccaagaggcccaggattgaccatcttcctgctgacattcgctatccatcactcccaaacattgaaagcttaccagctgctcggccaattcctgaaagtactccgagacgcttatttggcgaaattacctcttctgccctgcacagttccaatgtctttggggccagtatgaatgctttcggcggtgacgaccttagcgttcatgacttcgtttcttccaccggtgagtcgattataagcgacggcaacagcctaaactctgtcctttcccttccggataatccctttgctggatccgcgccaagcttgatgggggctgagaatctcgttgggcagctgaacatgaactcgtggcaccctggcacttcggcacacagtcccccggcggccgccgagctgccggctctgaagactagcttggatgaatga

SEQ ID NO: 7311 - DNA, 456 bp, A.fumigatus
agacgcggtaacatgtacaacgtgactggtcaaatcggaaaaggagcgtttgcaactgtttataaacttgccacaaaacaacacggtgccgtgtacgctgctaaggagctcgacaagaggaggttcatgaagaacgggattcttgatcagaaggtcgacaatgaaatgaaaattatgaaagatctcaaacatgtgagctttggaactccttcgtctaatacaggactcttagaactaatcactactgaggacagcccaacatcgtgcaatacattgatcaccatgaacatgacagatggatttatattatcatggaatatgtgcctggcggcgagctttctacttatctttcaattcatggcaaaattcctgaagacatggtcaaaacattggcccggcagctcctgcatgcattgcaatatcttcacaaacgcaggattacgcatcgtgacataa

SEQ ID NO: 7312 - DNA, 357 bp, A.fumigatus
accattcctccggctgcgtgtacggcgaatgtcgactcgcccctgcttcttcttcttcttcttcttcctcttcctctgcttctgcctctgcctctgcctctgcctctgcctctgcctctgcctctggttcataagagctttctgattcacactcctcttgctcagattcagatatctctgataactctgccgttcggtccctgtgcctgtctcgagtactcgtgtcgtctcttaaaccatttcgcactggcagtgaccttctgttcggcttttttgaaaatgcgtcaacttctgtctgggctactggaaccaccaaggtatgtccccgtgttcttccgcgggttgggcagctcctga

SEQ ID NO: 7313 - DNA, 630 bp, A.fumigatus
ccacagggcgatgctctctgggatattccgtcggactggtcgggggaggagacacgaccaagacgcaatgcacggaccgagccccgttttctgagacgctcccaacgagctcgaaagtcggttcaggtggaggataccccgacccggacatcgcggaggttggcgcgtgtcattgaggataggcatgagcgcagtagcgaggaagatgattctgaaatggaggaattggataaaatcattgataagcagctaggtggcgcgaggctcatccagtcgataaatgagaacagaagcacagacgtgagtcatggttctatcggtgaagaaagggggccacaagaaggtgaagacgatcgggcttctgaggtacctgtggaatcgacctcaccttcgaaaaagctcggatttcagaattttaagacgacggacgcgcatgaagaccaagaggacgacccggaatgggcgcctgatacagcagcaagtgaagagttgggagaagaagacgacgagagaggatgggacattacccggccggatggagtcaacacaaatcatccagactggaagattgactcaggagctgcccaacccgcggaagaacacggggacataccttggtggttccagtag

SEQ ID NO: 7314 - DNA, 426 bp, A.fumigatus
gagacgacacgagtactcgagacaggcacagggaccgaacggcagagttatcagagatatctgaatctgagcaagaggagtgtgaatcagaaagctcttatgaaccagaggcagaggcagaggcagaggcagaggcagaggcagaggcagaagcagaggaagaggaagaagaagaagaagaagaagcaggggcgagtcgacattcgccgtacacgcagccggaggaatggtctatcaccgcgagaccaagcaagagacgccgaactgatgggtatcagcgcaaccctcaagtcgagattttacgcacacggtcaacaccgccgccagtgcattcatatcgatcgactcctgatgacaatgaaagccacagaagctcgcgtcaaccttcgcaaagttctgctgttgccgcaagcctcatcactgtga

SEQ ID NO: 7315 - DNA, 1263 bp, A.fumigatus
ctcaggagctgcccaacccgcggaagaacacggggacataccttggtggttccagtagcccagacagaagttgacgcattttcaaaaaagccgaacagaaggtcactgccagtgcgaaatggtttaagagacgacacgagtactcgagacaggcacagggaccgaacggcagagttatcagagatatctgaatctgagcaagaggagtgtgaatcagaaagctcttatgaaccagaggcagaggcagaggcagaggcagaggcagaggcagaggcagaagcagaggaagaggaagaagaagaagaagaagaagcaggggcgagtcgacattcgccgtacacgcagccggaggaatggtctatcaccgcgagaccaagcaagagacgccgaactgatgggtatcagcgcaaccctcaagtcgagattttacgcacacggtcaacaccgccgccagtgcattcatatcgatcgactcctgatgacaatgaaagccacagaagctcgcgtcaaccttcgcaaagttctgctgttgccgcaagcctcatcactgtgatctcagatgatgcacaaaacgaagctctggtgagaagcgacagagactatgcgggggataaagcgtggtttgcggaggcttgcaaccttgggcaacaaagagagaactgggatattatagtgacggcagcatcagaattgaaagaaaatatagacccctctcgagccgagtccttcggtacaatcgacaaacaagtatctcagctacgtacgcgatatgcaaagatcaacaagaaactcaaatctcaacaggggcctctccgagagaatctgcgtgagtgcgacgacctccgcgaggccatctcggacgaggggaccaggatccttgatagtgtctactggctgtctctccgacaggcagagtcgcatgaaatgctgaaacaggcacaccgacttgttaagcagtttgaagctcgggtctttcccacgatgatcaaagtgatccttctttgctttgaagggtactacaccaaccggaaactctttccgtcggcttatagacattttgccggagcaatgaagctccttctacggttctgcgaccggatcgccagtctgcgcaccgagcgatatatacggtgcaagatacacagtcgaaccatccgcaagccgcttcgagagttgatcaaggcggtggaagataacttgctacaacgacacctgaatgagactcacggggctaccaggggtgagaaagaaggaatggactga

SEQ ID NO: 7316 - DNA, 1446 bp, A.fumigatus
ctgtccttccacggctgtggtgaagatgcctgggagggcccccagtggcttttgcgtgaatccaacagggatactcgccacgcgtatattgatgccttcctcacatggctgtcgtttgaaacgactcaagatgaaatcaaggctacatccaggccagtgaagggaacaggcactctcccgagacgtgaatcgccggaagttactaaaaaggatgacaagcgacccttgaacgtgagtcagcgagagaaagtcatcatagcagctcagctgaacttcctccgactgttccacttgaccatatacgatattgcgctcgactgccctacagacgaatccgagattctgctacttcatctccttctcacaaaccttgtggagcgactcggagtcaatgccgtcagatttgggctgcccatggtcctgaagcttcaagaggatttagcatctgtgcagtccttgcgttctccaactgccaaggtcaacatcggaagcttggtccatggatatctgtgggcagtgtgcgagaagtttgagttggaaggctataaagttggcaacgaaattaggatagagattgacaggcggaaacaaaatggcctttggctcgacagagtgcgtatgcctgccattggtatcgacgatatcatcgaatcgcgtgaaaagtctccgcgcaaggacgattccatggcgcaaagcgagcttatcactttcaaggacggtattgaggaacttgtcaacagaattgaggaggtttataattcctccatcacctcagccgcttccagccctccggcatcacccgaacacagctatgctcttcccgtcctgggacatggagctgcgactgctagctctctcaagtgcaatttaccgtcatctatcaaagagcaaatgctttcaccatggtccagagaggcttgtctagcagcctctgagaaggagaaggcagaggctatgtcaatcagcggatccagacacggtacattagggttgcgtaattacgccaccttaaatggcgccggtaatagctctcattccattgctacctccgcacatcaaagcgccttcggcgctgcagcaggcctgcaacatctccggcgcacgagcatacctgactcgcagggtacacctgtcaacggctcaggcagagagtcgccagtgcgcgtcaacgaactgagacaagttctttctgtgaatgtcgagggtaatgctcgccggttgagcccactccgcgggcgtctggatgcttcgaatggcagtattgtctcctcgagcagtgagagcatggtaagcggcttttcgttgtctgaatatgacgcggatggcaactcaatcagaccacagtccattcgggatggtcgattgtccgccaatggagacggcatggaaacacctaaagcctcttctattggtgtgaacggggcccagtctcggcagtcttcatcg

SEQ ID NO: 7317 - DNA, 1797 bp, A.fumigatus
gctaatattctgcagttacatggtcgagacaaggtttccaccctgtacaagaacatgaaaggacataagacggtgctggaaaagaaccgtatcgtccttgagagtttgaacggtctcacgacttgtttcatgcatgtcgagccagacggctgttctcgactctaccagtactctggtcgccatgagcaagaaccgagtcaacggcagaacctggtggccatcaacacctacacggacaagctcacccttcgcagtcgggaagagtatgacggcaagggagcgctgcggaacgagtttgtatatgactatcctgaggcgtccaagaccaagctccccatgcaacggcaatgcctggctggcgagctagagggacaagtcgtccagtacgaccagcgtggatacatcaccaccgggtccgccatgagaggcgtcaatcccgttcagttccagtactggtaccgcaagaacgccaagttcgacgacgagttgctccgtgccgagtatgtgtttccgcatatcaaaatcaaggtcgcatggagtatgcctccccggacgcgtccggagcgcctggacaaatggatcccctatccacgggtcaccgaggctgtcttcatccaagacggcgatgtctataatgctcagtggacgtatgatcacaagttccatcccatcattgcgactaccctgaacggcgaacacattcccacgccgcccatgatctgtgacgactggttccatgtcctcgacaagccgacaggatgcaccttattgcacgacaatccgctggtctcgttctcttccaccaaaacaaacattattgcccgcctgatgcgactgaatgtcaagcaatatccgattcccacgtcacgtgcgcggacgcatctctggaaatcctggaaggcctccaaggagtttgatgcggttactacccggtggctagacgagatcttacttcgatctgaccgtattctgcgtccgtactggaggcggcgtgactggggccgtctcgagtccgccgcagactatctcgacgcccaggtcgacaccattctcgctcgggtggatatcgatcccgaaatcagttcgtggacccaactggcctttaaaatcagcgacctctacagtttcggccaaggaggtgacgcaaggatcaatacgcgcacactgtcaacgcagctgcaggataccgatagcgaactgcacgttttggcgatggacacgggcacctggcccaatgagccaggaggggtctctgcatgccgaagggacatggtcaacgatctgaagcatatccggtggcatatcctcgcggaggcggccaacgactttggcgtccctcgattccagatcgaacggaatgtgcagtcgctgacggtcttgccgcaatgggggctggacttcctcaatccaacacacggtgtgttccaaaattgtttagattccgcggtggtcgagaagtcgtacgacaccacggtagcagatatccgacgcaatttcctccccattctgtctagcatagttcggtgctcacgaaccgaccagctcacccgctcgcatatcgaggaagcgacgcgggccctggtggacttgaacacgtactttgagtcatctcgcagttggaacgacgtctggatgagtgatactgtcaagcaggcgtggagagaaatgtggctcagcgaagacacgcctggcgcggttcccgtttcacaatggttggaatccgagaagcccacgctactacagcttgacgcggctttggacggctttcagcggggtgcaaggagccgctccattggg

SEQ ID NO: 7318 - DNA, 2736 bp, A.fumigatus
agacgaaagactgaccaaggctcaatccacacgaacgacgagggcactgaaacgaatccagaagttcctcctggggatgagaagcagagctcacaaccggaagtcggagaagaaagatcgccttccccatctagggcaagctcgactttcggggatagtagtttgggacatcgatactcgagcatatcttctgtctcgacggcaactggactcggatctcccgtacccctttcaagcatccaaaagctcgagccagaacaggtcgcgacacctccctccccgaggcgcatttcccccgagcgttcacgttcaacgtcgccgacaaaagggcttggaggctttgtgcagagtgccatgatgaagcggtcggatagtgtctcgaagagatggagtgcacagttaccgtcaggggttagccgaggagtcaactcgtttgccagcaaccgcaatagcattgctggcctagcttctggcgatgcacatgctcctgcatctccgtcgaggcttggccgcgaggacccgttcattgcgtctaagagaccaagttctagccacagtgaggcaacgattgtccataatgcgaaggagagcgaaagaccggcaacgccgccggtagtgaacaaggtggagacagacgaagctaccgccagacctacacttcacatcagagctctcagcacattgagcggaaatggacacgactccgactcaaattcgttgccgtccacgagcccggttgtctcgaggaccatggatcccaggcgctggagtcccacaaaatcgacatggctggagagcgctcttaatcgacccgactcaccaaagcacaagaggcagcactcacagcaaacatcatgggcgaaagatcgacaatcaagggcaagcgtagatctgggccgcgtgaacagcttcaaggaagtcactacagtcgggctcatgcgttccgcagcacctggcagtcattataagactccgagtgtttctgggatcccggatctaccaagtaatctggacatcaacaaatctaaggaatccagggaccaaccattgtcctactctgtagacagcgaacccagccctgcagagacacttaaggttgaacctacacccgatcatgagactactcagaaggtggataatactcgcgaatccgtggatatgaagcccgaagcttcgcctacaaagaaagaaggtggaccggaaggcaagagcgaggatgctccaacacgcaaacatgcaccttccctcctagtacccgtcaaaaaaagtgagacccgtgcacctctctcttctccccgagaccttttatggaacagaccaaagccacaatctcctgtgatagatttcggtgcaaatttgcgaaagcgagaaattacgaaagacgaagcaccgaaacaagaaccggagttcaagaatgtgtttggcaaattaaagaaaactgaatcttcgacttacgtcgccccagatgagctcagaaataatatcctgaagggcaaagcagcgctgaatgcgacaggcggcccgaagaagacctcgaaggttgatgatctgaaggaaagtatcttgaggcagaaagaggcaatgaaagcgactggaggcttacttaggcgtaatacggccggagaaatcgatgcccctgcgaagatgattccagaagcgattgccaaacggaataacctatctaaatctagcagcagcagtaggagcacccattcgggtggtgccttggcttcgccgtcctctgaagacaattcagtaccgaatgatctcagaaatgaccagaagtcgccttctttcccgcgtaaggacgaacaggcgcaggaggcacagtcctcgcagactgcagcagaggtttcaacgcccaacgaagggaaagaacagcttgcagatttagcatcttctgaggctggaaatggggagatcaagaagggtgatgtcgagaatcagttgatcacagactcagcggtcaccgcagagaacacgtctgagataagggacaagcagattgaagaggccatcaaaccggtgcgtgctctgccgtcggggactgttgcggaggctgcagaagcgcctgctgctactgaaggtcttcctactaaaggtcaactcgcaggccgaataaaccctgccttggcggatctcttgtctcgcggccctcttattatcggtgggaactcaaacaagcacttctcgacagactcaatacgggaaggcagctccaaattctccgacacccaggctactgcacctcttgctcatatgacgaagaaccgtgcgaaggggccgaaaagacgcccacctaagcttgcagtcacggaattgacaacgccgctggccaacgatgatgcgaccattccagagaatgataactcttcatctgattttcatgaaacgggactagcgccatcatccagtcaagatattgcgaagacttctgtcggttggccgcttccggacgctgaaacgactgggcccatcgtttttgagccgactctgcctccactgacttatacagcctctgaaaaaccagtggaattcaagcgaaccataccgcatcttatggagcgtagactggagcaaaagctcgcacaccgggactctaagtcttcgctggatatgaacccttcgccttcccccatggacgatctggaagacatcgaaaatcttggagactctccctcgcgaagaccgactctcccgccaaaggtcttcaaaggcgccggaagatcacattcc

SEQ ID NO: 7319 - DNA, 264 bp, A.fumigatus
ttctggtctctgcctcaaggtcatacagaatatgatgtagccatggatatgaactatattacactggttgagcatatgcttccggtcgaggcacatgcacgtttacgcctgtcccaagtcctggggaaccttatgtacaaggatatgggacatgctatcgaacctaaacccaggaatatacggtactgtcctacgaaccactggaaaaaggcttttgccaccgaactgacaccacggttcgcaaccacgaacagcagactgtag

SEQ ID NO: 7320 - DNA, 402 bp, A.fumigatus
caccagatcccaggattcgacacaatcgtgagttgcttgggtcgaaacatgattgctgctcaaataaacctcatccgaattgccgaaacctgcccgaacgtcattcggttcttcccgtctgagtacggtacggacatcgagtacgggccgcagtcggcgcacgagaagccgcaccagttcaagcttcaggtgcggaaatttatccgggaggaggtaaagagactcgaacacacctacctcgttacgggcccgtacgcggatctctacctggagaatgcaagcaagtgccctcgcgcgggaacgttcgatgtcgcgaacaagaaagctgttcttcttggtgatggtaatgggcgtatcagccttacaactatgagcgagtacgtcgcatggacttgtccctga

SEQ ID NO: 7321 - DNA, 186 bp, A.fumigatus
cctctactgctgtatttccccaacgccggtcgacagcctgaagataacgccttccctctcgacttccccggacgtaccgcggagcaatatcctacgagcgatgcaagatgggctgcaacttacaccgttgaatgtgtctctgtcccagaatacagttgttcatcccacgctgcagacgacgtatga

SEQ ID NO: 7322 - DNA, 747 bp, A.fumigatus
ctggcgcgtggcggcgagtgtctcagcggcggggatgattctgccattcggactcggctccgcgatctcgtatggtctgtatcacacgttccgaacagagcctggaatggctcatatcgatttcggaacgtatctgctctttattggcattgccatggcgatcacggtgggtgttatgacatcccaacgattgatgacaactactcattcaggcaggctttcccggtcttgtgccgtatcttgaccgaattaaaactccttggaaccaatgtcggtgtcattgtactgtctgccggtgtcggcaacgacgttgttggctgggtattactcgccctttgcgtcgctctcgtcaacgcaggaagcggcatcacggccctctgggtgctgctagtcgctgccggctacatcgtcttcctggctctcgtgttccgcccgttgttcatgcgcttcctgaacaagaccggaagcttgcaaaaaggacccagtcaatcggttgtgacaatcaccatcctcatagctctggcctcggcatttttcacgcaaatcattggaattcacgctatctttggaggattcatcattggcttgttatgcccccacgaaggtggtttcgcgatcaagttaaccgagaagattgaagacctggttgcggtcctgttccttccgttatatttcaatctttcggcctactccaccaatctcgttctgctcgtattcgccacagggctggcaggactcgcgctgcga

SEQ ID NO: 7323 - DNA, 504 bp, A.fumigatus
ttggaccaggcttcgatcatcattattctttgtcgcctgattcactggccgctttccaagctccgacagccgcgcgtgattgcagaggtcattgccggtatcgtcttggggccatcggtaatggggcggattcccgggttcacagaggcaatcttccctgctgcatctattcccaacctgactcttgtcgccaacttgggtctcgtgctgttcctgttcctcgtcggcctcgagaccgatctgcgtttcctcatcagtaactggcgcgtggcggcgagtgtctcagcggcggggatgattctgccattcggactcggctccgcgatctcgtatggtctgtatcacacgttccgaacagagcctggaatggctcatatcgatttcggaacgtatctgctctttattggcattgccatggcgatcacggtgggtgttatgacatcccaacgattgatgacaactactcattcaggcaggctttcccggtcttgtgccgtatcttga

SEQ ID NO: 7324 - DNA, 309 bp, A.fumigatus
ctcgtctttagtcacatcttgagattgtcactgctgcaactcttcttccgtgcaactacaattatggccgaggcacttacaaacacggatctccagggtgcgctgcccctgattgctcggggcaaagtgcgcgatctgtacgaagtcgacgacaagactcttcttttcattgcgactgatcgcatctccgcgtacgatgtgatcatggagaatgtacggctctacgtcttggatgcgccaatagttctccatattggatctgctaacgaatgtctcttcagggtattccgaacaagggtgttcttctaa

SEQ ID NO: 7325 - DNA, 453 bp, A.fumigatus
cgaatgtctcttcagggtattccgaacaagggtgttcttctaacactatgcacaaaagcatggttcaagatcctcaccgatgctattccctctctgcgcacgcatttcattaccctcgacctcccgccccagatccccccttcacttcggccagcccttcagaaccgaagcatgcaagtgcggaagcttaagatccttcccattgaagccatagtccgaggctacatcactgggtccgcttggaacgagtacaagaagtccggtaccgtgcacggaatcaaggtagctccgggtctgagggagagcgaagccttccccgatggcccgatctacactcccagcaccaaagccgaacaaggcgaacatgatgaaaacatccaccctgatcaaggtatgcatggtcctccttgctccgggaatgtttatcaagtttccgaatggattcagagctga

SEQ ID NO: 7326 - DNA, 573 bp, A.fumigatus
aagaggtcgaagaagcaaaagagaagcaagatgagtcgctatctgactccctcgaagatcgctcttctgtgtctaatctccgtttacaccgatggagtcgttcccaactcctccgcaattgatgtcctttcttttcttatgtcatgtctcagtcctttgggatcagatgcatcttcatctctaaacaggggagatagcaactatattgtcgccattgatgacctggaggatgccctttcatccaaagcttcctcgatccctggccgttcaatatgggacttgtttctcaagaagatctggtctattgattcttgcgacgctttggaagtatttttcactgagattagcgatatccttgtcaagtctcgagaagaacagatccgcgacagggataatggtctggcgcctgagactggtcgtatgcgactctcaagatgctcaccactcggtgcgttcgtgagaagagcccagctcgagtttactaggcttcagttccatgactccgtcaaactatggaagggctttgtcttcaccacagggggtcgaaggatccgcgctaagcgtataccgcaa

SEQ ID NO: 7327 - DNA, 219 bp, A.fumigatus
agatgcccgttcttggagccttcacttgcgacgtcgactgattcttattcgtctgatacagttggaaccctacgcctcttcagaaactctatcatcagtctggattctggaatcggccacaagtccaatgtgtctaccctggatgtgacgatttttaatattttgatcaacagacaagataaaccaattgaggagtttgtcactcactcctgttcatga

SEQ ID NO: 7328 - DNA, 354 bp, A.fumigatus
tcagaattccttaccatgatggctcggaagatgaaggacaccgactccgaagaggaaattcgggaagctttcaaggtcttcgaccgcgacaacaacggtttcatctccgctgcggagctgcgccacgttatgacctctatcggggagaagctcactgacgacgaagttgacgagatgattcgcgaggcggatcaggacggtgacggccggattgattgtacgttcatcaaacagctttcttctgtcgcacctcgatcttcatgggacatttcgctgattgtttctagacaacgagttcgttcagctcatgatgcaaaaataagcctttcatttggctgttttgttcattcttag

SEQ ID NO: 7329 - DNA, 192 bp, A.fumigatus
ctagtcgggtgtcaatacatatatccacttttcccgtctgaccttagttgctattacggtgtatccaataaatatggaatatggaccgcgattgactcttacgacccttctgcttgcatctgttggttctcctgtggagactccgacatgatcgctcttgtctttactccgtatgttgagcgatcttcgtaa

SEQ ID NO: 7330 - DNA, 252 bp, A.fumigatus
ccctgttccgtaatcaccttacctcccaccgacatgaagttccaaaccagcatcctcgccgccaccctgctggccggcagtgccctgtctgcccctaatggccggtccctggagcgtatccgcgcccgggctctagccaggcagtcccaccccatggacggccccggagcgagccctgctgaagcagaccccaacgcagagcaccgaaccgccgactgtcttcaccgcggggctgcaagggccgactctcat

SEQ ID NO: 7331 - DNA, 1674 bp, A.fumigatus
tcattcgggctctcaaagctcgggatcaaagccttcttccagcttgtccaaatccctgttagctcacttgatcacttattatcaagtctccaggataccttcacaaagaattcggaaatcgtctacgaacgagctatgcgaggtgagccagcttctgagctagtctcggagaacaagtccatccacgagaagatggatgctatacgcttaatgaaacaagagaaagaggaatatcaggcattcgaagcgaagcaggagagcctaaagaaagctcttatacaactaatatcacgaggctgtgacccacaaacgatgccggacgaacttgctcaaagtcgagaggtcacatcaaagcttcagcagattgaggagaagatgagtcgcctattgaggacggccggcattgacactgagactctgaattcaatgtctcgagacgcaaaaaagagtagctcgcaaccagctgcctgcgattcccgaccttgtactacgggttctttgagaaatggggacatggagtgtttggaaagggcgcgagaagttccccactctcacataatgtctccggtgcggaactcgtttgaccgtaatctttcacggacgagtgtagtcgaacgcacgtctgacacgtcattcaggacaccgggtggtggggataacgcgcgtgatgagttcgacttagatgacccgatgatctatgaggaacgtgaagcattcacgggaaccatgggaactccgtcacgcccgcttggcaatgtcgatgagtttgatctcgatgccgatgatgtggatatgctggaagccgcagaggattttgacgacggtctgaccttgacaaccaaaacctccggttatgaatctcgcagggtcttcgctgaaacttccgggaacgcctctcgtatacctgcaacgcagaagtcgcaaatccacaatccactgtggaatcaaaacccgtggacaaaggatgtgaagaatgtgttgagagataggttccatcttcgcggatttcgaatgaatcagcttgaggctatagatgctactttgagtggaaaggataccttcgtcctcatgcctaccggaggaggaaagtcactctgctaccagctgccctccattgttactagcggctcaaccaggggagtcacgatcgtcgtgtcgccgctcttaagtctgatgcaagaccaggtgtctcatttgaaacgactaaagatcaaagcgttcttattaaatggtgaaacaaagcaagaggagaggcagtggatcatgcagacgctgtcggggcctgcagctgaagaacagatcgaactgctgtacatcaccccggagatggtcaacaagagtcaagctctcatccgaagtctggagaagctcaatagacgacgcagacttgctcgtattgtgattgatgaagctcattgtgtcagtcaatggggccacgatttccgccctgactacaaagcgctgggagaagtgagagatcagttgcccggcgttcccatgatggcactgactgccacagcaacagagaatgtcaaagtagacgtcatccataacctgaagatggagggttgtgagatatttactcagagtttcaaccgtcccaatctgacgtacgaggtacgacaaaagacaaaatctgccgaggtcctggaaaacatagcggacatcatcaag

SEQ ID NO: 7332 - DNA, 414 bp, A.fumigatus
agagtactcaagtcaaacatcttactatgtatcatgcctccatccggatcccaagacaacaccccctcctgcttcaccgacacccacggggttatcaccacgacggccaacgacctcccgggctacaaaatcacgaaagtcctcggaacagtctacggtctcaccgtcagaacctgcaactggggcactgatctcggcgcgatcgtgcgctcgtctgtgggcggcgagctccggccgttcaccaatctgatgtatacatcgcggaatgaggccgtcgagcgactggtcggagaatgtatggggcgcggggggaatgcactcattgcgatgaggttcgatgtctcgagtattggggcttgttcgcaggtgtgtgcgtatgggacggcttgtgtggtggagaggtatgaggggtaa

SEQ ID NO: 7333 - DNA, 189 bp, A.fumigatus
cctctgattagcacgtatacgttcggaaacaaccatctagctcgggtgtatgagggtcgaatggttgacgctttacgcaacttctccacttctaaggcatctgcttcgccaaaccccagcggaaatgagcaacagtatgacaatgtttgtagcatagcaatttggggggtatacaatattcttctgtga

SEQ ID NO: 7334 - DNA, 342 bp, A.fumigatus
gggtttcggttctatatgtccagacttctggctagcctacattcgcgacactttcacactgagcacaacttccaagtccaagacacgatgaccgataaaatgaacgtcaacatgttcaaagcagaggatcccctctgtcaaccgtcttcctcgccggagcccccctacgatcctctcccacccgttgaagagctccccctcccatcaagctttgaatggggaacagcaacagcagcctaccaaatcgaaggcgctccctcggtggacggaaaatgccgtcaatctgggacacgttcacccatcttgttccatcccggaaccatggcgagaaacgtgacataa

SEQ ID NO: 7335 - DNA, 699 bp, A.fumigatus
aagacggtctttgctaagcgttggctctcaatcatgacgcgcattaccaacgtgcagtttgagcactatcaccctcctaacaccatcggagtggaggaaactcgtccgcggatatcctggcagttccgggattacccacctagtttccaacaggatgcattcgagattgaagtctcagaggtggcttggaattcacaggtcactgttctttcctctaccaggcagtcatcgccctcatcgtatctcgtcccctggccacattctcagcctttgatctcccgacaacaggtgtctatccgggtcagagcctgggatccagatgggcatgacacggaatggagtgagcccgcgtctctagaagttggcctgcttaatccgagtgattggcagtgtgagcgcatcgcggctccatggggcccaggtacttccaagcctgacacggagcagctatatcgcagggaattcaagctcgcggattcttttgtcaaagcccgtctctatatcaccgcacagggcgtgtacgaagcggagatcaacggacgccgtgtgggcgaccacttcctcgctcccgggtggacaacatatgatgggagactgcagtaccaaacctacgacatcacggattatctctcgactggggacaactgtatcggggttcgtgtggcagagggatggtttttctggtcgcattggttttga

SEQ ID NO: 7336 - DNA, 267 bp, A.fumigatus
  unsure (173),(220): Identity of nucleotide sequences at the above locations are unknown.
agcaatcgtttgccacacagatatgaagctcgtggggaaattctcctgttcctattcgctactcaaccagctgtaccagaatatagtctggagcatgcgcgggaattcttctccgtgcccacggactgtccccagcgtgatgaccgactgggttgggtcggggatctggcaanattcgcccctaacgcgctgctcatctacgactgtttcagcttcctanagaactggctaatcgatgttgcatatgaccacaatggtctgggttga

SEQ ID NO: 7337 - DNA, 312 bp, A.fumigatus
ggacacatgtttcaagcctcagggaatacctacagtcacaagatattgatgtccgcgcacagtagattgatgtatactaacatatataaatattttgagattgctaaagttgtttttatttctataacagctaaacgccctacacctttcgactcaagactagggatctatgaagtacaccactatccgagacttttcgcagataaccgacagcagattcatctgcatgagtcacgccttgcggaacatgttaagccgcttatcgatatatctgttactctcaatcgtttagtagaacctgaactactataa

SEQ ID NO: 7338 - DNA, 198 bp, A.fumigatus
agatcccctcgacgtaccgacgtccgtcccctcggagcatggggcggaggtggctcttcctcggatataatggcatatgtgggcaagatggccctcatggttggcctgcaagctgcgctgaatgcaagtgtgtggggggtgatatcaggcgctgcgattaggatcggcaagcgattctgtggttggggaaatctatga

SEQ ID NO: 7339 - DNA, 1197 bp, A.fumigatus
cacaaactaatccgcctggttttccttataggcttcgtgggaatgaacaacatcaaagccaacgattatctcaacgttgttgtccaggtcttggctcacgtcttgccaattcgcaactatttcctgctgcatcaatttcctgtacccggaacgccagagttggcccttcgtttcagcacattggtgcgcaaattatggaatcccaaggcttttcgctcgcatgtttcgccacacgagttgctgcaggagattgcgctccggtcatcgaagcgcttcacccttacccagcaatcggatccagtagaattcctctcctggtttttaaacaatctacacctttccctaggaggttcgaaaaaaccgtcgtcgaccccgacaagtgtgatacaggctgctttccaaggtcacttgagaattgagagtcaagccattactgcgcattcagatactcaaaacgcccgtctggtcttcaccgaatcaggcactatcaatagccaaaccatcccgttcctcattttgactctggatcttccgccaacacccctctttcaatccgccaaccgagaatccatcatcccccatgttcccctcacaactcttctaaacaagtacaacggaattactgcctccgagaagctggctcaccgtgtccgacatcgccttctgcatcctctgcccccttacctcttattccacatcaaacgattcagcaagaacagatttgtttctgagcgcaatcccaccattgtcactttcccgtcgcctcgctctctagatatgtcgccgtacgtggagcctaaccctgaaatctggccgcctggcgaaccgattctatatgacctagtcgccaacattatcctggatccaactgtggcagcgccaggtactactgaagatgctgcagagaagggcctcaccgctgcgggtggaacctcgtccgctggcgccggtgctggcagtgagagggtggcttggctggtccagctccacgacaaggccatggcagaggagaacagacggcaccaaagccaaggtgccggggagcagcaaggacctgaatggctggagatccaagatctatttgtcaagaaggctgagagtgagactctgttcacgcgggaaggctatctgatggtttgggagcggcgaaagatccctggtatgaacaaccggaaaggcaagggcgcggccaagtga

SEQ ID NO: 7340 - DNA, 306 bp, A.fumigatus
tcgtatgcggcaaatattcccagggcccgggtccccagatcgtatgcgtactttcacgctctcgaagttggacatcatgtcttcataaacatatcgacaaagaaggtttatgtccttcctgaaggttatgaagttaagagtaaaagtttggaggatatcaaatatgtggtagatcctcactactcaaaagaggaggtttctaaattggataaagaggttcatgatgcttttgatcttgcaggcaatcgttacagacctggtaagtattttctttcatttttatcggagatttctagcacaaactaa

SEQ ID NO: 7341 - DNA, 243 bp, A.fumigatus
cagctcaagtgggtacagttcatcaatatcacccgccctgagatccaaagcgacgtgtgccctacctgtagcttaagtacggctgagcagacgggaagctctgttttccacaccctatggtcgtatgtgccagaatttactgtgctttgggttatagtcaacctcccttctgctccctatgtactattaggatgttatactaccgatatatcacacctgagcccgaaatttgctactatatga

SEQ ID NO: 7342 - DNA, 198 bp, A.fumigatus
accaaccttgatgcacagctggtcaagcgcgctgaaagagtctcccgtctaggattgaccggaggcatcgtccagatgccggagggttgcgctccaacagagcagatcatggggagtgggatgaccgtgtactacttggtcgactctcttgacatggtcagttctttgtcgaatacttcaagattgatacctttatag

SEQ ID NO: 7343 - DNA, 756 bp, A.fumigatus
tccttccagccccgtggtgaagacattctggccaaggactactataccaatgcgtttggcgaccagaacctcaccaagcgtctagggctgccggtgatcccgctgtcttgcctctttttccgggtctctgtccaaacgtatcagatgttccttgccgccctgcttccgcaccagccttcgtcgacggccgttgagtcgacctccctcgcctcgattcacagccactacgtgccatcgccgatcccgtccgcgcccccgctgactttgcgtactatcctccctgtctctgccgcgcacgccagcgctttcttccggagggtgttggccaacgcgatgccgtcgccggcacaatcggtgtacattttcaccattgtgctgattctgacggcatttatcctcttgttgattctaaagttgcttctcggcatgcttctgctcgtgtactcgcgctcgcggtaccggaggatgaaggtcagggaggcggaacaggcagcgcacaagacggacagcggaagtgccaccggcccggcctctcggggacgcgagttcgcgattgaagggagccgtcgcgtgggtgggtgggggtcggtcgaggtgaacgacgacaagcggcggtggatctatacggatgacccagagggactgcgtcggttgaaggcgcgggaagagagggacaaggagaaggctgcgaaggagggcgaggcgtcgatggaccatgtgcagcgctacgagatggtggccaagcggatatggtag

SEQ ID NO: 7344 - DNA, 186 bp, A.fumigatus
cctcacctggcaacagcaattggcgcttcatggctgtttttccgatctctctacttgtacggctatgtgtactcgggtaagccacaaggcaagggcagattgctgggaggtttcttctggttttctcaaggcgctctgtgggctctgagtgtgtttggtgttgccaaagacatgatctcttactga

SEQ ID NO: 7345 - DNA, 699 bp, A.fumigatus
tcaacttttgatgatacaggtctcggtccctacatcgccgtcatcaagacacacatcgacatcctcaccgatttcagcgtcgacactatcaatggcctgaatgtgctggctcaaaagcacaactttttgatcttcgaggaccgcaaattcatcgacatcggcaataccgtccagaagcaataccacggcggtgctctgaggatctccgaatgggcccacattatcaactgcagcgttctccctggcgagggcatcgtcgaggctctggcccagaccgcatctgcgcaagacttcccctatggtcctgagagaggactgttggtcctggcagagatgacctccaaaggatcgctggctacgggcgagtataccaaggcatcggttgactacgctcgcaaatacaagaacttcgttatgggtttcgtgtcgacgcgggccctgacggaagtgcagtcggatgtgtcttcagcctcggaggatgaagatttcgtggtcttcacgacgggtgtgaacctctcttccaaaggagataagcttggacagcaataccagactcctgcatcggctattggacgcggtgccgactttatcatcgccggtcgaggcatctacgctgctcccgacccggttgaagctgcacagcggtaccagaaagaaggctgggaagcttatatggccagagtatgcggcaagtcatga

SEQ ID NO: 7346 - DNA, 210 bp, A.fumigatus
ccctccattcccacgatgtcgtccaagtcgcaattgacttacggtgctcgagccagcaagcaccccaatcctctggcaaagagactttttgagattgccgaagcaaagaagacaaacgttaccgtctctgctgatgtgacgacaacccgagaactcctggacctcgctgaccgtacggaagctgttggatccaatacatatgccgtctag

SEQ ID NO: 7347 - DNA, 1107 bp, A.fumigatus
atctgtacagaactgctctaccaacccctcaccctcctaaactgcctacacaccttctgcggttcgtgcctgaaagaatggtttgctgcgcaggcatcccgtcggcggccgtcttcatccatcccacaattcacctgcccagcctgtcgggccgtagtgcgcgacacacgacccaatgccaccgttacgacgctgttggacatggtcctcgcagccaaccctgagcgcgtcaagtcagccgaggagaaggaggaggttgcgcagagatacaagcatggagagtcggtgtttcctgtgctttcgtcttcgggccaggatggtacggcgtccgacgtcgaagatcgacggttgctggaggaggttcgtgaattgagtttgcgagagagcagggctggtacaggacaatcttcaagaagcaggcaagccgagagcgtcgacgctgatggacggagagcggacggtcgctcaagacgacggcgtgaggaggagcgtgtactgcggcgacagcctggggcccgtacggaggataactcggaaagaacgaggcggatcgagcatcagtccagtctgcgatcactgctcagcttttctgataccgaaacgatggaagaggagatcttgcgacagatcatcgaagacggactgctgaatggtatcgacctggataatcttgggccggcgcaggaagaggaactgactgagcgcatcgccgatgcttatcggcgaagacacatgcgacggccgcgctcacggcagagacaagaggcggatgaggaaccacaagcgtcgccgcgaccgcgtgcaagatcacaatctgtgcagagaccaccggcgtcgcccactccacaaccatcctcaaggaatccacctgtgtcgaggccatatctgctggagccacttgtctcgcgctcggaggggtttaatcatcagcgacgtctttcggatcaggggactcggaggaggaggacgtcgccggctcctgtcaatgcggcgtccacatcggagggacgccttgcgacctgctgcgagatcgtccagcgatatagcttcggatcgccctcgtccttctcagtcctctcgagctcgcgcggccgaattgtcgactgc

SEQ ID NO: 7348 - DNA, 237 bp, A.fumigatus
gaaggtgccgaggagatgcttgagcaccatcctggtcatgtctctgtggatacggcttcgactgctggatcttccggtgtggatgcctcaactggataccacgttggctccgatgggccgtggtctgataccaacccgaccgcagagttggtgagagattatgtggaggatgatacgacagaatggaagggtatgtaccgttggttctgggagaaacaaaagcatgaacaagagtga

SEQ ID NO: 7349 - DNA, 711 bp, A.fumigatus
ccagacgtcttggataacttctccaaacccacaccccagccaagcacaagcgcacccccacctgcaaccgcaccagcctccgcgactgaagacttcgacgaagacgccttcatgcgccagctcgaacaggacatggcgaagatgatgaaccacgccgcgcaggagtctggagcgccagatcacaaggagttcgagaatgcgatcaaccagggggccgacgcgttcacgaagcagcttgaggagagcgggattccgcctggtgactttttgaagcagctgctggcggatgtcatggcggaagaaggagagagcgctggcgctgctgccggtgcaggcgcacgcgtgggcccgagtgccggtggatcgtccgggtctgcgactggtgctgagaaagcgactgcgccagagtccttcaatgatgccattcagcggacgattaatcggatgaaggagtctggtgataaggctacggcggcggcaacggaggacggggggatctcggaggacatgctgatgcagctgctcaaggggttggaggcgggggtcgggaacgggggcgataatctcgatctcacgcagatgattgccggtgtgatggagcagttttccaataaagagatgctgtatgagccgatgaaggagttggatgcgaagtggggcccctggttgaaagagaataagggcaaggttcctgcggaggatatggtcttc

SEQ ID NO: 7350 - DNA, 450 bp, A.fumigatus
cctagtctatcggctgcacaaacccgtcgtagcatttgtcttgtggtgcctgtttttgacactagcatactgaatgccagattatacatactgtggtctgtgttccgatttggtcttcctctggtactaccatctacttacatgagaagcccatcagatatcaagcccaaccacatcatgttcggtatcgctgatgattcgttttcggcgactggaagagcaggagctcactcttcttgcccgaggaaagagctagaccggagaatcatctacgtctcccgggaactcagaatgccaagggtatggagcgctccagtcctctgtgactttggctctggagtttccagtggcatagagcactcggaagatattcaacctaatatatatcgcacacctgaggtgattgtggaagtcccctggacgtacagtgtcgatgtatgggacgtgtga

SEQ ID NO: 7351 - DNA, 1692 bp, A.fumigatus
tggcgcggctccttccagccccgtggtgaagacatgaatgacgacctgaagatgaaagattatcaaatagtggggattaactggttatccttgctgtttgagaagcagttgagctgcattttggccgatgacatgggccttggaaagacctgccaggtcattgcatttttagcgcatctgtatgaaaagggcataaaaggaccgcacttggtggttgtgccgtcgtcaacaatcgagaattggcttcgggagtttcaaaaattttgtccgacattgtctgtcatgccctattatgcagggcaagcagaacgcgccgtgatccgtcagaccattgaagataaccgtgatgacatcaatgtgattatcaccacctacactgtcgcaaaggcgaaggttgacgcccacttcttgcgcaacatggacttctgtgtctgtgtctatgatgaaggacatatgctaaagagcagtacatcagtgttgtatgagaagctgatacggatcccagcccgttttcgacttctcttgactggaacgccgttgcagaacaatctccaagaactggcttcactgctgggcttcattcttccaaaggtctttcaagagcgcaaggaagatctccagtatatctttgcaaataaggcgaagacagtggatgaatcccactccacgcttctctcggcgcagcgcattgaacgggccaaatccatgctcaagccgtttgtattgaggcggaagaagcatcaagtcatcgacctgccccgtaagacgtcgcatgttgaatattgcgagttgaacagcgcccagagggagatctatgagcatgaaaaggaagaagttcgtcagcttcttgctgaccgcgccgccggaaagaagactggtaacaggtccgccaacattctgatgaaacttcgacaggctgctatacacccactgttataccggcgtcattacactgacaccatcctcagtcgtatggccaaggcctgcttgaaggaggagcaatggtctcaatcgaaccccgacatcatcttcgaagagctgcaggcttataatgattttgaatgtcatcagttgtgtctcaatcaccctcattccctggggaaattcgccctcaaaaacgaagagtggatgaactctggaaaagttgataaactctgcgagttgctcaaacggttccaagagaacggggatcgaacactggtgttttcccagtttactctggtcatggatattctcgagcatgttcttgagactctccatctgggtttcgttcgcctggatggtcggacgaatgtagaggatcgtcagtccattctagatgctttccatgaacgaaccgacattcctgtgtttcttctttcgacgaaggctggtggcgcgggaatcaatctggcctgtgcgaacaaagtcgtcatcttcgattccagctttaacccacaggaagatgtgcaagcggagaaccgagcacatcgtgttggacagaccagggaggtagaagtcatccgccttgtcaccaaggacacgatcgaagagcagatttacgctcttggccaaaccaagttggctctcgaccaggccgttgcaggcgacgaaaccgagagcaagaagggtgaggaagctggaatgaaggtcgtggaagatatgcttcttgcaaagcaagaggaggtgaagacagatagcacgaacgcctga

SEQ ID NO: 7352 - DNA, 285 bp, A.fumigatus
gtgaccagctccatcactaagttgtctacagtccaatcgatttacctcttcatgaacgccatctcgtctgcaatccagcaaggacttacggcgttgtccactgatccgctcctgatctggaactatggattcgtggctgttctggcgtttgttgctggtaacctcttttacctaacccactattcgctggacaaggaggaggaccgactcaacaatctcgaggcttcggcgtacttgggtactaaccctggtgctcgagatgaaaagattgacccggagccgtag

SEQ ID NO: 7353 - DNA, 627 bp, A.fumigatus
gcatatgctgtacatcaccattatacacgaccatgtatcaaacatgggaagttttgtaaatctagacgccatatcccgacacaagatgcaaagaagaagaaaacaaagcaggacaggaagtctacccgactgaaagaacgacaaggaccccacgcttcacgtagctccaccaaacagaaatccacgagggacaagttcacttcttctccttctcctccttctcctccttctcctcgtgcttttccgtcggcgccggcgcagcctgcgcactcgcatcgtcttgatgctcatgaggcttctcatacagcggctgatgcttctgcttcaaccgctcctcctcagcagcaaccatatctttccacagatcgccactctgaggatcatgcgccgcagcaggggtcggagtctgagtcggcgccgcctccttctcgcccgcagccttcttccccttcttcgccgcatctagcaaccccttacccttcctctgatccgagatctcaaacgccgccgacgcaaccagcacagcgagggttaggccctgcgcatacacacgcgcctgcacgatcttctgcgaaccggtcaggtacgggttgcggctcaccatggcaaacgagccaatcatgctag

SEQ ID NO: 7354 - DNA, 792 bp, A.fumigatus
acaattactaacttgaatttcatcagagaggtcctcaagggcggcaccgtcggcggcatagtcggtctcatcggcggattcgcaggtgtggtggccgcctccaaacgctacgccaccatccgcaacctcaccctccccatgaaatccttcctggtcacctcctcgggaaccttcttcggtatcatcgcggccgaccacgcctcacgctcctttgaagcctcccgcaacgccgagcgccaatggtacgagtcccgcgaggagcgcctccgccaggaggagctggcggggatgagcttcatcgaccgcacgatggcctttgcgcgccgcgagaagtacaagatcgtcggcgccacgtgggtggctagcatgattggctcgtttgccatggtgagccgcaacccgtacctgaccggttcgcagaagatcgtgcaggcgcgtgtgtatgcgcagggcctaaccctcgctgtgctggttgcgtcggcggcgtttgagatctcggatcagaggaagggtaaggggttgctagatgcggcgaagaaggggaagaaggctgcgggcgagaaggaggcggcgccgactcagactccgacccctgctgcggcgcatgatcctcagagtggcgatctgtggaaagatatggttgctgctgaggaggagcggttgaagcagaagcatcagccgctgtatgagaagcctcatgagcatcaagacgatgcgagtgcgcaggctgcgccggcgccgacggaaaagcacgaggagaaggaggagaaggaggagaaggagaagaagtga

SEQ ID NO: 7355 - DNA, 300 bp, A.fumigatus
  unsure (127): Identity of nucleotide sequences at the above locations are unknown.
gggcaaataccttttccaggaactttgtggcccccctattcgcgttatggaaatgccctgaaagcccaccgtttcggaatcttgggaatgttcatcttcccttcggctaagtgcccgagaacaaatncgatactcatcaacccttgtacgcgacttaggggtagagccccatgcgcgaagaggaattcctatccatcctcgatgaagtgtgcaacccccaaccagccagccaccatcccggtgattaagtcccagatctccatcggcatccaaatgcccgaaactcgtgtcgcaacgtga

SEQ ID NO: 7356 - DNA, 405 bp, A.fumigatus
gctgaagaaccaggctggatgcgtgacccgctcttccgccacctataccggatccgcacgctcgagggcgcggctgagtcggacgagaggagcgtgaattacgctttactgttagcgggcgcggataacttcgaggaggccagtgggattgtgtacgaagcgatggtgagcaagctggtcaaggcgctgaatatatcgcaaggggatgttgatccttcaaagccgctccatgcgctgggcgtggactctttggtggcagtcgagttaaggacctggatgctcaagcagcttgatgctgatgttgcggtgtttgatcttatggaagtggctagtttgagagctcttgcaagcttgattgctaccaggagcggttatgtgaagaaggataatgggaaggagaagtaa

SEQ ID NO: 7357 - DNA, 216 bp, A.fumigatus
gtgtctgataccccttctgcagctgaacgatggatgggggaagaccaggaacattttgaggctagtacggactctctgtcttctatctggcttgatgagcggattcccctagggccaatctcatcctctatgcagcaatatgtctgtgatattgatctcaacaacttggtaaataggtgtatatcgatgcaaccggtagcttcatgcttgccctga

SEQ ID NO: 7358 - DNA, 1110 bp, A.fumigatus
gtcggatcatctcttgagctttctcaacgtcttgacgaacctatatataatatgccaacccagtcgaaccccacacaagattccacgattcctgagacaatgcacatcttcgatattcgccgatccaactctgtcactgagctatggaagcggtttgagtttaatccggctggccgggaaacagaagacgcaaagaaggcagtcgaatcgacatctgacaattctactcctccttcaccagacggcagggtatcgaatgctggtctggcctcaaatgagggttccgaaccgcttttggcagcatttgaaacagagatggccaagatcctaagcgcttcagagcctcgcaatacagacaatgctgaagagattccttcttctacggaagtgccaaacgagcctccaagctccgggagacgcacaaatcccgctctggccctggctcaggcaatgcaccaccttatcaacggagctgaaatgattggctccgaagtgaggtcaagattgccagagttggaacatcagttagagcatcatctgcagaacgcgcaaagagtcctgccagaaaacgtcgggtcgactgtccaggcagctcttgcgagtttggatgctcagatgaggaatctgaccaacgcactgaacaatgcaagcagtgcaagggatcggagaaccagcaacatgttccggggcgacgttcgcacacctgcagacgctgtagacagcctatataatatggcttccgagctcggccagatgggacacacactatactcggcctttgagactgagtttggttcccgtattggagcgagagacgcaagtcagccatcggatgaaagtctccaaaagtcgacgccgggtgacgaagctgcagtaaacggagatccttcggctgcagcttcggttttgagcactaagactgaagagacggcgaagatcccgctaaccgctgaagaatctgatacaacttcaagagggcagggaagtaaaaatcgggaggagccgcgatcatccagcaaccggacagaggagcctggtcgtgcacagcgcgtcccatcgcaacaggacgagccatcagagctcccatcttcacacacggccgccggaagg

SEQ ID NO: 7359 - DNA, 855 bp, A.fumigatus
ccgtatcgcatagcgcggatgcttccgccccctgtgcgtgaagaactgcccaccccggaaatcaacctctttgcagccggccacgacaccggcgtcatggtcttcaagctggagagagaaagacccgcgtcggccgtttaccaaaaccaattgttttacatcaccaaggagaagcatgtcaaatcatacgactttgccaagaatcttgagtcgccgccgatgctttcactacgcaagttgggatcaccctgggtgccgccaagaactctttcttacaaccctgctgagcgcgccattctcgtcacatctcccactgacggtggagcgtacgagctgatccaccttccgagggatgcaacaggcgcagtcgagccgacagacgtcaagcgcggccaggcatcttccgccgtcttcgtcgcccgtaatcgatttgctgtcttcagccaggctaatcaacaggtggacatcaaggatctgagcaactctacgacaaaaactattaagccgccttctggaactactgatatttactttggcggaaccggagctctgctcttcattacacccacttccgttgttctctttgatatccaacagaagaagcagctggcagagcttgcagtgagcggtgtcaagtatgttgtttggtctaatgacggactctatgctgctttgctcagcaagcataatgttactattgttaccaagtctctcgagcaagtgagcagcctgcacgagaccatccgcatcaagagcgcggcgtgggatgacgcagggcgtccttctttactcgaccttgaatcacgtcaaatactctcttctaaatgggtatgtattgatttcccttttcactag

SEQ ID NO: 7360 - DNA, 582 bp, A.fumigatus
ctatactcaactaactctcaagcagaccctctcgcctatcttaccgccaagtctcacggcttgactgaagaagctgaatccattctcgaagcgtgcgggttgaccgaagaccagatcacgctccccacaaccgaggagcctctgcgggtgcctcagcccattgtccctactttcaagtcgaattggcccgttaaggctgcagcccattcgtcgtttgagaaggcattgcttggagaagttggtgtggaagatgaggatgctgccgcccttggcctcgagcccgaggaggaaggcgaggaggccgttctggcccgtgagactcttgaggatgaagaggaagatgttgccggctgggacatgggtgaagagatcaacatggaggatgatgtcgacttccttaacgttgacagcgcagacgctggcgcatgcagctccgatgccgacctttgggctcccaactctcccctggcggctgatcatgtcgctgctgggtcttttcgataccgccatgctcctactcaatccgtcagttggtgcggtcaacttccctcctctcaagattcccttccccgatattattaa

SEQ ID NO: 7361 - DNA, 615 bp, A.fumigatus
aaaccttttagcgacaacggtataattcgtactttggaccacaccgtgtatctcgtcaaggtgaaaggcaaaagcgtttactgtctggatcgcaatgccaagcccagagttctcgaaatcgatcctaccgagtaccgcttcaagctcgccctggtcaagcggaactacgacgagatgctgcagattatcaagacttccagcttggtcggacaaagtatcatttcgtatctgcaaaagaaaggctaccctgagattgccctgcagtttgtgcaggaccttcagactcgttttgagcttgctctcgagtgtggtaacctggaagttgccatcgagatggcccgcgagctggacgttcggaagctgtggagcagactgggaatggaagctttggctcacggtaaccatcaaactgtggagatgacatatcagaagcaaaggaacttcgacaagctttcgttcctttacttgtccatcggtgattctgagaagttggccagaatggccaagattgcagagcatcgtggagacttcacgtctcggtttcagaatgcaatctaccgtggcgatgttgacgataggattcagatgttcaaggaagtcgatttgtgtaagtga

SEQ ID NO: 7362 - DNA, 636 bp, A.fumigatus
ccgaagaccagatcacgctccccacaaccgaggagcctctgcgggtgcctcagcccattgtccctactttcaagtcgaattggcccgttaaggctgcagcccattcgtcgtttgagaaggcattgcttggagaagttggtgtggaagatgaggatgctgccgcccttggcctcgagcccgaggaggaaggcgaggaggccgttctggcccgtgagactcttgaggatgaagaggaagatgttgccggctgggacatgggtgaagagatcaacatggaggatgatgtcgacttccttaacgttgacagcgcagacgctggcgcatgcagctccgatgccgacctttgggctcccaactctcccctggcggctgatcatgtcgctgctgggtcttttcgataccgccatgctcctactcaatccgtcagttggtgcggtcaacttccctcctctcaagattcccttccccgatattattaacgcttccacgacttaccttccgctaattgcggggcccctccttgggttaactatctgcgtacccccggttgaaagaaaactgacgcccgctaattcctggccctattttccctcggtattcttgataactctggcctttgttccaccttccgggtag

SEQ ID NO: 7363 - DNA, 375 bp, A.fumigatus
cattcaacctgccgtagaggatttgcatacattttgcagacttgcacaaaggaaggcatggcaaagattgcaggtcctaaagttgacttcaacgatcttattggagctgcgtcggcattgaaccagctctctaccctaattactgggtcttctaacgagtctgtaaaggaccctcagggccgcagatacgtccatcccctggtgttgttacacgtcgcaagggctagacaaaggcccaggtcttctactgaccaaggtcactcgcctgttggccacgacttcggctttcaaatctccttcgaaggaggcataaaatgtcaaataatgaactccgcagaagccacaaacttgaaaactcgaaagtctcaatattaa

SEQ ID NO: 7364 - DNA, 1482 bp, A.fumigatus
gttttcgccttctctccggtcgctcaatgtatcgacggcgattgcagtgatggtgatggtgatgtcgatgacgatgctaaatggtgggactccctgacattagggctggatgacctgtgtgtccgcttcattataaatttacctcgcgaagagctggagtccgtcgaacgaatctgttttcaagtggaggaggcacaatggttctacgaggatttcattcgcccgttggaccccgcgcttccctcgttatctctgaaagctttcgcgctgcgcatctttcagcattgcccactgatgtcccaatggtcccactaccatcatattacagcgttctcggagtttctggcctacaagacccgtgtgccggtacgtggtgccatcctgctgaatcaggacatggatgaggtagtgctggttaagggttggaagaagggcgccaattggagctttcctcgcggtaaaatcaacaaggatgaaaaggacctcgactgcgccattcgtgaggtctacgaagagactggttatgacgtgcgggaggccgggctagtgaaggatgaaaaggacgtcaagtatatcgagatcaccatgagagaacaacatatgaggttgtatgtgttccgcggcgtgccacatgatgctcactttgaacctcgtactcggaaggaaatcagcaagattgaatggtataagctgtcggacttgccaacgttaatgaagaaaagcaagccaaacgatgagaatatggcggttgcaaacgcgaacaaattctacatggttgcaccgttcatgcaccccctcaagaaatggattgctcaacaacggcggcttgacgcaaaggcgcaatcaggaggcgttaaacaacagtcgcagttggaaggagaaacatcaatggacgaggcctctcaaccggccatccaccagacaccagccaggcatgctgctcctagtgatttacctgaagttacttcagcagaggacgcctcttctcacctcaagcgacttcttaacattcactcggcctccactcagactccgttccctcctccacagacttctgctccggatgcttccaagtccaatgctctgctggaattgttaaggagcggctcctctcacaaacctactcatgaggctcccacaaacgaccaggaacttccccctaatgtgctccatgaggctatgcccccaccacatcaacctcaaactctttcggcaccagatttctttccagggttccctcagcaagttgcctactctggacaacatgacaatttactacatatttccgggcaaccaaaccatggcgctgctctttcacatttgccaactcccgtgcactcgcttggtgtaggaggaccccacgctgggtatcatggggtatcacagttttcaaatcgccacccatctgagttgcacgcagctgcgcagactcagaggccagcgccagcgccagctccataccagagaactggtgatgtcttc

SEQ ID NO: 7365 - DNA, 1353 bp, A.fumigatus
  unsure (1318): Identity of nucleotide sequences at the above locations are unknown.
tccagagcgctttccgacaaacatcgggcggaaacattgtaccaacttgactcgcaacttagggtaattgacccgcgacaagacgatctcctcgatacggtcatggcctcggcaccgtcgcattcttcgcagaaacggcctctacctgctgagccgaatcccgtcctccacgcatcgcaaacacaatggctcttcacagatgaagaactcactcgtacgccatcccaactcgacggcatgaagatggaagcggaacatactagtcgcagcaaaggcgtcaatttcattacccaggtcgggatcatgctgaagctaccccagctcactttggcgaccgcagccgtctaccttcaccggttcttcatgcgctacagcatggtcgatatacctcaacgaccgggtatgcatccctatcccatcgcggccactgcactattcttagctacgaaagtcgaagagaacgttcgaagaatgagagagcttgtggtggcctgctgccgagtggcgcaaaagcaaccgaatctggtggtggacgaacaatccaaggagttttggaaatggagggacacaatcctgcaccatgaagacttactcctggaagcgctctgcttcgacctacagctcgaacagccgtaccgcatcctctacgattttatctgtttttttggcgtgaatgacaacaaaccgctccgcaatgccgcatgggcctttgtcaacgactccatgtttaccgtcctctgcctccagttcaccgcacgcaccatcgctgccgccgctctatatgccgccgcgcggcactgcgacgtgggatttccggacgacgaccgcggtcgagcgtggtgggagcagattgacgtggatctgacgcaggtgcgtcgcgcctgcatgaggatggcacagctctacgagaacaatgccatgcagaaacatagccagtactacccgaccaccccaatactgtcggacgagggcactgagaagaccaggatcccgcacgatggcagtcccgcaaatcttcctccagcggagtcagacgtcactcatggacggaaacgatcgaaagagccggaagacagcggcgagcctcgaggagatggctcagcaccttccaacggagagcgttctccaaaaagaccacgcagggatgcggatgccgcgccacgtggcagctggcaggatcaacagagcccatccgctccttcctcgcaaagcctgccaaacgcaggaagcccttcctcctcctctcagggccgaccccatctcaacggccaggcacctccgtcattacctcatccccccgtccagcccggccaccgtnttctaccgaagggacggcaaggacacgcattcaag

SEQ ID NO: 7366 - DNA, 423 bp, A.fumigatus
cccgcaatttcattgacaaaccagtgctctctaccagccatgcgtagatcaagctctagctctcactcctggcagtctgccctgcagaaggtattccgcagacgctcatccgagtcgaagggtaaacaacctgctttggatgatgatttcaaaatcggtgaacacaaggacggcttctacaagtactcccaagaggtgctggaaaagaaaaacagaaagttcgaacctcccacgatgcgtgctctggacagtgctgaagtttacgacatgcgtgcttatagcactgtcagtagcactgtcagagtttctcgcgtgcgtggttcagacagtaccgaaacttcttacgcttcagctgtgagtggacgcaacatccttagctggcagtttgccaaaccagagcgaagggaaaaaaaactaacatag

SEQ ID NO: 7367 - DNA, 228 bp, A.fumigatus
tccttttcaacacgcccgagccaattcaaaaactccggctgtgcaccacggcaggtcctcaacttcaagactctcagcctaggattcctctccacaagcatcgccaactgccatggcgtgatgcctgatcgttccaatatcagagtctcaaggccagtgacccctatgtccttggggttccctatgcccgctagtaagttccaagcagtgctacctggcgcaggatag

SEQ ID NO: 7368 - DNA, 1944 bp, A.fumigatus
agacgctgtaacgacccacttcgagtcacaccgcttcctaaaccacccgctttgaacggtttggcctctccggaacacacatttggccagcagcccagtgggtcgtggcaggagacattctacaatgctcggaatagtactgtgggccgtgtagtcagaaaggttttcagttatgcttggtcaaccgtcacccggctcttcaaaccaagcggcgtttcatctcgtcgaaccgctgctgctgtgtcaacttcccccactcgggcaaacctccgtaactttccagagcagcaaagacagcaacttaagagtcatcaatggcggaaggaaagagggtatcctactgttgaacactatccatttccagaactgtcccttgatatcccactctacccggctggcgctgcttctcaggccgaatcaacggcggaagttcgcggtcgttccgtatcaaagaagcccagtggaaccccgcggcagcctcgaaagcgtattggaacatcgggacctcgtactgtttcactcaaggaacgagggaaacatggaatggagaagcgagcgcgtgtggattcgctcagtccgcgtctcaaacgacgcctgctcgcgggcacccgactcagtcgttggagaaatgctcgtcgtgagcgcgctctggcccatgcacttgaaacaaccgaacatgatgcagttcggccagtgcaaacatctgcccaggcgttgagcatcagtcccattgaatccagacgctctacactgattcagcctcgagctactattgagccaaaatcgaaaccgaagcgcgtccggttccaagagcctttgacagaaactcctaccctcacagctccaaccctcctaacggaacttgcccctcacctcaccccaccctcccctaaaattgaccgggttgcccatagaacagaacagattgttgaagagaaagagaatgtgcccccggcgcccgaagctgcaaagacagtggaacatgctgcgcatgacgacgaacttcgaaccagacatgatgactggcttcgtaccgagtttccatttgggcgacccgtgtccgcagttaggcttttctacccagttcagaagccacttccgccaggtcgcacagagtctatttacgcggctgaatggagaaagatcgaagaagaacaaaaagcgaagcaaaaacctgtccgagtcaaaccggagggccctgctgtccgacctctccctccaaaatgggaagcgaaagtgtcggagatcaagtccatgccaaacaatcggcagatcgccactaccctgtccggcgatcctctgaccaagagagatcttgccacctgctacactccaatggcatggctgaatgacaaaatcatcaactcgtatcttgctctgatcgttgactacttgcgtcgttctcacggaaacgccgggcgtcatgacaagccccgattccacgcatttaacacgttcttcttctcaaatttgcgcgacaaaggctaccagtcggtacgccgctgggcaacacgtgccaaaattgggggagaggctttattgaatgttgatactgttttcatccctgtgcacaacagtgcgcactggacattaatcgtcgtcaagccaggagagagaaccatcgagcacttcgattcccttggttctctatcccggcgccacgtgggcctggtgcagggctggctacgggctgagctcgcctcccgttatgttgaggaggagtggacagtgctcccgtccatctcccctcaacaggataacgggagcgattgcggcgtcttcctcttgtcgactgccaaggcggtggccatcggtctcgagccactatcatacggcgctaaggacattggcgtcctgcgccgtaagatagtggctgagctaatgaacggcggccttgaaggggatttcgatcccaccagcgggggtggagaaccgctgctttaa

SEQ ID NO: 7369 - DNA, 273 bp, A.fumigatus
tcgaacatcgcttcgtctctccagctgggacagggatctatctggtgccgctatgcatccggttcttcctataatcagttacatgtggaggctcgggcgaagatgcctttcttcacacatctatcatgcaatcaaggtcgagtggctcattggaccttcggagtggagtcttctgatgtgccatattatgctaccagcaggtgtatttatattgaagaagttcccgccagaacttctctctcgcattgcctttaccatcactcctcattctga

SEQ ID NO: 7370 - DNA, 246 bp, A.fumigatus
  unsure (156),(157),(178),(187),(232): Identity of nucleotide sequences at the above locations are unknown.
aatctcgcgtttgggcaaactattgtttcccctcctaccgccacattggacggaacgcgtggcttggacggtctctatgttgtcgtcagtcggtgtcccctgatacgcatgaggcctgcatggtttggtgctctgcgaatttggtgcctgacatcnntcgatagtgcgtgggggttantaggacatnacgggtttttaattagtcctaagcccagagcccttttgatcaacnagatgacgacttga

SEQ ID NO: 7371 - DNA, 537 bp, A.fumigatus
agaagttcccgccagaacttctctctcgcattgcctttaccatcactcctcattctgagccgcaagtgttcttctaaggataccatgcccccattcgcgttcaagggcctcgccttaatagccctaggtactgcagtcgcccaggcccagctctggaaccaaatcattcagaccaactatggcccagtccaaggcttcaagtacttcaacgagtctacgcttgagagattctttggagtctcggagtccaatgtgacggctttcttaggcattccctttgccgcggataccggttatcaaaaccgctggaaaccccctcagccacgcgaaccgtggaatgaaactttgaaagccaccaggtttggccctcgttgtcccaccggtgagtccagctacatcagcgaagattgcctgagtctgaatctatggacgaatgccggctccgcggatgctaagctgcctgtcatggtctggaaccagggctcggatgagaccagcgatcagtcctggtggtatggcggcgggatggccttgtag

SEQ ID NO: 7372 - DNA, 309 bp, A.fumigatus
gatgtcatcctcattaccttcaatcgcagagatgatgtgttcggatacctggcgcatccggatctgaatgcagagggtctggcagtcactggtcacaatacatccgggaactatggtgttctcgaccaacttgaggtgctgaaatgggtgaagaagaacatcgccgacttcggtggtgaccctgaccgggtggtagtggctggtcagtcctttggctcttccccaggtgtatcatgctgtgaacagtccactgttcaaaggttacttccatggtggaatctctcagtccggcatccgatacccatatga

SEQ ID NO: 7373 - DNA, 198 bp, A.fumigatus
ttaatacagagacacaggcctctatctagcttctttataaagagtactggtgctactactgggctagataattccctaatctaccccttcttaagtattttattaaggtatttatatagagcctctagctctagctataatatagcaaatagggggctatatagcagcaacttcccattaagtagctatatcttatag

SEQ ID NO: 7374 - DNA, 183 bp, A.fumigatus
agacatgaacttttcgaagagtccctcgagcaatttgtggtgagtactgtcagccttgcaattattgagccgacgcgaggtttccatattgtctttgagacgttgtcttacctatctatagactcgagtgctatcctagaggcgctacccgatggacagaacggcaaatatctttatacgtaa

SEQ ID NO: 7375 - DNA, 456 bp, A.fumigatus
  unsure (28): Identity of nucleotide sequences at the above locations are unknown.
acgctgaccaaaaggttcgccatgtttntgaatcaagtcgaggcctccgttgggcattaccgacgacagtcgcagcctgtccagggcatgaacggcatctcgcgaacccacagcaatgcgtcgagcaacacgatcagtggcgtcactggtcggtcaagagcggacagcgccgtgtcgcaagatgacccgttccctgacaatcgtggctctatggcgttggactcccttgctaatgagctggaggcattgcgcagtcactgggagagtaccaaccgcaactatcgactgagcacgcaatcggactttgatcgaactcctaccaaggagacccatgggttgagtgacagtctggccgagtggcggcgcaaactggacgaggaggaagcaagagcaggctctccagagaagaataagcctcgcgcggcgggggaacaagccgcagcgaacatgatctag

SEQ ID NO: 7376 - DNA, 1041 bp, A.fumigatus
ccaccgccgcctggggaacccaaggagtggcttaaaacccatgttaagagcggagaccccacagaacgcctttcggccgggattggaagggcctcctccttgaattccgaaacgtctatccgtcaaatgcccgaccagcgagtggttgctctggaagctcaggttgacagggttaacaaactggccaagggcaaccaagctgcggctgatgaggcagccgacaaaatgaggcgagccgaagagaggatcgctgggcttgaggcctaccaagagcaagcaagtcgagaaggcctgcaacttcgcagacagctgcaagccattatgaaggagagccaagcgcatgctgcggagaacagagagctcaagtcaaagatggagaatcaacagcgagaggctggagccttggccatccaacacgccgctttgaaggaccttctcgcagagcgtggagtcagctatactgacagcaggcgttctcccaggctggaatccccaggctctcggttcggtacgcccgagcaaacccgacttcgtgagctggaacagcaactatcggctagcttgaaggctcatgaagaactcaaagcatcctttgaaactcgcgaacaggaagcggaccgtgcgtacagagagaagctggagcaactggaaaacgactaccagtctgctgttcactatgtcaaggggaccgaaaagatgctcaagcggatgaaagatgaattgacccgctataaagcacaaaatgctaagattcaggccgatctcgaagcggcgcaaagaagcataagtcaggcatctggcctggggtcagaaccaccagcggaatgggaatctgaacgctcgaagctgcagcagtccatctctgacttgcagcaagatactgcatcttccattgccaacctcgagagtcagattgcgaacctgaaggaggacttgtctgccgccgaggctgagaaggacaaatcgcggtcagaatatgagagcgtcaaacagaagttcattgctgcagcggagaagattcgggcgaactggagcagctga

SEQ ID NO: 7377 - DNA, 306 bp, A.fumigatus
agcagaatgatttcaaacgtcgatggacagctctcctcaatgactgcgatctggctactgccaattgcaagctgcgttgtggcttcagggactggtgcagtcgttgcagaccttcttttcaatcctaatcatgctttatggacgattattgtcagctatgttctatggggagttggcatctgcttatctatgattgtttatgttatctacttccaacggcttactgtgcacaaattgccacataagggagttatcatgagcgtgttcttgccgatgggacctttgggatccggaacctttgcgtaa

SEQ ID NO: 7378 - DNA, 333 bp, A.fumigatus
tttacacctaatccgtcaggtttcagggccctgaaactcggtacagctggaaagactgttctatcaaagactcaaatgttgaatgacagctctgccgcctccatagtttatgtcgtaggcgcaatgaccgcactgatcctctgggcttttggtcttccttggcttttctttgccttcgcatcggtgctgaagtcaggaaggtttccgttcaacatgggttggtgggctttcacctttccagtcggtgcgtatgcgatgggaacatgtcagttagggaggcagcttgcctctgcttttttcaaggttcttgggaccagtagtttgcatgaatga

SEQ ID NO: 7379 - DNA, 204 bp, A.fumigatus
ggacatggctttaaaatgggcatcatggcctccctggacccctggtcagaatacagcttcggcattctggataactgtcttttcttctcaggcttagcaggagtctcttgtcattgctcgttcggcccaaaaaggagacttccgagccctatttccccctacagaatccgaatcttgaaaaagaacctaatctaccgcagcatc

SEQ ID NO: 7380 - DNA, 222 bp, A.fumigatus
ctttgcagccccattttctggttatgcaatggccaggccaacaacaatctcgtcagtcaggcgtcgtctcttaagacatacgggatgccccatgatatgagtatgtcgtcaattgagcttgttattcgagcgctgtctaatgtttatagtgggcctcttcaaccctctgaccattttgattgccgtccctctattgtatgttgcttcacttcattccacgtc

SEQ ID NO: 7381 - DNA, 198 bp, A.fumigatus
  unsure (151): Identity of nucleotide sequences at the above locations are unknown.
tcccaaccttttgagaatgtgataaagcaaatttgtgccccacggcgtctagaccaggattttggcgttgccattatgttatgcacagaatggagtatattatctcggatcatttcgactctgtttgaagaggatgaaatcttattcaacnacaacaaccccatcagcatggacatccattcgcttatcaatctatag

SEQ ID NO: 7382 - DNA, 231 bp, A.fumigatus
attgtgcaccaaacacggagaagattcagttaccttgacccggcgttcctacgccacgttggacgaaattctacccttctcacactaaccgaggagggacgcgacaaactcggcggtgtggaatatcgagccgtctgtctgctgactatcattgtgccagtttactatgtagcctggccgccatcagtatctgcatcgtggaggcgggtaattttatccgtgatccggtga

SEQ ID NO: 7383 - DNA, 888 bp, A.fumigatus
cacgaccagaactggctgaacaaacccgacggagacgaaggatgggcgtcttactctctctcgcaaggctacgaatgctatttgcttgatcacacctcccgtggcaggagtccgtgggattcccgaaatggacagctgaggaaatacagcgccgagcatctgcaaaagtactttacggacacggcaaaatacaacctctggccacaggcgagtcttcacacccaatggcccggaaccggtgtgatgggcgatccgattttcgattcgtactatgcgtcgacggttccttcgcttgccgaaaacgctgctcaagaggcctccatgcagcctgcgggcgctgctttgttagacgccatcggcaagccggtgatacttatcgctcactcccagggaggagcaatggcgagggttacggcagatcggaaaccggatctggtgcattccatcgtatcaattgagccatccgggcctccattccagaatgcaatttttgggagtggaccagcccgtccgtacggattgactgatataccgatcacttattcgccgccagcgactgatccagacgcggactttgttaagcagacgatcacatccaactccagtgcaatatcagactgtgtgatccaggctgacgaccctcccccccgacagctcgccaacctgtctaaaattcggactttggtcgttacagccgaagcatcatatcatgcgacacacgactggtgcactgctcgatttctcaaacaagctggagttccaacaaagcacctgcagctacgggaggtcggcatccatggtaacggacatatgatgttcctggagaagaacagcgaccaagtggtcagagcgatacacaattggatcgaggattcaacattttcatga

SEQ ID NO: 7384 - DNA, 603 bp, A.fumigatus
gaaattccctatgcggtgctcaagtcggacttttgccgttatctggtcctgttcgggcgaggaggtgtctatagcgatcttgatgtccacctcgtccagccgctgccatggactgtgatgggttcggaagaccggcatcatcgtccgccgaatgtgattattggcctggaaggcgacgcgaccaccaaaggtctccctcgctcgccgcagttcgtccagtggactatggcatcgactgctttgcaccccatgttccgagatctacttactcgtattgcggagagaacgcccaactttgtgaaacaggcgcaggccttggagggtgatgctgaggtcaacgttatggactggacggggccgagtgtatggaccgatactattctcgattacctgggttgttcggaggagcaaatacaaaacctacgcgacttgaaggacccggtgcgaattcgcgacatgatgatccttcctaaacgatcatttgcggtcacgcagggggaagatcacactttacccgatgtgctggtgaagcactatttcagcggcacatggaagggttgcaagaaccactggcatgggtggagcctaccatggctgtgttag

SEQ ID NO: 7385 - DNA, 216 bp, A.fumigatus
atccatcttttcctcaaccatttcttagcgactacatacaatatgctcattgtacatcatctgcaacgatttcaatccgagcgcattgtctggctgtgcgaggaactgggcatcccctacgagctcagaacctaccagcgcgatgcaaaaacccttttagcaccgccagaattgcagcagttgtacgggtctcccggaatcagccgatcgaagtga

SEQ ID NO: 7386 - DNA, 495 bp, A.fumigatus
ctgaatccatcttttcctcaaccatttcttagcgactacatacaatatgctcattgtacatcatctgcaacgatttcaatccgagcgcattgtctggctgtgcgaggaactgggcatcccctacgagctcagaacctaccagcgcgatgcaaaaacccttttagcaccgccagaattgcagcagttgtacgggtctcccggaatcagccgatcgaagtgaaacgactgattcgtgtcagacatcccacccaagccgcccccgtcatccaagacggcaccaccaccctcgccgaatccggcgccatcgtcgagtacatcctgaccaaatacgggaaggggaaattgaccgtgcctcccaccgcagacaactacgcagattacctgtacttcttacactttgccaacggatacttccagcccgcgctggtggggtactccacggttcctccgatcggagatctcccggtcttcaccccgcggctggaaggaacacgt

SEQ ID NO: 7387 - DNA, 1608 bp, A.fumigatus
aaggtagcgttttcgttaacctcttcttggaacaactctttgcttaatggggcctatcatgctaggttcgaagatcaccgtggtggggagagctatcgaccgccagctcctcgaggttacagtcgtcacgcatctcccacacgaactcgttcacctcggcttgtcgctgatacatgggtaccctcccctagtcgacactacggccgtttaaggagtcgttcaccgttacctttcagacgtcattctcggagccccccttaccggcacagagactctgagcctggactatttacaaacagtgccccgaggagattctcgcctagacgagatgcacgcctccgatcgcctcagattgggtggcgcccgcgttcaccatacggcgaccgccctcgcgatacctctcgcggtcggtctacccctagacgaagagatcaaagccctcttaggcaggactttacctactcgaatcgagagcgctacccatcaactgtcgatcgttacaaaaagtctgtttctcccctaaggcgggttccaggtcgtgccagtgatatcactcccttgacgacaagccatcgtcgacgaagttcttcacaagagttccgagagcgtcgtccggataacaatacaagccaggcgcggccttcgccttcattgagggctgcttcaactatccacaactcaacttctagctctcgtacggactcaagacgctcatctccattattgaatgacaggaccagtgcgacggtgcacgaatcgagaagcaggtcaccaatgactagagactttccgcagcgccgcctgtctgtatcttctgattattcctcatctcgccaagttgaaacaatctcgtcaaacgaacacaaaggtgaagaagaggcaacagatatgccgccaacctcagtgcaaatcgctgcacagtcaaatgatcgtagtgtccctgactccaagctggggcgtccagagaataacccggagcctgcggatgcaatttccagcactactcctcaaagtggaccgagagccgtctgttcctcgtatggccagactgcattgcccaacatatctgcagggcccaagccgtcattcaatgctcggggctccatgatatccctactttctgccccgactcgcccccgaggaaatttgaatccgaaggactttgctcgttctactcgtcgtggacaggtgtcaatctcgcaagcagcccctcccacaggcccgcgcaatggtcacatcccgactggtccgagtgttgactccgatcggcagcatatctatcggcaaaacagcttctctgggacgtcttatccccgccaaaggcccaccaattaccttgccagcctcaatataattgtcccaggaggcagatttctgacacacgatctggatactgctgtggaaaaaaggcttgcccagttagagatggacaaagaacggctatatgaacaaattgccgatagccaaaggctaaagcacgttgtcattagagactgggagaggctagatagagagagctctatttgtgccttgaagagtgagttagccgagggtcatttgctatgtataactgatggcgagagcatgcatacaagtaccacattttga

SEQ ID NO: 7388 - DNA, 312 bp, A.fumigatus
ggagtcgttcaccgttacctttcagacgtcattctcggagccccccttaccggcacagagactctgagcctggactatttacaaacagtgccccgaggagattctcgcctagacgagatgcacgcctccgatcgcctcagattgggtggcgcccgcgttcaccatacggcgaccgccctcgcgatacctctcgcggtcggtctacccctagacgaagagatcaaagccctcttaggcaggactttacctactcgaatcgagagcgctacccatcaactgtcgatcgttacaaaaagtctgtttctcccctaa

SEQ ID NO: 7389 - DNA, 705 bp, A.fumigatus
catcacctaatctggtactctgacgcgtatcgccatacgctggacatcatcccggtcgggaaattgaggaatcatcatacgattcctttctatatcatatttgacctgaacatctactctccatccactccattcaacattcaatttaaaatacaaatggccgtcacactatcaacgactccctccatgaacaagcgctggcctcctctggccgacaagacctccctcccctacagactcactacactctctaagcaaaaactcgcccgcgaggccaccgcgcccgacccggacatcagacgatgcctcggccactttcgcctccactgcacgtccatggaatgggcccagcgggatatgacctctcgcatcaactcgtttgatctcgactccgactcggaggacgaggaggagacacaggacgatgaggttcaggaggttgtggagcgtctggccgagaaggccagcactgttaccatcactgactccgcggctaaagaggagacgacgcttcatgtgagctttgaagtcgtatcaagcgcccctgctactactcctactccctctacaccaccaccaacaacaacagaacaagaaaaagaaagtctcctagaaaaaggtcgcagttgtctggaaaggacagtccagatgaaacatttctggcctgctcgtgggccctgtctacctgttcggatcgccgggtaa

SEQ ID NO: 7390 - DNA, 249 bp, A.fumigatus
atatttcaaagcaacagactcttgatttcctccactgttcaaactgtcaagccccaagccacccaacccaacgagtcatactccgtactccataatcctatccgaatacccggggtcccatccacccaaggaactaagtcgtcagctcctacctttcaaaccaatgatataaatctcatgaactcaatcatcgcccaaaagagtccgaacaacgctataatccaactaaactccacagatcacacatgg

SEQ ID NO: 7391 - DNA, 735 bp, A.fumigatus
cttagcgcggattgccatccccggggtgaagaccctgccatctctccctggcgcacattcacagccgaggatcgcgccgaggccaagccccgcgacttctccaagatcaagttcgacgccattctcgtctttgccgactctcgcgactacgctaccgacatgcagctgatcatcgatctgctgctagctgaggacggcaagctgctgacccgcgccaaggaccctgtgtcctcccgcatccccatctacttctcccagggtgacttgctcatgccgaccgaccacaagggcccccctcggttgactcagggttgcttccgtatcgccgtcgaggcgcagtacaaggctctgaccggtgtcgacctggagcgtgttgtctacggcaagcccgagcgcgccacctacacctacgccgacgaggtgctcaaggcctggatggagcagatccacaacgagaaccgcctgcccaagaacatctacatgattggtgacaacccgcagtcggacatcgtcggtggtaacatgtacggctggaacacctgcctggtgcgcacgggggtcttccagggcggcgagaacgacgagcacaaccccgccaactttggtgtcttccccaacgtgctggaggctgtcaaggctgccgtccgcaaggaacttggccaggagttcaagttcaagtggaaccccaaggtcaaccctgtcacccacggcgatggctcttccgctgtcgaataa

SEQ ID NO: 7392 - DNA, 207 bp, A.fumigatus
gctgccatctcggcgctgaatttactgcagagcaacttcgccgccattcagcaggtgaataaagacaggaagaatatgaatttacggtccattccggagaccatcgagtggctccgacgcatcgggtacaaggtgcgtattcatcccatctgtgatattagtttggcagagccttgctcacctaaaatacgtatggccatgtactga

SEQ ID NO: 7393 - DNA, 1173 bp, A.fumigatus
tggaatgtctataaaattgtgcagccctctgatctggaccaactaaatctcgttcacatcgcgggcacgaaaggcaaaggctcaacttcagcttttgtgtcgtctatcctttcccaatatactgtctcgcagtcacccgagttggaaagctcttccccaaaaatcaccaaagttgggttatatacctcccctcacttgcgatttgcccgcgagcgcatcaaaatcgacaatgcccctctttccgaggaaaagttcgctcaatactttttcgaggtatgggaccgcttggaggaggctgctcgagtggcaggggagaacccttcagatccacagacgaaaccacaatacttccgttatttgacactgatggcatttcatacgtatatcagtgaaggtgtggatgccgcagtgatcgagtgcggaatcggtggggagtacgattgcacaaacgtgattgatcggcctgtttcaactgccattacaagcctcgggatcgatcataccgctttgcttgggaacacgatagatgagatagcctggcacaaaggtggaattatcaagccaggcgtgaaggttttcagttcacctcaaccccccagtgccgaggaagtactacacaagcgtgcgcaggagaagggaacgcagctgcagattgtgtctgggcatcgtgaactccatggcggcagtgagctcaagcttggccttgccggcgactttcaatatacaaatgcatcgttggctgtagctactgccgccgagttccttgcgaaattgggacttgaagatatccccccggactttatggagaggcctctaccacccaagtttcgcaagggattagaatcggctcgattgggcggccgatgcgagaccagacgtgagaaagacatcacatggtacatcgatggcggccatacactggagagcatcaaactggctggccaatggtttgcttcccagattcagaataattcgtcatcgagcgctgcagctaagaggaagctgagtcttctgatcttcaaccaacaaacgcgcgacagtaatgctcttgcccaagcgctccatgaaaccctctcaagtgctctagggtcggagagcccatttacccatgcaattttctgcaccaacgtgacctacaaggacgccgggtacatacttcgaccacgggctgga

SEQ ID NO: 7394 - DNA, 1017 bp, A.fumigatus
  unsure (140): Identity of nucleotide sequences at the above locations are unknown.
aatccatcccaccatccaagctttaattgttctttatcccgattcaatacagcccgttgccgtgccagaagtagacgacaccccgattgtgaatacgtaacggcctccttgagacgagtatcgaccaccgctaatatacncaggttccttgtggagcagattgtggcgttgaattgctttggctgtcctctcctgtctcgcgagtctcatcgacgcaccatgaccggccaggcgcaactggaccacgacgagcagaaattccattcctgtggcgtttggctcctggcatcctacatcaaccattcatgctgcagcaatgcgcggcgttcatttattggcgatatgatgattgttcgtgccgcacaagatctcgccgcgggcaccgaaatcaccttctggtatcaatcacccctgaacagcgatttccccgagaaacgaatgaacctgcagcactggggcttcaagtgtgcctgcgcaatatgccaagatgcgcaacagaccgagaagagcattgtgatgacgcgaaagaaactcacggctgatttgaagaaagagatccaatgccgcaagaagccaaacacaacgacaatcacggctctcctctcccggctggaggagacatatcgacagcccgcctctgaggttcctcgtctcggcctttggagaccatattggaatcttgcaatgctgtacgccatgcatggacagccacagaagacaatcgagttcgcgctgaaaactctggaatcgctgggctacgttgttgaaggcgggcaccttccccgtatctcagggacaccactgcgggtcaagcaatggggattaatgacagatagtcttgtcgggtgttggatgagtctctcccatgcgtaccagcaggtcgcccctgacctagcgcctcaagcgcacgagtatgctcggattacatatcggatctgtctcggcgaagacgaaacatttgacgagacctacgcgcaggtatcggagcggtcatatggtttccttgccggcgagtga

SEQ ID NO: 7395 - DNA, 252 bp, A.fumigatus
cgggtgacgcttagtatggacgccgccacagccacgtcaatgcagcatgtcctcgaagcggaatgccgggactgcacggtgcttgccgtcatgcaccaactccagcacgtcgaacggtaccacctggtggcgctgatggatgctggccgcatcgtcgagttggattcgcctgccgccttgctggcgcgagactcggagttctcgaggttatcccgtgcacaggctgcgacggggacaaggcagcttacatga

SEQ ID NO: 7396 - DNA, 429 bp, A.fumigatus
  unsure (352): Identity of nucleotide sequences at the above locations are unknown.
cacccccaggaacgatggccccccggctctgaactccgtttccctgcagattcctccaggcaccaagctcgcatctgcggcgctccgcagcggcaagtcctcgctcatcctttgcttcctgcgactcttagacatccagcaaggcaccatcaccgtcgacgggatccacctcgcgaccctggacccggcgagtctccggacccgcttcggcaccgtcccccaaacaccctacttcatgccgggatccatccgccgcaatctcgatccgcacaacaccgcctccgacgccgatattatccgcatcctgcaagctatggccctctgggagcgggtccacgcgctgggcggcctnaccgccgaactcagggacacggactggtctgcgggcgagcagcagttactctgcctggggcgtgcgctgctccgtag

SEQ ID NO: 7397 - DNA, 537 bp, A.fumigatus
  unsure (375): Identity of nucleotide sequences at the above locations are unknown.
atgaatatttccggaagaaataacacccccaggaacgatggccccccggctctgaactccgtttccctgcagattcctccaggcaccaagctcgcatctgcggcgctccgcagcggcaagtcctcgctcatcctttgcttcctgcgactcttagacatccagcaaggcaccatcaccgtcgacgggatccacctcgcgaccctggacccggcgagtctccggacccgcttcggcaccgtcccccaaacaccctacttcatgccgggatccatccgccgcaatctcgatccgcacaacaccgcctccgacgccgatattatccgcatcctgcaagctatggccctctgggagcgggtccacgcgctgggcggcctnaccgccgaactcagggacacggactggtctgcgggcgagcagcagttactctgcctggggcgtgcgctgctccgtagaagtcggattctgttgctggatgaggcgacgagcaggtttgtttccggccccttgccctcctctgtcgtggtcatggtcatgtag

SEQ ID NO: 7398 - DNA, 207 bp, A.fumigatus
  unsure (97),(98),(171),(175): Identity of nucleotide sequences at the above locations are unknown.
cggatttttttcgttcttctttgccatggtctctcaacatttttcacaggcaacaattgtctcccaaagttgttttcctctgttgaagggttttccnntccaaaaaccacttggaaaaacacctccaatttgcaaaacccccattcccgtgtgccatacaagaaagctccnccanaatttgggggcgcaattattttcttaaaccaa

SEQ ID NO: 7399 - DNA, 1110 bp, A.fumigatus
  unsure (1005),(1006),(1079),(1083): Identity of nucleotide sequences at the above locations are unknown.
acgatggcgtccacttcagcgaccaatggtcacgaacccgagaaaaggtccaagttggagaaccaaagtcctcctcggtttactgcggtaaatggaagggaaatcacagcgccaacgtccgttggccctactgcggccgactcatcaagcaacgaagatataccgaataatcaaggcagagtcgaactcgacgctccatctcgaacggaagaacgccctagagacaatggaaacaccgaaattgacccggacgaacgatcgacgcagtgttccacgtcccatagcgattcattatcaggaggacaaggtgcaaacaagaggaagagatcagaaattgatgagcgtcaagaacttctctcatcatcttctaaaggctcccgaagtccagccatacggtcagatgctgctgtggagtctcacacccaacagcttgctgtgaacttcgctataacacctcctggctctcatgatctcaagcatccatcaccatcaatcgctcaatcagacagaaatgaagattcacgatccgcctcagcaaacgcttcattgaacgactatgattcacatctggtacaacaggcacagcgcgcacagcagattgatccctcagatgctcagttggtggaggtacttcagcgcgagtcccaggatcatgatggacaaagcttacagcagaagaactggagtgcgacgaatcgctcgacagagggatctgcgcaaaccaaagagccacaacatgctttttcacaagaacagccacaagcggctatacaagtcgcgcctaaaagaaagcgcgttttcagcaaccggactaaaactggctgcatgacttgtcgcagaaggaaaaaaaaatgcgacgagcaacatcctgcgtgtaagttaatccttgcgacatctctcatagatgacggatttttttcgttcttctttgccatggtctctcaacatttttcacaggcaacaattgtctcccaaagttgttttcctctgttgaagggttttccnntccaaaaaccacttggaaaaacacctccaatttgcaaaacccccattcccgtgtgccatacaagaaagctccnccanaatttgggggcgcaattattttcttaa

SEQ ID NO: 7400 - DNA, 222 bp, A.fumigatus
ccaataacactttctttctttatattggccatcattcattgcgcgctgttgttgaaagaatccaagcaatctcaaccttcttcctctattgcctcccaccactcaacaactcatccaatctcctatcttatacattgtttaacctattatgatcattcaactagtatcttcaataccgcaagtgacctcttagtgcagcgacaaggcatcgaatccgaataa

SEQ ID NO: 7401 - DNA, 1476 bp, A.fumigatus
agacatgcgctcgacggcgcccttggtgaagaccatgctgcgttcggtgccgccgtcgccgtcgaaccggctaaagatgacggacatcttcttgacggtcgagtcgaaggggaactcggccttttggtgccagacgggacgctcgcccttggtccaccggtcgcggttccagttgaaccgcgccgcgaagacctggatggcgatctcggtgggctcgccgcgggcgtgccactcgccgtcgtcggagcggtagacgtgcgacaggttggccatggccgcgacgttgaggaactcctcgagccggggttcctgggctgccaattcgtccagtttgccgatcaccacggggccctcgttcgcctcgtcgaagcgcaccggtggcaccggggcgaacatcacctccccgacggtcgggttgaacggctcattgttactgccaaccgagtacgtccccttggcggggatccacgccttcttgaccaccatcttgccctgcgtcagggtgcccgtcttgtccgagcagatgtcggtcacggcgcccagcgcctccagggaatcaagcttgcgcacgatcacgttccgctcgaccatgcgcttcgtccccaccgccatggtgatggtcaacacgacgaccagacacgcggggatcatactcagcccggtcccgaccgcatacagaatgacctcgttgctactcacgaatttgttcgaggccatcacgataatcgcaaacagcaccgcgaccccaaacagcaggatcgccagcttggacagcttgcgctgcagcggcgtcccgacattaacgcccaggaaccggccgacggcgtccgtccccgtcagcgtccacgcctgcagataccaccgtttcttggtctcgccgttggggcccctcttgacgggtcggcggcggcggtcgcccgcgcgcagggccgcagcgatcgagccaatctccgtggccatgccggtggcaatgaccacgccgcgggctcggccgcgcgtgacggtgctggagctgtaggccaggttgagccggtcgccggggccggtgtcttccttgaacacggcgtcgcagtctttctggaccgggagggattcaccggtcagaagggcttcgtcggtctcgaagttgactgcttccaccagactgttctggtcagctctcccgtcgagggcactggacaggttgtttcggggtggggggcataccgaatatcagcaggaacagtatcccccgtgcgcaactcgaccatatcccccgggacgatctcggcactgggcaccgaaaaggtctgtccaccacgggagaccgtccccgtgggcgagctcagggaatgcaacgactccatggtcttctcggccgcatactcctggaagaatcccaccacgatgttcagcacgatgacggcacagatgacgccgccttcgatccacgactggatgccaaagctgaccgccatggccaatatcaggacctag

SEQ ID NO: 7402 - DNA, 765 bp, A.fumigatus
acgtgcgacaggttggccatggccgcgacgttgaggaactcctcgagccggggttcctgggctgccaattcgtccagtttgccgatcaccacggggccctcgttcgcctcgtcgaagcgcaccggtggcaccggggcgaacatcacctccccgacggtcgggttgaacggctcattgttactgccaaccgagtacgtccccttggcggggatccacgccttcttgaccaccatcttgccctgcgtcagggtgcccgtcttgtccgagcagatgtcggtcacggcgcccagcgcctccagggaatcaagcttgcgcacgatcacgttccgctcgaccatgcgcttcgtccccaccgccatggtgatggtcaacacgacgaccagacacgcggggatcatactcagcccggtcccgaccgcatacagaatgacctcgttgctactcacgaatttgttcgaggccatcacgataatcgcaaacagcaccgcgaccccaaacagcaggatcgccagcttggacagcttgcgctgcagcggcgtcccgacattaacgcccaggaaccggccgacggcgtccgtccccgtcagcgtccacgcctgcagataccaccgtttcttggtctcgccgttggggcccctcttgacgggtcggcggcggcggtcgcccgcgcgcagggccgcagcgatcgagccaatctccgtggccatgccggtggcaatgaccacgccgcgggctcggccgcgcgtgacggtgctggagctgtag

SEQ ID NO: 7403 - DNA, 384 bp, A.fumigatus
gccaggttgagccggtcgccggggccggtgtcttccttgaacacggcgtcgcagtctttctggaccgggagggattcaccggtcagaagggcttcgtcggtctcgaagttgactgcttccaccagactgttctggtcagctctcccgtcgagggcactggacaggttgtttcggggtggggggcataccgaatatcagcaggaacagtatcccccgtgcgcaactcgaccatatcccccgggacgatctcggcactgggcaccgaaaaggtctgtccaccacgggagaccgtccccgtgggcgagctcagggaatgcaacgactccatggtcttctcggccgcatactcctggaagaatcccaccacgatgttcagcacgatga

SEQ ID NO: 7404 - DNA, 1221 bp, A.fumigatus
tattcggtatgccccccaccccgaaacaacctgtccagtgccctcgacgggagagctgaccagaacagtctggtggaagcagtcaacttcgagaccgacgaagcccttctgaccggtgaatccctcccggtccagaaagactgcgacgccgtgttcaaggaagacaccggccccggcgaccggctcaacctggcctacagctccagcaccgtcacgcgcggccgagcccgcggcgtggtcattgccaccggcatggccacggagattggctcgatcgctgcggccctgcgcgcgggcgaccgccgccgccgacccgtcaagaggggccccaacggcgagaccaagaaacggtggtatctgcaggcgtggacgctgacggggacggacgccgtcggccggttcctgggcgttaatgtcgggacgccgctgcagcgcaagctgtccaagctggcgatcctgctgtttggggtcgcggtgctgtttgcgattatcgtgatggcctcgaacaaattcgtgagtagcaacgaggtcattctgtatgcggtcgggaccgggctgagtatgatccccgcgtgtctggtcgtcgtgttgaccatcaccatggcggtggggacgaagcgcatggtcgagcggaacgtgatcgtgcgcaagcttgattccctggaggcgctgggcgccgtgaccgacatctgctcggacaagacgggcaccctgacgcagggcaagatggtggtcaagaaggcgtggatccccgccaaggggacgtactcggttggcagtaacaatgagccgttcaacccgaccgtcggggaggtgatgttcgccccggtgccaccggtgcgcttcgacgaggcgaacgagggccccgtggtgatcggcaaactggacgaattggcagcccaggaaccccggctcgaggagttcctcaacgtcgcggccatggccaacctgtcgcacgtctaccgctccgacgacggcgagtggcacgcccgcggcgagcccaccgagatcgccatccaggtcttcgcggcgcggttcaactggaaccgcgaccggtggaccaagggcgagcgtcccgtctggcaccaaaaggccgagttccccttcgactcgaccgtcaagaagatgtccgtcatctttagccggttcgacggcgacggcggcaccgaacgcagcatggtcttcaccaagggcgccgtcgagcgcatgtcttcaaccacg

SEQ ID NO: 7405 - DNA, 372 bp, A.fumigatus
gtcctgatattggccatggcggtcagctttggcatccagtcgtggatcgaaggcggcgtcatctgtgccgtcatcgtgctgaacatcgtggtgggattcttccaggagtatgcggccgagaagaccatggagtcgttgcattccctgagctcgcccacggggacggtctcccgtggtggacagaccttttcggtgcccagtgccgagatcgtcccgggggatatggtcgagttgcgcacgggggatactgttcctgctgatattcggtatgccccccaccccgaaacaacctgtccagtgccctcgacgggagagctgaccagaacagtctggtggaagcagtcaacttcgagaccgacgaagcccttctga

SEQ ID NO: 7406 - DNA, 1002 bp, A.fumigatus
cagcgtgtaccaggtgccgacaggtacgttccttttcgagaattcatcaatcatcatctttcatctaccccgcctgtcgaatttctcgttcctaagctaagggttacgaagcgaaaatctaggtgcgatccaggtattccgagatgttccccatgcgaacgcagtaacgccaagtgcgtatactacgattccgcccgcaagtgcaccataccgagaacatacattatctccctgcgcgaaaaagctcgcatgttagagaaagaattggccgatctggagaaagatattcagcatgctgcagatgccgagctcatggtccgaggggcaggacgcattcgattcaaagagaatgacgagtcgaggtaccttgggccgtccagcggtatcgcaattactcgtttggtcatggagatggccaagcagaacacagactcaaaaagcatcaaagatgttgttcctgagttcacagcccaggagatcaaagcagcatttgcgctagaaagctctaaaccgacatcgaaagtctaccccatgatcagctcaattcctcaacctaatctacccccgcgtaatctaacttatcgattgattgatgtatttgtagtcaagggtgagttctgcctctctaaaccgacgattcctggtgcatcccgtttgaccatatctgcagcgcaagccatgctaccgacactgcacgagccttcttttcgccaggaggttgaacaggtcttcaatggctctgatgacccttgcctcaatttccaactccgtatggtcattgccatcagcatgcaaaaaatgagcaccgagtatgcagggctggctgacagttactacttggcggcactaccatacttagaggcctcccttagacgaatggatctcagggctttgcaatgcctcgtcctcatagcccaatattctctactgacacccccaaaaacgctgccttactgggttgtggggaatggaggtcaaactctgttcaagactacggtctga

SEQ ID NO: 7407 - DNA, 228 bp, A.fumigatus
tcctccgatgcaaggaagaggggcgtagtggtacctcctcggtccagatcccacagaggcgctaagtcaagtgatgagccaacgactagggactcagcagggagctacgcacctgcgggaggtaacattaaccatttcttttattccacccaccccgacgctcaagatcactacactccaaggtgtatctacgtgcacttgttgcatcattatttcgatatccaatag

SEQ ID NO: 7408 - DNA, 258 bp, A.fumigatus
gcgcggatcctgccagcccctgtgagtgaagacaagcagccctttttcattaatccaagctctgataaagctgcagccatgaaggtcgtatctattggttcaacactgtacacttctctcgagctgacatcagccgaatcccctattttgatcctcgcaaactatcccgtcgggccattaattatcttcttctcggaatatcacttccgccaattttggacgtcaattcatcaccgtcggaatacttacgcgccttaa

SEQ ID NO: 7409 - DNA, 210 bp, A.fumigatus
tttcttgttctcgaactcacgctgctcaccgaaaacccttcggctcatttcaagaacagtttcgaaaccctctctgcctctcttggcattttggctgaacctctcgatgctagcctcctctaccttattcttgattttctgccagccgccgcaaagggcagtgattttggcctcttgactgaaatccgtgaccaactctggtttcgatga

SEQ ID NO: 7410 - DNA, 438 bp, A.fumigatus
cctgaacgccccattcagttgcgtacggaacgcctcatcacttgtgatcaatcagtaccgcaatgggttctctcattgttcgggggaagcgctacttctcatgtatacgaaatctcatatgttgatcctggcgcaaagaaggtcactatgtgctcaacaaatcttacgtggtctaacgtcttgaacgtgagagaaactgttatttaccagccttcgtcatcgaaaccagagttggtcacggatttcagtcaagaggccaaaatcactgccctttgcggcggctggcagaaaatcaagaataaggtagaggaggctagcatcgagaggttcagccaaaatgccaagagaggcagagagggtttcgaaactgttcttgaaatgagccgaagggttttcggtgagcagcgtgagttcgagaacaagaaattacagtcctga

SEQ ID NO: 7411 - DNA, 348 bp, A.fumigatus
gtgctgaaattccatattgcaggagatatattgctcttcagaatgagtgactcgatctatactaattatcctccggaactgaaccccgcacagaaggacttcctggtaaagactatcaaggactgggctacgcaaaatggcttgatggtccgacctcatctttcgttcgtttcgaaagagtctgacccgtatggtgtattggccacgaatgctccagtgacgttatttcccagtctgttcccacgggcatgcttcgaagaggccaaggcgttgcagaccgtgtacaaccagctttatgccgcaattacatgtaatgaggaatggcttggcaaaataatggaagagtaa

SEQ ID NO: 7412 - DNA, 2532 bp, A.fumigatus
  unsure (794): Identity of nucleotide sequences at the above locations are unknown.
gattccattaacaaattagccccaccagacggaatggaagctgatgatggagatcccctcgactggacagttgacgaggtagtagccttcctctgccataatcctgagacaccatggtcccagtctgcgtcgcaggcccctcggccaaaccctgtccaattcgaagccgctcttcgagaacatttgattaccggggaggtgctgttgcatgatgtcgacaaggagactctgcgggatgagcttggactcaaagctatcggccatcgtagctctatccttatggcaatacgttaccttcagcgacgttctcaaaaataccagagttctagggtggagcttgcttcccagctcgataatcgtcggtattcagttaccccaagtcacctaacggctgttgttccaagccctttcgaagaattctcatcaccgatccatcggaactctgcgctaccaacagtgactcctcaaaatttgatgcaatgccctcgttgggtgaccccctcagcatttacagtatcccaaactaaaaggacctttccccgggatgccgcgacttcgggtgagctgaggggcaacgagtctactacgacgacagttactactacaggcagtgaaagtgcaaccactaccagcgagagacgtccaagcatcgccccacctgcagaacaacgtacagacccatccaaccccggcgaacgcgtgcgagcttatgagcacatcgtggttgatgctgaaggaaagaagcgacgcaggctggatttgagctctctgcccgactcacaaaagaatcttcntgcctcgaagtcttcgaacgctccgcaagacaaggactggtacatggacccagatcggattctgctttcacaattattctatccgtctatttctgatgatgatgatgatcattcgtttgtaatgcttggtcctccgaatctgcctaccgctcagcgccactttgtcagaaaatgcatgaattatttcctcaggcagaagcccatccagttgagctctgataacgaaagtagtcggatggctctgatcccatatgaccactcgagtgcgagcgagcacgacaagaaattcttcactttgtacactgccacacgtggaaatgtgtcagtcacacaagaggacataaagaaatggccccagttagaacaaacaggggctgccggttcgcgactgtcgcaaacactggaaccatctgacccttattcatatcttcttcagaaatatcccgctgctgaagacaaccaagacgtctgtccattatacggtgactcgggttcagaaggagagtttgatgaagaaacttggcaggaaattgataatgaacgcaatgatgctgtccaaagtaaaccggcaaagctgacttccgctgaggttgactcagtgattgaagattgtatggctgagtttgtgaaccggtggcgccagaatggcctaccaagagaggagtataaggcccggaagctttgggtcacagcccgaagggcgaagtgtacgtaccaaaaagtcaaggccatcaatcgcgatattaccttgctggagaaacggttaggcaaagtgctcgaggcaatacgcggaagtgaatatgcctcaaaatctgagctacaaacacaatgtcaaagcatggagcagactgttatcgatatacagaagcagaagtggcgtatctcggtcctggaggaagagaagtgtccgccaaaagttgctcctgcccccagaccaaaaccattgccaaaaccaaagcctagcgctgcggatgaggagtctctttactccgagtccgatgtcacttctgatttccaggatgacttcattgacgagtccgaggctcaggaagaggtctcgtctgttgaaaactttggaaacgtggacagcatcgacagagggtatgtgccggcgtcgacgccctcaacgtccgaaagcgatgatgacattatcagtccttcgggaatcagacgtaaatcaagggccaagagatcgcctttcatggcaaccagctcaccatctcctgccccctctggaaacgcacaacaggcagagatcattgacctcacaatggattctcctccagcttcagcagacgaattcaggatcgaaacaccgcccctcaatcctgtgcgaccacccaggttgtcagaatcggacgacgttagcttgaaggtcgaacgaagtccttcaatatctcctcctccccgactcagctccaatgtagttgttgagattccgaggcgaagaccagaaatcacaaatcagaaacctgaagtgacgaaatcgtcgcacaagcctaacaccccagacctgcctgaccacaatgatttcgatggtctgctgtcctacccttgggaacttcttgaggaacgctacgatcgccgtaggttgcttgcaaagttaattgcgaccatgccggactgcgatcgtgaagagatggcttcattaatacctgaatacgaatatgatgagttgaacgaccttgtcaaacaggctctcagagtcctttcggaaggccaggaggagatagtcttc

SEQ ID NO: 7413 - DNA, 750 bp, A.fumigatus
gatgactccataataatagatattcagcatatctcaacctgccttggaatccagcttctctttctccagtccgctatcaccgcccacacaacaatgatggaaacacagaccacagcaccggccctggcgtcatcgcgccagtccggacgcagctccgagagcagtagctccgtggacgtcattgcgcaagagaagcagaaggtagccgcagcagcagcatcatcaaagacctcgactgcaagtaaagaccgtccggacctgcacaattcagcttccccgaagcggtggaagaccttctgggccgccttccgatacctgcagcacctgacgcccaagcaggttgacgacttcatggcgtcatatgtcatctataaccttgactggtcggacgagaagcagatgatcgagacattggggcctaactaccaggagaaagtcggcgactgcctcaaggcgtactatggggtgttgaatcacctgtgtgcgctgggcgacgtggagaagatgtacattccgccgttcatgagcaagaaggcgaccgtgctggagaaccagctgctgtacgaggaatcgatcgcccgtgacatcgggcttggtcccggcgacaaggtgttggatttgggttgcggccgcgggcgggtggcggcgcacatgacgcaattctccgggggtgcccaggtcaccggcatcaacatcgacccgcaccaggtcgcgcatgtcttagcgccgccgatggaagatgtattgctc

SEQ ID NO: 7414 - DNA, 213 bp, A.fumigatus
cctatcgacgtcgctcttcctgaaaatctgaccgtcgtcaccgagatcctcaatgagtttcgagtatacgtctcggggtcctcgcatactggcgcaattgatatgcgctacttgaacagtgtcgagtcccagcccgttacatacctctcggaccatagcactcttgccggtacctgggggcccgctgacatacagacaaccgccctttcttga

SEQ ID NO: 7415 - DNA, 546 bp, A.fumigatus
gcaggtttttacaagttggtgctgacgacagcagatgaaaatacaaaacccatcgagttcaaaaccccttcaaagtcaagataccgagacgccctcgaatcgccgccagtcaccccgaaacacagagtgcaggttggcggcaagtcgatgactccgcgcacacctcgccagatatccagcccatcatcttctcaaactatttatacggctgctaggcagctattcgcgcgaggggcaacttccggccgattggtcggacgggacgctgagcgtgaaaagctgacctcatttatccaggaacgtgtgacctcaagaaagggcggttgtctgtatgtcagcgggcccccaggtaccggcaagagtgctatggtccgagaggtatgtaacgggctgggactcgacactgttcaagtagcgcatatcaattgcgccagtatgcgaggaccccgagacgtatactcgaaactcattgaggatctcggtgacgacggtcagattttcaggaagagcgacgtcgataggctaaaagcccttgtttcttcctga

SEQ ID NO: 7416 - DNA, 1077 bp, A.fumigatus
aagcccttgtttcttcctgacaagaaacatgatggtctattcttagtcaccttggacgagatcgaccatctgctcaccgccgatgctggagttctacagtccttatttgaatggtctctgaacaacaaatcgcgtctgatactcatcggaatcgccaatgcgcttgatctcaccgatcgctcattgccacaattgaaggcgaagaacttgaagccctgcctcctaccttttttaccttacaatgctacccaaattgcgaacatcatcaccaaccgcctccggtctttgcttccttctgatcaggatgtggaaccgaattttgtaccctttgtccagcctgcagccatacagttgtgcgcgaagaaagtcgcatcccagaccggtgacctacgaaaagcgttcgaactcgtcaaatgtgccattgaccttattgaacaagagacgctacaaaagctggagaagcagagctccagtgttgatggcgcctccaaaaccatcctggttgaaaataacaacctctcatccccggccagaacttcgatatccaagcagaaccccaccgcaacatatgatattcttacggcaccacgcgcaagcatcggacatatagctcgcattacttcatctgccttcggacaaggaaccgtccaacggcttcaggcgctcaatctacaacaaaaagcggctctctgctctctcctcgccctggacaggaaacggcgcgagagtgatctctcttccacgccgtccaaaaccaagatgtcagcgcctactattaaacagatcttcgatacttattgcacactgtgtcgaaaagacaacatcctccatccgctgacggctaccgaattcaaggatgtcattagtaatttggagacgttaggcctcgtcggcgaattccagggccgtggccgaggtggaacggtttcgggcggctctgatatcagacgcactccctcaaagtcgggctgtgggccgatgactccacgaaaaggaatggatgagcaaggccttatttgctttgtttcacagaaagaaatcgagggccagattgctggcctgggagacggaccatca

SEQ ID NO: 7417 - DNA, 183 bp, A.fumigatus
caacagcccctggacccatccacagcctctctgccaccccaagggaaccagcggactggtcgtcttgccattgacagcacctccagtgtctatgtgagcaacgtgctctgggctagtctagacgacgaggtctttctctacccccaagtttcaatttcgataagacctgtccaggagctatag

SEQ ID NO: 7418 - DNA, 621 bp, A.fumigatus
attgaatacctgcgagatttgctgcacgaattctcatcgaagaacaatgacgatgacgaggaaggggtttggcacgaagaaacagatgagaaagagggaccggtcagcgcaatcgggctgaatgccgccattatgggcttcaggtcgctcgctcactccctgcgagactaccatccgtccatctctcaatcagtcgccctgtttgagatcttccagaccaatgtcgctcccgtggtgaagatcttccatatgccaaccctgacgacgcttttttggaacgcagtcgcctcgcttgacaccctcgattgcaacaccgaggccctcctgtttgccatatactacgctgcgatcaccagtactatcgaccagacccagtgtcctctcggtctaacgcgaccgcaggccctttgtacctgtcgttctgccgtcgagcaggccctcgcctgtgctgatctgctgaatacccaaaacatggttttgctgcaggcagctgctttgtttctctgtgccttgcgccatgaaaaacactcccgaactctctgctccctgacagcctttgattgtacatatttgcacaggcgaatgggtctcctatctgaacggcgtggcctttgggcttaa

SEQ ID NO: 7419 - DNA, 207 bp, A.fumigatus
attagaatagcttcaaatattaaaatatctaaaattagtggttacggtgcaattggtggttacggtgcggcgcaccctcaacgcggaagcggtgagggtgcgtatggcacggatactgttctatataaagcctctctacgttgtagggtaatgccattgcagctgattgagttgatattgttgtatatacatgttccgtccgtttga

SEQ ID NO: 7420 - DNA, 861 bp, A.fumigatus
agacaggaaatcggttctgcatggcccctctaccgttcactgaacacagctattgaaaagttgtatcgcctcggaaacgtgccggggccgtcattatctttccaaccgtcctgcgaggacagcttctcaagaaacaggcatgccttgtccgacactgtatccaaaattgcgactacaatgggtgcagcgccaggaacccgaaatccaccagacggcagccgaacacactccgacatccgaggattccagcctggtgcgggcgattccgactctacctccactatactcggcataagcatccctgtcgacacccaatatatgactcccaaggatacgacgatggatactgatgacctttccatgctggatatatcctttcagcaacaaacggggggcgattcttctaattttggcaagtctaattcgacaaatgagctaggagcggcactgcttccatcagctcaaacccaccctcatccaccgaccccggattcttcaagctctaatccaatcatacatggcaagtccaacgtccatgaccggtcccaacaaccaggaccaaattcgagtagggaccttggtatatctatcaccgatggtcagaccacgcccggtgatattgatgctatcttcaaagaccttgcatatctggacacgactgattgggctacaagtcgtgaggcaggcttgaaggattttgggtttctagacgacagtacattccatgccttttgtcatgatcctgatcgtttggttggatcccagccactgcttcacccgccgtctattgccgacatctggcctcccccaggatttttccccgagaccttccaagaatctaccgacgacgtagaaagttga

SEQ ID NO: 7421 - DNA, 771 bp, A.fumigatus
cacaaatttctccacccacaggccatgaacacgcgatcccacttgattccgtccatcgcaaagtccctagcttcagtgctgaagacaacgagaaactcgtctttgcaaagcagaatcaacgatctccaagctttgcataatcctcgaacagacgcgtctcacgcaccagggtccaccgactctagagcagcaatacagaccgccctctggaagatcgcccacaagcaactatatgattcccgtgcttcgcggaaattgagtgcatcagatgccgtgactacttccgccgatgattacagaggagccgaggaggatattttatcggaagcaggcatcgatgactttcacgatatcctaaacagtgagaatcacgaggtatgcgattccgatagttatgtgggaagcaattctgagtatcttgagtttatgaatgaagacgaaatgaactctatcttatcatttgacggaaattattcacaccattcaattgatatgctgggacatgacgatacagaacttgatcaaattcgggaagaccaggcaatagttgacgatacccagggcagaaccacaatacccgtgctcaatctttcagagcaactctcctgccacttttccctcagtgatggcgagatgctggcatcggactgttttgaagatgagcctacgagcccacaccttcttccctatagctctagcttctcgggggcttgtgagtcttccgatgaggactgtgacctgatgctgtgtgaccacaattgggttctataa

SEQ ID NO: 7422 - DNA, 516 bp, A.fumigatus
cgactgcgattcttccaggcccggcggcaagatctggctcgcgcaaagaacggcaccggcaagacggcagctttcgttatccccactctagaacgcatcaatcctaagagcacaaagactcaagcgctcatccttgtaccaacaagagagcttgcgctccaaacatcccaagtttgtaagactcttggaaagcatctgggaatcaacgtcatggtcactaccggagggacgggtttgatggatgatatcatcagactgaacgacgctgtgcacattctcgtggggactccaggaagagtattggacttggccagcaagggcgttgcggatctttcggagtgtcctaccttcgtcatggatgaagctgacaagttgctgtcccccgaatttacacccgtcattgagcagctcttgtcatttcacccaaaggacagacaggtgatgctcttcagcgccacctttccgttaattgtcaaatcattcaaggtaaggcgagacttttattgttcgttttga

SEQ ID NO: 7423 - DNA, 948 bp, A.fumigatus
gcagctcttgtcatttcacccaaaggacagacaggtgatgctcttcagcgccacctttccgttaattgtcaaatcattcaaggtaaggcgagacttttattgttcgttttgagttgtccactgataagcttcataaaggataaacatatgcgcaatccttatgagatcaatctgatggatgaacttactctacgaggaatcacccaatactacgcttttgtggaggaaaaacagaaggtccactgcctgaacaccctattctcaaagcttcaaataaaccagtcgatcattttctgcaactccaccaaccgagttgaacttcttgcgaagaaaattacagagttgggctactcttgcttctactcgcacgctcgaatgctccagcaacacagaaatagagttttccacgacttccgcaatggtgtgtgtcgcaacctcgtctgctccgacttgctcactcgaggtatcgatatccaagcagttaatgttgtcatcaatttcgactttccaaagaatgcggaaacataccttcacaggatcggtcgatctggtcgtttcggacacttgggtcttgccatcaatctcataaactgggatgaccgcttcaatttgtacaagattgagcaggaactgggaacggaaatacagcccattccccagaatattgacaagaagctatatgtctatgattctccagagacaattcctcgtcctatctccaatccatcacagcaacgccaaataactaatactgcggcaaatacgagcacgacagaccgccgccatcataatcctccaaatagtggacaataccagttcaatcgaggccggggttcgtaccgtggacggggacagggtcagcgccggagcgcacaaatcgaatcaaacaagttcggtcaccctcagggccaacacagtggcaagacttcaacagcgccggtgtcataa

SEQ ID NO: 7424 - DNA, 414 bp, A.fumigatus
cttcttgtcaatattctggggaatgggctgtatttccgttcccagttcctgctcaatcttgtacaaattgaagcggtcatcccagtttatgagattgatggcaagacccaagtgtccgaaacgaccagatcgaccgatcctgtgaaggtatgtttccgcattctttggaaagtcgaaattgatgacaacattaactgcttggatatcgatacctcgagtgagcaagtcggagcagacgaggttgcgacacacaccattgcggaagtcgtggaaaactctatttctgtgttgctggagcattcgagcgtgcgagtagaagcaagagtagcccaactctgtaattttcttcgcaagaagttcaactcggttggtggagttgcagaaaatgatcgactggtttatttgaagctttga

SEQ ID NO: 7425 - DNA, 369 bp, A.fumigatus
agaggcagatatcaaaagagttatgcgcgtcatcaaaacagctcagatgagaatatccaactctcattcgacaaaaaggacgttccaatgtctgccatcttcgattatatccaccagctggtggaccaggcgtttgccttcaccaagctcatccagaatcgcgaagtgggatggctgacagttgaccgcaagaccggcgaatgcaagcgcgagaagcaagcattatggaagaaatttaagctgctactactctttaatcccttgacagaatggatcgatcagactcatctcatacgaatgtatacgcatgagaagaacctcgctgcaggttcgttatcatcccttaggaataaggtctacgaccactga

SEQ ID NO: 7426 - DNA, 357 bp, A.fumigatus
cagaatggatcgatcagactcatctcatacgaatgtatacgcatgagaagaacctcgctgcaggttcgttatcatcccttaggaataaggtctacgaccactgattgtattcaagggcgcaaagaagggaaaccccagtcccacaaacagatcaaaaccttcgtcgacttctaccaaatcgacatgtcgaagttcgacccatccgatatggagaaatacgagacattcgaggacttcttcgtgcggaagcacgccccaggcgcgcggccaattcatgcaccgaacgaccccacaaaagccatcgtcgttgccgactcgcgagtcgtcgtatacccaactgttgaagctagccccagg

SEQ ID NO: 7427 - DNA, 303 bp, A.fumigatus
ccagtaagcatagagacaattcaattccagttgcatgagacctacttgagcaccattggcccattgatttgcaggtttctcgaattctacaatccaggcacgctagtgtacgaggtggggttgaaatatttcgctactgatcttgatctgtggtacggagaatcagaaagtgccccatcattaaaacgttccaagaagttgaccaaatggaagccgactagtgacatatctgtttgcttaagccaagtttcaagacaatcagactggcacaactgggaattaagacaggagagtactccatag

SEQ ID NO: 7428 - DNA, 219 bp, A.fumigatus
actggagaatattctagaaggagagatttacccaaatacgacgtgcagtcagaaggagatcacccatcggatgtcatgaccacggcctgtttaagcttttacttgtacgtattctggtgttccatcagtatcatgtgggctaaattggccaagggcctgtgcttcagccttctagtccagtgcatttttgtgcgtatccttgacaaggctgaaggctga

SEQ ID NO: 7429 - DNA, 1287 bp, A.fumigatus
gcctcccccagagtaacgccgagggaagtgacccaggagacccatgaggcgaccgctgaagctgctgatgcacatgctccttcaagcactgtatccccggtcaagccggtactgaagaagaaggctgccgatgagcaggccgagccagctgcagcagccaatggggtcgagaaacctgagaagaagaagaaaaagaaggctgctgctacggcccccgttaccggcgagagcccagcgaaagccaaggaagcaacattcactgccgatagggggctgtccggtgagtccggcattgtgcctcaaccaagtgagcagaccactcaagtggcaccttccacaacacaaccatcaaccatggacgcccctttccctgccgccactgctgccgcaccgctctcccctgaagctggtgccaaaaaagctggcgagatctgggccagacacttggaggcactccagaccggcgtcactactgaatttaataagagtctcggtcgcgagcttgaaggcctgtactcccgcttcgacgaagagcgacgcaactgggacgctgcatcagcagccaaacaggatcaagtcttgcggttggtctccagcactctgtccgacaacgtggagaagaatctggctcgtatcgtgtctagcagcattcaatccgacgttgtgcctgccctgactgagcttacttcggccgctgttggaaaacagctagatcaggtcatttctcagcacctgggcagtgttgtgcctcgtgaggtgcgtcaggctctgcctgatgcagttgctcgttcagtcaagcaacctgaagtgatgaaagccatttcggatgccgttggtcagaagatcgcttcccaccttgagagtgacatgtcgagggccttgcacaactccatcacccccgccttcaagagccttgctctgcaggccgcggaacagatcggttctgacatgcagaagcagttgcaggttcaaatgaagcagtacgaaatccagcgccacaacgatgctgcgaagatcgatcagctcacaagttttgttcgtggtctgtctgacacggtcgcatcgatggctgccgctcagactaacttccaaaacgaaattctgagactcaatcgcgtgttgagtgctaaacaacaggacgaggaaagccgcagctcacagcaggcatcatccgccggtcgggctgctgctcccagtgaggccagaaccgccgaggatcttgaactggcagagattgcccagctgatgagtgagggccggtacgaggagggttcagtcaaggtatga

SEQ ID NO: 7430 - DNA, 984 bp, A.fumigatus
ataccagacactatacagtggtcacgttcgaaaaaggtccagagtcagctgctccttgggtttgatctactcctctctcatcttctgcacctcacgagcgaaaacaacctcgggtttggccgtgctgtcgatacagttggccttgacggagacaatgacaccaccctcgttcttcaagaacatgtgggcattcaagccgacaatacgggcctgatcgggctgggcaacatcggcgaagataacgtcaaccatgggaacgagcatacggtagcggagagggtgtctggcgtcctcgacgatgggaataacgttggtgcggtgggtggccatgccaatcagatcacggccagaacggtgggagaactcaacagcgtagacgtttccggtaggcccgacaatatcagcgacgtgactgacggaggtaccactggcagatccaaggtagagaactttggaaccaggcttcatgtagatatcatcgagaccgcccaggataccggcggcaagcttggaacggaaggggttccacacacggtactcgatcttagtgacggcgccatcttcaccggcaggggactcgacagcaatgcgcttctcgccatagacagactctccaggagtcaagttcttcgtgacaagcaaatcctccttaccaccacgggcaacgaagacaccggcgtgacggtgaggctcctacatacccctgtattagtatccaaacccatcgatcgctcccagccacagaagacacatacaatgatgaccttggcaccacccttggcacccttagcaccaccacgaccgccgccacgaccaccgcgaccacgagcagggccaccacggccaccgccgcgagcaccaccacggccacgaccaccgcttccaagtccgcctgaaaatgaacacaaatggtgttggcttgccgtcctccccggggatctgttgaaaggcgaacgtttaacctcccaattcggccccctttga

SEQ ID NO: 7431 - DNA, 627 bp, A.fumigatus
gagcctcaccgtcacgccggtgtcttcgttgcccgtggtggtaaggaggatttgcttgtcacgaagaacttgactcctggagagtctgtctatggcgagaagcgcattgctgtcgagtcccctgccggtgaagatggcgccgtcactaagatcgagtaccgtgtgtggaaccccttccgttccaagcttgccgccggtatcctgggcggtctcgatgatatctacatgaagcctggttccaaagttctctaccttggatctgccagtggtacctccgtcagtcacgtcgctgatattgtcgggcctaccggaaacgtctacgctgttgagttctcccaccgttctggccgtgatctgattggcatggccacccaccgcaccaacgttattcccatcgtcgaggacgccagacaccctctccgctaccgtatgctcgttcccatggttgacgttatcttcgccgatgttgcccagcccgatcaggcccgtattgtcggcttgaatgcccacatgttcttgaagaacgagggtggtgtcattgtctccgtcaaggccaactgtatcgacagcacggccaaacccgaggttgttttcgctcgtgaggtgcagaagatgagagaggagtag

SEQ ID NO: 7432 - DNA, 1014 bp, A.fumigatus
ctctttgtccctgtttggtgcctccaagccgtttgtgtacgaacccgccactcaactgttccgtctggagccgtccaagtacgcctacctgagcgcatggcccagaaacaacatctaccgccagttcctgagcttctttctgatcgtttggtatgcaaaatcatctttgaccccatcctgtccaaaagctggtttgctaatgacgcgattttctttcaaaataggatcttcggcattatcgtttactttatttccgcaaccctctcctacatcttcatctgggacaagacgacagtcaagcatccaaagttcctcaaaaatcagatccccatggagattgcgcagaccatgcgatcgatgcctgtcatgtctcttttgaccgctcccttcttggtcgccgaggttaggggatacgccaagttgtacgactccgtcgacgaagagccgttcccgtactatagcatcctccagtttcctctttttatcgccttcaccgatttctgcatctactggattcaccgcggcttgcaccacccgctgatctacaagtccctccacaagccccatcacaagtggattatgcctagccccttcgcgtcgcatgccttccaccccttggatggttggtcgcagagtgttccttaccatgttttcccgttcatctttccccttcagaagctggcctatgtttttctcttcggctttattaacctatggacggtaatgattcacgacggagaatatgttgccaacagcccgatcatcaacggggctgcttgccacacgatgcaccacctctacttcaactacaattatggacagttcaccacactgtgggaccgtctcggtggcagctaccggaagcccaacgaggaactcttccggcgcgagacgaagatggatgaagccgaatggaagagacagaccaaggaaatggagacaattctcaaaacagtggaaggcgaagacgaccgcaagtacctctctcaagaagaggctaaaaaggacctttga

SEQ ID NO: 7433 - DNA, 573 bp, A.fumigatus
  unsure (42): Identity of nucleotide sequences at the above locations are unknown.
actgtctgtcaagcgcttcaaccccgtgctaagtttcgtctntgcgtcaaaaatgctttctcatttccgggcatcatggatatcgttcttgagatctgggataccttcatcggggactgcgtatattcggctatgctgcccctatcactctcctcgacggtctcattaccaggcttgaccaatgctgccaatagctctttgtccctgtttggtgcctccaagccgtttgtgtacgaacccgccactcaactgttccgtctggagccgtccaagtacgcctacctgagcgcatggcccagaaacaacatctaccgccagttcctgagcttctttctgatcgtttggtatgcaaaatcatctttgaccccatcctgtccaaaagctggtttgctaatgacgcgattttctttcaaaataggatcttcggcattatcgtttactttatttccgcaaccctctcctacatcttcatctgggacaagacgacagtcaagcatccaaagttcctcaaaaatcagatccccatggagattgcgcagaccatgcgatcgatgcctgtcatgtctcttttga

SEQ ID NO: 7434 - DNA, 477 bp, A.fumigatus
gtcacgctcttctatttttcatctcgaacggatctttgtattttttttgtctgtttccacctccacgaccagtcggtctattcgcaacggaatacgatattgatgtttttatccgccgacgcaatttgtcattactggaggacattggcgtacttcatggcgcgaggaagtcgatcaaaggtcctttttagcctcttcttgagagaggtacttgcggtcgtcttcgccttccactgttttgagaattgtctccatttccttggtctgtctcttccattcggcttcatccatcttcgtctcgcgccggaagagttcctcgttgggcttccggtagctgccaccgagacggtcccacagtgtggtgaactgtccataattgtagttgaagtagaggtggtgcatcgtgtggcaagcagccccgttgatgatcgggctgttggcaacatattctccgtcgtgaatcattaccgtccatag

SEQ ID NO: 7435 - DNA, 201 bp, A.fumigatus
  unsure (46): Identity of nucleotide sequences at the above locations are unknown.
tgcactggatgtgaggtactctctttctgtgtcattgacggactangtatcaaatcggttcagcggagaagttctcaacttcatgagtatgacacgtgcgagctactccatatgttcgcctctcagacattactgactcctaaatggaaggacacgcaaagtaaacctagatggaatggcgtccccccatatttcgactga

SEQ ID NO: 7436 - DNA, 384 bp, A.fumigatus
gcaatttacgggcgcaaccataatccccaggatcttcctgtcgagaggctcacgcacgtgctctacgcctttgcaaatgtgcgccctgaaacgggggaagtctatatgacagactcttgggctgatattgagaaacattaccccggtgactcctggtctgatactggcaacaatgtctatggctgtatcaaacagttgtatctcttgaagaagcagaaccgtaacctcaaggttctcttgtccattggcgggtggacctactctcccaactttgctccggcggctagtaccgacgctggacggaagaactttgcgaagactgcggtgaagctgctgcaggacctgggatttgatggactggatattgattgggaggtgagttga

SEQ ID NO: 7437 - DNA, 213 bp, A.fumigatus
ctcgtatggtttcaatgtttacggagtactccgtactacctgggtaaatcatccgagctggactactttagctcatgccaaatctttcctgttttatcaaaggaaatcatgatccgaggtccctcaatgagtaaggtattacttaagatcctgcttgaaacatttccttcgaactgtcaagcctggtttattactgatggacttttgctgtag

SEQ ID NO: 7438 - DNA, 732 bp, A.fumigatus
aactctgaaaaaaatcatgcaggtctaacggaaaatccagcggcgagcgcaacagcgacccatcctactgtaccccacctctacacgaaatcaccaacaagtgcgagcgaatttgagaacgatctgagactagacaaaatatcaattgaatgcgttgatatgataccctgggaacacgaaagcgcagcggcttggaaacgggttggcaagcgagacgtcaaggacaacccggtcgcaaccgggatcggcaccgatattctcggcgggctacgcaccaaggggaaatatataccacttgaccagcagacgtcggaaagtatctggggtattgtgcacctttaccgagatgcagaggagacgccgttcctcgtcagtgaggattaccctctggagctgaaagggtcggcggcggcggccagacagccgtatgatcagctcggtggtcgccaggatgcgccggccaagggccactcgccttctctgcgccaggatgaggattgcacgaccctgtgcatacttgcagtgccatcttacatgtcgccttcggactttctgggcttcgtgggcgagaccacaatggatgaagtgagccatttccgaatgatcaggacggcgagggcaaatcgttatatggttttgatgaaatttcggagtgggaagaaggcgaaggagtggcagaaggaatggaacggtaaagtcttcaatagtatggaggtgagtctcctcggctag

SEQ ID NO: 7439 - DNA, 375 bp, A.fumigatus
agacggttgagatacaagctgttaattccgactctgacgtctccacatcccagcagagtactccttctgcttcgcatgctgcgactagcccccagcggacgaccatgtctacctctgttcagccgagctccatacccactgccaccctctcgagtaaaccccttgcgcctccctcacccgcgctcattgagttacccacctgccctgtgtgcttggaacgcatggatgaaacgacgggggctgttgacgatattgtgtcaacatgtctttcattgcacctgtctgcagaaatggaaaggaagcggatgcccggtgtgtcgatatacccaagatgatttccgcagggggcagtcaaggagcggcctacggagatga

SEQ ID NO: 7440 - DNA, 375 bp, A.fumigatus
tttcgtccacagccggaaacgtgccatgtcgtcttcgtgaagacggttgagatacaagctgttaattccgactctgacgtctccacatcccagcagagtactccttctgcttcgcatgctgcgactagcccccagcggacgaccatgtctacctctgttcagccgagctccatacccactgccaccctctcgagtaaaccccttgcgcctccctcacccgcgctcattgagttacccacctgccctgtgtgcttggaacgcatggatgaaacgacgggggctgttgacgatattgtgtcaacatgtctttcattgcacctgtctgcagaaatggaaaggaagcggatgcccggtgtgtcgatatacccaagatga

SEQ ID NO: 7441 - DNA, 807 bp, A.fumigatus
tttccgcagggggcagtcaaggagcggcctacggagatgagcccggcagagtgcagcgtctgtcgctccgaggtcaacctttggatctgcctcatttgtggaaatgtcggctgcggccgctatgacggcgcgcacgccttcgcccactacaaggagacctcgcatgcgtttgcaatggatcttgccagtcaacgtgtgtggagctatgtaggagatgcgtacgtccaccggatcatccagagcaagacagacggtaagctggtggaactccctgcagcggacaatagcgcgcttgatcctcccgactggagcgatgcagtgccccgcgagaagctcgagaacatgagcgtcgagtacacacacctcctcacgagccagctggagagtcagcgcgcttacttcgaggaaatcgttgagcgagctgccgacaaggcatcgcaggctaccgctgcagcctccagggcacaggaaaccgccgagaaggcgacggccagtctgcgggtcctgcaggcgcagtacgataaactgactgcagagacccttcccggcctcgagcgggacaaggctcgagcggagaaacgggcagagaaattcgaagccatgacacgcaaaatggagaaggaatggcgagaggaaaagacgatgaacgagagctttatgaagcgtatcgcacatctaacgtccgaagtcacggagctcaaagccgcaaacgcagatttgaccgagcagaatcgtgacctcactttcttcatcagcggctcggaacggctcaaggtcttaaccgcggcgtccaaggatacgagtcag

SEQ ID NO: 7442 - DNA, 453 bp, A.fumigatus
gcagcaacacgaagccgactaggaagtgcagcgcgacgccgctgctcctgctcttcctgctccctccgtaatttcgcaaggcgcagtctttcttgtgctagtctcttctgcagctcatcctcggcttgcttgatccgcctttgctcggcctccttccgtttgcgctcctcttcctcggccctttcgcgcgccacacgggcagctcgttcttcctcttcctttgccaagcgagccttctccgcttcagctgcaagacgctcttcttccgcgatacgctctttttcggcccttttcgcctcttcccggcgccgttcttcagactcggatctcttggcgacagtcttcgcatcttccatgggaatatcagccaggtggcctacatcctgcctttctccctctttcttcacagctcttgagtcggtcgccgtgtgcggtgtactatcaacctgctga

SEQ ID NO: 7443 - DNA, 1662 bp, A.fumigatus
gagaggcctatgataattacattagagccaagcgcctgcgcaagcaggaggcttcttcaccgaaacgaccgcgcgacagggagaaggaaaacaagcggccgggccgcagacactccccgtcgcccgcggtttcttccaggaaggccgtatcaagtccaggcgccggtcaccaccgagagctctcttccaaagatgctgctacatcggaaggaaaagaaacgggagggtgtaactcacttaaaggagagatccggatccagtaccaatcgccccagaatagcccacaagggcagtgacaatgcggcggacgccgatgggtttcgggtggaatccgctcagtccacatcattagcaacgcttaccagagatgaggaagctcccaggagaaggcgtttgattgcagggcgccctccacaggatcgcgatcgcagaagacccagcataccatcttctgattccctgtcaggccttgaagactctgctaaatcccggatcgatccttctaccgaagctacgacagtcccgactgggccggtggtcttgaaacgcggacgcagtagcgctagtcccgaacgcccccgttctcgtggtgcagattctgaccaccactcacgcgaaggccagaaaaagaaacgacgtgttctatctgaagacaggacgccaagcatttccaatggtggattgaagaaaagtcacagcaacggcatagcggaggattccaaagccgatgttcggctgaagaaaactgaagttcaatccttggagtgcgagcgtgatcagcaggttgatagtacaccgcacacggcgaccgactcaagagctgtgaagaaagagggagaaaggcaggatgtaggccacctggctgatattcccatggaagatgcgaagactgtcgccaagagatccgagtctgaagaacggcgccgggaagaggcgaaaagggccgaaaaagagcgtatcgcggaagaagagcgtcttgcagctgaagcggagaaggctcgcttggcaaaggaagaggaagaacgagctgcccgtgtggcgcgcgaaagggccgaggaagaggagcgcaaacggaaggaggccgagcaaaggcggatcaagcaagccgaggatgagctgcagaagagactagcacaagaaagactgcgccttgcgaaattacggagggagcaggaagagcaggagcagcggcgtcgcgctgcacttcctagtcggcttcgtgttgctgctcatctcatcggctccaatgacccgcgagcgcggagtcatgcctggctgaagaggttcatgcccgttgttactgcattcacaaaacaactggatccttcatgtgataccagcgtcgctgacgagagatgggttccaaactacctggtggcacctttattagcgaccaatgatctccagctgtcccaatacaccagttgggagaagcgtaatgcgactcccactcagcgggagaatctgtggcgcgtcacccgtcggatgctggttcagggagatgatatggacttcatgaattcctcgtttgggcagatcatgcagaaggattgcgaaacacgaccgaaatactttgacatggaacatgtattttgggttaaagtaagtcattttcctttgcgaccgtccttcattgtgcctcagaatcagttcaatcactga

SEQ ID NO: 7444 - DNA, 1116 bp, A.fumigatus
  unsure (4),(5),(6),(7),(22): Identity of nucleotide sequences at the above locations are unknown.
aatnnnnaactgaacactcgtngatccttccagccccgtggtgaagacacgaaaaacattgacaaagatactcctttaattgatgccgtcgaaaatggtcacttggaagtcgtcaagctcttactggaggcgggcgcaaatcctcgcacggtcaacgcggaaggtgatgagccgtatgatttggtcccatccgactcggaagactatgcagaaatccgccgtgtacttgcagaggctaaagccaatccccggccgggtcgtcgttccgaagagcgttctggttccgcaaataaggagataagctcaaaaagggttgctgcttcaagcccgcgcaattcccccccggtgaatgtacctcgtagcccccctctattcggggccactacgaggcgaaagactgtgcgaagtgaagccacacgaaacgacctactctggaccaaagctacacccgagaatctgcaagcatttgctgcaaaaggtgatattgcgggagttgccaacattctcaacgttgggcaaaaagccgacaccgagtcgatgatagctgcagccaagggcggtcatgatgaggtactgtctctgttgcttgggatgggcgacgcggatccggatcctgagccacttcatggaggaaaccagaaacccggctacaatacacccatgcttgcggcgatcggccgaggtaaccttgctgtcatacgcttgctgctggatcagcccaaattcaatccgacacgccgactttaccgtgatcgtacctactttgagttatcgcgagaacggagagctgacaactgggaggaggaatatgatttgctgagagaggcctatgataattacattagagccaagcgcctgcgcaagcaggaggcttcttcaccgaaacgaccgcgcgacagggagaaggaaaacaagcggccgggccgcagacactccccgtcgcccgcggtttcttccaggaaggccgtatcaagtccaggcgccggtcaccaccgagagctctcttccaaagatgctgctacatcggaaggaaaagaaacgggagggtgtaactcacttaaaggagagatccggatccagtaccaatcgccccagaatagcccacaagggcagtga

SEQ ID NO: 7445 - DNA, 891 bp, A.fumigatus
aaaacagttgctacttcgattgagcaacctgctggtccttcacccgtgtgcaacgggtctgatatgggggccttgggtaacagtactgtcgagtctgacaatgacaaggccgtggaccctgccctgccttctccgcccgctgattctcctccgtcaactgctgcgaacgaatcagaacgctcatcaacatcaacaaccgccacctctgtgtgtgatgctgcggtcaaaatcaaagtagaagaaacaatagaacaatctgcagagaaagtttccgccctatctgaggcaaatgttgagctgccgaccacgtctctgcggtcaggcagcactgagggagacacaaaattagaactatcagaccagccgagcacattaaaacagggatctattggttctaacagaaaggagcgcagaaagtctcgcggaaaaccccttgttgttgagtcggtggaggctgagcgccaactcgtccgtgttccaggggattataccaagacttcgaaacttttggcgcagacatacgaccgctgggttgactgccacacttgtaatgcctggtttgtgcaacatgactcctacttgactcgacgagagtgccctcgctgcgagcgtcactctatgttgtatgggtaccgctggcctaagactgataaggagggcccgtcggacgatgaagaacgagtgatggaccatcggacggtgcaccgtttcctataccccgaggaagaggccctcatctcgcgtaaagatcgcggcgtcagttttggtgtaacgcccacgccagaattatccgagccacgcacagaaaccgaaggaagcgaaggctgtgaggacaggcgcactactcgtgcgagccggcgccgcactcggtcgcttcgaatgacaatgtga

SEQ ID NO: 7446 - DNA, 219 bp, A.fumigatus
ccttggctgggagttgccttcaattttgtgagaacctttgccacattcttcacgacttctgagcgcattgactcgtcgaagaaaggcgtggtcaagactttgaagatcagtgtggccccggaattctggtcactcaagatcttctccaagacctcgtccccggggctgaagaacaacgcccgtaaaacaatctcgcgagcctcgggctcgttgcgctga

SEQ ID NO: 7447 - DNA, 1758 bp, A.fumigatus
  unsure (113): Identity of nucleotide sequences at the above locations are unknown.
atccagattgtcaaggagtttggcgctaccgatgatgatacactcaatatcactgctgatattcagcgagccatcgcatatcaagctttcgaagacgagatccatcgtattcntgaacccagcccgaccagaatgttcgatgctccacgtattcgagacatccgcaagaggatagacaacggttcttgttcaattcaggagattgaggaaactgcggtcgcaatgcttcctgagatcgcggaactgtcgtcagattatctgggcaacactgtcgttcagaaactcttcgagtattgctcagagcagactaaagaacagatgctcgttcccattgcaccccattttgctgagatcggtgttcacaagaatggtacctgggctgctcagaagatcatcgatgtcgccaagacccctgcacagatgaagatgattgttgatgctcttcgtccctacactgtgccgcttttccttgaccaatacggcaattacgtcttacaatgctgcctacgttttggcgctccattcaatgacttcattttcgagaccatgctaagccgtatgtgggaaattgctcagggacggttcggcgctcgagccatgcgagcctgtctcgagagccaccacgcctcaaaagaacagcaacggatgcttgcggctgccatcgcctgtcatagcgtacagctggcgacaaatgcaaacggcgccctgttgctaacttggtttttggacacctgcacattccctcgtcgccgtaccgtactcgccccacgacttgttcctcatctggtccatttgtgcactcacaaggtcgcttacctgaccgtgctcaaagtgattaatcagcgcaacgagcccgaggctcgcgagattgttttacgggcgttgttcttcagccccggggacgaggtcttggagaagatcttgagtgaccagaattccggggccacactgatcttcaaagtcttgaccacgcctttcttcgacgagtcaatgcgctcagaagtcgtgaagaatgtggcaaaggttctcacaaaattgaaggcaactcccagccaaggctacaagcggctcatggatgaggttggactatcttcacgtggaggcgctagagacaatcatcacgggcgagaacaatcaggtcattctgagaacaagcagcatcgtcctacttctaggcaagcacaatcgaccatggataggcattttaacggacagttcgcacccagtcttcttgctcaaaacatggacaactcaaggtccgttcctgagcaacaaccaggcgctgcgccattcgacccttactcgatcagtgctgtcaatggcatgagccccacaggtgcactcagctctctcaacggacttgctgcaatgaatggtgctgggtttgtccaggatcccctgctgcccctcactcagcaacagctccaatatcaagctttactagctgcccaatcccggggggtgtctcccgctggcctttatcctactctgggtaaccccagctttgggtatccacccggaacaccgtccttggaacagtcttcggcagtctgctcctatgcctggaacacccactcaattgctgaaccagcaagcctttgctccccagcagttcagccctgttatgggcacgccccagatttatcagtatcctcctcaattctattcacaaacacctcaggcccctggacagtcggctgggggacgccgcggacgtgtaagttcatctccagatgggtgacatggtgcgtgacctaa

SEQ ID NO: 7448 - DNA, 543 bp, A.fumigatus
gcatggcaaattggcctgtcctcgagaccctgcattgagcatccacttctataccaatgccgcacaaagcgggcatgtcttggcgatgatggccttgtgcgcttggtacctggtaggcgcggagcccgttctggagaaggacgaaggcgaggcctacgagtgggccaagcgagctgcagaactcggtatgtgcacacacggactcaactggttaatatgctaactctctacataggactggcgaaagcgcaatatgctgtcggatactttaccgagatgggcattggctgccgtcgtgatccattagaggccaacgtctggtacgtgagagcggcggatcagggcgacgaacgcgcaaagcagcggattgccacgattcgagctgccgcggagggcaggagccctgcgcagaatggaaaagaagggcaaaaagagaaacagaagtctctaggtgcgttcaacgacccttcgtgttatctcaagctaatccatggaacagatgccggaaagtctggcaaatccaaacgtttcactattttctaa

SEQ ID NO: 7449 - DNA, 198 bp, A.fumigatus
gtgacgagctacgtattgagtgcaatgaaccacctggtcagtgccagtactcgatatgatgtcattatggacatgctgggacttatgatcgtggcgtttctcttggatgaagatgcaccattcattcagctaaaacagatgtacaaagagtcaggcattcgcaatgcggcattttcaggactatctatgatcttttag

SEQ ID NO: 7450 - DNA, 378 bp, A.fumigatus
cagtacaactctgcgccttacgaacttggtctccttcacgaaacgggcttcggcgatgatgtctttcctgatccggcctacgcagctcagctattcaccaagtcggcggatctgggccatgtcgaagcgagctatcgtcttggagatgcgtatgagcatggcaaattggcctgtcctcgagaccctgcattgagcatccacttctataccaatgccgcacaaagcgggcatgtcttggcgatgatggccttgtgcgcttggtacctggtaggcgcggagcccgttctggagaaggacgaaggcgaggcctacgagtgggccaagcgagctgcagaactcggtatgtgcacacacggactcaactggttaatatgctaa

SEQ ID NO: 7451 - DNA, 483 bp, A.fumigatus
ttaccttgcttgcagaatctggacgacttcaagtccgaatcgtgtctaacgcccttctcttactttttggtatacgtctttcttttggtctccatcgcggtgtatggcgtcgacaccttcactgcggtcaatctgctggccttctcgcgatgggccggctcaattgaaccggctattccctttacagtgtcgaggtggatctttgccgtttgcattatcgtctctttcgtcctgttgtttcttcggtggcttcatgcgattcgcgcgatgcgctcggggagcattgcccgaagttacttggatccgctggctgcgcgggtccagagtatccgtatggggagacgtggtcgcggctggagacgctttttggtctttgcggagttaacgaagagtaagaagggcgcagagtatgtggctttgttcgcgtacttttctttcgagagtaagcctcttgctttgtctacctttttggggttcaactga

SEQ ID NO: 7452 - DNA, 186 bp, A.fumigatus
  unsure (164): Identity of nucleotide sequences at the above locations are unknown.
acacagtccttcgcagatggtccccgccaagttgtcaatgccatcactttgtactccgtgatgagaatggaccttcttcccggtggtaaaaactccgtggacgacgacaaggcaggcatcatacagtttttcgagaatgtcaaaatcctggccgatcttctccntaggacgggacgtacgcattag

SEQ ID NO: 7453 - DNA, 198 bp, A.fumigatus
gtatataataattatactttctctaattactttatttacttattattatattatattactcttgttttactactttactcttatattctttatttattactttatcttatcttactagaatgccttattttactagactactatatacttttttatcttttttttcttctaatctctaggggggactattatatataa

SEQ ID NO: 7454 - DNA, 417 bp, A.fumigatus
  unsure (393): Identity of nucleotide sequences at the above locations are unknown.
ccagacatcccaatctccctcttcttgcccattctccatccaaccgctctaaccttccccgggtttgtttgttcctttaacctttttggccttttccttcctgtttcatccgcagtcgcccctccatcccccccccccccgcccccccgccccccccctcctcctccccctctatcgaaggcctggtttccccacccgctgtgcaaaaactacccacccccccccttaggaaacttttgggcccccccccctggttttcccaaaaagaacaacacctacacccccccggccccccccccccccccccccccccccccccccccccccccccccccccccccccccccccgcccccccccccccccccccccccccccccccccccccaccccnccccccccccccgccccccccccg

SEQ ID NO: 7455 - DNA, 729 bp, A.fumigatus
gagcgagcggatggatatcattcttcctgcaggattgtatatggcagagtaagatggtatcttatgagaatgatttcaatcagcaagtctgcgctgctagtagcggcggccctgagcggcctctcccaggcggccaattataccgaatggatggcctcgtccttcatgaccaagaatatctccctgtcccgcaactacgccaatggcgtcctctacaccggcatggagttcgcatacaacaagaccaaggatgaacgctacttcacctacatcaagtcgcaggtcgatgccgttgtcgatccctccggcggactgatcgactacccggggtcaaccgtctcactcgacgacatccgcattggcctcaatctcctttggctttggaccaagacgggagatgacaggtacaaaattgcggctgataccctccgtgagcagcttaacttcaccccacgcaacaaggccggcgggttctggcaccgcaagcccacgtacccgaaccagatgtggctggacgggatttacatggcggagaacttctatgcgcagtacaccgcgtggttccagccgaacaatgctactgcatgggacgatatcatgctgcaatttgacttgatcgaagagcactgccggttgaagaccggattgctggtgcacggatatgacgagagtaaagtggcagtctgggctggtatgtctcaacagaaccccactgacctttgtggatga

SEQ ID NO: 7456 - DNA, 633 bp, A.fumigatus
  unsure (605),(606),(611),(616): Identity of nucleotide sequences at the above locations are unknown.
aagagagacaataggctacacaaaatgacaaaaccacttactgaaataaaaccctcgtcccccagcatcacgcgctcgactactactaaagcaacgttcactaatctcacccccgcagactccatattccgctccacagtggaaaacacctccatcaccaggagtcccacatccggagccccaagcagcgccagcatcagcgtcaaacgcagcaaactccagtcctgcaccctaaccaactcctccacccgccgctgcactctcaccaacacaaccctcctcaacgtccccgcagcccgctcgctcgatgcaactgactcgtcgctctcgaatatccgccgcctgcgacggagcgagatccgcgccagcgcggtaagcgatagtgccgtccggcggagcacggttgtggactccaccgtgaagcagtctctcctctggcggagtaagctgaaccacgtggacatgttcaagagcagggtgaagagggcggtgctgacggactgcgaggtgagtgagtgtgtggtgatcgggacggagttcaaggggatgcggttaaggtttggggtttggaagcatgggaggttggtggggagggttggggaggnncatgncgcanagaatgcgctccgctag

SEQ ID NO: 7457 - DNA, 762 bp, A.fumigatus
tattgtcaagaacgcctcaaacgatgttactgccgcactgcgcaggacgcaccagctgatgcaggcagaactatctcgaagtcaatttgctcaccaaactctaggttcgttatatttgcattgggagaccatcctcaatctgctaattctataaccacagagcaatccacagctgccctgtcctcattatcggagtcttacaccgatctggactctctcctctcatcgtcccgcgatctcatcggttctctcctccggtcccaaaagtctgacacttggtacctggaaacagcattctacatccttgttggaacaatatcttggctcatattccgtcgcatattatatggaccgctctggtggcttgtatggctgccgattaagttgatagcgaggtccgcgttcgctatccttggaacagtcgggatcactagcacggccgttcaattacaaccatcagcttcactcagccaaagcatgcctcatgaagcaccaacattaggacaaacagcagccatgcctagcgcgtccatcagcgcttcttgggacgaatcccaagctcctgaagagcaatctgagactgatcggctgattgatcagattggcgatacgatagaaaagaacagcaaattgggggacgaaaccaacatcgacgacgtgtcaccagaagaaaggcaacgacaagaagagataccgcgaaatccaaagaaacgcatgtacgaagctacagaaatcgaacaagacctgagagatgagttatag

SEQ ID NO: 7458 - DNA, 1251 bp, A.fumigatus
  unsure (1200),(1220): Identity of nucleotide sequences at the above locations are unknown.
accctataccattggcggatccttcgcccctgtggtgaagacaaagagatgaccgcggccgagcttcaggattatgctcaactgatggacgaatttgccaaaggattcgaccctgactcccttgctcgagagatcatggctacgctaccacttctcgaggaagacctgttccccagctccttcgcccacctcttgatcctccttcttcagaccgatggcaagatcgaaatcgcccaggtaaagctagttcgttggctgcgtgctcgttatcccattgctttatgtgagccaagcgagactcaactggtcgacgagacgttcttcatgtccgagattgagatgctgagacggctactgtcgaccttgcgtggagacgacgacaagcccatatattggatcaactgcaggccctttgagattggcaagtcctgcgagcaacttgaagcgtccatcaaggtgattagagcctttgagtgtgacatgcggtccgcaacagaggagattgacgaggaaagtaagatcgcacgtcacccaccattccacctgccgatgaagctgaccacaataaacacaggacatttctatcatgatctccccgtctgtaatgaacgcactgtgctgataagtatgagggcacagcggtgggacagttctcgtgcatccattggctggaacaattatctgtcatctgagatcgagcttacaaggttccaccagtatttcaaacaccatgtcatggagcatgaccccaataaggctcgtggatatgggtggctgccaccagaccatatcagagttcctctctcgtcgtctaccaatgttgatcttgtcgacgtgtctgattggcctctaaacgatcatcagaagaggatcatgagcctgctgttcaaggttgctcagtggattggtctagcgagaggactcgcggccgttcatctcttttgtgacattgctcgtaactttaccatccacaagccctccgagaatccgagtgccagctacgtcctcttcatgcagaaacttgccgaggccagactgtgccccagctcgattgaatcgcagatcccgaccccgtttccctacaacgacgagacctacgcaaaacgcaacccggccttctttattgacgtcttcagatctgccaaagggttggtgtgctgtcaggtccaaatgaactcttttttgaaaaaaaaagcgacnagaatatcctggctatcccnaacacggccctccttggggttttttttgggc

SEQ ID NO: 7459 - DNA, 198 bp, A.fumigatus
aacctcccacttttatcgcctccgttactttcaaacggttggacaagaatcaaaacgcgggacaaaattcttccagtccagtattatgcccccacaagcattcaaaccgttattggttgcaagggtcccctccaattctcctttctccaaacactggactgggcttacgtctcattgctccatggtttggcatcttga

SEQ ID NO: 7460 - DNA, 1419 bp, A.fumigatus
tttatcatggcaaccctaacctcatcggcttctcggccgcagtcacaggtagtcacctcgatgacgaacctgtcggttctacctcctattataacagatgcttctgggaagacacaaatcgggcagcggacatcgttgtatgcgaaagatcgtctgtcgacgtactcgaatgtttccaccacttctcagaatcgctctcgtcccggctcgcatgtgtttccaatctttcattccagcttgccatatgcgctcgttcgggatttcgcgtaccctccagtccacccacttcattacggtcctctcccaccccgtgcctccggtgtgtccactccggcaagcgagcatcggcgcctttcggaccctcccgcaccatgggataactcgcgtggtcaatggtcgtcgggctcttggagagcggatcagagccatgggcagcatcaattacccgcaatgtcgtttggcgatgggcccccttatagcgaagatgaagatttgcatagcccagtgttctccgcatcccgccaccgcaagaacaagtcaacagggatgaatgcgaatggccgaagaacgagaagtcccggtcgcggccatcaatctgcctatttctccggtgatgtcgaccgaggaatactggtcagtatgaacgcagacggcagcgagacttattacgtcaatgatgacgatgatggttcagatgatggccctggaggagaatatgtcacctatcctccgagtgagagccaatattctcacatggggaacgaaacttacggcgactatgaggaccgtgagcatgatgcagggttcgaatctgaggacgattattccggtgccggccgatactcgggtgatttccaattcgcagttggctgtccagatgaggagatgcatggcaaagcggttgcgctatttgatttcaccagagaacatgagaacgaactgcccttgacggaaggacaggtgatttttgtctcatataggcacggccagggctggctagtcgcggaggatccaaagactggtgaaagcggtttggtaccagaggaatttgttcggttacttcgggacatcgaaggtggcctgacatcgctcagcgtcgacccaagtctcgatactgaggaagatgatagcacatatttgagcccggactcaaccgactcagagcaggctatcacaccaactcagaatgaccaattgcctcttaccactgaaagggggtctgttcatattcccaacggcgcatcgaatttggagagttcagccgtcatcccagatggcggcggcgaaatcgaatcgaaccagtcacattttctgcacaacggacaggagatcggtagcaccccaccaatcgaacaacaaatgccggagaaacaaaagacagaaagggaaagccagatgggtatcttggcgaagacatga

SEQ ID NO: 7461 - DNA, 246 bp, A.fumigatus
  unsure (16),(116): Identity of nucleotide sequences at the above locations are unknown.
gggcttcatccttttntggtcgataataatcttatggactgtatagacccgcccaaaattcaagaggcgcagtacatgcattcaaagttctacaacatcatttctttcgctcacantaccgactgcttccatctgcggttcgtccgcacgttgaaatggcgtggttcacctcttcagaaaaattcccgaaggacgaccgctcgtccagcgcgtctgaccaggcccgagattctcccgataaattga

SEQ ID NO: 7462 - DNA, 993 bp, A.fumigatus
ggcttgcattgcttggtcggagccaaatatctgaacacaataaccggccatggagcgtgcactatcatctggtcattggtgactgccatagtgtcgctggtgttctctctgccacggacgtttagcggattgtccaaggccgccactttgtcggcaattttcaccttcgtatccgtcattctcgcagtcatcttctcggccgttgaagatcatccggcgggctactctgctgcgcagggtgaaccaattgtgaccgcgattccagtggtaggcaccacgttcgtttccggtgtcaatgcatttttgaacatcagttacacattcattggccaaatcacacttcccagtttcatcgctgagatgaaggaacccaaggatttttggaaatccgttacggccgtgacgattgccgagatcatcgtcttcagtctggtgggcgctattgtatatgactatacgggaaatcagtatatgaccgcgcccgcattcggttccatcggcaacgaggtctataagaaggtatctttctcgttcatggttcctaccttgatcttcctcggtgttctatatgcttccgtgtcggcgcgtttcatctttttccgtcttttcgacggtacgcgccacaagggcaatcacaccgtggttggatgggcctcctggactggtatccttgccgtcctttggatcatggccttcatcatcgccgaggtcattcccttcttttccgacctgctctccatcatgagctctttattcgattcgttctttggattcatcttctggggggttgcctatctccggatgagatacgccgaccacgggccgggcttctacaagaagcgcggtatccgcggctgggttggctttatcgtcaacatcggcctgatcttgacgggattgttcttcttaggacccggaacctatgtaagccttcctctcaagcattctcatgagcgtgtcgctaacgtgaccctatgcaggctgccgttatga

SEQ ID NO: 7463 - DNA, 879 bp, A.fumigatus
agaacggatgtctttaagcgtcacttgacctccgtgcatggcgttgagcaaacaccacccaactgtcgcaagaggagtcctggtgcagcttctgtcaagaaggtttcggattattgccaggatgccactggcaaatgctcaacttgctctgccaccttcagcaacgcacaggacttttacgagcatcttgatgattgtgttctccgggttgtgcaacaagtagaacctagcgaggttattaaccagcaacggctggcagaagtggactgcgatgaggaggtcaagaagaccatggagaagcacaagcttctcgatgccgccggtgacgtcgacgatgaacctgaggaagatgacgacgattataacgaactcaatcttcagctgcgatcaagcaaaggtgcattcaagtcaaacaaagcgaattcgagcttaggatctcgtcccatcatgggtaaccacaacgctgttaccaagaatggcaaggcccgcgcaactatttcgaagaggcgcaacaaccgcgatcgctaccctccttcctggggctgccccagtagcagcatgaagacgaaaaagcgcgtcttgtgcgtcttcgacggccagcgccgtctgtggaaagatgaaatgatgctcgacaatgagttcgaagtacggctgaagctacccggaggagctggtgatggtacgaaccgggaagcatatataactgacctggatgtcgagactttaaaacgtgctgaaggcgtgttgagcgccaacgaggatgaaaagggtccctggttagagggaccggcaacccatctcatgggacagccagcaaagatgttgcctgcactttctcatactcacgaagatgttgatatcgatgacttgatgtcatga

SEQ ID NO: 7464 - DNA, 519 bp, A.fumigatus
tgctttcagggcgtcctggatgaggatgaacgctgcgccgaggagctgtccccctgtccagcagatggtgcttcctatctcgggcgagaaggggtacgttatctcgacgaggtactcgagcacgacggggaggaggccgaaggacgatgcgccgaggagggcgcagacgacgtacgccggggcgatgcctgcgggactggacggggcgaatatgagggcgatgtagcagatggcgacgatggggaccaggatccggatggtgccgaggtagtgcttgaagcggtcggtgatgggagagatgatggccgaactaatgaggccgacaatgatgagaatgccgcctgcaatgccggcgtctgtctcggagaaaccgtatggttcgagaatttggttcaggagggaggagacgctgttgaagaagccgacgtagacggagaaggggatcaggatgagccagaattcgagggttttgaggagctgaatcagcgccggacggaggggtgttttactgcctgctga

SEQ ID NO: 7465 - DNA, 453 bp, A.fumigatus
  unsure (435): Identity of nucleotide sequences at the above locations are unknown.
tggggggcaaatggattcgatatgctggaacgaaagcccaggggaggcatatttggtggggcaatgttggggcagatcttcatcggactggcgcaaccattctgcttgagtgcgccgacaaggtatagcgatctctggttttccgatcaagggcgcattagcgcaacagcggttgcaactttagccaatccattgggagcagccttggggcagttgctcgattcgttctgggcgacaacacccaagcaggttccagatatggttctgtacatatcgatcattgtaggtgcatcgtcaatcccatcagcaggagtgttttgtcgtaaagcaacccatatcagcagcaatactgatcgcatgcataatctgacaggcaaccgtcgcgtcaatcccatcattcttcattccagccgcacccccaacgcccccaagcgnttcatcagcaggcagtaa

SEQ ID NO: 7466 - DNA, 870 bp, A.fumigatus
  unsure (65): Identity of nucleotide sequences at the above locations are unknown.
caggcaaccgtcgcgtcaatcccatcattcttcattccagccgcacccccaacgcccccaagcgnttcatcagcaggcagtaaaacacccctccgtccggcgctgattcagctcctcaaaaccctcgaattctggctcatcctgatccccttctccgtctacgtcggcttcttcaacagcgtctcctccctcctgaaccaaattctcgaaccatacggtttctccgagacagacgccggcattgcaggcggcattctcatcattgtcggcctcattagttcggccatcatctctcccatcaccgaccgcttcaagcactacctcggcaccatccggatcctggtccccatcgtcgccatctgctacatcgccctcatattcgccccgtccagtcccgcaggcatcgccccggcgtacgtcgtctgcgccctcctcggcgcatcgtccttcggcctcctccccgtcgtgctcgagtacctcgtcgagataacgtaccccttctcgcccgagataggaagcaccatctgctggacagggggacagctcctcggcgcagcgttcatcctcatccaggacgccctgaaagcatcagacaacgcttcaccacctcagaacatgagaagtgccttgattttctcagccgtcgtggcagccgttgcggcgccgtttgcagtctgcatcgggctgtttgggcgggatgtccgccgccgccggttggaagtcgatcgcggcgtccctttggaaaatgctgtttgtcgagaccccgaggcagccagtgcgggcgtgcacgtaggtgatgagaaccccaatactggactggatcatgcttctgatatgccaaagctggcgcctaaatactcatcatattga

SEQ ID NO: 7467 - DNA, 240 bp, A.fumigatus
gatagtgtttcgcctctgcaagatcccgtccaaacgcctgcgcaaaagaaactcacggagcgtttccgcacccttgtcaagcatgtcatgcagtggcgcaagagttgcgaacattccctccacatcatggtcaccgaagtaaagtctagaggcttcctccaacccttcatgccagagttcgtgccacagaaccgcgactcgaatcaattcatggctgacgagatcggcctgctcgactaa

SEQ ID NO: 7468 - DNA, 1971 bp, A.fumigatus
tcaccattaaccacccagcttcagcagtctgaccccggtattggtattattggcaaagcccaagcatacagggaagtagagctgacagagacatggtttgagaaacttcagcgatgggaagaggcacttgccgcttacaaacgccgtgagagaattgatccagactcttttggtgtcactatgggcaagatgcggtgtctgcatgcgcttggcgagtggaaggtattgtctgatcttgcccaagagaagtggaaccaggcttctctagaacatcgcagagccattgctcccctagcagcagcagcagcatggggacgaggccagtgggagctgatggattcctacttaggcgtgatgaaagagcagtccccggataggtctttcttcggtgcaattctcgcgatccatcgaaatcaatttgatgaggcgacaatgtacatcgagaaagcccggaacggcctcgacacagaactatcagctttacttggagagtcatataaccgtgcctacaacgttgtcgttcgtgttcagatgcttgctgaattagaggagatcatcacttacaaacagaacattggggaccctgagaaacaggagtcaatgcgtcagacatggaataagaggttgctcggctgccaacagaacgttgaagtatggcaacgcatgctcaaggtcagggcgctcgtcacttcaccgcgcgaaaaccttgatatgtggatcaaatttgccaacctctgccgtaaatccaatcgcatgggacttgccgagcgatcactcgcatctttggagactgttgtcactgacaacaatggtacaagaactatcgctcctcccgaagtgacctacgctcgcttgaaatttaattgggctactggtcgccagcgtgaagctcttcagatgctaaaagagttcactgcaaatctgacggatgatttgaatcgctttaatgcgctcatggcatcacagtccgatcataacggagttgatggcgtcaacggaatcacagaggcaaatcatgcggatatgatgggtctccgtgaacgtattggcgatgtagccaagttccgcaagctgctttctaagagttatcttaggcagggagagtggcagacaactttgcaacgaggcgactggaagcccgaacacgttcgcgaggttctcggcgcatattctgctgccacgaaatacaaccgcgattcgtacaaagcctggcattcctgggctttggccaacttcgaagtcgtgacaacgattgccagtcagacaagcagggacgggggtatcaagcccgtagtccctggccatattgtgacagagcatgtcatacctgccattggaggcttcctcagatcaatcgctttgtcatccacctcgtcgctccaggatactctgagactgctgaccctttggttcacttatggcggtgaccaagaggtcaataatgttgtcacagaaggcttcaatgcagtgaacattgacacctggcttgcggtaactccacaactcatcgcccgtataaatcagccaaacctcaaggtccgaaccgctgttcatcgcctcctggccgaagtgggcaaggcccatccgcaagcgctggtgtacccattaaccgttgcgatgaaatcgcacattacccgccgttcgcaatccgccagcactattatggatagtatgcggcagcacagtgctactttagtcgagcaggccgatctcgtcagccatgaattgattcgagtcgcggttctgtggcacgaactctggcatgaagggttggaggaagcctctagactttacttcggtgaccatgatgtggagggaatgttcgcaactcttgcgccactgcatgacatgcttgacaagggtgcggaaacgctccgtgagtttcttttgcgcaggcgtttggacgggatcttgcagaggcgaaacactatcctatgcgtcttcacgcaccggggatggaaggtaccgcgc

SEQ ID NO: 7469 - DNA, 405 bp, A.fumigatus
caatgccaacagtggaacacggagctctgccctgacaacgaatcctgcgctcaaaactgtgctttagatggtgccgattacgcgggtacatacggtgtcactacttctggatccgagcttaagctcagcttcgtcaccggtgccaacgttggctcgcgtttgtaccttatgcaggatgacgagacgtatcagcatttcaacctgctgaaccacgagttcaccttcgatgtggatgtctcgaaccttccttgcggtctgaacggtgctctgtactttgtggctatggatgccgatggtggcatgtctaaataccctagcaacaaggccggtgccaagtacggaaccggatactgtgattcccagtgccctcgggatctcaagttcatcaatggcatggtaagataa

SEQ ID NO: 7470 - DNA, 777 bp, A.fumigatus
gcgctgacgataacacaggccaacgtggaaggctgggagccctccagcagcgacaagaacgcaggcgtcggtggccacggatcctgctgccctgagatggacatctgggaggctaacagcatttccactgccgtgactcctcatccctgtgacgatgtctcacagaccatgtgcagcggtgatgcctgcggtggcacttactcggaaagccgctatgcaggcacttgcgatcctgatggctgtgacttcaatcctttccgcatgggcaatgagtccttctatggccctggaaagatcgttgatacgaaatccaagatgaccgtagtgacccagttcattaccgctgacggcactgacagtggtgctctttccgaaatcaagcgtctctacgtccagaacggtaaggtgattgccaactctgtctccaacgttgccggcgtgtctggtaactcgatcacctcggacttctgcacggcccagaagaaggcctttggcgatgaggatattttcgcgaagcacggcggcctcagcggcatgggcaaagccctgtcggagatggttctcataatgagcatctgggacgaccaccattctagcatgatgtggctcgacagcacctaccccactgatgctgatccctcgaagcctggcgttgcccgtggcacctgcgagcacggcgccggcgacccggagaacgtcgagtcccagcaccctgatgcctctgtgactttctccaacatcaagtttggtcccattggttcgacctacgaaggttaa

SEQ ID NO: 7471 - DNA, 543 bp, A.fumigatus
tggtctccgtctctttgtttaccaggctgttacccccgagatgctcatgcttctttcacaattgcgccacaagtgtgccattggatacgtcagttaacccgttcactggatctcgacgtccaatctcacccactgcaggtcggcggatccaaccttgccaagcaacaagagcaacttggaacgggggcgacggacgtgacctcccttttcgatttctgcttcccggagaatggtttgatggcttttcgtctgggcaagcctcttgccagcaccagcttcattgagtggatcggcgaggagaaataccagaagctggtgaacttcatcctcagatactttgcggacttgcagttgcccaagaagcgtggtaccttcattgaattccgaaacggaatgatcaatgttagtccgataggcagaaatgcaagtgttgaagagaggaacgagttcgaagcgtatgtatacgaacttgggctcagccagccattgcaaagacgccaattaatctgtggataccatcagctaaccatacggcagatatga

SEQ ID NO: 7472 - DNA, 264 bp, A.fumigatus
caatcaatctgcagctactctatcggcggccagatttcttttgacgtcttccccactggttgggacaagacctattgcctgcggcacgttgaagccgagaaagaaatttctggggttgagtacacaacaatccacttcttcggagataaatgttttcctggaggtaatgactacgagatctactcagaaccgcggacgataggtcattccgtacatggtcccgaggaatacatgaagcagcttaaggaattgttccagctatga

SEQ ID NO: 7473 - DNA, 210 bp, A.fumigatus
cactcctttctcgatcctttttttcttttctacaccatccgacactcctacagccagcaggagtgccttaaatcatcatgtctacaccctcaacggccactgcaacgcatcccacgcaccaccagcaacactacgcatttcctcatcaccacgcctaccagccaaacgcctcctttcccgtcacaaccgctgcagggactgctcgcctag

SEQ ID NO: 7474 - DNA, 639 bp, A.fumigatus
  unsure (150),(179): Identity of nucleotide sequences at the above locations are unknown.
acttggaagattcccgacccagtaaatttcaatgttggagtattggtcctgcacttgttaaataggttcagcattgagtacaacaagaagccgggcaaattggccaccgtcaaggtcgtcaaggatcctgctgttgcccgagagaacagnaacaagagtgtacttattcacaccggtcntggggagcatgccaactcggtgtccaagccaaccccgaggcccaagcaagtcagtgcgcgtccagtcaccaaagggaagctactccgtcctggtggtccaggaggaggaccttccaagctggcagccagacccactcctgcagctcaacccctaccccgtgccacgccacagcctgctgaacctcagccagctgcgagggctgttcctcaacctgttgctgccgttgctgcttctcacactcgcaccggctcaacagcttcagtgagggcgccgcctccacccccaccagccgctgcacctgctccgaagaaaccgaccgcaaaggttttgtatgacttcaatagccagcaatccaacgagctgtcaatcaaggctggtgagattgtgcagattgtttccaaggaaggaaatggtaagcctggaagttccatttcgtctcaacagtctactaacgagtga

SEQ ID NO: 7475 - DNA, 426 bp, A.fumigatus
cgagtgataggttggtggctgtgtatgaacatgacgacttcggcgcagggttggaccccagaagcatatctcgaagagcaagttgctccgacaccgaaacctgcccctccgccgccgccagcagccccgaggtcgacccctgcaccagcgaccaacggtgccgccgcggcagccaaggccaagcctgcacctcccgcgcctccagcgaaacgaccgaatatggcagcacgcaaggcagtgcccacgccaccaccggctcctcgcgacagtgctgtcagcatgaactctcacgactcttctgggggtagcggtcgtgggacacccaacagtatgtccaacgcaagcttagctggtggtctcgccgaggcactgagggcgcggcaacatgcaatgcaaggaaagcaggatgatgatgacgactggtga

SEQ ID NO: 7476 - DNA, 687 bp, A.fumigatus
  unsure (70): Identity of nucleotide sequences at the above locations are unknown.
tccaatacgggcgttctcggtaatactccacattatttccttagtctgtggctgagtctgtcccactgcnccgccagatctgttccatcctcatacgtagctgacctgacccctcaccagcaaacagagtacacaagaggccccgtcggtagtatattaagaactcacccacatccgtctcacatctaccacattcaaccatcccttattccatacacctcagacatcaaccaattaaccaaaatgtccttctcaaacataatccaagacgccctctcgggccacagccacagcaacaacaacagcagacacgacaatgactacgacgagttcaaccccgccgtacgctacgccgaatcccacgccaacacctccgactcctccctcttcacctccgccctctctttcctaaacgagaacaagcaccgcctctccaatgacaacgacatcaacgagcaggaaatgatccacgcgcaccagtcgctctacgacggccgcgatagcgagcggcgccacgactcgtcctccgtcggcgcgggggcggcgatgcaagcgctcaagatgttcacgagttcgtctgagggggagaagagcgggatggataagaatgcgttcatagggctggcgatggcgcaggcgaagaagatgtttgaggagaaggaggcgaagggggaggtggtaagttga

SEQ ID NO: 7477 - DNA, 198 bp, A.fumigatus
ggggaaatgcatggggtaaggcctcaaggcactccatcccctcttctggttggccgctgcactcttagcgtggaatccctgcaattgtctgtgcccgccgattttaccagctctcagactgcggcatacctagggtatctaactgtcgtccacaaccatcaccaattacaagctagcctcttagtggtggtagcttga

SEQ ID NO: 7478 - DNA, 1260 bp, A.fumigatus
catactgcaaaattccgcgtccatgagacccagaccctcttgataataccgaactataccgtctcacgtggtctgctcttcatgtttcgatccattatcggccgccacgggcactcctatgggtcctctcgactgacaggctccgctcccaggcccacgctttgccagacacggccaaaccatccagcgccattcgtcgagcctccgtatccagcacattcagagcagcatcatcaccggaatcatcaaagccctccgggttatcaccgagagcctgcaccgatattctctcagtttcatgcagtcaaaacgacgcagagcaaagtcgtgtcaccgggtgaccgtgctaaagcacggaaggaggtgcaaaatgggcttgaaagtaaattcttttcgattgtccgagagggtcaaccggacctggtcatgagagcattactcgatcccaaatttgaaaacttggttggatcgttacctgagagtacctttgtggaagcctttcgctcgctgtctcctgcatacttcattgatccttttagagctatttatcgcccgttgcatccatctaccgtagccgtcaaaggttacccgcaattggacaaaatcttcgataggtttgcttccaatcttgcctcgatcgtctcgatcagacggtcggcgggtcatagactgggactggcagagtacacccatctcctggactgtgcgcggtctaccggggatgcgctgatggccgaccatatatggcatgccatgcgtcaggacgatgttatccccgacgtgcagtgctacaactactacatggaatccaaggtttgggatggggcctacactggccgagagaagtatcgtctgcgagtaacgccgttcgcttaccgtaagcggagcttcggcaaacgaaacttgggatggaaaggctatgggactgccggttgtactgtccgcaaggaaatcatgcctatcttggccgacatgacggaagaacgcactgcgggcgaccagggtacttatgtgaatgtgattttggcgtcttccagcgtgggatacatatcaactatgaaccacgtgttgaataacgttgggaacatcgacattgacgccctaccgccgctgggagtctccttaaaccctcccctcctcctaggaataccatcgttctttcaccctctgtatccaactaattccccctccttgttcgcctgtccccacccgccttttgggtttccgcaaccaactttccctgcacccctttcggggtag

SEQ ID NO: 7479 - DNA, 189 bp, A.fumigatus
cttatactaggaacctatctaaatattacttttactatatctaagcttgcttactttactaagaatcctagccctaattactttattatagtaaagtatatattctactatctagcagggatactcttactcttattattctatccttctacacttagtaatcttaatagttttattaatactaattag

SEQ ID NO: 7480 - DNA, 195 bp, A.fumigatus
gaggcaaaccgtaccaagttttctgatatgcccattaggatgtgcccgatcatgaaccaagattcggctgcttttatggacggctacaagatggccgccgtccagctcttagactcctttgccgccgagaacccgcaagtgctcttcacaatgtgcatcccggactcctccaaacggctatgtctgccaagctag

SEQ ID NO: 7481 - DNA, 459 bp, A.fumigatus
tttcatatcaagatcacccacgtcaacatgcaattggctacattcttgctggtcgcgctcttgtcgatcttccacatgaccttggcagctcccacctatcaccattacacagtgactcctgccaaccctgccctgacctggcatgtctccaacttttataccagctgctctcctgggggctgtgcctaccggttcgatattctcggcatcgccactcgaaacactcccgggttcaacactacgtgcaacggcaccgacatggagacagactacaccttctgcagagacaaacatatcaaagctaaattgacagctgtgaagtctcgttcatggaaggtcgaagtcatgcacgcttggttcaaacctggagccgaattctatgccgagggttcggccaacgtcacatcttccatgcggaactttacaattcctgtgaacgatacatacggtgctgcttga

SEQ ID NO: 7482 - DNA, 477 bp, A.fumigatus
  unsure (73),(74),(75),(76),(85),(99),(125): Identity of nucleotide sequences at the above locations are unknown.
gacagggtcagactctgctccgtcagattcccggcgctgaacggcagtgataatggaagggggagggggtggnnnnatttgtatnattattgttctttntttttttttttttctttttatttttntttttttttttttttttttcttttttttcttacccctccctttttctttcctctttttctcttttttcttttctttttcctctcctttctttttcttttttctttcttttctttcccttcttctcccttttttctccctctttttctccctcttcttttctcctctctcctcctttctcctttttttcccctctctcttcttctccttttttcttcttctttttccctttttctttcctcttcctctttcttcttctcctttctctttctctctttttccttttttcttctcctccctttttccttccttcttctcttccttccttccttccttttccctttccttcccctc

SEQ ID NO: 7483 - DNA, 435 bp, A.fumigatus
  unsure (33),(34),(35),(36),(45),(59),(85): Identity of nucleotide sequences at the above locations are unknown.
acggcagtgataatggaagggggagggggtggnnnnatttgtatnattattgttctttntttttttttttttctttttatttttntttttttttttttttttttcttttttttcttacccctccctttttctttcctctttttctcttttttcttttctttttcctctcctttctttttcttttttctttcttttctttcccttcttctcccttttttctccctctttttctccctcttcttttctcctctctcctcctttctcctttttttcccctctctcttcttctccttttttcttcttctttttccctttttctttcctcttcctctttcttcttctcctttctctttctctctttttccttttttcttctcctccctttttccttccttcttctcttccttccttccttccttttccctttccttcccc

SEQ ID NO: 7484 - DNA, 423 bp, A.fumigatus
  unsure (20),(21),(22),(23),(32),(46),(72): Identity of nucleotide sequences at the above locations are unknown.
tggaagggggagggggtggnnnnatttgtatnattattgttctttntttttttttttttctttttatttttntttttttttttttttttttcttttttttcttacccctccctttttctttcctctttttctcttttttcttttctttttcctctcctttctttttcttttttctttcttttctttcccttcttctcccttttttctccctctttttctccctcttcttttctcctctctcctcctttctcctttttttcccctctctcttcttctccttttttcttcttctttttccctttttctttcctcttcctctttcttcttctcctttctctttctctctttttccttttttcttctcctccctttttccttccttcttctcttccttccttccttccttttccctttccttcccct

SEQ ID NO: 7485 - DNA, 792 bp, A.fumigatus
  unsure (353),(379),(393),(402),(403),(404),(405): Identity of nucleotide sequences at the above locations are unknown.
gaggggaaggaaagggaaaaggaaggaaggaaggaagagaagaaggaaggaaaaagggaggagaagaaaaaaggaaaaagagagaaagagaaaggagaagaagaaagaggaagaggaaagaaaaagggaaaaagaagaagaaaaaaggagaagaagagagaggggaaaaaaaggagaaaggaggagagaggagaaaagaagagggagaaaaagagggagaaaaaagggagaagaagggaaagaaaagaaagaaaaaagaaaaagaaaggagaggaaaaagaaaagaaaaaagagaaaaagaggaaagaaaaagggaggggtaagaaaaaaaagaaaaaaaaaaaaaaaaaaanaaaaataaaaagaaaaaaaaaaaaanaaagaacaataatnatacaaatnnnnccaccccctcccccttccattatcactgccgttcagcgccgggaatctgacggagcagagtctgaccctgtctcattgggatatgcggtcgagttcatgcctcttggtgtgccaaaagacgctcctatggagctgtcaactgttcgattcactgtcctggatttggacggccaccccgttccgctggataccgttgccatcaccatcatcaatgacttcaagggtaacatctacatggcgaagaccgacttcgaagatacgtctccgaaccgcctctcgtggaaacagtgccgtggaaagcccaagtgcctgcgcaagcttctggttgaacgcatccggggattgttttcccgccgcaaaggcgcgtattcttggaatgaggcctag

SEQ ID NO: 7486 - DNA, 246 bp, A.fumigatus
gatatcatgctcctatgcgatagtaggattaaagttagtcctaatagatggactactaatgagataggcctttgctggcttaaaaatctctttattcctactacttctagttatataactgggaaatattgccttctaattcttaatagccatagcagccaccttatgcctcaattcaatcaactctacagtaaaaataatgtgattcctatctatatacctgcttattcttcccacaagctttaa

SEQ ID NO: 7487 - DNA, 1056 bp, A.fumigatus
  unsure (22),(940): Identity of nucleotide sequences at the above locations are unknown.
acagggagcagttctctcctgnaagctggtagtgacagtatcatgatatgccatacgtatgctgtccaagtagcctcaatccagaaagtctgcgaggctgtacagtctggtcagctatcagcttcacgtctagaggaagcataccgccgcgtggtcaagttgaagagcaagtttctaagctgggatacagcgctcctaacgcggagtctcgatgatctggttacgttgaacaggaaagctgccacactggcaagcaacgcctattcgctttcagtcacccttgtccgcagtgatcctgacgtcttgcctctatcaaagtcgggacaccttgtactgctgttcccaggggaaagaacccctgcaggaggtgctgttgacggggagggtttaagaatgaaaggcgcttacgatgctacggtgtttggcgaggcgctgaaagctcacaatcaagcaactgttgagcttcactatggctctgcaggactatcgactgagcaatacaagcttgtcgaagcggctgatgctgttgttctcgtcaccttcaatgcacgagagtcgccctttcagagagagatgggcctgaagctcgctcagcacactcgaaagctggttaccatagccgcttgcagtccttacgactttttggacgatgacagcatcaagacgtatataactacctacgagccgactattgaggctttcacggccgcggcaaatattcttttcggtgccataatcccaaagggtgccctaccggttggatcaaagaatgtcgcgctcagttctgtccatgtgtcgccgtttgaagccgcaagtgatctggctgaactggcggaagtctggaatactgccctgccgacatatccactgccagcggacagtcttcacaggtttttgactcaggccaacggacatcacttcgttgctcgactagaatcanagatcatcggcttctgcgtcatgtatatgacaactaaccgaggcacgacgtgctgtcagctggctgtcctcgcaatccacccagctaccaacgccagggtgtgggcacagccttga

SEQ ID NO: 7488 - DNA, 726 bp, A.fumigatus
  unsure (702): Identity of nucleotide sequences at the above locations are unknown.
tcccggtaccagtctctcactctggctctgcaagaggaagctagactggcaggacacgaatatcctctctttataggaattgaccaagagaatggactggtcacccggatatcaccacctattgctgctcagctaccgggaccaatggccctgggagccacccattcgccagaattggcgtatcaggttggccaggttactggtgagacgctgaggttcttcgggatcaacatgaattacgccccagtctgcgatatcaattcagagcccttgaatccagtcataggcccccggagccccggagacgacccagaatttgttggtcggtttgcaagcgctgctgcgcaaggacttcgagaacaaaagatcatccccagtgtcaagcatttccctggacacggagatactgcggtggactcccattacggtcttccagtgatagaaaagacgagagagcagctggagagatgcgagctgatccccttccgtcgagctgtggcagagggcgttgaggcagtgatgacggcgcatatctccttacctgccatcggtgacggcaaactgcctgccacgctctccgctgatgtcttgagcattctccgcaatgagatgcagtttgaagggatgattattacagactgcctcgagatggaggggattcaagccacgtccggtactgaacagggagcagttctctcctgnaagctggtagtgacagtatcatga

SEQ ID NO: 7489 - DNA, 186 bp, A.fumigatus
cgcgcacaagacttagtggagttttccggagcgtgtgaccgagcctacgactcggtgttgaaacgtcgagcagccgctgtcctctacaaaaccatgctacttcccgagcatgctcaatacgtgtggtatgtctcgattgagagtgggctgcatattggacgaatgatctattgctatggtacatga

SEQ ID NO: 7490 - DNA, 297 bp, A.fumigatus
ctaacccaattattgcaatgcttagaaaaagtcctcattctcactgtcgacggccgcactttactagggacactcttgtcgacggatcaattgacgaatcttgtcctgctggacacaattgaaaggatcatccgaaccccggatgaccctgagccgagctcgcagatcgaacacggactctacttgattcgaggcgacaatgtggttctgtgcggtgaagtcgatgaggcgatcgataacgatatcgactggtcgaaggtgaaaggcgaggttgttaagggcacgaaaaacgcatga

SEQ ID NO: 7491 - DNA, 378 bp, A.fumigatus
aattgttctagcaaaaatagaatctgcaagggaaatttttgtccgtggtttagttctgaacaagcacaacaacccaattccgcctttcgtattgagatgcgacgcttaatgtatcaccgctccgcgactgtatctagtcacgtgcgtggagcttggcctagcttcggttcggaaatctgtctcaaaacacgtctactaaagggggagattgaaagtggctacgaattgaatgagtataatgtactagaaaaatacctgcaggaagatatatcaccaaaaactattcgactgggatatcatgtacaggatctaacggctagcgtgtatattgaccgcggatcatcggtatctcacatatgctcagaagcagcgcagtaa

SEQ ID NO: 7492 - DNA, 1113 bp, A.fumigatus
aatttcgacaggagcaataggaaacacagattgcccgttgtcatctttgaaacacagacctatcagaagcgtgagggcgagaccgacgttttccgccagaagatgcaggacgaatttctgaatattatcaaaaatacgacgaccctcctcaattccgttgataatcgacgcaaagttgtcatcagtcaacaccagttccgaagcgtctttggccacatcggaccccgattgtcccatagcaattccaacatctgcccgcttcaacgatggcgagtcattgactccatcaccagtcattgccgcaaaccgaccccgacgatgaagggcatcaatcatccgaacctttgtgttgggagcgcaccgagcaatcacagcaggcagagtaggcaacgcatcgatttcctcgtctgtcaacttatcaaactgactggcagtcatcaccatggcgtccgcaacatctttggcaagactgtccatgttggctggaatgatgccaacctgcgctgcaatcgctcgcgcagtacccgggtggtcgcccgtgaccatgtgaaccgaaatcccagcgcggtagcactcgtcaatagcgccggccgtctcaggtcggggagggtcatacagaccgatgagtccacagaaagtgagatctttctccacttcctcacgcgcagggacaacttcccctttgacggggttgtgattctcccgacaggcgaggcagagaactcgcaggccctcctttgcgagagcttccatgttctgcaagatttcctcctttatgttctcgtccaaggcgatcgggtcggaaccagctgtccaggtgacggtggtgcaagcctcgatgacacgttccaccgcgcccttggtgaagatcatctcccgatcatcattggtgttcttaaagatgacagacatctttttcacagtagaatcaaatggatattcagctttttggcgccaaacaggcttctcgcctttggtccagcgatcgcgtccccagttaaagcgcgaggcaaacacctgaatcgcaatgtcggtcggttcaccacgagcctgccattcattgtgctcggacctgtgcacatgggcaaggtttgccatggcggccacgttcag

SEQ ID NO: 7493 - DNA, 1245 bp, A.fumigatus
ctgaacgtggccgccatggcaaaccttgcccatgtgcacaggtccgagcacaatgaatggcaggctcgtggtgaaccgaccgacattgcgattcaggtgtttgcctcgcgctttaactggggacgcgatcgctggaccaaaggcgagaagcctgtttggcgccaaaaagctgaatatccatttgattctactgtgaaaaagatgtctgtcatctttaagaacaccaatgatgatcgggagatgatcttcaccaagggcgcggtggaacgtgtcatcgaggcttgcaccaccgtcacctggacagctggttccgacccgatcgccttggacgagaacataaaggaggaaatcttgcagaacatggaagctctcgcaaaggagggcctgcgagttctctgcctcgcctgtcgggagaatcacaaccccgtcaaaggggaagttgtccctgcgcgtgaggaagtggagaaagatctcactttctgtggactcatcggtctgtatgaccctccccgacctgagacggccggcgctattgacgagtgctaccgcgctgggatttcggttcacatggtcacgggcgaccacccgggtactgcgcgagcgattgcagcgcaggttggcatcattccagccaacatggacagtcttgccaaagatgttgcggacgccatggtgatgactgccagtcagtttgataagttgacagacgaggaaatcgatgcgttgcctactctgcctgctgtgattgctcggtgcgctcccaacacaaaggttcggatgattgatgcccttcatcgtcggggtcggtttgcggcaatgactggtgatggagtcaatgactcgccatcgttgaagcgggcagatgttggaattgctatgggacaatcggggtccgatgtggccaaagacgcttcggaactggtgttgactgatgacaactttgcgtcgattatcaacggaattgaggagggtcgtcgtatttttgataatattcagaaattcgtcctgcatcttctggcggaaaacgtcggtctcgccctcacgcttctgataggtctgtgtttcaaagatgacaacgggcaatctgtgtttcctattgctcctgtcgaaattctatggatcatcatgatcacctccgggctcccggacatgggactgggtatggagatcgcggctccggatatcatggaccgtcctcctcaaagcgtaagtacatcagtcactctttctgggatcatatactaa

SEQ ID NO: 7494 - DNA, 237 bp, A.fumigatus
aatcccagtctcagtcttacctatgccaccgttcttacaatatgcaacttcggcccgttgccctgttgcagcacaatgaatcattcccaaacgccgagcttcactgcaggtccggagggctactgcgccctgaatgtcgcgcctgtgatttccaagttacccagcattcaggatcccccggagtttgaagtttattgggaacgcaatgacccagagaatcctcgtctgtggtcactt

SEQ ID NO: 7495 - DNA, 891 bp, A.fumigatus
caagccatcttgggttctcccatcattgcctctcttatcgcaactatgtcacctccaagtcttaccgtcacccatatcaccacagcaactgctgttctgaacatcgatggcataaactttctgacggatcctttttttgggtccatcaaggggaccgaatatgacaccacgcccgcttgggagaaaatggatctgaaagcatttggctttgacagtattccaccaccgccgcacttggtcaacaaacaaggtcccgccctccagcttcatgatctgccaccaattgatgcagtccttctaagccatgaagatcacctcgacaatctggatccagaaggccgcaagctgcttgatggccgcagagttttcactactatggatggtgcatctaatctacgcccccgccctggagttgttggtctgcgcccctggcaaaccgtgactgccaccatcggcggaaaggtctttcgaattactgggacgccttgcaagcacttccctgtcggagaggttactgggtttattttggagaccgattcctttggggtcgatgctactggaaagcctaatgcgatttatttttccggtgacacggtgtatatcgatgagctgcgagagattggaaagaagtggcatatctctgctgctattctcaacttgggcaacgccaccttcgacttcccaacggggcctatccagattacgatggatggaaaacaggcggtccaactcacccgcgatattggggcagacgtcatgattccaattcattttgaatcttgggcccatttcactgaggatcgagaagatttggtgaaggttttcactgaagagagatttatggacaaattggtgtggacagttcctgttgttcccaaggttgtctattaa

SEQ ID NO: 7496 - DNA, 255 bp, A.fumigatus
gtgagcatcggggagaatcggcagtatggcagcttcaccaaggaatgttatccctggatgctgtacgaagtatgcagcataggcgcatgcttcaagcactggcagggaataattacagagatggattacgtaacagtgcatatgcaaccacagctccctggtgatcagctgccgggaaatgaggctgagggtgaggctgcctgcaggacgctactgcttatttcctccattttcaacatcgtcagtgtcaattga

SEQ ID NO: 7497 - DNA, 333 bp, A.fumigatus
  unsure (88),(329): Identity of nucleotide sequences at the above locations are unknown.
aaacagacgtgccattggcggaacatcgtcacggtcaacgccctcctgttgtcatcgcgtctattgggtctcccatgtctcaacgtanctttgggcgggaacatgcagggccaaggaatgcaaaacaaggacaaagtccctaatggacacgtactaaataggaggctttggagatccgtactgccatccgatgccaacagcgaattgcatcctatcactcgcatgatcactgggaggacccagtatgcgtctctgtgttcgaggtggtctaatctgaacgagcttgcaacggccttcggctggaggaggttgtatagggcggtgggtanctag

SEQ ID NO: 7498 - DNA, 261 bp, A.fumigatus
ccatcaagaaagcctataattaatatgcctctgatggacagattcctcgtgcctctccctgactattggaataactgggcaaagaaaccagatgcaggctacacgcaggagccgacagacatctcgaccgctgtcctcaaggatctatggcgttccctacttgaagaacagaatgatgaagctgaagcatatcaaagcctgccacaacgctttggctgcgagaagtcgaatcgaaccctacgggcgaatggctgcaggtga

SEQ ID NO: 7499 - DNA, 339 bp, A.fumigatus
aaagtgcaacggaactgtcagacatggattgtagaatccgcagatgaatggctgatagccacaaagtcggcaaaaatccagataagtcagcttcttgctaagagaaggtgctcaccagagcaattcaaggagatcttctccctttccctgattaatggtaatatgatgccgaccctagtctctggaccgacttataatcctggtagcgccattcttcaggcgggaggacttctaaaagcaatcggagatggtctcgcgctcaaggatatccctctccagatcgaagaagtgattgatgatcccgtcgaggcgcagtcgaccgcttctggcgtttcctga

SEQ ID NO: 7500 - DNA, 468 bp, A.fumigatus
gctatgctaagcagagcaggttctactttgttgagtttaatgtcaccgaccacttggatgcaaggcctcctcaacggcgctccctatctctgctcggccgtcatcgaatgctggaccactgcacccctgaatcgctggtttggtcgccgcggatgcattttcatctcctgctttatctcctttgcctcgtcgttctggatggcggccgcgcatacctggtggaatttgttgcttggccgtttccttctcggttttgccgtgggcgccaaatccacaaccacccctgtgtatggtgcggagtgctcgccggctaatatccgcggtgccttggtcatgatgtggcagatgtggacggcatttggtattatgctgggatatattgcctctgttgcgtttatggatgtgacgcatcccacaatcccgggcttcaactggcgattgatgctggggtcgaccgcgatcccgtaa

SEQ ID NO: 7501 - DNA, 237 bp, A.fumigatus
  unsure (217): Identity of nucleotide sequences at the above locations are unknown.
ttctgcggtgttaatgcaattatgtactattcctcgtcgatgtttcgggaagccgggtttgacacccgtatggcacttatcacttctctcgggtgcggcatcaccaactggatctttgccctgcccgccgtatacacaattgacacctttggacgacgaaatctgctattgaccacattccccccgacctgtatattcttctttattagccggcggngatcgacgatcgatgggtaa

SEQ ID NO: 7502 - DNA, 666 bp, A.fumigatus
aaggcgacctcgacttcccccgtctcttccccagatctctcccagaattcttcccaactctctgcatttttcttcgttggcctatattctgcaaggcatatctacttcctcctaaatttctactgcttgtctgccaccatggtggagaagagttccgatccagaggttccaagtctctctcaccatgagtcttctatatctattgagaagcaaggagatgcagctactgctcgagagtgggctcaggatgtgaacagcaccacgaccaacactaaactcaagaatcctcttgccgggttgactcgagaacagctcctgaatgacgtcgaggctttcgcgaaggagaaagatctcgagcatatcctcgacgatctgcgcaaaggagctcttgtcgcacaggacccaagagaattcgagcagatggacgcgctgacagagagtgagaaagaacttcttcgaagagagaagacgcatcgatggagtcagccgtttatgatgtattttatgaccagtgagtcttctcggtatcctcctactgaatttgattttaacccagcctgtcagtcctctgtgctgggatctgctatcgtgcaggaaatggttcagactgctgtcacggttgcgcaggagtatgtactctaccattactcatctgagctatgctaa

SEQ ID NO: 7503 - DNA, 306 bp, A.fumigatus
caatcctggatcagtcccttctttgtctgcatccaagtctacttttgtcccgagtcgccgaggtggtatatgatgcgcaaccgctaccacgacgcgtacaaggcgctttgtaaattccgcccgtctacgttccaagccgcgagagacttgtactatattcatgccgcattaaaggtggaggagaagctccgcgagggcaagcatttgttccgcgagatgttcactatcccacgcaaccgacgtgcggcgcaatcgtctttctttgttatgttcatgcagcaggcaagtcaatctcttcacatctga

SEQ ID NO: 7504 - DNA, 456 bp, A.fumigatus
cacattggtaccagcaatgcaagggactacttacgggatcgcggtcgaccccagcatcaatcgccagttgaagcccgggattgtgggatgcgtcacatccataaacgcaacagaggcaatatatcccagcataataccaaatgccgtccacatctgccacatcatgaccaaggcaccgcggatattagccggcgagcactccgcaccatacacaggggtggttgtggatttggcgcccacggcaaaaccgagaaggaaacggccaagcaacaaattccaccaggtatgcgcggccgccatccagaacgacgaggcaaaggagataaagcaggagatgaaaatgcatccgcggcgaccaaaccagcgattcaggggtgcagtggtccagcattcgatgacggccgagcagagatagggagcgccgttgaggaggccttgcatccaagtggtcggtga

SEQ ID NO: 7505 - DNA, 1293 bp, A.fumigatus
cgcatgcgcggatccgcagtccctgatcttcgggcccgtggtgaagacatttgtgatcttatgaatcacatattcacagtattgaaaacacactgtgataaacataatgcagatactgagttaatcgagttatcgaggtcggtactccttggacttcagagtgtagaaccccgaatcttaagttcagcgttggcgacgaacgatttaagagaaatcaaccggactttgaacgaattaaccgaaacagtttttgagaaaccgagtccttcgcaatgcgagggtgccaatctctgctatgcctcgacttccaactctgcgaatgagttattgtttgacttaatcgtgtttacttcccttatgtcaccgttgggcgagatgggttctgaagtcagcaaccccactagaaccagcagtttgacaaattttttactgaaggcaaaatcatcgatcccgaaaaacaattgtagcttctccgaattcaagccatgggattcacgagtcgaacttccgttagttgtactcccaaaacgtggccccacttcgagacacgactggaggacgggtatagcagagactctgacgctcagtttgcgcatgacccataacaatctaattcagaaaatggaggaagtctgcttcgacctcgaacagcgttgcactacaattgaagcaccactccgagcagttgaagatgagcgtgatcagattgctgtgcaggctgaacaacttaagcaacagaaaagcgagctggaactgcaactacaacaagcttcgagcacaatatctgagctgcagcaagaaatcttccatctggaaaatcatgctcggtcaacttctgcccgcgttgaggaattatcaacaagcctcgatactgcgcgaagggagttggaagatcagcgtcgcacctcccaggaaaccaccaacagtgaaagggaaaaagctcgaacaagggaactagaccttcttgcttcaatcacagaaaaagatgatcagatcgaagagcttcaggaggaaacacggaacttgcgggaagataataacgccttgcgccaaatactggatactgtctcgaaggagaaaaacacttctttggagcacacagctgccctcaaacaggacgtagtaaggctggagcaatgtgttgaacacggcaagctcctccttgcacagagggatgaagaaatgagtagacttcaggcagatcaaggacacatgaagtcgcagatggaagccttacaaaagaaggtacaaaagtttctaacgtctcctgcagtaaggaatactttgtgctga

SEQ ID NO: 7506 - DNA, 264 bp, A.fumigatus
ggcttccatctgcgacttcatgtgtccttgatctgcctgaagtctactcatttcttcatccctctgtgcaaggaggagcttgccgtgttcaacacattgctccagccttactacgtcctgtttgagggcagctgtgtgctccaaagaagtgtttttctccttcgagacagtatccagtatttggcgcaaggcgttattatcttcccgcaagttccgtgtttcctcctgaagctcttcgatctgatcatctttttctgtgattga

SEQ ID NO: 7507 - DNA, 810 bp, A.fumigatus
agaaggacctccccacaatcaccaccacctgctcctcctctaccacacctccacctccatcaccagcaacagatgacactacccccaagcccccatcatccccaactttctccacaactctctccccaattcccttcaccgccgcacctcgcctcccccctccccccagtcatcccccgcaccccgccctcccgcggccgcagcgtcgaccgcgcctatacgcaagaccttcacatccgctcccgcagccccaagaccttcccgccacgcccggaagaacgcagctaccccagcaccgacacctctgacccagccaacaacctggggaccttccgcagcaacccgcgcaccagccgcatcggcgaccaggaactgccgtggaaactcacactgccgagcgactcagacgaggagcgcgctgccgacgccggcacgaccgccaccgcacgcgagcgtgagggaagttggctggagagtaccacgcagcaactcctgcagtcgtcgcggctgccgacctacgaggaggactcggaggtgcacgggcagccgcctcgatttgttgttgcggatgagaaggctgcaggtgatgagcctggggaccaaaggcgcgggcaagggcaaggacaaggacaagtgcagagccagcgccatccgcaccgcggcgaggcaagagcgatcaatcccgacgatgcaccggtggaattgccggtgcagcgagatgacgactcgggcgaggagatcaccatgtcgagtacggcgtatcccgggcaggaatggaggccgttggggttctcggggtgggaatactag

SEQ ID NO: 7508 - DNA, 738 bp, A.fumigatus
cactacccccaagcccccatcatccccaactttctccacaactctctccccaattcccttcaccgccgcacctcgcctcccccctccccccagtcatcccccgcaccccgccctcccgcggccgcagcgtcgaccgcgcctatacgcaagaccttcacatccgctcccgcagccccaagaccttcccgccacgcccggaagaacgcagctaccccagcaccgacacctctgacccagccaacaacctggggaccttccgcagcaacccgcgcaccagccgcatcggcgaccaggaactgccgtggaaactcacactgccgagcgactcagacgaggagcgcgctgccgacgccggcacgaccgccaccgcacgcgagcgtgagggaagttggctggagagtaccacgcagcaactcctgcagtcgtcgcggctgccgacctacgaggaggactcggaggtgcacgggcagccgcctcgatttgttgttgcggatgagaaggctgcaggtgatgagcctggggaccaaaggcgcgggcaagggcaaggacaaggacaagtgcagagccagcgccatccgcaccgcggcgaggcaagagcgatcaatcccgacgatgcaccggtggaattgccggtgcagcgagatgacgactcgggcgaggagatcaccatgtcgagtacggcgtatcccgggcaggaatggaggccgttggggttctcggggtgggaatactagatag

SEQ ID NO: 7509 - DNA, 675 bp, A.fumigatus
gacagcaagccctcgggccaggcggagctggtccttatcgaccacggcctctacatccacatggaccccaacttccggcaccagtacgcgcgcttctggaaggctctgctggccttcgacaacagtaccctcagcgagatcgccgagggctggggcatccgcaactcagacatgttcgcctccttcacgatgatgcggccctacagcggcggcgacctctccacgcgccagcatctggaggggctcagcaaggtcgagcgcgcccagcgccactacgagatgcaacaggccgcccgcaaggccatccgcgagatcctcgctgacgagcacaagtggccgcaggaactcatcttcatcggccgcaacctgcgcatcgtccaggggaacaaccagttcctcggctcgccggtcaaccgtgtcaagatcacgggcatgtgggcgtcccgcgcgctcgttgagtcgcccgatctgccctggtccgagaaacttgcgaacctcggccggcatctcctcttccgcgtcgtgctcttcagcagcgatctcttcttctactttaccaaggtgcggcagctcctgcatctgggcggcggcatggaggatgatatcgagaagcagatgaaggatatggccaaggatatgggggtggatttgaaccagagcattttcgagggctag

SEQ ID NO: 7510 - DNA, 426 bp, A.fumigatus
tgcggccctacagcggcggcgacctctccacgcgccagcatctggaggggctcagcaaggtcgagcgcgcccagcgccactacgagatgcaacaggccgcccgcaaggccatccgcgagatcctcgctgacgagcacaagtggccgcaggaactcatcttcatcggccgcaacctgcgcatcgtccaggggaacaaccagttcctcggctcgccggtcaaccgtgtcaagatcacgggcatgtgggcgtcccgcgcgctcgttgagtcgcccgatctgccctggtccgagaaacttgcgaacctcggccggcatctcctcttccgcgtcgtgctcttcagcagcgatctcttcttctactttaccaaggtgcggcagctcctgcatctgggcggcggcatggaggatgatatcgagaagcagatga

SEQ ID NO: 7511 - DNA, 1020 bp, A.fumigatus
cccgtcgtcctagttcgccaactgcttgacctttttagtgagattccgaataccctcgatatccaagtcgccgtcatcaagtcctgcatcgactgggccgtctcagaacgacggtccttcctccgacagaacctcgaaacccgactggtggctatatacatgcagaagcaatcttactatgatgcccttaccctcatcaattctctcctacgtgagctgaagcgcatggatgacaaactcatgttggttgaggtgcagctgttagagtcaagggtgtatcatgcgctcggtaaccaagccaaggcacgcgccgccttgaccgctgctcgtacatcggccgcttcggtttacacacctccgcatcttcaggctgggctggacatgcaaagcggtatgctacatgcagaggacaaagacttcactacggcattttcctacttcattgaggcactcgagggatacagctcgcttgatgagagtgacttggcaacggccgctcttcagtatatgctgctgtgtaagatcatgctgaacctggtggatgatgtcaccaatttactgggttctaagcaagcacagaagtacgccagcccacgacttgaggccatgaaggccgtggctcgtgctcatgccaatcgctctctcgaagaatacgagaaggctctttcagactataggtacgaacttggaagcgatgttttcatccgtaaccatctccggagactgtacgacgccatgctggaacagaatctcatcaaggtcattgagccctttagccgggttgagctagaccatatcgcgaagatggttggcctggatacacagcaggtggagaggaagctttctcagatgatcctggataaggtaatcgtcggggtcttggatcaaggtgctggctgcctgatcgtctatgacgagacggagcgtgaccaggcctatgatgcagccctggaaacaattgagaagcttagcaatgtggtggagggactgtacactaaccaggcatcactgctggagtga

SEQ ID NO: 7512 - DNA, 339 bp, A.fumigatus
agactacgagggcttagactccaatatcagaaaataacactcggtcaaatactcattcactcttattcggatacccctagcttgcagtacaacggcggtgcacagggtataggcaaagtcacctatactgtatacaatgcggctggttactcttccaccaaacagttgtctcagctaaaaaccaccacgctatatggtactgtcatgatgccactgcgtgggacttggccataccctgctaacaccctgtgtgttgtacctggcccacccatatctgccttgatattgaagataaagaatcctccatgtgcttataggtccaacaccaacctttattga

SEQ ID NO: 7513 - DNA, 270 bp, A.fumigatus
agtccattggtacctaaaattgacattgctgtgattgatttcacattccgcctcaacagcatgttcacccacgggatccccgtcattaagcctggacacaatatctttccccagtggcggtgcgtctcggatgatggtatcaccatcttcatcgacttcataatcgccattcgacgtgtaaatcatctccacctcgtcactcgcatttatcatattccttccaactgcatcgtccggcgttctcatccggtcatgtgcgttaacttttga

SEQ ID NO: 7514 - DNA, 696 bp, A.fumigatus
cctttctcgggatgtttcatcgcctcgagccgcccaggaatccgtgcgcccttggcggatgttctccaaagctcacagtccagcgacttgagcgattttagcagacctgacgaattctcggatcatgacgaggagaacgatccaatcattcactctttcggtcctttcggcgacaacctccttccccgcatggcatctttctccgcagatgaatcacccctgcgaggcccacgcacctcccgcccccttcagcctactcattctcccaaacagccaaagcagccttctgaggaagatagctcggaacgcaagtcaggactgactgacgagacctatgagagaatccagaaccatgcggcgaatcaactggccttctcccgcctgtcttcgactccattctcgactatactgaataatcttcctccggctttgtggaagcgggatgaccggtcaaaacaagggccttcgagcgaggagattcgcgctatcctagagtccacaaaatgtattggcaaggttgcgcgcgaaggaaaagatgccgccggcaaaccacttgaaagtgaatactactatatacctgacttcgacgatgatgacatgcgacgtgaagcagttgtgaatgacctcagaaagccgggtcttcgcaactgccgaaagcaacacaaggtatgctttaggtctctgaccgatcgttag

SEQ ID NO: 7515 - DNA, 198 bp, A.fumigatus
  unsure (10): Identity of nucleotide sequences at the above locations are unknown.
tattgggacnttaatccctgttggaagtggccatgctccctggtcacaaaacttggaaggcctggcttctttgggctaaacttcttccgggctggcatccctgatatactcaagtctcaaaactttcaaccccaatacggctccaccggatcatatctatcggaggccaaatggtcagggaatctgcaaacggtggcc

SEQ ID NO: 7516 - DNA, 909 bp, A.fumigatus
tacatggacccaacttacaaatataattctgctcaggtcctgatctgggctggttcatgcatgtttgacaaccgaaatatcttcgatttcaaggcggtgcacaacatcgatgatcgacctcatctctcgtttatcctgcagcatgcgtatcacgatgatggcagtgaaaagggactgggatatgtccttgatgagcattacgagccagaatatgcagttggggtgacaaacgatctttcagcattcaatatgcatgaattcaacatcctcgacggcggaaagacagccctagcttgcctataccggcctgaatacatggaccttggagatttggggcgtcccgatgaacatggctgggtcatgactggtggtttcgtggaattggatgtagctaccggggctgtactctatgaatggagctcggtcggccacatccctattaatgagtctgtgcaagtcaatccctgggattcgccatctgcccagcctggctgggattatgtccatgtcaacgccgtggataagaacgcggccggtgactatatcctgtccgcacggtttacaaacaccatctacctcatatctggacaagatgggcacattatctggagacttggggggaaattttcagactttgtgcaggatttcacattctctaagcagcaccatgtccggtttgtcgattcaaatgaaacgcatacaactatctcattcttgaacaatgcttctgatgaaggaggacaagacgaagatcattccgctgctctctttgtggaggtggataccagtgcatccccaatgacagcacggttgctcgaccgttacgaccgcccggatggaggtctcacacgactccgtggtagcgttcagcgcttgtcttcacccaccggggccggaaggacacgcgct

SEQ ID NO: 7517 - DNA, 372 bp, A.fumigatus
ttcctcactccctacatcgatctattccaaggaaacatcgagcaatcacagcttacttcccatgttgacatgtacggccttgatccgactataggctgccagaccagcttcaccaagctcccgcccaatgccgctctgcttgacacccccaaatggcactcgaggatcacagtcttggctactattgatccagaccattcccgaatcaatctctgcagcaaccctatgcgctcgttccaggtctcttgtaaacacggctgccccaaggccatagatggtatcgttggcccgacggatggcttcttcttccgttgcgaatggctcgataatcaccacggggccaaagacctcctcccgcacgatagccattga

SEQ ID NO: 7518 - DNA, 357 bp, A.fumigatus
aaattcatccgactgcttgcggttgacttctacacacggcatacaaacatcggctcaatggcctggaaccgctccgtgtcctcgtggatcatattcttcgtgtttctcgtggatgaaactcccccatggttcgcagcccatgaccgccaagaccaggacctgcaggtcctccgctggctctacaatgacgacatgcacgagagcgatatcgatatcacagccctacacgaggatattccccgcaccgatgcttgtgcaattccgttgctggacatcggaggcaaaaattcatgccgatcccgatgtcttggcactggaggatacaaagaagcggacttgttactgtttttgggctga

SEQ ID NO: 7519 - DNA, 828 bp, A.fumigatus
gacacttcaccatccctcgtgttttcggcatatactaataaaaacaaccagatccgcgtctaccgctacttcttccaatatggctacctcacgacccccgctgttgagcaaccgccaaaacccagcagcgacatcctaaaaccgaaaagcatcctcacccgcgctccgatcatggaaatcgacgtgaacatgcacaagtccaactcgacgtacttctccgacctggacgtatcccgaacagccctcgtgaattccctgttgatgaagggctccgcattccttgagaaacgcctccagaagcaggggaagcgcggcctccttcacttcgttctcggtggcgtctacacgagcttcaagcgcgagattccggcgtacatgaaatacgaggttcagtcgcatatcgcctcgtatgatgagaagtggatctacatcgtgacctatttcttgcagccgcgcacggggaagaaggcgtcggccgagacggacgaggatcggaggaagaggctgcttgccgtgtcgattagcaagtatgtgctcaagaaggggcggtatactgttcctcccaatgatgcgtttgaggcggctgggtataggccgttgcgagctcctgcggcgaatggcactgcgaatggtgccgcgaatgagaatggatcgctcactcagcgcaaggagtccaagtccggccatacttgggatgacaacagtgagtgggagcaattgcagaaggagattcgcaaagggaaggaaatggttcaaccatttgtcgaccaggaggagaagctgttggatgattacatggagaagatgaaactccctgcgtttgcatag

SEQ ID NO: 7520 - DNA, 186 bp, A.fumigatus
ctttatttgtgttggtgtttcctccaattagaaaacaacctaaatgcgtcccttgtaaaaggaattaatgcggcccaatcctccattctcttcttccgtcactcaagaggtttcattgaatacggacaggataaatatactagtgtcaaacgatcgaggactgcatacagtgcgaatcattgttga

SEQ ID NO: 7521 - DNA, 396 bp, A.fumigatus
ttccccgaaggagacaggaacagagatggatattttgtccggcctactgttttcacaggtaccacagactcaatggctatcgtgcgggaggaggtctttggccccgtggtgattatcgagccattcgcaacggaagaagaagccatccgtcgggccaacgataccatctatggccttggggcagccgtgtttacaagagacctggaacgagcgcatagggttgctgcagagattgattcgggaatggtctggatcaatagtagccaagactgtgatcctcgagtgccatttgggggtgtcaagcagagcggcattgggcgggagcttggtgaagctggtctggcagcctatagtcggatcaaggccgtacatgtcaacatgggaagtaagctgtga

SEQ ID NO: 7522 - DNA, 1251 bp, A.fumigatus
tcatggatacgaatcaatatggccacaacgtcttcatctgcgactggtctgggtgggtgtgacgtcttgcaatggcagcatgagggccggccagccaaaaggcgcaaagggatctcgatgacaagcacgtgccagccatcgcctcgagagattggaattatgagagagacagaacgggatgattcggcaacatttctgggaagttccagcggtattcattttatccgcacagtctacagcgcattcgcaaagcgttcggcggtcttacaggaagcgcgagtcaggaaccagagcttagtgcctggcgaagacgatcagttacaaagaagccctggcaagtctcacgggttggatgagctctgcctgaaacatgagttatctcttcaagcccctgattctgtgtcatttgagagcctcgtgggatggtcacggagctactttgagtattggcatcccatcttcccgttcctacatgcaccgaccgtgctgaaagccatggaaagggtcggggagagcggaatcgggtcgctggaccgtattaatctagcaatattacgctctatactttctatatcggtggttgataaccgccaggtgcagaactctggtatgacagcggacccgattccttctgtactggtgtatcgaaccgtgcaagaggcgatggaaagcatccatgctttgctcctggagccctccacgcttccattgttgcaggcagtattcagcgtccagctagtactgacgtctgtattacgtctcaatacagcttccagggtcgggggactgattagtcgaactgcgtttcatctaggtcttcatcgctgtcctgcacggttctcgtgtttcagccgtgaagatgcagatatccgccgtcgtcttttctggtcaatttattgtctggaaagatatttgtcccaagctctcggaacaccgcctagtatacaggatgacgacatcgacgtctgctatccagacaatgaaaggcatggagaaatcggaaaggtgccgcgggcgaagggccctcacagccacttgcgattgcttacccatctcgccaagtttgcgagacttaggggtctgatactggagcttcgcaacaaatccatcctgcacagtcataataacaccctcgcggccacgtatgtctacggtgaactggcgcaatggtggaatgaggtctatgacaaattttatcccatgggaaaaccaccttcaaggttccgtcccaatttgaaaccgtggctgtga

SEQ ID NO: 7523 - DNA, 327 bp, A.fumigatus
aggtggttttcccatgggataaaatttgtcatagacctcattccaccattgcgccagttcaccgtagacatacgtggccgcgagggtgttattatgactgtgcaggatggatttgttgcgaagctccagtatcagacccctaagtctcgcaaacttggcgagatgggtaagcaatcgcaagtggctgtgagggcccttcgcccgcggcacctttccgatttctccatgcctttcattgtctggatagcagacgtcgatgtcgtcatcctgtatactaggcggtgttccgagagcttgggacaaatatctttccagacaataaattga

SEQ ID NO: 7524 - DNA, 807 bp, A.fumigatus
gacgtgacccctgattccttctccgacggcggcaagcatttctcgcaggacctctccgccctcaccgagaccgtccgccatctcatcgcagccggcgcaaccatcatcgacgtcggcggagagagtacccgcccaggttcagccccagtcggtgaagccgaggagctagcccgagtcatcccggtaatacgacacatccgcacctccatccccgaagccaacaacattgccatcagcatcgacacctaccgcgccaaagtagccgaggaggcctgcgctgccggcgcagacatcatcaacgatatctccgccggcaccctcgacccggaaatgctccccaccatggcccgcaccggcaaagccgtcatcctaatgcacatgcgcggcacccccgccacaatgaccaagttaacagactaccccaacggcatcgtccaggacgtcggcgccgagctccgtgcgcgcgtcgccgctgcagaagcagccggcatccgccgctggcgcatcatcctcgaccctggtctcggcttcgccaagaatatgcctcatgatctggccatcctgcgcgatctgcagcagttccgcaccggtatcgaagggctagagtacttgccctggttgatggggccgagtcggaagagattcattggtcggctgacgggcgtggagaaggcgagtgagcgcacttggggcaccgcggcgactgtcacggctagtattgctggtggagcggacattgtgcgtgtgcacgatgtcagggagatgtggcaggttgccaaggtggcggatgctatataccgtgtataa

SEQ ID NO: 7525 - DNA, 366 bp, A.fumigatus
agcacagaggaggaacttgagcgcaccagatcccgattcggcaaccagaagggtatttcgtcagacgagttcttcggacgggatcgcttcgaccctaatgcacaggccgaagctaaagagcgactccgccagttcgacgggggctaccgccattttcgagtcacgtttattttgtttcttcgggaggatgatttcgcgaccggtgatgacacttacggtgactttgagagtgcagccaaggatttctttcgccgtttcggtatcacggccggtgatgattttgaaaagctgacacagcttgtaggtgaaggtgccgtcaaattgcagggtacgtaccgctattctgttgtcgaccataacctttga

SEQ ID NO: 7526 - DNA, 600 bp, A.fumigatus
  unsure (503): Identity of nucleotide sequences at the above locations are unknown.
caaggacgtcaaggtcaaatacacctgcaacgctgctgtcaagtacaaggaggagttgaaaagacgggctgcgcaggatgctcaacagttcgtcatccagtgattctcgactctatcacacacacaaatgctgatttggttttattcagataccccgaggaggtcgtggttacagacattcccgctggcactgcttcggacggatcgagtacccctgctggtgacgcggatgacgatttcttctcctcatgggataagccttctatcaagcgacccagcaacccaccttcgcgcacaggtacgccgccagtggtgagccggactgcgtcgccgttcctgaacgctggcgccaatggcaatggtgctcgctcgaaatcgcctctttcggcctcagacaaggaggctacttcgcctgctccgaccgctatccgggcaagcgcctctgtccggaaggcatcgtctacaactaccgcgaagaagggcagcgttctaggcgctaaganagcgcctaagctgggtgctaagaagattgggcggggcggaagccatcgatttcgaggaggcggaacgaaaggcaaaggaggaggcagagcgcattga

SEQ ID NO: 7527 - DNA, 327 bp, A.fumigatus
ctgctcagcccatcaccgcaatcttggtgtccatatctcctttgttcgttccacgaacctcgaccgtatggaaccctgctgccacagcctctgtcacatgtcttgaaaactaactacttatttacagaatggcaatgggagcagctgcggattatgaaagtcggcggaaacgaatcggctaccaagtatttccaatcgcatggaggatctgccgctttagctagcaaggacgtcaaggtcaaatacacctgcaacgctgctgtcaagtacaaggaggagttgaaaagacgggctgcgcaggatgctcaacagttcgtcatccagtga

SEQ ID NO: 7528 - DNA, 432 bp, A.fumigatus
  unsure (10): Identity of nucleotide sequences at the above locations are unknown.
gcgctaaganagcgcctaagctgggtgctaagaagattgggcggggcggaagccatcgatttcgaggaggcggaacgaaaggcaaaggaggaggcagagcgcattgagaagctcgggtatgaccccgaagcagagcaggccgaggccgatgccaaagccaagacttccaccgctgccaccgctatcgcttctcctactcccattagcccaggagcaggtggcttcgggtccacaagaaaatctcatgaacgaagtgccagtgaagtggagcgcctcggaatgggtattggaagactgggattcggccagactgttggcgccaagcctgctgctcccaaaaagctgggattcggttctgttgctcccgtgcggagcgctgaagatggtttgtttcatttctgtcatctctgggccagtttcattgggttctaa

SEQ ID NO: 7529 - DNA, 276 bp, A.fumigatus
gactcgggcgctgaatttaacgcgcgtcagaaggagttccgtgagaatttggaggcagctcgcaagaagagggaacagcaagagagtcagtctgtcgatgcttctggttctaccccagcttcccctgctattcgtgatcgcttccgtgagtacgctaccgctcccactgctccccgactgagcaatgcgagcagtgaacttagccctgttgttgatgccgccgacgttcttgatagcaaggcattgggcttactttccacccaccgttctgtatga

SEQ ID NO: 7530 - DNA, 378 bp, A.fumigatus
gacgagcagttgtcggaagccaaccagtctcccaagcgtggccccttatcttcgcttatttacggaacgaaggaaggccagcatttcgacaaggacatcgagcgttcattttcacaagtcctcgctcgcggcaaatatgtccattcgattgtcttccatgatgtcaaaccagacaaagtagatgaatatgtcgctctcgtcggcgagtggtacccccgcatggccaacaccgaagaaaacagggttaatctggttggaagctggcgcacgcaagtgggagacaatgacacattcggtatttccctctatgaacccagaaatcgccaatggagcccccttccgttgaaagtcgtttctattgagtttttccgatgctga

SEQ ID NO: 7531 - DNA, 501 bp, A.fumigatus
cgtagccttccggaagtgcacatatgggagtaccagcgttacgagggctatcatgcctctctgcataacatttctcaacatcccgagttcccagcatttgaccgcaagttgaagagtctgattaagagcaagaaaacgtccctgatgcaggaattctccttttggccgacaactcctccacgccgcctcggcggtctctttgagcttcggtcctacacccttcaccctggaaacttgcttgagtgggagacacactggcgccgcggcttgagggcgcgccgtgaagttatggagggtgtcggtgcatggttcgtccagattggtgatctgaacacggtgcaccacctttggcagtttgcgaacctggaggagcgcaagacccgtcgcgagcaatcttggggcattgaagggtgggcagagacagtccacaagacggtgccgctcattcaaagcatgcagagtcggattctgattcccatgccatggagcccggttggatag

SEQ ID NO: 7532 - DNA, 438 bp, A.fumigatus
agaacaaccccatcttcccaacctacccacgggtatgtagcccccgagatcctcaggggccaactgaccggataccagcgcatgacatcgactgaggttagcaatggactggtcctaccgtatgcagccatggcaattgcagggaagggaggcgccgcggccatccttctcatcacgttcatggcggttacatcgacactgtcggcgcaggtcattgccgtcagttcaatccttagcttcgacgtctatcgcgagtatttcaaccgacatgcttccgaccgccagattatccgtgcaagccattttggtgtcatcttcttcgcggccttctccgccggattcagtaccatgctgcactacgtgggcatagacctgggatggaccctgtatatgcttggtaagtatcgtgtcgtgacgactttctcccgcgataactaa

SEQ ID NO: 7533 - DNA, 339 bp, A.fumigatus
gactggtgtgcatattgtggcggccacattcctcttgcctgtgggtgtgaccgtctataccttcgtcggtggcatcaaggcaacgtaagcgctgaattgagtagacaggaatggcacctgacattgagacgcaggttcttgaccgattatttccacacggccgtcatcctcacaatcgcatgttacttttcagtcaaagccgttacagtcggcgaggttagctccatcggtcacctgtacgagctggtcaagtcggcttccgagcgacatccagtttctggaaaccatgcggccacttacctgacgatgacctctaaaggcgtgcgtcatcttccctga

SEQ ID NO: 7534 - DNA, 327 bp, A.fumigatus
ggcatcctcttcggcattctgcacatttgctcgaatttcggcttggtcattgtaagtgctcggcctaatgcgatgctcccgctaactcatcagatggacacgagtttcttcatcaaggcattctcggcggctccttcggcagttgtgcctgggtatacaattggaggcatagcctattttgccattccgtgggctctaggaaccatcatgagttcagtcgctctgggtctagagaacaaccccatcttcccaacctacccacgggtatgtagcccccgagatcctcaggggccaactgaccggataccagcgcatgacatcgactga

SEQ ID NO: 7535 - DNA, 186 bp, A.fumigatus
ccatggcgatctagacacggatcccagggtgtgctcgacggcgccagcaacgccagtctagacaatgagttcgggactcacaatatcgacgattgcattgtgaagatcctggagagggggactttccagacttatactgtaagtttgctttctaaatctgcagggatagcctatggcaaaagctga

SEQ ID NO: 7536 - DNA, 234 bp, A.fumigatus
gtaaatatcgtgaacaatgtcctgcataccagatccctgtgttttagtgatttctatgatcgagggactttctatgtggctcaccggctctggcaattccagcttttctctcagcaaaagggtttttgcaatgagttccctttgcttgagagtttcgttggcttgattgacgcgctcgattgttgggcgcagaccatccagcttatcatcaagaccgagctggaaaaagaaggg

SEQ ID NO: 7537 - DNA, 228 bp, A.fumigatus
acgcagttctttgtcaggtccgctctttctagaagcatacgcagctttgataatatttattcgatcgatatcatccaaccactcgacaacatggcctatcataagcgtccaacgtccaactaccagccttgtgacagctattttgtggagttctacgacgacttccctgctcctcgtatcgaccccaaggaacatgcgaaattggttggccggggaacgacggtttgc

SEQ ID NO: 7538 - DNA, 1146 bp, A.fumigatus
  unsure (1075): Identity of nucleotide sequences at the above locations are unknown.
gaagaagtccagagcaacgagatatttccgtttcattcatttcatcgacctaggctctcaagtaaagtcaatcatccatctcagatcacagccgccaaccgtttgacgcaccctacaatgaaagaaaatacttgcattcaagacgcgatgggtcctaaactggtcctaaccaacgcaatctctgaatataaccccttgccatgctcaaagtacagcacgcccaaaactggggtcttttctattatgccacggagatggatcccttatgccgaactcatgcgactcgatcgtccggcaggctactgggccttttactggcactttgttattggcctcaccttggcagccaacatgtcttctccaattccatcgccgctgaccctcgtctctctgtttctcttcttcgcagtctgggtaatcatactgcgtggagcagtgtgtacctggaacgacactctggaccaggatttcgaccgcaaggtgtctagaacccgaaatcgtcccattccacgaggcgcagtcaccacaatccaaggccatctcttcacactcgctcagattgccctggggacagcgatgctccttcctttgcccctggggtgcatgtatcgtgctgcactcatgacagctatcctgctggtgtatcctctagggaaacgagtcacggatttcccacaggtcatattggggattgcattcgggatgtctatcttcgtttgcagtgcggctctagatgccgatccccatccactgtcgggcttatatagtcttggaacggaaaccgatgacctgcgcctggttactgcgctttgtttctacatagcaagtatcctgtggacagccattttcgacactatctacgcgcaccaggatgccaaagaacatgccaaggtgggtgtacggtcgttagcggttcgccttggcgaacgcacgaagcacacattgtctgtcctcgcggcgacacaggtaatgctgctgtccgctgcgggtatagcatgcaatttctcggcaatctactttgcaggcagctgccttggaacagcaatctctttggctgctttgttatgggtttgtngatcttgcggaatccggcgaactgcccgtggtgggtttggccgggggtctccccctgttgggtgccaataa

SEQ ID NO: 7539 - DNA, 201 bp, A.fumigatus
acgttcttacaggcctaccactaccataaggtgcgcttgacagctaaagcaatcttcacagtttcggtccgcgactctggtccctcttcccctgtctttgagctgtctaagacgaatcaatatatctggcagtttgaccaattaagtgccgttgatctgcgctgcatcaaaccttactattccaacacaatcgcgttctga

SEQ ID NO: 7540 - DNA, 201 bp, A.fumigatus
acctttattttttgctttcgagccttgggccgtgcgttgttaagtcgagttcttggaagacgcacgttttgttgcttgccagtctttcgtgataatgacatttggctgcagatgcagatgaagaacgttaacaagggtatctcacaaatacggttggagaatatgattgagacttcgaagactgcagctttggatgcctga

SEQ ID NO: 7541 - DNA, 300 bp, A.fumigatus
cttcctcagccctgcaggttccacccgtcttgtactgatgtatatgaagtttcctcactattcggaaatatcttcctcctccgttctccacgaaaatggcatacacagcgtcttaacatgctgacaactagaactgcgttgcatgagactggcaaattacgccgtgtaacccacacatttacacccaatcctggactttacctaggtattaccaccgattgcttgatcgtcaacgacctacctattctgcagtcagaaagtgggtcgtgccccgtgttaggacatgtaagtcacttatag

SEQ ID NO: 7542 - DNA, 225 bp, A.fumigatus
ggcaagatctatactgcctgcgggcagggcaaaatcccatttatcagtgttatagatattatagctattacctatcacgctctaatagatcctaactcacataactatgaccaccaggtgctaggacctgagctcttaacatataacaacattactaagaagctaagccatgtcctaggacaaataattaagcatatcaaactttcaggagaggagcagtactaa

SEQ ID NO: 7543 - DNA, 1272 bp, A.fumigatus
ctattgatctccgctgcccgatttctagctcccactatcattaccaccgcacctaccagcaatgaactggatcaacccgttaagaagaaacccaaattcaaaatcctttccggatcgaaaaagagctcgtccgacggaccacaaatgtatgctcagcgacagagccccggtaccaggtctcgccatgggacccagggctccaccgggtcgcaggcaaccgatgcgacattggcaacgtccaagatgagcggggaagagccaggtcgtctctcgactacgtcaatccgcagtggtggccgtgagccgggcaacgagtcccaacgttcgtccgtcaccgacgctcggttttccgagtcatcccgttcggatcagagttccggagatcatggactataccactcccattccccgaacgacggaactttaagcggaggtaaacgttttcgcatgccgcgtttgaagagaaatcggggtcccctatttcccttgcctcctcgaccggctggcagccaacccatgaatggccatggacaggactcacagacctccagggccataagttctgatccctcccccagcttcgagccgccggatgagaaggatcaggaccgtgtttcgccgcttccgtcgcccagtcgttcgaccgtcggtcttgcctccccggcttttcctctgcgcagaaaggactcggcgaactccgccaattccgcccggtcagctacttccactggaagtggacatcgaatcagactgcgcccaaggtcatcgacgctcgactcgttggctaatctccgcgaagatgggcaacagtcacccgctcacttggcctcgtccggtcgtacttcgacttccaccagtggacgcaaaagtttcggggacatcttcagcatctcgcaccgattgaggcaaaattcagagcccccggttatgcgagatggctctcccggtgtgagacgctcggatactcctgttcacaagctgtcctaccccgaacgcgaggagaatgacacaccagcaacgtatctgacacgcctggaggagagcatacccaagagcacaatcgccggcgtcctctgtcagtcgaatgaagacttctacaagaccgcgttgcgaaagtacatgcggagattcattttctttggggaccctatcgatatggcgattcgaaagcttttgatgggcgctgagttgcccaaggagacccaacagattgatcgcttcttgcaaagttttgccgtcttcaccacggggctggaaggacagcgatggtca

SEQ ID NO: 7544 - DNA, 423 bp, A.fumigatus
ttccctctttatccggaagagacggacgctcagatctcttcgtttataatttctttcccgcaaggctctcattatctaccaaacattatccagctccttgcccctcctttctcctacgttccaaccaacctctccgttttggggtttcctttttcaccagtctgttttcccttccttggcatctccaatgttctcctcggccgcgtctctgcttctgatccacgcacttactactactccatcctactagacgcctggcaatgtaagggttgcattaaccctctccgactttttatatgcttgtcgactatccggggttctcttgctcaatcgagtgctcctctgttcccccttttttccctcttcgaactttctgcgacctccctcctcgattcccgccaaattgctcgattctcaagctag

SEQ ID NO: 7545 - DNA, 837 bp, A.fumigatus
ttcattctcgctttcgctctcaggccgctttttagcccccttcctcttcttccccgcggtctgcaccatctccatcaacgtcttctggcccttgccgccccccgcagctttattcttcttctgctcttccgccgccagcttccgctcatactgctcctggtgtttcgcgcggacttcgcggccctcctcggcgagttgggtctcgagggccctaaactcggggctttcggggtccatcccgatgagggactcgaggagggcgatttcgcgggcccagacagacgggtccgggacgagagctttcgcgcctccggctttagacttgctccgcttggaggtctttttcttgctggtctgttcggtctcgggtgccgagtcggcgtcgatgtcggcctcaacgtcacttggttcgtccttgatgttggcgggggttgggttggcggggcggtcgatgggcgtctcgaggatcatggggaggccttcgaggcgcgggtcgttcatgatgttgtggaaggcgcggagacccaagaagcctgtgccgatgttggcgtggaggtcgcgtttgctgccgcgtggggccttggagtcgttgaggtgcagggcgcggaggtactgcagaccgatttggtcttcgaactccttcatgaaggactggtagcctgctggcgaggagaggtcgtatcctgctgcgaagctgtggcaggtatctatgcagatgccgatgcgggggtgatgctcgcgcgggatcaaggcgaggaggtcccggaactcggagaggtagccgccaattgtggtgccatggccgcacatcgtctcaaggacgggaacgacggttga

SEQ ID NO: 7546 - DNA, 204 bp, A.fumigatus
ccaaggtgcaggcacatacttccccacggctcatatctcgtaaacctagcacaagaggacaaggtcaaggccaagcaggcatacgattcattcctagacgatctccgacgctgcgaagcgcttggaatcaccctctacaacttccagttaggctcagatcaccaccaccaaaaccaacccggccgttcacttaccatcccatag

SEQ ID NO: 7547 - DNA, 414 bp, A.fumigatus
gacgatgtgcggccatggcaccacaattggcggctacctctccgagttccgggacctcctcgccttgatcccgcgcgagcatcacccccgcatcggcatctgcatagatacctgccacagcttcgcagcaggatacgacctctcctcgccagcaggctaccagtccttcatgaaggagttcgaagaccaaatcggtctgcagtacctccgcgccctgcacctcaacgactccaaggccccacgcggcagcaaacgcgacctccacgccaacatcggcacaggcttcttgggtctccgcgccttccacaacatcatgaacgacccgcgcctcgaaggcctccccatgatcctcgagacgcccatcgaccgccccgccaacccaacccccgccaacatcaaggacgaaccaagtga

SEQ ID NO: 7548 - DNA, 1008 bp, A.fumigatus
gctcagatcaccaccaccaaaaccaacccggccgttcacttaccatcccatagtcccggaagcgccaaccaaagcagcctcccagacgccctctcaaggctcgccaaggccctgaccaacgccctcgaagctacctcaaccgtcgttcccgtccttgagacgatgtgcggccatggcaccacaattggcggctacctctccgagttccgggacctcctcgccttgatcccgcgcgagcatcacccccgcatcggcatctgcatagatacctgccacagcttcgcagcaggatacgacctctcctcgccagcaggctaccagtccttcatgaaggagttcgaagaccaaatcggtctgcagtacctccgcgccctgcacctcaacgactccaaggccccacgcggcagcaaacgcgacctccacgccaacatcggcacaggcttcttgggtctccgcgccttccacaacatcatgaacgacccgcgcctcgaaggcctccccatgatcctcgagacgcccatcgaccgccccgccaacccaacccccgccaacatcaaggacgaaccaagtgacgttgaggccgacatcgacgccgactcggcacccgagaccgaacagaccagcaagaaaaagacctccaagcggagcaagtctaaagccggaggcgcgaaagctctcgtcccggacccgtctgtctgggcccgcgaaatcgccctcctcgagtccctcatcgggatggaccccgaaagccccgagtttagggccctcgagacccaactcgccgaggagggccgcgaagtccgcgcgaaacaccaggagcagtatgagcggaagctggcggcggaagagcagaagaagaataaagctgcggggggcggcaagggccagaagacgttgatggagatggtgcagaccgcggggaagaagaggaagggggctaaaaagcggcctgagagcgaaagcgagaatgaactagagagtgacgacgaaggatgtcagagccattga

SEQ ID NO: 7549 - DNA, 216 bp, A.fumigatus
gagtttttaatgccgtgcataacagcatgcacattgggtactataagaagattgtggccgattgagtggattttggctgatgtgccctctagtggtaatgcatttgctctcttcctgaagtcgcagaggaaatgggagaaccctcccctgcaagatgatcatcgagatcagttccgtcagttgtgtctggaacacaagtatgacggcgcaaagtaa

SEQ ID NO: 7550 - DNA, 411 bp, A.fumigatus
ctgtcgacatggtacgcaccctactgccaacatactaggcagcggcagcacctaacagcaaaacagtcgcaatcctccctccctagtcccacgaactccgccgctgcgctgtccttcctcacctcggtgggcggaatcatcggctacacgcgtacgggctccatcccctccatcgcggcgggtctctcagtcggcgcgctatatctgtacagtttcctgcgtttgcgcgacggacagccctacggcgaggagatcgggttgttggcgtcggcggtgttggggggtagttctgtgccccgcgttatcaaaacgagggggaagcccgtgcctctggcgctgagtgttctggcgacgtatgggcttgtggtttttgggttggcgtttcgggagaagagggcctcgaggatttga

SEQ ID NO: 7551 - DNA, 285 bp, A.fumigatus
cagcaaaacagtcgcaatcctccctccctagtcccacgaactccgccgctgcgctgtccttcctcacctcggtgggcggaatcatcggctacacgcgtacgggctccatcccctccatcgcggcgggtctctcagtcggcgcgctatatctgtacagtttcctgcgtttgcgcgacggacagccctacggcgaggagatcgggttgttggcgtcggcggtgttggggggtagttctgtgccccgcgttatcaaaacgagggggaagcccgtgcctctggcgctga

SEQ ID NO: 7552 - DNA, 228 bp, A.fumigatus
gagtcccgtagcataaggcacgcgacactgtgcatccctaactcaaaatccccacctcaaatcctcgaggccctcttctcccgaaacgccaacccaaaaaccacaagcccatacgtcgccagaacactcagcgccagaggcacgggcttccccctcgttttgataacgcggggcacagaactaccccccaacaccgccgacgccaacaacccgatctcctcgccgtag

SEQ ID NO: 7553 - DNA, 213 bp, A.fumigatus
atcaatgacacgatgcccatctgcatcgaatgctcttaccccgtctcgcacctgtatagcacttacagtcgcgccgacgaccgctctttgggcaagggcgtgcgtctgacgcaatgtccgcgctgcaagcgttttgcggacaaatatgtggaacatgattttgtggtgctttttatagatctagttctgatcaagcctcaggtatttggttga

SEQ ID NO: 7554 - DNA, 1239 bp, A.fumigatus
agcgcggttccttccagccccgtttgtgaagacagaatgggccggcttcagaaggaggtgtccttggacagagtgattctcttagatccactaggtggaattccggcgttcaatcggcgacagccatcccatgttttcataaacatggagcaagaatacgatgatatcgaaaacgaattgctacaagcgcgagagatggtgcctgccacagagacaagcctgttgaaggcgggccccaattccgtcgcagataacaaccccatctcaaaattcgtccacgcagaggtcgtgccggtgccctcaggctcgacaccggaactgaagaccgcggtcccccaaaggagtgcaattgaaggtcatctggagaatctgcgtgttgcccagaaggcgctcgctatgctgcccgcggcctcgtcaggaataatcacatcgccattcgaggtcgcgagctcggcccagacatcgcccacttctgagttttccgcagtgggcactcgtcggcagagaaaccccttaatccacaatctactgacagataagcccttgctatcgtcgtccctacccatgagccggcgtggaccgacgaacaatgggcaaggcgccgtttatcctgtcacctcgcatacgacgtttgtcaaacgcggtatgccgttgactatgctgcccaatccgtggacggagccgtggacacctcagagtcggccgcggttgaagttggacgatcctagtatcgacttacctcgcttggttcatctcattgaggattcctttgaccggaaactcgacgtacaggactacttgaaccgtgtcaacgaccgccttgctgggttgatcattgccggtgaatacgagggcggcgccattctaacctgggaacttcctcctggcgtggaggatgatggcagtgaggccagtaatgctcgaatggttccctacttggacaagttcgccgtgctcaagcgcagtcaaggggcaggcggggtcgcagacattgtcttcaacgccatggtgcggtcctgctttccgaacggagtatgctggcgcagccgcaagaacaatccggtgaacaaatggtattttgaacggtccctgggcacttggaagctatccgacaccaattggaccatgttctggaccacccctggcctggtggaggattcgcagaagttccgggattatgaggctgtatgccgcagcatccagccaagctgggccgacgacaccggcgtggttgattga

SEQ ID NO: 7555 - DNA, 1038 bp, A.fumigatus
gaatcagctgacacaaaattgcagatgaaagctgcgaaacgcttcaaacggcttctagggccagctaaagccgagccggtgatgcaaagtatactcggccaggagtatgagagtcgtttcgtggagccgccgctcgcgatggaaccggaagagagcgtctcgtccagtgatattctcatgggtaacagaagccagagtgtaacttcatacaatagaaagcccttggaacgtgaggaggttctgaaaggctatcatcagaagtacgaaaaatcacccgaaattagtgattcagccggcaagtatactactcaacaagatcttctgctaagcatctcaaccgaacgttccgtgggcattacaccggaaaggcaagattcaagctctatcaccagctacaagccttgcaccaagttggtcgacgatctacaggcgaatttctctcgtcagtccccttctccccagacaacactgtcgcgggccagttcggctacaacaaagcgcagcgtcgagggtactaggggccacgcgcgggatcctttagaagaggcattcccatacctctttattggtccttccacctacacggggtctgatccggaagatatcgatatggagcgcaacgccgaccaatcggaaacttttcggtcagacgagcccctagagacgagtctagcaggggatgaggttatccctatagtgagcgagtcaccaggtgctgctgatttcgacatttatgaaacagcgtatcgacaggagatcgctcgaattcgcaaactcactctggctcgtgaaggtactctacccaaagtgtacttaactcggcgcgttgaagacaaagatgaggtcttaagacttgtcgaggacaggtctcttgacacgaactacgaaactgctgctcgcgaagcagatacagttattggtgagaagatcatggcgccatccagcccgcgctctggagtgagcatgataaaaactcagctggatggccaactcaagttgacagcaaatgaagcccatgttcaacaaagactcgaatga

SEQ ID NO: 7556 - DNA, 1470 bp, A.fumigatus
agacagagccagagtgtgaagaaccagattaaggacctccagcagcaactaaaagacgcagactcgcagcagagatggtcagcggaacgtgaagtggaacttgaggaatatcgcagagtccttccacgcatcgagcaggaatgcagcgaaattcagaatctgaaaaagcagcttgaattcaacaaccatgcgcttacggaacgcctcagtagtgccgaagaacagcgcgagagagatgatgctctgatcagtgaactgagagaacggatccgcgagcttgagggctcgcccggaagtccatcgctcactccaggagccgaaacaccaaagcgaggcacattgcaagaagactttgagggcataggcatccaggaatcgcaactgtcagtccttccgactatctttgaagaggctgagctgaccgatagtagtaaagcggaaaatgacgaattgcgtaaggacgttgagtcactaaaggaacagccctctgtaagttggctcgaggaggaattgggaaagtttgctgcggacgatgctgatgacgaaccccagatcggttcccaatttgagagattctcggagaatttctcacagattcatcggctcgctcaggccaattcctcacaagggtatgttattgaacctcttttctcaccacgtactcacggaacgttcagtgacgagtattggaaactatacgagcactacacccaagcacttggaaaacttgccgatgctcaagactctcttgaaattaccaagagggctctgacagacgccatggcggagggtgagttgttaatctacactgcgtacaaaacgtctcgacagtccgcttatgaaactacagttggacttgccggcaaggagaaagtagacatgattcacgaagtcaaggagagcaactcagccgaagtcgccaaacttcgtgccgaatgggatgagtgtcagcataggatacattcgctcgaggctgagcttgacgctagtcaagagttggtccgcgaagtgtgtgctgaacgagatgagctgcgcagcttgttcgacaaaaagcaagctgaaattcacgcggaggacaaggaaatgtccaatgagatgaagaggctgctggccgaattgatggcccaagagaacggtgattctgcagatgcttctcagaaatctggtccagagctcgccaaagaagttgctgagctgattgagaagtaccttgaaaagcttgcgaagcgcgcagaggtcagtaaattcaccccacttccttccaatggcgccgggcctacacattctgggaaaggcatctcggagagttcatttaccgctgctgtaaatactgggttgcgcgcccagccacggcgtgtacctgacttcgatgcagagtgcaccaatagggagaatccggcgaagccactcaagcgagatgtaccgtcatcacgctggaaatgcctgatgtcgagattcaagcgctcctga

SEQ ID NO: 7557 - DNA, 306 bp, A.fumigatus
cagttgcgattcctggatgcctatgccctcaaagtcttcttgcaatgtgcctcgctttggtgtttcggctcctggagtgagcgatggacttccgggcgagccctcaagctcgcggatccgttctctcagttcactgatcagagcatcatctctctcgcgctgttcttcggcactactgaggcgttccgtaagcgcatggttgttgaattcaagctgctttttcagattctgaatttcgctgcattcctgctcgatgcgtggaaggactctgcgatattcctcaagttccacttcacgttccgctga

SEQ ID NO: 7558 - DNA, 444 bp, A.fumigatus
atctgtgagaaattctccgagaatctctcaaattgggaaccgatctggggttcgtcatcagcatcgtccgcagcaaactttcccaattcctcctcgagccaacttacagagggctgttcctttagtgactcaacgtccttacgcaattcgtcattttccgctttactactatcggtcagctcagcctcttcaaagatagtcggaaggactgacagttgcgattcctggatgcctatgccctcaaagtcttcttgcaatgtgcctcgctttggtgtttcggctcctggagtgagcgatggacttccgggcgagccctcaagctcgcggatccgttctctcagttcactgatcagagcatcatctctctcgcgctgttcttcggcactactgaggcgttccgtaagcgcatggttgttgaattcaagctgctttttcagattctga

SEQ ID NO: 7559 - DNA, 813 bp, A.fumigatus
gtcattgcgtttcgtgattggcgggtcccccatctgaccgcagtagaggcgctcgaggatgcggtgttccgtcaggaacggccgcaggagaataggccggggtcggataccagtgctgtggctgcggcactgcgcgagggcatggagatgctcctgggacacctgcagcagcctcatagccgcaaacgacagtgtgaggactcggtgtcggatgcaccgcgttcaccatgcaataaacggagacgggtcaccgatacgctggttgagccggatgagttctccgatctgtcgtccagtctcccccccgcagccgttctagaggccgtggtcgatgcgtacttcgcgctggtccagccatggatccccatcttccacgaaaagagattccggcggcggctgcggagcccggacaaggctcgcctggaggttgtgctgcatgcgatggtcgtggcgatgctcaagcatgtcgaccagtcggtcctgccggccgatctccacgatatcgaagcggtctgtgaacgatcccggaagattgtggtcctgaccgcaatggatgacctctacgtggagaacttgcaggcgttgattatcatctgctttgaggatgtatgctggatgcccctgtgcgacttgccgccactgacgggtctagattggatccggcagagtctctcgagcgtggccgatcgtcggctccttgacgcgaacggtggagtaccttcagttgagcgttcagttcgaaaaaccacaataccggacgagtcttgcaacccccggcctttccttccgacggggggaagactgggtggaagg

SEQ ID NO: 7560 - DNA, 252 bp, A.fumigatus
tcgttcaagatatcgctgatatctgagactctattctgctgcgtatgtttgatggagactacgaaggactggcatccacactgctcctactcctactcctcctactcctcctgctaccactcctaccagcttctgccttgtatagcagcagctggtcctacttcgagcaagaagcccctcctcccttgccagggaccgcaatgctccgagaccctgagcaagacttatttgataatgaatttatcgtactga

SEQ ID NO: 7561 - DNA, 186 bp, A.fumigatus
gccagagcctttgccgacggccgatacggcgatgccgaagacgccaagcaagtggaccagcgcccgttccagaagcgcatagtactcgtgaaaatctatcttgaacatgacttcagcgtgagcgacagcctcaggagaatcagtgcggagtgtcgcgagacggtagccctcggccaggaaaggtag

SEQ ID NO: 7562 - DNA, 516 bp, A.fumigatus
gacatctgtccctttgggaatgccctccttgtgaagaagctccccggtgagattatccgccagtcgctagagaattctgtatccgataagcacacagacggacgattccttcagatctccggactaaggatcgtagcaagctggcaccggcctgagggatcccgtatcattgacgtccaactggaaagatcagacggtcgtcttgaaccgcttgatccgcgacgtatgtataccgtcgcgatgccctcctttatcgcgcagggccacgacggattcacctggcttcctcagctggagaccatcgttaacgaggaagcgggcatgacggatacagctttgctcctcgatatattcggacacagcgaagatccgtacgggggcgactgtgagagtagttcgcatgccctgggcgttgagcgagcccggaatctgactatcgtaggacgcagcatgtcagactcactgcctgttgtgaaacccgctgtagaaggcagaattcgatttgtcgatgcatag

SEQ ID NO: 7563 - DNA, 186 bp, A.fumigatus
cctccgcaacaaccccatagcgcatcccttccaaccgccgcgtgcccatggtggtgcgggtacagccctctcactatggccgccttcgtgcgagtgtcaggcccgccgaatggtaattttctgatcggctaccctggtatctctgcgactatggtaagtgctggtcagaataatgtgaaaccatga

SEQ ID NO: 7564 - DNA, 213 bp, A.fumigatus
cagtacgaaggctgtgacaacatggcggctgccttaggggctttccgtctgagccgaagacggctggagattattcttctcctcatattctacatattctacctatctccagcctcagtcaagtacttgatgggcaatgagtttagagtcgacttgggtcaatactggcatcggtatgaacttatgggccaggactatgaaactatatattag

SEQ ID NO: 7565 - DNA, 702 bp, A.fumigatus
ccaaacctagtgattttcatgatactgatgatagcaaaggtcaatcaagggctacaaggcacagcccgcgacatactaacgacctattggcaacacattatcaaccatctcgaatcggacaatcatgactacaaaattcaccaattgccactggcccgtataaaaaaggtcatgaaggcagatcccgaggtgaagatgatatccgcggaagcgcctatattatttgcgaaaggctgcgatatcttcattacagaactcactatgcgggcttggatacatgctgaagataacaagcgacgcacgttgcaaagatcagatatcgcagcggccttatcgaaatctgatatgtttgatttcctgattgacatagtgcctcgtgaagaagcaacatcgcatgcgaaacggtcgagccagacaaccgcaggtgctgcaggttcctctgctgcgacaggtgcccaactgccgccttctcaacatggtgttcaacatcctccgcaccatatgggtcccccagattacggttctctgggacagcatggcatgggacaagaccaagaatatcgacagccaacgatgtacgggggagccgttcagtcggatccgacggccgcatatggacagccgcaatcccaaatttttgaaggaatgtacaatccttatccacatcttccgccacagcaggtatgccaaaactcttcttaa

SEQ ID NO: 7566 - DNA, 471 bp, A.fumigatus
gatgagcttccttcaaaccaagtttgcgatacgcttgttgagcgtctttcttcgcaatatctgggtcagattgttcagatcttaatcaatctggagcattttgaatcagcatgccgtgagctcgaggagcttctcgccgcggcccgatcgcaaggtgctgcggggggtccgatatccttaagagcgacggagaagttcagaagcaacaaaaaagcggcggaaaagcgaatctttgaggtcgtcaattccaaaattgatgacctcattgaaactgcagagtatgactggatggcactcacgcctccgacagagcccagcaactacatgcaaacgttgacccgatttctgtccaatataatgaactcaacattgctcggtctcccaacagaaatcaaggaactcatatatttcgatgctctcagccatgcggcgaacatgatactggtaataccatattattccttgatttaa

SEQ ID NO: 7567 - DNA, 213 bp, A.fumigatus
aaataccacacgtcaattttcttcgccgtgtccgagatgcagaatatattgcaatggattgcggactgtccaaatagtactacttggattgatacaaagatgtcgacgtcaaaggagcgcgctgaaacaggtgccaagaattacgcaccgtacctatatacctacctacaggtaagagatacactatgtgtgctgttctactgtctaagttag

SEQ ID NO: 7568 - DNA, 681 bp, A.fumigatus
ctaattccttcattcgcagtcctgagagaattacggacgctgtttcaaaacatgatcacttcatcaaattcttttgtgactcctcgtccggagttagcacgtttgacgctaataagcccgtccaacgaggcagcaattcggcgccggtcgacgatatctatgacccgacctggcggactgggagagatcaacggcatgcctatcatgggtcccctcggcccgccactgccaatggcagatcaaactcaaagtccaacagatgccgagacagagacgcccaaacgtaaaacaacaagcgacgtggatagcgaagcgacccttgtctcagagactgccaagccagatacgtcgttgggtcccagtgaggacaaggaaaacgaagtcccccccgcggatgccatgttgacagatatcccagtatcccaagatattgagagcaatctttctcccaaagatgagacgccggctatcgctttcgggccaccgaaccagccccctccagtacctccgcgaccaacaatacaagttgatccacaaaagcagcttctggaggaggtagaaatcggtgctcaacaagatgtcaccgaagtgatcaacaatgtccttttccagagccaatgcgcaatcaagccgatcgcgttcgcccaggacggtgaacaacttgatcaggtgaaagagtag

SEQ ID NO: 7569 - DNA, 474 bp, A.fumigatus
catatgattgctagcctattctatggacggaccaagtcatatattctcgcggaagcaggtgctcggtccaaggaggaatggtggtgcgatatcaaggtcgacgtcgcgacgggacctcgtgatatttattcagcgattgatggcgcatttgatgcccaaaaagtcaatgtcgatgataccgtcgtggagcaattcggtgccatcagcaagctacctccggtccttcaaatccaagtgcaacgggtacaatttgacccagtcaagaagagctctttcaagtccacgcatcaccttgagctcaaggaaacgatctaccttgatcgttatatggacacgcagcatcctgagatcatgaatcgacgacggcagtgctgggaatggaagaatacgctgaagacacttgaagatcgccgtgccgagctgctacgtcaaaccgtaagggatgacatataccagtgttgtgttaaaaactaa

SEQ ID NO: 7570 - DNA, 249 bp, A.fumigatus
gttctactacacaggagaatgaatcgcgcattcgtctctggagaatcggggatagcagaagaagtgagcgtatcaagtccgtggcggaagacagtgagtgatcccctatataaattccgctacatcactgtgctaataattgaacaaggggtcaccaatgttgagcaggccgagatcttcctcggcgtcgatagcacaacaagcgacgagttcgttctgaccatgtataccacgaaggtaaagggctag

SEQ ID NO: 7571 - DNA, 885 bp, A.fumigatus
atgctgattgtgttcaggttaatgacaacccggcgactagggacattgcacggcgtgctgtcgaagctcatgcagaaaggccgaaattcggctgtcttgagacattttctcaagaccggcgaaatgacaaccggggaaatggatgtcgccgacgcctatcgcttgctccagattcctgatcggaccgtggacgatgcagcgataatggcagcttacacaatctgtgttgatgaagctcctggacaagccgagcgatactatcaagccttgagcatcatcgccaaggaaaagaatagctctctactcagcagtatgatcgctgggccgggcgccgaatctggccgtgacttgtccgagtggcccgtcggactgcagaacattggcaatacttgctatctcaatagcttactacaattttatttctccattcgcccgttccgggagatggtcctggactttgagagtttcaggatggagctcgatgacgagagtttgagcaagaaacgtgttggttcccgcgaagtcctgaaaaaagaggttgagcggtctcagacgtgtaggtgttgtccagttgtatgtacgatatccgaacgactgactaattccttcattcgcagtcctgagagaattacggacgctgtttcaaaacatgatcacttcatcaaattcttttgtgactcctcgtccggagttagcacgtttgacgctaataagcccgtccaacgaggcagcaattcggcgccggtcgacgatatctatgacccgacctggcggactgggagagatcaacggcatgcctatcatgggtcccctcggcccgccactgccaatggcagatcaaactcaaagtccaacagatgccgagacagagacgcccaaacgtaa

SEQ ID NO: 7572 - DNA, 525 bp, A.fumigatus
gtggacctcatcctcaaccacatgttttccaaggggtgtcccccgacgaccatcatctcgatgaacgcccgctacgacccccactaccatatgaaggtcggcgcgacactgcggcccctccgctacgagaactatctcctcatcggcaccggcggcgccgtccacaatctctaccgcaaccgctgggcccccatgctgcgcttccgggataatttcgccatggagacgccgccggaggagtgggcgctggagttccgccaggcggtcgaggacgtcatcacgaagacctcggggccggcgctgcggcgcgccatgacccgcttgatgaagcatccccagtaccgggatgcgcatgccacggacgaccactttatggcggcaatgtttgtggccggagcgatgggcgatttcgaggatacggggtcgccggcggtcctgggggcggagagttgggaactgaccaacatgtgtaattcgcagtttactctggggtcgtggtccaaagacattgctgtctatttgtga

SEQ ID NO: 7573 - DNA, 522 bp, A.fumigatus
tctttactctcgctgacggtcttcaggagcggcccactggcagcgacatacgcgtttggcagcgcctctgcagccaagtacatcacccagttcatcgacgccgccgtctcgtggattaaccacgtccccgtcgacatgctcagtacgtcctctttcccgttcccttccactcagctaacagactcagtcggcccggcctaccccatcaacacggctcccagcaccgaaacccgctacacgcccgctctttttcaggtcccccgtcctcagttcgtcaccgaagcaaacacctccgccttggtgagaagtattctcgacccctcggacgccacgagatcagctaccgcctggcgcgaggcccttgcccccctgccatctaccggccagcgccccggccgaagaatcggattcttcgagcaagggttaatcactggtggggtaattacccttgcgacgttgatagcgacggtgtcgactgtggggtggtatacctttacgtatgtgaggaggttgcgtgcttag

SEQ ID NO: 7574 - DNA, 516 bp, A.fumigatus
tcggcacggtcgtccgcatcggccgcagcgtccccaccctcgcctcctcccccgcctcccgcacaatcaaagtcggcgaccgcgtcggcatcggcgcccagagcatgtcctgccttcgcgctgactgcgagccctgcgccgaaggccgcgagaactactgcccccgcatcacaggcccctacaacagccgctacgcccgacaagagcaaagcatacggcgggttcgcggaattctggcgcgggcctgcacactttgcgttcaagatccccgatgcgctgccctccgcggccgcagcgccactgctctgcggcggcgtgacggtttacgcgccgcggcggaaatatgctgcccggccggggacaaccgttgggaatgtcgggattggcggggtgggggcatatggggatactgtttggcaaatccatgggctgggaaccgcgtgggttgcaatctctaggtcctccaaacaaaccggggggaaagcccctggaagggggctcggggcaacattcctt

SEQ ID NO: 7575 - DNA, 240 bp, A.fumigatus
cctttgctttcaccggttgagcgttttcatctttccaccaccaacctttgtatctcagacggcaacaccctgcgaaccattcggagactatatacggagtatacgcgaacaaactacaagttcacactgaagacctcctcatatccaatcaatgatgtcctcgtcaccacccaaaacatttcatggctgggttgcccgcgacgccaccagccctctgacattcaccaccttcgaacctaa

SEQ ID NO: 7576 - DNA, 693 bp, A.fumigatus
agacctcctcatatccaatcaatgatgtcctcgtcaccacccaaaacatttcatggctgggttgcccgcgacgccaccagccctctgacattcaccaccttcgaacctaaacccttcaccgaaaccgacatcgaagttaaagtctcccactgtggcatctgtggcacagacatccacaccctccgctcaggctggggcccaagcgactacccctgcgtcgtcggccacgagataatcggcacggtcgtccgcatcggccgcagcgtccccaccctcgcctcctcccccgcctcccgcacaatcaaagtcggcgaccgcgtcggcatcggcgcccagagcatgtcctgccttcgcgctgactgcgagccctgcgccgaaggccgcgagaactactgcccccgcatcacaggcccctacaacagccgctacgcccgacaagagcaaagcatacggcgggttcgcggaattctggcgcgggcctgcacactttgcgttcaagatccccgatgcgctgccctccgcggccgcagcgccactgctctgcggcggcgtgacggtttacgcgccgcggcggaaatatgctgcccggccggggacaaccgttgggaatgtcgggattggcggggtgggggcatatggggatactgtttggcaaatccatgggctgggaaccgcgtgggttgcaatctctag

SEQ ID NO: 7577 - DNA, 636 bp, A.fumigatus
cggtcagtccgtcccacaaatcagcatgaatcatcagccagactagttcgtggtgcacaggaatttacaatgagaggaagcaagcaactgacggaaagtagcatcttcaggtctcagcccttgtgtatcctcgtgggctcagagcaaattcggttatcaatacattcagccgtcgttgagcgttttccacagcctctaagggaggatttagatattcctggaagaatacaaggtgaagagccgatcgtcgtgagaaatatcgatctggacacttttgcactttactgtgagtacgtctatacggggaactattcaatctcagagacggtccttgcttcacagaatagctctcaggtgtcactacaattggaagaggcgaacgcccaagccttcgatggaccgttcgcagtcgtggtgccaaagcaccctagggagagtcgcacactcttacctacactcttcatccactcttggatctacattcatgcggctaaatataaatgggaatccttgaagtcactttccttccagaaattccagaacgcactggaaacgtcccctttgactgccgctcttattgatgagttggcgccgatgttctgtttcatctctgagcaagagtcggagagcccgtaa

SEQ ID NO: 7578 - DNA, 183 bp, A.fumigatus
  unsure (62): Identity of nucleotide sequences at the above locations are unknown.
gggcctgagccgacaccggtttgttcccttggcgtggccccctccccgcccccccccccccnagaaggggaccaggaaacaccaaagcgagtgtccccccccccccccaccccccccccccacccccccccccccccccccccgccccccaccaccgcccccccccccccgcccacccccccc

SEQ ID NO: 7579 - DNA, 804 bp, A.fumigatus
  unsure (238),(682): Identity of nucleotide sequences at the above locations are unknown.
gactatgacgaggagcttgttgttgcttgtgatttattgtgcgagtcttctttcttaattcgaattggaagagttgaacctgtagctcaggggatgcggagaagaggaaggaaggtgcggggagggacgaaagaaatagtggagggaaattttttaaaagaaaaagaaatgtggaaaataaaaaagaaaaaagataaaaaattcagagagaatattacgatattcacagacagttcanagaaggaggctgagtatccaccaggaagatcactgactgaatgttctcaagcgcctatccaatggcatcattaccaccctcacctccccgccctgcgccccctcacgcctgcatgcccctgtctcccgtcagatccccaccccagcccccactcccccctaccgcccctcaacgccccgcccaccccaccacaacccctccccgcccccctgcccgccccccacccaccccccctgctcgccccacaacgccacccgcccgcgactcccctcctccccccccccactcccccccacaccccctcccaatgctttggcactaaccagactaacactacccacccccatcaccccgcccccacgcccgaccccctgagctttaagggcctgagccgacaccggtttgttcccttggcgtggccccctccccgcccccccccccccnagaaggggaccaggaaacaccaaagcgagtgtccccccccccccccaccccccccccccacccccccccccccccccccccgccccccaccaccgcccccccccccccgcccaccccccccc

SEQ ID NO: 7580 - DNA, 291 bp, A.fumigatus
ccaatttcttgtttcttgtgtaggatcaaaaatcccctggccgacttgactccttctcaggttatccgcgatgtcgaggagtttgcgaacgagcatgacctgatcgacattctcccggagctgaagaagggggctctcgttgcgcgtgatcctgaacatttcgagactgtcccagatatgactgaagcggagatcaccgcgattcgtgatgaaaccgagcacaaatggcgccagccttttgctctgtacttcaccatcattctttgctccatcggcgccgctgtccagtaa

SEQ ID NO: 7581 - DNA, 408 bp, A.fumigatus
  unsure (123): Identity of nucleotide sequences at the above locations are unknown.
gggggggggtgggcgggggggggggggcggtggtggggggcgggggggggggggggggggggtggggggggggggtggggggggggggggacactcgctttggtgtttcctggtccccttctngggggggggggggcggggagggggccacgccaagggaacaaaccggtgtcggctcaggcccttaaagctcagggggtcgggcgtgggggcggggtgatgggggtgggtagtgttagtctggttagtgccaaagcattgggagggggtgtgggggggagtggggggggggaggaggggagtcgcgggcgggtggcgttgtggggcgagcagggggggtgggtggggggcgggcaggggggcggggaggggttgtggtggggtgggcggggcgttgaggggcggtag

SEQ ID NO: 7582 - DNA, 516 bp, A.fumigatus
tcccagtccttcagttgcatcaagacctggctaacatccatgtctagaggcccgtacattgccagtgccgccattgggtgttggctatccgacccctgcaacgctttcctcggccgtcgtggtgcaatcttcatctctgcgatcttctgcgtacttacccctattggcagcgctgtagctcagacttggccccagctctttgtcactcgtcttctcctcggcctcggcatgggcctgaaggcttccactgttccgattttctgtgcagagaacactcctgcttccgttcgcggaggcctggttatgtgctggcaactgtggaccgcctttgggattttcctcggtttctctgcgaatctggctgtcaaggacactggtgatattgcctggcggttgcagtttggctctgctttcattcctgccatcccactgcttgttggcgtgtatttctgccccgagtcccctcgttggtatatcaagaatcttcaccacgggggcggacggatccgcgcaagc

SEQ ID NO: 7583 - DNA, 990 bp, A.fumigatus
ggacctttacaggtcggtcggcggctggcatcaaacttcacaaaagggcgaattcatctcgccggagacgccattcacacccattctcccaaggcaggtttgggcatgaacatgagtatgcaagatggattcaatatcggctggaaaatggcgctcgtcgcgaaaggggttgctcgcccttctatactcgcaacttacgagctagagcgtaaaagaactgcgcaaatgctgatcgatctggaccgccgcctgcagccgttgtttgtgaagcagcaacaaagcgatgctacagaaagcacggcccctagcaacggtaaggaaacactgatagacgtgatccaattatccatcgcatttgccaatggatatgcctgtcactacgggcccagctctttagtccacaagggaggcgagaatattgctgcgaatctgatccctggagaaagattcccgccagtcaaggtccgtaatcaggcagacggccaggcctggtggacaacacgccttttcaaaagcgacgggcgcttccggattgtgctcctcgcaggagatttgcgtcacaaatatcagaggcaacgcgtcgaggctttcagcgcccacctagcttcagctgaatcggttctccagcggtacagactcgaaggcgagaaactcgatagtctcattgaagtgattactattcacagtgcaccaatgcgagagatggactttcccgactttccggaaatgctgagactgttcgaccaggagcgaggatgggcctacgacaaaatttggagcgatgacgactgcttctgggaccgacaatgtaccggaaaagggtacgaaacttggggtgtcgacagaatacgaggtgctctcgtcatcctcagacccgatcagcatattggatgggttggaaacatcgaggatgtcgatgaaatgacctgctattttgaacaaatctttcagcctcctcagaagtccgtgaacatggagggcaatgcgtaa

SEQ ID NO: 7584 - DNA, 270 bp, A.fumigatus
ctcctggtagctgatatccgccgcgtgtgcacagtggaaactgaacacggcactctcttgatcatcccgagggaaaggcagcttgtccggctttatctgcctctgcaagttgttgacggcatttcggggtccttagatcgatcctcagtcactcttgacatggttcggcaaagggccaaggagatgctgagacccttcgactttgacttcaaggtctgcgactggtggacagtttatcaggtatggtttaactcaaatagtgcattttga

SEQ ID NO: 7585 - DNA, 210 bp, A.fumigatus
tctgacatccctctgtactatatagatcaaaccatccaggctaggtttgccacagctgatcaacgccgcgtcctaattttcgaatttaatccttttacttggcaatatgcattgatcttcagtactacgtgttttgatagacatattggccatgccctcctacccagtagttattcacaattaaaagccagagatgtcttgattggctag

SEQ ID NO: 7586 - DNA, 471 bp, A.fumigatus
gtaagctactctgatccctcgctacgctgcagcactaacggtcccagccccatctttcgtagcgtggaatttgcatcggatatctctgttacagagcacgacgtacaagcgcttgcacgcctgagttccgcctgcgcgaaacattttgcattgtccaacgatctatactcgtatcctaaggaagtcatcgccgaaaaggagaacggagaacctcttgtcaacgccgtcaaggtcgtccaggaattgatgaatgtatcctcttcatcggccaagtcgattcttcgtggtattatattggataccgagcggcagataggcgaggaatacgagtctcttgtcaacgcgaagagtacaacattatcacagctggtctacgcccgagggttgatcatcgccgtagcagggaacatgttcttctcggctacgagttatcgttatgctaaagctgtcgacggatccaggctaatgtaa

SEQ ID NO: 7587 - DNA, 306 bp, A.fumigatus
acgcgtcagcgcggatgcgctattgattgtcctgctcaggtatactctaacaaatccaaggtattcaactacaagaagatggagtcagattataagcacggagtgtcttgccaagaaattactaccggagcacatcgttccccttctgtgttggattcagagtgccatgatatagtgatacgccacgtgatgataacaaagctgagcatatcttatgcactgctcaatgtgatggatcagatcaacgtgaaagatttacacatcctagtgctaggggtgttagtattatccatatatcctaattga

SEQ ID NO: 7588 - DNA, 1269 bp, A.fumigatus
gcttatgcttgcgcggatgctggctcctgtggtgaagactatagggcttgtgacacctgcaagaagaagaaaatacgatgcgacggtacaattccgtgtaccaactgtaccaagaggaaggtcagttgcgcgtatgacatgaaatatggccgagggcgacccccgacacctccatcttcagccgcgattcgcgaacatcaaaacaggctgagaagtaattactcatatgatctctctaactggcagccaccagtctccgtcgctcctgaaatatcgtcgccactagtccattctcgagcctcaccaactggtgaaattgagggtcaatattttgatcctacctcgggattgaactttttacaccgagcatggaaaaagcttttgaccacccagaatgatcaaccggcatcataccgcctaagcgttgcggagcagaatcagctccttacatcggcaggtgaccgaccctttcacattgagagcgatgcattggacagcttcattcctgatgcctcaacagcgagaaagctgcagcaattctacttcgagacgtgtgtggtcacataccgcatgttccatcgaccaagtgtggaaggctggatggagatctttctgaaagatggacaaggcgcagggcccactgctcggtctcttggtaaggccaaaactgctactctccttaccatcatggctatcgcgaacctgcgcctgcacagggtgagcggggagacatcaacggaggctgagtcgcttgccttgaaacggagcgatcacttgttttgtgctggtatgagaatgactgaagaggagattgggtttccgcgtcttgaatcagcacaggcacgtctggtccaagtcctctaccttcttcaaacctcccgtataaataaagcctggtacacatttggcaatgcgttccaaatcacactctcgctgggtatgcacaggaggcgggaccagaagagggattaccccttcacaagcaggaggcaggattatatcacgtcagagtgctataagcgcaccttttgggtggcatatactgtcgacagatatctgagtgttgtgcttggtcggcctcgactttaccaggatgaagacatcgaccagaattttccagatattgtaaacgatgaggacatgacaccggatgggttttccatttcagatgacccggctgattgttatatcgatgctctcatatatcatgcgaagtacataacaacccccgccgaccaccacaatactgcattgctaattcgattgtag

SEQ ID NO: 7589 - DNA, 717 bp, A.fumigatus
tccttttcgaaattcaaggccggtattgcagacaggctaacgagtttgcagaacgaggccgacgccgctcgtatggaggaacggcagcttgcagttgagatggatcagctgcgcgaatttgagagggaaaagcaaaactctcgtactcgcatcaagtatatggaaggatacttcaacaacgcccaacccccaccaacatcggactctgagtcaaactctggatccgaccagactactccggtccgacagtacaccaatcagcaaaaggccttgctggcgcaggaatatcatgaccacgaatgcatggatcgattacactcggccaagatcaaggtcctccgagaccgacaagaaatccgactacaggaggccatcgcgcgaatggcgagggagctggatgcgctcatagacaagcatgcattggaattcgctgaactacaacgacagcaccagcaggaagaggcgctggcaatgcacgcattcgaggcgaagaagacgaagctgcgccatcgctggaatctagaagaagccattctgcgcaagaaactagaactacaacacggacacccgtacggtcctctacccccactctcattctccgaatcgcattacgagacgcgggactcggcaatttgtgtctcggaaaacagtacaaacatgagcggtgacgaacagacgcacccgaaggaaagtgaggaaagtgaaccagtgcattaa

SEQ ID NO: 7590 - DNA, 834 bp, A.fumigatus
aacaatgaagatgaagctttgagagcatggcgctctgctctagacacaatctcctaccataacgcataccgactgtcatcgacttacacacccaagaacgaaaccgaaaaagcgctccaagattcgatccgccagttagagctccagtgccgagagcgagtggatctcttggaagctctccgtgaaagcagaaaggaagcacaggagaaggacagtcccaccacgagcggtatcagccaccgattcttcaaaggcaaatcggcctcgaaaccacctacttcgaacacacccggttggatcggagacgggacggtacctccagtggattatacagacttatctcgaccgccgccgatcccaggacgtccagcaccggtgacgcaggggagttcggaatcggttatccaagacagcagtgttgcgtctgcgactagcctaccggcattacgaattccatcgcattcgtccgccaaaaaccagtctcgcaactcgagccccgagaaacggaagacaatgcctaccactctgcggaagtcggacgggcacaagaagcacagcaaaaacagggatactctccggcggaaggatttgcggccggctgcgtctcaggctgcgggtttagcctgggggaacatctaccggctcccttcagcatctgggaatctagcaagtgacgccgctgcaacatcctcgcggcagagcatttccagtgactctgggttccggaaagattctggtcagttcaggtcccactctggggatgagcttgtgtcgaagaaaaatgtggcagacgactcaggtcttcaccgggggctgcaagggcgctcattgcca

SEQ ID NO: 7591 - DNA, 342 bp, A.fumigatus
caatcatgcctgcctgactcaaaccatccaacgacactaccggcctcttttcggacctcttttcctttacgactgaaccctctgtatttggcacgtcgatcagaatctctaacgaccgccgcaatgagactgccacctccccaggttctgcttacatggccgacacccaactacgtcgatcccctcactcgcgggaatggtgccctgatcgttaatattgtctgcttaagtttcgcgtttgtcgttacgcttcttcgtctctacactcgtttgaaaattacgtatagtcctggtctggatgatgctctgatcgtgattgccctggtatgtgctaagacttga

SEQ ID NO: 7592 - DNA, 198 bp, A.fumigatus
ctcaaaccatccaacgacactaccggcctcttttcggacctcttttcctttacgactgaaccctctgtatttggcacgtcgatcagaatctctaacgaccgccgcaatgagactgccacctccccaggttctgcttacatggccgacacccaactacgtcgatcccctcactcgcgggaatggtgccctgatcgttaa

SEQ ID NO: 7593 - DNA, 765 bp, A.fumigatus
cgagcgataaccttccagccgccgccgtgtaagacgaacttgggatcagatgtggcaacagaatggaaacccaccgataatagcgacagcatctgccagaaggtgaccacgagaaatctgatcaaatccactcaaatgagcaaagccgggagcacggatcttgcagcggtagggtctctcgctgccgtcactgacaaggtagacacccatttcacccttgggggcctcaatggcggagtaagtctcaccaggaggaacggcgtatcccttggtgaagagaaggaagtggtggatcagcgcctccatgttctccttcatggcggcacggggagggggagagatcttgtagtcttcgacgcggacaggaccagcgggcatcttgttcaagcactggtgaatgatgcgcaaggactggcggaactcctccattcggcaaaggtaacggtcgtagcagtcaccgttgacaccaacgggaacgtcgaactcaacctgatcgtaggcatcgtagggctgcgacttgcggatatcccacgggacaccggaaccacggagcatgacaccagtgaaactcatgttgatggcgtcagctgcggtgacaacaccaacaccctgagttctagccttccagatacggttatctgtaagcagctcctcggtctcgtcaatgcggtcgccgaactgggtggcccattggtagatatcatcgagaaggccaaggggaaggtcctgcgatacgccaccagggcgaacatatgcagcatgtag

SEQ ID NO: 7594 - DNA, 579 bp, A.fumigatus
acgggcaccggagacacgctcgtagaactcctattgaagatgaaaggtcaatgcattgctctcaacccatacgcgattaagagaaaaaatgccacctaccatgagcttctcacgctcctcgaaaccccacaggaaaggtgtcaaagcaccaacgtccatagcatgggaaagaaccgacatgaggtggttcaggatacgcgtaatctcgccgaacatagtccgaatccacttggctctctcgggaatttcgatgttaagcagcttctcaacagccagcgagaagcactgctcattcgtcatcatggaaacatagtcaagacgatcaaagtagggcagagcctgcatgtaggtcttgtactcgatcaacttctcggtaccacggtgcagcagaccgacatggggatctgcgcggacaatttcttcgccattgagttccagaatcaatcgaagcacaccgtgagcggcaggatgctggggaccgaagttgacagtgtagtgacggatcttgcggtcgactccttccgcctgcgactcaagattcgaggcagcctcggactctgcggtagccttgttggctag

SEQ ID NO: 7595 - DNA, 927 bp, A.fumigatus
cgtgggtacgctttagagaccattggaagaccaaccagaggcggcgtaatgacccgaaccatttatcacgtgattatccaatttgtcccgcaacctccaagcgtcagttcgcatcgaccatcctgcaagagtgcctctttcactacgtccggactgaggacagtcggccaatttgatccgtcatccttccttgcgatatttcgaatggctgcctctttcgcccgtctggcgggcagtgcgcccaagaagctctgtcttcgcccctctacgttcgccagaaacacccgttcaatatcaacgacccttccccgtcggtacgcggagcctaccagctaccaggctaccagactcgtcccgacggattcgacgttcacacacctagccaacaaggctaccgcagagtccgaggctgcctcgaatcttgagtcgcaggcggaaggagtcgaccgcaagatccgtcactacactgtcaacttcggtccccagcatcctgccgctcacggtgtgcttcgattgattctggaactcaatggcgaagaaattgtccgcgcagatccccatgtcggtctgctgcaccgtggtaccgagaagttgatcgagtacaagacctacatgcaggctctgccctactttgatcgtcttgactatgtttccatgatgacgaatgagcagtgcttctcgctggctgttgagaagctgcttaacatcgaaattcccgagagagccaagtggattcggactatgttcggcgagattacgcgtatcctgaaccacctcatgtcggttctttcccatgctatggacgttggtgctttgacacctttcctgtggggtttcgaggagcgtgagaagctcatggtaggtggcattttttctcttaatcgcgtatgggttgagagcaatgcattgacctttcatcttcaatag

SEQ ID NO: 7596 - DNA, 750 bp, A.fumigatus
gagttctacgagcgtgtctccggtgcccgtctacatgctgcatatgttcgccctggtggcgtatcgcaggaccttccccttggccttctcgatgatatctaccaatgggccacccagttcggcgaccgcattgacgagaccgaggagctgcttacagataaccgtatctggaaggctagaactcagggtgttggtgttgtcaccgcagctgacgccatcaacatgagtttcactggtgtcatgctccgtggttccggtgtcccgtgggatatccgcaagtcgcagccctacgatgcctacgatcaggttgagttcgacgttcccgttggtgtcaacggtgactgctacgaccgttacctttgccgaatggaggagttccgccagtccttgcgcatcattcaccagtgcttgaacaagatgcccgctggtcctgtccgcgtcgaagactacaagatctctccccctccccgtgccgccatgaaggagaacatggaggcgctgatccaccacttccttctcttcaccaagggatacgccgttcctcctggtgagacttactccgccattgaggcccccaagggtgaaatgggtgtctaccttgtcagtgacggcagcgagagaccctaccgctgcaagatccgtgctcccggctttgctcatttgagtggatttgatcagatttctcgtggtcaccttctggcagatgctgtcgctattatcggtgggtttccattctgttgccacatctga

SEQ ID NO: 7597 - DNA, 576 bp, A.fumigatus
  unsure (110),(173): Identity of nucleotide sequences at the above locations are unknown.
aagatatccccccgaaattttcgaaaccaaaaaaagaatttgggggctccaccaagtgataattcccacgaggtagtttttttctccaagggcaggtcaataagtcgtanttattttgccagggtggcaatcttactcggttgttcttggcgcaaatgtctcttccctccctntgaaagcaaagaagaaccccgaggcatctacacggagcacgagatgttcaaagttttagcagccttgtataattgcctctacttcgacattgacaagaccaagtcctaccctctgcaccacgcgtctcaggccgttggtgagccgctgggcaaagctctcgaggccaatgtcaaggcgcttggcggtagcagtctactctctggcatttttcgcagcttccgcgagaataagaatgctctcaaggagtacggagtgcacttgacgaagcagcttctggaaaatggtctgggggctcacgagattgcatgggcgcagtttttgcccacagtcattgccatggtccccgctcaggcccaagcagtaagtccatcccccaatgattgtgcgcctcgagataactga

SEQ ID NO: 7598 - DNA, 321 bp, A.fumigatus
gcaaaagcaaaccgtgatgccagcgtcttccctgacccagcggaagtgcgcctggataggcctatgaattcctacatcaacccaaccctaggaccacacggcttccttagcaaggaaaccagccacattgcattgaccgccatgctgcgagctgttgggcgtctgaacaacctccgcgtcgctcctggtgttcaaggacagttgaagaagatccctcagcccggtggctattctgcgtacctgagggaggatcatggcagttactctatcttcccgacaagtgagtgttcccggctaccattggcacatcagtcttgctaa

SEQ ID NO: 7599 - DNA, 285 bp, A.fumigatus
ttcacccagatcgtcgacttttacctgtcgaaagaaggcagcaaacatctcccagcaatccaacgcctggccaaacaggacacgaagaagtcggacgaacaattgctgcattactgcttggaggctgtgcgtctcaacgatatgtctgggttgtaccgccagtcagaaactaccctcgccgtgactgatgaggccgtcgaggtcaccattcagcctggcgacaaggtctttgtcagctttgtacgttccacccccttagtgttgtactatcccgcctctttctaa

SEQ ID NO: 7600 - DNA, 573 bp, A.fumigatus
  unsure (531),(557): Identity of nucleotide sequences at the above locations are unknown.
gacaccggcaacaaaatctcccgccgctcccaaatccacggaacgcagcacatcattctaggcggcaagaccgtcatccaagcagacgccgtcatccggggagacctgtaccgttcctcatcctctgcccccgccgacggcagcggcggcggcagcacccgcccctcacaaccctcgacccccttcgtcgccattacaataggcaggtacagctacatctcacggcaggcggtgctgaggccgccgtcccgcttacaccggggagtacacacgttctacccgctcaagatcggcgaccatgtgtttgtcggggagagggcggtggtggaggcggcgatggtgggcaaccatgtgcatattgggcgggaggcggtagtggggagcatggctatcctgaaggactttgcgtatgtgcttgatggggccgtggtgccagctggcatggtggtgccgagctggtgtgttgttggcggggcgccggcgaggattgtcggggaggtcggggaggggtatggggttgagggggccganggggggatggcgacggagaagtatanaatggttgggcggtag

SEQ ID NO: 7601 - DNA, 312 bp, A.fumigatus
  unsure (31),(57): Identity of nucleotide sequences at the above locations are unknown.
accttccgtgtcatctaccgcccaaccattntatacttctccgtcgccatccccccntcggccccctcaaccccatacccctccccgacctccccgacaatcctcgccggcgccccgccaacaacacaccagctcggcaccaccatgccagctggcaccacggccccatcaagcacatacgcaaagtccttcaggatagccatgctccccactaccgcctcccgcccaatatgcacatggttgcccaccatcgccgcctccaccaccgccctctccccgacaaacacatggtcgccgatcttgagcgggtag

SEQ ID NO: 7602 - DNA, 204 bp, A.fumigatus
agactgaattgtgtcagatttttaaattacccatgttgctcgcatcacttgcattgcacatatcattactatgctacgctagattataaagccaatcctcaatatccaaacgagagatatcttagtcgtgttaagtcgtggcatgcccatctatacaccagctacaagacaaagctgggaaccgcgcggcgatcgctggcttag

SEQ ID NO: 7603 - DNA, 1449 bp, A.fumigatus
  unsure (1334): Identity of nucleotide sequences at the above locations are unknown.
tggtaccctctcggatctcctgacttgtccataccgcgtcagcaaacttctgactcgacggagaccatggcagcggagtccgagaggtcgccctatcccaatggttcctccgatggaccgggcgtggcccaagacgatgatgaggctacttcgtttacatcccggcggtctgcgagtgaaagcgacatggtagaactgccacgttccgcatttaaatctcgaacacaggcatccactctggcccagctaccaaaagtatcctccgcagttcccagcatttcggcccctccctctactacgaattccgcccgatcctcgcgcgaatcctcccccattcgttcgtcccgacgtgcacgcaacccgacgtcggcgcctcgcacttccagatcgcgccagaacagtcaagatcgcagtccgcaacggtccttaccagttcctaccgcgagtgctgtgcaaagagcgctctcccagcccagcagcaagcctcttgtgctgagcgcttccccgaatgttgaatcatcctccaatgttcccagcccagacaaatctaacaacatgccattatggggctctacccctccgaatacctcgagcaagcggtccttgccgccgtccgacgaccttgccaccagaggagatcggagtgcacctcgcaacgtgagcagccgcatcagtgcgccgggttctgcccttgaaaccgtggaggagatgaccagcgatccctcgaccccgtcggccgataccatcctgaaccagcctctgtcggaggagccgaagctgcaaaagatcgatgaagacacaacaccaaaggcgtccaggcataataccaatgtcgagagtggaagtgacagtggcggaaacaaaagctcagagcgcatggaagacactcgtcgttgggtgtccacgggtaccagaaggtccgattccctcttggcgaagcgctccactacctcattgagtggcgctcgcgggaaaccggcggaggggtccgtccgcaacatgattgtcgagacggagacggtgacctcaattccccaggtctctctgggtgtggtaccgggcgaacgaggcatttcgggccgggtagacagcggcactctacgcatgaagccgagtacggagaccattcgtccgagaaaggaaaaacggaaaactcgcaaacctgctgcccttgccagcggcgccgcgtcttccaaagctgacatcttcgaagcgaaagtggccagcgcagtcgatgaggccgacgtctcggactctgatgaaacgtttgtctatgagtccaatcctccagacccatatccggtccggcagaaccggtatcattcccgcacccncagtgcaacgtctatggcaagccaagtcgaccagctggcaggtcgggcgcgacatagcatgagagactccacacacagcattacccggcaaacgcagcatgaaattcacaaataa

SEQ ID NO: 7604 - DNA, 234 bp, A.fumigatus
caggccgcctgggacccaacaaccccctttacaacagccattggccctctgggccccagctccggcatacgcattctctccttccgcacctgcaaagcagatgttgttgtgggtctgaagccaggtgaagacgagaaactccgtgagacgcaaggcggggacaaccccaaggcgcggaagtgggcatggagcggcaagtatgctgtcatctctttctgtgacggtaaagcgtaa

SEQ ID NO: 7605 - DNA, 1032 bp, A.fumigatus
ccaggaattggagcagaggggaacgccctcatggcagaatgcgtcgtggttgttctcagaatgctatctttgtgcgtttcgaaatatatatacgtggtaatgcgggcagtgctgacgaagacagaccggcgcgtcagtactctctttgcactgtcgaagaactggaagggttacgatgttttctcccggcagaagatgtctacattcaagtcatcgcgtccggcggtgttggagctagcggcgcggtaccacgagctcgcgcttcaggcacagaaaggcaagggggtggacggcaaggccgtggaggagatcgaggaagccgagcgattactcttctctgaaatgtgcgagatctgtctgtggggtaacgcgacagatctttctcttttgacgtctctcacatacgaggatatccagaagctgcagggttccaaggcgcgcaaagcggccgaggagaacatcctcatcaacgatctggacgccgcctttgatgcactcgccaaggcgcagaaggagaagaaggacggcgagcgccgcgtggatatcgtgcttgataactctggctttgagctgttcgtggatctcatcctggccggctacctcctctcggcgggcctagcaacaaccgtggtactccatcccaaggtgatcccatggttcgtctcagacgttacccctcgggactttatggatctcctcaacgctctggcggacgcacagggcttctatacggccccggacgagacaggacgcgagtacgagcccctctccgagaaggaactggctgaggtgaaattcctgtttgatcagtggagtaaattccacagcgagggcaaactggtcatccgtccccacgctttctggaccgctggtggctcttactggcggatgccctacgttgcacccgatctgtttgaggatttgaagcagagcgaactcgtcctgttcaagggtgatttgaactaccggaaattgactaacgacgtgagtttctcctcagctccacataatggtgtttatttccgtggttaa

SEQ ID NO: 7606 - DNA, 591 bp, A.fumigatus
  unsure (110): Identity of nucleotide sequences at the above locations are unknown.
atcgtctcctgtgcctccgccggccgctctcgatgccgcgccgcctcggccttcttccgtcgttcctgcgcagccaccatcgccgccgtctgttccgccgtctgcagtcncgcccgagcaccggactccatccgcagctctcccccgtcgtccgcgtccgcctcgtccacaacagcaggcgcctcgtcgtcgcctccctctccttccccacggcgagcggcgctctccgccgcagcggacgctaggatcgcgtctgcggcgtcccgttcgtcattcgcattcgagctgcccgtcgcgggaccacccaccgtcctccaattcgatttcttcgcgcggcggaactccgcgctccgaacggaggtaactaaactcgggccctcgtcgtcctcgttgtcgaaattagtcgctgacgtccgtagatcgggcggatcgtcgtcggcaataatgaggccgtcgcccgcggtgtcgacggtcttggtcttcttgcgtttcttttttgggcgatcggtggccggatcggctgttaggtactttttggcgaggtattctgctagtgacgaggggggcatggtgttgaatctgagggtttaa

SEQ ID NO: 7607 - DNA, 507 bp, A.fumigatus
tatcatcaaggtgtccagcaccatattcatgccgaatcagtacagataccactccctccaatgcaatttactcatccatctgccactggtaatccaacgcttccagtctccctttcttgtttctcgctgcaaaccattccttctcgaacccattgccccgatccaccccatcccaccgatgtcccggacggatcccatatcggtttggttgaaaagcccccttatacagcggcttccccgtcacactcacgcccggcccctttgtcttggtcaaaaaccctgccgcaggatcattccaccgctgctgcgccttcagttcctcattcagggcatcgtcctcgatcgtccgcgcaagtggcatcgcgcgagcctcctgtatctgctgtctgcgtgcctcccgctccgcccgctgcacatcgcccatcagcgcctccttcgccgcctcttctttctcccgcttctcctgctccgctcgccgcgcctccgcccgcttcagggcaacgttga

SEQ ID NO: 7608 - DNA, 483 bp, A.fumigatus
  unsure (161): Identity of nucleotide sequences at the above locations are unknown.
cgaacgggacgccgcagacgcgatcctagcgtccgctgcggcggagagcgccgctcgccgtggggaaggagagggaggcgacgacgaggcgcctgctgttgtggacgaggcggacgcggacgacgggggagagctgcggatggagtccggtgctcgggcgngactgcagacggcggaacagacggcggcgatggtggctgcgcaggaacgacggaagaaggccgaggcggcgcggcatcgagagcggccggcggaggcacaggagacgatctaccgagatgcgtctgggcggatcatcaacgttgccctgaagcgggcggaggcgcggcgagcggagcaggagaagcgggagaaagaagaggcggcgaaggaggcgctgatgggcgatgtgcagcgggcggagcgggaggcacgcagacagcagatacaggaggctcgcgcgatgccacttgcgcggacgatcgaggacgatgccctgaatga

SEQ ID NO: 7609 - DNA, 1053 bp, A.fumigatus
  unsure (478): Identity of nucleotide sequences at the above locations are unknown.
accctcagattcaacaccatgcccccctcgtcactagcagaatacctcgccaaaaagtacctaacagccgatccggccaccgatcgcccaaaaaagaaacgcaagaagaccaagaccgtcgacaccgcgggcgacggcctcattattgccgacgacgatccgcccgatctacggacgtcagcgactaatttcgacaacgaggacgacgagggcccgagtttagttacctccgttcggagcgcggagttccgccgcgcgaagaaatcgaattggaggacggtgggtggtcccgcgacgggcagctcgaatgcgaatgacgaacgggacgccgcagacgcgatcctagcgtccgctgcggcggagagcgccgctcgccgtggggaaggagagggaggcgacgacgaggcgcctgctgttgtggacgaggcggacgcggacgacgggggagagctgcggatggagtccggtgctcgggcgngactgcagacggcggaacagacggcggcgatggtggctgcgcaggaacgacggaagaaggccgaggcggcgcggcatcgagagcggccggcggaggcacaggagacgatctaccgagatgcgtctgggcggatcatcaacgttgccctgaagcgggcggaggcgcggcgagcggagcaggagaagcgggagaaagaagaggcggcgaaggaggcgctgatgggcgatgtgcagcgggcggagcgggaggcacgcagacagcagatacaggaggctcgcgcgatgccacttgcgcggacgatcgaggacgatgccctgaatgaggaactgaaggcgcagcagcggtggaatgatcctgcggcagggtttttgaccaagacaaaggggccgggcgtgagtgtgacggggaagccgctgtataagggggcttttcaaccaaaccgatatgggatccgtccgggacatcggtgggatggggtggatcggggcaatgggttcgagaaggaatggtttgcagcgagaaacaagaaagggagactggaagcgttggattaccagtggcagatggatgagtaa

SEQ ID NO: 7610 - DNA, 231 bp, A.fumigatus
tcgactcccgcgtctacttcaaatgtgcccacttgctcattggaaaacgctttgttccggaagcgaacccaatacccttctatccaactcatcctctgcctcgttgacgagtcggaaatcacccaggtccctgtctggtccggctcccatatgaagactggcaatggcggcggagccgacgaggagctcatggaatttgtggcagatatttctggagacctgaatgggtaa

SEQ ID NO: 7611 - DNA, 246 bp, A.fumigatus
ctcagactctcgcgtgccaggcgatctactgtggtacagattgacaaatacgacgacctgggctctgtcaatatagatctgtccagcataagagtcaaggtgacgatcaatatggagcggatggagatgatggactctacggcaatgccgcaccgtagcaatctcaaggtcttcgccatcatggtggccctgtcggtgagaaagaccatcactgaagatgactcggtatcaacgaataactcataa

SEQ ID NO: 7612 - DNA, 357 bp, A.fumigatus
ctcataaaaatccagctgtcgatgtttgtcgctgctctcgaccagacgatcatggccacggccatcccaactattgcagctaagctgcactcggctgcaggatatacgtggattggcggtgcctaccttctggccaatgccgctggtgcttgcatctgggccaagctctcggatatctggggacgcaagcccatcttactcttggccgtggcttggttttttggtagttcgatcatttgtgcgacggcggtggatatgcccatgttaatcgccggacgggcactgcaaggtgttgccggcggtggcctgctccagttggtcactattgtgatttcggatttgttcagtgtcaggtag

SEQ ID NO: 7613 - DNA, 495 bp, A.fumigatus
cgaaggcattcatactgcaacgcacggccagcggtgggtcgaatctgcacaccacggagttacatcgtcaagtcggtcaatacatacttgagaatggaaacgatggaagagcttactggtcgtgctgctaccatttctctcgagtcagcaaaacccgctcggtcaatccaggtgcagcccggccctttgtcttcccacctggacaagatctatgcgtccttgacgtccacctcaaccactgatttcatcaaggatctacaaaaagaagcgatcgctggtagcgttgaggccgcaaatcccctcgcgtccttggcagcattccgtgcatacatggccagtccagcgtctgatgccttgcttccggccgaaggtgaggatttgtcggcaccgataacagattactacgtctcatccagtcacaacacctatttgacggggaatcagctgtacagcgatgctgcagcggccgcatataccaacgtatgtctcacctga

SEQ ID NO: 7614 - DNA, 807 bp, A.fumigatus
  unsure (757): Identity of nucleotide sequences at the above locations are unknown.
gtacttctgaatggttgtagatgtgtcgaaatcgatgtttgggacggagatgcggacgatgacagcgtctctggtgacgacacaagcagcagcagcagtagtagtagcgagtggagctctgacgaagaaaatcccagtcgtcgtaagaagcaggacgtacaaaagacggatggtagcacacagtctgctaaggcaccatcgcgacgcaagggcctctcgtccaaactcggaagcctactgggccgcaaatcatcgcctcctaacggagcaactgataaacctgcgtcgactgctaccgctgctgctgtaggcactgcagcacaaaccctgcgccgtccggagccccgtgtgcttcacggacacacgctgaccaaaggaaccaagttccgcgatgtttgctatgcgattcgcgacagcgcttttgtggcaagtgatctgccagtcatagttagtttagaggtgcacacatgcatcgagcagcaggcgacgatggtggaaatcatggaggaggcgttcaagggaatgttgatcgaagtcaccccggagcttgaagcttctcaggccccgcctccgttggagtccttgaaacgcaagattctcatcaaggtcaaatgggtcccagcgacaggcgacggccaagcggaggcgcaaaaggacgatcagaccgacacgctcgatacacctccctccgtaaatcaggacggtgaacctgcaccagccaagccgtccaagatcctgcattccctgagcaggctancggtttttaccaaaggattctccttccgccagttcacccaaccaggttaa

SEQ ID NO: 7615 - DNA, 1188 bp, A.fumigatus
cctcaccgcctggagagaagcgctttcggacaagatgtacaccaccgtagaacaaatgacgggcgctttgcacatggcaaccaccgacacagaatgcagcctttggccacagcattgccttcaatggatgctactgatggcttcggtctgcggcccgtgcgtgataatgagcggttaccaagcatgcttcctggcttccacaccggactcacttctcagccagattctccgacaacccccaatgctcctgtacagcctcgaagcagcgcacaggctacaattgcgaggcaacgtccgtcgttgagacagcagcagtcagcatcgggcgaatccgatgatggaaacggagacggttctacgatggatgaagatcctgcttccacagaggcagctgagcctatcgttggactgcagaatagaatggacatcgatgacgtcggcgacagagacacaatactaggcggcgtttctgattcacacgatctcacagtgacagatccatccgaagagcaggaagccgagaccttcaacatcacacaccgttccacagtggacggcagcatgatcaataccgacaacgcccaaaataatgccgctctggggttatcccctacccaggcagctgataacgccaactcccctgctcttgtccctagcccttactcactatactttcgcgatcgaacaaccacagccgctcatggtgttttgacaactctgcccagagacgaggacgttctcatgtccctccaacttttggcttatgtctccaagtactgcaacctccggtcctacttccagcactctcatttcgtcccgaaactcaagattgatcgcgaacttcaaatgctagaggaaggaacatctccaattgagtttcctgaagatgaggacgagtatctgcttcctgatgatgtcaacatcttccctctagttgagaaatttaccgtccgtcaccactcaaaagacatgcagtactgggcttgcgtggtcatgcggaatctttgtcgtaaggacgaatctagaggaggtatcaggcaatgtgcatactacaagtgcggaaagtgggaggagtttcagcgtcaattcgcaaagtgccgccgttgccgccgcaccaaatattgcagcaaagattgtcaaaaagcagcgtgggtttatcatcgtcattggtgccacagcacgccctga

SEQ ID NO: 7616 - DNA, 669 bp, A.fumigatus
ctagtcattccacgctttccgctaatcgctatcgcacagatcccgaacgacttctttacatcccgccatgacccccagaacggtcccacaggctgcatactccgctacctctactacccctcgatcttctcacccgcaacatcctcctaccagcacgacgtcgacgtgcgcgctggtgcccactccgactacggcagtatcacccttctcttccagcggcccggacagccaggtctcgagatccggacgccagatggttcctgggctcctgtgcccgtgcagccgggcaacgccgaggatgctagtgcctacacgttcccgcctattctggtaaacattggtgatctgctgagctactggaccgacggtctactcaagtcgacgatccaccgtgtcgtgttccccttgtctgaacagcgtaaccccaacccgcaggacaggtatagtatcgcttacttctgtcatccggtagacaccacggagttggttcccgtacccagtaaagctgtcgtcgctcatcgcgagtattgcaggaagaatggtattgccaatgaacaggttggcttcggtggcggagcagggaacatggcgccggggaagcgggctttgacggcctacgaacatctcgaatcgagactggcggccacatacggattcaagaaggagtga

SEQ ID NO: 7617 - DNA, 309 bp, A.fumigatus
tcgctatcgcacagatcccgaacgacttctttacatcccgccatgacccccagaacggtcccacaggctgcatactccgctacctctactacccctcgatcttctcacccgcaacatcctcctaccagcacgacgtcgacgtgcgcgctggtgcccactccgactacggcagtatcacccttctcttccagcggcccggacagccaggtctcgagatccggacgccagatggttcctgggctcctgtgcccgtgcagccgggcaacgccgaggatgctagtgcctacacgttcccgcctattctggtaa

SEQ ID NO: 7618 - DNA, 519 bp, A.fumigatus
ctgctgtttgaaaagggtataatgttgctaaccataccattagggatcgcatatacggttccagatcttgatgccaaggtccggatttatatcaactcgacagaaacccgcaagagtattacttgcattgaagctagtctgtcaaatggcaagacggtttaccagaaaggcgttggttggacaacagctatcatctcgggtttgggtcttgctgcttccgcaatcacttctggtctcggtcactcaaataccgctgctcatgttgcagccaatgcgctctctcttttcggcttcatgcagtcgcaagcgatgttcggcatgatatccgttgcaatgccgccgatcgtcgaagcatggacgcagaatttccagtggaatatgggtatcatccacattgggttcctggaaaccctttgtacgtgggatctaccatcgaccggtggaacgccttcaacccttctgtcccagttgtctaccacgttccgtcaaagtcctgaaacgccgaaaacgttccattga

SEQ ID NO: 7619 - DNA, 492 bp, A.fumigatus
gctctattctcgcctccatccacaaacttcttccccgctgtcgagtgcaagaacacagctcgacagagccctgccaccatgcggttaatgtcgctgatcatcagcttgttcgtcgcttttctcgcaacaccgcttgtgtctgcgattaggctcatcgagtccaatgccctgaacctgtgccaagacagttcgaacttcacagcaaccttcttcagtgtcactttcacgcccaacaatcgatcattagcctttgcttttgatggagtcgctgcgatctccggtaaggttaccgccgagcttgttctcactgcttatggttatgaagcactgaggaaagagctggatccttgccaaatgaatctggcggggctttgcccaatgaacgccggtcccatcgatgtccccagcgccaatatcattgtgtcagaggatgtggccaaacagattcctggtgaggatgcctatactgactgctgtttgaaaagggtataa

SEQ ID NO: 7620 - DNA, 186 bp, A.fumigatus
  unsure (162): Identity of nucleotide sequences at the above locations are unknown.
ggtatctactcagcctctggtcaaagcgggtccccgaaagcagagatagaatatcaggcccttcgcaccaacggccatatggagtaccagatgcagaagtcgacaggcatccctgcatgcaacgtcgccatcaattgctccatcccagacgcagtaagagcnggagatcttggagtttctgcatga

SEQ ID NO: 7621 - DNA, 267 bp, A.fumigatus
  unsure (227): Identity of nucleotide sequences at the above locations are unknown.
ggtagaacaatcacagggcattacatcggaagatacgcggattactttatggggggcgcaaaagcgttcgaagccacaaagaccgattacgtccggagcggacaaggacgaatgaagcgattgacagttgaaaaggttctactgagagaaacagagattgttcagaagcagatcaaggctttgttacgctgcgacgtgggtcttcaccttactgtgactggtgctanatctgtgactgacagttcgccatcagcttctgacagatga

SEQ ID NO: 7622 - DNA, 1257 bp, A.fumigatus
cgcgattggccgttagagcattattttgagatgtcgaggccggacagcgagcgggctctagagatatacaagaccttcaccgcacagacggaggaggtcgtgaagttcctgggtgtcgctaggcactttcaatctgcaaccagattggaaatacccaaactcaaacacgcttcgacggacttgacgcgccttcttgaggatgatctcaatgaccctgatttcaacattcgccgaagggagtatttggctcgaaaaggcgcaaagaatggtggagcagacactgcgttgaagtccagtattactgggggccctcagaataccagtaatatgagttctgccccgagccgcccacaaacagaaccgaacccgcagaagaaaaccaatcctgcggacttgattgactttttcgaacctatcgaacccaatccgcagcctacagcacaaccaacaaatttccagcacccgtaccaagcacagcagcaacagcaaaccatgcccttccagccaacgggcttccagccgcagcagacagggctctatacccaacagacgggcttccagcaacagcctcaaggggcctcttttggtcaaccgaccggctttggagaacccttccctcagcagaataataaccaatttggacaagcacaagcccctcaaccactccagtctatgccaactggggccggattcggcggctactcggcacagccgcagacatatgggttccaaacccatcttagccccataccgcaaagcggtgtcgcgtcattttctcagcagcaacaacccgcattgggtgttcagcagcagccgcaacaacaatcaaccaatccttttaggcagtcaatgttgatgagcacaccaacagggactgctgtgccggcgtctccgttgagccgtcaaaacacgaacccttttgccagacgcctatcgacggtgaatccacaagttagttcaggtcctactgaagggactcagagtccagcgcaacaaccacttcggcctcaccgaacagggaccaatccctttgctcggagctcctctgttcctccccagcaaagtcaaggactgcagcctccagccgcagcacccttacggccgaatccaacgggaagcacgaatcccttccgacagagtgcctttgtaaaccaacaaaccggccagggctggcatgtcggtggtcagcagggtaccatggggggacttgaaaagctagaaacagtgccagtctttccacggcccgggatggcctag

SEQ ID NO: 7623 - DNA, 828 bp, A.fumigatus
caatctgtcctctccacgttgtgtgagagatcgccttatcaaaccgagtccgatctgttgctatatagatactttcgacccgagggaagaaagcggccatccagagttcaatattgcggaaatatggacgagactattgattcagaatccgtcctcgctcccgtgagggcctcgtcgccgtccccctccatcccagcaacgcctgcgatctcctcgtgtccatcccctgaccgtaccttctccaccatttcatccctctcaacctcgtccgccacatccgccgatgccaggtcatcaatttcggtctcttcgaaacgacatgggtacatccggccacagggagccgaattcgccgagtcggctaaaaatcgcgagagtgtgatgagtctggggagcattgcccacctacagtactattttgcgagaaccggtctgctagacggaaagggtgggcatgcgcgcgagtggaagaagaagaaaaagcccgaggaggagcctcggctcctgttgacacctaatgctcggttcatcgatgatttgacggagagcccgacggaggaatatagttcagatcttggtgaggaggacccggaagacgagatgatgctcccgccgacggtgagcacgtacagcgtgaagacgcatcatattccgccaccgcgggatgttctggcgctgcggaaggatttgctccatgcggtcgaccaagccgagaaaaccttccgggacctgtactcccagaatggacctccgcccggatgtgatggcccccgcggatcagtggtttctccagaagatcccgaaagtgatttccccgcccaggctccg

SEQ ID NO: 7624 - DNA, 318 bp, A.fumigatus
caatcatgttctacaggcggcaaaggaggcaagggtcttggcaagggtggtgccaagcgtcaccgtgagatcttgcgtgacaacatccagggtattaccaagcccgctatccgccgtctcgcccgccgtggtggtgtcaagcgtatctccgccatgatttacgaggagacccgtggtgtcctcaagtccttcctcgagtccgtcatccgtgatgccgtcacctacactgaacacgccaagcgcaagaccgttacctcgctcgatgtcgtgtatgctctcaagcgtcagggccggaccctctacggtttcggtggctaa

SEQ ID NO: 7625 - DNA, 1029 bp, A.fumigatus
gactcgtatcaactgtactatagatatgataatccaccaccggagaaggactggaagagagctgcactacgtggtccggctttgcctgccgttgggaatgcagtcgcgggggccgtgggagcggctatatccaacgttgtcacatacccgctcagtctgattgtgactcgactacagacgcaggcacaacgaaggacgaagaaaaagaacaagtcggaatccgaggacctagacgaggaggaagatgaggagtacaccgatgtgcttgacgcaacacgcaagatttatgccaaagagggcctggggagtttctacacgggtcttgcacaagatacggtcaagacagttgcggactcgtttctgtttttcctcgcgtatggttttttcaggcagcggaggatccgggctcggtatggcgatgggcggcggtcgaagcatgtcgtccttccgattctcgatgagttggcgatcggtgtgctggccggcgcatttgcgaagctctttaccacgccacttgctaatatcgtggcgaagaaacatgcggcgtctgggaaaaaagctctttcgacgaaggatatcgctgcgcggatcaagacggaaaaagggctgagggggttctggtccgggtattccgcgtcgctcattctcacactgaatccgtccatcactttcttcctgaatgaagtcttgaagtatgcacttttgtctcggaaaaagcggggaaaaccttcgccagcgacgactttccttttagctgccattagcaagtccgctgcatcgtcgatcacatacccgttttccatggccaagacaagagcgcaggtcgatggctcggggaatagcggaaaaccaagcattaagagcgtctccgaggacgggatttcgtttgcacctcaaatcattatggatgtgctggctattgcacgcaacgagggtgtttccgcgctgtatgcgggcctccccggggaagttctcaagggtttcttttcgcatggctttaccatgctagcaaaggatgccgtctattcg

SEQ ID NO: 7626 - DNA, 1392 bp, A.fumigatus
acgcaccccacaaggtcctctcaaacagtcgagatgtcgtcatctccaaccagacgagaaaggattcaccttgacggccgcaccctcgaaggaggaggtcaactcgtgcgcatcgcggtggccctgtccaccatcacgggccaacccatcaccatcgagcacatccgcggccaccgcactggcaagaagggtctcaaggcatcccacctggcagccatcaagtatctggcagacgtcagcgggagcgccgtctccggcgccgaagtgggctcgtcttcattgacatatcaccccctcccagacgcagagacctgcgttcggcaacagcaagagattgacatccgccttcgaacggctggggctatatcactggtcttccaggctttgtatccgtatattctccatacagccagctgtttagcagtcgccgaaccaaaaccacagcccgtccgtgtgagcatcacaggagggacaaatgtatccttttcgccgtcgtatgattacatctcgcaggtcctggtgccgaatctcgccagggtcgggctgccgcccctcgcggtccatctggagaagagaggatgggccactggcccgtttagcctggggaaggtgacgttcgtccttcactcgatggacagaaacgaggagtctccgtatgggtttccacgagtcgatctggacagatacccgcggggcgagatcacgcaggttgatgtcacggttctggcaccggatacgcttttgttcggtggatctggtcagcacgaagctcgaaagaagggcaattcgcagatatcggacggtacatctcagtctataactctccgccaagtcatcgagtatgagaccatgcgcgtgttgcgcactcgactacgacagttaccttcttcgatagtcaaacgagcaagggcagattctccattcgccagaacatacgaaaacgatgagattgtacctatcagactgcacacctcagaaagaacgcaccaccactcacatatctacattctcattgtggcgcatacatcgaatgggttcaggcttggtcgagatacgcttttcggcgctcacggggaggattctcatagaaagtcaggtggcagaaagggccgaccaacagacgataggggtatagctctgaaactggtagagaggtgcgtgaatgattttgtgcgtgagttgtatgacccaagactgcggagtacatccgagggacgtcagccttgtgtggacgagtatatgcgagatcagctggttatattcgaggcgctcgggaagtctacgtccaagtgtgaagccgatggcaggggaaaagaggatgagagatactgcagtctccatacgcagacagcacggtgggtatgtgagcagatgttggatgtggaccagtag

SEQ ID NO: 7627 - DNA, 609 bp, A.fumigatus
caggaccagcatgacgaccgatatgccattgccgaggaatatgtgagagtaacctacaaactgtgggagtcgtcctggcgagacgatgctgttgtcctcgatcgtgagcgcggaatctacaccgatcccagccgtgtgcgggaaatcaaccacgagggcaaatacttcaacgtccccggtccacatctgtgtcaaccgagcccccagcgaaccccagtcatccttcaagcgggcacctccaaggcaggaaagacgtttgccgcacagcatgccgaggcgatctttgtagccggacacagtccagtagtggttgccaagaatattgcagagatccgggcgacggcgcaggcacagttcgggcgtgatcccaaaagcatcaaattcttggccctgttgtgccctgttttgggccggacggaggaggaggctcgcgaaaaattccagtactaccgcagcttgggctcgatcgatggtgctttggcgctctttggcgggtggacgggaatcaacctggatacgtacggtgatgacgaagagcttcgacatgtcgagagcaatgcaattcggtgggcttctatggtcgtcgaaaccagagatggtgctaattag

SEQ ID NO: 7628 - DNA, 225 bp, A.fumigatus
ccgtctagctccgcggtcgagggctggtccaaatcgacaccagaagtcgcgaaatggaccaagtcaactgtgggtcagcatatcacagtgggaggtctgggtgccaccccagtaggcacgccagcccaagtagcggacgagatggaacgctgggtcagagaagccgatgtcgacggatttaacctggtgagttgccctgcagacgatcactcacaccgcagctga

SEQ ID NO: 7629 - DNA, 237 bp, A.fumigatus
caaggaaaggcctatgccatcaagccagggtccttcaaggatatcatcgacctgctgattcccgagcttcgtcgacgcggattgttctgggaggattatgctgtcgagaggggaacgtatcgggagaatctgtatggcaagcctgggcagacaggtcccccggcggatcatcctgcgtcgaggtaccggtggcatgcaggagtagacgctgccgatcataagattcccgaaaactag

SEQ ID NO: 7630 - DNA, 756 bp, A.fumigatus
cttggtccatttcgcgacttctggtgtcgatttggaccagccctcgaccgcggagctagacggctaattagcaccatctctggtttcgacgaccatagaagcccaccgaattgcattgctctcgacatgtcgaagctcttcgtcatcaccgtacgtatccaggttgattcccgtccacccgccaaagagcgccaaagcaccatcgatcgagcccaagctgcggtagtactggaatttttcgcgagcctcctcctccgtccggcccaaaacagggcacaacagggccaagaatttgatgcttttgggatcacgcccgaactgtgcctgcgccgtcgcccggatctctgcaatattcttggcaaccactactggactgtgtccggctacaaagatcgcctcggcatgctgtgcggcaaacgtctttcctgccttggaggtgcccgcttgaaggatgactggggttcgctgggggctcggttgacacagatgtggaccggggacgttgaagtatttgccctcgtggttgatttcccgcacacggctgggatcggtgtagattccgcgctcacgatcgaggacaacagcatcgtctcgccaggacgactcccacagtttgtaggttactctcacatattcctcggcaatggcatatcggtcgtcatgctggtcctgttagagaaggctagcggtttggggatggagcctacctgtggttgctgggcatggcccagattccgagctgctgagtccagatag

SEQ ID NO: 7631 - DNA, 243 bp, A.fumigatus
atggctggacatgcttacaatagctctaaaagatacggtgctgaatcgaatgatgcttgtaaagcaacattgacagatgggctgccacagaccaaaggggtaaacgcagccagtattacaaggcaaagccgccacgatgtgacggagcctaagcctatagccatgattgaagcaaggcttctaatccacaccttctttgtcgcactgtttatcaagttgctatgtggaacggcagccgaatag

SEQ ID NO: 7632 - DNA, 228 bp, A.fumigatus
tatgctatggtgtgcagagatccgcgagaacttcccttcgatcgtgtgctaggagatttatcgctcccaccggctgttctctatgccgatattgcgtctcccatgttcaaggactttcatcataccttgagtgcgctcgccaaggacgggcaggtctcgtatcgtgtgcgctaccgaccaactcagcattggatatctcgtcccctctttgtgtctggctatggtgtc

SEQ ID NO: 7633 - DNA, 1965 bp, A.fumigatus
cactctatctgtctatctatcgatttgtttctctttttcttgtttcatccccttttcttccttgggtctctttgtccatataaacctccgttccactgttttcctctctcacaactacccactctcagataccgaccatcacataggtcccggcctaccttatcaacgcactgtgagcggggagcatccactctatcttatctactgtgtagatcggagattacgacgtatttatcactcatggcctttcgcctaccccctcaagttactcgccgtcgcaattcctactcaacccaatatgtccctgagcctgatattccttctcccgtctctccactcttcgagaacgagaacgaatccacgcaatgggtgctcttctccccaccccaaccatccaccgcccgcactcacacgacctccactgaacgcactccgcgaagaactggagcatcccgcttgagcgatttcggctcctttgacacagcgacccgttctatatttgggtccgagggtgataacacggagggcgatgctgaagagcccctggatgaggatggaacggaattagacagcctcgacgatggtctgcacgctttccgggctccgtctgtcacgcaggagtctacatcacggctgaatcagtccacaccagcggtccttccaactcatgatgggctggggagtttccatgcatccagtcagcccgtgcaggagcagttgtggcagtatgagcagttcaatccccgccggcggggtgacgtgcgtccgagacgtcgctcgagtgtgcagcgtcagctggacacggtagaggatcgagagcaggttgatatggagtatgatcgctggcgacgtatcgagaaatggagaatggaccagagccgggcgctcttgcaagagatcgaaagggagacacgacggcgccgacgcaatagccgggtcagtgtgcagaccgaccaggtgacttctcgacccattgttccaggcacgtctgatggtgccttggagacaccgaaggaagattcgttgcaaccgcaccaggagtctgaggaggacgagtccttctggcgacgcatcacccgaaaggtgattcgggacttgattggcatcgacgactctctgctttctgtcattttgggcgagtcgctgccaaatatggggtcggaagacaataaatcagcaggaaccgacaacagtctcgacctgagcaagacacttggggagctggactccatgccggatgagcaaggtctttggcagagcaaattacttcagcggatcgcacgcgaattgggcatcttggtccaccatctttgcgaacaccccggcgcctttacgacatatctcaacgtcacgaatgagataccaagcgagtatgcaggcataccacttggccgtctagcagaggagaatgaagctgcatcacagggtgcatccgccgaacctgccctccacaccgcgatgagcagtcaggattcaatgatgtcaccacaattttcgcctacgatgcgcgatcccaccagcagagaacatgccgcacactggggcatcgaggacgaagaggacgcaagccgcgagccactccccgaatccacacgactccagcaagaaaaggagtactgggagcgcgagctggacgtgatgatggttttccgctaccttcgcaaccgcttcggccggcgaggtagcaacgcggacagcacccatgcatgctcacgtcgtcacccacaggatgcgtctcgacgcgcggtaatcatccgccagcaccaacccctcgtcgcaggggctcattcacgctctcaaacccagctccgacgtcagtcttggcccacaagctttacttcccccgctgctccgtcaacacctccacccaaccaattccagctggcgcgaagccataaaaaactctctggctctctccaattcggggtaaggctcccccatttccaaacccggaattactgggaa

SEQ ID NO: 7634 - DNA, 201 bp, A.fumigatus
  unsure (29),(43),(83): Identity of nucleotide sequences at the above locations are unknown.
accgtttgggctggagggctttctcctcnaacaattatcctcnggggaattaataacccggtgaattccctcggggggttttnaacaactgccttaatcttttaccctgttctggcccttcaaaatctgtccaggaccaataaagaaccgtcccctcctccttttaactcccgttggtttagaattgtatcaaccaattga

SEQ ID NO: 7635 - DNA, 474 bp, A.fumigatus
ccagtactgaccaacggaacagtgggtgaccagctttggatgtcccgcttcctgctccaccgcgtcgctgaagaattcggtgtcaagatttctttcgagcctaagcccatcaagggtgactggaacggagccggtctccacaccaacgtctctaccgccgccactcgtgctgaaggcggtctgaaggtcattgaggcttacatgcagaagctggaagctcgccacaacgagcacattgccgtttacggtgagggcaacgaagagcgtctcactggccgtcacgagaccggcagcatcgacaagttcagctatggtgtcgccgaccgtggtggcagcattcgtattccccgccaggttgccaaggacggcaagggttacttcgaggaccgccgtcccgccagtaacgctgatccctaccagatcaccggtatcatcgtcgagactgtgagtttgcaccttttaataccaaggtga

SEQ ID NO: 7636 - DNA, 249 bp, A.fumigatus
  unsure (50),(182),(225): Identity of nucleotide sequences at the above locations are unknown.
cacttctccttgggaatgacgggttggcctttatgggggggcccaagggngggtttcccagttgccccaggttctttattactgcggtgttggaactggccaggttttactgcgtggacattgttgaggttcattacggcgcctggcttgtacgccggtatcaagatctctggtatcaacgnggaggtcatgccttcccagtgggagtaccaggttggtccctgncagggtattgagagtacgtcataa

SEQ ID NO: 7637 - DNA, 189 bp, A.fumigatus
cccgaactggccatatgtgaggctgttctaagcagtcaatctgccagacttcccaccgctacctcgacgatcccatatgactctggcctgtatacctttggaaaggtattagtgtctgctgagcacttgcaatggctttattctacagacccatgggtgagccattgcctctttaacacgtttggctag

SEQ ID NO: 7638 - DNA, 705 bp, A.fumigatus
gttatcaactcttctgactgcatccaggctcctcccagcgcacggggattaggcaggtcgggccctcgaagaagatccgggtgcctgacatgtcgagcgcgaaaggttcggtgcgatgaagcgaaaccaatctgtgccaattgtacccggcttcggctgggttgtgtttacaagacgattgtgcctgcagccgtcccgcggcaggctaatggtcccacagcttctgtgacggggaatccgaccgcaaacgcctttcagagaccagatgcgggctatttcagtacagtactacgaccagatggacaacaggcctatcggccgccgcaagcatctaatgcttcacaattgcgatctgtggataatgcggcgacgtcacctggaccatttgatatgcttggtttcatgagcgagattacgtccgagctggagcgcaagcacctcgatttgaccaacgggttatctgaatttaccagttcaacgtcttgcaaggcgtcgaacgacactgcaaatgtaccgcatactgatcgatcgatgagctgcgactcatgttttcattcaaagggaacgcaatcacagcctcccgctacggagggtttgtggccggagaccggagccgcgtatgaggagcatctgctggcatctttcctcagctccgagccgcccgcgacgatattcggaccagtgaacctggaatggaaatatgtg

SEQ ID NO: 7639 - DNA, 876 bp, A.fumigatus
gtgtacaacgcgataccagaacttgtgcggacagcttcagtcccgacagatgatggatacagagctgtcgaggatgcgcgcgaacatcccacggcgaaccaaaagggtatcattaaaagtgcaattcaccttgtaaagcgggctgcttctccctggcgacagtatgtggctagtccagtcttcctggcgtccttcgccttgagcctgctctatcttactgttctctcctttggcaccaccatggtcacatatctcttgcatatgggttttgatcctctgcaggtcagctgtatgagaatcggtgccgtgctcgcagaattgtctggcacatgggcagcaccgttcatcatgggcaggatcggaccgattaggtcagggctgtggttcctcaactggcagcttggctgtttggccactgcagcagtcgcttttgccttgtacgactcgaactctcggttggtagcagtgagtctcatcctgggagttgctttgagtcggattggcctttggggttttgatttgtcggttcaatttctcgtccaagaggtaatcactttctcccctgagggctgctaccagaggttgctaatgtttatcaataagggtgttgaagaagatacccgggggcgattctcctcaaccgaaatgggcgtacagaacgtctttgagatgctgtcgtttgcaaccacagtagtctttcctctccctgagcaattcaagtatcccgtttttatcagttacggggcgattgcactggcagccatatgctttgcggcatacgtgagaaaagagcggggacatttgctgcacatatccaggtgctggggtggcgataaaatgcgaaggtcgtatcaggcacttcctggagggttatga

SEQ ID NO: 7640 - DNA, 489 bp, A.fumigatus
  unsure (472): Identity of nucleotide sequences at the above locations are unknown.
ctcgacatgtcggatcaacaacaccatcaggatgccatgcggaggttctccttgggaactggccagggccaagtcgaccccctggaccttcccctccgccaagtcaccaacgatgcgaacatggaagagtacaccacggagactgcggcgggagagatcatcaagccagtcagatcttctgctaccggcaaggtagaggactggaagctggtcacattcaaagtcgatgatcctgagaacccaaagaactggtctaaggcctacaaatggtactgcactatggttgtctcgttcacctgtttcgtcttgtcctttggcaacagttttgatcctgccgacttggacggggccccaaagggcaccaaagtatactcacgaacccggctagtaatagaatccgcacttgttacaaacccccggtgggtgcgactgaaagctgaaaaacaatcccccggtccctccggactaatcngcccatgttgtggcgac

SEQ ID NO: 7641 - DNA, 189 bp, A.fumigatus
agacctgtacgcgtgacgattgcggatgagaaagcagcaaaggcaggccgcggcgcctggactctggatggtaagatgattgacatccctgttgcggagaaagcacgcgcgatcgtgaagaaggcgggggcttgcggatttaatgtgaaggaattgcaagataagtggcagcatcaagagcccgaatga

SEQ ID NO: 7642 - DNA, 597 bp, A.fumigatus
aatgcgcagactaacatatctctcagcgctgctcaagcctggaaccggaacgacgctagagccgccaaagctttgtctcttcgaggccaggcagaaaacgaagcgatgcgtaggtgccaccgcgaagcggcacggcaattgtacgaagagcggaacaagcaccttcttagcgccggtttggatgagtcgtccgaagaactttacgtcgaccttcatggcctgcaccctgaagaggcaatcgaatatttagagaagatccttctgaagcatgctcgcgagggacgatgcgtgatctacgccattacaggcacgggccatcactcgaagaatggcaaagacaagatcggaaaggccgtcaaagcttggctcaacgagtggaagtacctctaccgcgagtttagtgtgcccggagagaggggaggatatgtaggtggcatcctgggaatcgacccgaccagctatgacaagactcttgccaaaagtctagaagagggtgaggatgggaagggtggtgacagcaatggtagtcaacccgtaatgacaatgggcaagattcaactgttgaagcgcgaggatctggagtcgaagagttcataa

SEQ ID NO: 7643 - DNA, 1293 bp, A.fumigatus
  unsure (55): Identity of nucleotide sequences at the above locations are unknown.
atggaaattgggggggtagccgatgccgaagctctggtgcctgatatgaccactntatatgggatcctttttcgtgcccgaactcagggcctattggtatacgccaaggctctgaactgtgactgggagggagttgacgcaggactgcaagagatgcacaaactcaagctgacgagacgccggcgagacttccttcctatttttgatcgaatatttctggagtactgggtctcacattcgggaattgagattcgcaattttgtgttccggtaccttgataaattcgacattgtccccgatcgcgtgctctacaagcacatcttggaggctttcgtggagaaaggagacaaggaaatgattgctgaatttacaagtatggcgaagcagcgatcgtggaatatccccataaacgagcagcaattcttggagatactacggtctcgtcgcctcgcattggaaggagcaccagtggggttctggcaaatgctgcaggcagcgcgtgtcaagtacgggcacagctccacgtctcagcgtatcatgggctacgaccaacagtcattccctttgccggaagtcaacagcatgccatatacacagaatccgctatcgtggtaccagagaacgatgcaagagaccacgccgtcgaagcctgtcgaccaatatcagaaactccataagcagatgacccattttctgcacgctggaaagctgaaggaagcattgaagtgctttcaaaatgctaaaaatgcccggttccagatgaggcagcttcacgttgaattggcggtcatagcgactttgcttgaggacggccttagtgcagcgcgcagtctcatcgagtctgaatggcggactatccgtcaccttgtccgcttctctcctatcttctttcgtcaagtcatggcggtcgacgaggatgcgggtggccacattgtccagatggcagtcctacgcttctaccagctttgttggtctacgaaacacatgaaggtcaagcatcaccttactgttgcgacaagccgtcgcttgatctcccaacataagccggaaatggctctggagcttctgacggccgtgtacaagtcccgttataggtttgcagcgacctttgacggggtttgcatgaagatgtttgcgcgcgccttcgccgcgacagacaacattctaggcttacgatggtgtattcttactgctttatcacgcgatagtgcactcaatcatgattttgtggtggaagttcgccgaatcttgggcactctaagtccaccttccgcgtcttcaccacggggctag

SEQ ID NO: 7644 - DNA, 564 bp, A.fumigatus
ttcattttaatagataagcctcggcgtactaaccgttatctgcaaaaatatagggaagacgcagaagccaagagagccgaagccgctcgcaggaaggccgagcgagacgccctcctcgccgccgaagaagcctcgctaccctccaagcccaaaggtgccggcgccaagcaagcacagaagaagactcgtggtttggatttatcacagctggacgatgagcccgccagccgcaaggctgctgcgctcaacgcctcgggtatcgataatgcgctagatgcgctctccctgaccgccaaggactcgtcgaagatcgaccgtcacccggagcgccggtacaaagcggcgtatgcggcgtatgaggcgcgccggctgccagagatcgaaaaggagaaccctgggttgcggagaaatcagcgtgtggagctctgcaagaaggagtttgacaagagcgaggagaacccgttcaaccaggtgcatgtggcctttgacgctactcgggaagaggttgctgctgctagggaggccgagagaaggaaggtggaggcgagactggctagtagataa

SEQ ID NO: 7645 - DNA, 231 bp, A.fumigatus
cctgtcgggcatggagcgatcagaccactgcaggacttatgggggatgccgatcccatgcgtggcggtccccgccggcccggtaatgggcatggagctggggcgtatgaatcggcataccgagtttgttacaggtgttgattggtgtctttttggcagtgaaggatggtgtgcgagcgtagggtgggatgagaacctgtatgtttgggatgtgcgagcagtgatgggataa

SEQ ID NO: 7646 - DNA, 216 bp, A.fumigatus
tgggataaagatgctatgatctattgttctccagttccacctaccctgtattggttatttagattaccacgagataccattatgacacgtctgcgggacagcgatttcaccttcccaaagaaatcacacgaatatgtgaagttctgtgtcaacgaaatatctcccacaattttgttttcatcaaaatcaagtcacgagatctatccgataaggtaa

SEQ ID NO: 7647 - DNA, 747 bp, A.fumigatus
  unsure (6),(41),(45),(57),(65),(108): Identity of nucleotide sequences at the above locations are unknown.
cacttntaccccctaacccattttgtcacgggctcagattntggntccatttccttntggtccantcacaagagaagccttctccacaccatccaatgcgctcacggnttagaccttctccttccgctagacgagctttcagctgaggtcgatcagaagctcgcggactcaaactcccgtttttttcggcgcatgccccgctggatcacagctttggcaacggttcctggcaccgacatcgttcttagcggcagctgggacggcttcatccgagcctggaaggtttccgaggacaagaagacaatcataccgcttggccccgtcggcggaggaaagctcggttctgcgacacaggacacaccatctcgacagctcaaacagactctcgagtttaacacagccgccgacgcggactccatgtccgtcgacgaaccccagaatcaacacaccgaggacaccaagaacgaagctgaacctctcatcaagggtgtcatcaacgatattgccgtgtttgagcgtcgtgccgacacggccaaacccggccaaggccaggccgagtccaagaccaagaccaagtcatccgaacccgagccccgcggtctctgcatcgtcgctgctgttgggaaggaacacaggttcgggcgctggaagtgctttgcgaacaattttcacgagggatctgcagctgacggccgcaacggcgcggtggtctttgaagttccctttatctctgacagcaagcagtga

SEQ ID NO: 7648 - DNA, 831 bp, A.fumigatus
acgagctttcagctgaggtcgatcagaagctcgcggactcaaactcccgtttttttcggcgcatgccccgctggatcacagctttggcaacggttcctggcaccgacatcgttcttagcggcagctgggacggcttcatccgagcctggaaggtttccgaggacaagaagacaatcataccgcttggccccgtcggcggaggaaagctcggttctgcgacacaggacacaccatctcgacagctcaaacagactctcgagtttaacacagccgccgacgcggactccatgtccgtcgacgaaccccagaatcaacacaccgaggacaccaagaacgaagctgaacctctcatcaagggtgtcatcaacgatattgccgtgtttgagcgtcgtgccgacacggccaaacccggccaaggccaggccgagtccaagaccaagaccaagtcatccgaacccgagccccgcggtctctgcatcgtcgctgctgttgggaaggaacacaggttcgggcgctggaagtgctttgcgaacaattttcacgagggatctgcagctgacggccgcaacggcgcggtggtctttgaagttccctttatctctgacagcaagcagtgattggaacacatttgctgaatggggcattggagcatgcattttgcatgcacaccttatcatgagggcatcggttgcacagatgaagttccgcaacccacccagagtagatttatggtatcgaaagactcgtatgccgcgtcgatttgtttgcatcttcctgtactgggaaaatagtccggcgttcggtacgctccctagccttcaatgtacataa

SEQ ID NO: 7649 - DNA, 471 bp, A.fumigatus
gagccactcagcaatgcagacgggtcattgaacgcagcagacgcatcggtgggtgccggagccggagcggcgggtgagggggtggcaggtacagccggagcagaaggggcagcagacggggcaggagcagatggtgcagcaggcgtggaggcagcagctctcgaaggtgtcgaaggggcctgtgaaggtgtagcggcagacgagggagccttgggctgtataagatggtacggtcagatgcagtgctcagagtctttcaatggcgaggccggtgtcattaccttcgataccatgcatactatgaaacccttctcctcaatgttgtatgtctcgatggtcttgtcatcttggaggattttccctgcgagttattcagcgaagcgtcagcgagataagctaagaaaaagcagaagcaaaggacacaaaaaacaacaattgactgtgccattccagcggattcctgagaaatga

SEQ ID NO: 7650 - DNA, 264 bp, A.fumigatus
aggagaagatttccaaggaaaaaggatgggaggtacctcagctcaagctcatctattccggttagtctgacaatgatcaccctgggttttgtcatttctcaggaatccgctggaatggcacagtcaattgttgttttttgtgtcctttgcttctgctttttcttagcttatctcgctgacgcttcgctgaataactcgcagggaaaatcctccaagatgacaagaccatcgagacatacaacattgaggagaagggtttcatag

SEQ ID NO: 7651 - DNA, 396 bp, A.fumigatus
ccgtaccatcttatacagcccaaggctccctcgtctgccgctacaccttcacaggccccttcgacaccttcgagagctgctgcctccacgcctgctgcaccatctgctcctgccccgtctgctgccccttctgctccggctgtacctgccaccccctcacccgccgctccggctccggcacccaccgatgcgtctgctgcgttcaatgacccgtctgcattgctgagtggctctcagagtgaggctgtcatcagtcaaatggagagcatgggcttccccagaagcgatatcaaccgtgccatgagagcggcgttcttcaaccctgatcgtgccattgagtatcttttgaatgtgagctgtcacctgctgtactccacgtgcgcttcacatgactag

SEQ ID NO: 7652 - DNA, 480 bp, A.fumigatus
ggaatccccgacaacatccaacaagagcagcagcaacaggctgctgcagccgccgcggccccccgcccgtccgccccttccggagagagtgctccctcgtcgaccggcggtgatgagccagtgaatttgtttgaagccgctgcccaggccggcactggagagggcactggtcgtggagctcgtgccggtgctgtcggagctggggaaggactgcccaacctcgacttcttgcggaataatcctcactttcagcagctccgccagttggtccagcaacaaccacagatgctggaacccatccttcagcaagtcgccgctgggaacccccagattgcacagctcatcggtcagaacgaggagcagtttctccagctcttgagtgaagaggatgatggcgcgctgcctccaggcacccatgcaatcagcgttacagaggaggagagagacgccattgaacgcgtacgtacttctccatactga

SEQ ID NO: 7653 - DNA, 240 bp, A.fumigatus
gaaagagatcctcctgataaacacagaagttcattttgccaagtcaaggaacaaaacgggcagaccatccataccgcttctctgccctatgtcctatgtgtagtgcctcgtgccatgtcccacaccgttaagatctgcgagcaaatggcagcgattgacggtgtgcagtctgctccactatcagccagccctgacggccttagtgcctggggtcattgttcaataatcgcacaggtttaa

SEQ ID NO: 7654 - DNA, 312 bp, A.fumigatus
ctaatagacgggcaggtataccgttaccgagaaaagagccttcagcagaagctggagatactctaccaacgcaatctttacattttggccatcaacctcgcgcagaaaaagggcattgacgctctacagcagaatgccatctatcgcaagtatggcgacttcctctatcagaaaggcgattacgacacagccatgcagcagtacctacgggctattgacaatactgaaccgtcgcaggttatacggaaggtattaccgcttgcacttggtaataagtctatatacctgactggattgatcgcagtaccttga

SEQ ID NO: 7655 - DNA, 594 bp, A.fumigatus
cagtcgtgtccttgtgattttccagggctaacccaggataaggcctaccataatctgatgaaatatgcccgagtattgctggcaaattgtcctcaagagactacggaacttttcatggcgtactacaaggggcagtatcgaccaagaacagaggtggaggtcccagctgcacctcagacacaaccaaccagtactttgcaaagcttggctggtttccttcctttgtctttgattaacgcgggttccgggacgaaggctgaaaagaccaaggatattgttgatgaggagacaaaaattgaaagaccgacaccaagctatgaaattccaagaccaaggacagctttctcggcttttgtgggccgcccgcaagaattcattgcattcctggagtcactcatcgacctggaaacgctgaaggaggaggacaaagtcgacatttatacaaccctctttgagatgtacctggacacagcaaagcgaaagaagggttctgctgaaaaggaagaatgggaaaataaagccaaaactctcatcgaagggaaagacgtaggtgctcttgctccggttgtagctccgcctctcattggtttctag

SEQ ID NO: 7656 - DNA, 441 bp, A.fumigatus
  unsure (416): Identity of nucleotide sequences at the above locations are unknown.
attccgatctcgacttccaacgtccttctcttatcagatctgtctaatttccgagagggatctaccctcgtacgcgagcaagaagggcttcggtctgacatctttcggtcttttacttcggcaaaggacacccacggagctatcaaagctctgcggaagtatgggccagaagagcctcagctatatgtggacgctctcacatacttcgcctcaagtccggccatccttgaggaagctggcgacgagctcgacgtggtactcaagagaatccacgatgacggactgatgtcgccattacaagtaatacaagcattgagcaacaattctgtggttaccatgggccgagtcaagaaatatctcagcgacaacatagagcgcgagcggaaagaaatctccactgtaggttgcgttctgtngatcttctacgtagtttcgaactaa

SEQ ID NO: 7657 - DNA, 651 bp, A.fumigatus
atatctgccttcgcggctctggaagatttgtcgcaggtagcggtgggatttggcaacggatcggtcacaatcattcgcggcgacttgattcatgatcgtggtgcccgacaacgcattgtcttcgagtcggaggagccgattactgggcttgaggtacaaagcggggtgttatcgacactctttatctcgacaacgagtcgaatattgaccttggtcatctctggccgaggacaaggtcaaccagcgcgtgtactggatgactctgggtgcggcgttggatgcatggcgcttgacagagacaccggagatattgttgttgctagggaggacgccatatacacctatgggccgcatggtcgtggcccgagctatgcatttgacagcccaaagaactccatcaacgtattcagggactatatggccttggtatgtcctccaagggctgcgttgggaaaccttcgcagccaggccgacgagatcttcagcacaacgactttcacgctgcttgatacggatctcaagtttatagctcattcagaatccctggcagcgtctgtcaggcatgttttcatagaatggggcgacttgttcctcctttcgacagatggaaaggtatgttccaatactgagaatgagtattgctatagctaa

SEQ ID NO: 7658 - DNA, 384 bp, A.fumigatus
tcgcagtaccttgatacacagcgtattcacaacctaatcgagtatcttgaagaacttcatgatcatgaccgagctaccgttgatcacaccacgcttcttctaaactgttacgccaagctcaaagatacgaacaagctaaattcatttatcaaggctccaggagagctcaagtttgacctggagacggccatcgctatgtgccgacaaggagggtattatgagcaggcagcctatttggctacaaaatacggtgagaacgacatggtcattgatatcttgattgaggattcgaaaaagtacgctgaagccgtggaatacatctggaggcttgagccggacttggttcgtaatgacagtcgtgtccttgtgattttccagggctaa

SEQ ID NO: 7659 - DNA, 399 bp, A.fumigatus
ggcgctgcgtctctatacttcagtccgcaggatagatcagctctcgcaatggcagcttcgattatcactcggggatctagctccctggagtcgctgaagggacgctctcgtcccaagatccagatcgacctggttaatcagacagaaggactggtcagctcgtataccaccaagggccagattgaggggaccgtgaccatcagggtagaccatgacacgcgctttgaggacgtcgaaatcactttcgaaggtgcgactgactcccctgtcagctggccagggtttgcgtgcatgctaacagccgagaataggaacagcaagaacatcagtcgagcgcgcggcctaccccggccgcacaggggcgtatcagacattcctcaagctgcgccagcccattga

SEQ ID NO: 7660 - DNA, 318 bp, A.fumigatus
cagccgagaataggaacagcaagaacatcagtcgagcgcgcggcctaccccggccgcacaggggcgtatcagacattcctcaagctgcgccagcccattgatgacgccgcatacccaactccccgcattcttgaaagtggacgcgcctaccagttccccttcacttttgtcgtccccgatcgtctgctcccccatgtctgcacccactccaagatcaacgcccatgtggagcggtcccacacgttgctgcccccgaccctgggggaccccattctcgccagtaacggaaagaccctgctggacgatatggtgcccgag

SEQ ID NO: 7661 - DNA, 330 bp, A.fumigatus
cattctcctgtagttgcgctgccacttcttcaaggaggcgcagaaaagctattcgagttcaaagcttttgacttggacgctgtcgtcgggacctcggtcgtgtcctttggaaagagagactcgtcctacatctgtctcaacggtcagcgggcttcggatttcgggtacaaggaagagagcgtcttttggacatttccgttccccgtagatcaagttgcagagcagaagatcaatgtctcaaaactcaaatcggcggatctgatcagattgagccgaactgagacaggacccagtttccttttcgacgtttacaccgaaaagagcagctaa

SEQ ID NO: 7662 - DNA, 498 bp, A.fumigatus
accggttcagtcctaagctatatcagtatcattgatccccccggcgtcatcgaagctttgcgctttaggtcgttttctgcctgcgtataccgccttgacatgtttccctccccgccatcgccgcatcttgaagccatcgagaattggagaatactatattccttgattgccgcatatctctcccgctcgcagcttaaaatgcctttcgcgcagctggtaatagggcccccgggtgcggggaagtcaacatattgcaacggtatgcatcagttcttgggagctatcggccggaagtgctctatcgtaaatctggaccccgcaaatgacaagacgtcgtatccgtgtgcgctggacgttcgcgacctcgtcactctcgaggagatcatgagtgaggatcaactaggccctaatggcggtgtcttgtacgcactggaggaactggaggagcactttgaatggttggaggaggggctgaaggacctcggaggtaggccctga

SEQ ID NO: 7663 - DNA, 240 bp, A.fumigatus
atgctacagctaatcgtaatacatctcattgactcatacaacctcacactaccatcgatgtatatatccgctctccttctttccctccgcgccatgctccagatggatctccctcacatcaacgtcctcactaaaatcgataacctttcgaactacgcccccctacctttcaacctggatttctacacggaagtccaagacctttcgtcttcaccacgagaggccgcaccgcagcagcac

SEQ ID NO: 7664 - DNA, 420 bp, A.fumigatus
agcacaatatggcatcaagtaaggtcaatagaaaccgctgtacatgcttgtactgaccgcaagctagatcaattcgccgtcgcaaatccgcctgcagatgccatctccgctttgaagttctcgccggatccaaattcaacgcgaattgtcgtttcatcatgggacaagaacgtctacctttatgatctgagggacgagaatggaaacgttagtgaagggaagctgttacaaaagtttgaacatcgtgcgccggtgcttgacgcgtgttttggcgagaatgaggatgtgatctacacagcgggtttggattgggacgtccgaaagtacgttttcccatcgccgcttggtgctttctctcgactgactgtctcttgttattggcaggatcgatgtcacatcatctacacagaccgtgcttag

SEQ ID NO: 7665 - DNA, 783 bp, A.fumigatus
ctgtctcttgttattggcaggatcgatgtcacatcatctacacagaccgtgcttagcagccataacgctggggtccggtgtgtcgcctacagcaaggagcataacattgtcatatctgcgtcgtgggactcgacgctacatgtgcaccgcgtgaatactgaagccgactctatccccgcaatcattcctcttccttcaaagccgttctccatgtctctcaccgccacgaaactcgttgttgccatggcctcgcgctccctccacatttacgacctgaaagcattggcactccttacagaccagtcggacgccacatctcccaacaaggttgatatcgagccatggcagcgacgagagagcagtctcaaatttatgacccgctgtgtcgcgtgcatgcccgatgacgctggctacgcatcctcgagcattgagggacgagtcgcagtcgagtggttcgatccgtctgctgagtcacaagcacggaaatatgctttcaagtgtcatcggcagacggctgatgatgttgacgtggtatatcccgtgaacacgcttgcgttccaccccatccatggaacattcgcgtccggcggtggtgatggtgtcgttgcactttgggatggaattgcgaagaggaggatcaggcagtatcagaaatacccatcgagcattgctgctgttgatttcagcggcaatggaaagtacttggcgattgctgttagcactggttttgaagacggaagacacgattcttcactgcgggagctgccggatacaaatattggt

SEQ ID NO: 7666 - DNA, 783 bp, A.fumigatus
catgctgcgctcaggaaagctcataacaacagatattgtgcgtttccgcctcagttgcctttttctaaattggaaatactgatatcattgggccaaagacccaagcatttgcaggatgcactcgctgaatgtggctgggaagatgcagctgagtttcgccagcaagatacttccgaagcctttacattcattacagaaaagttagagctgcctctactcacgttaaagatggatatctatcacactggaaaggaggatgtgagcagcgaccacaaatttgtcaatgagagattgctggaggtcgcgattcctgagcctgtcgatgggaagacagtgacactggaggactgtctggaatcgtatttcaacaataggattgaggttaagcgccaccttgagcgacgcaatactgtcggctcaaccagatccttcgattccacgtccaaaggctttatatcacatatcgagactgttgaggtcaccccgtctcctgcggcttctccaactcagttgactccattgcgatccgacgactcagcgctattaacgcccataataacccagtcagaagtaagtggctcaaacacgcctcgaggcgcccacatgcggcggactagcatcgttcaagaacgattcgtacctgactcagaagacggagcaaacgctgacgggcgctttaccacgaagagtcactcgggaagaggttcttacaggaaggaagtgatgatgcccgcgtggcaattcttcagtctgatacgtaggtgcattcgatccctagcatga

SEQ ID NO: 7667 - DNA, 414 bp, A.fumigatus
ctgaagatactggggcgccgcatcgcacaacttggctatactggcttgaaggaagagcattttgagtatgcgctccagtccgctcagggagacatagagaaagcatttgatctgctcctcatcttggaggattcaattgagggtataatcagaccgtacactccgagtacaaagctacttggagcagtcaaccgacagggggttacctgctacctggacgcattattgttcgcgatgtttgctcgtttagattccttcgaagcaatcctttacaagtcgtttaacgacgagcctcgtcgcaagctctcaatattgctaagactctgggttaacatgctgcgctcaggaaagctcataacaacagatattgtgcgtttccgcctcagttgcctttttctaaattggaaatactga

SEQ ID NO: 7668 - DNA, 711 bp, A.fumigatus
  unsure (101),(210): Identity of nucleotide sequences at the above locations are unknown.
aatccagattgtagtaatcagttccgctcgcctaaatacgaccgtggccctctacaccctcacagacctcctccaccatcagatccctcgtctcgactctntgttcctggccccttttcacttcccagagtatcacagacatgggagtcgaccatcgctccagacattctcaccctctgctacgtccacactcctcccgggttcaagccnccaccaaaaggttctcgtcttcgtgagtgggacgacagctctccttaccacaagaaccggccgctacgtgggcctcgtggcggcgacgtcttacgactgctccgtaaacccatcactttcaacaacatcccccagctagagcgcatcaccatccacagctacgtcaagcaggctgctacggagaactcgtcctggctccatgtcgccggtatggccgttcaggctatttccaatgtccgcgttcagacattcaaatcaaagtccagcgttgctacgtggggtattgcgcctggcagagacaccgtcgcggtgaaggcagaactgcgcggtgaggatatgctccacttcttcggaaagttagtcgatgttgttctgcctagaatcaaggactgggaaggtgtcaagggcaccagcggtgatagcagcggaaacatcacgttcggccttgagcccgagaacgtggctctcttccctgaaatcgaggtcaactacgacatgtaa

SEQ ID NO: 7669 - DNA, 423 bp, A.fumigatus
  unsure (15),(341): Identity of nucleotide sequences at the above locations are unknown.
agaccctcaccattngaagagtccgaggtggaagaagctcccgagcatctgtcggatgcggaagccgctgcgttgccattgactggattgacgggatggagagcgttggtggttaaggcgggcgaaaggaactctggcaaaggcgcagctgtcttgatcacggggattggcggtggtgttgcgctgattgttctccgtttcgcggtggccaggggtgcggatgtctatgtgaccagttcgagcgaggagaagatccaaaaagccgtggcactgggagccagaggtggtgtgaattacaaggaagagggatgggaaaagaagcttttgggtatgcttcctancggcaagcagaactttgacgccgtcatcgatggtgcaggtggtgattctgtcgagaaggccaccaagttgctcaaggtatga

SEQ ID NO: 7670 - DNA, 306 bp, A.fumigatus
ccgagacaggctggtggtgtcctctccgtttatggaatgaccgtgtcccccaagatgccattcctaatgcaggctgttttgaagaacattgacgttcgtggctctaccatgggctctcgcaaggagttcaaagagatggtcgatttcgtcaagccgaacaagatccatccagtgatttctcgcgttgtgcagaccgacctgggcgatattgagggacttgaccgtttattccaggacatgaaggagggaaagcaatttggaaaactggtaatcgagttcggaaagtcttcaggaagcaagctataa

SEQ ID NO: 7671 - DNA, 636 bp, A.fumigatus
gccaagatggcccaggtcactgtgggctcggttgccgcagaggttgcagataactatgcactcgaccatgacatccaaagcgactcaggcttggaaagtcttgacaacgattcctcctgggactccgatgtacagaactatgactgggactctgactggtcggacgaggatgccactcttgctagacctacgaagaggatagctgtcaatcgtgataagcacgccgatttcattgacttgactgacaagccatcccttccagcaccagggactatgtcaactccaacaactgctgcgcctgcaacactcatggcggccgctccctgtcaatactctcatgatatagccgcgttgtcggttcagatcatggagctttttccagatatctgccgcgaatatctgaaaggacttctgtctcgctacgcggataacatgtctctcactggatcgaatgtggcctctggaatgctgttggccatgaaggagatggtggtcgaggaaatcttggccaacccatcatatcccaagcgcaagcaactgaagagaaagagaaaagataccaaagacgatgacaaagataatacatggacatctataaaccacaacggggagccttggtatcaggaagccgcgtaa

SEQ ID NO: 7672 - DNA, 681 bp, A.fumigatus
gagctcattcaaaatcagaaaaggcaagaagaggctgagagaaggaaccaagagcagcacgcccgggcggggactctagtagagtgccaatgctgctattctgatgttcctccaaacagaaccataacatgcgaaggagagaatgttcatttcttctgcttctcctgtatccgcaagtctgcagagacacagattggcctcatgaagtaccagcttcaatgctttgacactagcggttgtcaggctggctttccgcgctccgagataaaggaggtgcttggatcttcgattatggcaaaattggatgctctccaacagcaagacgagatctctcgtgccaacatcgaagggctggaaagctgccctttctgcgaattcaaggccatctgcccaccggtcgaggaagaccgggagttccgttgctgcaacccatcctgtgaggtggtcagctgccggttatgcaaggatgtcacccatgtacccagaacgtgtgaagaagcgaaaaaagacaggggcatctccgagcgccacctggtcgaagaagccatgagtgaggctctgattcgcaattgccctcgatgcaaactcaaaatcgtcaaggagttcggttgcaacaaaatgacatgcccgagttgcaggtgctgcatgtgttatctgtgtaagaaagacattacacgcgaa

SEQ ID NO: 7673 - DNA, 192 bp, A.fumigatus
acagacacggttatgtccaggatgtacaaccagactggtaatctttacaagggagcatttgattgcctcttcaagactatccgaaaggagggtatacttgcgatctacaagggctactttgcccatctggctcgtatcttgcctcataccgtgagtaactcccgcatatcgaggttatgcgtcacggcttaa

SEQ ID NO: 7674 - DNA, 564 bp, A.fumigatus
  unsure (391): Identity of nucleotide sequences at the above locations are unknown.
tacatctaccaaattctgctcaatggctgtcgtttgggcttctatgagccgctgcgcaagggtatcacgaccgctgtctacaaggatccgcaggttcaatccctcggtatcaatgtcttctcaggcgccgcgtccggcatcatcggtgcagcagctgggtcaccgttcttcctcgtgaaaactcgtttgcagtcttattctcccttccttcccgtgggcacgcagcacgaatatcgaaactcttttgatggtttgcgaaaaatctacatgtccgagggcgtgggcggtctctaccggggcgttggagcagctatggttcgcactggtttcggcagctccgtccagcttcccacctatttcttcgcaaagcgacgcttggtgaagcacctgnggatggaggatggtccgggccttcatctagcccgtaataccgtatctggcttcgtagtctgctgtgtcatgcacccttccccggtatgtataattgggcattgttcgattacgcgcccagctaattttataaacagacacggttatgtccaggatgtacaaccagactggtaa

SEQ ID NO: 7675 - DNA, 198 bp, A.fumigatus
tatgtacaaaaagcccaagccgcatcgcagcaggacgacccggaagtcaacgcctccaatgaatatacccaacgatttgagcgatcttttcggtgcaaccgctcgacaatgcaaacgaccaatgccgcactctatagaaattccaccattcccatcaccgaatccatcgaagacgccaaaggcgtcccgttgcggtaa

SEQ ID NO: 7676 - DNA, 840 bp, A.fumigatus
agaccccctcatttctctcagttcctcgacgagatgagcgtcaatggcgttcccacgcccaatctacctcaatctcaatcccaggtccctcaatcccagccacagcagcagcagcagcagcaaccaccacaacaacagcagcaacagcagcagcagaataaacctcagtctcaaccacagcccatggggcagccacccatgcaggctagcattgtcagagatcccactcctaatcacagtatcccagtccctcagaaccctcaggttggcatggtcatggttcctaatcaaccgatggatgtttctgcaatgggtcttaacaatagcgcctggaacacaggaattgacatgagctatggcaacactcctgtatttgctgtcctagaggttcccgaaggtcccgcactcgacacagagatgctctccggaaagagctctactttgttcagaacatgtctgccagaagtatcctctgcaaaggatgaaatccccatgatcgagcggccgccaaatacaaaggaggagacaaatgattctcctgtcggtgtcgagaacccagatatccagtttgacgagtccgaccctgctttcgcccttttcgccgactcccccgccaaggcctcatcgtcagactcccctgtggagtttccttgcaccatccgatctgaaaagtcgtcacctgcatttgagctggtggtcgaaaatgagtccaaggccactgcagaccgctttatcgttctttgcaacagtatggaggcagccttccaacgcgtctctgtgatgacctctcatctttcatgctttccccgcgccgcgcccgagcatttgcgatacctatag

SEQ ID NO: 7677 - DNA, 723 bp, A.fumigatus
ttgcgcagtgtcatccattccttcggtgaaagcttttcaacagccacattggcttcccttcttttttccgggaggctgttcaccaaagcctttcgcctggttccgtcgccagcaggctcttcgtgcttctctagagctgcgtcgtacctcaagtcgcgtcaccgggtctacgaaggtacatctgggcctcccaaattgtcagttagtcgtccgttcaaggctcttcgaacacgcgactatcgccgcgacatcaatccagaggcatatcttctcagagcgcccaaactcgtattcagacgagggaaaacctacgttatatacaaccctgcttcgcaccaggactccggcttcgactctacacctacttcccctgttggaaacaagccaatgaagttttactaccaggtgctgacgacgccgacggccgatacgccgggcacgaccgtcgtcctacattttccggagaagcggtatttctttgggcagatctcggaggggacccatcgggcctgtacggagcgtggcgtcaagctatcctatcttacagatattttcctgacggggcggacggaatgggctaataaccgcgggttgatcggtgtgattctcacgctggcggatgggctggcgaccgccgcaaatgcgctggagcttactgcgcgtgaaaaaaaagccaaggggcgtggtgggtcacccggtcaaacaacaggctcaccaacatga

SEQ ID NO: 7678 - DNA, 399 bp, A.fumigatus
ctcctttcatgcctggcggttctgctaacatgctacaacagtgagggatttgacaccgtcgttggcagcaagggaggcatgttgtctggtggacaaaaacagcgtgtcgccattgctcgtgccctcctgcgtgaccccaaggtccttcttctggatgaagccacatctgctcttgactccgaatctgagaaagtcgtacaagctgcgctggatgctgctgcccgcgggcggacaacgattgctgttgcccaccggctgagcaccattcaaaacgctgatataatttacgtgttcgaccaaggcaagatcgtcgaaagtggaacgcaccacgagttgattcgaaacaagggccggtattacgagctggtcaatctgcagagtctcggaaagactcattga

SEQ ID NO: 7679 - DNA, 567 bp, A.fumigatus
acactctgcttttctgagattctttttggtgcgcaatcagccggaactgtcttctcctttgccccggacatgggtaaggcaaagaatgccgctgctcaattcaagaaactcttcgacagcaagccaaccattgacatctggtcggatgagggcgagaagttggagtctatggaaggcgaaatcgaattccgggacgtccactttaggtacccaacgcggccggagcagcctgttcttcgaggactgaatttgagcgtgaagcctggacaatacattgcccttgttggacccagtggatgcggtaagagcactacgattgctctgcttgagcgattttatgacgcacttgctggaggggtcttcgttgacggaaaggacattaccaaactcaatgtcaactcataccgcagtttcctctcccttgtcagccaagaacctactctgtatcagggtaccatcaaggaaaatatcctgcttggagtcgataaggatgacgtttcggaggagactttgattaaggtctgcaaagatgccaacatctatgatttcgttatgtcactcccgtaa

SEQ ID NO: 7680 - DNA, 600 bp, A.fumigatus
cccagttcaccattaataggttgtcttctcggcgctatctttgccttgatctttggcgagatcctcggacgccgaaaaatggtcatctgcggtgcatcggtgatgatcgttggagtgattatccaagtcacatcattcccgggctcacttcctctgctccagttcatcttcggccgtgtcatcacgggagtcggcaatggaatgaatacatcgaccattccgacgtatcaagccgaatgttccaaaacgagcaatcgaggtctgctgatctgcattgagggaggcattattgctattggaaccatgatcgcctactggatcgactttggcgcacactacgggccaccggacctggtctggcggttcccgatcgccttccagattatttttggcatcgtgattatcgtgggcatgctgtatctacccgactcgccacggtacttgattgcgcagaatcgtatcgcggacggcgagaaggtcctggcagcgcttgccggtacggagataagcgatcgtcatacacagctggagaagcagttgattgtagactcggtccgagcgtacgttcccctactttgcacatcatattctcatagctga

SEQ ID NO: 7681 - DNA, 201 bp, A.fumigatus
ctatttctatgggtctgcctcgcgcagggactcaaaaatgtttacacgaattcaagtctcactgtcttcgactcgaatgattaccgattcgtcaccatggcgccgcccacttttgctggtatgtccggacggaaactgtcctggactgtgtcaaccattgcgaccatgggattcttattgttcggatacgatcgtaagtaa

SEQ ID NO: 7682 - DNA, 351 bp, A.fumigatus
actcggtccgagcgtacgttcccctactttgcacatcatattctcatagctgacgtgcgcctcagatccggtgcccaaaaagccagtttcagggacctcttcaccggaggaccgtcgcagcacttccgtcggatgattgttggctcgtcctcgcaggttttccagcaaatctctggttgtaatgcagtcatctactacctgccagtcctcttggaagactcaatcggccaatcgcacgacttcgctctgctcatcggcggcgtcaacatgatctgctacgcgatttttgccacattctcctggttcttcccgcaaagagtcttcaccaagggggcggcggaccgcgagtaa

SEQ ID NO: 7683 - DNA, 423 bp, A.fumigatus
tggggagttatggcggaggctaatcaagttactacagatatgactactctgaagtacgtcgagcctgcccccatgggcagcggcgaggagcctcgccccgtgacgaccaccaacatggattacgacaagggacaactgcgccaattgatgaagtcgcaactcatgggagtgggtatgatgggtgtcatgcacctgtactttaagtacaccaaccccctcctgatccagtcgatcatccctctgaagagcgcactggagtcgaatctcattaagatccatgtgttcgggaagccagccactggagacctacaacgtcctttcaaggccgccaacagcttcctgagccagggtcaggtcaagaccgacaaggcctccgtcgagaacgccgagaagaacttccgtggcggtgtcaaggaggagtag

SEQ ID NO: 7684 - DNA, 228 bp, A.fumigatus
ccatgccttgatctttgcagaactaatctggccatcatccttgtgatgatgcagctggcgaagaaggttccctttgacaacccggatgtcctcttcctcgtccgttgcatatacctcgcgtccaatgtgatcattcttggactctacatgtatacgcaatccaagatcaatcagaagaagggtatgcacttatccgcagttgtaatggggagttatggcggaggctaa

SEQ ID NO: 7685 - DNA, 1605 bp, A.fumigatus
  unsure (53),(109),(113): Identity of nucleotide sequences at the above locations are unknown.
ccattgatacggccccagcatcctcttctggatcggggatctgcttctccggntgcaccatgcgcagaacccagaccggcgagaagaggccggggtgcgacgtacccanaatnccgcccgagagcctcgcagcctcttaattctgatgattccgagcgtgcttcagaggacctttcgatgggtggcgagcttcccacgcattcacctctggaccaatctgggggcctggcagctactaagctatcgggtccgggacgccgaacagaactgagccagcccacaactgccgaggacttagtggatagtaatccatggctacagcaagtgatgcacaaatcgcctggctcgttccctcctggtcctggccttgacgcgaataccccccccgtcctgcaacgctttcctgaatgctgggattccactaattattcccctgatgtgagtctcgaggatggcgtcttcctgcctgggtccgactatcttgagctgcactccaccctaaggagccatctcatgcaggaagcgcgatcccgttacccttctcggcgaaattctaccgacagcgcgggtcccgctcgatcgagtctcgggcgcgaaggtttcactacggttccgattatacagcttagagattacgaagattatagcctgatgcccaacaaccaaacctccgtggatctgcccaaggatgtggaatatgatctgtggaagaactggctagaagagattgccccgtggctggacaagtttgacagtcaacgtcattttcaatatacccttccagtgatggcacaatcccacgagcacctccgctacgccatgttagctgtatctgcccgtcagcaagagcagaaaaacaaaacattgcccatcgagcgcagtttaacgctctaccataaagccatccagcttctcctcccccagcttccaacgaggaccaccgcagtgatcgcttcttgcgttgtcctgtgtgtgctggagatgctcagctgtgccccgaaagcctggagacggcatctcgacggatgcgcacacttgatgcaagctgtgggtatcaatggctttgtcggaggcgttgagcaggcactcttttggtgctttgcccggatggacgtatgcggcggtttgatttcctccatcaagacattgatcccagtcaaccattgggcttccatgattgatctcgatacggacatcagactctttcaatccacatccacctttgaaacctgcgcaaatcaagccgtctacctctgtgcacagaccttggatctcctggcgccatcccacttgctaggacgagcggcgagtgtgcggtgcgaccccagcgacatagcctacatggaacgatggttgaagctgtggcgttatgtggaagactggcacgtcaaacggccgaaagaaatgaaaccgatcgtcaaccttccctccactgatccatgtcccaccattcttttcagcaatgcagcggcgatctccggagatcagctctaccacaccgcggcaatactcctgttgcagtccaagcctaccaatgtgcgactaagaacccaagccacgctcgatcctgtggcatgcccgccaaatttgtggcatctcccatga

SEQ ID NO: 7686 - DNA, 621 bp, A.fumigatus
ctgaccctttttgcagcttaccattttccttttctctgcaggcaaaaggcacatctactgactcgtaaaaaggagtacgtgacaatgtcccagtccaccacaagagcctcatcggctccccgggcctcggcctcaggccttactcgcgtctacctcctcgcctacaatgcaatcagcttctgtctctgggccacctgcgtcatccgtggcgcaacgcttgtcttctcgctcgcgcccaacggccatctccccgccatcttccaccacgtctactccccgctgctcacaacgacccagacactcgcgggcctggagatcctgcacagtctggtgggcattgtgcgcgcccccgtcatgacaaccgccatgcaggtagccagccgcctgctcctggtctggggcgtgatgtatctcttccacgaccgcgggaacgggcacggcggcattgtcggcggcgactttcacgaggcattgccgtatggacctggcgccaaggtaggcgattatgcgttcctgggatgtctgggggcgtggggcgtcaccgagtgtattcggtatgggttctttgcgttgcaggtttggggtagtggtgtcccgagttggtggacttggttgaggtaa

SEQ ID NO: 7687 - DNA, 300 bp, A.fumigatus
tggtgtcccgagttggtggacttggttgaggtaattatccctgccttgtgtaaggtacgtatgttgcttgctgacaatgttaggtacaataccttctatgtgctatatccaattggtatcagcagcgagtgcatcatggtctggaaagcgctcaagcccgctgctgaatggaaccctctttactggtggttcttggtggtggtccttatcatctatgtccctggtacgtcggttgtctggcaacgcgcgccgccagtcgctaactttcttcaggctcatacattctctacacgcacatga

SEQ ID NO: 7688 - DNA, 411 bp, A.fumigatus
gcacgtcgtccaacccttacggctgtagtgacgctatggggacttctgactactttgaactgtgctccgcagaattatgctggactcattgtcctccgtgtcttgctaggatgttttgaaagcgcagttgctccggcgtatgttgccaaccccggcaatctcaatgtccgagttcattctgacaggtatcagactgattctgattacttcaaggtggtacaagaggaatggcaaggtgtatctctcgtggcggggacccttgctaaccttcgcaaaacagcccaagcggataggtttctggtatttaggtactggaactgccaccatcatcggagctctcgttgcacacggactcctcttctatacaggtggctgcttccggtcctggcagatcatgttcctcatctttga

SEQ ID NO: 7689 - DNA, 531 bp, A.fumigatus
gatgttttgaaagcgcagttgctccggcgtatgttgccaaccccggcaatctcaatgtccgagttcattctgacaggtatcagactgattctgattacttcaaggtggtacaagaggaatggcaaggtgtatctctcgtggcggggacccttgctaaccttcgcaaaacagcccaagcggataggtttctggtatttaggtactggaactgccaccatcatcggagctctcgttgcacacggactcctcttctatacaggtggctgcttccggtcctggcagatcatgttcctcatctttgagctgatcaccatcgctgtgggaatatgtttcatgattttcctcccagacaatcccatggcgtcccggctggcccatgaggagaaactgttcgcgattgagagtctccgggagaatcggacaggtatcgagaacaagcatttcaaaatgtaccaattcctacaaattttccagggaccccccgacctaatttcatcccccttgatcgtgggcgccatgaaactttcccac

SEQ ID NO: 7690 - DNA, 576 bp, A.fumigatus
taccgacatgtctatcagtgtggttgtaccctccatcatcgtcaatctccaattattcatttacggaaggtcattgatgtgccagccatgctgtctgcgaccgcgctgataacatgggcacccaaatgtagcgagagtcacttctacaagaagagtagcaaggatattgtgccgagcccgtgcttcacaaccaaggctacaacaattggttttttgcgcacagtacctgaaactggtgacttgagcatggataccgaagcaaagaagctcagctctgcagcttcgactgaggcagatgccgctttaggtttccttgcctcagaaggaacggcggcatttactgagattgttgaagagaagcttgttcgtaagattgactggacgatcgtaccacttatgtgggccatttattttctccagtatcaggacaagtttctgagtaacacagactcctggacggttttgattcctccagcgacttaccctaccccagtcaattatgcctccgtcatgggcttgctcaaggataccggcatgcagacggaccaattctcgaagctggccctagcattttaa

SEQ ID NO: 7691 - DNA, 315 bp, A.fumigatus
tctatagatagatgggattggcatcaatacctatcgttctcccactcatcagttcaatgctccgcctgccttctttctccccctacccatgcagggaaatcaaatgaccactaccactaccactattctagactacatacttcttctttcgctttcttcatatctcttaaaaaccatactaggcaatttatcaagtctgaaagaaggctttacgtcactgtgggctctgaagataatcggctgtttattcttgaccatcgttgccagacctatatggaacatactcttctcctcccacacaccaagagattctaa

SEQ ID NO: 7692 - DNA, 891 bp, A.fumigatus
  unsure (703): Identity of nucleotide sequences at the above locations are unknown.
atagatgggattggcatcaatacctatcgttctcccactcatcagttcaatgctccgcctgccttctttctccccctacccatgcagggaaatcaaatgaccactaccactaccactattctagactacatacttcttctttcgctttcttcatatctcttaaaaaccatactaggcaatttatcaagtctgaaagaaggctttacgtcactgtgggctctgaagataatcggctgtttattcttgaccatcgttgccagacctatatggaacatactcttctcctcccacacaccaagagattctaaatcgccccaaattagaacctttctaccattggggattgattacattacacggggaatcatctacagtgcgcaaaacaaaagcctggtgttctgggaggaactgttccgaaagtaccatcccttccagactctcgaggttcgactggggcctcagaccgtcatcgtgtcccgggatccgcaagtagtcaaggcattattaaccacccagttcggggatttcggcaaaggagaaagattccataccgagtggagagagttcttgggcgatgccattttcaccaccgacggagacaaatggcacgctagtcgggctttgatccgacctatgtttactcctgacagagtttccaacctgtcgacgtttgagagacatgttcaaaagcttctaaggattntggaatctccccgtcatgagcggcagccagtcaatgttctggatctctgccttcgactcaccatggacattgccacggacttcttgctcggacagagtgtcgacagcctgtcaaacccgactcatagattctctgcagcatttgccgacgtgcagcgaatacaaagctggattaccatggcggggtag

SEQ ID NO: 7693 - DNA, 612 bp, A.fumigatus
  unsure (6): Identity of nucleotide sequences at the above locations are unknown.
ggattntggaatctccccgtcatgagcggcagccagtcaatgttctggatctctgccttcgactcaccatggacattgccacggacttcttgctcggacagagtgtcgacagcctgtcaaacccgactcatagattctctgcagcatttgccgacgtgcagcgaatacaaagctggattaccatggcggggtaggtttcagaccggatccatatcttctccccaaaaaatatcgttgctcaccatctcaatctttagaccattgcaagtcttcctgcccaaggccaaatactatgaaggtctcaaaacgattaactccttcgttgatccattcatcacgcgaaccctagccttgggccggcgcagcttcgaggaaatggaaggctccgaggaagaatacaatttcctcgaaggcctggctacattcacgcaagatccgaaggtgattcgagaccagttgatttccgtccttctagctgctcgggataccacggcggccactcttgcccggaccctatacgagccgtccgggcacccggatgtagtccaacgcttacgcgaggaaattctaattcgaccacggggctggaagagccgcgtcggagaacccgtc

SEQ ID NO: 7694 - DNA, 450 bp, A.fumigatus
tccttccagccccgtggtgaagactcgcccatcatgatggatcttcagaagcgccctcctcaatatccgtcgctctttggcacctcacacgaccctcgtgccgctccgcagccgcctccaacctacagtgtgcctccccctcaacaggtctactacgattcgatgaagcagcacggaataccatcaagccaacctgcgaacacaatggcctacccctactctacacccatgtcttctgcgccaccgactcctgcctcatcaacaccatataacatgtcggctgcgccacgggtagacaatcagagctatcaagtgccgcagaaagactatgaaccatccaaaagacatcagctggaggatcacaataagcgtcaccgtcacagccgcaacaatagccatgatcagctaatatctcgcgaaggtaggcaatactattttgtttccttctga

SEQ ID NO: 7695 - DNA, 573 bp, A.fumigatus
gacgggtcgacttttgatgccggcgatctctttgctacgctcatctctcttttgagggaatacgagatgatgtcctggctcagctcgaacgtccgaaagtgtgccgacaagtctccgagtgtcattagtgatacgtccaactcgacgttttccctgaaagactccacacccaagggcaatggcgagcgagtcgtgactattttggaggatctcttcgccactgatattaaacctcgccaagctattggcttgccccagagctacatactgacactcggtattcgagatgtcctttcctgggtgactcgccaaggggaggtggcctacccgaacgcactggtttacattcagtgcgatctcattgcgaagaacaactttgaccttgcctgggatttcttgcgcttccaagcagccacatcatggtcaacttatgtgaagggtcgtttatatgtggcgatgtccgaattcgacactgcggctttgtacttccgtaaggctgcatacctcctctgtaagttatacttggctgtgtacttcaatcccaatcgtctaacgtattacagcatgcggtaa

SEQ ID NO: 7696 - DNA, 1173 bp, A.fumigatus
cgtattacagcatgcggtaaacctctcggcaacttgcatgagatgtcatcaacgctactggacatcgtctcggtagactgtttccacaacggactccccaaatacttccaacatatcttgtcgatattcgaacaggcacgatccttttcccacgttgcagactttgccagccttgcactacaagcgctcgcaagtgaaaatagggatgaaaaggaccctgagcgtattaacatgcgcaccgacctgctctcgcgtcttttctatgcgtccttgaagacctgccaatttgacctggcctattcagcaatgtctcgatacgaggatcatgcactgcagcgatccgccctctcctctcttatcaccgccatattgaatgcctccggacctggcctgtctggacttcagcagattctacactttcccacatcgctcctcccaaatatcgccactcatgtggatgacacacttgtctcccttgctcggaagcagacctccttcaattctctattggaagccggaacaaagtgggccgacaccacaccagattatcagcgcatcctgcaagcataccgtgttgcccgtaatgattatcgcggagctgccgaaatcgcgtatcgaaacgtccaacgtctaagacatgctagagacagcccgtcgcatcatctggttctagccaaaggcagagatgctgacgatacgcggcagacggtcgaggaggacgacccggagagcaaggaaatccgcaacgagcttctgtctctgatcaacctacttggctgcgttgacaagagcgaagcctacatcctcgttgagaaggaagattcgacgcctgtggcccgccaccacggcgttccagcggacgatgacggcaatgtcttcatggacgatgcagataccagctctcttacacccacaggatctagacgcagtatcagctccagcacaagcgctatcaaacctcatactcccagagatagcaagtcctcggtctccggtgcgggtatcaacaaccaccgccaacggcgggtcatagtgactctcgaccacatccgtcgcgaataccagtctgagctggaccgagtcagcagaatcgaaagaggagattgggaattcgggcttcttgacgcgccggaagcagataatggcctatcagccgcagagtggatacccggt

SEQ ID NO: 7697 - DNA, 252 bp, A.fumigatus
ccaattaccagggccacgcgcctatctcgttggtatggacctgttctcctccatatggatatgtatggagcagtactccgttctggactgtcgaatatggagactgtatggggctgtaactatggtacccagatggactccgaagtatgcagactgggtccaagtactgcacaggatttaaacaacagtattaatccctcccctcaagccctcaacatccaggttcttttatacttaaacattccagcctag

SEQ ID NO: 7698 - DNA, 285 bp, A.fumigatus
  unsure (1): Identity of nucleotide sequences at the above locations are unknown.
ntggggttaacccccccccccccccctcccggaggattggaacctgtgactatcggtctactatttgtccctctaattctcccatccctagtgagcagtgacacctttccgtcatctggactctggagcgccaaaggaagactcctccctcctccatttagccccattgagatctaccgtgatggagatcaaggctatcggctgctagtcgctgttgcactggccaccactataacccactctttcctcacatcgcatggcgcatcagagcttttcccgttttaa

SEQ ID NO: 7699 - DNA, 723 bp, A.fumigatus
cgcatagcgcgtgtccttgggcccctgtggagaagactggctgagaagttggtatcgctggctcctggcgaaaagctccaagctgcaggggagttgcatgctccgcccatcccgggtctcgaaaagtatcccaagttgacgctgcgagcgctcctgatggactacatcgacatcagagccattcctcggcggtcgttcttctcggccatcgcacactacaccagcaacgagatgcacaaggaaagactcctcgagtttacgaatcccgagtacttggacgaattctgggattacacctcgcggcctaggcgaagcatcttggaagtcttgcatgagtttcattcagtcaagatcccatggcagcatgtgaccacggtcttccccgtctttcgagggaggcaattcagcatcgccagcgggggcgaattgaagaggacatcaggtgggggagcaaaattcgagctattaattgccattgtgaagtatcaaacggtgatcaagcggatccgagaaggagtgtgtacaagatacctgtctgtgctgcggccaggcagtaccctcaaagtccaactgcagcgcgggggactcagctcatccgtcaaccaactggttggcccgactgtgcttatcggacctggtaccggcgtcgcgccattgcgatcaatgctctgggagaaagctgcttttgttaaagcctaccgaagaagagcatccggatgctaa

SEQ ID NO: 7700 - DNA, 612 bp, A.fumigatus
tcaagcggatccgagaaggagtgtgtacaagatacctgtctgtgctgcggccaggcagtaccctcaaagtccaactgcagcgcgggggactcagctcatccgtcaaccaactggttggcccgactgtgcttatcggacctggtaccggcgtcgcgccattgcgatcaatgctctgggagaaagctgcttttgttaaagcctaccgaagaagagcatccggatgctaatcccccgatcgggcccacgattcttctctacggtggtcgtaatcgcgccgccgattttttcttcgaggaggagtggcaagaactgagcgacttaatcggcttgcaggtcttcactgcattttcacgagatcagcgacataagatctatgtccaagatatcatacgacgcaatttcgggctgtttttcaggctgctccacgacatgaatggatcggtgtacatctgtggttcatcggggagaatgccgcaggcagtcagggaggcgctcattgaagcatttgaacatggtgggcaagctgatggaccacagctcgcccgacgcggagcggaggagtatctgataggtatggagaagagtgggcggtataaacaagagacttggtag

SEQ ID NO: 7701 - DNA, 489 bp, A.fumigatus
aaaacaagagcagcacccttggtcttcttgtcaccactaaatagcaaaaagcgtccgttagtatatgcatggaccacgtatcgccacattcgcggactcaacataccccaactcgaagtgcttgcaacgcttcagagcgagctgcttcttggtcttgcaggcagtgcactcaagacgcaggacgatcttcttggtggtcttagccttcttgtggaagacgggcttggtctgaccaccgtaaccgctctgcttgcggtcgtaacgacgcttaccctgggcgaacagggaggcctaatagatccatcatcagtgcctgtgccaactcatctaccgtggtgtgtaggttatgttcaccttgccagccttgtactgggtgaccttgtgctgggtgtgcttgcggcactccttggacttgcagtacgtccggcgagttttgggaacgttcacctagagcgcaagagctatcagcaactgtccgctacaatctaa

SEQ ID NO: 7702 - DNA, 234 bp, A.fumigatus
gcctccctgttcgcccagggtaagcgtcgttacgaccgcaagcagagcggttacggtggtcagaccaagcccgtcttccacaagaaggctaagaccaccaagaagatcgtcctgcgtcttgagtgcactgcctgcaagaccaagaagcagctcgctctgaagcgttgcaagcacttcgagttggggtatgttgagtccgcgaatgtggcgatacgtggtccatgcatatactaa

SEQ ID NO: 7703 - DNA, 276 bp, A.fumigatus
acgctgccgccggtggaagatcgcatcactatagccgttgcccatcgactttccaccattagagatgctgacataatctgcgtcttctgcgagggtagaatcgtcgagggtggaatgtatgacgagtttgttaagcagattagcatggtacaagcagatgtgcgacgctcagagcctcgacaagagcaccatgggttgggtccctactgtgggctccagtgcgtaacatctgaagatggttcaggttttaatgtgtacttatcttgtattatatga

SEQ ID NO: 7704 - DNA, 951 bp, A.fumigatus
cgcaaagctctcgaattcattgacaactctcaaatccgcgaagatcccctcggtgtgcaccacgtttaccggcagccgactcgcggcgcttggcctttcagcacccgcgaccaatcctacgccgtgtcggacaccaccgcggaggccgtcaaggtcatcgtgctcctgcagcggattgagggcttcccttctcgcatctccgatgagcggctccagcaggccatcgatctaatactgggaatggagaatgccggtggtgggttctcggcgtatgagccggtgcgggggccaaagttcctggaactgctcaacatcaccgaactgtacgagaacgtcatgacggataacctgtatccggaatgtaccagctccgtgatcatgtgtctgacgacgttcgctcgggagtatcctacctaccgaccacgggatatccaggcctgcctttcccggagtgtcgactacctgctgcggtctcagtacccgaatggcggctggttcgccagttggggagtctgtttcacgtatgcgaccatgtttgcgcttcagggactggcctgcatgggttggaacgagtccaactgcgccgcatgccagcgggcttgcagtttcttgctgcagcaccagaatccagatggcgggtggggtgaaagcttggatacagttcggttcaagcagtacctcccccatccagacgggagccaggtgactaataccgcctatgcggtgataggattgctagcggcacgatgtgggaaccatgaggccattcgtcgtggtgtggcatatcttgtgaaggagcagcaagataccggggagtggttgccggggccgctggaaggagtgtttgctcctcctggggggatgcggtatccaaattacaagtttcacttcacattaatggcgctgggaaggtatgttgcgatccatggaaatgaatgtctagctatataa

SEQ ID NO: 7705 - DNA, 597 bp, A.fumigatus
catgctcgtttggttgtagtcgctcagcagcagactaccagcttcgacaaaggtaagcaagcgttcagtacctcctcgacaggggttcacgaatgtttttccctgaagacgaagggcttgatgctaattagctcgttcgtcgtagtcgctatacctcgtaagggtccagtcatgggtgccagaccaattacctcacgcaagtcgtctggtctcgattacgacgctgagctggcccttcccatgccaaagcctcgccaccttcctgtggaagataatggcgaatccgtcgatgcctgcaagtcggaggttatgatcaaccctaccatgattaagaaacgttccgtcaccgagccagctcggcctgaagacgtcaaaattaaggcggacgacaacagtcagaaagaaaaaatgaaatccagagtggctgcgctcaggtccaagctcagtctcaaagaacttgcgaaagagttccgcagaaacagctctaaaaacgagccagcagcgggcaatgaacgcggccagatctcctacgtggatactcaggacttcaacgaagagaagctgttagtccctaagccccgagatcccggagtctaa

SEQ ID NO: 7706 - DNA, 225 bp, A.fumigatus
aaagaaactgcctactacttctgctacgttgccatggcttcgcagagtggaaacgcgtgggcgcagatgaaggctcaggagcaaaagcagcagcaggagactgccaacaccaacttcgataaaggtaagcaggcatcagcatccagtgtctcctcgccaggggttcacgaatgcttttccctgaagacggagaaccttggtgctaacatgctcgtttggttgtag

SEQ ID NO: 7707 - DNA, 192 bp, A.fumigatus
ttccccctcccgtccagattctcccttgaagaccatctcttcccccttctcctacttataattaagctcttgcctttattccgacagtatcaccttcttctatccttccattgtctcactgaatcctccgagttcatcgtcctgccttcggcttatctctgccttcacctactaccaaccacatctccataa

SEQ ID NO: 7708 - DNA, 192 bp, A.fumigatus
ctgacatctcttcaagcactatgccgcatttgcgagccaattgcattcatgtccatttttccgtatgtctaccacatggtagaggcattcaaggtgacagatgacgatcacaaaatcgctctctatgctggcctgatcacatcctcctttacttttgcggaattctcggcgggcatgttctggggtcgtctt

SEQ ID NO: 7709 - DNA, 753 bp, A.fumigatus
tctgtcccgagaactaatgagactcgtacaatagagggaaccgcgcgcgatgtgtcattattaatggactatcttccggcctatgtgtttcctcaaggcgaacgcatgatctccaaacatatggtgctgggggtatccctggggggtcatgcagcgtggagctgtctcctccatgaaccccgcgtaaaagccggcgtggtcatcatcggctgtccagactatgtgaatcttatggtagatcgtgcgcgattgtcgaagctgccatcctgggtaaacagcgaccccccgggatctcggattctaggctctgaagcatttccctcctctctcctggagactatctctaaactcgacccagcgagcatttttctgagctatgtcaactctaattcggacgctggcccccctcgaaacaatcctctgcctgagccgactgaaaatgaaaaacaagctctgcggccggtgcttaggcgctgtttggctggcaagaagattctcaacctatctgggggggcggataaactggttccctaccaccgtggagaagttttcctgacttggttgaagaaagctattgctccggatggttggtttgcagatggtgctattacattcgaagacatcattgatgagaaagctggccacgaggtcactccgaagatggtggacgaagcagttcggttcataactgagacgcttgcctccagtgatgacgccaaaaagagtgcgtatgtccgggaatccaaaatataa

SEQ ID NO: 7710 - DNA, 231 bp, A.fumigatus
cttggatacttcttctactacagtcgcggtcatgtgtcggccggttacggtcgcgttggcaagcaccgtaagcacccaggtggtcgtggtctggccggtggtcagcaccaccaccgtaccaaccttgacaagttccaccctggttacttcggtaaggttggtatgagatacttccacaagaccaaccagcagttctggaagcccaccatcaacctcgacaaggtacgttga

SEQ ID NO: 7711 - DNA, 270 bp, A.fumigatus
tttgtacttgttatggacaaagtgactgattgggacgtcttttttttacagctgtggtccctcatccctaccgagactcgcgaagcctacctgagcggccagaagaccgacaccgcccccgtcatcgacctcctctccctgggttactctaaggttctgggcaaaggccgtatccccgagatccccatcgttgtccgcgccagatacttcagccgggacgctgagcagaagatcaaggaggccggtggtgttgttgagttggttgcttaa

SEQ ID NO: 7712 - DNA, 462 bp, A.fumigatus
ttttctgcttacttgctattctcaaagaccatccttttgagtacgaggtcaataatcgactcagattccacagaaaagaaaaaaatattcaagatgcccttccattcacgctatcacgtcgatatcccaaacatccacctcgcctcactccttctcaagtcgcccacgcaccctctctcgtcaacacatcgatgcttctccgaagccgcccgcccaaacacccattacttcaccacccatgacttccgattgtggagccagcgcttcgcggctggcctgcgcaaagctgggctgcagcccggtgaccgcgtattgctcttctccgggaatgatctgttcttccctgttgagttcatggggatcatcatggctggcggaattttcacgggtgccaatccgacgtttgtggcgagagagctagctttccagttgcaggatagcggagctttgttcctcctttga

SEQ ID NO: 7713 - DNA, 1257 bp, A.fumigatus
atgagcatcttcggcaccttccagccccgtggtgaagactcggtcgtacagagctgtctcgaagccaacatcaagggagttccgcaagaagcaatattcgagaggatacagcaaactagggtagaatttgcacaggccttacttcagcggctagtggaggctggagcaaagggtgccgaagtcttcggcttgctgagagtcgtttgggatgctttgcgcactcgccgcgcaacgtatgaagaagccttggtgaacgatgacgcagaatactatcgctcagttctgaatgtactcttccttgcgctacagtgccacctcgacagcaacccccggacgacgcctgacacatcgagcaggatagctgaaattccgtccgatctgacgttagtgattgagattgtgaagaccgtcgttgcgcacggtttccggtcgttgactacgtatctgcatgaccaaccagacaagtgtgagccgaaggatttcgctctactgaccgctatcctgcagacttcgcttcaaatcaagaatgcggatcgcttatacgagcatattgtgtaccacattgaagacaacaatacggctaggcacgccatgtcactgttctcatgggcggatcaactagcggtgtccggggatcctgtgtacggagagctcagtattctgttccttgtcaagctgtcaacactgccgatgctagcggaacatttggcagtcgaagcggtcttgacgaggctttccacctgccggttgactaatatcttgcaacaaccccgaggctttggacctttcgacgccgtacccagattgtacacaatctggacggcgggattccttccattgtgcttgaatctcctgtaccacgtcctccgcaccgctcccgaagtggctgcattcctaaaccaattcgaagggcagcttaagcgggcggccgaatcctttgttgcggaccgctcaggctctccatctatacgcatctgtttgagcatggcatccgaagcatactcgcttgcgctcatttctttcatcttgaaccgcttccgagaagccggtcccagtgccggggtagatgcacagtctatccaagacctcaagtgggacaagactcaggtcaaggaagatttgggggaattactagagcgtcggcagagtcttcgcgcgcgaatggtggatacgagcgaaaaagaagtggagctggcacgacagaagccggtgaaattctgcctcgggcgcagagaaccgtctggaggagaaaattga

SEQ ID NO: 7714 - DNA, 324 bp, A.fumigatus
tcagaatgtacttgtcgtagggcctactttcttgtgaccacgtcgtccgactcgatatccggccctgtcaatgacaccgctacccacagaaagcccacagaaattgccaaaggtgcaggcaggctttcctgcagagacagatcctcaaaaagcgcaagttcgtcggcaacggcaaaggcagtgaaagacgcttttacccgatgctggtctgcctacaagtctcgcgcctggatggctgatgaggttacgccgctttctgggacaacacgtaacggatttggtggatggggagccaccctcgttgacagccttgatgccctataa

SEQ ID NO: 7715 - DNA, 309 bp, A.fumigatus
atcatgaaactccgcgaggaattcgaggaagccgtgtcggcagtcgttcatatcaactttgagacaacgtctctcagccatttttatacctttgagaccaatatccgaaacctgggcggtctgttagcggcctacgacttagatcatgacaaacacctgctaaacaaggccgtcgaggtcggcgaaatgctgtacgccacgttcgacacgcctaaccgcatgcctattacacggtggggctttcacctgattagtcttgatgaatatgtattcaccaccgaggcacatcccttgaagagggctatgtga

SEQ ID NO: 7716 - DNA, 288 bp, A.fumigatus
  unsure (19),(41),(43),(46): Identity of nucleotide sequences at the above locations are unknown.
gtgggggggttacacctancttccaggcccagtctctaccnanctnggccggctgacttccttttcaactgcacttctctttggactcctgtcgcttacgccgtcgatcctcctgccatgcccgaccgtgaggatctgttggtccgagaccccaagacgggagtcgcgcatccgaccgcccggagcaagaagattgcgttcggtggtcaggcggcctggttcgagctggagtatacagtggcaacggctgctacgattttggtcttcgtgtattcgttctttttctga

SEQ ID NO: 7717 - DNA, 261 bp, A.fumigatus
agacgtgggacagactgggacgtgatccgcaagtgcatctgctccggcttctaccaccaagcggccaaggttaagggtatcggcgagttcatcaacctcaggacaagcgtgagcatgcagctccaccccacaagcgctctgtatggcctaggttatgtgccagaatacgtggtctaccacgaattgatcttgacaagcaaggagtatatgtcgactgtgactgcagtggacccacacgtaagccgaaccatcttcatctga

SEQ ID NO: 7718 - DNA, 378 bp, A.fumigatus
tggctcgccgaacttggaggtgtgttctactccgtcaaggagaagggctattcccaacgagaacgtcgcgtcaccgaacaggaattcaatcgacggatggagatcgagacccaaatggccgccgaccgcgagcgtgccgcggccgagaagttacgagagcaggagcgcaacgatccctccagacgaaagaaggaagtagaggcgggatccgttgtacgacgtcctgctgttaccggcgcacgaagaattggtggtgtcactgcatcttcgaccacgagaaacgggaccaatggagcaagtggaggaggaaccgtggtcaagaagccacagatcaaaaggagacccggacgagccttttacgatcatgttcaagcatag

SEQ ID NO: 7719 - DNA, 267 bp, A.fumigatus
accagcatgcctcccaaacgaatacagacccccagctcctcctccctctcctccggcccagcagtcctatcctctaattcctctgtataccaaatcgcccaccatgtatggcagcagtacctcaccacaacgccgcagcgcaccatgatgcttgacgccttcatggtgtttttgttgtttgtcggcgctgtgcaattcctctattgcgtattggctggaaactacgtgagacctgttccccgttccgttggcagcattacaaattga

SEQ ID NO: 7720 - DNA, 189 bp, A.fumigatus
cccttcaatgctttcctgagcgggttctgtgccgcggttggccagttcgtgcttacggctagtttgcgcatgcagacgagtagcgagctgaagggggtaaacagtaagcccagttccaaggggaagaatgcgcgatttgcggcggtggaaggcggggagcagcagggtgcggtgtctcatgaaaggtga

SEQ ID NO: 7721 - DNA, 225 bp, A.fumigatus
ctgtcgaccaccatgcgccttctacctctcgttctcctgcccctgactgctcaggcgattaacatcgtctcatccaacgacgatggatgggcagagattaatatccgtcagttctacaaggccctgactgcagctggccactccgttgtggtgtctgcgccagcagaaaaccagagtggaaaaggtagtcctgtttcccctcatccccagcttaatcgcagctga

SEQ ID NO: 7722 - DNA, 729 bp, A.fumigatus
tcgcagctgaccaactcaggttcctctgacaaaacaccaaccacacggacaaagccatgcgagttcaacagctgtccgtccggcagccctgcaacaggatttaatgcctccgacccccggctcaactacgtcaactcgtaccccgtcacctcgatgaaatacggcatcagcaccgcggcgcctccattcttcaacgacgcccctccagccctagccgtctccggccccaacgtgggctcaaacctcggactagccgtgtacttctccggcacagtcggcgcagcacactatgccgccgaagctggaatccccgcgatcgccttctcggggagttccggctcgccgacggcgtggaatgcagccgtgccggcgtacagccgggtgtacgcgcagctggccaccaaaatcaccaaccagattgtcgcctcgggaacgccatacctgcccgaccaggtctggctgaacgtcaactttcccgaggtgagctctgagtgcgccgccgcggacgacttcaagtttgtgctgtcgcggatcttcacggggatcttttcggcggatgatgttgagacctgtgggagctcgcggctgccgactgagagcaccgtcgtggggactgacggatgctatgtcagtatctctgtgggatggagcgacaagaccgatgcggctgccgatgtgcaggcgattgtgctggacaagctgggtgatttgttggtttgtttgccttga

SEQ ID NO: 7723 - DNA, 732 bp, A.fumigatus
gcatataggggaagttcgaacttgaatcagctaccctccgggacgttctgcgctgtacattgctcagaagcggtcccagtcacaaatccctcgttacaggtcatcaccatggccggagttggtagtaacctgaaggctcaccaatatgagccttctcaaacatccgaagtcggctcagagacaaggagtgcaacaaccattgagtataggcgccatcccatctactatcccagcgagtggctactggaatccatcagttcactcatggccctaggtctcctccttggaattgctattatcttctggtatatggacaacaagcctctctctgcctggcgcggtcccatctctctgaacgcgactatttctatcctgacaactgcctgcactgccatgctgatgcacggagttagcacattcattggacagtctaaatggcttcatttcaagaacaggcctcgcaagctcgctgacttggaaacatttgacggagcaagtcgcggtgtgtgggggtctatcctactgctgaccactatcaagtggaatcttgccaccatcggcgcattcatcacaatcctgcgacttgctttctcacccttcacacaacaggtggttctgattgagcagcatgagatcatctccccttctgacaccgccgccttcggttatgcccacaattacagccggaatgtactgagtggcttggcaaacgctggcgttggtaagccttga

SEQ ID NO: 7724 - DNA, 561 bp, A.fumigatus
aattccttacagctcttcttcctcgattctggcactgcaccggttgttactgagctttcagagacttcgaaggcggggtccgactccgaggaagacacagaagcggaggagacgcatcgcgcggtgtggcatgatagcgacgatgagcgcctgacaatttcgctggccagtcatcagagattgaggaagttgcgcgtcaccgaggcggaggatgtcatcagtggcaaggagtatatcaagcgacttcgccggcaattcgagcagctgcaccctgtaccggactgggctaaaccggagttgaacaagaaacggaccgattcggactctgagcttgacagcgacatggatacggacgatgagaatgagcggctatccacgcaaccattggcgaagctgctgcaaggtgctactgatctgaccacgcttggtgaaagcacaggtgcaggaggcaagaggaaattgcgacaggaggtgatagatattcacagacttaaggatgttggcaaggatcagccagtaagtttctgcgccagcggcaatatttcatggttttggtattaa

SEQ ID NO: 7725 - DNA, 978 bp, A.fumigatus
ggatgttggcaaggatcagccagtaagtttctgcgccagcggcaatatttcatggttttggtattaatgtttctgttgcagtcttccatcgactcgctcatgttccaccctcactatccattgcttctgtcgtccggacctgcagcaacacttttcatccatcacatctcaccctctgcggaggctcccaatccccttctcacgtctcttcacatccgccgtacacctatccacacctccgcttttgctcctcctaccggtaacaagatctttgcctctggtcgtcgacgatacttccacatctgggatctcgatactggcaaggtcgagaaggtcaatggcactgcagatcgtaaggaagaacagaaatccatggagcggttcaagctttcgccctgtgggcggtacgtcggactagtcggctcctctcgcaaaggaggtggtatcatcaacgttctgcactcggagacggcgcagtggattgcccaggttcgcgtggacggccgtgggggcgtcgcggatttcgcctggtggagtgacggagaaggtatgactgtcgcgagcaagaacggtgaggtgtctgaatgggacggacgtctgaaccgggttgtggctcgctggatggacgccggggccgtgggcacaacgacactcagccttggtggacgctctggacggacacagttgggtggagaccgctgggttgccattggaagttccagcggggtggtcaatgtctacgaccgtcgcgaatgggcggccgcgtatgctgcacagcctgcctcttcggaggtgtcgccgatcccgcgtaacccggagcctgtacgtgccttggatcaactcaccacgccgatcagtcatctggtctttgcgccagacgggcagttccttgtcatggctagtcggtggaagcgggacgcattgagattgggtaagtctctagttctgtcactgcttatggtgacttttttttactga

SEQ ID NO: 7726 - DNA, 819 bp, A.fumigatus
cggtactacatcactgctctacagcaggttccttctatgtgtgaagtacggtccatcgaaaatatagaggctatggctcttctggtggtatatcaccttcgctcagcatcgagccatggcctctggtatataatcgggctcgccatgcgcacggccattgatctcggcctgcacaggaaggcaaacgagatcaatctggacccatggaccgcgcagatgcggcgacggcttttctggacaatctactacctcgagcgggtcatctcgatgtctcttggtcgaccctttagcattgcagaccgtcagattgatctgcccctgccggtggacgtggatgacgacgtccaagaccccgctatactgaccgcccctccccggacagacaggattacttccctaacgttcgcgatctatttgtttgagcttcgtcggatcgactcgagaatccagcacaagatctaccgcgcggacaggccactacatacgctccgctccaagatggaccgcctcttcatcgagctggaagagtggaagagatctgccttgcagcgttttagcggatcggacctggactacccgatgctgcactacaaccgtgctcttcgacttctcattcagccattcctgccctccctgcccctctcggatccctactaccacatctgccttcgtgcagctggtgatatctgccagacccaccagcgggctccaccagatccccgaattatggccaatcccttccctccctgttccaaaacggtcttccttggcccggtatccactccttttggttaccccctgttggaacgcccaccttga

SEQ ID NO: 7727 - DNA, 183 bp, A.fumigatus
ggagttgtacaagagaatgtggcaaaagctataagcagaggcattttaattgtgccgactctatttcaacaacttttctctccccagcgactaatgttgactgatgaattactttattatgagaaattgtatatttggcacaccttattatttactaatgacaccgcacttctgttcctctag

SEQ ID NO: 7728 - DNA, 204 bp, A.fumigatus
ctctctataaatctagcccctagttactctgaggattcacagccacttaatactcatacttataggactaacatagaaatgacaataaaggaaacacaggatttatttaggcccggcactagtcaccaaatgatgcttatactaatagttttgatagaaaacgcccaaacactgtattattttttatggatggatgatgggtag

SEQ ID NO: 7729 - DNA, 198 bp, A.fumigatus
gctggcgtgccaagctcatgcaggttttgccccaccaatttttttttttttttttttttttttttttttttttttgcccgtatctgtcataaagcttcccgtgtgtccccctatcgaattacaaaacactcctttagtatttacttctctggaaatctggttctcaactggaaaataaaatattcagtctctccgtga

SEQ ID NO: 7730 - DNA, 240 bp, A.fumigatus
catataaaaacttcattatgggtatcaggaaatcaagcatatccagcacaatgcagatctctgtatgtccttactcaagcaaggcttgcttcccactcgcaatctaaagccttactgactgacgtttcttcttctatagcgctcgctgtggcgtataaggactctgatattcgcaatgttgccgctattgtgttgggaaccccggggactccttatcagttcggtctctttgaggtttga

SEQ ID NO: 7731 - DNA, 186 bp, A.fumigatus
ttcagcatcggttttggcaaaggtaggaccgctgatcgcttgattacaatctgcggtgagtgtcaaatggctgatattgtttcagactatcctgctactccacctattgtccaaattacgacgaccaacgcaggacgatgccgtttcggtcctaatctctatgctggggggaaggtttgcttgtga

SEQ ID NO: 7732 - DNA, 183 bp, A.fumigatus
aacaatatcagccatttgacactcaccgcagattgtaatcaagcgatcagcggtcctacctttgccaaaaccgatgctgaactagctggcagtcagcccatgggcctcatcctcagtgtgaatgaattcaaacctcaaagagaccgaactgataaggagtccccggggttcccaacacaatag

SEQ ID NO: 7733 - DNA, 195 bp, A.fumigatus
tggcccctggacaagcgtcctccatactacgccagccaaggcgatcgcttctctgacattctgcacatgttgctgaagatgcgcagcttgccccccaaggcggcaccaggaccggatggcattttgaaggctatggacggtagtgacgagaatgcagctcgctggttcgacatgatcaagatcactcgtaagtga

SEQ ID NO: 7734 - DNA, 927 bp, A.fumigatus
acccccgatcccacctccaatgctcgccagtcgcagctgtctatgatcgccgcatcggctagtgagatggttcctcagggcatcccgatggatcatgatccgaacgctctcatgccagatggcctgcccaagcttggctcatccccgtggaatcagcagctttcgagtcatgaacagcttctcttcgacagccttcaggaacatgaccctactctcaccgccgcgactcaacgtgcggcctccttccctcgtcctatcgccatgaatccaaactctcagaccaagggttttgtcaacgaatttgggaacgcgaccaagccgactaagcccaaggtgcgcggtcgcttctccgccgcgagacgcagggaggtgcaagaagtgcgcaaacgaggagcttgtatccgctgtcgcatgctcaagaaaccatgctccggtgacagcccttgcacgacctgcgccagtgtcgagagcgcacgtctttggaagcatccatgcattcgcactcgtattgcagaggaattcgaactttacaacgcaaacttgcatgctaccctcgcatatcatgatgtcagcagtatcaagaatcaggtcaaattcgagcactatgctggccgcatcgaggtaacccacttcgaggagagtatggtctacatcactttcagtggactccatggtcacaaaccatcaatgtcgacgcttgaccctcagcttcaaggacttggagacgatccccagttccagggacctctgcacgaactttacctgctcgacagcgatgccgatgaccttcctggaaagattgaaatgtacatcaagaagacagcgccctttttctacgcgcgggaaacttctgagattatcaagcatactttgctgctcgcgtcggagttgagtcagcagaagaaggtaagcatcagttcagtatga

SEQ ID NO: 7735 - DNA, 252 bp, A.fumigatus
cgaacagacggccgcgttgccccccggagtggtcttgcctcgaagcacttcattgataccggggcgggcgtcattgacgctgattaccggggtgaagtgaaggttctgttgtttaatttctcggatgtcgattttacagttaaggtgggggatcggattgcgcagcttgtgcttgaacgggtgaggctttttttgtgtgtcattctgggtgtgttgatgctgacggtatctagatctatacgcccgacgtga

SEQ ID NO: 7736 - DNA, 894 bp, A.fumigatus
cgccaactgccaaacaatacaagggtaggtagtcgatttagagatccctgctccccagcgtcaagtcggataggtgtagaaaaaccggaggagcctggagacagaaatagccccggtaatgaaaaagcaggacatgctccaggtcagctccagagctgcggaccgaggcaaaacagtccaattggcagcaaccccatctctctggcccgagcttggacttgcggggcgtcggagctcggtcttttgaagttgtgcctgaggctgagatctagcgcaaagttagcaaacatgccaagtcaattaaacagcgcggtgcgcgtacaccgccagacgcgtctaaccaacacatgcatcttcctactaggtcaattagcaacacttctggataagtacaccgcgatttccctctcttccatacatctcacaatctcaacccaagttatgacaaaggagaccacaccgccgcctcaacagtccaaagctcctacccacgaacctccctctctccccgcctctcccctcgccaaacgaacaaaacccgactcaaataacacagccaacagcaacaagatgaccaccggcacagcacccgccgtcacctccatctctcagcccctccctcccctgctcgtcaagaagctcaccgagtccgcccaagcacctacccgcgggtccgccttcgctgcaagctacgacctctacagcgcaaaggagaccgtcatcccggccaagggtaaagccctggttgacactgggcttgcgattgctgtgccggaagggacatgtatgcccccttcttccccgtactttttgtggagcgtgtatgctaaccagttaacgaacagacggccgcgttgccccccggagtggtcttgcctcgaagcacttcattga

SEQ ID NO: 7737 - DNA, 315 bp, A.fumigatus
cttcaacagtttggcttcgggcagtccaatcccacgtacctaattaccggctccgacaaacaacaatatgtcctacgaaagaaacctccgggcaagctcctgtccaaaacggcgcaccaagtcgaacgagaatacaagatcatccacgcattagagaagaccgacgtccctgttcccaaagcatactgtctatgcgaggatagcaacgtgatcggcaccccgttctacatcatggagttcctggacggccggatattcacagatcctgccatccccggcgtaagcgcggaagagcgaaccgcactgtacgtctaa

SEQ ID NO: 7738 - DNA, 738 bp, A.fumigatus
ccctctgctttaggacagacagatactaagtgccgcagatggcgcgatgcagttcgcacattagccaagttccatcgggttgtccccaagtctgtcggcctggagcgatttggcaagccgtccggctactacgaccgccagatcgcgacctttaccgccgtgtccaatgcgcaggcgcaggccgtcgacgtcgagaccaagaagcccgttggcgaactgccccacttcatggacatggtgcgcttcttctccaataaggctacccagccactcgacagaggcaccctcgtgcacggcgactacaagattgacaacatgatcttccacaagacagagccgcgcgtcatcggcattctggactgggagatggcgacggtcggccacccgctatccgacttttgtaacctcactagtccttacttccttgacgggacggaccacaagacagagcagttccagcctggggtggtgccaggcttgccgagacgcgaggactgcttgcggtggtaccgcgaggtcgccgggtgggaccccacgccggatttctcttggggggatgcgttcttctcgtggaggagctcggtgatcatgcagggaatcgcggcgcggtatgctctgcgccaagccagcagtgcgcgtgcgcaagaatacgcgcagaagaccggaccgtttgccttagaggcgtgggaacgggtcaagaaggtgcaggagcaggtgcgccagaaggggaagctgtag

SEQ ID NO: 7739 - DNA, 192 bp, A.fumigatus
atctttcggcggcgatccagtatctatctatctataattccactttcaggctcctacccgtacgtattcttcgacacagcttatcaggcatctgcgaatgcgtactggtgcactacacaatgtgttttgggtcatctcgagaatctgacttgttattactttaagtgcaggccacttttttccgatttctga

SEQ ID NO: 7740 - DNA, 1935 bp, A.fumigatus
gagaagctacggtgtgtttgcgtgtcctgtaaccttaagagaagaaatctgcttattatttcttgtcatccgttgtctatagggactataagctcttctgatttggcggacttcgacacattgccgaatgacggccaggccgacaactccagtcgcataccttcctcccaatcaccatctgtggcagcgttaccgtcagataggccgagaaagccatctgtaacacgtcggatatcttcaaggcgacaggtcccgcataaaggccaggagttctctacagacgatgatgtccaggaggtcgaggaggatatagccatgcaacaacagggctcaaacccccagccttcgccgagactgcgcccattgaggaaacagagctcgacactgaggcgcaggttgaacgctcgacccagtccgttggcacgagcggactctgacaatgacagtggggaggaatcgttattaccagagtcctgcatggaggctataggaacgcgaccgccgtcgcagcagtcagaggccagctcccatcatgggatcaatcacggtgatggcgacaacgatgagacgagcgatgcggagagcttcaccctgaaagatcgtcaacaggccatcaacgaaacgcacccatttggcatcagactatggaagccggctctctacaagaagagccgttccgtggagaagatgctgagggagatattcattcgtctcctggcggcagagtgggaaatatactcttcttggccaatttgctctggactgctttctttgggtggtggctcgctcttgctgctctcttcggtgccatcgcatgtttcatatttgcatattctcctagcgcagtggagtacggaaaagtcttctggggactttcatggtacctcctctatccattcgggtcttttgttcgtctggagaccgacgaacactatgcggaggaagatgagggtgaaggccgcagcattagcgagtatgagcaatggcagaacggtgatctcgagcacggcaggcttttctttggcccccgtagcagccggtctctcgtgggtaggcgtcgcaatagccattgactctgtgagcgaacaggacagtctgcttggcagaacgcaaagaatctcacctcgtgaaagcaacctgcattcgaaacgccgcttgttcggccgcggagaatggacattaggacgtgtcgtattcttcgtcttcttttattttctaattggccctttgatgctgtttgtgtccatggtatgctggttgcttgtattctggatccccatgggacgtgtgaccctcattctattcgatcatcttcgtcgtcacccgctggccttatccttccattctgatacatcttacactcgactgagtcccggctccccctcatcgatactcttatgcacttaccgtgcggctggactgagctactggaaatatacggtggatggtaccaatatttttctcatcaatctccttggtgttgtgctgtttgtcatcatcgactacttcctcttggctgaaacgctgggtctgcataactggatgacacatcctggcttcgtttttactctcgcactggtctccattattcctctggcctatttcatcgggcaggccgttgcgtccatctctgcacaatcatcaatgggcctgggtgccgccgtcaacgctttcttctcgactgtcgttgaagtttatctttactgtgtcgcgctgacagaaggcaaagggcagctcgtcgagggcagtatcattggaagtatttttgcgggtatactgtttctccctgggctgtccatgtgcttcggcgctatcagacgcaaaacgcagcgattcaacgtcaaatctgccggagttacatcgaccatgttgatgttcgccgtgatcgctgcattcggtccagttttcaccacgggggccgaaggatccgcgcta

SEQ ID NO: 7741 - DNA, 507 bp, A.fumigatus
gacgagcgatgcggagagcttcaccctgaaagatcgtcaacaggccatcaacgaaacgcacccatttggcatcagactatggaagccggctctctacaagaagagccgttccgtggagaagatgctgagggagatattcattcgtctcctggcggcagagtgggaaatatactcttcttggccaatttgctctggactgctttctttgggtggtggctcgctcttgctgctctcttcggtgccatcgcatgtttcatatttgcatattctcctagcgcagtggagtacggaaaagtcttctggggactttcatggtacctcctctatccattcgggtcttttgttcgtctggagaccgacgaacactatgcggaggaagatgagggtgaaggccgcagcattagcgagtatgagcaatggcagaacggtgatctcgagcacggcaggcttttctttggcccccgtagcagccggtctctcgtgggtaggcgtcgcaatagccattga

SEQ ID NO: 7742 - DNA, 753 bp, A.fumigatus
cttgtgagaattcccaaccagtttctggttcccctcaaccttccggtggtcaccagttacaggcgaattgatgcgccgcagcttgagcgtttggcggcaggtgatcacgtccggtttgaactaggtggataccctgacaacatgttctttgtggagcttccaacctttgacgccttcgttgaatcggcgcagcagggtgttgtcaccttccgttgtatttcgtatccgcctgctttctgtgcttcggcacgatggcggatgagacattgcggttcttttgtcacctgccaagcaatgttagatgcgttagtggcgctagtcgagaaaaagcaaaacggttgtgtgttatatcctctactggtggagaataaatcccccccagaatatttaccgctcggtccggcgtatgatttccgggaagatctcaacgaatgtcaaaatcgggccgtggcggctgcccttacctcccgcctgagttgtatctggggccctcccggcactggcaagacacagacagtggtagccattttgcaggagctgttgcagaggaggccggaagaacgcattcttgtcactgcacctacccacaacgccgtggataatatcttgaagcgatacctgtgtgttgcaggttcaacaggcgctatacctctccgggtttccacaaacgtaagcgtttcctcaattcttgggaattcatttgaatactcgcactcaaacgcttcagccagtgctaattcctttgttaactag

SEQ ID NO: 7743 - DNA, 828 bp, A.fumigatus
atccgtaaagtatcatcagatttgatgcaatatgcttgtgacgcaatggaccgaagggagttcaatttcgatcctgcagcaagacgtcgggcgcttgagcgcatccaacagtctcgcctgatattcaccacctgtgccggggctggactgggactgttacggaatgagcaatttcacacagtggtgatcgatgaatcgtctcagcagacagagcccatgtcgcttattccgttggtcaaaggaagccggcaagccatccttgttggagaccatgtccaacttcgagcaacagtccgaaaccacgccaaagcaatgggtctggaggtctctctatttgagcgcctttatatgggtggtgatactgccaacgatgcgctgagtaaagtgatgctagacatacagtatcgaatgcacccacagatctgtgaatttccatcggccgagttctataatgggagactccaagcagccgcttcatgtcagaacaaccccttacctccttccaattttccgtggcctagtctgccatcagcaggcggtggccaagtgcgctgcgtttttgttccgtgtcttctggaggaggatattggacatcggtctaaagcaaatgctggtcaggcgcagctatgccaacgcatttaccagttactgacggactcccgttcgagtactggtgctgcgactatgccaattgcgatactgacaccgtacacaaggcaagtcaagaatccttcaagcctcctctttccaaccagttgctttaaatttccaccgttccaacgggtttccaaggggcaggaaaacaaaatgtttatcactttatgttaa

SEQ ID NO: 7744 - DNA, 1200 bp, A.fumigatus
  unsure (1143): Identity of nucleotide sequences at the above locations are unknown.
gaaaggaacattttactgggccttgctcttggcgaatacctgagcaccgtccaccagacgtctttcagtgttctgacgaccgttgacgaagtcggggtagttgagagtgagctcaacagcaccgttgacaatgttgtcaacggcttcgacacccagcatgaaggagtggtcctggttgccaacctcgtagcgccagctaccgaagcggccacgagaccaaatgtccttgtcttgcaacttgggcaggatctgagtgagagcaccctcacgctccagtgtgggggtggggtagccatggtcgaagcggcggtggtaggtggagacaatctcatcggtgggcttcaacatctcggtattgaccagaccctggatgcagtcggccaggatagtctcctggttgacaggcttcatagaggattcggagacctccaacatgatagaccaataagggccctccttggcctcagtgctctgaggcctggagccatcggcaagctgcatggtgggaagcttcttcgaggcctcaggctggttgtaaggggagtagttggagaagatggtggcacggtagaaagggcagttgtcctcggggaagtagagctgaatagcccatacgttagcacaaaaaacggagactgcagaacggaaactgggcctgtagtattgacttacccagcacttgtcaccgattctctcggggcgggagccacgaacaccaacaccgatgacgtgggtggaagagtagaacagctgcttggtgagaccaacgagctcctggtcgttcatggcctcggccaagaaatcaacagccatggtggagacaagcttcttgtagccgatggtggtgccgtcctgcagcgtcaccgtcttgttgttggcattgaccttggtaaccttacccttctcaccgaagcgggtcttctccttagggagagtgttggccacggcaatccagataccaccagtaccgccacgggcggggaagcggaatgtagcgttcggaccccagttaccagcggtcttgccgaggataacgttggtcgtcacggccttgagattgggagcagcaacacgctcaccgagccaggcgcattgcatctgatttacatcagcctgtttgttcctcaagtgaaccggggccanactcctcccggaaattggggcccccccccccccgattttcaaacgtaccttggatag

SEQ ID NO: 7745 - DNA, 1221 bp, A.fumigatus
  unsure (91): Identity of nucleotide sequences at the above locations are unknown.
ggccctacaacttcaaggtctgggctgtgcccactatccaaggtacgtttgaaaatcgggggggggggggccccaatttccgggaggagtntggccccggttcacttgaggaacaaacaggctgatgtaaatcagatgcaatgcgcctggctcggtgagcgtgttgctgctcccaatctcaaggccgtgacgaccaacgttatcctcggcaagaccgctggtaactggggtccgaacgctacattccgcttccccgcccgtggcggtactggtggtatctggattgccgtggccaacactctccctaaggagaagacccgcttcggtgagaagggtaaggttaccaaggtcaatgccaacaacaagacggtgacgctgcaggacggcaccaccatcggctacaagaagcttgtctccaccatggctgttgatttcttggccgaggccatgaacgaccaggagctcgttggtctcaccaagcagctgttctactcttccacccacgtcatcggtgttggtgttcgtggctcccgccccgagagaatcggtgacaagtgctgggtaagtcaatactacaggcccagtttccgttctgcagtctccgttttttgtgctaacgtatgggctattcagctctacttccccgaggacaactgccctttctaccgtgccaccatcttctccaactactccccttacaaccagcctgaggcctcgaagaagcttcccaccatgcagcttgccgatggctccaggcctcagagcactgaggccaaggagggcccttattggtctatcatgttggaggtctccgaatcctctatgaagcctgtcaaccaggagactatcctggccgactgcatccagggtctggtcaataccgagatgttgaagcccaccgatgagattgtctccacctaccaccgccgcttcgaccatggctaccccacccccacactggagcgtgagggtgctctcactcagatcctgcccaagttgcaagacaaggacatttggtctcgtggccgcttcggtagctggcgctacgaggttggcaaccaggaccactccttcatgctgggtgtcgaagccgttgacaacattgtcaacggtgctgttgagctcactctcaactaccccgacttcgtcaacggtcgtcagaacactgaaagacgtctggtggacggtgctcaggtattcgccaagagcaaggcccagtaa

SEQ ID NO: 7746 - DNA, 267 bp, A.fumigatus
ttacctaactactgcttttccgtgacacggatatggcagccgtttgggcgcttctgggtaatttcgtggtgtcccgagcggagacgaaccaaaatccaccggattgccatattgggtcaaccgggtcaatttaggacccaactagacctatttgcgtttagtggccgtgtcagggaactgcacaagccgaaggctaaggcaggcaagaccctgttcgcagtaaattattacttaccgtacccattacgacaggcaaatcatgagtga

SEQ ID NO: 7747 - DNA, 1152 bp, A.fumigatus
  unsure (547): Identity of nucleotide sequences at the above locations are unknown.
ccgagtgaccagattaccacgcgtactgcccaactactgcagcacaatccaggcgaacctaccgcaggtgcattaaacttactattcatcatggcggcacctaatatgccgattcgtctttcggtccacactggcacccaagacggcaagcacccccagcttccaaaagggtcacagccaacccctccaattaccccaactatcagtcatggccgcagctcgcccggagtcgacacaccaagtcgttcaatatctcctgtgcccttttcaggaggacagctgcatgacgccgtaccatctgaccatcagaatgtaactgcgccacacaagttctctgacgaattggagttccactatgactccaagggccgcaagttggagtttggccgtggcgtttggagcgtcgtgtacatggcttcctcccgcgcaccttccatcccagctgcactgagccctccaagctcgcccgcatcaggaagccgcgtggtggccgttaaaatgcctgggcgacgcgatgcgcccccagtgcttgacgccgaggccctancgctgacccgtctgagcatggttgctggttgcgcggaccatatcgtgccattccacggctacattgccgattctcatgccatcgtcatgggcgctgtgccgcttgccctctcagcctatattgaagaaaaggctagtgcagccaagaagcacatgtccaccagtacgatgtttgaccccgttcaaggcatggccgaatggcacggtctcgcgaataaacttgtcgcgggactcgattggcttcataacggcgctcgaatggtccatggtgatatcaaacctaacaattttctattgcgcccccgccctattgccaacgacctggattccgacgaattcccctttgaagccgctcttcgcagacttttcctctgcgcaccccatcggcgactgcacctcccgcaaacgatggcaacggccctgaaagccctgatgccaccattcaccgcccccgaaactcttgtccatctcggcgctcaagttccctggaacttcgtccccaattccaaccgtcagaagtcctcctctcctcccaatggaatcctccttcccaacttgcgaatgggaagatttccttactcttacccggggccaccagccaaattg

SEQ ID NO: 7748 - DNA, 1041 bp, A.fumigatus
  unsure (14),(23),(24): Identity of nucleotide sequences at the above locations are unknown.
gggccggtcgatanagatcaaannatggccgcccgtgtcctaaagggcttacaggggcgcacggatgagtggggctaccgcatccccttcgccatccagtgggtgtggcccgtccccatcttcatcggcgtcttcttcgcccccgagagcccctggtggctcatccgccgagaccgccgggacgacgccgtcaaagcgctcaaccggctggccagaaccggacatccggacttcaacgccgacgagaccgcgtcgatgatcgtctacaccaacacgctggaaaaacaggtcgagacaggcacatcctacgtggactgcttccgcggatgcgacctgcgccgcaccgagatctcctgtctcgtctgggccgcccagagtctctgcggcggcgggctcatgggctactcgaccttcttctatcggcgtgctggcctcgccgtctcccagtccttcaccatgtcgctcgtccagtacgccatcggcgtggtgggaacctttctctcctgggttatgatgacctacttcggtcgtcgcacgctatatgtcggtggactggcactgctggccatcgttctcttcgtcatcggctttatctccatccctcactccaccccggccctctcctgggccaccgggtccatgctcctcgtctacaccttcatctacgattcaaccatcggcccggtttgcttctctctcgtctccgaaatcccctcatcccgactccgcaccaagactgtggtgctagcccgtaacctgtacaacgtgatcaatctggtttcgggaatcatcatcccgtacatgctcaacgtggacgcatggaactggagaggcaagtcggggttcttctggggctcgttctgcacctgctgtttgatctgggcgttcttccgcatcccggagcccaagggtcggtcctatgccgagctggatattctgtttgagcgtagagtccgcacgcgggagtttgcaactgccgagacgggcttggtggaggggagaagcgattacaaggttgatccacttgctgttagggtttga

SEQ ID NO: 7749 - DNA, 687 bp, A.fumigatus
gtggggctaccgcatccccttcgccatccagtgggtgtggcccgtccccatcttcatcggcgtcttcttcgcccccgagagcccctggtggctcatccgccgagaccgccgggacgacgccgtcaaagcgctcaaccggctggccagaaccggacatccggacttcaacgccgacgagaccgcgtcgatgatcgtctacaccaacacgctggaaaaacaggtcgagacaggcacatcctacgtggactgcttccgcggatgcgacctgcgccgcaccgagatctcctgtctcgtctgggccgcccagagtctctgcggcggcgggctcatgggctactcgaccttcttctatcggcgtgctggcctcgccgtctcccagtccttcaccatgtcgctcgtccagtacgccatcggcgtggtgggaacctttctctcctgggttatgatgacctacttcggtcgtcgcacgctatatgtcggtggactggcactgctggccatcgttctcttcgtcatcggctttatctccatccctcactccaccccggccctctcctgggccaccgggtccatgctcctcgtctacaccttcatctacgattcaaccatcggcccggtttgcttctctctcgtctccgaaatcccctcatcccgactccgcaccaagactgtggtgctagcccgtaa

SEQ ID NO: 7750 - DNA, 372 bp, A.fumigatus
aggtcccagcgattgtttgtcttggagtcgcgccattgtagaacagtcgcaatgagccacctcgataaccccggaactcttttgaaggagatcctggtaaggatcccactcattttgaagacggcccttctgcatgcactccatatgtcccctggctctgggaaacaagatcttcgcaccgagttgaccgtcgccattatccgctcgtttatcaacttcaagctccccgttagcaagcagcagaagggcagtatgcgcgacccaggcatcaagggtcccatgtgggtgtccaaggtcacgtttcctcggcctgagaacgatgtccaggatgcggtcatcaaagcgtcttcaccacgcggtggagatcaacga

SEQ ID NO: 7751 - DNA, 315 bp, A.fumigatus
attgattgccttccgacaactattgttccttctacctgtcttacctgggtgtcgtcgatcatcgtcgcgccgtccacggccctcgagttctccgtacctcagtcgcatatctctactctttctttcttccactcatctttcgctcttatgggcgcgctcatctcctatacttatgctccttctttcttcgctttattcttgtcgttcttctgtcaatatgtcttccatattcttcgccatgctacgggcgactacctcatcttctcttcaccccgacccgtccctatcatcctctacagcgtacaagctgtctga

SEQ ID NO: 7752 - DNA, 450 bp, A.fumigatus
  unsure (8),(37),(48),(59),(62),(72),(83),(92),(93),(94),(116),(126),(127),(138),(146),(147),(150),(151),(153),(154),(155),(156),(157),(158),(159),(160),(161),(163),(164),(165),(166),(167),(168),(169),: Identity of nucleotide sequences at the above locations are unknown.
gggggggnggggggggggggggggggggggggggggnggggggggggnggggggggggnggngggccggggnggggggggggnggggggggnnngggggggggggggggggggggngggggggggnngtggggggggnggggcggnnggnngnnnnnnnnngnnnnnnngnnnnnnnnnnnnnnnnnnnnnnngnnnnnnnnnnnnnnnnnngnnnnnnnnnnnnnnnnnnnnnnnnnnnccccaccccccatatctcgctctcacttacccttccgccgttccagtctcacactccactatcacccatatgcgcagtaagcgaccgccgcaagaactgagtccggagcatatatttttagcgcaccgtttgattggcctgaatgttctggtgaaggtggaatccacggatttctggttgcagctcaatcagtcaggcaagcaaccataa

SEQ ID NO: 7753 - DNA, 198 bp, A.fumigatus
ccctcagtcgttgatgatgttcaagtggcccccggtaagaatgcatgtcaacatgcagaaaggtcatggacggacggtggtaaccccccactgcggctggcaatcggagccttgttctcctataaatgctctgacccgcagtcattgtacggtgtcaagctgtacattagacccggtctccacctatccagaggataa

SEQ ID NO: 7754 - DNA, 219 bp, A.fumigatus
atatggggtgctgactctaaattcgcggcttcccccgccaatggaggaatggggaatcagaagatttcacccattccttctcagtcgtggccggattctcctgaacatcatcaagtatccgttccggttttcgcgacagctctagttacccagaaccgtcaaaatgtcgaaattacagcaattccctctatccaagggatggagcttcagagacaatga

SEQ ID NO: 7755 - DNA, 1029 bp, A.fumigatus
  unsure (940): Identity of nucleotide sequences at the above locations are unknown.
caagtatggcaaacttttaagtctgcactaactggccgagctaactattgtttttttccctgggggtacaggctgaaggatccctatatcgggttcaacgagctcgaggcgagatgggtcaacgagaaatcgtggacctacaaaactgttttccagaaaccagctgctcccgctggatcttgcattgtcctagcattcgacggcctggacacattcgctaaggtcaaacttgacggcaacgtcatcctcgagaacgataacatgttccttgctcgtcgcgtcgacgtcaccaaggcgctggaagccgagggtgaccacgttttagaaatcgacttcgactgtgcctttctgcgtgcaaaagagcttcgcaagcaggaccccaggcacaattgggcctccttcaatggtgacccttccagacttagtgtacgaaaagctcaataccattggggctgggactggggcccggttctcatgaccgctggcatctggagagaagtgcgacttgaggtttactctgcaagagtcgcggatctttggaccgaagtgcaattggcttcggaccatcagagtgctcaggttactgcttttgttgaagtagagtctgtgcactctggttcgcacagggcttgtttcactctcagcttgcatggccaagaaatcaccagagaggagattggtgtgactgagaatggcaccgctaaggctacctttgatgtcaaggagccctcactctggtggccccatggctacggtgacgccaccctctacgaagtatctgtgtccctggttaaggagcaggaggagcttcacagagtttccaagaaattcggtatcagaaccgccgaggtcattcagcggcctgataagcacggaaagtcctttttcttccgtgtcaatggcgtcgatatcttctgtggtggttcctgttggatcccanccgataacctccttcccagcatcaccgctgagcgatacccgcaatggattgagctcatggttcatggccgtcaagtgatgatcaagtaa

SEQ ID NO: 7756 - DNA, 660 bp, A.fumigatus
  unsure (369): Identity of nucleotide sequences at the above locations are unknown.
tacccttgccttaccaggtctcgaactcgcatgaacggagcaacacagactttccgccgtccgtcagtcgcaacgaacccttctcaaacgcgagacctccctcaaactacatctgctacgcatccgacggtcggtgcttatactcccccacacatgaactcaaatcaatccggcgcaatccgcaacggggccggcgagaatcgttattccaaagaacaactgttgagtctctacaaagctcaacgtgagtcgggtactctaggtaaaaacgttgcggattactttatcgccgactgggaacctcacgtggagactcctcccaccaacggagcatggggaaagcgagaggattccaaggataatcctcgnggacctgagatttgttgggatcacggcgggcaggtggagcctctgggcttagtggatatgactggtgatgagaaagaggttggttttgtctttgtgtgcccccttggttctgaacacctgaagatcgcccttttgattcatgttggaacttgccgtgctgaatcgtgtagttattttccgcctcggtcaactctccgctcaagcctcccccgaccagcgccaccaaggaaaataccggtgctgccactggaggacgcaagtcatccatttcgtatccccagagccacatga

SEQ ID NO: 7757 - DNA, 441 bp, A.fumigatus
ttattttccgcctcggtcaactctccgctcaagcctcccccgaccagcgccaccaaggaaaataccggtgctgccactggaggacgcaagtcatccatttcgtatccccagagccacatgaacaactacaacacgtcttcccccagttccgcgcgccccggccctaggcgtcgggagaccggcgaatctgtgagtaacgccatgtctcctaccaccagtggctcccgtttcttccgcgacgaaccgaccacctttaccccgcctccgtctctattgcgccgcaaaaccgattttcgcgagactacgtctatttccaagtgggatcagaaggataaggaagctcctgcccgtgacggtggctctggagaagtagcctctccgtttggttctgtgcaacggagcgccactttaatgatcacgccggggagtcgaaggaatcgt

SEQ ID NO: 7758 - DNA, 198 bp, A.fumigatus
gcgcagatggagctggtcaaattaattcttataagctcctggtctctgacacaagttgcaaataatgaggttacaggctccagcttcacagactcgacccttatgatcaaaatgagcattgtagacctccagaatgtcctgatagaaacttgcaagaccgatacaggatacaagcgttatctgttgtcgacattttaa

SEQ ID NO: 7759 - DNA, 348 bp, A.fumigatus
ccaccaatgagactgtttactgactttgtcactaaggtcattgggccggtcaataccatgctaagcaagatttaccctgacacgtacaaaaactctcctgccagtaggaatgtctcttccatcgtctttgcaggaaccgtgcttggtcaacttattttcggctatgtcagtgatcattggtcgaggaaatgggctttgatggtctccacggtgattttgatcattttcagcgcgctctctgccggctcctacggagctcatggtagccaagctggtttgttcgccgctctgaccgcgtatcggttcttgtattgcagacccgggcctggaaggtaccgcgatggcgtg

SEQ ID NO: 7760 - DNA, 327 bp, A.fumigatus
acgcataaccttcttgccgcggcgtgtagacacacagtgctgattgtcagcctgccaaccgggagtggcctacataaatccttacctttcagagactcagactggtggtgttggcactctggtaagctccctatttcctccagcctaccacatgttgatgtatgggctgctgacctacttcaagtagaatccctacttatttacccggctccttcgggagaaatacctagcagctgtggactcaagactatcaattacataggcaacacccaggaccaacgccaggcactgaagaacctatggtggcgtcagtactggccagcatga

SEQ ID NO: 7761 - DNA, 198 bp, A.fumigatus
ctgaccctattgattggttgtttcgtatttattcaccatcgttgtccatcaagcccctcgtctggattttccctccagtgtctggtcatccctgtaacacagacagacgatattctcagctcggcggatcagaccaacgcccaccaatcggccactgacggcgtactctatcgtgcgagcgtccagtggcgcagttag

SEQ ID NO: 7762 - DNA, 516 bp, A.fumigatus
gatgaacgcatcggcagcatagtttggcattcgttcctaccttccccggagaacccagcgaccatctgctcaatcaatctccaaaagatgcactccgctttcatcgtcctcgcggctctggctgcagccgttttcgtggagggaaccgatgtccaagtgttccaagcaggccccacgacccttcctctgcacgccgtaaaggccagcgtcgttaatgccaatgctgtcgcaaccactctcgccatcaagtgcgagggaaacgtatgcacccccggtgatcactgcggcctctgcagccctttcaccatcacccagggcccgtccacctacagcgtcagcgcagtctactcagcctctgtgggtggagtcgaggaaacgcacactgtagtacaagactgcgacatcacctcatccaccgagttgggccacgtgcacactgtccgccaaagtggaagtctcggcacttggaagaaagaccgccacctcgtcctcggcgacggttaccttccactctga

SEQ ID NO: 7763 - DNA, 1797 bp, A.fumigatus
  unsure (1768): Identity of nucleotide sequences at the above locations are unknown.
cattttgcgtcttcttttcgccatctgtactcactgatttgcgttctcggacagcaaggaaactctgctcgatctcccccgcctgtattcgcatcatctctccaacagttgagcgctgtctcaacccctgtccttactctcccagcggccgcctcgcatgacgctcatgatgacaacgtgattttccttcgttctcgagtccgctcacctcacaggtcttcttcctcaagtcggcaacgtcgccgacggcaccaaatactatccgagttcgagtctgatccgatggaattggacgagtcgactggagtgcgtatgtccgtggaaatcagtcgtcatcctatagggcgtcgaccacgagaggaaccgacgaatatgccgaactatgaaggtcgtgtctccaacattcggtcgctgtacggctgggccccatgctccgacgaggatgacgaggatgatttggtttacgaacccctgcaggatcccaacagtgcctcctcttggtttggcagactctcggatcgcaatgcgacgtcgaggcgccacgcacgacgcgatgtgaccggacgaagcccccttccaatccccgttgagccttcagagagaagtagacaccgaatggacgacacaactctcgccacggccgaagctctgttgcagtcggttagacgacagccgcgcctttcgaggacgcggacattacacaactatcttttggaccgggagcgtaccagccaggattcagaagatggcagggaacgagcgactcagtcctcgacttcacgcgcatatcggttcatacccagtagtcgaggggaatccagccggatttcaactcacggcgatgtgcgcgctcgtgccaacgctcatcggcagctgcatatggatcatcctcccagcccgcgcttgaaggaaattattacatatctcgaccggttgcgctattcgacctcctttgaagaaagtctttcatcagctgccgcaggtggctttgctcaactcgatttctcctgggacgaggatgatttcatcctggatactacatcaattgcaccaccgccgccatgttcctggctacgtccaggtatggtttttaaaggctcacagatggcagcatgcactcccagttcgattttcgcgcacgtgggcccaacttttcatccagccaccgaaccagtgatcgtcaatggcagcgataatggccgcattagtgtttatacgacaagcgggcgacgatacttggccaacaataatatccccagctttggaatagggaaggatgagaattggccggtcaaagtcaccattcacaatatcaactatcaagagatgacactttcaggtacaatggaagcctacaacattcctgataagacttcgccatctcacgatgcacatattgtcacctttctggagggggaaattatagacttcaacactcacactcttgagacgaaaaatttcaagtccgacgctgaaaccgacagtacctactggcgcgagctgcaaccattcaagcacttaacagacgacgagatgacaaggaaccttgtgagtaggaaatggattaccgaagaactatccaagcggtggattttgatgcggtggaaaggtgtgtatttgatctttcaacacctctccaatctgtttatggtttgtgctgatgacggtacagaacgctgtttcatcactcccaccgacgcccgccagggcctcacaatctcaggattctactatatctctcttcgtggacatattggacacatgtctnttagccagcgatggcgatccaccttggta

SEQ ID NO: 7764 - DNA, 273 bp, A.fumigatus
aagcacacctttcgcttgagcttgacttgggataggcgttcttttggaggtggatgtagacctaagcattcgcttcctctgccaagccacaagcatgtgttttggttccatatcaacagcgccaagcttaagtacttctgggttatcaatattggcgggggtgctacagtcccgaacgacaacattgacacctgcattatagtctaccagcaatatgtaaatgattcacgaagtatatatcagtcaggcgaagttttttcgcagtggagctag

SEQ ID NO: 7765 - DNA, 354 bp, A.fumigatus
atgatgccgcaccagagccagggcgcctgcatggctatcgaagaaccccctgccctgggcatcctctcccggccgccccccccccacccccctgcccccccccgcgctgccccccctcccacccccccccactacccccccccaccccccccccacccccccccgcccccccccccccccccccccccacgaccccccccgctaggcaccccccggttcacaggccccccccccccccccccccccccgcccccccccctcaagcaacccccaatatcccaaaaaaccaaagccgcctcccccccccccccccgcccccccaccccccgccccccacccccccccccccaactg

SEQ ID NO: 7766 - DNA, 639 bp, A.fumigatus
gctaccaacgccactgcggatagtgcaccgagtctgcggcccgcacacaggactgcggttcgacgcggcggccatgatgaacggatgaagtataagacctcgtctctagatctttggaacgaatctttcattactcgcaacaaaacatccaacatgcgactgccacaggccgacgcagactcagcgagcaacatgcgatccaccgccactggctggagacgactcagcgttggcgtcgtgggcggcggcatcggcggcctcgcagcatctattgcactgcgtcgcgcaggccacgaggtaaccatctacgaacgtcatgatttcgccggggaagtgggcgcgtcgatctcgtgcgcggcgaatggaacgcgctggctacatgagtggaaggtggatatcgccaagggggaccccgttgtgctgcgcaagctgatcaaccgcgactggaagacgggggagcctgtcagcgtgtatgatctagctgggtatgaggagcgatgggggtacgtgtactacatgttccatcggcagtacatgcatgccatgttgaaggattgcgcgatgcaagaggagggggaggggacgccggtgaagctgctcgtgaaccatcaggtagggcttctggcccacactcagtga

SEQ ID NO: 7767 - DNA, 501 bp, A.fumigatus
gagcagtgcaaggacatcaacctcgagacggggttgatcacctttgccaacggcaagaccgcgcagcatgacctcatcgttggcgcagatggcatcggctccgccgtgcgtggcatcatcggtctcaagccggagaagaaacccgccgactcgagctgtctgcacgccaacgtacgcaccgaggacgccgtccgcctcgggctggtcgattactcgcagcacagcgcgctggagtactggggcgggcaggacaacagctgggacaagatcgtgctgtcgccctgcaacggtggcagcctgctctcgtactactgtttcttcccgcgggagaaaggcgatttcacgaaccacacgtggggcggcacggaccggccggttgaggagctgctggcgccgtatcccgagctggacaagcaggttcgggcgcacctgccccattgggcaggagatccggccgtggcggctgtgggtgcatcagccgtacccgtatctggtccgtaa

SEQ ID NO: 7768 - DNA, 480 bp, A.fumigatus
cggggggggtcgtgggggggggggggggggggggggcgggggggggtggggggggggtgggggggggtagtgggggggggtgggagggggggcagcgcgggggggggcaggggggtggggggggggcggccgggagaggatgcccagggcagggggttcttcgatagccatgcaggcgccctggctctggtgcggcatcatttacagccaatcagcggagggcggcggggggggaaatgggaaccaaaggtaccggatgaccagcatcgcccagcagacacaccatgttacggaccagatacgggtacggctgatgcacccacagccgccacggccggatctcctgcccaatggggcaggtgcgcccgaacctgcttgtccagctcgggatacggcgccagcagctcctcaaccggccggtccgtgccgccccacgtgtggttcgtgaaatcgcctttctcccgcgggaagaaacagtag

SEQ ID NO: 7769 - DNA, 378 bp, A.fumigatus
tgggggggggtgggagggggggcagcgcgggggggggcaggggggtggggggggggcggccgggagaggatgcccagggcagggggttcttcgatagccatgcaggcgccctggctctggtgcggcatcatttacagccaatcagcggagggcggcggggggggaaatgggaaccaaaggtaccggatgaccagcatcgcccagcagacacaccatgttacggaccagatacgggtacggctgatgcacccacagccgccacggccggatctcctgcccaatggggcaggtgcgcccgaacctgcttgtccagctcgggatacggcgccagcagctcctcaaccggccggtccgtgccgccccacgtgtggttcgtga

SEQ ID NO: 7770 - DNA, 612 bp, A.fumigatus
gcacccgattggaacagaagaatattggagctgatcacgatccttgaaaacagtgacacccgcaagcaggtgaaccagggttggggcgctcagactggcgacaaggctggtgacaaggcttgggatgacgagagagccgctgagaatcttgctcagaacgaatccgaaccccagacccccgccaacgaggagcctgctgagcccgccgaaaagaccaagacttacgccgagtaccttgctgagaaggccgcccagggcgaccttgccgccaagcccatccgcgcccccaacgagggcagcaacctcgacaagaagtgggccaacgccaaggagctgaagcgcacccccgaggaggaggaggcctacatcaaaggcaaggaagagaaggccaagcgcgagaagcagcgcaaggagaagaacgtcctcgaggtcgacatgcgtttcgtcgagtccccccgtggtggaagcgctggccgtggccgtggtggacgtggcggccgtggtggtcgcggtggccgtggcaacggtgctcctcgtggtgagcagcagcagcgcggtgctccccccgtcaccgtcgacgagaagaacttcccctccctcggtgccaaataa

SEQ ID NO: 7771 - DNA, 219 bp, A.fumigatus
ccattgaacagacaaaacccggtggtgatgtccaatgccgacaaggtgtttggatacatcgtgcaggctctggaagccgagacgctacaaggccaaacggcaggacgcgtggccaactcggccaagcaactggtggccgctacaggactgaatgcagagcaaatcctggcaggagtgagccctgacaaccaggcggcggtgcgaagctacttccagtga

SEQ ID NO: 7772 - DNA, 912 bp, A.fumigatus
gcaattaacgaagccccaaggctcttgcaaacaacgttcagacggcatccgaccctcgcaactctagccacaggcccggaccagcgcgtcgacgtccacgcaccaaccatccccatcatctccatccccacctccctctccacaggcgagtactccgacttcgccggcgccacagacgacaccacccgccggaaacactcctttcaggcgccgacgcgcgggcctcagctcgtcatcctcgacccggacctcgcaaccaccaccccgccgtccatctggctgagcaccggcatccgcgctgtcgaccactgcgttgagacgctgtgcgccacgactggcaaatccgagacgacagacgcgcacgccatgcacgccctggagctgctcgtcccgggcctgctgcggtgcagacatgaccctgccggccacgaccgcgacgcgcgcctgcagtgccagcgtggcgccgtgaatgccatggcgacgttgacgggtgggtcttcggtcgagctgggcgccagccatgggatcggccaccagcttgggccattgggggtcggccacggcgagacgagctgtatcctgctgccggctgtgtgcaagttcaacgcgaggcatggcgccaatcgcgagcagcaggagcgggcgcgggactttcttgtgcggaatgccgaggtggcgcgcgtgctgcgtgatcggggcgtggacgcctcgttggcggatttgggtgatgtcttggatgccgtcattcgggagctggggatgccgcgctcgttgaaggaggtcggggtcggccgggatgcgctggacgagctggcggccaacagtctgcatgatcgctggtgcaagacgaatcccgtgccgttgacggagaagaagcaagtactggagattctggaaatggccgtggagtga

SEQ ID NO: 7773 - DNA, 282 bp, A.fumigatus
tctaacccaaggcacaaaatgttgccagaagcaccaaaaaacaagtccctatacgaagaggccgttgaagctttctcattcttgaaggaacgtctacctgaaaccctacagcaccctcgtgttgcagtcatttgtggctctggtttaggaggactcgcaaataccatccatgacgagccgcgagcagaatttgaatattcttccataccccatttcccttgtctgacaggtaaaaatgaagccttgaagctcaatatcaacctgctgatttctgacctctga

SEQ ID NO: 7774 - DNA, 240 bp, A.fumigatus
aaattgcagcacatcttccctgcaggattcgcaggaactcatcccctgcgagggccaaacacggaggaattcggacccagattccctcctctgtctgatgcatacgatctcgagctccgtcgccatgcacatcaggcatggaaagcagtgataagcgagaacagtacacgaagactgcacgagggtgtgtatgcctttgttgcgggtcccaggttcgtgactatttctccaggaccatga

SEQ ID NO: 7775 - DNA, 363 bp, A.fumigatus
ctatttctccaggaccatgaattcgtatgcaaccatacactaatcattcacagttacgaaactcgagctgagtgtcgtatgcttcgccaagttggggctgatctagttggcatgtcaaccgtgccagaaataatagtcgcgaggcactgcggcattagggtactggcgttcagcttggtaaccaacaaagcggtcctctctccagttccccgaggagatgatcatcttcttcaagccaaggacgtgaaggaactggattctatactgcaagaaggcaaggcaaaccacgaagaagtcctcgaagctggccgcacagcagccatcgatatgcaggtaagcgcattgagaagcttatcggtatag

SEQ ID NO: 7776 - DNA, 381 bp, A.fumigatus
ctgacgatcctgtctcagccaccgaaactctccaaaagcgccaaagaagacttgatagtttcgcatctccggtccacacgtacgtgccacacgctcaaagacctcgagaagatgcttccctcggtggcctcgatcaatgggatgcaggttaaggaatacattcaaaacctgacggacgagggaaagatcagggtggaaaagatcggaagcggcaactggtactggtgttttggtggggatgagaaaagagagaagcaagcaagattaaaccagctcgagaaagaggtgaaaatgctgcaagcgagctatgacgaagcagaggctagtctggcggacaaaaggggtcttcaccacgggggtggaaggatccgcgctaagata

SEQ ID NO: 7777 - DNA, 261 bp, A.fumigatus
aagcaacccgctgacactgctcgtatcagtgaaactgactcactgagttggaaatctagtgaagatttcccccgatgctctcccacgggtgaccctcaccacgataggactatgtcctacggcaaatcccttgcgctgagccagaattccttcgtccagcctccggaccaggacgatggcgcgcgagacactcaaggcgagcctgtgctcaggcgacaaaaacgtcaagcaactgtctacgatgctgtggctggttggtag

SEQ ID NO: 7778 - DNA, 204 bp, A.fumigatus
tccatccagcaacgcctcggcacttcaactacccatcaaacgaccacgaacgctccgttcaagccgatcctcacccgtaatcaccaacctcacaccgcgcatcacccgttctcgctccgcttcttcgaccacctctctacctccgtcaacgcccaactcccctctcacaccgtccactacacccgacgagatctcccgctctag

SEQ ID NO: 7779 - DNA, 1227 bp, A.fumigatus
actcattcgagtccaagtatcaggattaaaagggtctatgagctcactgctggccgtctcttgatacttcttcgaggaactgactccatcaccactaatccactccagaaaaggtcttcgtcaacagcgagtatgtcacgacctgcttctgttgctgaggatatttctcaaggatatcaagatgaagccggcaccgacgacgaaaatgatgtgcccgtgaacaaaaagacctctttcaacggcagactgaaccaatactttcatgcatccaagaacgtcgcaccgacaggagagtcgctgtcaaaggttgcctcagcgccggatctcccaaccgcaacgatcaagcgcaaacccgagtctgactcagaaccacccagtgatccatccagcaacgcctcggcacttcaactacccatcaaacgaccacgaacgctccgttcaagccgatcctcacccgtaatcaccaacctcacaccgcgcatcacccgttctcgctccgcttcttcgaccacctctctacctccgtcaacgcccaactcccctctcacaccgtccactacacccgacgagatctcccgctctaggtcccgccgccggcagccctctacaccagctacatcctccatctgcctcctccgcgacaccatcccgccgaatctcaccctcctcctggtcggcgtaaacccaggcatcatgaccggcaccacaggcttcgcctacgcgcacccctctaatctcttctggaaactcctgcactggtccggcatcacccccatccgccacccgccctcagacacctaccgcttaccggagctctacaacatcgggaacacgaatatcgtcgagcgtccaacgcgagacgcaagcatgcttagcaaggccgagatgaacgcgggtgtccccgtgctcgaggccaaggtcgcgaagcagcgcccagaggcggtctgtctcgtgggcaagagtatctgggaggctgtgtggcgggtgcgcaaggggaggccgatccgcaaggaggagttccggtatggctggcaagatgagacggagaatatggggcgatgtgatggccctgatggatgggaaggggcgcgggtgtttgtcgcgacgacaacgagcggcctcgctgctgggatgagcatcgcggagaaacaggccgtgtggaatgaattagggcgctgggttattcagcgccgtgaggctcttgcgggcaagcggcctagccaatga

SEQ ID NO: 7780 - DNA, 1632 bp, A.fumigatus
  unsure (1534): Identity of nucleotide sequences at the above locations are unknown.
aaaaggaaaaagaagcacgtacttttcctgccgacgtggtgtaatacggagcttctgcggtatccccgggagattgcgcgcaagataccagccaaccgattcaatatcgacgcattttatcatccagacggagaccatcatggcacgacaaacgtccaggaatcgtatttcttggacgaggatgtccgagccttcgatgccgccttcttctatatctcgccgacggaagcggcggccatggatccgcagcaacgattactgctggagacagtgtacgaatcgcttgatgccgcggggttacggatggatgcgctgcagggctccatgactggagtattctgcggtgccctccgcaatgactacagtcaaatccagaccatggatccccaggccctcccagcgtacatggtgacgggcaattcgccgtcaatcatggccaatcgcatctcctactactttgactggcgtggtccctccatgacagttgatacgggatgctcatccagtcttcttgctgtccatctcggagtcgaagctttgcagaacgatgactgttccctggcagtcgcagtagggagcaacctcatcctgtcacccaatgcctatatcgcagactctaaaacacggatgctgtctcctaccggtcggagtcgcatgtgggacagccaggctgacggttacgcacgcggcgaaggcgttgcatcggtggttctgaaacggctacgggacgccatcgtcgatggggaccccatcgagtgcgtgatccgagcttccggggcgaattcagacgggcgaaccatggggatcactatgcctaatgcccaggcacagcaggcgttaatcctccaaacgtacgcacgcgcgggactatctcctcaagaacggcccacggatcggtgccagtatttcgaggcccatgggaccgggacccaggccggagatccccaggaagcggcggcaatccacgccagtttctttgggcctgaatccgttgcggatccgctggaccgcctgtttgtgggatcgatcaagacagttgttggacatacagaggccactgctggtctggcgggactgattaaggcgtccctgtcgctgcagcacgggatgatcgttcctaatctcctgatgcagcagctcaatccaaagatcgaagcgtttgccgctcacctatgtgttccaacggagtgtgttccgtggccggcggtcccagagggctgtcctcgcagagcctcggtgaactcgtttggttttggaggcgccaatgtgcatgttgtcttggaaagctacactgcccggcagatcaccccgtcgcataacctgccctccagcctgccttttgtcttctcggcggcctcggagcggacactgacatctgtcctggagtcctacgcgacattcctgcgcgaacacgcagcagtgagtcttccgagtctggcggtgtccatgtggactcggcgttccgctcatcgccaccgcctgacgcttatagcacgctcggtagaggaactacaagaccacattgacaaagaantaagtcgaagggccacggggacaccctcctccatcgtctccagacctagcagtcggcccaggcgcgttgtcttacaccacggggctggaaggaccgcg

SEQ ID NO: 7781 - DNA, 327 bp, A.fumigatus
  unsure (290): Identity of nucleotide sequences at the above locations are unknown.
tggatggtgatgcagccgagcaccctgatcgtgttgtgccagcaaatcgccgtccccacgaatcttctaaatcagcgtggcttgatggctagtgctgctgcctttgcaacccaaacggagacccgcaaagcactaacaggctggcttttccaagacctcaaaggtgatttgactcccaatgccttgaaaaatccaggctgtactgtgcacggcaccaccagctatatcacacccaaccaggccgaacactctcgcggggatcacatcctgttcgctgctttgctcttatntaaggcgccgaaatcttgctacaagttacaactgtta

SEQ ID NO: 7782 - DNA, 183 bp, A.fumigatus
ttgcaccgccacaccttcgatcacgacatcaccgcagaaaagaagcaaaagaagttcctggatcctgggctctcgttgactgcgcgctcaattcaaggagcgatatcatcaattctatttcttttctttaatttgtatttctcctctgttaactcgtttatatgtatctacggtagttcttga

SEQ ID NO: 7783 - DNA, 2265 bp, A.fumigatus
attgactaccgtcgatccttccagccccgtggtgaagacgacaggcgtctgaactgggccatggatatattcagcgctggctgcgtgattgcagagctgtttctagaggcgcccatcttcaccctaagccagatgtacaaataccgtaaaggtgaatacagtccgcaacacagccagctggccaaaattgaggacccggaaattcgagggatgatccttcatatgatccagcttgagccagagtcgagatattctgctgaagaatacctgaacttttggaaaaataaagctttcccggaatatttttacagctttcttcatcagtacatgtctttgatgacagacccttcgtcgggcagggcgcaagtggaagcggaatcggcaaacaggggcgaatcagatgacaggattgagagggtttactacgactttgataaaatctcttacttcctgggggcatcttcgaagcctgtgaaagatggccccagtcgcagtaactccaggctcactggtaacgggttcccgatccatcttgatctcccgaactacggactacaggctgcgaagtctcagccccgaactgacgatggcgttctgatcttcttaacgcttgtcgtgtctagtgtgcgcaacacagcaagggcatcttccagaatcagagcttgcgatatcctacttgcatttgcagagagattgtcggatgaggcgaagcttgatcgtattttgccttacattatgatccttttaaacgatcgcacagatagtgtgaaagttgccgctattcgtactcttgcgcagctgctggagatggtgcaggtcgtctcgccggtgaacgcgtatctctttccagagtacatcttccctcggctacaaccgttcgtctctagctccagctccaatcccagcccgatggttcgcgctgcgtatgcctcctgcatatcttcactagcgcaatcttctctgagattcttagatatgatccaggccctacgctctgatactcgtctttccgcccttataccggcaggctccgagccaagatggactgaggatgctacatttcacaacctctatgacgttgcgagggtagaacttctcgattattttgagaatcatactaaagctctccttaccgactctgacgcatctgtccggtctgcattcttaagctcagtgcccaatgtgtgtgtgttcttcggcaacctcaagacaaacgaagtgattttgaaccatctgaacacttatttgaacgatcgggactggatcttgaaatgtgcgttgtttgaaacagtcgtcggagtcgcagcttacgttagaagtacgagtttggagcagtacatattgcctttgatgatccaatctatgaatgagcccgaggaatttgttgttgagagagtccttcgatccctggcagcgatggctgaccttggtcttttccagcgatccaccacttgggaggtccttcaggtcgtcgtgcgtttatcagttcatccaaacacgtggattcgtgaagcagccgtttgcttcatcatcaatagcgcaaagcacctgtccattgccgacaagtactcaatcctgggtcctctcgtccaaccatacctgagagtgaacattgtagatttctccgaagaaaagctgctggatggtctcaaaaaacccctatcaaggagtgtatatgacctggcctttgtttgggcttctaaagcggagaaaggtcttttctggaagtcgacagctcgagatgaagtgttcagtgtgggcggcactgatcatcttcttcccaagggtggccaaaagaaccaaaacttctcacacaacgcacaacccaaaaacgaggaggatgagcagtggctatctaggctaaggaacatgggactcggtccggatgacgaattcaagttgctcgctctacgaagctacatttggggtgtgtctatgcgtcagatgaaagagtccgacgatgcggtgtcctcgttgaacaacgtaatagctttgactcaatacggggtgacacctcaaactgtcttctttgataagcaacaaagcgtcaagccccagggccctcccttgcctaaagttgacgatgctggattgggagaaagcaagccgcacactatcaccgatgcccttttggatgcgtcaactacgattgacagcgcctctcatactcgtcggagacacttgaggacgcgcagccagctgcagagagatccaggaaacgccaatgatatgtcttcaccacggggctggaaggagccgcgccat

SEQ ID NO: 7784 - DNA, 210 bp, A.fumigatus
acgaaattgagcaattgcattggatatttggctgatgccgatgacaactatccgaatctggaacggttcgtcgccgtcttcttaatcaaattcgcccaggattcaatatacggatcaggcaacagtgtagttattcgccgactaagtcttttggctatcactgagcctgctttgtctcacttcacgttggacgtcgaagaactgggttaa

SEQ ID NO: 7785 - DNA, 219 bp, A.fumigatus
tgtgccccacgctgtggagccatgccagtggcagagaagcttgccttgatattaaagctgtggagctttggaaatgaacggggattactgcaccgcatattccgagatgacatggtctacggagtatataacatgagcacgatggaccagttctctgagggccactctctcttccctctagaactcaagactggtttcttgtcactcattagactttga

SEQ ID NO: 7786 - DNA, 561 bp, A.fumigatus
atacacggctcagccaatatggacgagatctcttgggttgccacagaaaagggtcagacattgggactcagcaacacaacgttcggcgatcgctcctggccaaagatcctcgacggggagaagctgatgaatgaggccatcaatgcgcatgtgcaagcgggtgaagacgaagatcaactcataaaccggctacttcaagttctgagcagggatactcttcccaggctctcgggcgacgccactatggacacctacctcctcctactgcgacaaagcatcttcgtcccagtcattggagcacaggcagagaaacctagggcagccgacgaggtcgctgcagctcgtgatacggacagagttccagtcgaaagtcaaccgccgcatgattcgctggacaagtcattcttgcagggcgcatacggaactcagaaacagacggtggtgctcgtaagtgcgaatggaagagtgagatactttgaacgtacgctctatgataatgatgtaaatgcaattcccaccggcaaaggggataggtcatttgaattccacgtcagccgataa

SEQ ID NO: 7787 - DNA, 2058 bp, A.fumigatus
caaggattttggccacccgattcgaccagtaccggatggaacaaggaggactttatggaaagtgaggatgaggggcccttccccgttatggtggttccccgcatcaccaagttggggcgtattgaggcgcccgcggttgccatcgatgatgatggcttcgcaaccgttggccgcggtggcaagactttgcagtacacccctgagagcatcctgaagcacctccgtgtgatcgtcgagtcgcgaggaaagaagaacacagaccgtatggagcagattcggacgatggagaagcttctggaggtggctcagactccttatcagcgcatccgtgtttaccttactctcatttccacgcgtttcgatctcacatccacgtccagtgccaactacatggccgtcgatcagtggaagtccgccgagcaggacttctcgtccctgctgtcggttttggagaacaaccgtgaccatgttgtgttcgaagatgccgaagaatgggaagatgacgagaagcaacccaccatcgcccccggcgagaccctctacatccccggtagcattgtgtctttcgccgagagactcgacgacgagcttactagatcgctgcaacacatcgacccccacaccgctgagtacattgagcgcctgagtgatgagaagctgctgtacaccgatctcgttcgcgcccaagcctacgtcgaaggtttgaacgaagtcgagaagactgatcccagacaggacagtgtcaaccgggtggtcatgagacgattggagcacgtctacttcaagccctcgcaggtcatcacaatccttgaagatgccacatggaagtcccttccctcagagctggattctagcatcacccctcgggctagcagtggcaacgtcgagaacctcgttttgtccctgtgcaactatctgttcaagtacagtgatggtatcatcagagcccgcgcgatgctgtgccagatttacttccttgccctgcatgaccagtactaccgctctcgtgatctgatgctcatgtcccatctcactgagaatatttccaactttgacgtcagcactcagattctcttcaatcgaacgctggtgcaaatcggtctttgcgccttccgctccggtctcatctacgaagctcagaacaccctttctgaagtttgcggcagtggacgtcaaaaggagctcctggcccagggtatcattatgcagcgctactccacggtatccccggagcaggagcgtcttgagcgtcagcgccagctgccgttccacatgcacatcaacctggagctgcttgagtgcatctacctcacctccagcatgttcctggaagttcctctgatggcccagacttcctcttctcccgagatgaagcgccgtgtcatttccaagaccttccgccgtatgttggattacaatgagcgccaagtcttcactggtcccccggagaacactcgtgacggcgtgatcatgagcgctaagttccttgccgctggtgactggaagaaggctgctgagatgctcaactcaatcaagatttgggatctgatgccccagcccgacaagatcaaggagatgctttcccagcagatccaggaggagggcctgagaacctaccttttcacttacgctcctttttacgacagcctctccatcgccaccctctccaacatgttcgagctttctgagaagaagatctccgccatcatcagtcgtatgatctcgcacgaagagctggcagctgctctggatcaggtcaacaacgccatcgtcttccgcaagggcgtcgagttgtcgcgcctccagtcccagatcgtcacgctggccgataagtccatgaaccttctggaagccaacgagaagactctcgagcagcgcacccaaggcatggccaacgccttccagcgcgatcagggcgccggcgcccgtggtggccgtggatccggacgcggtggtcaggcccgtggtggccccagatttcccggtggccagcaaggccgtcggcccggtggacagcaatttggtggtggtgcattgggcggagctatcaaggcttaa

SEQ ID NO: 7788 - DNA, 207 bp, A.fumigatus
atatacaccatggttgcagaaacgaaactatacgacgctctaaatatcaaacctgatgcctcacaagacgacatcagaaaggcataccggaaagccgccttgaaatatcaccccgacaagaacaaagatgatcccaaggcggtagagaaattcaagggtgagttgctcctgatcacgagacattgtcagaggatgaacccgtgctaa

SEQ ID NO: 7789 - DNA, 624 bp, A.fumigatus
caaaaagcagaggtctcacaagcctacgaagtcctctccgatcccgagaaacgtaaagtttacgatcaatacggcctcgagtttctgttgcgcggcggcccggccccaggacccggcggggctcccggtgcaggaggattcgaaggcttcgagggcggcatgcctggagggttctcctttggcgggatgcccggtggaggaacccgcacgttccatttctcgactggtccgggcggcggtggcgggttccgcttcagctcggcggatgatatcttccgaaactttgcgaaggcgagcgggggcggcatgggcggtggaatggaagatgatgacctgttcaatatccttaacggtgggctaggtggtggtggtcgcgggttcaggacgagtcgcggcgctggtgcgggcggtgcgggaggtggaggattccagcaggcgaaccgggcaccaacgcctgagccgtcggtggtggagaaggagttgccgctgacgttggatgagcttttcaagggaacgacgaagaaggtgacggtgaagagtaagacgttcgatgcgagcgggaagcgcaccgtccaggacgtcacactggaggccaatattaagcctggtctgcggacgggctag

SEQ ID NO: 7790 - DNA, 555 bp, A.fumigatus
cccgtccgcagaccaggcttaatattggcctccagtgtgacgtcctggacggtgcgcttcccgctcgcatcgaacgtcttactcttcaccgtcaccttcttcgtcgttcccttgaaaagctcatccaacgtcagcggcaactccttctccaccaccgacggctcaggcgttggtgcccggttcgcctgctggaatcctccacctcccgcaccgcccgcaccagcgccgcgactcgtcctgaacccgcgaccaccaccacctagcccaccgttaaggatattgaacaggtcatcatcttccattccaccgcccatgccgcccccgctcgccttcgcaaagtttcggaagatatcatccgccgagctgaagcggaacccgccaccgccgcccggaccagtcgagaaatggaacgtgcgggttcctccaccgggcatcccgccaaaggagaaccctccaggcatgccgccctcgaagccttcgaatcctcctgcaccgggagccccgccgggtcctggggccgggccgccgcgcaacagaaactcgaggccgtattga

SEQ ID NO: 7791 - DNA, 1395 bp, A.fumigatus
gcccttttaagacaaggtaacaagggaagaacaccctttccggggggccagtatcattggagtgggggggaccagtacgatggacggggaaaagaacggaatctgccagaattgctggaagatggcgtgccgcagtcttcctatgagtcggtagaaagtggaggcagggacaatacggcacagcttagtttgagctcacagacaagcctgtcgcaagcaagcgaaatcagtcaagagctccataaggccgttcccgacgcaacgtcgacccaacaagataacgacacgccgtctgatgacacacaactctctgccaagagaaagcgttccatttcagacctgcgcggagatgtcccaaccacacttcagcagcagcagcaacaaccaactcctggcggcctacaggttctgaagtcgccaccatccctacgtctgtcactgtcctttgacggagaggcaatggtacgaagagaaggcgagttgacaccgtctcccccgaaaggacgcaactctctccggatcgccatgtcttcggatgggaaagctgtcatccgtacagaagatgagccatctccgtccaaaggccgcatttccatgttttccacaagaagctcccgattcgcagggcttcgtagaagcagtagtgctgtggcccttggaacacctcgggctggcgccatagagaaggagaaagcattcgggagatctcgagaccctcggaactgggaatcatttttcgacaccgacgcaagaagcgcgttgtcgaccccaaccagctctcagagtgctcctaactctgcctccccgaacctcatgtttgcccctggtcagcgctcattgacccgaagcttatcagcaagacacactaatatgtcgacttcgaccacccacgattacctcaacactccgattccacagcatgctggtgagaagcggcggaaactctcacgtactgtctcctctctaggccgacttgagtctagctttagcaatctcaacagaaggccatcaggcgcatataatatctccaaagtccgtgataccatgaaagacaaggatgatttggatatcgaatgcggcgactcggacaaagaaaactggattcctgggacccgagtctcacatgtccgtcagcgagccgcctcccaccatcagtcccatcgcccagtgctcaaggaagctaatggacgagatggcaggataaacaggaatttagccgcaacaggcgggcgttcccgaatttctcaaccgtcgcatcgcaaaagcatcaagtccatgccagagcttgatgctgatgtttcagctttcatggctggcggaggagtcgcaagccaagaagaagacctcgactgtgttcaaggtctattatccttgagccaaggcgcttggaggtag

SEQ ID NO: 7792 - DNA, 210 bp, A.fumigatus
ctgatttccgagtcacgaacaccagagtgctttcctgcttcaagacttgcaaagtggacgtttgcaagtaaaacaagcccccagtcggatgcagacaatatgcatatgagcacatgtgctttagaaacatccactacactctatcacactgcctacgccaacacaattatctttgacgcgagtggtgtaacaaccatctggtatgggtaa

SEQ ID NO: 7793 - DNA, 1203 bp, A.fumigatus
agacacgcgactgagtttttcgctgcaaaactaattttcgtggagaacgcgcattctgaaaaggaatctgccgtcggtttccagaagtatgaatcagttcgccgcggagcaatggatgtcctggcaaagattttctccaggtatcccgctcagcgtccgttcattctcgacgagattcttgtgtctctggaaaagcttccgtccacgcggcaaagtgccaggcaattcaagctggccgatggtaagagtatccagcttctgaccgctttggtcatgcagcttgtacagaccactgcccttgacactccatcgtccaaaacacgaaaatcgaagcgtactctctcggcagccgacgatgacgaagagtctcaagaaaatgaggaagacttggacgaagatgacgatgaggatcagactgatgcatctctggagcgtctcgcaacgaaagtcaaccgtctctacgataatgcggtccgcagtgcgcaatatatcgtcaagttcatagttcaacgtgcaatgacatctaccaagactggcgaccaaccttttcgcaacattcttgatatcttcaccgaggatctgattggtgtcctgggttcaacagattggccggcggctgaactacttcttcgcatcatggcgtctcatatgattggtattgcagatcttgataagagccctgccactgcgaaaagcatggctctggagcttctgggctggatgggatccgccatatcggatctagttgtgaccgctcagcacttgcttccctcgatggaagagtccgatagtgaactcagtgtctatttgagacagttgttcgaggactactccaaccatgctttacatcctcaagacctagttgtgccagaaggtccgtatcggatagctctcgagtactttctacaggcacagtcatcggacaactggcagctctccagtgctcggggttattacttggcgcaatgggcaaagaccgtctgttccgtctattataattccgaagacagggacgttgtacctgatggcgaagctaccgaaggccttgtggtactcttaacgaagttgttctccgagccgctgtggttggaaactcacaggtacgggcttcaacaacgcccctttgccgcaaatgctaacgctgctattctagacacttcgataggatatcaaccgctcatgggcggttcgcttacgttttga

SEQ ID NO: 7794 - DNA, 390 bp, A.fumigatus
cacctaacgtttatctctaggacggccctcctccttcatatcctgcgcctgttcatgacgctggcccatacggccaccccggttcacctgctcctcctggtggcgcaaaccaagactactacaaccaaggcggttactaccctccccagaattacggtccccctccccagcaaggatatggcggttacggctcgccccctcccccgggtcaacctatgtactatcctccgcaaggatacccgccacagcagcaaggctactatccggaagaccggggagggtcttcaggcggtggcatttgtgccggtatcatggccgctcttgcatgctgttgctgcttggatattctgttctaagcagtatgaagaaaaaggactcgggcccttataa

SEQ ID NO: 7795 - DNA, 1119 bp, A.fumigatus
cacactctcgccatgtctacctcagcttttggggttgtgatgcggtttgagagcgcctcaccgatcgctaaccctgcggccgtggtgcgaaaagatcggcaaggtatcgctcgcactccctccgaatatgagctagatcatatgcgcgaaagtcgccagtctcctgcgtctgggccaagcaccggagttcatatgcctatcacatccgtcactcccaacgagttggagagcctaccgggctcacctgctgaagacggtgccattgatgctattgatgctatcgatccactgccgaatctcacctcatctgcgacaacaagatggcgactattgagtgcttgtatgatgagtgtggccaatggcttgaatgacagcggcccgggtgctttgattccgtacattgagaaagactacaacatcggttacgcagtcgtgtctctgatttttgtgactaatgcgctggggttcattcttgctgcgccagtcacacaattctttgaggcaaagctcgggcgctcaaaatcttacgccttatcaatgagtttgttggttgcgggatatgtgatcattctctccaaaccgccatttccagccgttgtggccagtttctttctgctgggattcggaatggcgctgaatttggccttgaacaacgtgttctgtgcgaacctagcgaacagtacaacctctctcggtgccttgcacggtagctacggcattggggggattatggggccgctaatagcgacggccatggtatccgacggtgtccagtggtccatctattattctattaacctcgcactagcagtgttcaacctagtgtttgcaatatggacattccgcgggtatgaaaaagagctgccgattcaacttctcaccgcgcttcagcagacggtttcacaacaggagcatggccacaatgtggcaagcaaaaagcaactattgaagcaggcagtcaagaacagaacgacgttactcggggctcttttcatctttgcctatcagggtgcagaggtttctatctcaggatgggttgtctcgttcctgatcagctatcgcaaaggagatccctcccattcttcaccacggggccgcaggatccgcgaaaagttacga

SEQ ID NO: 7796 - DNA, 195 bp, A.fumigatus
ataggctggttcttgagaaatcggatatcaaggtgctcgaggatccgggaaggcttcctcgaaatggacgatgcctccctcgtgttctcctgcagccccaacatttgtgtcaaggaaattgttgaggacattgcccgtccactggctctcatctggtgtactgtcaaagacaaagatccggaacacgccctgtag

SEQ ID NO: 7797 - DNA, 519 bp, A.fumigatus
cttgcaatatctgcgtcaagtcgaaaaaaggctcgttgtccaggtgagaagccgacgtgctcgctatgtcagagacttggtcagcgctgttcatataacgcgcggcgggcagccaatgatgcaacatcgggagctcccttaggactgagccaaccatgcaccccagatgacgcgctaccaggaacttcgccaaatgctcagcatttccggcgtgtcgaacagaggctggatgcgatcacagcgcttcttcagtacgttctcaagatcagatgcatctcatcactggcttcaattattctgatgttagtccgatcagagagaggttgccgacaagcagtgccgggtatagggcatctgacaggacggacaattccagcccaggagaaaggatgccatggtaagttattggcgatttttattcccattgcaatgaacggtgtaatgatgaatttcaagtgtcccatttcaaacggaatatatcagatctcaggtagaggtttacctggatcactttcatga

SEQ ID NO: 7798 - DNA, 2241 bp, A.fumigatus
gtggtaagctatacgggccccccgaaccgtttgccccaatttgaatacgagcctacacaaaaagtcccgttgaaggccaacatgtggctggagacagtcataacgctgctcctccgagaaaagaattgggaaatctatagttacgtcctgacgcacctggctccgcagcttagcaaccgaggccttttccgcaacgctgttcctcaaatcaaactattacgcagcgtcatgtgtgatcaggtcaagaacgaatcgtttcgagagcccccagtatccacaggtgtcaagaaaacggacgtggctggctatattttcgattgcctctccgtactggtcagttatcacgaggtcttcgccaagagcgaggaagatgagcttgtacgcgcctttatgatgggcatcataggatcttggggtgatacatctcgcagatgtgtacatgcgctttctgtgtgttgccatgaaattccactgtctgtgacgaaatcgttgaatggcatattcgacaagatggcaaaagtgattactatgtccaacctagcagtacacattctcgagtttctgtccctccttgcacggctgcccgatgtctacgtcaatttacgcgacgaagagatccgaaccgttttcggtatctgtattcgcttcctccagacctctagagagcatcgcgtgagggccggtgactcgtcgaatcggcccagccagacctcatcacggcttgctggtggtgtcaaagagatagcgacgccaggcgagccctctgatccatcacagcaagatggaatgtcgagatacatctacactctgactcatcatgtcatggtattttggtttttgtccttgaaacttcaggatcgggcaaagcatgtcaactggattaccagcagactcattttcagggatgaatacgggcaggaaagggttgaagaacagagccaggtcttcattgatctgatgcagagagtcgcattctccgatttgggagagaccattccatatgaaacgttccctccatcgccctcggatggacccgtgtccaaaaagtcgtgggttgtcggtatgagcatagtcaccgtggagacagctggagtatctggtttgactcaaattacgaagcgacaagcttccggaaccacttatgcgatgtaccagcagcggacagctcctgtgcttcctcatcaagtgccgacctcacctgatgcgcatacccactcggacgatatgcgcactgctgtgctaccttcccacgtgctactgcagctgacaaccacagcttttcctacacccaccgtaatgcaaccaatcccgcttcctgacgacgacatgactcgcagagcgctaagcatttttgaccggaatgacattgtcgatggccataaaataggcgtcatatacatagacgacggccaaacaaccgagtcggagatcctttctaataccattggtagccctgactacgagtacttcctttccggtctgggaaccaaggtacctatcagaggagcacagttcaacacccagggattgcatccggacgtggatggcgagttcacttatgcttggagagaccgagtcacggagatagtataccacgttgcgacgatgatgcccaccgattttgatagagacccggcttgtatcaacaagaagcgacatattgggaacgactttgtcaatatcatcttcaatcggtccaatgttccattcaatttcaacacgattgcgtctcagttcaactttatcaatattatcattagtcccgtgtgccgcatcgcatctgcacctggtgccgcaactccgacgcccagtgattttgaacggacatcctacaccgtgaaggtcatgagcaagcctggactgcccgaaatctcacccgcatcgacggccaaggtcatttctggaaagaacctcgcagcttttgtgcgcattcttgcgttgaacgcatccgtgttttctctcgtatggaacagccaaggaggcgagcatgtttcctcttggcgcaatcgccttcgcgagatcaaacggctcagagaacgggcactgggctcgcagttgcaaatgtcagaggccgcggagggtgcctacccgggtcaacgacgcaacaccaagcccaacattttctccgaagaggtgccttcgcgaataacccctgtcaaaacggactttgctaccgattggaatgccgctgcagatgccaacattttgcagaacttggacttttctcgatggggccgttaa

SEQ ID NO: 7799 - DNA, 264 bp, A.fumigatus
accccaaccaaatctccatcaagagataccccaggaactgtgatcacgtttcatgtcgtgcggttttcccccattcccctcatggccgatgctctggtgttgaatcccgataacctatctcgactggatttcaaattattttctgattggaacgcttaccattttaagaatcccaatccacctagtttcaacccacggcttgtccctcttagtatttggggttttccgcttctttccaaatttccccgcctctcaagcccttaa

SEQ ID NO: 7800 - DNA, 2268 bp, A.fumigatus
  unsure (2204): Identity of nucleotide sequences at the above locations are unknown.
tttgtcgtgtcatactcggggtcatgtgtccgtgctttgggagacgacgtattcgtcctccagactctgatggctgaaacggacactcagtgtcataccggcaatggtggtctagcacggatcaggattgacgaggccagagtaatactgcaggtgtcggtagatcatatgagagatcttgctttccgacacccatctcgtgcgtctgctcttcgaggcatcttgctcaacatgctcttggggttccaccccgtggcctcgaagatttacgcgctctctgtgaatccgagagattgtgagaaatggagcgaatactaccgcaccgccatggctgatatcaaggcccatggctattttcagaagattatggccctaccatcacgtcctgctggatcttcagatagcaatcaaccgcccattatgcttaatatgactgccatattccaggagcagagggaagccgagagccttgcgagaaattaccatgaaaaatccaatatggcttactcagaactcgagaaaggcaatatcgatggatacgaagctcatctacaagagtttctggatgacagctcctcaagcggcgctcctcaagatctggtagcaacattccggctactaaccctgtcgtccttgggcgattttgagcaagcgaagacggagttgccgcgagcagtcccgaggcttttcggacaggaggaaaacctaacagagcgttgtatgaggttgttacacatggaaggccaagtgatcgatcattcaattcaaatcgattcgaaccaggctctccgggctatatccctctgcttcctctgtcgagactgggatcgatggtcctatttacttgagacgatatctcaaaatgtgccggggtacttggatcttgatgagatgcgtgaccacagtacagattggatgcttgccacatgggttggagcgatctatgatcacaatggacagtacgacacagcgttcgaatggtatctctgggcaaacgaagttatggagacccatcgtgagggaacctcggatgatgaagcgagacggggaagccaatcctccattcatggaggcgaacttttcgccggcctcattagggtttgtctgaggtacgcaagtctctcgacgacgaatccccaaccgaaagctcccatagactggggtcttccggcgccaaattggacaggacaggcattggtcttccttgagcggactttcgccaggacgctgcttgagtttctcatcgggcggtcgaaaacagatcccgaaatcatcgaagcctgggcggcttttacgtacattaaccggcaaattacagatttgaccttgttgttgcccaacaagagcgaggatgaaggcaaaaaaagtagagtggagatagaactggatcgactgagggccgagtctgagaaacgacccatgccagatgcccagatatcccaagtcacaagatcgctactctctgcaacccgtttccagattgatccagagtcaatttgtcgcgtaatccccgaggacgcggtcgttgttgaaatgaacctttcccgaggcgggctgatcctattttgcttgaccaccgccggggttgtgtccatacaccagagcgagaggacgatattggatctgcgacgacaagtcctccggtacgtcaagaggctggaaaatgaccaatgctcacgagatgagctgtccagcctgatcatgggcatatcgcgggaaattatccacccgttcgaagaggtgatctggcagaaggatcatgttatattcgtgcccacgcaagaattcaatttcttccctttttcagctttgactttcaatgacaagcccctcttcttggagaaggctgtttcccaagtgcctagccttgcgacactcgagcagattgtcaaaaggccccatcccggcatgttaccggagctctcgaccattgttaatacacacgaacccgatgcttccggccccaagcacgctggcgagcctgttccaatggttggtgttggagccgcggtcgtttctcacatcttttcagtcccaccgactgacgcgaggtaccttgaagaaaccggattcaagaacatttttgaaaactccgagatagtctacataggcacacacggtgccaagcacgagttatccccctggcagtcttgcatcaatctaaaggacgaattccgtgtcatggaggtagcgaagttttctancaaagcatccctgatcatattcggaagcatgcatgtcgggccttggccgcgttactgttggtaa

SEQ ID NO: 7801 - DNA, 348 bp, A.fumigatus
cagatactaggtgatacgagaatgcaccgcctcatatccttgatggagatagctgtcatgctacccttgtccctagctatgtacacagataatggcagactaactattgttgatggtatcaattactacatcgatgggcttcctgtatcgaggctctctgtgccactgccgcttaattcaacatggatcgacgcaggcttcgatctcatcccagtaactgtcgttcagtcaaggaatgcaaattttacctggcaggacatgcaggagaccatctcgaggttcacaatggaagacgatgtctttcaacctggattcctagaaggtaatcgttgcactcgtcttgagtaa

SEQ ID NO: 7802 - DNA, 351 bp, A.fumigatus
ctttgtgctcatgacaatatagcgatttttctaaaccacgctgcatacaaccaaggatatctgataaacgcacataacctgtctgcctatggaaatattaataagaaggtcatattcgcaacgcctggctaccattcccgggaccctattgtgcaggcaagcttggacggtgatgttcccgagggaccatactttcttgcagtggggacgggagctctttaccaggcttttcggctataccccgaccaccagctcgcgtttacagaggccgcggttagtgatggtaatggtggatttaggccattgcctgcggtgacagacgtatccatctcccacgcctggattctttga

SEQ ID NO: 7803 - DNA, 555 bp, A.fumigatus
catacatcccagctccgcctcggcataaaagacatcttcgaccttgctggcctccgcacaggcggtggaaaccgcgccttctacaatctgtacccaccgcgcaacacaacagcgcccgcaatccagcgcctcatcgacgcgggtgccatcgtcgtaggaaaaatggggactgtacagttcgccaacggcgacaatccgacggcagactgggtggattttcattgtccgtttaacccaagggtatatggccccctttgtccgttggtttctattttgccactacgcatctacgttgatattgacgctctatgcagggtgacggatatcaatcgcccggcggctcctcatcggggcccgcgtccgggattgcgtcgtacgagtggcttgatatcgctgttggaagtgatacgggcggatcaatgcgcaatcccgctggattgcaagggatctacggaaatcggccgtcaaccggagctgttgccatggagggggttttgccgctatgcgatgtgctggatacggccggggtgtttgccagggatgccagaacgctga

SEQ ID NO: 7804 - DNA, 231 bp, A.fumigatus
agacacatgaacatgagaaacaagctgaactgttgtagcgcccccactaagccgccaatgggtttcaaagacggtcgcatcgcaaccatggctggtgtgcctgatgttgttgttccctgtggcgaaatgtcatatgcctctactgtttcgctgcgaaccgagtatttgccggtgactatgattctggttggcgctaagggaatccatcttatgccttgccacctgggttag

SEQ ID NO: 7805 - DNA, 366 bp, A.fumigatus
acatacgcaatcctcacatcagtgcaccagtataagaccctggccctgtcttttttcacggactacgcagccaaacacaacggcagtcaaccctacataaatcctgggccgcgtgtccgttgggcctggggccaagagaacggcggtgacacaggctacgagatggccctccgaaacaaaacaatattcaaagactggtgggaatcacatggctatggtgtacccaatgaagatacctgctcggagggtatatacatctatccctattccacggggaagacgcagtatcgggatgtttataccaggtacgtcctctattcctcgagacattgcaccgacgtcgaagaaagctgtgaagacacatga

SEQ ID NO: 7806 - DNA, 534 bp, A.fumigatus
cgctctatgcagggtgacggatatcaatcgcccggcggctcctcatcggggcccgcgtccgggattgcgtcgtacgagtggcttgatatcgctgttggaagtgatacgggcggatcaatgcgcaatcccgctggattgcaagggatctacggaaatcggccgtcaaccggagctgttgccatggagggggttttgccgctatgcgatgtgctggatacggccggggtgtttgccagggatgccagaacgctgagcaccgtgcttcatgcgtggtatcaggactcggacaaggcgtataaaggatatccgaggcgtttgttttaccccaatgcatcgtttcctgatagtacgacggaagctggggctcttcttgaggaggttgttacaggaattgaagggttcttaaggttgagaagggaagtcgttgatacaccttcacgatgggcggagacgcatccgtctgggacaccgagtaatatcacacaactattgaacacggtaagctcaataggcttgaccacaaagtcatggtaa

SEQ ID NO: 7807 - DNA, 249 bp, A.fumigatus
tgtgaggattgcgtatgtctaataggcatcgtcagttaccatgactttgtggtcaagcctattgagcttaccgtgttcaatagttgtgtgatattactcggtgtcccagacggatgcgtctccgcccatcgtgaaggtgtatcaacgacttcccttctcaaccttaagaacccttcaattcctgtaacaacctcctcaagaagagccccagcttccgtcgtactatcaggaaacgatgcattggggtaa

SEQ ID NO: 7808 - DNA, 252 bp, A.fumigatus
cgaggccagccacggaacctgttactaacaggaatgtggcagaaaggagatacccccctgctcgaggactttgagattattaaatatcaatgtaacatggccacggaaactcccatgaagagtcatgtcgacaacggacatttatcccctcacggcacagatccctgcacatgggcacaccacggcgcaacatcagtcgagccggggctagattccctgctcgagtctcgcaaccgcaaggatgatgcatga

SEQ ID NO: 7809 - DNA, 318 bp, A.fumigatus
tccctgtctctctgttggacgctcttcatttatgtgccggtcttcctgccctcggcccctgacgcagactgtgcgatatgtgtccgtctgcaggccatgcctctgtttagcgattatggggatcacccagacagctctgcgcggctgtcctatccatcgctggtctttgccattgtcactcctctggtggtgattgcaagactgcttggtcgccggttcctttccggccgcgttggcgctgatgactggacgattctggtctcctgtgtgcgtatcagcaatggcgggtggttgtccacgtatattgactcctcgtag

SEQ ID NO: 7810 - DNA, 555 bp, A.fumigatus
tgcagcacggctaatgaacgagtagtctgcggatgggcgtttggcaagcaccagaatgagatgcccaaggaactggtcctccgaacactaaaggtgagtccgtccaacgcagatcccctggcgactggcagctcacagcgacagctctatttcgtggcccagatcctctacaaggtcaacctcggcttgaccaagatcagcattctcctcttgtacatccgactgtttgtccatcaatggttcctgcggacctgctgggtgtggatcgccatcatcgtctccttcaccatcggcaccgtcttctccagcatcttccagtgcaccccggtgcaatgggccttcaacaagtccctcccagaccgcggcacctgcatcaacatgacggccttctggtacgccaacgccgcattcaacatcctcaccgacctggtcgtgatcgcgctgcccatccccgtcgtgctgaagctgcagctcccgcccaagtccaagatcgccctctgcggcatattcgccgtgggtcttttgtgggttgcctccttgggtccatgcatctga

SEQ ID NO: 7811 - DNA, 243 bp, A.fumigatus
ctggtactggatactgatgttctgaccggcagcacctgcatcacctccgtcctgcgcatcaccaccctcaacgtcgccaccaaccacctcgacaccacctggaacagcatcggctcgtccatgtggaccgtcatcgaatccaacctcggcatcatctgcgcctgtctccccgccttgcgccgtccgctctcctttttctttcctcggctcttcagcagactgcacaagagctctgcggcaccc

SEQ ID NO: 7812 - DNA, 495 bp, A.fumigatus
gaggtctcttttttctcctccccagtcgtctcaaaacgcatccgtatcagttcctcgatcctaggacaaagttgcttggccgcgatggaaaaacagcctaatcatgaggttagccagacaggcagtagcctggagactgcggcccccgagatcgaggtcaacgagaagcgcgagaaggcgcttctacgtaagatcgacctgcatctgatggtgccgctctgggtcatcttcgtgttcggcttcctcgatcgaatcaacctgggcaatgtggcggtgctggggattctccaagagttgaagatggacggcaaggataatggcgcttgccatgcaagatcttttttcggccccgatatcaatcgcggatatcccgaaccatattgtgcttcaagcggtttgcgccggccaaccctgaacaagggtttgaactttttgcctgggggaagcaaccagactccccctctcctatgtaatcccttctctactttagatcgg

SEQ ID NO: 7813 - DNA, 669 bp, A.fumigatus
gggtgccgcagagctcttgtgcagtctgctgaagagccgaggaaagaaaaaggagagcggacggcgcaaggcggggagacaggcgcagatgatgccgaggttggattcgatgacggtccacatggacgagccgatgctgttccaggtggtgtcgaggtggttggtggcgacgttgagggtggtgatgcgcaggacggaggtgatgcaggtgctgccggtcagaacatcagtatccagtaccagttatcagatgcatggacccaaggaggcaacccacaaaagacccacggcgaatatgccgcagagggcgatcttggacttgggcgggagctgcagcttcagcacgacggggatgggcagcgcgatcacgaccaggtcggtgaggatgttgaatgcggcgttggcgtaccagaaggccgtcatgttgatgcaggtgccgcggtctgggagggacttgttgaaggcccattgcaccggggtgcactggaagatgctggagaagacggtgccgatggtgaaggagacgatgatggcgatccacacccagcaggtccgcaggaaccattgatggacaaacagtcggatgtacaagaggagaatgctgatcttggtcaagccgaggttgaccttgtagaggatctgggccacgaaatagagctgtcgctgtga

SEQ ID NO: 7814 - DNA, 1023 bp, A.fumigatus
ccgatctgcttccccaaaccagatgactggtccaacgtcgagaatagaccgagtccgacagcccagatcgtccagccgaagaggatgcattccctgtaccggccgatccagtggacgacgagtccggaggcggtactactggcggctaccatctatcagcccgtgtctgtctgcaaggggaggagaggacatactctgcaacagtgtgatgggcagcaacatggcgccggccttgacggtcgagtacccaaagaccagctggtagaaggtcgggatatagtacacctgcaccaggaaattccatccattgataaacatggtcagacacgcgccgttgacgatccgcgagcggaagatatgcatcgggaccagtggaaacgcggcccctttccactgccacagcacgaacgccacgcagacggccacgcccacgacgagggtagcaatcacatgcgccgagtcccaggcgtactcgcctccaccccagttcaggcccagcagcagtacagccgtcccgctgagtgccagcgccgcgccgacaaaatccaccgccgccagcttcaccttccacgagcccgtgaccttgcgcaggggcatgaagaagaacacgcacagcgtcgtgagcacggtgagtgggagattgagccggaagatccaccgccacgactccttctcgatcgatgcggatgcgagcgcgcctccgatcacgggcccgatgccgttcgcgatcgcgaacactgcgccgagaataccctgatatttacctctttcgcgcagcgggaccacgtcgctgacgatcatctgggcgacggtcataaggccgccgccgccgatgccagtgaaggcgcggaagatgatgagctgggtggctgtttgggcgagggaggcggccagcgagccgaagaagaagatggcgaggccggcgaagaggacgtatttgcgggaccagatgtcggagaggcggccgtagagcagttggaagcaggtggatgtactggcttgtcagcagcacgcaggacttga

SEQ ID NO: 7815 - DNA, 213 bp, A.fumigatus
tatttacctctttcgcgcagcgggaccacgtcgctgacgatcatctgggcgacggtcataaggccgccgccgccgatgccagtgaaggcgcggaagatgatgagctgggtggctgtttgggcgagggaggcggccagcgagccgaagaagaagatggcgaggccggcgaagaggacgtatttgcgggaccagatgtcggagaggcggccgtag

SEQ ID NO: 7816 - DNA, 186 bp, A.fumigatus
gacaagcagatcttcctggcatgctcaacggtcgatcttgtcgccttgatggaccagacgaccctcgcggccagtttgtccatcgtcggcaacgccctgaacgccagcaaccagacgtcctggatctccggcgcctattttgtgtacgtcaaaatcctcgcatcatcaagtcctgcgtgctgctga

SEQ ID NO: 7817 - DNA, 867 bp, A.fumigatus
caagccagtacatccacctgcttccaactgctctacggccgcctctccgacatctggtcccgcaaatacgtcctcttcgccggcctcgccatcttcttcttcggctcgctggccgcctccctcgcccaaacagccacccagctcatcatcttccgcgccttcactggcatcggcggcggcggccttatgaccgtcgcccagatgatcgtcagcgacgtggtcccgctgcgcgaaagaggtaaatatcagggtattctcggcgcagtgttcgcgatcgcgaacggcatcgggcccgtgatcggaggcgcgctcgcatccgcatcgatcgagaaggagtcgtggcggtggatcttccggctcaatctcccactcaccgtgctcacgacgctgtgcgtgttcttcttcatgcccctgcgcaaggtcacgggctcgtggaaggtgaagctggcggcggtggattttgtcggcgcggcgctggcactcagcgggacggctgtactgctgctgggcctgaactggggtggaggcgagtacgcctgggactcggcgcatgtgattgctaccctcgtcgtgggcgtggccgtctgcgtggcgttcgtgctgtggcagtggaaaggggccgcgtttccactggtcccgatgcatatcttccgctcgcggatcgtcaacggcgcgtgtctgaccatgtttatcaatggatggaatttcctggtgcaggtgtactatatcccgaccttctaccagctggtctttgggtactcgaccgtcaaggccggcgccatgttgctgcccatcacactgttgcagagtatgtcctctcctccccttgcagacagacacgggctgatagatggtagccgccagtag

SEQ ID NO: 7818 - DNA, 627 bp, A.fumigatus
gaccagcctctcctacgattacctcacgagcttgcacggcgaaacttcaaatctgttcaacgacttgtcgagagggaaagggagtatgtcattcccgccctcaaagaggccgccaatgcctccctgtcaaatgctcagacaccggatcaaactcttgcggctctcgactctatgttggctcgcatgcaaaacctgaaacgtaaaatggaaagtatccagcaagaggagaagaaagtccaaaaccagtcacgaaaacgtatacagcatctggagcatctgcaccaaattcccagcctggcagatgtcaaatatgaccagtggtccaggatcaggctggataggctggtggttgatcacatgctgcggtctgggtacactgagagtgctcagcagttggcccaggagaagggtatcgaggacctagttgatctggatgtcttcgtacagtgccaaaggattgctcagagcttgcgccgtggggaaacaaaggacgctttacagtggtgtaacgagaacaaagcggcgttgaagaagagccaggtatgtggagtacacatgaataatagctgtgtctcggatccagtctcattctctaacaaaccagacacagttcaatctagagtttga

SEQ ID NO: 7819 - DNA, 456 bp, A.fumigatus
atactccagctaaccgaccttcagtcgatgtactcattcgaccggtggaattacctgtctgacctcttcatccggacccatcatgaacttctatcgttgccttcaagcccgttattacatattgcattgtctgctggcttatcggccctcaaaactccatcttgccactccgcatatacttcctcgagctctaactctttatctaccacaacatccgtatgccccatatgctcgaccgagctgaatgaacttgctcgtaatatgccgtacgcccatcatgctaagagctatgttgaaagtgacccgattgtcttgccaaatggcaggatttacggtcagcagcggctactagacatgagcaagaaacttggctgtgtcgaaacaggcaaggtgaaggatcccaccaccggcgagatcttcgacaagagtgagatgaaaaaagtttacatcatgtag

SEQ ID NO: 7820 - DNA, 2283 bp, A.fumigatus
acacgctgggtaaaaagtctcagttttattggcagcatcaatggcaaggtttatgatttgaccaggtacatcgctggcggtcggctgacgaaagcacttcccggcgagacggttccttcagatgttgacactgatttcatggacaacagtgttgtgtcgctcttccaatcgcttcctggccaagatctgtcaaaacactgggaaaatttgaagatcgacccggcgctgcgtcgccggatgcaactttgtttggacaaccttttcttcgtcggtcatgtggacacgcgtaactcagctcagtgcgagttcgctcggtacttcatcctggttatatcagttcttatttgctcgattatcgtcttcaagttccttgcggctctacaattcggtaggaagaacgtgcccgagaatttggataagttcatcatctgtcaagtccctgcctacacagaagacgaggaatctcttcgccgtgccattgattctatggcacgcatgcggtacgatgacaaacgcaagcttcttgttgttatctgtgacggtatgattattggtcagggtaacgatcgtcccacgcccagaattgtcctcgatattttaggggttccggagtcagtggaccctgaacccctcagctttgagagtttgggagaaggtcagaaacagcacaacatgggtaaagtctactcgggattgtacgaagtccagggtcacattgtccctttccttgtcattgtcaaggtcggaaagccctcggaggtttcgcgccccggtaatcgaggcaaacgtgactctcagatggtgctgatgagattcctgaaccgtgtccactacaaccttcccatgagcccgatggaacttgagatgcatcaccagatccgcaacgtcattggtgtcaatcccacgttctacgagtttatcttgcaggttgatgccgatacagtcgtcgctcctgattcagcaacacggatggtggctgcgttcttgaatgatactcgtcttattggtgtctgtggtgaaactgctctgaccaatgctaagacttctgcggtgactatgattcaagtttatgagtactacatatctcacaacctcacgaaagctttcgagagtcttttcgggtccgttacgtgtttgcctggatgtttcacgatgtatcgaattcgctctgcagaaacggccaagccattgttcgtcagcaaggaggtcgtggacgcttacgctgagattcgtgttgatacacttcacatgaagaatctgcttcatctgggtgaggatcggtacctgactacacttctcctcaagcaccactccaagtacaagacgaagtacatctcgagcgccaaagcctggaccattgctcctgaaagttggacagtcttcctttcacaacgtcgtcggtggatcaactccactgtccataatcttatcgagctgattccaatgcaacagctttgtggattctgttgcttcagtatgagattcgtggtgttcgttgacttgctcagtactgtgattcaacctgtcactcttgcctacataatctacctcatctactggctggtcaaggacacatcgacgatcccctacacttcattgattctacttgccgccatatacggcttacaggctcttatcttcattattcgtcggaagtgggaaatggttggatggatgatcgtgtacctcctcgcgttgcctgtcttctccctggccttgcccctctactctttctggcacatggacgactttacctggggtaacacacgtatcatcacaggagagaaaggccgcaaggtcgttatctctgatgaaggaaagttcgatcccgcctcaatcccgaagaagaagtgggaagagtatcagacagagttgtgggaggctcaaacttcacgagatgaccgatctgaagtttctggtatctcttacggcaccaagtcttaccatcctgctcagtctgagtacggtttcccaggctcgcggcccatgtcacagctggacctacctcgtttcggatctcggatgtctttggcgccatctgaaatgatgagccgacacgcggacatggaaatggagaatctgtcccacttgccaagcgacgatgccattctcgctgagatccgcgagattctgcggacagccgatctgatgtccgtgacaaagaagagcatcaaattggaactagagaggcgcttcggcgtcaacctggaccttaaacgtccttacatcaactcaggtaagggctatacgtttccattccctgtattgcgtacagtatgctaa

SEQ ID NO: 7821 - DNA, 429 bp, A.fumigatus
aaggaagactgtccaactttcaggagcaatggtccaggctttggcgctcgagatgtacttcgtcttgtacttggagtggtgcttgaggagaagtgtagtcaggtaccgatcctcacccagatgaagcagattcttcatgtgaagtgtatcaacacgaatctcagcgtaagcgtccacgacctccttgctgacgaacaatggcttggccgtttctgcagagcgaattcgatacatcgtgaaacatccaggcaaacacgtaacggacccgaaaagactctcgaaagctttcgtgaggttgtgagatatgtagtactcataaacttgaatcatagtcaccgcagaagtcttagcattggtcagagcagtttcaccacagacaccaataagacgagtatcattcaagaacgcagccaccatccgtgttgctga

SEQ ID NO: 7822 - DNA, 237 bp, A.fumigatus
atatcctccgataggattcttcccattctggctcttctttttctatgttctttccttgacaggtggggaaacagaatgcctctaattagtgccagactgaagattgatccaaacgttccttccaggacaaacgtgggaaacgcaaagattcttggtctccaaaatgatctgaacatcactggtcatcagtatgacataggccttacggtcttctatctcacatatatttgcaggtga

SEQ ID NO: 7823 - DNA, 294 bp, A.fumigatus
acgcgtgccgatagcgagctgccgagtaatctgataatcaagaaggcgtcaccgaagatctggctacctactctcacgatggtctggggaattatcaccatgtgtctgggttttgtgcgtaattttgctggctttgttgctgtccgtgccatactcggtgtggctgagggaggactgttgcctggcatggtatgtgaggcgtatcccggatccttctctcagctactggcgggctctgttccagtgagcgagactaagactccgtcaggtactctacctgtctttcttctataa

SEQ ID NO: 7824 - DNA, 222 bp, A.fumigatus
tctcaaattctcaattgctttcattctcaatgttctctctacaatttgccccagcatctagccatggatacaatgaagcctagccacgagacattggaagatgttagacataagtcactagataacatgtcctttggtaatgcctaccaacaaaagctaactcgaagcattctattcaagctggacacgaggttggtccgcttcgatgtctatggccaataa

SEQ ID NO: 7825 - DNA, 201 bp, A.fumigatus
tcacaggtgggctctttgatcatcaaccgatccaacatgtactcagtcgctgaccgcatgccttcctcttccccagttattgtggctctcatctcggaccggctgcagcttcgtggtgtaattatgctctttatcctgccaattgcgattgctggttacggagcaattgccaacattgagtccgtcagagtcaaatatggg

SEQ ID NO: 7826 - DNA, 630 bp, A.fumigatus
  unsure (51): Identity of nucleotide sequences at the above locations are unknown.
aagacaattccctcgacgacatcttcggctcgtccccaccccacgagggcngaaaaattctcccaacaagcgtcaatagaagcacccgaaccctcggatctcccctctctccgccggcaacacgtcacagctggctaccgcgacggcgtctccgccgcgaaaggcgagcacgtccagcacggcttcgacgccggcttcccaatcggcgcacagctaggcatgagagcaggaacagtaatcggtatcatcgaaggcttactgcgtggattcgagagtcccactgcgtccagagcagtaaagaaaccacttcagcggaaagaggaagggcaggggatcgagccagacgaagcaaaagcagcgcggcaggcgaagagggagcagctgctcagattgtatcaaaaagctgtgaaggagctggaggttcggtccgtatttgcagggagcgaggatgagagcacgcgagacaacggggggcaggagaaaccatatgttgttctgcgccggaaaggggacgccgtcatttcgcagtgggaggaacaggtcagggtggcgcattgggaggagaacatggctgccctggagccaaaggaggatgagaagcgcgcgtcaacgccgacggagcagatatga

SEQ ID NO: 7827 - DNA, 309 bp, A.fumigatus
cctagacacacgctgtatatttcctgctaccggactgtggaacccttgatcaattcgcctctcccgcacgccaatgcaagacataaccgagacattattgaagtaattgcactgcagctgcagctgcacatccaacacctaaaagccactcgacccgcccgcaacacaaccctcctcgttgtacctaaagctagccacaactacctagaaagaggagaggggcaaattacccagtaccccgtaccaccactagagggctctggcggtcctaaccagcaaagtatcgctcccttccaaggaccaatgtag

SEQ ID NO: 7828 - DNA, 399 bp, A.fumigatus
cgattgctcgtagtcttcacgtttcgctgccaaggcgtctatccagttggaaagtcaacgaccgcgacgtctgaaagcaaacccagaccatacctgaaccagtcccttggttcgagacttgcttctttcgctcgttattacattcgattcctcgtttctgacaagagctgcagggatttaatccatcgcatcgcagtttcatcgacgtgcactaagggcaaagggatgattagcggccattttcacgcaactaacggcaatgtcgaattaccgattggcaagcatgtcgccttctccctcgctgtcccgtatcagggatctgccgatccccccttttcgggcaatcggagtagtggtcacgaacgttgtcgctgcagcatggtcacgggcaaatgttag

SEQ ID NO: 7829 - DNA, 963 bp, A.fumigatus
ctttccaactggatagacgccttggcagcgaaacgtgaagactacgagcaatcgtcagatcgtggatcgatcaaatttcttctcaatggcggtaccgatagtttcacgcagcaattcctccttccaccccgcagcgatcgaacacgcagcctggaatatcacaacaagaaaagtctcgaagacgcagggagttccattctcggatatgagttgaaagatagccggacagattatgcgcccacattcatcgagtccgacgctgctaccttgagcttcttccaagatactttcattgactttttcaacgggccctttggcgatcctcacaagctactggacgacccctatgtcgggcaggttgcctaccatgctgtcgttccgcccggacaggatcccaacctgacactcacggggcaacagcttagctacgaacctgaacggcccttcgccaccggaatgatacaggctattctcgcaagggcctggtccgtgccccttgacgcgaaggctcaacaagagctgtcgacgaatcttaatttccttctgacgacaagccgtattcgcaagtttgtggcaatgtactttaagtactggcaaccgagctgtgcgatgcttcatcgcacgtcgttcgatcctgagattgtgtcattaccgctacttacagccgtcacattcatgggtgccatgtacaccaatgacgagagggaggcatatattgccaagcgagtgctggatttcgccgagctcttcatcttctccagcgaggtttatgcgtccgagaccgagatcagctcgatgttttgcgggaatcgatgtttggacgacgagtccagcgactggattcagtttcagaatttccaagccggcttcatcattgtggttgtgcaatactgggctggaagtcgcatatcgcgcaatagagtaatggagaacaggttcagcgaagtcatcaaggtgggttga

SEQ ID NO: 7830 - DNA, 249 bp, A.fumigatus
tcaactgctgctgcaagcgctgctgctgagcagccaggaagagattggtcgacatcagttccgcgtaaagagtctcgtccatcggcatgtcacccgcgatgtcgatggccggcggtgcaagcacctgttccggtagagtgtacatcggccgcccgtttcccatgtccaaatgttgattggtggcaaacgagcgccggggaaagccagctcctgtcgcagtttgcggaacacgatcagctgtgccactag

SEQ ID NO: 7831 - DNA, 273 bp, A.fumigatus
tttccgatctgtaagaaagataatatgaacgcgtggagtgtgctctgcaaccccagcaatgttgaaggacgcttgacgcgcgataagcggaaagaagctctgacacaaacgatggccaaagccaaggaagagcagaaaagtcgacgcgaagcggaggtgtcacttcgaaaagaaaaggaagactttttgtttttttaccctctattaaacggttttattatgtctcccggtatcccgcacaagaaagaagaattggatgtttctcagccgtga

SEQ ID NO: 7832 - DNA, 270 bp, A.fumigatus
  unsure (2),(12),(13),(34): Identity of nucleotide sequences at the above locations are unknown.
cngggaggggannaaaaaaaaacggcacccatcntataccaatacatttctcttctctcctctttttataatttttttttacttactctccttttgatacatctccatcctttctcttccctccctccatttaactccccttatttttcttcgctttcctttccattatttttttcccatctcttcccggtcaaatacattttttggaaacaaccaaataacaatgtctactcatactttgctcctcgtaggctaactgtgattggttag

SEQ ID NO: 7833 - DNA, 810 bp, A.fumigatus
atgtgcctcctccacatatttctaccatcgacgagtcccagcgttcggcgccggttcctcataccccttcgtactagccggtcccatcttttggcgggtttgagaactgctcccaaatccgcgaccctaccgtccgcgtcacaacgtcagcagcatcttggcctggaaacagggcgatatggagcccatactagtggcacagctgatcgtgttccgcaaactgcgacaggagctggctttccccggcgctcgtttgccaccaatcaacatttggacatgggaaacgggcggccgatgtacactctaccggaacaggtgcttgcaccgccggccatcgacatcgcgggtgacatgccgatggacgagactctttacgcggaactgatgtcgaccaatctcttcctggctgctcagcagcagcgcttgcagcagcagttgatcagcgtcaccgctgcagcacagcagtttcagggcctcaaccttggagcgtccatgggccaagcccctgaaatgccctctctctccgttcccgccatgggcttctaccagcagcagctccagcagggtgttcaacctgtggtgcagcccgttcctggtcaaccaggactattttctgtttataaccctctaactggccagcacaattatgtttatgacaacagttatatgcaagagaatggttcctcgccctacgttgaagacgaggatcaatcgcccgttatgcagactccagccttctatgcagaggtgtctcccccatcggaatcagtgcagtcccctttggaaaggcagcagacggtgtcaccccca

SEQ ID NO: 7834 - DNA, 375 bp, A.fumigatus
ataactcgttgtattagcctcgcgccgacaacttggtttcccagtcctcgtcgcccccaatgtaccgaaagaccacccgtgagtccaggtcgtgacacctttcaacgatttctctttacgatggtccccgagggacgacacgtgcgaagcgtgtatctcgactcgcacgcaggtgtgctgaccacgtcggtggatgacaagatcctcgtcgactgctccaccatcgacacagcgacctcgatggatgtgggcgcggctgtctgccagaattccaagaccgcagctttttacgacgccccagtctccggagggtccctaggagccgtggctggcacgctgacattcatggtgggttgcgtggcggatgacccgaac

SEQ ID NO: 7835 - DNA, 1092 bp, A.fumigatus
gtcccttgtggggtagtaatgcgtaccccacatatcaccttggatgctagctgggccagttgcccaaggcagaaacagacagaaaagaagaagagaggaaagacatcctcaggacacccagatcaatccgggatgattgcccagcctctacagtcccaacgccattccatcagggttgtcgcccagatgggtgatccgcttccagcacccattgaaggccaggcgtatgtcacggtgggcccaatcaatggaggtctgataacgctcccagaacgtgcattcgtctctcccagcggagatgctgcggttaccgttccctcgctaagctttctcatcacgcaccccggcagcggaagcgagaaaagcccacgacacctgctcttcgacttgggactgcgagcgacgctgggggactatatgaaggagcagcaggcacacttggagctgcgccgaccctgcctcctcggtcccggagttgcacagtcgttgcaacggtcaggcatcgatccggggaagatcgacacgatcattctcagtcacgtccactacgaccaccacggcgatccggcgcatttcccgaacgcacacttcttcgttggggctggttctctcaaactgcttgacgaaggacttggaattgcagcatcgcatcagttcttcgatccggacctgttccgcaacgtcctccgtgtcagcgagtttccctcgccaggcgcctcgccatggagggcactggggccattcgcaggagccctggatttccttggggatggatccgtttacgtcattgatgcgcccggccacctgcctggccatatcaacctcctttgccgtgtcggccccgacacctggatgtatcttggaggggacagttgtcacgattcaaggctgcttacgggagagcggcaaatcgcgacctgggacgatggccatggcaatacgggctgcattcacgttgatcagacgagggcagaggaatcgctgtcgcgtattcgccggctgcaggagatggaagggcacaaggtcgaggtggtcatggcgcatgatgtagagtggtggagcacgaatcaacatcgcgctctgggactatga

SEQ ID NO: 7836 - DNA, 312 bp, A.fumigatus
tcgagagtcaacaacatgcatctcatcctcaccggcgccacgggcctagttggctccggcgtcctcgacgcaatgctggcgatgaaagaagtcaccaaaatatccatcctcagccgacgaccagtgcaaatggccgaggacgcccatgacccccgagtgcaggtcatcctccaccagggctttgaagcctacgaccctaaagtcctctcccagctgcagggggcaacaggctgcgtatgggcactgggtatcagccaaacaaaagtcaacaaagagtctgtctgcgccttgtcatttgagagaaactactga

SEQ ID NO: 7837 - DNA, 201 bp, A.fumigatus
tctgcctttaagagttcacctatgtgcagcgcaattgctctactgctcactgctcaggaatatggatatggtaccatgcttgagggtgggatcagttcctctcctagtatcctgagatcttcaaacatttgcaatatgaacatttatacacacgcctatcctcgtcttaaaccagccggctgggcggatcaacgatcggaa

SEQ ID NO: 7838 - DNA, 567 bp, A.fumigatus
  unsure (468),(471),(472),(481): Identity of nucleotide sequences at the above locations are unknown.
ggtggtcttattaccgaagagtccttcacgtccgtttttcctgagatgaaagacgccaacatccagggtatcgtgatcgcctcttttgaacttggtgctcttgccggtgccctcgcgtgcttggacctgggcgatcgcctcggtcgtcggctgaccgtttggttcggcatgctcttcatgttggtcggcggcacgctacagaccagtgcctgggcgctatctcagctgacggttggtcgcgtcctcagcggcatcgggctcgggttacaggtagccacgatcccctcatggcagtctgagtgtgcgaaagcgcatagtcgcgggcgttgggtcatgattgagggtggtctacagacattcggcgtcgcctgtggccaacttgttggctatgggtttttttttgtaaagggacaagcacaatggcgtgcccccgtcggcatccagctcattccggccttgatcgtcttngtnntcatcaatntccttcccgagtcccttcgctggttgatcaagcacggtctggttgaagaggtgtgcattctctccatgatggaggtttctcgctga

SEQ ID NO: 7839 - DNA, 795 bp, A.fumigatus
tggaggtttctcgctgaccgtacaaacttgcagggcgcgtacaacctgtccaagctccgaaacctgcccttcgaccacccggagctgatgtttgaacgcgatgccatcattgcttctttcgaagcgcagagcgaactcgctccgttctcctatagagagatgctgcgcaacgggaagaccaagatgttccatcgcgtcgccattggattcttcatgcaatctgcgcagcaattgtccggaatcaacttggtctcgacatacgccaacaagattctgcaggagtcattcggcctcgcggccagcacatcccacctcatcgctgccatgggagggctggagtatgccgtatgctcgcttctgtccgttttcctcatcgaaggtcttggacgccgtcgcgcctttctgtggactaccgtcggcatgtccagctgctttgctgtgatcgccgggcttcaaagcacggattcgcgcacctgtcaactgaccgctgctggattcctgtttctcttcaatactttctttggcctggcctgggtcggaggaccctttctgtacagcgccgagattgcgccgctgcgatgccgcgcccaggccaacgcctttgccagcgctggcaactggttgttttgctttgtggtggtcatgatcatcccccctgctttccagaacatcggctggaagacggtacgactacttcgcgttcctcattggccgtcatctaatgtgcgtctagtatatcatttttgccattttgaatgcctgcttcgtacccatcatctactttttccttgttga

SEQ ID NO: 7840 - DNA, 249 bp, A.fumigatus
attcaggtcggtgggaatcaagcaggacgctcagttgctgtctgtgatatgttccaagtcaaaatctcgtcatccgtctcaatcatggccatcttcccattgaccagatacacagcccacatgggcgcgtccggtctgacgctcaactttctcgtcgcaggcattgcaacatgtgcgttttggctttttggctacgacatgagcgttatggtatacctccttcccaatgggacatgcaccccggtctaa

SEQ ID NO: 7841 - DNA, 270 bp, A.fumigatus
ctcggatcagcgcagctgcggagagggccccgaaccccgaagcacgttctcctacagtgtctatcataccaagaggcctacaggaagatggccaataagctacttaatatagaggggtccctccagggcaaaataacagactacaacatgctcatgtttgaccctcaggcagttcactacattgctaaattaatgcacagcggcaagcacggccaaaaacgtggaaacctcctacaaggttcaggaatggacgtggaagactctagttag

SEQ ID NO: 7842 - DNA, 1905 bp, A.fumigatus
gttgctcgagcattaacatatattcttgctaggttcgttaactcgttgggcgccaaggtacactcctctccaccgaccattgagaaaatatctcagcgctttcaagacttttacgttcgggctgaatcgcacattgctactcatatatcagccctagcgtctcgaataaaccgtgatccttctcctaaccctcccccgccccgtgcttctcgcttcggccagtctaaatcaacaaacagagattcaggcaatgttccgtctagccggcagatgttgacagcatcagaggttgctgaacggcggaaggcacgaaagtcgctcgcttctaaaggggctgccctggaagaagctatcgagcgaagagcttgtgaatgcgtctacgacagaatctggaggcataagagcacattggatgaagttcgggatgagaagttgcgttcaaaaacagcagcattactcttggttgggatcaacctgaaagacctagggattgacatcgatatggccactataaatgaagaggatcagaaagaggcggatcaatgcctctccgttgcccgtaaatgtctggcaagaatgaatgaagcgaaatatcctttggggaagcttcagcatctggctggcgcacacaaggctattgttgatgcattgacaaagcttcttccttcgtcctcctcagctgatgagattttgcccaccttgatctatacgcttatcacttgcccgccagaaggtattaacatcattagtaatcttctcttcatacagcggtttcggtcgacaaagaaaatcgatggtgagacggcttactgcttaacaaatctcgaagctgcaatcagcttcctggaaaatgtagaattatcggagctacgagcggacgaaacgcaggaaggaaaacttcaactgagcaatgagacaataggtactcctgacagccttgacacccctcaccagatgagcaaggcccccgtgtctaccgtcacaaaagcgaacgcttctccagagatctccaaatcagatgctaaggaagatgctgccgaaggactacttaagcaacagtcaccagcgacgcctcaacaacctcgtctgaacaatttgttccaacctccgtcgaaagtgcttggtgctgccaacgatgttgttcgcaacactgccgatcaagggttgaagaatattagcgcatcgctggacagcagcttcaactttctgttcggccgtcttaaggagctgcaatccagccaactgtctgccaaagacggtggcagtccaatcctgccgaagacactagcagaagctcgtcgtcttgtcacttctccgccttcccttgataagggtgtctctcgggataatggagggggcgattctttagcgactcctgatcgacccccactgcgacgcatcggctcaagggcggaagataccttcatgggtctagtcagcggacacaggacccctcgtgatcgtagcacggacagtgtgaggactcaggccagcttgaaaacggccactgccaccacgggtgcgctaaaggatgagccttcgtcagctgcctctcaaacgaaccctttgcctaccacccctctagagtcaatgaggaactttggaaacagcatcaatccgcttaatcatattccggggatgatacggaacttcgggcgcagcacaccagactcgggaggaagtttcgccgctcttgctccttcagagaagacgaagacttcaccttcttctcgagaagtccccgggaataacagcagtaaccagcctaagatcgatccgcctattcaaagatttctccaaacccaacatgccaacgaactgacaataggtgatgtagtcgtgttgctcgaagactacaaacgccttgcagcagcgttactcaggcaggcttcggattcgagttaa

SEQ ID NO: 7843 - DNA, 1923 bp, A.fumigatus
  unsure (1651): Identity of nucleotide sequences at the above locations are unknown.
gccaaccttacgcggattttggcccctgtggtagaaaacaaggggcgagccttcgtgtggggtctcgtaaagtggtgcggtatcggtaccctcgcttcttataccaacgccatgatcaagttcctgcagtcgaaagtctctatcgcttttaggacacgcctcacgaggtacatccacgatctctacgtcgcggacaacaactactacaaactgttgaacttggatggtggtatcggtcaaggagcagaccagttcatcacgcaggatctcacactcttctgctcggccgctgcagcactttactctactatgggaaagccactagtggatttattcgtcttcaactatcagctgtactgctccctagggcctttggctcttagtggcatcctcactggttatttcagcaccgcagtgatacttcgcaagttgtctccgccttttggaaaactcaaggctgtcgagggcaaaaaagaaggagacttccgaggtctgcattccaggttgcttgccaatgccgaggaaatctcattctatggtggtgcagatatcgagcgagtatttctccttcggagcttcaaagatctgcaacggtggatggaaggcatctatagcctcaagatccgctacaacatgcttgaggacgtaatcctcaaatacgcctggtcggcttttggatatctaatcacgtctttgccggtcttccttccggcgtggggaggtgcagggggtgctttggagctggcaaatgcctacgaagagactggtcgcgaacggggccgcatgaaggagttcatcacaaacaagcgtctgatgctttcgttggctgatgctggtggtcgcatgatgtacagcatcaaggatatttcggagttggccggctacacctcacgggtctatactctcatctccacacttcaccgagtccatgtaaatgcctactatcctccacgtggctctcatgcggaactgtactctctggcagatgcacagggtaccattcacaacggattcgacggtgtgcggctggaacaagtgccaattgtcgctccggctctccatcctcgaggcggagacgagttgattgaatcgctgtcctttatcgtgcattccggtgagcatcttcttatttcaggcccaaatggagtaggcaagtcggcgattgctcggattgtcgcgggtctgtggcctgtctaccgtggccttgtcagccggccccgaggattcgggcttgacggcatcatgttcctccctcagcggccctatctcagcgtggggactttgcgagatcaagttatttaccctcacaccgagattgacatgcgcgaggctgggagaacagatgctgaacttcagaagatcttggaagatgctcgtttgggatacctgcctgcccgtgaaggtggctggaatgctcgcaaagagtggaaggacgtcctcagcggtggtgagaagcaacgcatggccatggctagactattctatcacgagcctcgctatgcgttccttgatgaaggaacctcggcagtttcctccgacgtcgagggcgtgctgtaccaacaggccaaggacagaggtattactctgatcacgatttcgacacgcgcgtccctgaagaagtatcacacctttagtctcacactatgtctangcgccgaaggggaacagtgggagtttgagaagattggcaccgagaaggagaagctgggcgttgagaaggagatccaagagcttcgcaagcggttggacaaggtcgacgagtggaagcgacgccgtgaagagattgacaaggagctgcataaggtctgggccgaggagggagagcttgcacctccaccgtacgaactggggaacgaagaagccgtggctgaagtatcaaatgaagcaacggaagaggccaacgtcgacaagacacaggaatag

SEQ ID NO: 7844 - DNA, 1359 bp, A.fumigatus
agatctttcgaagccgagttcgtcgtcaagaagccaaccatgtacgaatacatccataagctgcgtcgctggcgcgacaagttcgaggagaagctggatcgccgcggccagtaccaatttttggagacgtattcgccgcatctgagcgagttccgcttcttgaaatttgatgaagtggaggtgccgggacaatatctgctgcacaaggacaagaaccaagatttcgtgcgcatcgacaggttcctgccagacattgatcttgtccggggtattggtgtttgtcatcgtcggctcaagattcgtggtcatgacggtagcgtgcatccgttcgctgttcaacatcccgcagctcggcattgtagacgagaagagcgcatcctgcagctcttccgtatcttcaacgggcttcttggcaaacgcaaggaaagccggcgccgtaacctctatttccatctcccgctcatggttcccctcgcgccgcacattcgcttggtgcgcgatgatccttcatacatttctatgcaaggcatattcgaggactattgccgccgagtgggaaccagcaaggatgaacctgttctgtttaccatggagaaaatgcggtcattggcagagacgaagcaaaatgtacgtcaaacggataatttaatggtggagcgagctaacgtatcccagcgcactcctgaccagcagcaggtacttcggactgagattctcacggccattcaggagaagtgggtgcccagtacgattgtgaaggactacttccagaagacgtatcccaactttgcaaatttctggctcttccgtcgccaattctcctatcaatacgcggctatcgcatttatgacctatgtgatgcatatgggcaaccggtatcccaataagatcatgatctccaggtctacaggtgatatctggggcacggagctgataccggcgattaaccctgcaaaggctttcttctacaacccagaacatgtgccattccgtttcacgcctaatatccagacactgatgggaccgatcgcaactgaaggtctctttgcttgcgctttgatggcgatcgcccgctgcctcaccgaaccgcgccatgagctcgagcagcaactgagcatcttcgttcgtgacgagatgatgttctgggccacagcgcaacatcgcggtgtacttccagtgcaacagcttcgtgacctggtgtacaacaatagtgatattattgtcaaccgggctgttagccttgccagcccgccagaaggcaatttgcccgccaaccaaaccaccatcgacctgatctccaaggccgtgaaccctcagcacctggcatcttgtgatgcactctggatgccgtacctctag

SEQ ID NO: 7845 - DNA, 189 bp, A.fumigatus
ggagcatttgaaggttgtaggtatcgggcgtttcggtttatgggttgcactgcactatcatggaatcctcagtacagttaccttgtacatatcaaatatgatacatctatttcaattgaacctatttcaaaacactctaaagacaagtggctgccaatgaaattctctgctcaggttcaaaaccagtga

SEQ ID NO: 7846 - DNA, 306 bp, A.fumigatus
tcagtccacggcctccagcatcttccctccttctgccatcattctcatctattcaaatcaaccatgcctgccaccacggcggacactctctccctcgtcacgcgcaccgtcacggtagctcccttagtccttctttcagtcgcagatcattatggacggtcagccaagggaactcggaagcgtgttgttggtgtgctgctcggagagaatttgggccagacagttcgagtatcgaacagctttgcaggtgcgtcgtctcccaaaccggcttacttatgttccctggtagatggacggcagttctga

SEQ ID NO: 7847 - DNA, 297 bp, A.fumigatus
tgtctctgtcttttagttccattcgaggaagatgagaaggatccctccgtttggttcttagatcacaacttcgttgagtccatgcgagacatgttcaagaagatcaacgcccgcgagaagcttgtcggatggtatcactctggtcctaagttaagagcctctgatcttgagatcaatgaactcttcaaacgatacacaccgaaccccttactggtcattgtcgacgtccaaccaaaggaagttggcgttcccacagatgcctattttgctgttgacgagatcaaggacgtaggttga

SEQ ID NO: 7848 - DNA, 597 bp, A.fumigatus
gatggcacaacaacgtccagaacatttgtccataccccttcagtgatcgaggccgaggaggctgaggaaattggtgttgaacacctgcttcgagacatcagggatgttgccgttggaactctttcaacacgcataacatcgcagcttcagtcgctgcagggtctgcacttgcgcctgcgtgatatcggccaatatctccagaaggtccttgatcacgagctgccggtcaaccatgctatccttggcaatcttcaggatgtgttcaatcttcttcccaacctatctactccagcagcaacgtcgcgtctaagtgggtcggaacctcagatggaaaatagtgaattagcgcgggcgatgagcataaagaccaacgatcaactgatggccatctatatcagcagcttgattcgtgctatcactgccttccacgatttgattgagaacaagattcagaaccgacaacaacaagaagagaacgaatcaaagaaggagcaagaagcaaatgctgccaaaggtgataaggaaggtgcgaagaaggcgaatggcatgaacggcgagccaaaggaggatcaggagaagtccaagaagaagagctag

SEQ ID NO: 7849 - DNA, 300 bp, A.fumigatus
tatatacaatccgttcttgatttgaacctcatcaccatcttcgctccagaagtggccccaatggatacaccccgagttcaggtaggcgcgccggacgtcgcccaggctcctgagagcacccaaaccactgatacacccgatgtggatatggatgagactcagcagagcccgctgaatgaaattcaagcagacgcgacacaacaggatatttctctgcctgacgcgcagcccactggatcagcgccaacagaaccgccgcaacctcccaagaaaaagccaggacttcattttctcgagtaa

SEQ ID NO: 7850 - DNA, 795 bp, A.fumigatus
ggctcaaatcttcggggagcttcaacaatgcgaccccaattggcgcatgcacggctcacaccgcttagctacctgacgtcgcccattgtggagctcattgtcgggaaggacgagcacaagacttccttaacagcgcaccagagcttgttgttggaatcgccattccttgcgcaggctgtcgccgcatttagcgaatcagggcccgtacgcactagcttcctcctaagcagtattctggatgcttttactaatacaatatccgtcatgcagcggcgtattgagcttcccgatgagaacgtcgaagcattcggttgcttcctccagttccaatatacccatgactacactgcatcccatgccgatccatccgccgatcaagacgttgtcggcgaactggatgatagcggcgagctactgttgaaacacgcgcgtgtctacactctagcagagaagctcggcgtgcctgcgcttaagagtctggcacactcgaagatccaccgtatcaacagtacctctcacggagagatcgcgtacgctcgttatgtctatacacacacgcccgtcgatgatgtcactattcgaaagcccgtcgcctctttctgggccaccagaagccatgtgctgcgccacgaggctgaagaggagttcaagaagctgtgtcttgaagtgcctgagttttgctttgatgtacttactcttgttcttgaccaaaaagagaaacgtgcccaggatcgagcagagaccgaatcgggcataaaaggcagtggtaggaaacgtcttaggagcggtatctag

SEQ ID NO: 7851 - DNA, 249 bp, A.fumigatus
  unsure (82): Identity of nucleotide sequences at the above locations are unknown.
aggcaattttggagggcgccgaggacgagatatttgaaaaagagagtcagtgttgggtttatcccccatggtctcggacatnatctgggaatgaacactcatgataccggcggcaatcccaattacgcggataaggataccatgttccggtaccttcgagtcagaggtcgtttgcctgcgggctcagtgatcaccgtcgagccaggcgtaagttggggtttgcccatgtttcctaaactgatccattga

SEQ ID NO: 7852 - DNA, 204 bp, A.fumigatus
gtatatttctgtcggtttatcatcgagccttacatcaagtcccccgagtcaaacaaatacatcgataccaacgtcctcgaccgttattggagggttgggggtgtccgcattgaagacaacgttcttgtgaccaaggacggatacgataatctaaccacggcgccaaaggctgttgatgaactagagagactagctgcatcctaa

SEQ ID NO: 7853 - DNA, 312 bp, A.fumigatus
atagccctgttttcatccttttcgtcccactccttattttctttcccccttttcatcatcctcccccctctccgaatccccgtccgaccgggtaagaatccagaatcttttcgtgcagattatatccgtctgctagacccttatctcattacacccgggtctagaaccatctttacagctctagtttcagtccgtgccatcgcggacaatttccccccttcgaggatcttctgggccggatcatgcaaaagacgctctccgtccgccccgctatcgcgtctaccccgccatgagctcctccctcgaggctaa

SEQ ID NO: 7854 - DNA, 573 bp, A.fumigatus
ctgttgtctacctgccacccaggagtcggcaaaacctctctcgtccagcgctatgtgaagaacgccttcaaccccgcgaccatcacgtccaccgttggcgcctcattcatcaccaagcgcgtcctcgacaccacctccgataccatcgtccgactccagatctgggacacggccggccaggagcggtttcggagtatctcgcggctgtactaccgcggcgcgaacgcgtgtctgctttgctatgatatcacagacgagcagagtttcgaggagatgaccgggtggttgctggagctgaagaagcatctagcggacgatgacccgatcgtgatccatgttgtcgggaccaagtcggatatcgttacgcttgatccgtcccgccgcagggtgccgtttgagcggacgattgcatatgtcgctgagcagctgtacccatcgcgggcgtcgacgccgccgccgacggcggggatgggcttggggctcggtccgtcgtctactgcactacagagccccgatagcaagcgcagtagcgggttctggggacagggatatcggctgggactgctgccatga

SEQ ID NO: 7855 - DNA, 321 bp, A.fumigatus
tccatgttgtcgggaccaagtcggatatcgttacgcttgatccgtcccgccgcagggtgccgtttgagcggacgattgcatatgtcgctgagcagctgtacccatcgcgggcgtcgacgccgccgccgacggcggggatgggcttggggctcggtccgtcgtctactgcactacagagccccgatagcaagcgcagtagcgggttctggggacagggatatcggctgggactgctgccatgagattagtgcccaggatggggagggcattcaggaggcgtttcgtgtgatcacccggaagctagtcgagcaacgggaataa

SEQ ID NO: 7856 - DNA, 204 bp, A.fumigatus
aaggtgatatttcctagttatataactagaagtagcaggaataaagagatttttaagctagtaaaggcctatcttattagtagtctatctattaggactaactttaatcctactattgtgtgggagcgtgatatcttaataccaaccctctatatagacttttcctttgaagataatgcatggaggaagcacctaactagttaa

SEQ ID NO: 7857 - DNA, 222 bp, A.fumigatus
cctgttctcgggcgactcgccctttcggtcctcttggtcattaaatcgttggcgccggcaacaatcccgacgacaatctttttctggatccgtttgtcgatgaatgatatcaaccaaaatgggtcctctgttgacgctatggagatggaactaaggcacacacacaccacgatgatcgtctctgctggcaacttggcactgtcgggcacctacagtcggtga

SEQ ID NO: 7858 - DNA, 204 bp, A.fumigatus
ctccgatgtaacctcttttgcacagtcacaaattatttcaagtgcctaatggcgggaaaggggaaggggaagggaaagaaaaaaaccaaaccgaagatctcagaaatatccgctggttcggctattgcatctactgagacggctgttgcaaaggacgaggtcagcgcaaaaatgaaagagcttgtcctaaggtatgaggtttaa

SEQ ID NO: 7859 - DNA, 246 bp, A.fumigatus
gtgctaattatagtagctccatcccctatattccctctgatgcttggcacatctgtccaaggcggaaagacaaatttccaacataaagttaggaaccgcttccaaaaaggtgccgtccaatatgggattgttattagccctcagaagcagaaggttatccgttgtcatctggacgacaaggtccctgagccctcggtcgtggtcttccgtcgagccatatacctcaagcacagcggaagtatatga

SEQ ID NO: 7860 - DNA, 333 bp, A.fumigatus
ggccttggcttcaatttgtggaacatctaccattctcttccggtagcctgcactacccctcaaactgctttcatcatggagcaacagctcttgacactcctcgcagacacacagtcgccagcggtcgatacaacaaaagccgctgaactccaacggcttcatctctactccaatgaacagttccccctctctctcgccgccatagcctctcacgactccgtccctaccaacctccgccagtcctccctgtccgtcctgcgtaccttcattacggccgcttggtcaccgaatctagacgaattcaacggtcaggttctgatcaatgacaccaac

SEQ ID NO: 7861 - DNA, 192 bp, A.fumigatus
cctacctatagtgtgcctaaaatcatccatggattactgccgcgtgattactctctctctgatttcgaaaccacatggccatttggagcattaagtgcatttagactcatcaattcagttaccattaagctaggagccgctttacacaccactctcgtaaaatcatttcgatatgaacaggaaagccagtaa

SEQ ID NO: 7862 - DNA, 501 bp, A.fumigatus
cttgaatatgaccaagagtggttagcaatcactcgtgtcttggccgacgagctgcagctgggcgatctcgccgtgcaaatgcagccggaccgtggccaggcattctacaaaccccttatcgaagaggcggagcagtgggttgaagaaaatgtcgtcaaggctggcaagatgatggttccagagaacttcacccccactgcacctttcttcgatcctgccgtccctatcacgaccgacgagttgccccctgaattcaccaacccccagactgctcagttctgcgaactcatcggaatcgaaaacaagttccacctgtcggacgaggaacgccaagcaagggttgaggctggccctcgccccaacaagcccaagcccgaaggtggctggaaccgtggccgccgtcgtaactataacaataacaaccgcggcggcggtagtcagtggtggggaagaggagcagggcgcgatcggggacgaagtggtggtaatcagcgctggtaa

SEQ ID NO: 7863 - DNA, 636 bp, A.fumigatus
gcagtcgcaatgcgcctggtgacctgcctggagcatctactgggtcgcggaaggactggaaccaatgacttgctcattctatctacacttgaactgattcaaggcgtcctcctcctccacccgccatcgcggactcttttcgctcgcgaaatttacatgaatcttcttcttgacctcctcgaccccatcaattgccctgcgattcagtccgcgactcttctcacccttgtcacagcattgttggaccacccagctaacacgcgaacgtttgaagaactggacggactgctcaccgtgacttccttatttaagcagcgcgcgacgtcgcgtgaggtcaaactcaagcttgttgaattcctttatttctatctgatgccggagaccccaacatatcccgtcggggcaagtgctccaaatacggcggtctgcgggttacagcgcagccccagcaaactaggcggtggtccgtattcacgaagtctcaatgtggcgggccccgggcatggaggaaagggccatggggatacgcgcacgaccgaggagaaacaggctctgttagggcgatatctcaacaatgtggaggacctagtggaggatctgaaggagacggctccctttggagcgacggtctattag

SEQ ID NO: 7864 - DNA, 234 bp, A.fumigatus
ggaaggggttggcgattgccaagaagatacaatctgggtcagtattttgggtatcatattagtctctttacaacactaacaggttgcagcgctgtacacatcaacagtatgactattcatgacgaacctgtcttaccccatggcggtgtgaagaacagtggatggggccgattcaacgctgctcagggactagaagagttccttgtcaccaagagcgtgacatggatggattga

SEQ ID NO: 7865 - DNA, 471 bp, A.fumigatus
tctggccaaatttgcatgtctactgacagaattctcattcactcgtccattgcgccggcgttcatggatgcgttgaagaaagccctcggatcgaatctcgacccttctgcgccgcctcccacattggtcaacgttgcctctaaggcgcgggtggagggcatgattgacagggctctcgaatcaggcgctcacctcatccacgggtcactcgacaagacagtgggaaaatcaggtgtgcgcatggccccggtacttcttggtggcgtgagagaagacatggaggtatggcaagaggaagcctttgcctcgctggcagcatgcatggtggtcaacagcgacgaggaagccatccgcatcgccaacagcagtggctacggattgtccgcggccgttttcaccgaggatttgaggaaggggttggcgattgccaagaagatacaatctgggtcagtattttgggtatcatattag

SEQ ID NO: 7866 - DNA, 1176 bp, A.fumigatus
aataacgaggtaatcgagtcagccactctgcgctcgctatccgtggcctcaaatttgaaaaaagtcgatctcgtactggtaccggaggttgactttgtcgaccagcgtatctaccgcttcgagccgactgatggagcatccgatgccattgcccgtctcgataccttgtcattttccctaaacaccacgatgtcagtccagcgcttcaatcaatggcgtcagaagaccgatattagacgtctccgtacatggagcatcggccgtatcaataacaccaccctcgctcgaacgattggcgcggttgcaccgtcctttcagcgtctggaacggctcgaactcaacctacgggagacacctaggagaagcgtcgggtactggcgctcagtggaagagatgatgctgtcattgccaccgctcaagggtctctggctgctcggcaaccgcaacgcatccttcatcagcaaggtcttgtccagacacggtgccaccctattgagcctcggactagacacacgcaatatccaacacgacgtcctcacgcagagacagacacgtccatactataacgcgcaggcaatcgcccgttttgcgagcaagtgccccgtcctccgagagctgcacctcaccgtccaccgcgtgcaaggtctagctcccgaggtaaaagtttacaaagcactcggtcgtttctcttccctattgcatctctgcgtaaagctccattacttccccagtgcaggtgaccctcatgacaatgtagatccttccactataccggactatctctccaggtacgactttgccatggtgcggaaagccagagcattgtacatcaacgccgtcatggatgatcacctggcggagagcatattcaataccatactgtcatcccaatccaccaggcgtctcgccagtctcagactttttccagcctcagaactgcaaccccaggcccctccattatttgtacgaaatgcttaccagactcacctttttcatggtttcacagtgaccagatcctccaatcctcgacctggcgtcctcgacatcaagcgaactcgcacagcgattgcttgtcccgtggccgaactggcccccttttccgtgcttggccgcgactatattctggaatggatttggcccaatgatattacaagcttcccgtcgcaggatgcatga

SEQ ID NO: 7867 - DNA, 330 bp, A.fumigatus
ctcttgacgtacagattcacaactattgaccctcagcgcgccattggatatcttcaaatagaatgtgcctgcaaacgcttcaaagtttcagacaaatgcaagccaaattacggtagttgcgttgacggccgccgttccgtccctatcgagcttttagatgttgcgggtctcgttcctggagcacaccagggtcgcggcttagggaacaagttcttagatgacctacgtcatgcggatgctttgattcacgtggtggatgttagtggaacaactgacgcagaaggtcagcaatcgtattctgcgtttacctcttgtctcaatatcagctaa

SEQ ID NO: 7868 - DNA, 369 bp, A.fumigatus
  unsure (233): Identity of nucleotide sequences at the above locations are unknown.
attgcgcccttaggaaaggcgacgcgcggatatgatccatcggtagacatcgagtggctacggtctgagattgtgcgatgggtcttgggcaatttgatgcaaaaatggtacgatatgatcaagggtgaccctgggacttctttgtgtttgtcccacgaagcttacggtcatacgcaggggttctatcaaaaaaaaacatgttgcgaacaatcagtcaaagcggggttcccganaatcgatcgaagttgtttgactggtggatgcagaatccaccgcagtaaaaacattacaaaggccaattttccccgaatatgggaagcacctccggcgaaacggttggcgcccctgttctgggaaaaaaaacgggtc

SEQ ID NO: 7869 - DNA, 402 bp, A.fumigatus
tccaagataccattgcacgacaaaccatttccttccattatcactgaaaaactgggtgataatgcaaagggcgccctccatgaactgagcaagttgctagctgacgaggctggttatcctatcacatacaaccattactatacagacaatgtccaaagggcacgcaacaaccggtggaggcaagatcttcgcacatcgctcaataatgccattacccaagactggaatagtcgctttcacgtaaacaactcgcctgacgagatcagtcggcttgtgacgtctctccaaaatcatcacatcatcgttgatatggaagagcgggcatgctatgaggcggaaatggacttggatgcctactacaaggtttgcttcccttgggatactgggaaccgtgtgtattaa

SEQ ID NO: 7870 - DNA, 213 bp, A.fumigatus
gggtttttttcccaaccttggttttccctctccgtcacgcaaatgcgggagcaatgtttgatgcattgggctttctgtctttctgatctgattaagaagcaatgcgattttgttatagagctgcctgaaacagcggttctgagtctgtttcgcgggccggatgctccctacgaaacgatttcgtatgtaagatcccaagaaaaaaagtcctaa

SEQ ID NO: 7871 - DNA, 690 bp, A.fumigatus
gacgcttcctgcgccggagcccggcgatctggattaggttcaatttcagcggttgatccggtgagggctttagaaaggggctggacttacgacgatgcctttcgcgccgttgtcgacggcgtcgtagagcgtatcgttttgcatatcctggtacgagtagaggatgtcgactctggggatggaggcgacgttgcgcacgtcgaaagtggtcttaccggtgggcatgacgggcgggtaaaagaagtacggcttgttggagatgatggcgccgaggttgcccatctcgacggccttgaaggtgtccatggtgttggcgtttgtcttggagacgtagtacgcggacacaatgcggtcgttcatgacgaccagcgcaccacggttgcgcgcagtggggtgcgcggcgacggtcacggcctggaggaggttgaacgggccgtcggcggagatggcggttgcgggccgcatggcgccgacgacgacgatgggcttgccgcagttgactgtagcgtcgaggaagaaggccgtctcctcgagcgtgtcggtgccgtgcgtgatgacggcgccgctcatggtggggtcgtcgcagacgacctcgttgatggtcctggccatgtggagcagaagggaagacgtcacgtcggggctgccgacattggcgacctggatgccggccacgttagcaacgtctag

SEQ ID NO: 7872 - DNA, 411 bp, A.fumigatus
tacgcggacacaatgcggtcgttcatgacgaccagcgcaccacggttgcgcgcagtggggtgcgcggcgacggtcacggcctggaggaggttgaacgggccgtcggcggagatggcggttgcgggccgcatggcgccgacgacgacgatgggcttgccgcagttgactgtagcgtcgaggaagaaggccgtctcctcgagcgtgtcggtgccgtgcgtgatgacggcgccgctcatggtggggtcgtcgcagacgacctcgttgatggtcctggccatgtggagcagaagggaagacgtcacgtcggggctgccgacattggcgacctggatgccggccacgttagcaacgtctagcatctcagggacggcatccatgagctgctggatgccgatcgcgccggccgtgtag

SEQ ID NO: 7873 - DNA, 465 bp, A.fumigatus
cgtggccggcatccaggtcgccaatgtcggcagccccgacgtgacgtcttcccttctgctccacatggccaggaccatcaacgaggtcgtctgcgacgaccccaccatgagcggcgccgtcatcacgcacggcaccgacacgctcgaggagacggccttcttcctcgacgctacagtcaactgcggcaagcccatcgtcgtcgtcggcgccatgcggcccgcaaccgccatctccgccgacggcccgttcaacctcctccaggccgtgaccgtcgccgcgcaccccactgcgcgcaaccgtggtgcgctggtcgtcatgaacgaccgcattgtgtccgcgtactacgtctccaagacaaacgccaacaccatggacaccttcaaggccgtcgagatgggcaacctcggcgccatcatctccaacaagccgtacttcttttacccgcccgtcatgcccaccggtaa

SEQ ID NO: 7874 - DNA, 975 bp, A.fumigatus
taccgttgcctggcgtgtacagcgatttcactccctcgaaagcagagcagttcgcctcgtgagatcgcaaagatgaccaaactcagcttcaaaatcatcacactcgcggctatgatagccgttgggaatgcctctccgtttgtctacccccgagcaaccagcccaaacagtacatatgtcttcaccaactcgcatggcttgaacttcacccagatgaacacgacgctccctaatgtcaccatcctcgcaaccggcggtaccattgccggctccagcaacgacaacaccgccacaacaggctacacggccggcgcgatcggcatccagcagctcatggatgccgtccctgagatgctagacgttgctaacgtggccggcatccaggtcgccaatgtcggcagccccgacgtgacgtcttcccttctgctccacatggccaggaccatcaacgaggtcgtctgcgacgaccccaccatgagcggcgccgtcatcacgcacggcaccgacacgctcgaggagacggccttcttcctcgacgctacagtcaactgcggcaagcccatcgtcgtcgtcggcgccatgcggcccgcaaccgccatctccgccgacggcccgttcaacctcctccaggccgtgaccgtcgccgcgcaccccactgcgcgcaaccgtggtgcgctggtcgtcatgaacgaccgcattgtgtccgcgtactacgtctccaagacaaacgccaacaccatggacaccttcaaggccgtcgagatgggcaacctcggcgccatcatctccaacaagccgtacttcttttacccgcccgtcatgcccaccggtaagaccactttcgacgtgcgcaacgtcgcctccatccccagagtcgacatcctctactcgtaccaggatatgcaaaacgatacgctctacgacgccgtcgacaacggcgcgaaaggcatcgtcgtaagtccagcccctttctaa

SEQ ID NO: 7875 - DNA, 264 bp, A.fumigatus
tccagatcgccgggctccggcgcaggaagcgtctcaagtggctactacgatgccatcgacgacatcgcatccacgcactccctccctgtcgtcctcagcactcgcaccggcaacggcgaagtcgccatcacagacagcgagaccacaattgagagcggcttcctgaacccgcagaaagcgcgcatcctgctcggtctgctgcttgctgaggataagggattcaaggagatcaaagaggcgttcgcgaagaacggggttgcttga

SEQ ID NO: 7876 - DNA, 612 bp, A.fumigatus
tatcaaactgaatgcaggtcctcatcatcccattttgaccatcacgcagacgaactggccgacagcgttcctccccgccctgtgacacccccgctctgcgaatcagcggaatgtgtacatgctgcctccgaaattctgtacagtctagatcccaactatgccgagattgacccctgcgaggacttcgagcaatatgtctgtgggggctggagagaacggcacgatctgcggcttgaccagggctccatgtttactgggactctcatggctgaagcagctcagatgcgccttcggcacattttgaaatccacaagtgtccccgaagctgctgatgaagagaaccttaggaaattgaaatccgcttacaatgcttgcttggacgaagccgtgatcagcaaacgtggtagcgagccattggatgctttgcttgctcaactcgacgatatctattctgcagagtcaactgcggttggttcggatgtcaatatcactgacgcagtattgtttctcatgaattctggcgttacggcgctggtagaaatgggcccaggtgtaagtacatcagccgttggcattcgacagcttcttgttctaacaggcgaagcccgatga

SEQ ID NO: 7877 - DNA, 213 bp, A.fumigatus
atggcgaacggcgttttaccgaccttccgaaacacgaggcgtttgaggctgaccttcggatccagcatcactgagagtgaaatcaccatctctctcgtcctcagcttcgtcgcgaatgagaccaagtacacggcgaacgatgtttccaaccaccatctctcttggttgagcagccaccaatcgcctccccacgctctgcacccgttcaattag

SEQ ID NO: 7878 - DNA, 657 bp, A.fumigatus
cactgcttgatagacccatccgatccgttgtcactccgccacgagggctctgagcggtcgtcctcaaggccgcctttcacttcgctggccaccactccaatctcaatgttcaatctgctctcacatccggaacctgaaacatcgctccccggtactcccgcatcggcttctccatccggtagattactgggacatgctccaaccagggatattcgcgccgaagtcctggatggaattggagagatcatcgacgaactgggacaggtggacgaccagattgcggcctatgctctggaccacatccactccaatgaaataatcctcacccatacatcctccacaaccgttcagaagttccttctcaaggccgctgcaaagcgcaagttcaccgtgatccatgctgaatcctaccccaacaaccatgaagcgacgcacaccaccgttagcggtgccgcttccactgatgaagaaattctcagcaccgattcattccagaagccgctgatcgccctgggtattacagtcattctaatcccggattcggctgtctttgctctcatgtcccgagtcaacaaggttattctgggcacgcactctgtccttgccaacggcgggctggtcttcaccgggggtgcaagagcgctcgtttcaaacacc

SEQ ID NO: 7879 - DNA, 369 bp, A.fumigatus
tatcgtgcgtttctggagtctcataccttttgcacaaggagctaccgttctaacaggaatatcaggcttctcaagcggagacagatccgtcattccagatcatgcgctaccgcgaccgcctaccttctccttcgcgtcgtttcagcttgcaggacgacagatgcagctaagctaattgaacgggtgcagagcgtggggaggcgattggtggctgctcaaccaagagagatggtggttggaaacatcgttcgccgtgtacttggtctcattcgcgacgaagctgaggacgagagagatggtgatttcactctcagtgatgctggatccgaaggtcagcctcaaacgcctcgtgtttcggaaggtcggtaa

SEQ ID NO: 7880 - DNA, 1584 bp, A.fumigatus
ctagagactgctgtcaatactgatattccttgcgcactccatgtctttattatggaggatatatccgacgcccctcatttgaccgaatttgccaatttcactccaaacggaccgcttttcggctcaagcccttcagccgacggaccagcccccatcaatgggacaaaaacggcttccgacgaagattcaccacatcgcgaggaagaaaggcgactgagcgacgatgctcatatgcctgttcaggactgtgggtacaactcatcggaatcctcaacgcaacactccacgagcgacacatctagtcatgacatggacgatgacgacttagctccatcagactcgcgtgcatccagtcgctcttcaatctcctctatccccgattcggtgctgatccaccccccaagcgagctgaaatctgcgatcggctgcggtacagatgagcgaatccgccactcctggatcaatcaaaatagccccggtcatggcaggatggaggcacagttcaagtctatacaaacaatcaggcaacgggaggctgctttccggaagcccagttctgtgcgcgcaatgcagatgcatacggaggatgaggatgatgacgagttcctgactccgcccaagcggaggggtggacatcggatgtcggatatctcaattcgttcagcggggtcgtctccgcttaagagatcgccttattactcgcctaccggatctacagggaggcagaaagttaagaatgagtatccgcttgttttgcttcactgcaccttgcttcctccttcgctgcctgtgccaggtttgattgggtacccggaccagaagatactgaaagtagtgctgcctccagagtactggaggagatggaagttgctggaggagaaagttggttccagcgtggttcgtgaccggggtgtgcttatctctcacccggaggatatgtatgatctgcttgaggaacgattgctggaaagcttggaactccagcgtccacggctccatcatggtcactttttgggacatgaggacacggaatcggacaagggtgaccagtcggccacggaggatagtgccactgatgatgagcaaggagaagagtgccctgattgtggaggccgatttccaaggcacgattcgagcaggaagtgggagatcaaggttttcgccgcgaatgggctgatgagagctggtgcctgggctgcagcttggaaagagatggaaaaggtggatgtcgaagtcggcctttggctgccgtctgagattaggagggagctggaaaagcgacttttggacaatgatcgccctagcactgaccctaagctacaggtgccgcaactcagggagccagccaccagcatcaccccagagctgtatgatcaaccattgcgcacgaatacacctaccccattgattcacgaaacaagtgtatgtgttcctgacgaagctgcccgcccctcatctcctgcaccagcaattacaacgccagcgaaagctacaggcatgccaccccccaacgtatcctccgaggtccgtgggaaaaatcgaactgcatacgctgctcatcaactacttccgggtcttggctaa

SEQ ID NO: 7881 - DNA, 465 bp, A.fumigatus
cgacgacctgtccgcccgatcaagccctgggtatcaacactacattcactttcaacaagactctcgacgataccatctggaatgtcaccaatggagtcctgtcgcacaccgacgaaggaaccgaattcaccatcacaggcgagaaccaatcgcccacgatgcagtcaaacttttacatcttcttcggtattgtcgagtcccacgtcaaaatggccaagggcgccggtatcatcagcagtatcgtgctgcagtctgacgacctggatgagattgactgggaatgggtgggttacaacaccagcgaggtccagtccaactatttcggcaagggtaacaatgagaccttcaaccgcggcggctaccactatgtccccaatgccgacacggaattccacaactacaccacgtactggacccaagagaagctggagtggtggattgacggcaagctcgcccggaccttga

SEQ ID NO: 7882 - DNA, 303 bp, A.fumigatus
caggtaaacaggggcaactccaccatcgccaatgccatccaaaacccaccaaaatctttgtccgagaagtgggccgaactcccgaccggggccaaggccggtgtatacatcggggccggatgcgttggcgccgccttgctcgccgggttcatcttcttcttcatcgcacagcgcaagaagggccgtctcgagcacgcgctcgaggatgccaagtgggccaatgaacgcaccgaaatgagcactttccagaacgattggaagcagagcgagtggaaacacaagggataccagccggtcaattag

SEQ ID NO: 7883 - DNA, 261 bp, A.fumigatus
  unsure (247): Identity of nucleotide sequences at the above locations are unknown.
gcactttccagaacgattggaagcagagcgagtggaaacacaagggataccagccggtcaattagccctgcgttgcaaaacgatctcgtcctcggttccctaagcaagggatgtcccatgtccttactcccccttaatgctctttttgccgctggtgtttcagagacctacgttttatcccgtgctgctttgctggtcaaactgcgcggtggtatcgtggagctcggggttgggcgtcgtttggtantaaatgtcttttaa

SEQ ID NO: 7884 - DNA, 240 bp, A.fumigatus
accacgggaaccaatcccatgaacatcatggaccgcgtcgtggagcagagttctgatagccactggtacaatgattacaacaaccacctcttctcatccgaccccaaaggcttatgcataacatcccaccccacctcgaccccctccaccgcagccgaatgcctcacaaacgtcatctccccaaaccccgtctgcctcgtctccaggtatccttctggcacatccgccagagacacataa

SEQ ID NO: 7885 - DNA, 843 bp, A.fumigatus
agcgttgtccttccagccgcctggttaagacaccccatcatgtcgctcctttaccttgtggccctcttcgtggccagcatctgttcggtgaccgctcagacatggacatcgtgcaaccctctgacgacgacctgtccgcccgatcaagccctgggtatcaacactacattcactttcaacaagactctcgacgataccatctggaatgtcaccaatggagtcctgtcgcacaccgacgaaggaaccgaattcaccatcacaggcgagaaccaatcgcccacgatgcagtcaaacttttacatcttcttcggtattgtcgagtcccacgtcaaaatggccaagggcgccggtatcatcagcagtatcgtgctgcagtctgacgacctggatgagattgactgggaatgggtgggttacaacaccagcgaggtccagtccaactatttcggcaagggtaacaatgagaccttcaaccgcggcggctaccactatgtccccaatgccgacacggaattccacaactacaccacgtactggacccaagagaagctggagtggtggattgacggcaagctcgcccggaccttgacatatgaagattctcagggggccggcaagtattacccgcagactccttgcaacattcgttatggcatctggcctgctggtatcaaggggaatgcgcagggcacgatcgagtgggccggtggtctggtggactactcgaaagctcctttcaccatggtcctccagagcgtccgggtgcatgatttccataccggcaaggagtataactacaccgatcactctggatcctggcagagcatcgatgtcatcgcgtaa

SEQ ID NO: 7886 - DNA, 441 bp, A.fumigatus
cctgccgatacaccgccgcctccacccccgccgctaggaaataccccgccgcatgatccagcacctggcacggcgctgcgcgccccgcctccccagcgccgtattgctccgcctcggacacgttcatcccggaacacgtctgcaccagcgagtcgaagccgcgacgtgcccgccatggacccgttggaccgtacgccgagaggttcgcgcagacgatccccctgccctgcgccgccgcccgcgccgccagcgtttccggggagaatccccttgctgcgagagctcccggccggaaaccctgtacgaagacgtgcgcgtcgtcgatcagccgccacagctctgcctccccttctgctgcgtccagatcgatctggatggtgcgtttcccgcggccgaattcccggtcgatggggggtaggtcgggaaggttgggagacgtga

SEQ ID NO: 7887 - DNA, 1083 bp, A.fumigatus
  unsure (16),(29),(31),(33),(34),(35),(37),(40),(55),(58),(63),(66): Identity of nucleotide sequences at the above locations are unknown.
aatgggctacttgctnatcagcactatcnantnnngnctntcgtcccaagggctnaanttttnaanttcgccatcgccccctggcgctccggcgacctcgaaaccgccgccttcgacgccggctgcgtcatctccgccctgagatcctacgctcagtgggacgccaccccgcaagcccgcgccgtcgccgacctccccatcctcctccgccgcatcggcgacgctcccccgggtctaccgccgtccatgcgcagcgcacccacagacaagtgcctgcgcggactccgcgtcctcgaactctcccgcgtcatcgccaccccgctctccggtaagaccctcgccgcccacggcgcatacgtcctctgggtcacgtctcccaaccttcccgacctaccccccatcgaccgggaattcggccgcgggaaacgcaccatccagatcgatctggacgcagcagaaggggaggcagagctgtggcggctgatcgacgacgcgcacgtcttcgtacagggtttccggccgggagctctcgcagcaaggggattctccccggaaacgctggcggcgcgggcggcggcgcagggcagggggatcgtctgcgcgaacctctcggcgtacggtccaacgggtccatggcgggcacgtcgcggcttcgactcgctggtgcagacgtgttccgggatgaacgtgtccgaggcggagcaatacggcgctggggaggcggggcgcgcagcgccgtgccaggtgctggatcatgcggcggggtatttcctagcggcgggggtggaggcggcggtgtatcggcaggctactgaagggggatcatgggtcgtggatgtgtcgttggcgggggtgatgaagtatctgcggtcgctggggcagtatgaggggagaacggggttcgacgaggggcgggattatgtgtctctggcggatgtgccagaaggatacctggagacgaggcagacggggtttggggagatgacgtttgtgaggcattcggctgcggtggagggggtcgaggtggggtgggatgttatgcataagcctttggggtcggatgagaagaggtggttgttgtaa

SEQ ID NO: 7888 - DNA, 483 bp, A.fumigatus
gaccctcgccgcccacggcgcatacgtcctctgggtcacgtctcccaaccttcccgacctaccccccatcgaccgggaattcggccgcgggaaacgcaccatccagatcgatctggacgcagcagaaggggaggcagagctgtggcggctgatcgacgacgcgcacgtcttcgtacagggtttccggccgggagctctcgcagcaaggggattctccccggaaacgctggcggcgcgggcggcggcgcagggcagggggatcgtctgcgcgaacctctcggcgtacggtccaacgggtccatggcgggcacgtcgcggcttcgactcgctggtgcagacgtgttccgggatgaacgtgtccgaggcggagcaatacggcgctggggaggcggggcgcgcagcgccgtgccaggtgctggatcatgcggcggggtatttcctagcggcgggggtggaggcggcggtgtatcggcaggctactga

SEQ ID NO: 7889 - DNA, 744 bp, A.fumigatus
  unsure (609): Identity of nucleotide sequences at the above locations are unknown.
tatagacagccccttggtgaagaccaggaaattcgggtgaactgggcttaccagtcaaattccgcgaacaaggaagatacttcttctcactttcacattttcgtcggcgatctaagcaacgaagtcaacgacgagatcctgctccaggccttctccgccttcggctcggtgtcagaggctcgtgtcatgtgggatatgaagactggtcgttcccgtggctatggcttcgttgccttccgtgagcgtgccgatgcagagaaagcactgaatgccatggacggcgaatggctcggttcgcgtgccattcgctgcaactgggctaaccagaagggacagccttctatttcccaacagcaggctatggcggccatgggcatgactcccaccacgccctttggccatcaccacttccctacgcatggggtccagagctacgacatggtcgttcagcagacgccacagtggcagactacgtgctacgtgggtaatctgacaccgtacactacgcaaaacgatcttgtccctctctttcacaatttcggatatgtacttgagacacgccttcaagcagaccgtggattcgcctttatcaagatggatacacacganaatgctgcgatggctatttgccaattgaatgggtacaacgttaacggacgtcctcctgaaatgcagcgtacgtttgctctcgccttttttgctcttattttaaggctgcttttactgaccgttgtagtggggtaa

SEQ ID NO: 7890 - DNA, 378 bp, A.fumigatus
  unsure (33): Identity of nucleotide sequences at the above locations are unknown.
gccctgcgcgcccagggaatcgatcgcaagagntacctgcactggatctcgccgctgcagccgtacatggccatcgtggcggtgatcctgggctttagcacggcgctcttcaacgggtatgccgtgttcaagccgtttgatgcccaggggttcgtcacctcgtactttggactggccttctttgtcgtcatgttcgccttctggaaggtggtgaaacgcaccaagtgggtggatccggcgacggcggatatctacacgggcaaggccgagatcgacgaggagtgtcgcatctgggaagatgggacctgggacgagatacacaaggccgagctggcccagatgaacattatccgccggatgtgggagcgcatgtggtga

SEQ ID NO: 7891 - DNA, 765 bp, A.fumigatus
tctgtccagtatccccactacctcccggtctgggatcacagcgagaaatatccacccctggagcccttcacacacagcgaccccggcttgcgcgcagacccgtccttcccagacctactgaaaccgggcacgaagattcagaacctgacgcctaccatcggctccgaggtcacgggtgtgcagctctcgtccctgtcagctgccggaaaggaccagctggcacttcttgtggcgcaacgcagagtggtggtctttcgcgaccaggatttcgccgacctgcctattgcggacgcgctcgagttcggctcccactttggccgccaccatatccacccgacttccggccagccagaggggtaccccgagatccatctggtgcaccggcacaacagccagggcgagctggacgcgttcttcgccgacaggaacagcacggttgcctggcactcggacgtcacgtacgaagcgcagccgccgggcaccaccttcctctatatcctggactcccccgaggtcggcggagacacggtgttcgtggaccaggtcgaggcgtatcggcgactctcgccggccatcaaagagcgactgcacgggctgaaggccgtgcacagcggcttcgagcaggcggagttcagcaggcagcgcggcggggtcgtccgacgggacccggtgaagcatgagcatccgatcgtgcgcacgcacccggtgacgggggagaaggcgctgtttgtcaatggggggtgtaagtgtccttcaccaacttga

SEQ ID NO: 7892 - DNA, 336 bp, A.fumigatus
ggaaatgagccatctgacgaatgtgcagtcacgcggagcattgtcggcctgaagaaagaagaaagcgatgcgttgctgggtttcctgctgaaccacgtgggccggggtatcgactatcaagccaggatcaagtgggcgcccaagactgtcgtggtttgggatgtaagtcacccgacactatcctctcccctggacgatcaaacgctgatgagggaagaaccgcgtcacggcacattctgcgctggtcgactggacgacgggggaacgtcgtcatttggcgcggattacccccaggccgagcggccctacgagacgccatacgttccggaggagtag

SEQ ID NO: 7893 - DNA, 450 bp, A.fumigatus
cgcctaccatcggctccgaggtcacgggtgtgcagctctcgtccctgtcagctgccggaaaggaccagctggcacttcttgtggcgcaacgcagagtggtggtctttcgcgaccaggatttcgccgacctgcctattgcggacgcgctcgagttcggctcccactttggccgccaccatatccacccgacttccggccagccagaggggtaccccgagatccatctggtgcaccggcacaacagccagggcgagctggacgcgttcttcgccgacaggaacagcacggttgcctggcactcggacgtcacgtacgaagcgcagccgccgggcaccaccttcctctatatcctggactcccccgaggtcggcggagacacggtgttcgtggaccaggtcgaggcgtatcggcgactctcgccggccatcaaagagcgactgcacgggctga

SEQ ID NO: 7894 - DNA, 294 bp, A.fumigatus
cccacatatgctgcacgtggcaatcggaggataccctacaaccgcgtctctattggggagtacatcttgtctgtggacatcgtcgtatcacgagatgctatgaagcctaagagtgagactgtaactctgtgggatgatgtcctctctgagtcacgtgcaatgagaagcagctgtctaagcctagcttgccgtcacatgtacagtagtaacagtactaacgtatccaagaaaaaaaactgctttcatctgccacttggagggaggtggcaggaggtagatctcaatattttgtga

SEQ ID NO: 7895 - DNA, 324 bp, A.fumigatus
gtctatcgctcccacaggaacaatcagtcagttgatggaagtagcttgtggaacaacatcgacgccatcaactcaatcaaccagacttacgagatggccgataattttgacatttggaactaccgtagccaccttcttttgactgaactcaaagatcaaatcacgcgattttcatgcagtggagggatctggacgcaaacaacagatgtagaaggcgaggtgaatggtctgttgacttatgatcggagactgaagcgtgtagatgagaagatgtggaaagacgatattcaggctttgtatgacgcggcgaaggccaggacttga

SEQ ID NO: 7896 - DNA, 435 bp, A.fumigatus
caatccgtcgtaacctcgtcgcccgcgtcttcgcccttcatcacatcgaacaataaacgaacatcttggaccgtccgtgccatcggccccgccacatcctgcgtgtcagtgacagggatgattcctctccgcgaaatctgtcccctagttggtctgaatccgatgatcgagcacgccgacgcaggcgagcgtagcgaattcatcgtatccccaccacatcctacgagtgctagattcgccgctagagcagcagccgtcccacctgacgaaccgccgggtgtcccgcctgaggtcataccggttccgcgtctgacctcccagcgaagaaacagtgacaccctccagcgaaagttcgtggagattggccttaccaaggataatggcgccagcgcgacgcagcttcgtgacgacgaaggcgtcggcttttgtctgtag

SEQ ID NO: 7897 - DNA, 951 bp, A.fumigatus
aagccctccattccctacagacaaaagccgacgccttcgtcgtcacgaagctgcgtcgcgctggcgccattatccttggtaaggccaatctccacgaactttcgctggagggtgtcactgtttcttcgctgggaggtcagacgcggaaccggtatgacctcaggcgggacacccggcggttcgtcaggtgggacggctgctgctctagcggcgaatctagcactcgtaggatgtggtggggatacgatgaattcgctacgctcgcctgcgtcggcgtgctcgatcatcggattcagaccaactaggggacagatttcgcggagaggaatcatccctgtcactgacacgcaggatgtggcggggccgatggcacggacggtccaagatgttcgtttattgttcgatgtgatgaagggcgaagacgcgggcgacgaggttacgacggattgtcaacgtgacgcaatggagcgtagctccgagacatgtggtagacgcaaaaggatcggtgttttgagatcgtttttcgcggatgacggtgatcctgaaggctcaattgtcaaccagacagtgctggacgcgctggataaagctagagctaacgtgccagtcgagctcgtcacgctctctccccaacgcgcccactgggacattcccacgctcatttccacggcggacatgcaagcatacgagttccgcagtgtcatcgacaccttcctacaatcgtcattgatcgcgttcacgccgcatgattcactaaactcgatcgtcgccagcggcgagtacctccaagaagccgtgacaccggccctctatcgtacactgcagaaggacggcccatatacaatgcaaagtccagagtatgaatctcgcttggcgacaattgcagcattgaagaagtctgtagaggattgcttcgagtcttcaccacggggtggaaggacagagtcacat

SEQ ID NO: 7898 - DNA, 645 bp, A.fumigatus
ttatcctgttcaaagaagggagatatgggaagtataggctccattgacatccaagagcttacggtatcagagtaccatgatgctctacgcgacaggaggacgacctgcactgaggttgtggtagcatacctcgatcgaatatcacgctataatagcctgctcaaagctctaataacggtcaacaagaatgcactcgacgtggcccgacaaagagaccaggaaacggaggcacttctacagcaacatgggaaagaccatacccttccgccccttcatggggtccccgttatccttaaagacacctacagcactctcgacatgcctacaacatctggagtaaaagccctccattccctacagacaaaagccgacgccttcgtcgtcacgaagctgcgtcgcgctggcgccattatccttggtaaggccaatctccacgaactttcgctggagggtgtcactgtttcttcgctgggaggtcagacgcggaaccggtatgacctcaggcgggacacccggcggttcgtcaggtgggacggctgctgctctagcggcgaatctagcactcgtaggatgtggtggggatacgatgaattcgctacgctcgcctgcgtcggcgtgctcgatcatcggattcagaccaactag

SEQ ID NO: 7899 - DNA, 630 bp, A.fumigatus
ctatctcggcattctcacgttgcagatacatacagaacacggacaatgcctccaaaaggcacgaagcctacgaacgatgagctcctcgcccaattcgacgatctcggcatcgactcgacgacagagaagcgaccatcaaagccgatagctgcatccactaccgcacagtccgaagatgatattctggctgagctggacaatctagcttcgcagcgcccaaacagtgggcccggcactccacgactgtcaacgaacgagcctagaccagccaccaaatcacctaagccagcagcagtagctacacctcgctctagcgaagacaaatcggcccctcgtaagtctggggagagtgttcggtcagccccttctggaaacaaggctacaactacacaaccgtcagagcaagagaagccaaaggcgcaggaggcaccagccagtggaggtggaggatggtggggaggtatttttgcaacggccactgctgctatgaagcaagcggaagctgcagtcaaggagattcagcagaatgaggaggcccaaaagtgggcgcagcaagtgcgagggaacgttggagttctcagagacctaggtgagtgggcaatgttagttttttcatttgattcgtgctaa

SEQ ID NO: 7900 - DNA, 423 bp, A.fumigatus
tactctctaggtggcgagctcaagaacaaggccctgcctacatttacatctctgcttcacaccattgcgcctccaatttcctcccatgaacggctccaaatacatgtcactcacgatatctccggataccccgctatcgaccctatcgtttactctgttttttcgcgcgtaatggcacaggtcgaaggtggagaccttctcgtcatccaacgcggtcaagaatccgccccgaaacgcggacttgaccttggaacctcattttccaccgcaggctggcaagatggcccatggtggcgcactgtcacacctggaactcctcgcagtattgcgggcgtccgaggcactggtgaggccaccaagcttgctcgggcaagcgcagaatcatatgctaccgagtattttgccttgaggggccgggtttaa

SEQ ID NO: 7901 - DNA, 489 bp, A.fumigatus
gccatcagccaaacttcgtcaacggaacttttccaggctggcccgacgacggagatggccacccctcctggggtggttgacgttcccgaggtgacggaagaggaggtagcattcgccctttaccttcatgaccccatccacggcattgccttccatactatctcccagactattccccggaaatggatcgattggctggatgctgaggctccggctaccgcagatcccagcgtcgaggacgccaaggcaccacgcacgaccgtccctgaggatattgctgagattgttgccagcggaggtgtcgatccccgcgaatgggtggcagaatggcttgaagaatctttagcattggcgataggagttgttgcacagcgttatgtggctcggagaatgggtgttggtgaacggggtcccggtaagggcaagatgcgagctgaacaggcgtcggtcgttgagagtggtgcaggagaagctgcaagagcgctctag

SEQ ID NO: 7902 - DNA, 702 bp, A.fumigatus
caggttctcgtagctggggcgctcaatgccgaggttgcggcggcaaatgtcgtagatggcctcgttgtcgaccatgaagctgcagtcggagtgctccagggtggtgtgagtggtcaggatggagttgtagggctcaacaacggaggtggcgttctggggagcagggtagacgcagaattccagcttcgacttcttgccatagtccacagagagacgctccatcagcagagcaccgaaaccggaaccggtaccaccaccgaaagagtggaagaccaggaatccctggagaccagcgcagttgtcggcgaccctgcggaccttgtcgagaacctggtcgatcatctcctttccaacggtgtagtgaccacgagcatagttgttagaggcatcctccttgcccgtgatcatgttctcggggtggaaaaggctacggtaggtgccggtgcggacctcatcgaccacattgggctcgagatcacagtagatggtacggggaacatatttgccctggcctttacgttgtcagatcataaggtcgtaagtaggagaacgagtgcaaacagcaagcgtaccagtttcagagaagaaagtgctgaatccgtggtcggggtcggccttcttgcgctcctcggtcaagtaaccatcgggctgggtaacagcaaaaaaatgtcagtcaatctacgcgtcaattcgaagagataa

SEQ ID NO: 7903 - DNA, 300 bp, A.fumigatus
cgccaggccaacgctacgaagtccggatatgctatctggcaactgtacgccgcctcccttcccattgcaatcaacactaacactattaagcaacccacatccttcacactggacacattcaccctctccagcacaatggaaagaaccatctctcctctcctcgatcagcctctactcctcacccagtcttgcaacgctcgattcttcaacctcatcctcaaaacccctccctccgcaaaggcaaaatacaaccaaccggcctccttccaatggatcacacaccaacctccaaatcgggtg

SEQ ID NO: 7904 - DNA, 414 bp, A.fumigatus
atctactctatctcatatcaagcccaacatgaccatatagaccacttttacagccaccaatacatcagagtggaggacaatagtattctcaaaatgaagaactttaacccccttgttcttctctctctcatccccctcgtcgttgccaacgtcgagaaaaccatcttcgtcgccccgcagccatcacatatcccctcaacagattccaccctcgacgacctaggcctcgagcgactctccccctcatatccaaccctacgaaccttcatcaacgcctcatttcctaccccagactccccaggaacagattcttggttctttctcgaaaacctgacgccaggccaacgctacgaagtccggatatgctatctggcaactgtacgccgcctcccttcccattgcaatcaacactaa

SEQ ID NO: 7905 - DNA, 522 bp, A.fumigatus
caacgtaaaggccagggcaaatatgttccccgtaccatctactgtgatctcgagcccaatgtggtcgatgaggtccgcaccggcacctaccgtagccttttccaccccgagaacatgatcacgggcaaggaggatgcctctaacaactatgctcgtggtcactacaccgttggaaaggagatgatcgaccaggttctcgacaaggtccgcagggtcgccgacaactgcgctggtctccagggattcctggtcttccactctttcggtggtggtaccggttccggtttcggtgctctgctgatggagcgtctctctgtggactatggcaagaagtcgaagctggaattctgcgtctaccctgctccccagaacgccacctccgttgttgagccctacaactccatcctgaccactcacaccaccctggagcactccgactgcagcttcatggtcgacaacgaggccatctacgacatttgccgccgcaacctcggcattgagcgccccagctacgagaacctg

SEQ ID NO: 7906 - DNA, 213 bp, A.fumigatus
gatagagtagatctaaacaagctgttagcatatgtctctgaagaaattaaaactcgtctagggatacaattggaagagcagattacagcatggagcaaggatgccaaatctcgaatacattctatatcatatgcagagctattcattgcttgggtttccattgccagtttgggaactcccgcagcaaatggtgacaccgcatcaatgaattga

SEQ ID NO: 7907 - DNA, 336 bp, A.fumigatus
ctatgccatgataatgagtcgcctcgaggggcttccaagcaaccaacctctacctccagctccacccagacagcaagtggcatcgtcagcgtcactgactcctcgctactacccccccgcacccatccagtactcacagccactacttccgccaccaccaccacccaccgcgaacccggttgcctacagacctcaggtcctcgaccccgtcgaccaggctatccatgtgatggtccacgagctcggcttcaaagaagaagatgtcaagtgggccttgaagatcacggatactggcgagggcatcgatgcaaatgccgcggttgcactgctcactag

SEQ ID NO: 7908 - DNA, 906 bp, A.fumigatus
actgacaagggaatagaggaatggacatactatgtcctcacgcttggaccttcggcagtccttagtattggctcaatctgtgctttcgatgactctgaagcgacattccagacagcgcaatccattggactgacaaagtgggagcctgccgactcctctatcagccggtccacttttctcaaagaagccgtatctagagcctacaaggtacgggaaggaagcccgtcgctccctggctcacgtctatcgaatgccagttctacctcttccagatcttctgccggccgcaagacaacgtctcaagcaagcagcaacacgagcgacagcaaccaaatcaaccgacgccgacaagctgtcttcgcagctcagctgcgaaaccgacgcactcagcagcagaataaccctggtaacccgatcacattcgccgaggagcgcccgatctctagctatgccatgataatgagtcgcctcgaggggcttccaagcaaccaacctctacctccagctccacccagacagcaagtggcatcgtcagcgtcactgactcctcgctactacccccccgcacccatccagtactcacagccactacttccgccaccaccaccacccaccgcgaacccggttgcctacagacctcaggtcctcgaccccgtcgaccaggctatccatgtgatggtccacgagctcggcttcaaagaagaagatgtcaagtgggccttgaagatcacggatactggcgagggcatcgatgcaaatgccgcggttgcactgctcactagggaacaagaacgatacgagcaacggcgcagcggccgcttcgcctttcgctcgaagagcccgtccctgcttgaatccgtcatcaacagtcaagagtcggtcaactctggctggaggtgggcttga

SEQ ID NO: 7909 - DNA, 225 bp, A.fumigatus
ccgcaacgctcaaggtccaggtggctcgttcgcagagccttaagccggtcgatgggtatggtgtttgtgactgcgggcggaaagcaaaagcccgagagctttaaggaaagcgtgcagattctcaagggcgcaacggactttgtgggcaagttcttctaccagatctcgcagcacaggaattatcagcgtgaattggacggtctggcatcgaccattgctttctag

SEQ ID NO: 7910 - DNA, 762 bp, A.fumigatus
atgtcgattgtcaaggaactagcgaagcggtcttgggatcggagagaattgaacagcagctttttttttgttcaactttttagcgtaccgccgctttattttccttccagaagctgccccgcaacaaattctcaaaagagcttcgagctcccaaaaaatcaacaacaaccattgcacaaaatgtcctttcgcaagcgcaatataggcttgtcgggaaccgtcgatcgcacgcctattgccaatacgtctgcgcaggcgccgcaagccaccactactacagaatcgcatcctggtatccgtccctcccccgacgatgggcgaccaactacttcaacaggcacacgatcgctcgataaccttctggcgggacacggagggcttcctattgggaaaatacttctaattgaagagaatgggactacagattttgcgggtgcactgctacgatattatgctgctgaaggtgtggtgcaagaccaaaaggttcacgtcattggaatgccggaacaatggggtagaagtctcccaggcttaataggtcccgcagacatgctggacgagaaatccgataagaaaaagagcgagcgcatgaagattgtttggcggtatgagcgtttgggagaattcggtgctggagtcgcaggatcacgaggtatgcatcgtcaacaaatgcgcctcagcatccaaatcttgcttgatgaaattgtgctgacaaaaagtagctcctgctgtttcaggagaacaaagcccaacagctgctga

SEQ ID NO: 7911 - DNA, 720 bp, A.fumigatus
caaaaagtagctcctgctgtttcaggagaacaaagcccaacagctgctgatatgaacaagcaagaggcgttctgtcacgcctttgatctcacaaagcgtctcacccacccttccatatcgaacttgacatatatacccctcacgccgtcgaatgaacccttgttcatctcgatttacaaacgtcttcagacggcaattgcttcgagtcaccccagcacagtccatcgtgtcgtcattccatccttactcaaccctacgatatatccatccgaagtcagccagccagaccatgttctgccctttctccatgcattgagggcattgatgaatacccagggtcaccgcatcacggcaatgatcacagtccctttgtctctcttcccgcgctcgtcaggactggtgcgatggatggagataatcagcgacggagtcattgaactttgtcctttcccccattcggccgatgccctcgcaacatctggggctgcgacatcacaggaggagccaccacaaggcatgctcaagactcataagttgccagtgcttcacgagcgtggcgggggaagtgatcagaacgtaggacaagactgggcctttacccttagcagacgaaggtttgaaatcaagccttttagcctaccacctgctgaaggagacaaagaggcgcaagatgcagcgggacccggcgggatgccgaagaaagcggaccttgagttctga

SEQ ID NO: 7912 - DNA, 186 bp, A.fumigatus
ttccggccccatgccctgtgttttgaccgggggatcgacctttcgtgcaccacgcatttactgacgatttgcgcatacagggctgtttttgtctcctttggcggactgctgctttacctcgaagggccctacaagaagctggctcctctccgcatcgattacgtgtatctgctcctgaagaaataa

SEQ ID NO: 7913 - DNA, 378 bp, A.fumigatus
caatttctcgtcaagtctctctcaaatcgctcggtcgcaaacatgtcggatccgctccttttcgatgataccttcacgatcactgcgatcaattcgcaaaaatatgatcgcgtttctcgtctgtcctgcacctcttccgattccgtgaccacatttactctcgatatcaacagtgagctgtacccctgcgcggttggcgagtcggtttccatggcacttgcttcaacactttccctggatggcaaggaggctacaggggcgaaggccagctggagagaagtaggagccggtgagcagactttggcgaatgactatgactatgtctgccacggcaaggtctatcggttcgaggaggcagcgacccagggcaacatgtaa

SEQ ID NO: 7914 - DNA, 1641 bp, A.fumigatus
ggtgtagcggaaaagcagaaagtcggttccatccacgactccaggtccatgtcgtcggaccataggcaagtcgattcggcgcataactcgggcagcgtccccgatacttttggtgccgatagcggctcgaccctaatggccgctccaactgtggctagtccgggccccatagaggactctacctcccaggacggtgatcgcccgcgccatcgagacgacgcagatatgcaggagagtagtaataaggctttctcgtacccaatgcctacgggccatctcggcgatgcgcgccgcggtctcagtctacccaattctgggttccaaaaaagtggccaacgatcaccgtcggccaaaaaacatcgttgtccttactgtgccaccgagttcaccagacatcataacctcaagagccatcttctcacccacagccaggagaagccatacgtatgtcagacttgccagtcgcgctttcggagactccatgatctcaagagacatacaaagcttcataccggcgagcgtccacatatctgcccgaagtgtgggcgtcggttcgcgcgcggtgatgctcttgctcgacataataaaggccagggcggctgcgccggtcgcagagccagtatgggaagttttgcgccagaggatgattatggcgagggcgctgttgcccccagtgccgaaaataccatggacggtctcgtttatgccgaacccgagcgaatggatgaagaggatgaacgccgactcaacatgcccagcatcaaaaagcatgatgccccttcagactctattccacgctctcattctggcagcagctaccaaccgcgtcagccaaatacatatcctccgatagctgccggcagaccctccccgggaggattattccctcctcccacaagccacggtgggtctagtgcgtcgacatctcccgtgtctcaatccgggaatatgactttcccaccgccggggcagccttcgggcgcgacggtgtatcagtctacgaatgttaccgagagcccacggcccctttcaccaaacgctcttacatcgcaccaaggcggacatggaccggagggcggcagtatccagttgcaccggtcacactctcccagtatgtcgcagccatttcagcagcaacccttcagccgatccggaccttcccagggacccgtcacgaatcattccgctcctggcctggggcttcctccctctcaacccggcgcccctcagctgcctcctccacccgggctgggcccctcagatacgcggttctcccttcacaatccaggatctgtgcagccgccgcagcaggccgctacaaagcacggatcttccctcggtcattctaccaatcacagtggatccctgtcttcgaaagctggcctggacgccacagcaggcaatggcactcatcttcccggaccacatgaccccagctttgtggaacaaagcagagaccgggaggacaagctttgggcctacatccgatcagtccacgaagaattggcaggattgaaaagcgaagtggccgctttacgatcccagcttgcttcgtcaaatgccagcaacctagcgcctacgaatacaagcgccgcgtcggctcaacctgagagcagttccggtagcactgcacagcgatga

SEQ ID NO: 7915 - DNA, 231 bp, A.fumigatus
aacactatgagaaacccgatcatagcctatccggagtcatatcatattgcaaggggcctaaattatggtgtttgttcactactaaatggttattccaagggaagtgcaaagaggtgggcgacttaccctaccgcaaagcccgatggatcaacacagagcctcgaagatagtaactatatcactgcgcagagttcgtccgggaaaaggcacaccctggtgagaagccaatga

SEQ ID NO: 7916 - DNA, 564 bp, A.fumigatus
gtctcgggtttaactcggtctgtaggcattgggagaggtcttgcagcacattatctcgcccaaccgggcaccactgtcattggaaccgttcgggacaactcgtcggagaaagcgaaagatctcagtaagctgccaaagggtcgtggctgtgatctgattatcgtgccgctcagtgtcgacaacccatcaagggttgcggaggccgcgtccgaaatccagacacggcatcatatcgagcacatcgatgttgtcattgccaatgcaggaatatgcaaccactggggcccgattcaggaaatgactgacttggacgtgctttctcactttgcagtgaacacgctgggaccgcttcggctgttcacagccatggcaccgttgctgcagagagccagtactcccaagttcgtttatatctctacgctcctggccagcattcatgcgattgaacaaatgccttcattaactgcagcttatgggatgtcgaaggtggctgggaattatctggttaagaagattgatgccgagaataagcacttgataactctgtcgattgatccggggtaa

SEQ ID NO: 7917 - DNA, 330 bp, A.fumigatus
aggatcagggctggcagttgcccagagcgacggggcttgaccgttgatggttttagcgaaacgaaggatcgtatctgtgtaaacgtcgctagcgaagcgcagaaccgtgtggccgtcgacaccagtgtgttcaaagttgatcccagcacttccgttcttgcacacaataatctgcagtttgtcgtaccaccggttggtacaggtaccaacctggacacctctgacgacctcgctcgtaccacagagcatgttggcgcaaagctgcgacgtattttccggttctgtgtcgtccagacagaggacaaacaatgctgtgtcgacaatgtttag

SEQ ID NO: 7918 - DNA, 258 bp, A.fumigatus
tatatctctcagacccgaccatactttccgattctcggtgctgagaacaccaagggcaccctttgcggcctcctgtactggggtctgttcggcatcgccaattatcacctgcagattgacggcgatatccttctcgctcatgatcaagtcgttgttatcgtcaagaacatcaaaccagtagaactgaccccggcacaaaaccacgatgtgctttgcgtgcgggtcctggctgatgatacacccattgtccgtgggtag

SEQ ID NO: 7919 - DNA, 465 bp, A.fumigatus
acgtcgctagcgaagcgcagaaccgtgtggccgtcgacaccagtgtgttcaaagttgatcccagcacttccgttcttgcacacaataatctgcagtttgtcgtaccaccggttggtacaggtaccaacctggacacctctgacgacctcgctcgtaccacagagcatgttggcgcaaagctgcgacgtattttccggttctgtgtcgtccagacagaggacaaacaatgctgtgtcgacaatgtttaggcactccgagttgttagacccctcgtccttggttagtatatctctcagacccgaccatactttccgattctcggtgctgagaacaccaagggcaccctttgcggcctcctgtactggggtctgttcggcatcgccaattatcacctgcagattgacggcgatatccttctcgctcatgatcaagtcgttgttatcgtcaagaacatcaaaccagtag

SEQ ID NO: 7920 - DNA, 444 bp, A.fumigatus
  unsure (26),(77): Identity of nucleotide sequences at the above locations are unknown.
cccggtttcaacccagggttgatggntagggttatgcctcccaacccaaattcatggacggcgggatcggcccgggntcgttctggcgagaaaaagggcttgacatttgccaaccaggactcactgccaaagttgcctattcctgaccttgagagcacatgcaagaaatacttagaagcactatcagctttgcaaaccccacgagagcaggaagaaacaaaggctgctgttcaggagttcctcaaaacagacggccctattcttcaggagaagttgaagaattatgcctcgtccaaaacgagttacattgaacagttctgtatgtattctctgaaacacgtcgcatgcaactgctctaacatacagcacatagggtacgactcttacttgaactatgacaatcgtaaggacttctccatgcttcttacagcactcgatcgctaa

SEQ ID NO: 7921 - DNA, 1683 bp, A.fumigatus
gctgacctggtcacagctgttgtcttgaatcttaatccgttctttttgctggaagacgaccccacgcctgccaggaacaatcaggtgactcgggccgcgtctcttgtcgtatctgctctctcctttgtccgggctgtcagaagggaggaactaccacctgacacggtccgaggcacaccactatgcatgtaccagtactctcgactattcggaactgcgcgtctacccacggacaatgggtgtatcatcagccaggacccgcacgcaaagcacatcgtggttttgtgccggggtcagttctactggtttgatgttcttgacgataacaacgacttgatcatgagcgagaaggatatcgccgtcaatctgcaggtgataattggcgatgccgaacagaccccagtacaggaggccgcaaagggtgcccttggtgttctcagcaccgagaatcggaaagtatggtcgggtctgagagatatactaaccaaggacgaggggtctaacaactcggagtgcctaaacattgtcgacacagcattgtttgtcctctgtctggacgacacagaaccggaaaatacgtcgcagctttgcgccaacatgctctgtggtacgagcgaggtcgtcagaggtgtccaggttggtacctgtaccaaccggtggtacgacaaactgcagattattgtgtgcaagaacggaagtgctgggatcaactttgaacacactggtgtcgacggccacacggttctgcgcttcgctagcgacgtttacacagatacgatccttcgtttcgctaaaaccatcaacggtcaagccccgtcgctctgggcaactgccagccctgatccttcaaagcgggaccccaagagctttggcaatgtcagcacgacaccgcgaaagctcgagtgggacatggttcctgagttgagcattgccttgcggtttgccgagtctcatcttgccgatctccttcaacagcatgaattcgctgttcttgactttgaaggatatggcaaaaatttcatcacttcgatgggcttctctccggatgcctttgtgcagatggcatttcaagccgcttattatgggttgtatggtcgcgtcgaaaacacctacgagccggcaatgaccaaattcttcttgcatgggcggacagaagccatccgaacggtcaccaatgagtgtgttgactttgtgaagaccttttggggcgacaaccctgcggagcagaaggtcaacgctcttcgtaaggcgactgaaaagcacaccgccatcaccaaggaatgctccaagggccggggtcaggatcgccacttgtacgccctgtattgtctttggcaaagatcatttgacgaggacagtccgtcagcgggcaatagcgttgaaaatggatccaacggatactcgagccccgttgagaaacggatcgcgatcggttctcccaaaacgtcgtcctccatgtctgaggatggcctctcctcgaacggctatagctaccgcggtatccggacactgcagcccaattcgggcatcttcagtgaccccggctgggacaaaatcaaaacacgatctggtcaacatccaactgcgggaacccgagttgaggcatttcggtttcgaccgacatccgaaaaggatttgggatcgttacattatccaagaacaactattctgaactgtgccctg

SEQ ID NO: 7922 - DNA, 528 bp, A.fumigatus
gatgatcgccagctcggatccttccagccccgtggtgaagactcagatgagcacccgcaaatctcctcggccaacatcaagcgcggggatactcagttggccatcttcaaggtcaagggcaagtactacgccacacaacagatgtgcccgcacaaacgcgccttcgtgctatctgatggcttgattggcgatgacgatgcgggtaaatattgggtctcctgcccttaccacaaacgcaacttcgagctcaacggtgagcaggcagggcgttgcacgaatgacgagagcatgaacattgcgaccttcccggttgaggaacgcgacgacggctgggtgtatatgaagctgcctcccgttgaggaactagattccgttttgggaacggagaaatggaaggtgaggaaaggggaagcaccagatccgttccagaaggtcgacaagaggtacaagggcatgaggggcaagaaggcgtgtgatatcagtacgaaagccccgaccacacaggcggcaaacatcatcgattggtag

SEQ ID NO: 7923 - DNA, 189 bp, A.fumigatus
acattgggattctcctgtgcttggtctattttcgcagtgaattggtccgtgagatcattctatataactccgcccatgggtctaattctacttcagttatgcaacctcgtgtcagtcctcattttttcaatcaagtctgtccattatctctccaaggtctttgacgctactaggcttgtccatccctga

SEQ ID NO: 7924 - DNA, 330 bp, A.fumigatus
aatttttcaatgatattctcattcccccggatcttctgttggatggcgctcgattgtaagcaaccgtctttctccagactgtcgcaggtgcatactggctcaccaagaaacagtgacattgccgatcaggtgtgggtttgggaaaatgaagatggctcaaccttctacttcgacataggagaaattgtccgtttcagagttgagatggaggaatggcatgatcagattcctaatgccccagatctaggagacggcacaaccattgaacgaaagcccccctactccatcatagtatgtggccatgcgtttcgatttcagacggaacgttaa

SEQ ID NO: 7925 - DNA, 219 bp, A.fumigatus
ttcgatgtagtaaagcggcaacgcgtcgtgtctttggccactcaattagccgtctgttacatccaggtgtcaaacagcaattgtctgtgcaaacgcaaagccctgcatagtcccaagtcccttctcacatctcgaatcatgcatatgcagaacaaatctgccagccaagtcttcaaccaatgtctactgtctgctaaagcacccattcctaagtcctga

SEQ ID NO: 7926 - DNA, 645 bp, A.fumigatus
cataagtctagtgtgaatgagatcttcaaccccgagcgagtcgacaagttctacagccaatctgccgcagaacgccagcgctctctcctcgccgacaaggctaccaactacagtgttgtccgcctggagttgattgaggagatctataacgacatgtacctgcagagggtgaagaaccctgacgaaactcagtggcagcatcgcatccttccggaacgcaagatcacacgggtcgagcaccatggtcctcagagtcgaatgcgcatccacctcaagtcatccaagcccgagtcggaaggcgcagcaaacgacgtcaaagaaacgctggaagtcgacgctctcatggtggctacaggctacaatcgcaacgcgcacgagcgactcctgagcaaggttcaacacttgagacctacgggacaggatcagtggaagccccaccgagattaccgggttgagatggacccgagcaaggtcagctcagaagccggcatctggcttcaaggttgtaatgagcggacgcatggccttagtgacagtttgctgtcggtactggctgttcgtggtggcgagatggtccaatcgattttcggagagcagctggaaagagcggcggtacagggccaccagctacgagccatgctgtaa

SEQ ID NO: 7927 - DNA, 1068 bp, A.fumigatus
  unsure (18),(1056): Identity of nucleotide sequences at the above locations are unknown.
atggtggtaaacgtagcncacggcgcgccgcttgctggtacggtgcaaagacacttgatgtggaaagtggaccggcttgtggtacttgcgtcaacgtcgggtatgttctgtgtcttgctcccacgtacggcccggggaagcgtgggatttgctaacgggagggtttgcagctgtgtccccaacaagatgacctggaatttcgcttccatcaacgaagctctccacgtcggcgagcactacggctacgacatccccaaggacgtcaagatcaactaccgtcaattcaaggaaacccgcgacgccgtcgtcaaacgtctgaacggtgcctacgagagaaactggggcaaggaaggcatcgacctcgtgcacggtcgcgctcggttcgtcgaacccaaggtcatcgaggttacgctcaatgacggcgcaaaggcgcggtactcggcgcctcacattctcatcgcgaccggtggccggcccagtattcctcctgtcaagggtgccgagcatggtatcactagcgacgggttctttgagatcgaggagctcccgcccaaggttgctgtcgtgggtgccggttacattgccgtcgagctggctggtgtcatggctgccgtcggcgtggagacgcacatgttcattcggggtgagacgatgttgcgcaagttcgaccctatgattcagaagacgatgacggagcggtacgaggcgaccggcgtgcacattcacaagaagcatggcgggttcaaggaggtgcagctggtgaaggacggcaagggcaaggacaaggtgctcaagctgatcggcaatgacgggtcggaggaggaattcaacgagctgctgtgggctatcggccgtcagcctgaggtcgaggatctgcatctcgagatccccggcgtgaagctcaacgaaagtggccacgtcgttgtcgaccagtaccagaacacctcggcggagggtgtttatgctctcggtgatgtcactggcgttgcggaactgaccccaggtacgttattctcgtcttcaccacggggctggaaggatcgacggggtgtcagngatctatgcgca

SEQ ID NO: 7928 - DNA, 918 bp, A.fumigatus
cgtacctggggtcagttccgcaacgccagtgacatcaccgagagcataaacaccctccgccgaggtgttctggtactggtcgacaacgacgtggccactttcgttgagcttcacgccggggatctcgagatgcagatcctcgacctcaggctgacggccgatagcccacagcagctcgttgaattcctcctccgacccgtcattgccgatcagcttgagcaccttgtccttgcccttgccgtccttcaccagctgcacctccttgaacccgccatgcttcttgtgaatgtgcacgccggtcgcctcgtaccgctccgtcatcgtcttctgaatcatagggtcgaacttgcgcaacatcgtctcaccccgaatgaacatgtgcgtctccacgccgacggcagccatgacaccagccagctcgacggcaatgtaaccggcacccacgacagcaaccttgggcgggagctcctcgatctcaaagaacccgtcgctagtgataccatgctcggcacccttgacaggaggaatactgggccggccaccggtcgcgatgagaatgtgaggcgccgagtaccgcgcctttgcgccgtcattgagcgtaacctcgatgaccttgggttcgacgaaccgagcgcgaccgtgcacgaggtcgatgccttccttgccccagtttctctcgtaggcaccgttcagacgtttgacgacggcgtcgcgggtttccttgaattgacggtagttgatcttgacgtccttggggatgtcgtagccgtagtgctcgccgacgtggagagcttcgttgatggaagcgaaattccaggtcatcttgttggggacacagctgcaaaccctcccgttagcaaatcccacgcttccccgggccgtacgtgggagcaagacacagaacatacccgacgttga

SEQ ID NO: 7929 - DNA, 2226 bp, A.fumigatus
agacacgagcgctgcgatttctcgaccatccatggcctccgtcatttccatcactctctccctggctactgtccaacgccattagtctcacttcctgagattgccaccgagctaggggtcaaggcagttttcgtcaaggacgaaagtgaccgtttcggattaccttcctttaaggttttgggcgcatcatggggatgctatcgctctgtggtgtctcatctgggattatcaccgactgtggctcttgacgatgtgaatcagcgactcaaggaaagccccgtcactctttttgcagctaccgaaggaaaccacggacgagcggtcgcctttatggcacggcagttcggagtaacggcgcgaatcttcgtccccgcctcgatggacgaggagacacgtaaccggattgcatccgaaggcgctgaggtagccattagcgacggcgactacaatcttgcagtccaagaggcatggatcgcatcacagaacgatggtggactactcgtccaagacaccgcattcgatggatatgaggaggtcccggcatggattgtggagggctactcaacaatgatgacggagatcgatgaacagctaagccagcttggtctgcaaagcactctgactgttactcccgtgggagttggaagcctggggcatgccgtagtcaggcattgcaagtctcggacgaccccaattgctgtcgtggctgttgagccggacagcggaccgtgtctgatcagcagcctagaggccggcacgatggtctcagtcacgtcttccgaaacgatcatgaatggaatgaattgcggcacggtatcagccaccgcgtggcccgatctgcagcgagcggtggatgctgcagtcaccgtttcatcgtatgagagtcactgcgcggtgcagtatttggcatctcacagcgtccgcgcaggcccttgtggcggagcatctttagctgcaatccggcggttgcgagcatcaggccaggccgcatcattactacatagggacgctgtggtggtactcctctgcactgaaggtgcccgtccatatcccattccccgcgatgtggccgttgaggacgttgtgggtttgacgcaagtcctaacacagatcgactcatccaaccctacactctctgtagctgacggtgtgggagagaccgagatcgccaactatctggctgcgtggctcgctcatcgtgggatagagtatcatcgcgtcgagccggtagccggtcggccatccatcgtcggcgtattccgtgggagcggcggtggtcaatcgctgatgttcaacggccatattgacactgtcagcttgagtagctatgaaagcgacccgttgtccggtcatttgggcgagaaggaaggcaggcaagtgattttcggacggggtagtctggacatgaagggtggactggctgctgctttggcagctctcgcagcgattaaagccagtggtcgcacccttcggggagatgttatcgtggccgctgtgtccgacgaggaagatgcttcccagggaacccgcgatattattgccgcaggatggcgtgcagacgctgccgtggttcccgagcccaccatgggggcgattgcaatagcccataaagggttcgtgtgggtggaagtggacattctaggtgttgccgcacacggctcggattctcaagcgggagtggacgcgattcttcaagcaggctggttcttgcaatctctggagcagtatcagaagcgactgcccatcgacgatactctgggacaggccactctacattgtggactgatcaagggcggccaggaaccttcctcgtatccgcagcgttgcaccatcaccatcgagttccggacaattcctgcccaatccaacgagtcgattcttgaggatgtaaatgctttgttaagtggcattgccaaagagaaacctcgctttcgatatgctccccctcgcctcacgatctcgcgtccgacacagaagctctcagcggaccaccctctagtccaaacagctgttgcatgtgccactgaggtcctggtagacggtcctggggtgattagtgtacccttctggtgcgacgcagctctattgagtgaagcgggggtccctgccatagtctatggtccatcaggagccggactacacagcaaggaggaatgggtggaggttgacagtctccaagagatgagcagagtcttcgaaaagctgattcaagaactctgtgcttga

SEQ ID NO: 7930 - DNA, 357 bp, A.fumigatus
atccgcgacccccgtggtgaagacgaattcgggaccaagggagacgccaacacattcatcggcacatcttactacatggctcccgaacgaatcaccggccaatcctacaccattacatctgacgtttggtcccttggtgtgacgctgctggaggttgcgcagcatcgtttcccgttccctgccgatggcaccgagatgcagccaagagccggattgatagatcttcttacatacatcgttcgccaacccatccccaagctgaaagatgagcccgaaaaccgtattcgctggtccgataacttcaagtactttattgaatgctggtatgtatactctgctatggacgaatggggctag

SEQ ID NO: 7931 - DNA, 288 bp, A.fumigatus
ccatgcgattgtctcgagtgctaccggccccgagtactacgtttctatcatgtcatttgtcgacaaggatctgctggagcctggtgccagcatccttctgcatcacaagtctgtatctgtcgtcggtgtgctgacgggaagagtccgatcctctggtctcagttcatgaagctccaccaggcaccaaccgagtcgtacgcagatattggtggtcccgagtcgcagattcaagaaatcgaagagtctgtcgaattggcccttgctccaccccggaactgtatgaagaga

SEQ ID NO: 7932 - DNA, 540 bp, A.fumigatus
caaagcctatgtctgcagaaggagaagcccaagtacgaaccaccaccaccacctaccaccaggattgggcggaagaagcgcaaggctgccggccctagcgctgcctcaaaactccccgacatttttcctacgtcacgatgtaaattacgataccttcgaatgcaacgagtccatgaccacctgttgctcgaagaggaatatgtggagaacatggagcgtctgcgtaaggccaaagctcaggcaacgctggactccgtgagccgaggtgacctggatatcatggacaggaatgcggacgaaaggagccgtgtggatgacatgagaggcagccccatgggagttggtaacctggaggagctaattgacgatgaccatgcgattgtctcgagtgctaccggccccgagtactacgtttctatcatgtcatttgtcgacaaggatctgctggagcctggtgccagcatccttctgcatcacaagtctgtatctgtcgtcggtgtgctgacgggaagagtccgatcctctggtctcagttcatga

SEQ ID NO: 7933 - DNA, 207 bp, A.fumigatus
tttgaatgctggtcgccaagaccgggccagatggcgacaacagcttacctgagagctctccgtccatctctccagcggaagcttcactcacttacgttcacgccttcatccaccctcttaacatcaaccgccctttttaacgactcttctggtagcaaggttgctgttgtcaggggactaattctgctaccgctttctaactcttaa

SEQ ID NO: 7934 - DNA, 240 bp, A.fumigatus
tatatcttctctgctgagctatcctgtgagtgttcgaactactcctcgtctgcctcgtcgtcccctcatgaatcactcctcgagcctcagtcctcaaaagacagcgaggctcaatatgccttcatctaccagtaccaaacaagcatgcttactttttctctggctcttcccgtcccaccttctccccgctcgtcatcacgcttcgagttgataaagaagataactgatcactcttgctga

SEQ ID NO: 7935 - DNA, 186 bp, A.fumigatus
aatcatctcattgatcattgtaacatgctttctgcccgcggggaaacatatgccaaggccggcttggcaaacagctaccttgaggccctcaagaccccctacaacaaagacaacaagcagggagttgtgtctttccgtaatgcagagaatgtactcagccacatactcctccttgtgggttcttga

SEQ ID NO: 7936 - DNA, 558 bp, A.fumigatus
cggaagatgtattgtggaaacgggtcccttatgcgcgttgcacccattggactggtgtattttcgggacatggagatagcattgtccaacgctgcgctttcctcaaatgccactcatccttaccccaggtgcgccgagtgctgccagatctacaccagactcattgtgcgcgctctgaatggcgctagcaaggaagagcttgcagaagagttcgctaggataaatttcacagatgttaaggtgaagcagcggcttgatcgttattcaaatctcaccgattgggagaacacggatgaagaacatatcaaatcatccggatacgttctttccacgctcgaagctgctctgtgggctttctttaccacaagcacattcaaaagcggagctgtcaaggtcgtcaacctgggtgatgatgccgatactgtgggggcggtatacggagggctggcacgatcatattatggacttgaaaagataccagctgattggattgcgagcctacagaagaaaaacattgttgaagaaattgcatctggtctctgttctcttacggagtga

SEQ ID NO: 7937 - DNA, 480 bp, A.fumigatus
ctaactgcgctagatgccgtccccaagaagcgcggccccaaaacagacgtcctcgaggccctgctcaagcgtgtcgacggtctcgagaaacgtctgcaggatgagaataaaaatcccatgtcgcccacctcacccgtcgagccgcacaaggaacctccggatccgtccgcctcaatgcatgccctcgcacgcccatccacctccagcacatccactaccagcgtccccccatccgaaccttttccccggccattctcctttccgtcgcaaccgtcgcctcccgtgcattactttgccctgccggattccgtgttggatgcgtactttgctcgcatccatggcaagccctacttcatcctggacgagtcggtgactcggcagagtcatcagatggggcaattgcctgtcgctttgtccatggccatctacgccattaccttgcggtttgttcccccccctccttgcctctctttcatctag

SEQ ID NO: 7938 - DNA, 240 bp, A.fumigatus
ttcagcactgaccattgcagttatacgagctcaccgaacccctccgaacagtccctgcgaatggccctggattatgccctgcaggcccgacgcatggtagatgtcgatcaaccgaccatggatgggctacaggtcctacttctgctctcgcagacattcctcgcccatggtctgggcaaaaaggcctatatgactttcagtatgcaatccatcgccttctggaaagacaagacaggatag

SEQ ID NO: 7939 - DNA, 534 bp, A.fumigatus
  unsure (496): Identity of nucleotide sequences at the above locations are unknown.
tttgactgtatagccaactgtgcctccatggccattgctctagacctctaccgcgagcccccgaagagtctgcctgcgggggaacgcgagatccgccgccggctcttctgggccgtctacatcatggaccgcttcctgacctgcggctcgaaacgtcccggcctcatcgccgaccactccatcgtcctgcggctccccgcgtggtccccgcatacggccggactcaacgtcgagggcgagctgttcaacaatgtcggccccaacatccagtactcgagcgacccgcgccgtaaacccgcggccaccgccctcctcatcgacatcacccgcatcctgggcatcaccaaccgctacctggccgccggcggcgtcaagggtgactcgcacttcccctggcactcgctgtccaacctgtccaagatccgtcaggagctggacatctgggctaccggtaccccagatgtgtttgcgtcggtggaagcgctgttcgggcatnccgagagctccatcctgctgctaagcaagctcatctaa

SEQ ID NO: 7940 - DNA, 513 bp, A.fumigatus
tatctggtccactgtctgatctaccgcccgttcctgcccattgacctggtcgagctgcgtggcaccggccagcaccagtcgtggcagatcgaggccacgaacctgtgtttttcgcactccaacgccattgccgagctcgtcgagctggcccgcaactccccgctgatcgaatggcctgcctttgtcgggtactgcgtctgcacggcgggaaccgtccacgtgcacggcgtgcactacaagggccgtgagggcgaggtgttttcgtccagcgccgagtttcttactcgggagatgcaccagctgacctggctggggtcctactgggccggcgtccagcaccagcgcgagatgctgcagaccatctacacctgtcatgcggagctggtgcgcacgctggccaccagtcccatgcgcttttcgcccgtctttcacctggaggactttttggatcggtatcccggtctgacggccgacgggtcgcacgtgcgcctggtggatatggatgatacgtaa

SEQ ID NO: 7941 - DNA, 495 bp, A.fumigatus
ctcggtagcccccaattggacccatactaccgatccatgcccgcatattccatgtaccataaccaaccactccgcgcgcccgtcaccctcccatccaaccacaacccgtcaccacgccgcgactcgcacagcaccgccagcactgcgaccaagccgccaggcgtctcgtcgccatcgctcacctttcctccttcgcagcatccccagccttcgccgcaacaactccactctacctttccgctcggcaacgccgacctgacccacccttcttcctcggatgccagcaatcaccacaaccacaaccacaaccacagcttctccccaccaccgccatcggccatgttcggcttctcgccgcccgccttcctgaccgaatccctgcccgtggcgcccactccgccctcccaccctcagtacgccaccttccccttcgacagcagcagcagcaacaacaacaacaacaataacagcaaccatcaaacccacaccggccaa

SEQ ID NO: 7942 - DNA, 210 bp, A.fumigatus
tcgctttgttgctccttactgtctggtgtcggtctagttgcttcgtgcggctctgaatctggtgacaacaggtctgggctctttggctcgaaagtaggatcgagggtggtcgcgatctcctccttcttcagggcaatcctgcacgctatctgggacgaccagacaaaccccagcgcgggcgtcttgtgcgtcgactgtccagagaagtag

SEQ ID NO: 7943 - DNA, 1371 bp, A.fumigatus
cttactggacgacgtacgtcttgtttgctagttctgactgtgcgaggatgtagtgggagcggcaagacgcaattcctcctcagtctccttctagcggtgcaacttccagaacctcgaggtcttgggaaaggcgcaatatacatctcaacggaggctccgttggcgacatcgcggctctcacagctcttggagtatcatccatacctttcggacctcccgaaagaccgcgccccgacactggataacatcctctccatcaacgcgatggacctggaatcccaagaccatatcctcaactaccagttgcccgttgcgattacccgctacgatgtcggcctcgtggtcatcgactcgataacctccaactacagagcagaacatacatctcacaacgttttgggcctgtccacacgatccggggaactagcaaggctgggccagatgctgcgcaacttagccgtcgcaaagaatatcgcgattgttgttgcaaatcaagtttccgaccgcttcgatcctctcgaggataacgcagcattacggcgcgccgccgcatacggaaatactattggctcatcctcgcccgtatcgacacaacaacaaccgacgacacctttacaccgcgattcagccatcgcttcacctcttcccgctgcccgatccaggcctccagagtctggcaatgccgaactatcccctcatatcacgatcgcaccaccgtcctcatccccagccttcccctcctcgccgttcctcgcggacgacaacccgtccgagcagcagccgcaagactttgacgggtcgtacctgatcggcaaccctgtgcgcaatgagctactgagcctaatgcaccagcaacgattcttcactgggtggggtgatacgccgcaggctgccgcgccgccttcaccatactacttctctggacagtcgacgcacaagacgcccgcgctggggtttgtctggtcgtcccagatagcgtgcaggattgccctgaagaaggaggagatcgcgaccaccctcgatcctactttcgagccaaagagcccagacctgttgtcaccagattcagagccgcacgaagcaactagaccgacaccagacagtaaggagcaacaaagcgatcaccgcgtcttggaaacaagcttagatgtcccacccgtacggcaacggatcacgccccaaccggcaccaccggacataatcccccctcgcacgctccgaagaactatgaaactggtctttgcgccttggaccgccgggagggtgacgactactgtcggcaaggacgggaactctaccgttcacgtccaagatgaggttgaatataccatctggaagggaggtttgaggagtgtggaagcgcaagagtag

SEQ ID NO: 7944 - DNA, 210 bp, A.fumigatus
ggagcaacaaagcgatcaccgcgtcttggaaacaagcttagatgtcccacccgtacggcaacggatcacgccccaaccggcaccaccggacataatcccccctcgcacgctccgaagaactatgaaactggtctttgcgccttggaccgccgggagggtgacgactactgtcggcaaggacgggaactctaccgttcacgtccaagatga

SEQ ID NO: 7945 - DNA, 600 bp, A.fumigatus
tgtgccaaagtggaagcaataggcttcatttcccgctctatatccgcccaacacgtctccgaacgcaccccctacgtactgcaattctctctgattatcctcgcacccgtcctgatggcagcttgctgctatatcctgtttggccgcatcctctttcacgtcgtcccacctgaagcacgaacctttcaactgtgctgggttcctcctcgctttatcactccgatcttcgtgggctttgacattgtggccctcctgctgcagctcggcggtgcagtcttgatcacatcagccgatggtactagcagtgatgcgaaggacaagttcgaccgtggtcgcaatattgcattgattggcgtcatagtccagatggtcgcctttgggctattctcccttgctgcgtttcggttcaacttcacatcgaaacggtttgcgaagcctgtcgacgagcaattcgaaatgcttgcgagcaatgatgcaggaactggtggccgggaaaaaagtgccaactggaatgcgctgctgagagtggtgaacttttctactctgatgattcttgtaagtgtttccaaaagatcgtctcccgtgttaaatcatcgctga

SEQ ID NO: 7946 - DNA, 456 bp, A.fumigatus
acctccgtcaattactggcttaagtatccctcataccatccattcggtggccgccccgaagacacacccatgattaacactggcggacctgccctaagtcggaatgacactctaccgaacagtctggagaaaaacaacccttcttttcaccttgtattgcccgctggacagaagagcgccgcgctgtgtcgcacaataacatccgcaatgatcttgaattaccccccgcctactttggtccagtacggcagaaagctcccaagcggatcctctgaatatgattatgtggtggaccgtgtgacggccatatacaactttctgcaatacaccccgcacgtgcgagacggcgattttgtcctcatcgccgatggctatgatgttttcttccagttaccgccggaggtgctcatccagcggttccaaaatatcctccgagagaacaatgccaagttgtct

SEQ ID NO: 7947 - DNA, 459 bp, A.fumigatus
cccattggggagggttcaagtttttcccgggttgttccatttgcaacccggccattgttttggcgggataggaaattcaaatcccctctggagttaatggttaactcgaggaggtcattgaggtttcccatttcttcaacttcggtttcgtatatccctgtatggactgggggaattgtgggcacagctgcgggcattaaccccaaaatactggacaatttgcaatccgataccgttttgtcgatcgcttcgtgggagcacggcggctacgaccagcaattcgagtgggatactagcccagactcgaatcaggatgaagcagaagtcgtggatttaggtgttatacatggttcactggccgacgatcagcccagcgcctctgtctttggacataattccgaccccaggttagcacaaaatctcctattccgtcgcgatggttgcaatagaagtagctga

SEQ ID NO: 7948 - DNA, 1251 bp, A.fumigatus
ctgatggatctttcacttgcttgcagcaacccaggtctcatctcgcccgagaagttaagcgccgtggatgccgcaatcgagggcaccatcagcgggaccgtgagccccagaaccttgccctcctcgaccgatgataactttcacgttgatgaaacatggccgcacttccagctcatcaaccccatggcggctggactgcccgtggacgcgcctatggccttaccttacgcgaaagacccgacctctaacaacacagtgatcgtcgacgatggaggggagctctccaacggacaggggtttccggaggtccagccggagcagtacctgacattccagaatctttctcaagcgtttcagttcgccggtgatccttgggcggagcctcctgtcaatcttgatgcgaatacgtcggcgcaagcacccatctccgttcctcagatgagaccacaggtacaaatccagattatcaatcagcctcgcagcttccagggctctttgcgcccgctcgaatcgcgctggcttgaaagccttgaatcccaactgcctacgaacctaactttgcctgcctcattaacaacagattgtcaagaccactccttacctaaagatgacagaagacttcaggatgcatttcagtacaagtcagagagctcttctgtttctggtgatctttcaggagtttacgactgctcctactcgggcttaagtgatgatgtgccggcgtttgcagaacgacaactggaagacgatggtgcttggaaggatgcgcagaagaaggagtcttcgtctgcaacctcacggccgctgcagggtgccactgcattcgtagtcagcgaaaacccccaagagtctttctttatgactgctcctagcagatcgagggcttcgtcgaccgctgcgcaacgagcctctggccggcctcaggcacttgctttgcaatcggtggctaccgtcagaaagcgcaagcagcgtacctcgaacgttagcattgaccagagtttgccgaaaccactgcagattgtccaggaggacggccaaggtggctccattgcctccgctgattttgtatcgccgcctcggggagcccgccgcaagggtcctttgagcatggttggcagggccaatgctggattgcggaggaagaataaggatacttgtgttcagtgccgcttgaacaaacggaaggttggtttacctgcgtcgggcttgttttggtctcaatatcacagaaagctgatgattgcagtgtga

SEQ ID NO: 7949 - DNA, 216 bp, A.fumigatus
ccccatgagtgtgtttcttgcaatccaataatatacctcaaacgatgcgcattcgcacacagccaggggaacgcgtgtacaaatacgggggtgcatcccgcaacagaattcatggaagtgtacgacagccaggattttgagaagacaacaactgcttacggactccaaacacgactaattatcatctgccatgtcatcacctggtcaatgatataa

SEQ ID NO: 7950 - DNA, 186 bp, A.fumigatus
acatatgccttggcaaactgtcaccccttttgcatttctttaggaatctgcaaaacatcggaatctgcacaaggatccaacgttgttgcgcagaacaacctgcccacggagtacaaatcagatgcaaattacgctagttacaaaaatggaggtcttttctgtcaaatatttaactacccacattga

SEQ ID NO: 7951 - DNA, 351 bp, A.fumigatus
tctctccaatttctcttgaagtcggttattatggcttcagaacagccagtcgaagccgccccaacgggcggttctctcgccgatcgcatcacgaaacccgatgaatcaaacacttccggtacgcgcgcatatcatctcccttcggcggatcagaccgaacatacgactaatctgttgaaagcagaaacacctgcgcccatcggcgatcagacagatggcgctcccgcgcaacttggtggctccgacctccacgagccggagtacaacgttgaggtcaagctcagcgatctacaagccgaccctaacaacccactctactctgtcaagaactttgaggaccttggactgtaa

SEQ ID NO: 7952 - DNA, 525 bp, A.fumigatus
ctaacctctttgcgacccaacagggaccctcgaattctgaaagggctgtcgagcatgaacttccgcaagccttcaaagatccaagaacgcgccttgcctctactgttgaacaaccctcccaagaacttggtcggccaatcccagtccggtaccggaaagaccgccgctttcgttctgaacgctttgagtcgtgtcgacttgtcgacggagcaaatgcagaagactcctcaggcattgattttggcccctacgcgagagcttgcccgtcagattcttggcgtcgtccaagtcatgggtcagttcgttgacggactcatcattggcgcagccgtcccgaccgatagagacagccgtcctaaaagactggagtgctccattgtcgttggcactcctggaaccgtaggggacatgattaaaaggcgtacctttattcccaacaagctcaaggtgctcgtgcttgacgaggccgacaacatgctcgaccagcaaggtctcggcgatcagtgcatccgtgttaaagcgtaa

SEQ ID NO: 7953 - DNA, 384 bp, A.fumigatus
  unsure (326),(341): Identity of nucleotide sequences at the above locations are unknown.
gtgtcgaatgggatacaatggctcgatgagatccaacaattttatcgcgagcggagcgcgatcgagaaggaatacgccgccaaactcactaccctctgtcggaaatactccgatcgcaaggcgaagaaaatcagcagcctgagtgttggagacaatcctgcaatgaccccgggctcccttgaaagtgcttctcttaccacctggacgacgcagttgaccgctgtcgaatcgcatgccgcggaacgggacaagttcgcctcggagttggtcgcgcaagtggcggagcctctcaagcaagcagcggcgcagtacgaagaacttagaanatgccatgtggactntcatgcgaggctggagaaggagagagactcatcttacagtgag

SEQ ID NO: 7954 - DNA, 546 bp, A.fumigatus
  unsure (75): Identity of nucleotide sequences at the above locations are unknown.
atcagtctactacctgtactttttcctatatttgacacccaacactccttccacacgatgtctagcgaaaccttntacaagacccaacaggaccttcgcaaggccgaatcccatgcttctcatgccgccggtggaaatacacctgccaattccaatgtctctgctatgaaggtaacaccaaacctcctgatccaatttggggacacagctgctaactctacgaatcagtccatcgttgatgagcacacagacaaggcgaaggccatcgaagaacgcaaggccaacctgcctttgcctgaccagcctcccgtggccagcgactggcagtctgcagaccagagagctgtcaacgtcggctccggcggcgtacaaggatccgtttctggcgagagtaacaccgctctaagggatcccgctactgcaggaagcagcgcacggatgtcaggagaggaattgcacaaggaaactcagcccacaggcaacgttggtcgccaagccacagaaggactttcggatatcccgggggatgctaaagctcgaaaataa

SEQ ID NO: 7955 - DNA, 255 bp, A.fumigatus
ctccccttgtgggggaagtatggggatcaaactctatctggacctagaagagatggtaaaacttcacaacgcttcgtgcgttcgatgcatcaccctcagtggtttatccggcccagaccagttactaagacgaacggtgtctctgacggacgtatccaagcaaaagttcaggatgcagcattcggtctggctgcaaggttggcaggcctgtctacgaaggaaaacttccacgagcagtacccgcacgacaagtaa

SEQ ID NO: 7956 - DNA, 399 bp, A.fumigatus
cggctgtacagaactgcattggctctcttggccgaactaccaaagacctgcgatacaatcgccgatgcgttcaataaaaatagccgcgaactcaaggcagcacgagacgagctatgcaatgcacagtccgaactcactatcctcaaaggccttctcgaaatccttttcaatctcctcgagaagatgtgggccacggtccggacctatcagatgggcaaagacatgaaggaagcagaggtacaaggagaaggagaacctttgggagcgatcctagatcttgctatcatgcagctggacttacaaagcaccaagattgactgtgatgctttgcgtcgagaaaatacatttctacgaagcttactccatggtacggaagcagcagcagaccagtgcgagtag

SEQ ID NO: 7957 - DNA, 333 bp, A.fumigatus
tataaaggtgacgaaccctcgctggaaatgaccttcaattttctttcggtcagcaacaacacggtttggtcctgtttccctgagactctcaccatggccagcgtcctgggcctcgtcgccagtgcctggctcctccccacggcctatggcgcaagccattcgcttgcgcctagcacgtccgcaacctcagcacaggcgcaatacactttaccatcttctattgacgttggcgctcacttgatcgccaacatcgacgatccccttgccgtcgacgcgcagtctgtgtgtccgggctacacagcctcagatgtgcaccagacatcccatgggttt

SEQ ID NO: 7958 - DNA, 246 bp, A.fumigatus
gttcaagctaatggattcagagcggtcacctacagcggctcctggcagaacagcggaaacggctacctctccgtgtacggctggacgaccagtccgctggtcgaattctacatcgtggagagttacggctcctatgacccctccacggggacccacccatctcggcaccgtccaatagcgaaggggccacgtacaacctctacaagaccacgcggaacaaagcgccgtccatccagtgcaccgcta

SEQ ID NO: 7959 - DNA, 336 bp, A.fumigatus
tcttatccactgactcgactgacgaatatcacgtccattcataactctcacacacttctcatttgcaatatggcaagcttccgaggcatctcgctccacatgacggtctacattgacccagcgaaactccctacgttctgggaagcattcaaaccagtatacgagcatgtcatcgcagagccagaatgcaccttctttgaagtgtatcaagaccctgagaaccccgggaccatcacgtgggtggaaaactggtgcgtagtcgccaatatgatgaagaacttaactgactggagtccctggacaggtcaaaaccgaagaaatggctcgttgaggtag

SEQ ID NO: 7960 - DNA, 396 bp, A.fumigatus
agccatgactatttaagccttggaatcgccacgaaggacatcatcttcagcatcgaagcaatcaagcaatcaagcaatcaaacaaccatcaacatggtctcattctcttctctcgttctcgctgcctccaccgttgctggcgtgctagctacacccggctcggagcaatacgttgagctagccaagcggcagctcaccagctctcagactggcacgaataacggctactactactccttctggaccgacggcggcggccaggtgacctacaccaacggcaatggcggccagtatcaggtcgactggaacaactgcggcaactttgttgctgggaaaggctggaacccgggcaacgagaagtatgcgtcctctccctgcttgttaggttcaagctaa

SEQ ID NO: 7961 - DNA, 849 bp, A.fumigatus
  unsure (79): Identity of nucleotide sequences at the above locations are unknown.
gaagaagcgattgaaagggagaaaccggaggtggaggagagaagtttacagcgggaaacgggaggaggcgcagagaacntgcggatgggagcagtcaaggaattcaccgtttcacacgaagggcggcacggatgttcccagaattcgagcgtttttgtcaaattgcgctgggttcgggaaggccgaggtctggaactagaccaacatcgcttgatgtctttattcaagcctttcggtaaagtcgagaacacgttcatgctcaaggacaagcgccaacgtgtcggggacaagcgagagaagaagactgtcgcgacaggtgtcgtggtattcgcctccattgtcagcgctcatgccgccgtgctggacagcgagaaaaagcgacgccagagcgctggccaaccggacaacgattggtcacttattgaatctgtatcctgggcgtttggcaaccagccagacatagtgggcacagaaacccgggctgcttctcccatctccacccctgatgaagcttcgtcagcacagaagccacctcctcatgttggcccctccaaaacggctttcgatttttccaagctcaaatcagcagcgcctcctggaggttcaggcaagacccccgggaaagcgccctcgtttgcctcattcgcgtcggccgcagggtcttcaaagccaacgccatccgatacatcggccaatggacgaagcactccaagtttccaggaaataacattaatgcgattgaagaatgcacagcgcgaaaaggagcgaaaggcccttgaggcgcagcttatgaaagaggatgaggcagcagatgctgctgaggctgctgccgctgaggctaggtgctaa

SEQ ID NO: 7962 - DNA, 921 bp, A.fumigatus
acttcgatcgaaagtggaaggatcggaggccctgaaaaacggggaacgcccgttatggtcttccagggaaagaccatgttgagcccccgatgggcggagaataacttggaatcggaattgtcctcgccgttcgcaccgtggtcatccgttgctgaatgcatcgataccagggctccgggtttcgggtctcggctcgtcacacctggcgaggaggacctgcgtgttcatctaccggatgaggctcaggttgctggctcccaggtcgatttgggcacgtatacggttcgtcggatgttgcacgggatagcggagggacaggatgagataatccgcgaatctgcgcttcccctcgaatgcaatatggacatgatgcggggtgttgacttccgcaagggctgctacgtcggtcaggagcttacgatccgtacgcatcatacgggggttgtgcggaaacggattgtgcctgtgcagttgtacgcgaactccgcccctcaatccggtgatacccctgtatatgatccctctgcagcggtggccttgccacctagcggatcgaatatctccaaggttgatggtagaaagggccgaagcgcgggaaagttcctcggtggagtcggaaatatcggtttagctctttgtcgattggagataatgaccgatatcgtgctcacaggtgagggttcacactacagccctgagcaagaattcaagatttcatggtctgcgccagaagagggatcatcaagtgctacggagccaggagaagtgaaggttaaagctcttgtgccgccctggctgagggactatatctcctctggagcgaggaaccttgctcgcaaggtggacaaccaggaaggccaccgggcaaaggagctcttatatcagttagaggaggaggaagagcaacggcggaatgagtga

SEQ ID NO: 7963 - DNA, 2061 bp, A.fumigatus
  unsure (12),(28),(32),(1966),(2045): Identity of nucleotide sequences at the above locations are unknown.
tatgatattttncggccctgcggtaaanaaancgagggcgcgagggatggaaccaaccggttctcgatctcgtcttccggctggcataaccctttcccgccacactcggcgggcccaacaaaccagttcgccatggattactcctctccgacccttaacgatctaggcatccctcccgagaccgtgtcacccaagtcgctgatggcgcagaatccgtttgctgagacctatgctactcccccctccatgacgtcggtgggccagcccttgatggcaggacattcccagagtatgttttcatcttctatggcaacaaacggtgaatctcctaatcctttcaacctgcctttcacgaacagtgacctacgatctcaccatgccccaacctcaaccgatacctttacagactccacacgacaggctttattagccagcatggctttgcccaccggtctccagaatcatcgcaagtacagccagccagccagcggaatgacgccctgtcgcgacctgttttcacgttccgccaccttcagtggtaccggccaacttcccagcactcaagacatgcaacgttatatctcggcttatatcacatatttccatccccatatgccgttccttcatatcccgacactcaactttcaagcccccgaatacacaaacaatcttcgtactccaagcggccatctgaacttgagctctaccggtattgccggcggcggggggtgcctgatcctttccatggcagccatcggcgctctctacgaatttgacaccgccgcctcgaaagatctttttgaagcagcgaagaagatgatccaactatatcttgaggagcgtcggaaagctgacatgtctgctgcattttcgcgctccaatcccgcgcgcgagaactcggttcacaacacgccgttgtggctggtgcaggcaatgctgctcaacgtaatctacggacattcctccggcgataagacgtcagcggacattgcaagcacccactgtgctgctctggtcagcctcgctcgcgctgctgggttgacccatcatatcgatgccaaagaccttccccaggactacttgaacacccatttgagtggtaaagtgggttccatgggtgcgagctccgaatcagaagattccaataccgcgtcattcgggccgccgaaggagagaaaagactggttggattggaagattgttgaggagcgcaagcggacagtctatgcgattttcaccctctcctgtttcctagtctctgcctataaccatgcgccggcgcttaccaactcagagatccgccttgacctaccgtgtgaggaagacgtttgggcagccgagtcccctcaagcctggaagaaattgggtggacatttgtcggcgaagaagggtctggcattctcgtctgcattgactacgctgctgacagccagtcaacgcgagcaatcccacgggcaattgtcctcacccgatgcaacaaacggtgtttcggcgtcggatcctaccgccactgatctgaagcctagtaccttcgggtgcctcgtactcatttatgctctccataactatatttgggagacgcggcaacggcacatgggccggcagtggaccgctcgcgagacagacgccatgcaagcgcacattgagccggcattacgggcgtggcagaccgcgtgggccagcaatcctacgcatagtctggagcggcccaacccgtttggagcaggccctctctcggccgatagcataccactcctggatctggcctacatcagactgtttgtaaaccttggacggagcaaggaggctttctggcagagagactggattgccatgtctgacgagttggcccgtggtaccgaagtgttcccgtattccgacgacatttcttcggacgttctcgacccctcgatcacccaggtgccaagtgagttagatcaccgtcgcgattcggtggctgacctgngtgtcggcgatctcactatctccaagactccgacccgggaacagcccatgcagatcttgatgggagtctaccggccggngcagtccaaacgcgag

SEQ ID NO: 7964 - DNA, 363 bp, A.fumigatus
ctggattccatcataatgactcttcctacagctaatatccaaagaaatgcgggttgctctattgttctctacaataataccgaatccacgacacagtattgctgcaactctattgtcaataaccctaatgggagtctgccgttctgtgaccaagggcttaacaccattgaggttgattctgcttcaatgattgcgggaatagcagcgctcgctgattacaccaggatcgacgactctaccaagacaacgtctagcgcagcttcgccgacttcgccgacttcgaatactccggataatattaactcccacggttcctcctcgcatgaagttagcagttggagttggtgtgggtgttccacttga

SEQ ID NO: 7965 - DNA, 1032 bp, A.fumigatus
gcggatccttccagccccgtggtgaagactcatcccagtgtgagcagtctgttgacaccgccggcctcgacgcaggccggcgaggtgaccgctcccagcacggccgcgccggcgaccaccgtgtctgcgacttcggacgtgacgccctcgtatgggacggcgtattggcagggacacagcggctacggaagtacgcccgggccgcggcaaccgtggactgcgggcagcaaccagtcatatccgacgcgggactcgttctcgccatcgacattaaacccattgagccgaaatcaaccgacatcgccccccgtgaccgaaggcatggcgcaaccctacgacatgcaccacctccctccgttccagcaatcgctttccgtccccccgtcaggtctctcgaccggaaccgcaccgcatccagccatgacgcacgccatgttggccagtcccacgggactaccgaaccccgggccctctccgcacctcctcccatcgaatgacccctacggacccaaatcgcagccggcacccgtctacgggggagcacagcagatccccagcccgcaccagaccagtttcccaccgtacggacagccggggctcggcatccatccgccgggccgcgtttcgtccactccgaccctctcggccacagggccaccacctcacctgaactattcacgccagccgtggccgtcgtactcgctgccggcgatgaacgggccggtgatgacgaacatacacagtccaaacagccaaatgtcgttgctcggtagcatgcaaccaggcatcctccccggtttcaacagtggccacgtggccagcatgcagcaaatgtacggcgggcacccgccgcaccctatccaccagccggggccgaccaacgaccggccgttcaagtgtgatcagtgcccgcaaagcttcaaccggaatcacgacctgaaacgacataagcgcatacatttgtcggtgaagccgtttccatgtacgcattgcgataaaagtttttcccgcaaggatgcattgaaggtttga

SEQ ID NO: 7966 - DNA, 354 bp, A.fumigatus
ctctccaaaccaaaggtccaccccatcaacaccaccgtcttcgactggtggcactttgacgccgtctctgcctcgaatccgaatgcctccggtgtgatcaccctcttcaccaacacacctaccgcattcccgttcctcccaggcaagagcaagagcaagagcaataccgactccgtcctcgctggcctccctctggatctcatctccaaatgggaccgggaccacctgcgcacgctaagcagatacatccctagcgacagccgacgcagcccgcggcgttacccgagggatctggcacgggagcggcgtttcctttgctggatccgagcgcgtggagtatctggttacgattga

SEQ ID NO: 7967 - DNA, 357 bp, A.fumigatus
atgagacaatcgccaacattggccatctccgcgatgttgccgacactacgtgcagtgtgcctgcagctacttgtgcccgtgtatctcatgagggaggctcgtcaattttcttctgcaactttgtatgtagtgaagaccggcaagcgtcatatgcgggttattgatatgagtctacaggaaagccacaacattgacacgacgtgtggaaatcttattgaacccgccaagcagatctccgacgcctgccgtttgggcaaccgctatacttacggttacgtctccaggaccatagttgacgggtcccaaagctacccgtacttagtggctatcggtgacgattatgcatttgagccctag

SEQ ID NO: 7968 - DNA, 360 bp, A.fumigatus
tttgaacaactcaggatgcctctcgatacctctacaacttatcctcttacgaagctgcgccttgatgggcgccgctggaacgagctccgactccttcaagcgcagatttctaccaaccccgcgagttctgggtcatcctttttgtcgatgggaaatacatcgataatgtgctctgttcatggtccagcggaggggaaaaggggtgacgcgacaggaggtgctgcaggatccgcgggagctgtggtcgaggtcgacgtcaacatcgcgggtttcgcgggcgttgatcgcaggaggagagctgggggcagcgacaggtatgcggccttattactccgcttcgtctctctcactacgttctaa

SEQ ID NO: 7969 - DNA, 840 bp, A.fumigatus
ctactagctaatctgaggaatttgtgtttagatagagaccgggaattcaaatcagacccggaaccccctctgtctacctccgatcatgaacgttccaagatcaggcaattgccgtccccttccaaccgcgatacctccgttgttcatttagctgatactgagagtggcgacgattccttcaacgatggcgaagcagcgtacaagcagtttaaagaaaggagagctctcaagcggaagcgcagcagtgctaatcttcgcaagtctaagaaaaccaaagtggcgaaccctgactcgtttgtcggcaaaaggccgaaaaaagaaaatgagcaatccactcgcacgcgacccattctaaggacatatggggaagagcttccctcggacgatgagctcatggaatatacgcttccggactacctgcagaagcgtcgaacccagtttgaccggcggatggaccacctgaagcagtccggattaaagctgccgccagatttcgatgacgtggaattttccgatgatgagcggttagagtttctgaaggagaagcctgcatttaggaatattgaaccttgcgggaagtacgaggatataacccttccctactcgctcgggttaattccggcgccaattgcccaatggttgcggccctatcaggtcgaaggtgccgcctttctacatgagctgttcgtttatcaaaaagggggcattctgggtgacgacatgggtctgggaaagacggtgcaagtgattacgtttctcactgctgcatacgggaagactggcgatgaaagagacgccaaaaggatgaggaagatgaggcgaagtggtcgggacggttgg

SEQ ID NO: 7970 - DNA, 249 bp, A.fumigatus
aatagtgtggtgtctctaaggttaaggatagaggtggtagtggtggtaacctatgttatagtattaataatatactcttacctagtaattatctgctataatacctctaactttatcttaagttccctaatctattactttaatataataacttccttaacttttacttatatagcttatttatatttctacttaatctttattacctcttctctatataaggagttgctattatatattatctcttaa

SEQ ID NO: 7971 - DNA, 192 bp, A.fumigatus
  unsure (121): Identity of nucleotide sequences at the above locations are unknown.
tctacctataggttaataatcctacccttctatattaaggtctcttttagtttaataggtatagcttttagtagattctattaccccctagctttctttattaaatatttagctttttatnatctatctaagagttattactatagctcttttactttctctataatattactagacttagtaataaaataa

SEQ ID NO: 7972 - DNA, 204 bp, A.fumigatus
ttagtgagctgtgacgtgaggcaaatatacttttacctccaagcaccactacttagaccaccttgccaacattcttaccaaggtggggttgctgatatgatcaataaaatacctaatcaatacaccaccaatgatactgatgcttatactgatggatttgatggaaacgcccaaaacactgtattgtttattatggatagatga

SEQ ID NO: 7973 - DNA, 189 bp, A.fumigatus
gaagaaaacctacacctactagcatgtgcgccagtgttgagtcagattgttagtgcaaggggacggtccgtcgtcttaacaatcagtcttaccagcggaactgtctacctccgtcgccgcactgagttgacgttggatcagggtgactgcgcggatggctctcacagcacaagaaacacatcccgatag

SEQ ID NO: 7974 - DNA, 219 bp, A.fumigatus
cgccagcctttcttttgggaaaggaatctgaaagtgatctgtggagtcatgaccttgatcttcatcggtcgcgccacttatggggctggtccatcccaggtcaggtttaccactggcgttgaaccttctagaggctctattcggctagtcaccatgaccggcaaatactcactggcctggatcgagttaaaccgtgtgagcgaccacgagagttcatga

SEQ ID NO: 7975 - DNA, 738 bp, A.fumigatus
tcggcatcgcacggtgtattgcaatggtttgtcccttgcccatacgacggaataactctgaacatgcaggctaatagctttcaggtccttgtctggacgggtctagcaggaggagacggtgaatactgtgcgattttggttgcaatcaactcgatcctgcaaatggtcctatttgctccactcgcgatttttttcattcgcgtcatcggagatggagacgacggtctgaccatcgaatattcgttggccgcaaagagtgttggtgtgttccttggtataccgctgggagcagccattgtcactcgcttcggtttaagattcctcatcagcgatgaatggtacaacagaaccttcgtgaagctgatcagcccgctatctttgatcggtcttctgttcacgatcctggtactctttgcttcccaaggcaggcaagtcgtccatcaaattgtatcagtcgttcgagtcgccgctccgctcatcgtttatttcgccgttattttcctcatcaccctccttgtgacgcgtcgactaggcttcggttacaaactgtcatgcacacaaagtttcacggctgcgagcaacaactttgagcttgcaatcgcagtagcaattgcaacatttggtgtcgacagcgaccaagcgctagccgccacagtcggtcctcttgtcgaagttcccgtgctcttggcgctggtgtatgtcgtcaggtggtttgccaggcgacagcaatggaaatga

SEQ ID NO: 7976 - DNA, 183 bp, A.fumigatus
tggctcacacactccatagcaatcggcctactagtcatgatgtaccccattctgtgtaaagtgcgattcgagactctccaccgctcattccgcgaaaaagcactctggattcaagttgcattcagtctcgttgtgaactggattatagcgcctctattcatggtaggtcggagacttcgctga

SEQ ID NO: 7977 - DNA, 189 bp, A.fumigatus
agatataggcctctatttagcttctttataaagagtactagtactgctgctgggctagataattccctaatctaccccttcttaagtattttatcaaggtatttatgcagagcctctagctctagctataatatagtaaatagggggctatacagtaataacttcctattaagtagctatattttatag

SEQ ID NO: 7978 - DNA, 234 bp, A.fumigatus
ctagtggaagtcatcaagtcaccccccaatatatatatcatccgtcggattatgctggtttccaaggattatactttcccctggcggagttcagtcaattgtagcatctctgttaagtttcattgcgctgttgatgcagctgccgggagacaagaccaacccagttgcaagaatatgttcatcagcatgaccgcattgatactcactttgaccaccacgagagtgtggcactga

SEQ ID NO: 7979 - DNA, 315 bp, A.fumigatus
tctattgatgaatggactccacagtccagacttcaaccatctttgcaggatttttctccttgttcgttcaatgtgtctttcagccgcattctagaaaaagtcctgatcagtagtattaccaaaggtggacaagagataacactatcagtcgtcactcagattccaactggctcagaccagagtccatcactctctagcaaggcccagattttcaagagtgcagtcaaggctgctaaacacctagtgccatcaggaatcagagaagcctgccagaggttcaaacaacttacccaattctttccaagtatgagttaa

SEQ ID NO: 7980 - DNA, 813 bp, A.fumigatus
  unsure (2): Identity of nucleotide sequences at the above locations are unknown.
anatcaggtcggaggacggtctgcctacccgtgtcgtaccaaagttcgaaatatccttatatggcggctacgccttttcttggccagattctgaaaggccggagagggctttaccctctcacgaaacaattgcaggattgtgtctggcttgctatgttatccctttttggcatcctgtcattaagcattctaacaattcatagctacgaacatcaggagacagtcattgcgaagagtgtccggcacttcagattacagaacgaacgggatattttacttcgattccaagaccgaacgccctgtattcgacctctaattgaagagcttggtgactccactgttcctcctacactcatattaaaacaccttgataatgatgctcttcgcgcttcaaataagcagcggctcactcgcctagagttgaagtatgttgcgaaaagggtgctagaagcactttcagtgttgcatgatgagggatttgtacatactcgtatgctccgcctatttaggttttctactttgcgagtgttattaatgggaagggtaatagatatcaaaccaagcaatgtgttagtgaactatggtcatggtgatgtccgttttacagatgtccaattagcagattttggaagcacagttcacagggactctccttatgcacaacatggcgaccccattggcacgcctatctttagaagtcctgaagctcatctccaaatgaggtggggtactgcaacagatatttggtcttttggtgcaatggcaagtccaaacctcacgccagaaatgtcagatctaaatcatgatatctaa

SEQ ID NO: 7981 - DNA, 357 bp, A.fumigatus
tatctaattaccgcacagcttatcagtcttctctatggagatggattccacatattcaagccggatgttcctccagatcacgatgattacgatgtcatgattctcatgaagcatcatagatgttttgggccatttccagaatcatatgaacagattgccgactcgcagcgacttgcaattctagtctggatcatgcaaaacagccctcctgagaaactgcgaccatttcatctcaccagtacccaggagatctgtcaggaagataaggaatttatattaagaacaatgaagcttgatcctcgggatagaccttcagcacggcagctcttggaagatgaatggtttcgtcactcttaa

SEQ ID NO: 7982 - DNA, 561 bp, A.fumigatus
caaggcattgaatcagttttcaacatccatgtaagctcttgcgactccaggaagaaaaccctggcgctgacggtgtccatcagtgtcaatcctctctactacgttacatttacaaccgccacgctatgcgcctcctttattctcttcaagggattcaatacaagtgatgccgtcaacaccatctcattgctctgcggattcctcacaatcttctccggcgtgtaccttttgaacctttcccggcatgatcccgatggacggcacctgcttagttcgaagttggatgatgaaggggtgcctacggatggcattgccagcttccagacccggcggtcgatgcaatcgcgccggagcaatgagccacaccgtcgttcatctagctttgctttcatgaatgggcatggggaccgcgaaggcctcatgcattcctacgatgttgagaatcaggctttcggtctgtcagagttgacagaggagagcgacggagaaccggggccgacctataaacgaagcgatgatattgatcgcaccacacaacatcccaataagcatgacgagtga

SEQ ID NO: 7983 - DNA, 438 bp, A.fumigatus
catactggcatacctgtgaaactcagctgtacaccttgggttgtgatttcaagcgtttctcgtcttgacgtacaccagtctgggtcgttgcctccacagagaattctatccggcgacatgcctggcttgctgcgcaagtttgtcattatcgcggctgtggacggcctcattcttcagccgcatgggaatggaggacgtaacagtggcaattacgagccacagtctgtccggattgactacaaaaccaacaagatctcgcccctgccggcgccggcatcggatcccgctgtgaggaaagaggccggactggaggcttatggtctagtcggtaagttagcatcttcagctactgttagtgatattgtcttcagtctatgcaattctgaatataccaaattcttcccccctggcaaaagtctcgtattcacaccagcctga

SEQ ID NO: 7984 - DNA, 324 bp, A.fumigatus
agatggttgactcgcgtcactttgtcagggttccttatctattgccttgcggttgcgattttctcgacggtcatgatctaccgagtggcgccagtttatggaaagaagaaccccttgatctttatctctatctgctcaacagtgggctccgtctccgtcatgtccgtcaaggccttcggaatcgctctgaagctcacattcaacggaaacaaccaattcacacatgcgtcaacatacgtcttcatgatcgtcacaggtttctgcatccttacacagatgaactactttaacaaggcattgaatcagttttcaacatccatgtaa

SEQ ID NO: 7985 - DNA, 978 bp, A.fumigatus
cgcacgcggtaccttctaggcccgggtcgtgatgacagtgctaaccgcggcgtgtttaagtatcaacttcgttactgcccagctctcgcaaacaaaccctcaggcgctcctaaatccgacaaggaccggccaggtcctaagcccgatcctttcgagaatccctcgacagaccttttgatcgctcagattcctcaggaaaacccaaaatatacgcttgtcttgaacaaatttcccgtcataactaatcacttcatcctcgcgaccaagacctggaagtctcaaaccgatattctcgagaaggaggacctggacgctgcttatgcctgcatcaaagcttggagggataaccagactgaacagggagattcggggtcaaacagactatttgctttcttcaattccggggacgagagtggcgcgagtcagccccataggcatttgcagttcttgccagtggaagacatgtctcagggtgactcgggaaactggcagcctctcattgacacgatttcatcccagtgggtatgccccgactcggagtaccgacgcttgagccaaatacccttcgcccattttgcactgccgctgccaccgaacccaacggcagataccctgcatgcgatctatttatctttgtacagagtagcgctctggactgcgaagggaagcctggaggaccattcacgagtgacagatggccctgcggcaatcagctacaacttagctatgaccgagtcgatgatgatgatttgccctagaagatgtgaagctgctcgtatacctgtcgacccaagtgctttgccaaatgtccaggaacctggcgtcgtggccctgaacggcacgatcctagccggaacgcttatggtcaaagctgaggccgagtggaatgagcttcggcgcaatccggatacgttggcgggcatactcgcgtctgtcggctatccccagccagactcttgtggactcgctttgttatga

SEQ ID NO: 7986 - DNA, 234 bp, A.fumigatus
aaccgtaccggatcaacccatgggtatgatcaacgatcaactatagcatggttttcaccaacaactttctatactgtgaaagagtgggaagattattactatatgcatatcaagaacagcatgtcgcggtggtgtgaaataatcacttattactatactcttatctggctagggtactgtcctttttatcttggtaataaaagtctctccctatctaattatataagatcctag

SEQ ID NO: 7987 - DNA, 198 bp, A.fumigatus
acaaagacaaccaccaccaccagtagaagtcgatggcctaaaagaatggattgtcaaggatatcttagaattcccgctgggaacactggggccgatggggccccccgtctgaagtataccgtcaaatggctgggctatgataaccccactgaggatcccgctcattacctaagggaacgcacaagagattatagctaa

SEQ ID NO: 7988 - DNA, 309 bp, A.fumigatus
ctagtttggttagacgcccgaaatattaggaccctgcgcccccagaagaagcttaactggaaacacctagggccgttctatatcaagaagattattagcccacacgcctatgagctagatctaccagcttctatgaagattcaccctgtgtttaatgttagcttgctgcaccctgttgctaaagaccctgttcctagacaaagacaaccaccaccaccagtagaagtcgatggcctaaaagaatggattgtcaaggatatcttagaattcccgctgggaacactggggccgatggggccccccgtctga

SEQ ID NO: 7989 - DNA, 501 bp, A.fumigatus
cgaatttactggggccacaaatctcttaacgctggacgcaacaaaatgtattactattactacggacatgatttgattcaagatagttttaaaaccccaaaaacaacccatatgtgctacagtgctactccaatactcctgcgcgaaatgtgctctgaaacctatagcacatccagtcatgtgactcatgtcaatcgccatcaatcgaggagttctctacgagtgcagatcatctggagcatgcgtttcctgcggctatttgtggtttgtgcggtgtctcactctcacatgcgaagattacgagctgccgctgcttttttctccaagtgcgacagcaccattattcaaatcaactatagctaccaaattatccatactatgttcacaaccaagaactggttggttggtaagtgtttcggtggccgtcagggtcttctcaccctttcatggttgcgttggcttagagagtggtacatatggaatcgatccatttacgcgtaa

SEQ ID NO: 7990 - DNA, 327 bp, A.fumigatus
tcaaaaatggcaggatcgaaaactgagtccgctgtgcgcttccctgaaaaggacagccagacccgtcgtctgcgcaaccaaaccacccaagacaagaaggctgtggctcggatgcaagctgaaactgcttcagctcaagccagggttgcgagagctactcacgccggtgaggagtggacgccagtcgagaacttcgagaccgccatggaccaggacggcaacccagtacctgatcccgcgtataccgactatgaaaagatgaggcagcacaagggtggcgaggacgaggctgatgactatgttgctgctaatgcgaacttcgactaa

SEQ ID NO: 7991 - DNA, 2376 bp, A.fumigatus
  unsure (2168),(2182): Identity of nucleotide sequences at the above locations are unknown.
tgtaaccgcggtgaagactctgaaccgttagctcctggtgacctaagaagaaacacagtcttcaaaatgagactggagatgagccaagagacaatgttgcgcatcccgacgagggagccgtcaaaagactggctgtggaaaggtcgagctgatgcaatccgaggagctacaaaactaaagaagcagcgaaagagaagaccatcgcgccctgcggaaggtgataaaagtaaccttggccctgacatccgtccatttggttggctgtccctccgcgtcgctggggactccacggtcacgtatagtatggatatggtggcctcgactacaaagggattcaacaatttactcgaactggatcttcgtgattctagactgtcctccagtgtcaatcatgcattgctgtggcaatgtcctaggcagcttgtcacctgcgatctctctaaccccctttcgtggaacaatcttcgtacatggacgtttgacgttgagagtcataacatggagctgtttttgttgcgcgatcacatattccttctcactgatctcgtgagtgactgggcgtctgggcccccacaggaatacttcactttcgtgccgtttacctacactctcaacttatccttcgtcgatttcaagctctttgttaacgtcaatgacctcaacatcattagcaatccctccgatctagatgacaaccggatgctggtgatcaagggcaagaagctggcatctgatgtattgattcctttgacaacatacaagccggagcaaaatgccgtcaatttcaacgtttatctcgacagtggtggaatagactttttgtcgccgcagtgggatacgctgcacacatttttgcaagatcaatcaattgccacgctcgacggtctttccctcagagggtcatacaattattacctttcaacagcgccagatctcaccgacaccttgttgctcagtatcaatggtgtttcacctaagctctatctatatggattcttgatcaaaagtttcatgacgataagggaaaattattttggagacgagatgcatttcaaaacgctcgaagaattccaggaattggcatattccgaggagcgagttaatttccacaatggaatcaatccgaatcggaagtcgaatgatctcgatgttatcgttcatgttaccgttgatgatgcttgtgcccttctgccggagaatatgtatgatcgcttgaaatgtgtaaggctcacaactccctccttggaggttgacttgcggtttaccaactactacatggaccttcaattctcaatttcacccttgagagcagctatgcaggtgcatagggttgaaggaccagccagcatatctaatactcagctgttcatcgatggagctttcatccacgggcatcgactatttggcctgcctccttccgagccgacgtatgtttgtaactgggactttgaagtagggcaaatttttggtgaatgttcggcggaattcctgggctgcttagctgcagccttgcagagcttcgatcagtctttcgataacgaagaaaatgctcttccaccgttggttcccattgcactccatgatgtcaccttccttcgtgctaaaatacaaccaattcatattgcggtgttgtctgaccaagcggcattgatactcagctcagggctgattacaaccaaattcaacgactgggcaaatgcatcattttcaaagcgcatgagccttcttgtacctgatctttccatcgctgcggttaactaccgcgatattgacctgaaaggaagttcgtcgccggcgggcgtatctccccttgcgcttttccagacaacgatcaaactgaggatggcacaacggagggcggatatcgacgagaataggaaattgcaacaagaacacatcggcgtgcacgaccagaggactcaaagaacaccatggctcatgtttgattgggaagatattgaccccagttcgtttcgcactccaaatgatcaacttgctcccccaacaattgccataccttccatgcctgagcctattattaagcagcttcatacgttatcctcagcggacagcctctccgatttcaagagccagcaaagctcaaagagcttcgtcttgacttcagataattcgagctttaaaagtgggagaagacgaacgacgcgcangatgtctttgccanatcagccccaaattgacaagcgatcgaaaaacccgaacaaccgaattgatgaccatgtcccaaaaattatcacctaccgccaggccaacgaatttccgaaatacccttccttacccaaccctgcccccaattcctccaaatgcctagacaaatgccccaaattccacgcttccccaaagatttccctgaaataa

SEQ ID NO: 7992 - DNA, 198 bp, A.fumigatus
ggcttcacgtcaaaccttgtaaaagtgattgaaactgaatgcacgtcattgtgtcaaacagctggggtgcatgtggccgactattcctgtgtccaggaggagaaatctaaagccaagcaggccattgactccaagagacggttcgctggcggcaatgaagaagcttctgacaatctactgctctccgatgagtcgtag

SEQ ID NO: 7993 - DNA, 441 bp, A.fumigatus
atcctgaaaactttcttatggtccgcgctagctttcgattcgactggtcggcactatgatcagactgggaactacaccgactggtgggacgctaaaacagtccaaggttttgaagatcgcgcgcagtgcttcgtcgatcaatactcaaatttcaccgttctaggagagaatggagagcccctccatgtgaacgggcgccttactctaggcgagaacattgcagatgctggaggcataggagccgcatttcaggcatggaagaagagagacgaagcgtcgccggatgctcacctccccggcctttccaactttagcaaggagcagctgtttttcatcgcctatgggaactggtggtgtgctaagacgaccaaggaagccgccattcaggctatctatactgacccccacgctcctaagtttgcaagaattattgtgagttga

SEQ ID NO: 7994 - DNA, 963 bp, A.fumigatus
  unsure (248),(318): Identity of nucleotide sequences at the above locations are unknown.
atcatgcctccagtacccggacgacccgagcaccgtcgcgtcatttgttaccatcagaccttgtgtccgaaccgaggcgactatgtctcggtgctgcctttagtgaagaacaacaccggagttacccacatcatcatcgcagcttttcatctgaacgaggaccccggccatatcacgctcaacgacgatccacctgaccatgagatgtataacccactgtgggcggaggtgcccgtgctgaaacgcancggtgtcaaggtgatgggaatgctcggcggggcagcgcaggggtcctataggtgtctggatggcgaccangagaagtttgagcggtactaccaacctcttctggcgatggttcggcggcatcagctggacgggctcgatctggatgtaaaaaaggaaatgtctctgcccggcatcattcggttgatcgaccgattgaagctggacttgggcgatgattttatcatcaccctggcgcctgtcgcggcggcgctcctgggaattggtaacctttcggggttcgattatcggcagctcgagcagcaacgagggtccaagatcagctggtacaatgcgcagttttacaacggctggggtctggccgaggaccctcggatgtatgcggccattgtggcacaaggatggtcaccacaacgcgttgtctacgggctgctgacgaacccaggaaacgggtcgcaaggctacgtcccgcgagaaaggatcgggcccgttctcgcagtgttggtcgaacaattcccgaactttggaggtgtcatgggctgggaatacttcaattccatacctggtgagcaacagagcccatggcagtgggcagcagagatgtcgcttagtatgcacatgaaggatgtgctagctgctgctcggcagatgctcactgcgggacctatggccaacagcttgatgaatgttcttcgagacatgatgcatcaaccgtag

SEQ ID NO: 7995 - DNA, 672 bp, A.fumigatus
atacaggtgaacgtgtactatatccactcgccagatcgccagatcccgctggaggagaccctcgcgggtatcaacgagctccacaaggcagggaaattcaagcacttcggtctgtcgaatttccgcccggaagaggtgcaggaagttgtccgcattgccaaggagaagggctatgtcctgccttccgtctaccagggcaactacaacgctgtagcccgccgcatcgaagcggagttactgcccgttctccgggaaaacaacatccgcttctatgcgtacagtcccattgccggtgggttcctgaccaagacgaaagagcagctcctcgctggcggcgagggacgatgggatccaaacagtgcgattggtcagatctatcataggctgtacaataagcctgcaatgctggaggtgctggatgattgggctgagattgcgaaggcggagggagtcaccaaggctgagctggcctatcggtggatcttcttccattcgcatattcgcgaggatctaggggatgcggtcatagtcggagcgactaagatcagtcagtttgaggagacgatcgcggcaattcagaggggtcctctgagtgcggatgctgtgaagcggatcgatgctgtctgggagaagatcaaggatgtggctaccttggacaacttcaatgcgtga

SEQ ID NO: 7996 - DNA, 243 bp, A.fumigatus
gcttcaacatgcgacaagcgacttacatataaacccctccaattccaagggacttcttgcctctggaccacagaaacaaatttggactctgttagaatatactttatccaaaatgtcaacaactacagcgacgtcgatgcaaagctctcatccgtgagttctggcttgaaccctctcatctttacaccttgtggctccattgccggtctgtctttgcgctcgacatttagactgattgtataa

SEQ ID NO: 7997 - DNA, 354 bp, A.fumigatus
tgcacccctggtgaagacctggctatcctgctgctagcccgcaagttcggcgtccccatcgtcccccactccggtggtgtcggtctgcccgagtacacccagcacctgagcaccatcgactatgtcgtcgtcagcggcaagaagagcgtgctggagtatgtggaccacctgcacgagcacttcgtgcatccttctagcgtcaaggatggatactatgtcactcccatggaacctggatacagcgtggagatgaagcccgagagtatggatgcgtttgctttccccggcgaggagggcaagagttggtggcggacagaggctgccaaggcaatcttggaaggtccgcggatatag

SEQ ID NO: 7998 - DNA, 618 bp, A.fumigatus
cctcgcttttcggacacttttgctgtgaaagaagccccctctctcatgcagacgattggacgattcttgcactatcgcagagagcctgataataagcatgtctatatgatcagagatcctccaaggatcaagaatgcgttggccattggtgtgcatgggtattttcctgctccactaatacggacagtgctcggacaaccaacaggtacctccgtgagatttgccaccatggcggcggaggccatccacaagtggacggagagccatggctatgcatgcgatgttgagaagattgcactagaaggtgaggggcgcatcgctgaacgcgttgatttgctatggaagctgctcctcaattgggtggagaaaatcaggaaagccgattttatcctagttgcatgtcacagtcaaggtgttccggttgcgatcatgttagttgcgaaactcatagcttttggctgcttgaatgccactcgtgttggcgtgtgcgctatggctggcgtcaatatggggccattttcagattatagatctcgatggattagtggttcggcgggggagctttttgaatttgctctgccctatagccagttctcaaagattatgaaggtgcaatga

SEQ ID NO: 7999 - DNA, 270 bp, A.fumigatus
cgttcgttccttaggctggccattgaatttgctctggaaacgacgaatgtcagtaacgctgccttagacgtcagacggagtcatccatctcctgcgaacccctatattctaccgtttgctatgcggggtatactcgaagaagagtatgttcgccgcgaactctatgaagagacaatgcagttattaaggcaatacgatgactggaagccctcgagcaaagttctaaaggatgtcaaattcagactcgagggaatcaggtccaaactctaa

SEQ ID NO: 8000 - DNA, 456 bp, A.fumigatus
gaaaaagtcatcagctatcttaaaatctatctaataacaggaataggaacgatgttctttatcggaatactcctcccgtacaatgacaagcgactactgggctccagttccaatgcagcaagctcgcccttgacaatcgcattgacggatgctgggattttgcctgcagctcatctgatcaacgcgctcattgtgatcagcgtcatatctgcaggaaatggttccctctacgtagcatctcgcactttgctcttcatggctcgtaatggcaaagcacctcgattcatcggacgcaccaatggagcgggggtaccctgggttgctttgatattctccaatcttttcacctgtattgtgttcctgactcagtcctcgggggccggaaagatctattcggccttgatcactttgtctggtggtgagttggcttctcgtcctccgattcttgtctgttaa

SEQ ID NO: 8001 - DNA, 423 bp, A.fumigatus
cgagtgacagtggcgacattcatcgtctgggccgtaatcggaatctgccatattcgcttccgtcgagccttggtcgtgcagggagaggatcctgcaaaactgcctttcaaggcgtggctgtatccgtggggcacatacttctctgtcgcactgaacatcttcctggtattcttccaaggttacacggctttcttaaatcccttcagcgcggacgattttgtgatcaactacatactgcttcctgtgtttgccctgtttgttttgggttataagttttggcacaagaccaggtgggtgaagctagaagagatggatatctggacaggtagaaggaagtcaccagacgtagacgtgacggacgaaccgccagtcaagaaacaaaaatcatggtgggctcgggtattggccgttgtcattggttga

SEQ ID NO: 8002 - DNA, 2145 bp, A.fumigatus
agacgagaaatggaacgaaggctcgcatatctgaagcgtcttcgtgatcaggacatcagctctgaacaagcttcggacgagaaggccaagtcgcaaaagttcattctcattacacctgaaatggttcatcaatctcctcagaatgcttctcctaaagtcaaggaagttctgcatgcggctcatgatgccgaatacgacaacgccctgcatcactatcagacccaaaagcgccaatgggaagcatacatctcgggcgcctccagtctcttcgacccatacgcccaccagaatatagtcgtgctttttagccttgtctgcactaccacatctattccctgctccggtcctgatttgttcgctctggagtactataacgagcacggtgacgacacgatattcgagccggactgtaccattggacaatatgtcgaggacatttgccaaaatgcaaacgccatttgcacagcaaatggctgcgagaagcggatgtttgaacatcaccgtcaatacgtacatggagaggctcagataagcgtatttgttcagccctatccatcaaaattacgaggtcttcaagacacgattctcatgtggagttgctgcaaagtttgcggcaacgaaacacaagtcttccccatgtcagatagcacctggaagtattcttttgggaagtatttggagctctctttctacagcaagaacttgcacgctcgcgctggtgtctgtccccacgacctgcaacgcgaccatctccgtttcttcggctacaaagacattgccctgcggatccactacgacaccatcaatttgcttgaaatcatcgttccgagaaccagggtcacctggaaagtggacaacgacttgaaactgagaaacgaggtatatcttaagatagaacagcgtctgaaccgattcatgggctctgtcaaagcccgattgaagggcatcaacgttgacagtgtcgtcccaaagttggcagaagcgtgcaaggccgagattgaggtactcactaggaaagccaacgaggaccacgccgcattgatcaagcagctacaagacaagtatattagttcgcgatactgggaagtgactccattgaacgaagtacttcgttcagtccaagaaaaggtcgtggaatgggatactgccttcgctgattttgagaaaaacttctttccgtcagaaaaggacattaggcggctggcgactctgcaattgaagaagattttccttgataaggactcctccgtgacatctctcacgtcatctgaagagcctccgacaacgccgaccgaggccgaaagtggtcatgaccaaatgactgaacacccgcgcccaatgcgtcgtatgacattgtcacccgaaaaagctcaggatgtcctcgtatccgtggtggaagaagattcaagcgaaaagaatgcccacgaagctaccttgtataaggatgaagtcccactaccgtcgtcaccgagcccggaggagacagaaacttctattcctcctgcagccgagcctgatgagccggagggctcacagagccctgaatccactgctcaatccgctatgccggagcaagtacctccttcaaccacgccatctgcaagcagcttaggcacctctggtgccacgtcggatgccgctgagtcaggtaaggtttcaccagagcatcctcctactgagcaaggggacagccaacgtcaaaatttggatacagagtctcaaacaccttcaagtatgttgaaacaacccactccttcgggtattcctcggcttgctgaaggtgttgtccgacgaactggaaaagcgacctctcccccgcttctccgcgcccagtcccaaccattgcaaggccagagggacagagtaaagatgagtgtaccgctccgtggtttcagggtaggagcagcaggcgccggcggcttagacaacatctcgagcccaaccccggaatccaaatttaggccctcagacaggaagttttcggatcggttcggcctcactgctcttagaaattctcgtttaacgcccggtccatcgctcatacctcggtctgtcccaagtaggaagaataacacccgtgtctcgaatttggccaaacacctcgagcagtttttctacaagccggccgctggaagtactagtggg

SEQ ID NO: 8003 - DNA, 477 bp, A.fumigatus
atcttcccatcccaccgatggcgttcgccaaacctgagaacacgacgtacttctcgtttatccacggcccggcctccttcttcatgctcgacacgcgcacctatcgctccgagcccgcgcaggtcaactctaccatcctgggatccgcccagcttcaatccctcctcgcgtacctcgcccgccccgaatccgccgaagtccgctggaagatcgtcgcctccagcgtccccttcaccaagaactggcacgtcggcaccaccgacacctggggcgggttcctgcacgaacgtcgcaccgtcttcgaagccatgtggcgtgctgagcgcgagctcggcgtccgcgtcgtccttctcagcggtgaccgccacgagttcggggccacccgcttccctgacccgatgctggattacaccagcgaggatctcctcgcgcacacggcgggagaaggcgtccacgagttcagcgtcggcccgctga

SEQ ID NO: 8004 - DNA, 999 bp, A.fumigatus
  unsure (41): Identity of nucleotide sequences at the above locations are unknown.
ttcgaaaaggaaacaccaccgcacctaatcccagccgcggngaaccaaatattccattaccatgtcagcgtgaatcttcccatcccaccgatggcgttcgccaaacctgagaacacgacgtacttctcgtttatccacggcccggcctccttcttcatgctcgacacgcgcacctatcgctccgagcccgcgcaggtcaactctaccatcctgggatccgcccagcttcaatccctcctcgcgtacctcgcccgccccgaatccgccgaagtccgctggaagatcgtcgcctccagcgtccccttcaccaagaactggcacgtcggcaccaccgacacctggggcgggttcctgcacgaacgtcgcaccgtcttcgaagccatgtggcgtgctgagcgcgagctcggcgtccgcgtcgtccttctcagcggtgaccgccacgagttcggggccacccgcttccctgacccgatgctggattacaccagcgaggatctcctcgcgcacacggcgggagaaggcgtccacgagttcagcgtcggcccgctgaacatgttctatcttcccatccgcacataccggcagacagacaccgaggatgtggcggtcaagtacgtcccggacggcaatgtcaagtacggccttgtggacatcagcatccaagacgagcagatcgacaccgcgtcggggacgccggtgacggtcccgagctctgtcctgacatataccctctacgtggaggaccaggtggtgtggaagtacaaactcagcgttcccttgcccgagtacgattccatgatggcggcatcgtccgcgaagcatccacgactgcgtcctggaaaggtcctgatcgacaatcggaaagcggaagggtggcatgctgccatccagaccatggtgggtcgattggaggaggcggcccgccagtttgcacaccgggccgtggacgagttctatgaattgctggataagactgagagagcggagagattggactga

SEQ ID NO: 8005 - DNA, 378 bp, A.fumigatus
caaccaagccgcatggtccgcatcgcttgtggcagtggcacgaccgttcgcgaagttgaggatctcctctctcagcaccgcatgatggccggcatggccaagcgggtcggcgggcagaagaaacaaatgcagcgcgcgcaaaatatgctcaagggtggcaacaaggagcagcagctggccgccatgcagaagcggatggcggccatgggtggtgccggtgcgggcggccttccgggaatgggcgacatggcaaagatgatgcagatgctgcagggtcaaggcggcggtgggatgccggggttcgggggaatggacttgcagagcatgatgagccaaatgagtggtttgatgggtggaggacgaggacgaggacggtga

SEQ ID NO: 8006 - DNA, 459 bp, A.fumigatus
ctagtactgatgcgtatgaccagacacgctgcttccaccacatctcaagctgatgcctccaaaatcctcgcccaacagcgcttgaatcgccccgtttcccctcacctctccatctaccgtccccagatcacctggattggctctagcgctcaccgtatcaccggcattgctctttctggctccttgtaccttttcgcaaccgcatacctcgccgcgcctctgttcggttggcaccttgaatctgcctccatcgctgccgcttttggcgctcttcccattgctgccaaggttctcatcaagggtaccgctgcctttcctttcgtctaccactgcttgaacggcgtgcgtcacttggtctgggatcttggccgtggaatttccaaccagcaggttatcaagtctggctggactgtggtgggcctgactgtggttagcgcgctcactcttgctttgctgtga

SEQ ID NO: 8007 - DNA, 186 bp, A.fumigatus
  unsure (31),(67): Identity of nucleotide sequences at the above locations are unknown.
cacaaatgggcttgtagctcagtggtagtancgctcgctttgcatttaataaaggtgcaggtcctcngactatatatgcgaaatgtccggggttcaatcccccgtgagtccattttttgccacgcttacttttgccttggtcttttttctactttctttttcgtgtggtttggcgccatctggtag

SEQ ID NO: 8008 - DNA, 402 bp, A.fumigatus
caggaatgcgtaggtcgcacactctcgtacccgtccaagttaccgtgggagttcacctctgagaatcctattcgcagcgtctttccgctatggccggtttacagcttgccgatgggccttctgaaatggttttacgtggagttagagatagggaacccctcgccggaggtggcttactattctttgagagcggtcatgtttcttttaagtttcgttttagaggactgggccatctacgagctggtcccgcttccgcgacatcgccgggctgctgtggtgctggttgcatcctcgtatgtcacctggacatatcagacgcacaccttctccaactcgcttgagactttactggtcacctggggtctggtgctgattcgtcgcatcgctggacaaaaggtttga

SEQ ID NO: 8009 - DNA, 441 bp, A.fumigatus
gacgatatttcggacgacgaaatggtgcgatgctgcaagaacgcaaacatctacgatttcatcgtcagtctgccaaacggttttgatactctcgtgggtagtaagggcaacatgctatcaggtgggcagaaacaacgtcttgcaatagctcgagccttgctccgcaaccctagaatccttttgctggacgaggccacttccgctctcgatttagagtctgaaaagctcgtgcaagctgctctggataccgccgctcacggccgcacgacgattgccgtggcacatcgtctcagtacggtgcaaaaggcgggcatgatctgtgtcttcaaccatggccgaataatcgagtctggcactcattcagagctgatgcagaagcggtcggcatactttagcttgtcagcttccagactttgggcggaatgtgactcttctccctag

SEQ ID NO: 8010 - DNA, 186 bp, A.fumigatus
acggacgactcgactttattgagaaggaaatgtgcgtttttccttgtcttatacttccggcacgggttgaagatcatggctgacggcatcgatagcaagagaatcgagggacagatcaaggaggctcaagaaaaggctgagaagaaacgggcggaggtgagaaactcctccaaaaagttgtcatag

SEQ ID NO: 8011 - DNA, 531 bp, A.fumigatus
tttggtcgttgttcaccgttctgtcattaccgtaattaccaacattttgtgtccccgccaacgcccctcacgctcagagacagcattgccaaagtcataatcaaccttggaaggaggatacgtaaggcactatggcagacccgcagaagcagtttcaggctctctctgatgagtatcagcagctacaaaccggtatgtgatcctggttcacagcacccaaaacaattcaatcaactccatggcatcatcgcaagctctaacgcgctgccaatatcttctccagacctcgaaggtttcatcgatgctcgccagaagctcgagtcgcagcagcaggaaaacaagggtgtgcaggcggaattcgacaaactggatgaggattcgagaatctacaagattgttgggccggtcttattgaagcaagacaagaacgaagccgtcatggctgtaaacggacgactcgactttattgagaaggaaatgtgcgtttttccttgtcttatacttccggcacgggttgaagatcatggctga

SEQ ID NO: 8012 - DNA, 186 bp, A.fumigatus
gggaagttggagactccggccgttggggtaagttgtggggttgagcatctccataccccgcttcggtgtacctccaccctaatggaggactcaaacatcaaccagcatccaacagccacctttgcagttattgccaacaaacaatctcgcctagatggatgccgatcgtcctactggttatactga

SEQ ID NO: 8013 - DNA, 1200 bp, A.fumigatus
  unsure (82): Identity of nucleotide sequences at the above locations are unknown.
gccatatccatggtactttccacccctgggattttacgtggggaaatagcagggaagagttcaaatgtggcctttgcgcccngacacattatggaagtgcacagggcagagctggaatcgggacattgtgatgtgatcgttactgttatggatggtaggtgttgtcccattgtctggccaatctatagcgctaaccgggtgatagccgacacgcatttctggcaggactactttacagagatccggcgccttcattatgcgcacatctcggaggcagatcggactctatattgctgtcctatcattttcgaccgcaattcgcaggagaccccagttctggtccgttgtgcagacctactttggggatttgccggtttgtccaccatttaccccgggacgtgcatttcaatcccgacatcagtctactctctgccactgtctctggctgaaaggattggtggctgggacagtgactctactgcgatcggagaggacatgcacatgatgcttaagtgctattttgagaccgcgggcaacgtcatcactcggccggtctacgtccccgcaagccagtgcaacgtcgcgagtgataccggacgaggctggcgccggtcgttgaatacgtgccgcgcccgttatcgacaggcattgaggcacatgtggggtgcacttgactcgggctttgccgcacggcgtaccatcagttacattcgctctcattgccgctgcctgttcttccgaccgaggcaccttgccttgatacacttgctctgggaagctcactttcttccttgccatctgatcatactcatggtattctctaccatctataccttgttgacgcctccagcttcgcttcatccaaccatggcatggacgttcgaccttaccaacctgctacgcgcatcttcatttatcggaatgaatatgtgcatttttctgtacgagccatggcatgcactctgtgtgcgcacgcggaaaacagatatgcaacaagcaaacgtggcggatgcagggttctcagaacggatctggtggagccctgcgcagctagtggagcgcatctgctttcctattgcaggaaccgtctttggtggtattccaacggtccacgcagtcttttcgcatttctggaccgacaggttggtatatcgggtgaccaagaagccgactttttcggtggctggagcgatggcctag

SEQ ID NO: 8014 - DNA, 459 bp, A.fumigatus
ctcattctgactagatatcatctcaacggctgggctccggatgaccccctctgggccgagcaggcaggcgagtataagaagtacctatctgcctaccaggccctcgcaaaggagctccatatctgcctggtgccgggaagcatcgtcgaaaggcacgagaccgaagccgacgggaaagaaggattcaacctctacaacaccgcatacttcatctccaacgacggcagcatcctcggctcctaccagaagaagaacatttggcatcccgagcgacctcacctcacctcatccggcgaagcgccgcacgaggtattcgacacgcccatcgggaaagtcgggctgctgatatgctgggatctggcgttcccggaggcattccgagaactgattgcgaccggggcggaagtggtgattattcctacgttttgtgagtggcctgtctctctttctgttgtgtga

SEQ ID NO: 8015 - DNA, 1005 bp, A.fumigatus
atgcgcttagcgcggatgcttcgacccctctgtggtgaagacgatcctgagctcaaggctgcattcttaccctccccactaacatcttctttccgacccttccaagctgccaaggaattcacgccatatctatatgagctgaacgaagcggagctcgagcgcactgaagtgtccatatccagagaccaacgtcggcagaaacgctccgtcaaccgccgcggtggcccggctctgccagatctgaaagatcgtcagcgcaccattcgtacaatgcttgtatcctccgtcatacccaatactgcagcatcaatcgaagagagtaatgtgttcaaacggtccgggtcgagtcgacacagacgcgctgcagttggccagcgggatggtggtgaggagtccgatgagtcggatagcgacgagtcatcgatgacgggctctccggctatcggcccccatctagcccaaggaacagcccgcacaagaggcatgagaggagccgcaagcgcagctcacgccgctctccgggcgagtctggctcattctgccacccccgaacctcatcacgagcctcgggtctccgctagaagacgagattaccgggaagagagcatagaagagcaagagaagctcattgtgaaattaaagatctctcctgagaaatttcgccaattcctcgccaacaggccacagtcattacctaacgcttcggtttctacctccacgccagccgcccaaccagtatctcagaccggcacacctcaagtacggacaccaacgccgagtagcatggctccgccatcgcagcccaaaccccaagttcaagtaccgaatactgctggccatcttcctcagcggcctgtacaacagcttggggctgttgatgctacacacccccctcagccaggcgttcccggggtaggtacctcctttcttctcacccttttgtactctgtttcttttctggctctgtccagatgcccatgtctacagttcatttgcgtttgctga

SEQ ID NO: 8016 - DNA, 324 bp, A.fumigatus
cctcctcccccagcctggctatcagcaggtcttgcccgtttgaaccggtcacatccaaacgactcgtttgaaggtgtgatgcgctacacggcagtggatacagagactatgttaccagtcgcaaacgccaatagccagccgggccaccgactgaagtaccagtatcttcctcggattcgctgtcacgattgtccaggtaaattgtatactcccggaccaggaatgacggtcgacaactttgaggttcatttgaggaatcgacaacataaagagcgcgtagaggagaggctcgcaaaggcagctgctaacggtggctcctcataa

SEQ ID NO: 8017 - DNA, 327 bp, A.fumigatus
ggccgggcgtttgtgatgcgttttctgaatgcgttcgagcgtgagtcaaaggttcgctataccctaaacagacatgtttgtaatctaagcaagttttacacactagggcgacaggtcatcagtaatagcatcgataagtatataagtgcggcatcagcttctcacctggctgttcaccagagcatcttattttccgcttgcgacatgtccgacacctataggagccaaataaagctacggttagcccgggaaagaacatttgtcatgaaggcaagcttacgccgcattgactcgacggcgcttcggctggggctgtccatcgcttga

SEQ ID NO: 8018 - DNA, 1230 bp, A.fumigatus
tcgcacatcatgagcaacgacggtttttcgtccttaaaattcagacgaacgtctagcaaactgcaaaaggaccctcctagcgtctcttcccgtatccttagaagtcagcagagcaacacgtcactcaaacgacacccctcggcgcctgtctatccccgttcctctgtcactggcagtcgagaacattcgcgcacaagatccaacgcatacggttcctcttcatcgtcccttgagcaacacagtggcggtccatctcctgtccttgctggcggcgactccaacaattccttttcgagcaagtcccgcccggggcggttttctttcaataccgaccccagctctgatgaattgaccggttccccgttcgattcacggggcatgctcagtgcattggaagagaacaccgcagagtccgagaaaagtcctccgccgcaaccgccgacgttacgatcttaccacaccagccccgattcccgcggactcagacagtcggcgagtttcaccgctttacagaaccgtatggacaccttcacccagaaaagcgaaaatgatcaatcaacaaacacgaagaggcactcggacgaggcgaacggaacaaaggtctttgggcggagtaagaagagcagcttttcgagctttgtcaacagcatgttagggtctccgcggggcatcaagatctccgcccccgaaaaccctgttcatgtcacccacgtgggctacgacaatcagactggccagttcaccggcttgccgaaagaatggcaacgactcctgcaagagaacggtatctccaagaaggagcaggaggagcaccctcaaaccatggtcgacattatgcgattctacgagaaaaacgctcgcggagatgacgaagtctggcacaagttcgaccacgcctatgctcatcatcaacccactgcaaacacaccggggtcccagcgaaactcgcctccaacgagccctcggttcccacagaatcacgaaggcagttttgagaatccacgcgcgcctcctccaatacctcgtggtgctcccgctgccactcaggcgatgtccccaccaatcggtgggcttgttcccagtcgagcgcctcgaaagcctcctgctccggccaacatgatacctgctcgaccggcaccgcacccgccggtggcacggccgcctcaagacgcttatgccaacccattcagcacgcctcctattccagaattccgaccctttgccctctga

SEQ ID NO: 8019 - DNA, 210 bp, A.fumigatus
tttgagagatggaaaggagaaggggggcggctaagcaagcggcaagtcatgagtaggaagacaggccttgctgcctcagtcacaatatccgctcaaagaaactatgtcaagactattaaccccatgttcccaacgaccctgatcccatacaagcgatctatcgatgcattctcaaccttctgtcatgtcaaacacttaactaatccctga

SEQ ID NO: 8020 - DNA, 249 bp, A.fumigatus
  unsure (42): Identity of nucleotide sequences at the above locations are unknown.
cccccttccataatcttcggtcccggcacgatcgaggtgaanatggatggccttcctgaatatctttcgcgatgtaagtggcgtcctttgctgagcttcctggatgtgattgacagtaaaattgcaggtcagacctatgaaggtggtatctccgggagtccgggctccgaggcgcatggcgcttatgccttttgtgctttggcctgtctttgtctccttggtcggcctgaagtggttgtgccaaggtaa

SEQ ID NO: 8021 - DNA, 666 bp, A.fumigatus
agatccgcatttacagatcatctttctaccgttgctgagtgtattagatatatgaatattgcaacactccttccctggctctcggctcgacaatatgcacccgagggaggtttctccggcagaaccaataaattggtggacgggtgttacagccactgggttggaaattgctggcccctcgtccaggctgcgctagatggcactcagccattggcaggccctaagcgatcttccgtcggcaatctttacagtcgagagggattgacgagatatatcctttcttgttgccagtgcaagcttggcggccttcgagacaaaccgggaaagtatgtcaattcatgtgcccaaacattcgaagttgaagtgcaaaggctgactgtctacagacacccggattcataccatacgtgttatgccctcaccgggctcagcacggtccaatattaccattactgtactgactcaagtgtgagctcgaaggatgacttcagctctgcattctcttggaagcatgaccctaacttcgcctcggatggtcaaggatccgacattggcgtattcactgagaatgaccgactcgttcctttccatcctatttttgtcattccacacaagtcagccgaagatatacgtgtctggttcgaaaatcaatctttcgacctgtag

SEQ ID NO: 8022 - DNA, 585 bp, A.fumigatus
ctgtcgctactggcattcgaactatgtgcacacacagcctattcaccatccatgagggcaccatcaggcagtctataccacctccaaccccgactcgatgacatcctaaacgatgtggcccccttcccctacaccctgggcgcattcattgcctttctctccgagcgccagtgcctagaaaccgtcgagttcttactggaaaccaagcgctactgccgcatctaccactggctcgagcagagaaccgagacctgcgaggccgtccgcaaggcccatctctgcggtctgtggaaccgactgatcaaccagtatatccggccctccgcggagcgcgagatcaacatcccctgcgacattcgccagcggctgatgcagcagttccacctgcaagaggacgaccctcccccgcccgaaatcctcgatcaggtcgtgtgtaacgtcaaggagctgctgcgcgggtcgatcctcatacccttcctgcgacgatcgtccgcgaccgcgcgcgtccagccgctctccatgccatgtctgaacggtagtttggttttctaccacagggggtcgaaggagccgcgcaacggttaa

SEQ ID NO: 8023 - DNA, 549 bp, A.fumigatus
acttggaaatgggaacgattcgccgggtggacttttcgcaacgcctttattgggtggggtgatctggcgtcggaggaggtcccgtcaacaagggatgggaccgcaggtgtttttgactcggggcaactcttcgacgtcgaaatatcggtcctcgtgcgattgtcaatcaccgtcaccatcgggcgtatcaccgtcgacaacgtccatcggggcatccttggtgccgccaccatactgtccgtggtcgccggaaccattttattattattcaccatcttccaatgcacgccggtcgattattactggaaccgcctgacgaaagagggccattgcatggacatggatctactggtgggaatcgtctacatgtacagtgccgctgctgcggtatgcgactttacgattggactgctgcccgccttcatgattgggaggctaaagatggaccgacatacgaagatggccgtcattggcgttctgtcgattggatgcgtgtatgttcctgctcctgatcgaaccggctggacgctgacttttcgccagtgctag

SEQ ID NO: 8024 - DNA, 693 bp, A.fumigatus
atcgctcgcagcgccggaatcgctcagaagctcaagattggcgttgttcagaccgcttatgccaacggatcgagcaccgagtacatagaaaaagttctcaaactcccatctgtttgcaccaatactggtgtgaaacatctccaccatgccgccatgcggttcgatgttggcgtctacttcgaagctaatggacacggtactatcactttctcagagaatgctttgaagaccattaagaatacagagccgcagtctccggcccagcagcgttcgctagagtgcctgcaagctcttactgatttgattaaccaagcggttggcgacgccatctctgacatgctcctcgtcgaagctattcttgctcacaaagggtggacgcctaaggaatggcttgccacatataccgatctcccctcccggcttgtgcgtgtggaggttgctgatcggtcaatcttcaaggcctacgacgctgagcgaaagctcgaatcgcccccgggactccaagcaaagattgattctctgcagtcccgctacaacaagggacgaagcttcgctcgtgcaagtggcacggaagatgcggtgcgtgtctatgccgaggctgcaagccgatcagaagccgacgatctcgctactcgcgttgccaatgccgttcgggatgccggcaccgtcaaagaaatcttgcaggcttcttaa

SEQ ID NO: 8025 - DNA, 519 bp, A.fumigatus
gacgctgtcttcttcccggcggtggagattcttcttcggtcgctcggtttcggcgccattccgctacatggtcagctctcccagtctgctcgattaggcgctcttgggaagttccgttcccgcagccgcgatattctcgtcgcgacggacgtcgccgcccgtggtcttgatattccgtctgtcgacgtcgtgctaaattttgatctgcccaccgactcaaaaacctatgttcatcgtgtaggccgtacggcccgtgcgggaaagagtggtgttgctattagctttgtgacgcagtatgacgtcgaaatctggttacgtatagagggcgcacttgggaagaagctcaaggagtatgagctagagaaggatgaagtaatggtcctggctgagcgtgtcggcgaagctcaacggcaagccattatggagatgaagaattttgacgaaaagagaggcaccaaggccaagaaattcggcaaaggaaaacgctctcgagatgagatggatcaagaagaaggatga

SEQ ID NO: 8026 - DNA, 489 bp, A.fumigatus
ccccgggctaatgctcggattgtcgctcctgtggagaagactgatgtgtgtgctggcattggcggaaatattctgcaagctaaagttgcgctacgaaaggcaaaacccgctggccagttccaactaaagccggacagcgtattggacttgattggagacctcacggtgcaggatctacccggtgtcggatatagtcttggcgcgaagctggaggagcttggtgtcaaactcgtgaaggatgtcagaggcgtctctcgtgagaaactgattaaccaccttggacccaagaccggtctcaaaatctgggaatatgctcgtggtatcgatcgaacggaagtcggcaatgaagttctcaggaagtcggtctcagctgaagtcaactgggggattcgctttgtgaaccagacccaggcggaggactttgtgaaatctttgtgcgaggagttacaccgcagactttcggataacctggtcaaaggcaacagttga

SEQ ID NO: 8027 - DNA, 1038 bp, A.fumigatus
cctggtcaaaggcaacagttgaccttgaaagtgatgcgaagagctgcagatgcgccattggagcctgtcaagcacctggggcatgggaaatgcgatgttttcaacaggagcgtcgtactgggcatagcgaccaacgcgccggaggtccttgcaaaagaggcaatctccatgcttcgcagcttcggaataacacctggtgatttaagagggttgggcgtccaaatgacgaagcttgagcctctcaagttaggggctaccaacaagcctgaaggtagccagcagcagctcaaattcaaggcgtccccagcgaggaaaagtcatgaacaggtccgggatcctgatgacttggacagcccacgcaaagccgacgctgcagccgtcagccatggcccgactttgaatgacgattcgtacaaacctctgaacatctctggaactcaattcatcatgccgtcgcaggccgaccccaaggttattgctgaactccctagtgatatccggtcgaagttgatgtcgcagggcaaagggcgacaagcgtctcgctcgacctcgccttgcccggccgcacgtaggacacaaacgtccacagccacggcactccctcctcagtcgcagctggaccccgacactctggccgctttgccggaagatgttcgtgccgagattttgggctactatggccgaacgtcaagcactccagaacctcaaccggctgtttccactgttcccagctctcgtccagcgtcgtctggcagtctcggaataaagaagtcatcaacccctacaaaaaaacgacggggcagacccagcaccaaaggcacgggcaatatgacccttacgcagtccaattttattatcgcaagatcgacgctaacccccgtcaatacggaggagcaagcatcatcacggcagccctctccctccccggacccggaaatctccgccgacttcctcgcagccttaccggaagacatccgccgcgaagtcctcgaagagcagaaacgagcacgtaagctccaacgctcaggcttgcaactg

SEQ ID NO: 8028 - DNA, 222 bp, A.fumigatus
ccagaaatcgtccatttgtgtattcgaagagttgctcgcgctgaatgggctctcctgaacgaagagatatctgtaagagagtgtgcttatctgagagatgcaaatgatgtaccgcaacaagtcaaggacatgttcctgcgtatcagttttggtgccgatgaagtcattctagaaattttgtttcttattctgttcatggttacgcgaactgttgttgcttaa

SEQ ID NO: 8029 - DNA, 396 bp, A.fumigatus
cttgttgcggtacatcatttgcatctctcagataagcacactctcttacagatatctcttcgttcaggagagcccattcagcgcgagcaactcttcgaatacacaaatggacgatttctggttaatgagaaacatgaaatgtccaaacgctatgccaagtttgatcttgacgctctatgctcgctagtttcgtctttgccctctgtctcgtcgcctatatccaaggttgagaagatggagggtggcttcaacaaaactttgctgatgactgcagaaaacaggaaaggagtcctcgccaaaatgccgtgtcctgctgttgtgccgtcgaggtatagcactgcgtctgaagttgccacattcgaatatggtaaactatgtgtgacggtaccgttgtaa

SEQ ID NO: 8030 - DNA, 219 bp, A.fumigatus
aatatgacttttcttccagtgaagtctcttacttctatgccggtgcccgaggtccttacctggagctgtgatgctctaaaccctgtcgggaacgaatacattgtaatggagaaagccaagggacggcagctagtcgaagtatggggtgagatggatcaggcgcaaaaattcaagcttatccaaaccttgtccggctggaaagccagctggcctcagtga

SEQ ID NO: 8031 - DNA, 786 bp, A.fumigatus
cgcggatccttccggccccgtggtgaagacattgcggacttggccgcctctgttgtatatgttccctcggaggtattgaagacacggctgcaactccaagggcgctataacaacccttatttcaattctggatataattaccgctcaacctcagacgcgctgcgaaccatcattcgacaagaagggttttctgcgctcttctatgggtacaaggctaccattttccgtgatctacctttctctgctcttcagtttgccttctacgaacaggaacaccgactcgccaaagaatgggtagggtctcgagatatcggtcttgggctaaagatcttgactgccgtaacggctggtggcatggcgggcgtgattacttggccaatggatgtcgtaaagactagaattcagacacagcagaacccggatgctgtcaagccttcctccgcttcgtcaaagggccccgttgagcacgcttctaccaaggagactctccggcagcacacttcaaaccaaactacttcaagtctccggactcgctcacggccgatatcaaccggaggagcctctacttcggtacggcctcctggaacgcctcgcttggacacctcgtcattcttcactgggttgaaggtgatctaccagacggaaggattttctggatggtttcgcggggttggcccacggggcgtttggaccagcatacaaagcggaaccatgctggtcatgtaccagtatctgctgaagcagctcgaggcatggcaaactactggggagacgggccccctttag

SEQ ID NO: 8032 - DNA, 288 bp, A.fumigatus
tctgtgcgcagctatgcggattacagcaacaaggacgcgctagccatcgctctcaacaaataccttcaagacaaccaaactatcctgatcaatgttcccgagttgaaggaatactggacgcgcgcgtcttcaacatcgcctgcgcgcacttctccggtcaagaaggctgtcggggtcgacgtcacgcctgccccgaagaaagttgcgcctgctggacggaaagctactcctggaacaacgcgtcggaggcaaacacagcctaagaaggaggaggttgaagtgacgtag

SEQ ID NO: 8033 - DNA, 1203 bp, A.fumigatus
  unsure (924): Identity of nucleotide sequences at the above locations are unknown.
tggtcagagcatcaccagggatttaacagttccattggtacataccacaagatccaatccaatatacaaagctcgcagaatcgagtccgaaatctaaaacatgcgctggaggacgccaaggctggattactctatacgaagcccgagttgaagggactagcgacgtcttcccagaaatacgacgacttaatccagcttttaagtcaaatccaagaaatacaatctctgcctgaaaagctcgagtcccgaatatccgacaagcgattccttggtgctgttgaggtgcttcacgatgccttccgattgttacggcgctccgagctagagaatatcggagcactggcagacatacgcgcctactttgcgaaccaagagatatctctgactgatatcctgatagaagagttgcatgatcacctgtacctcaaatccccctattgctcgaatcggtggaaaccaccagcgcaagagggagaagttggcaccgcaaacgcctctagctggactggagtagcaacctgggaaaaacctgtctacgcctttcttgggaagctggacgccaccacaccactggtagaggacgcgtcccgaaacccggaggctgacacgttttattatatccgacttttaattgaggcgctgaacaagatgggccatttggacatagcggtcgaccgcattgagcagcggcttccagttgagctatttgcagtagtcgataaaacaaatgcagaagtcgacgcgcgtcatccgaatttgggccggggcctctcatcccgggatggcaagactagtctgccaacagaggccattgaaaaacgcggacatgttttgacggagttcttatggactctatatgccaaatttgaagctattgctgaaggtcatcgtgtcctccacgatgccactgctggaattgtggancgcgaaggcatcccaaaaacagtgcacttacaagtggtttcaaagagttgtggaaactctatcaaaatgaagtcagtggccccccctaggttcgggcttaacgcttctcaatgcagtctatctcacagtttctatagattcgttccctgttgcacgattacctggccaccgatggagagtcctcctttagatttagagaagaagaagccgatgctaaacgtcaaattcatgctggtcatagggataggaacaaggtgcgtctgcttgccacatgtctag

SEQ ID NO: 8034 - DNA, 393 bp, A.fumigatus
catcgtgcaagtgctcttctagattctctacgacaagtagcggccgtcatgaacgatgccagtgagccgcaccgggcagcctaccaggagacctgggattttctacacgacaccatcagtttatggccattgggaggtcctcgtggaggcatcatatcctggcccgtccatatcggcgaagactacattgctctgttgaagcagggagactggatcgctcgtattttatttctacactatggagttggcatgcacctgctgtcggataaatggtacgttagcgattgggggcgtcgcttggtggctgcggtcttgcagcctctgcaggacattcctccaatctgggccgaaaccatcacttggatacgacaggcagtcgatctcaacagctag

SEQ ID NO: 8035 - DNA, 213 bp, A.fumigatus
gcccctgcattggaaccggaccaaatcaatcaacttattgtaatcccaggcatgtaccatagtggtattgggggcggcggctttatgctagtccgagctcctaatggctccttcgagttcatcgacttccgtgagacagctccggctgccgcattcgaggagatgttcaataactcgactcatgcatcaacaattggtggcttggctaggtga

SEQ ID NO: 8036 - DNA, 639 bp, A.fumigatus
gatttactctacccggctgaactacgcagaagaactaatgtgtctctaagtggcgttcctggcgagctgcgtgggctggagtatcttcacaagaagtatggttcattgccgtggtcggtcctggtgcaacctgcaatcaagactgctcgcgagggcttccctgtcggccaggatttagtgaagtacatgaaatcggctgttggtgacggcatagactttttggtcgagaacccgacctgggcgctcgactttgcccccaatggcactcggcttggactaggagacaccatgactcggaggcgctatgctgataccctcgaaaccatcgcaaacaagggaccggctgctttttactcaggaccgatcgcggagacaatgatcaacgcgctgcaggccgcgaatggtaccatgacaatggaggatttgcgcaactatactgtagccattcgaaatgtatcacagatcgattaccgaggatatcagatcacaagcacatcagccccctcaagtggtactgttgccctgagtattctgaagatcctgagtacttacgatggcttcttcgccccggggaacgtgaacttgagcacacaccgactggacgaagccatgcgttttgggtatggtgaggtatgttga

SEQ ID NO: 8037 - DNA, 198 bp, A.fumigatus
ccagagacgaagagaactaatctcggcgaccctctcttcgtcgctgggctggatgagtttgaagaaaacatgttgaaacaatccaccattgatgaaatccgacggaatatctccgattaccgtacacagaatgtgtctgcctacaatccgcaaggaattgagagtttgaatgagtgcgaatatcgttcgtcttcttga

SEQ ID NO: 8038 - DNA, 219 bp, A.fumigatus
atgagtgcgaatatcgttcgtcttcttgaagtccttactgacaagcccagttcgggtacatcacatgtggtagcagcagatcaccacggtctggcgatctccctcgtcacaaccatcaataccctctttggcagccaactcatggttcctgaaactggaatctttattaaccacgaattggaacgtacgtgctgcactggtccacccccattccactaa

SEQ ID NO: 8039 - DNA, 279 bp, A.fumigatus
ttcctctttttctcccgagttcatttctatattctcttcttaaataatcttttccctcttaaggatttatttagtgaccgcttgtcgcttgtcatttctctgctcttcatcctctctttattttggtgttgcctctgcggagccgggcacctggtttccagccacctcgtccctttcggattcgtttcaatcatcacttcttctttatcccactcactcagcggcaataacttgagcgacatttttgtttcctcacagtccttccagggcgttctctag

SEQ ID NO: 8040 - DNA, 228 bp, A.fumigatus
ccttttcactctgccggtcaattgtcgatctcgttacttcagcaagaccaaagacggccttctagtcagtatctgtacgagtgttcgaaagtttacgtcgtgccccatggtttcttcggctcggatcttcaactgaacatcactttctgtcatactcaaccgggtacattttttgcttacgcatattatcggctttgcatcttgggaaaaagcagttcgcctttttaa

SEQ ID NO: 8041 - DNA, 186 bp, A.fumigatus
acttcaagtgtctacagagtacctaacggtctgaacctcttcatttatttccaaccctacaccatcggtgctagactaagctcccgtaatgcggtccatgttatggcaacgccacgtgccagccggaaatcctccatggccctgatctcggtcaatttgggccatcacatatatatatgttattaa

SEQ ID NO: 8042 - DNA, 936 bp, A.fumigatus
tggtgtatttatgatcaagaaatttttctacctggtgttcaactactctggttctgccccctcatatatccacagaccatgctgcagtacaaaaatggaatctatcctattttggcccatgaaatcggtgaaggacttcccgttttgatcattcatggatggaagatggaggccagagtcgaggagttggactttgagccgatattcagcacaataccgggacttcgccggatttacgtggaccttccaggcatgggcacaacacctgcaaagaacgtcaaggatctggacgatatataccttcgcctggtgcagttcattgattctcgacttggcaagtcaagattcttacttgtcggctcatcgtgtggcggctaccttgcacgtgcgatagctcaaaaatatagtaaccaagtcgatggtctcctgttacgcgtgccgcttatagagccaaaggacagcatgcgcgatctcgatgctttcaagcctttggttgcaaatgagcaacttatgtcggacatgtcggccgaagacaagacacttcttggcgacgttcttgttcaaacgcctgcttacgttaagactctgaaggcgaaatacgacgaggtttacctgccagcggagaagaaagcagacagccaggtgttagatccgatccgagcagatccacatcgatatcagttatctttttcggtggacaatgaaggtgccaagttttttgcacccacgcttattatatgtggtcggcaagatgagagcgttggctatcgagacagccttcgcttgctggagctttatccacgatcaacctatgttgttctagaccgtgggacgcatggccttcctatcgacgagactagtgtttttgaagcccttgttcgtgactggataaatcgggttaatgaatggcggggtcgcacggacagagaagtgtag

SEQ ID NO: 8043 - DNA, 192 bp, A.fumigatus
aatcttacctttaaagataaactaaggatctatatactatctatctacagatacacatttaatagctgtaatattctctcctcttttagatttagcaagattagggactttccctttctcttttatactaatcaccttcctagatttaccttcaccaggttagaatctatatttattaaagttatatactaa

SEQ ID NO: 8044 - DNA, 549 bp, A.fumigatus
  unsure (6): Identity of nucleotide sequences at the above locations are unknown.
cgcagngtccctacccgcaaaagcccgggggtgcttttctcaaatcggttctccgtgaacgcgtttgccttgaaagcactctgtctcagctccggttgtacgttagcaagtctgttccaggcttgctgggctgtcctgctccagtgctatgtgggatcggatgacgttttattcggctacatagcctccaaccgcggccttcccatccgcggcattgatcgcatggtcggccttcttatcagcatcctcccacgtcgcgtcagactctccccttcagcttcctctgtgtccgaacaagtgcgagccattgccaagcatatccacgagcaactgcacgatgatctggaacaccatatgtccgccggaaacactatggccgaggtgatacagcgcggtagatgcattgaggagctgttattccctttcgataccgccattaatttccggagtcagccttccgcagcggtgaactcggtctcatccgatcccacatcgcctttacagttcgctgatgggcaagaccctatgccggtaagtcatccaccttga

SEQ ID NO: 8045 - DNA, 573 bp, A.fumigatus
  unsure (478): Identity of nucleotide sequences at the above locations are unknown.
tcctatttcaatccgtcgatctcttcgtgcttctcacatttctcagtatggatccattctcgacagaaggtggtgagtgctgaccgattgacttccccaacctcatttcgcagcctgggaaaagcaactcaattgactcctaatccccgcagagctcatcaacatccacaatgccttccatcaaggccaataccagaacgtgatcgacttcgatacctcggccctctcaccagacaaccatctcaccgcccgcatcctgcagctccgcgcccagcttgccctcggccaaaccgccgaagtcctatccgccgtcgagggcgaagaagaaaaaaaccccgacctcgctgcggtgaaggcgctggcgcaactcacggcgggcgatgccgagtctgcactccagctgacacaggaactggcggagaattatccggagaatgcctcggtgcaggtcctgggggggacggtgctgcaggctcanggccggagcgaggaggcgctggcggtcttgacgaagcatcaggggaatttggaggcgtgagtttctatttatccttcattcagcctttttcttga

SEQ ID NO: 8046 - DNA, 402 bp, A.fumigatus
  unsure (342): Identity of nucleotide sequences at the above locations are unknown.
ctcctaatccccgcagagctcatcaacatccacaatgccttccatcaaggccaataccagaacgtgatcgacttcgatacctcggccctctcaccagacaaccatctcaccgcccgcatcctgcagctccgcgcccagcttgccctcggccaaaccgccgaagtcctatccgccgtcgagggcgaagaagaaaaaaaccccgacctcgctgcggtgaaggcgctggcgcaactcacggcgggcgatgccgagtctgcactccagctgacacaggaactggcggagaattatccggagaatgcctcggtgcaggtcctgggggggacggtgctgcaggctcanggccggagcgaggaggcgctggcggtcttgacgaagcatcaggggaatttggaggcgtga

SEQ ID NO: 8047 - DNA, 456 bp, A.fumigatus
cgatccctaggaacggtgttattgctctcctcgaatcgtaacgaaccattgggtctgcgacaccagcagcgacgaacatccgcatcttctctacccaatgtcattcccggctctcgctcttcgtcgcgcacgacggcgccccagccaaaaaagacggcagacggtcgaattgttctcaatccgcagccagacgattccgttaacgacccgctgaactggcccatgtggcggcgcgatgctgcgttgctatccttgggcttctactgcttaatgggaggaggaatgacacccattcttgccgctgggttcaaccaagtctctgaaagctacggtgtgagcactcagaaagtagcctacaccaccgggttatacatgttgggtctcggagtcggatcggttatcatgtcgccgaccgcaatattatggggaaagcgaccagtctatctcctaggggct

SEQ ID NO: 8048 - DNA, 261 bp, A.fumigatus
gggcatcatggatgcctggggtgggatccttctgacctacaagggcaagcctcagggtacgtagcgatatctgatttatcacgtttgacttattctaatgatgtcgcagccgctcagctccagccctacgtcgagtcgattttccagctcctccacattatctctcaggacatgagccgcagtgagggtctcatgagggcatctatgggtgttcttgggtatggcttctctgtttcctccttttttttgccaattttctaa

SEQ ID NO: 8049 - DNA, 582 bp, A.fumigatus
ggtgctcaactcgttcgtcaccaacgccgcgaacgacagcctgcccctggtcgcgacactgtccgatgttatgatccagcgtctggaacagaccattcccatgcaacaacaggtcgtcagtgtcgaggatcgtatcaccctcgaggagatgcaaacctcattgaccagtgtactcctggtaaggattcccgatgcgcctcggcggtatatccattgctaactcgttggcaggctattgttcagcgtcttgaaacggagatcaagccccaggcggaccgcatcatgcatgtcatgctccaggttctctccaccgttccccccaagtccagtgttcctgacgtggtgttcgccactgtgggtgctatcgccagcgctctcgaggaggagttcgtcaaatacatggaatccttcactcctttcctatacaacgctctcggaaaccaggaagagccagccctctgctccatggccattggcctcgtcagtgatatcgcccgtgcattgaacgagaaggtccagccttactgcgatgctttcatgaactacctgctgaacaacttgagggtaagacatcaaggatga

SEQ ID NO: 8050 - DNA, 276 bp, A.fumigatus
gaagaatcactagctaatatcgcgtcacagagtgccaccaatcagcttaagcccgcgattctcgaaacctttggagacattgcccaggctatcgggactcaatttgatgtatacttgcctgtcgtcgcccaggtccttcagcaggcatcggccgtcacagccagtaccgacgtaactatggaaatgcttgactacatcgtctcgctccgtgagggcatcatggatgcctggggtgggatccttctgacctacaagggcaagcctcagggtacgtag

SEQ ID NO: 8051 - DNA, 507 bp, A.fumigatus
gaagcggcctacgcgctcgggcgcgtttgtgacttctgctctgagaccctcgaccctgacgtgcacctacaaccccttattacttgcctttttaacggtcttgctagtagccccaagattgccagttcttgctgctgggctttgatgaacgttgccgatcggttcgccggtgatgtcggtgctcacaccaacccactgtcgaagcacttccaggacagtgttaagtccctccttaccctcacagagaggcaggatgccgacaaccagctccgcaccgctggatatgaggtgctcaactcgttcgtcaccaacgccgcgaacgacagcctgcccctggtcgcgacactgtccgatgttatgatccagcgtctggaacagaccattcccatgcaacaacaggtcgtcagtgtcgaggatcgtatcaccctcgaggagatgcaaacctcattgaccagtgtactcctggtaaggattcccgatgcgcctcggcggtatatccattgctaa

SEQ ID NO: 8052 - DNA, 198 bp, A.fumigatus
cgacctttcagtgatctcgcagatacgttccccaatggagagttcgccagcttcttccgcaatgattgggtcaccgcgcttgttagggagactaggaacaaccgggaatacagcgctcgcactattgacaccgctcggtggacacgcgagcaggtcaagcgtcaggtcaacatgtccacggcggctgccatggcttaa

SEQ ID NO: 8053 - DNA, 405 bp, A.fumigatus
cttaatgttaaagaatccatgaagtacgcatccatacgcatgaaagagatctatgattggaattataaactaattaaattccgcgttagtgatcaggtctatgtccaactgcactgtggctattccctactaactaagcaagctaatcataagctccaattgcagaatgctggactgttccgcgtattggaatgcgttggaagactcacctactgtatcaaactaccctctacatggaagatccatctagttttgtccgtcgcccaccttgaacctgcgccggccacccctaatccattccaccatgagttaccgaagcctcccgcggttgttgatgccgaggtctaccctggtgaggataacatatataaagttaaacacttgctggataagtatactgtttag

SEQ ID NO: 8054 - DNA, 234 bp, A.fumigatus
ttaatactcctactaactataagactaaagtattctattagttataatccacatttaacagtctgcttttccgtgcctattttaacccccttaggcacttatatactgaccttaatatattatataaagggtttgggtgttatagtatatcatattcagattaacaaccaccacactaatcttttaattccacccatacatatagttattcaacctatcttatttcttagttaa

SEQ ID NO: 8055 - DNA, 267 bp, A.fumigatus
agaagggagacagtggaactgttccactttttcctgctgaagcttattggagcccatctcatctttgaacccattgcgcctagcacccactatccaacttcgtcgattggtcaggatacacatgagagttggctgaaatgtttcaaaatcaacgctgcctatcacaagaatctctgcaactgctataacagtagctggaaaaacttggctgtgctagatattcaaaagcagcaatgctatagatggtcgatggttcataaaacctag

SEQ ID NO: 8056 - DNA, 558 bp, A.fumigatus
acagagttagtctcaatctttgtagaggactgtctcacgtacctggctgagcgtctcgagcatcttcactgtagtctcaaaaccaacacatccatccgtgatggagacaccatacttgagcttctgcacctcgtcctccgactgtggcgcagcctgcttaccctcgttgatattactctcaatcatgactccggtaatggcaggctccccagcagcgatctgggaggcaactgcatcgatcaccttgggctggttacggtaatccttttggctgttgccgtgcgacgcatcgatcatgatactcggttggagattcttcgggtaagccttgattgtggacgcgacagacgcagcgtcgaagttggggccgctgtctcctccacggtggataacgtgaagatgaggatttcctttcgtgtggacgatggctgcaagaccttgttcggtgacacctgcagacagtcagcagcagtaaatggatcgccgcggactttactagcggacctaaaaatgagtgaggagaggaggcgctcttcatcgcatcgcatgcgatggtga

SEQ ID NO: 8057 - DNA, 522 bp, A.fumigatus
  unsure (183),(295): Identity of nucleotide sequences at the above locations are unknown.
ggagaggaggcgctcttcatcgcatcgcatgcgatggtgatattacccgaggacccattcttgaagccaatgggaaatgacaggcccgagactaactgccggtggacctgcgactctgtcgtgcgcgcccctactgcaccccaggagtacagatcggccagaaactgccgagagatggtgtcnagcacctcgcaggccacagggagaccgagaacagtgatgtcgaacagcaattacgggcaacctgcagctaacgggagcactgatcttccagtttcagggatgcgcagattgntaaggtactttcaatcccatgttgacttggttggtggagtcgatattcggatagtagagaaagcctttccagcccaccgtattccgcggtttttcaaggtaggcacgcatgacgatcagaagatcattgtcccatccgtgctcctgaatggcggcctgcaggcggacagcgtagtcgcgtgccacgtcggtatcatgtatggagcagggccccacgatgaccagtaa

SEQ ID NO: 8058 - DNA, 450 bp, A.fumigatus
ctgtctgcaggtgtcaccgaacaaggtcttgcagccatcgtccacacgaaaggaaatcctcatcttcacgttatccaccgtggaggagacagcggccccaacttcgacgctgcgtctgtcgcgtccacaatcaaggcttacccgaagaatctccaaccgagtatcatgatcgatgcgtcgcacggcaacagccaaaaggattaccgtaaccagcccaaggtgatcgatgcagttgcctcccagatcgctgctggggagcctgccattaccggagtcatgattgagagtaatatcaacgagggtaagcaggctgcgccacagtcggaggacgaggtgcagaagctcaagtatggtgtctccatcacggatggatgtgttggttttgagactacagtgaagatgctcgagacgctcagccaggtacgtgagacagtcctctacaaagattga

SEQ ID NO: 8059 - DNA, 447 bp, A.fumigatus
  unsure (447): Identity of nucleotide sequences at the above locations are unknown.
caagatagcagcccgcacactcgccctcatctcctcgccggtagcattgtgcctgagccctcgtcccctcttaaagacagcaatgttgcagcctatgagcctctcattccgcctgcacttctgcttcacgagattcccgtcaccccggcctctcgacgcacgatcgagtcagcccgacagggagcagcgcggatcatccaacggaacggcgacgaccggttactggtcatcgtggggccctgctccatacatgataccgacgtggcacgcgactacgctgtccgcctgcaggccgccattcaggagcacggatgggacaatgatcttctgatcgtcatgcgtgcctaccttgaaaaaccgcggaatacggtgggctggaaaggctttctctactatccgaatatcgactccaccaaccaagtcaacatgggattgaaagtaccttan

SEQ ID NO: 8060 - DNA, 498 bp, A.fumigatus
  unsure (51): Identity of nucleotide sequences at the above locations are unknown.
ttgctgttcgacatcactgttctcggtctccctgtggcctgcgaggtgctngacaccatctctcggcagtttctggccgatctgtactcctggggtgcagtaggggcgcgcacgacagagtcgcaggtccaccggcagttagtctcgggcctgtcatttcccattggcttcaagaatgggtcctcgggtaatatcaccatcgcatgcgatgcgatgaagagcgcctcctctcctcactcatttttaggtccgctagtaaagtccgcggcgatccatttactgctgctgactgtctgcaggtgtcaccgaacaaggtcttgcagccatcgtccacacgaaaggaaatcctcatcttcacgttatccaccgtggaggagacagcggccccaacttcgacgctgcgtctgtcgcgtccacaatcaaggcttacccgaagaatctccaaccgagtatcatgatcgatgcgtcgcacggcaacagccaaaaggattaccgtaa

SEQ ID NO: 8061 - DNA, 219 bp, A.fumigatus
atgagctggtctcctctcctaagaaacgcactccgatcacagtctcgttctactttcatacgagtcccacagcgcactttctcctcttctatatcccaaatggctccattcaccctctacactcacgccggtaaagccttctttcctgtggaccaggaagtctttgatgaatggctgcaggccccggacccaaccctgtcaagtggccattggccctga

SEQ ID NO: 8062 - DNA, 891 bp, A.fumigatus
ttatttgatagcgtcgaccggaataaataccagatcatgttaccccttcctcctaagatcgaccctagcgtgacgatgatgacggtcgaagacaagccggacgtgacctacggcgatgttggtggatgcaaggagcagatcgagaagctgagagaagttgtcgaaatgcctttgctgtcaccggaacgattcgtcaacctcggtatcgatccgcccaagggcgcgctgctgtacggtcctcccggtaccggcaagaccctctgcgctcgagcagtcgctaaccggacggacgccaccttcatccgtgttattggtagcgagttggttcaaaagtacgttggtgagggtgcacgaatggttcgagaactttttgagatggcccgtaccaagaaggcgtgcatcatcttctttgacgaaatcgacgcggtcggcggtgctcgtttcgatgatggagctggtggtgacaacgaggttcagcgtactatgcttgagttgattacacagctggatggttttgatgcccgtggtaacattaaggtcatgtttgcaaccaaccgaccgtcgaccttggatcctgccctgatgcgtcctggtcgtattgaccgcaagatcgaattctcgcttcccgatgtggaaggtcgcgccaacatcctccgcattcatgccaagagtatgtcagtcgaaagagacatccggtgggagctgatctcccgactatgtcctaatgctaccggtgcggaactacggagtgttgccacagaagctggcatgtttgcgatccgggcgcggcggaaggttgccacagagaaggacttcctggctgctgtggacaaggtcatcaagggcaaccttaagttcaactcgacggcgacatacatgcagtacaattag

SEQ ID NO: 8063 - DNA, 399 bp, A.fumigatus
cattcaagtactcaagacatacggcgccgctccatacgcgaccgcattaaagaagctcgaaaaacagatcaaggacaaacaagcgagtgtaaacgagaagattggcgtcaaggtttgttgaacctagtgctttgttatctccggaccttggctgacttcagacaggaatccgacaccggtcttgcacctccacacatttgggatgttgctgcagataggcaacgcatggcggaggaacagccattgcaggtggctcgctgtacaaagatcatttccgacgagaaagatcccgataagagcaaatatgtcatcaacgtcaagcagatcgccaagtttgtcgtgaatttaggggagagagtgagcccgacggatatcgaagaaggcatgagagtcgggtaa

SEQ ID NO: 8064 - DNA, 498 bp, A.fumigatus
catactcttggcatgaatgcggaggatgttggcgcgaccttccacatcgggaagcgagaattcgatcttgcggtcaatacgaccaggacgcatcagggcaggatccaaggtcgacggtcggttggttgcaaacatgaccttaatgttaccacgggcatcaaaaccatccagctgtgtaatcaactcaagcatagtacgctgaacctcgttgtcaccaccagctccatcatcgaaacgagcaccgccgaccgcgtcgatttcgtcaaagaagatgatgcacgccttcttggtacgggccatctcaaaaagttctcgaaccattcgtgcaccctcaccaacgtacttttgaaccaactcgctaccaataacacggatgaaggtggcgtccgtccggttagcgactgctcgagcgcagagggtcttgccggtaccgggaggaccgtacagcagcgcgcccttgggcggatcgataccgaggttgacgaatcgttccggtga

SEQ ID NO: 8065 - DNA, 219 bp, A.fumigatus
accaactcgctaccaataacacggatgaaggtggcgtccgtccggttagcgactgctcgagcgcagagggtcttgccggtaccgggaggaccgtacagcagcgcgcccttgggcggatcgataccgaggttgacgaatcgttccggtgacagcaaaggcatttcgacaacttctctcagcttctcgatctgctccttgcatccaccaacatcgccgtag

SEQ ID NO: 8066 - DNA, 240 bp, A.fumigatus
catgactttggatgtcctgtagtccaggcactgacccctgacaccccagaaaagcccaagcaattcttgcacattgtaagtatcatgcaagtgtcttcacagtttgatttaaggttgggagatatggcaacttcttttggcctttttggcactactgctaccatctctcttggcactaacggcaaatacatctattcctgtcctgttgtatccatctgttcccccgtgaccatcagctga

SEQ ID NO: 8067 - DNA, 1386 bp, A.fumigatus
atacccctggatgggaattccaggagccaacttggcttgaaacctgggaacgtgcgaagatttattccaggcgtatcggaagtccggagtcgcctgaagtcagttacaaagtccggcgtgtcaatttttgaagggtataaggagcatgttcgggacttgtggtttccccgaaccgaccctcctcattaccttcgcatccgcgagtctccctcagagggcccctatgtcaaagatcttacagaggttactgtcaggaactacaacgaactgatgaagtacatgcgcaagggtgacatgtctcgcacagtcgcgagcaccaagatgaatgacacatcttccaggtcgcacgctgtgttcaccatcaccttgaagcagatacaccacgatctttcgacagatgagacgactgaacgcacggcccgaatacgcctagtcgatcttgcaggatctgaacgagccaagtcaaccgaagctactggtcaacgactccgggaagggtccaacatcaacaagtcgctcactactctgggcagagtcattgcagctttggcggatcctagacatggacgttctggaaagcgcaaaggaaaggacgtggtgccgtacagagactcaatactgacgtggctgctcaaggacagtcttggaggaaactcgaagaccgcaatgatcgcatgcatttctccctcagactatgaggaaaccctgtccaccctgcgctacgcagaccaagcgaagcgtattcgcactcgtgctcgtattaatcaggaccaaatgtcagccgcggagcgtgataagcaaattgcagaaatggcggaaactatccgagcccttcagctcagcgtaagcctggccgctgctaacaggagggagaccgagattcagaacgagcgacttgaagtctaccagcaaaaggtagagaagatgcagagacttatggaagagaccaagatggtcagtgagtgcaagatccggcagctgcagaccgaaaatgaagcgctgcgcaatcatctaaagcttgcactggacagcctcaagaatcccatacccctggtaacaattgaaaagcgcaaaagtggcttatctgcctggggagaacacaatggcaacacagatgacggtatcaacgagacccggcctcagtcaccgatttctgatgcaggaccggagcccgatctcatctgggaagatgatgacaccatcctcatcgaggctagccaggtcaaggctcaggaaatgcaggctgacatggaagacttgctggtggatttgaacatgttcaagcgcaaactggccaccgaccatgaacgatttcgattcatccagaagcacgaaactcgcaggagacgccgtgcgttgcaagttgttttggccaacaatcgctag

SEQ ID NO: 8068 - DNA, 234 bp, A.fumigatus
atgattgcgcagcgcttcattttcggtctgcagctgccggatcttgcactcactgaccatcttggtctcttccataagtctctgcatcttctctaccttttgctggtagacttcaagtcgctcgttctgaatctcggtctccctcctgttagcagcggccaggcttacgctgagctgaagggctcggatagtttccgccatttctgcaatttgcttatcacgctccgcggctga

SEQ ID NO: 8069 - DNA, 558 bp, A.fumigatus
tccccgctattgaccatgtccgacaacagcgcgaagcggggcactggcgagaaatcccccaacgaccccagaaaacaggccgactctcgcaagagtgacccagagagtcaaaactctccgtctcttgctaatcgcattcaaaattccgcagcgggtctggcatggagtgcttttaatgcagctggttcatccgcagacgcagcgcaggtgtttggaagcggcagcaaagccggaccatcgtcctcggcatcgtcctccgccctagcagcagcagaacagtacagagagaccgcgacccctacttcctcgaatcgagttttggccaatcaccctgcagcatcatttcgctcatcgtcggcaggtcaacagggtgcattcgagctcccacccctcactgaggatgaattccagtgcacatacgatgaaagccaagtacacgacagaatcgactttcctccttcaacagaaacggaaacagacacagagaaaggcaaaggcaaagcaagcgaagcactatctgccgtcttcaccccggagctggcaggaacgcgcttatgt

SEQ ID NO: 8070 - DNA, 666 bp, A.fumigatus
ttacactgtttacgatatcgtgtcgccgcgtgggacgccctaccttgctttcatgtgttggattgggatgtaagaaaccccctttgctttggtgactcttatacttgtgctgactgtcgaagctggtcgttgattatgcattggattttggccatcaccaacgcgtgcaatggtctgacttatgtcacccgcttttcgtgtgatatcttcgggttttacgtggccttcatctacttgcagaaagggattcaggtcctgacccgacaatgggttcaggtcggggaggcctccgcctacctgagtattatggttgcccttcttgtcctcatgagtggatgggtttgcggacaactcggtagcagcacgctgttccagagatatgtccgcaaattcttggaggattacggtacaccgttgactatcattttcttcactggattcgtccacattggccatatgcgggatgttgaagttgcgaccttgcccaccagtaaagccttctttcccacggctgatcgtgactggttggtggatttctggaatatcagtgtcggagacgtcttccttgccattccatttgcccttcttctgaccattctgttctacttcgaccacaatggtgggttctcactttctgaagggtatcacccgaaccatagtggctga

SEQ ID NO: 8071 - DNA, 228 bp, A.fumigatus
ggtccttcttgcctctgttttgggggctgttgtttttgcggtctttgctgcgcagcctttggttattgttggtgttactggtgggtttgttccgattctgggggctgtgctcatgatgctcacctgtattgcgcaggtccgattacggtgtttaattacactgtttacgatatcgtgtcgccgcgtgggacgccctaccttgctttcatgtgttggattgggatgtaa

SEQ ID NO: 8072 - DNA, 447 bp, A.fumigatus
agtgtacaagtgtaccattgtactccgtacaaaatgcagagaaaccgtcgagcctcacacacttctgctcgtgaagaggacaccgtcttctcgaggtcaaatctacacccgacaacctcgcatggctcggtccactcatctcactcccagcggaattcttggcagtccagacctccgcacgcccgacggggaagtggccaatcgcactcccagcgctcccagcatcagcatggcggtgtctcccatggacagcagggtgcggagggtctgtcgggggtgcagactggcgcgtcgtctgcgcggacgagcaggtggtggcgggtaaggctcttccgcggcatgatcaaagatatcaagcggagggcgccgttctactggagtgattggactgatgcgtgggattatcgcgttatcccggctactgtttatatgtattttgccaagtaa

SEQ ID NO: 8073 - DNA, 375 bp, A.fumigatus
ggcttttttttttgtccaggctattgcggagtagaagagaacactgactggtgcagtattctgcctgctctggcgttctcgctggatatgttcgagaagacgaagcagagttatggggttaatgaggtccttcttgcctctgttttgggggctgttgtttttgcggtctttgctgcgcagcctttggttattgttggtgttactggtgggtttgttccgattctgggggctgtgctcatgatgctcacctgtattgcgcaggtccgattacggtgtttaattacactgtttacgatatcgtgtcgccgcgtgggacgccctaccttgctttcatgtgttggattgggatgtaagaaaccccctttgctttggtga

SEQ ID NO: 8074 - DNA, 270 bp, A.fumigatus
  unsure (142): Identity of nucleotide sequences at the above locations are unknown.
tggctgacatactgcttagtgtcatcactgattgcgcagggaacagagttccctctacgcaaacccgccggcttccactgggatatctggctgctgggactaaccaccttcatagctggaattctcggtcttccattccccnatggactgatcccccaggcacatttccacacagctgcaggttgcgttacaggcgcactggccgctgtcttgacgacgagaaaaaaggggagaaagagaagaaaggaaaaaagaaaaaaaaaaaaatga

SEQ ID NO: 8075 - DNA, 615 bp, A.fumigatus
ggaggatgtcaattacggcttgtgtcaaattatatacctggctccagggtcgagaacatatatcgtgacctcaacgtcgcatatgaaccttcaagcggggtcggttacctgccatgcaagttggcgggaaacaacataaatataacatatactttttcttctccgaatatcacggttatgattgatgagcttctcttggacgcgggcgaccttcgttttcgggatggtgcacgtgcatgtatctttggaattgtccccgccggagacagtactgcggttctgggtgacacattcttgcgcagtgcatatgtcgtatatgacatagccaacaacgagatatctattgccaacacaaacttcaactcgacagaggacaacatattggaaattggcgttggacctgattctgtccccagtgccacccaggtttctcatccggttacatcagttgtagctgatggctccggagcaagaattggggcgccgacaggtgcatcttcaacgacagtgccgtcaataagctcggcgggtgctctatcagcaggggttgcaagagccgataagcagtacctggccatcgccttgatagctgtttggtttgtgctgggtttgtga

SEQ ID NO: 8076 - DNA, 432 bp, A.fumigatus
tccattggtagccttcaaggtgggaagggtttcacggaggaggagcggatcctcatccttgaacgagtccggagtaacaacgcaggctcagagaaccgtcacttcaagtggtaccaagtccgggaggctctctgttcataccatttctggtttatattctttctctccatgttatccagcgttggcagcggggcagtcaccacattcggctccattatcttcaatggaatggggttcactgtcttccagtccttgttactaaacatgccaatcggtgcattggcctttatttgcatcctagggtctgggtacattgggcgaaaggtccccaactcacgcctgtacgttttgagtggtgcatgtgtgcctgttatactagggagctgtttaatgtatgtgtccttcaatgttgacacggggaatattacttga

SEQ ID NO: 8077 - DNA, 207 bp, A.fumigatus
gtcagatggcaacttccctcctcccagcgcgccggacgcatcatcggattctatctcatcaatttcttttcctctgcctgggttcagtgtatcgccatgggaacgtccaacgtggccgggcacacaaagaaggcgacgatggctgcagggacgttcgtcgggtactcgctgggaaatatcattggtcctcttacatttgatgcgtaa

SEQ ID NO: 8078 - DNA, 1428 bp, A.fumigatus
  unsure (1424): Identity of nucleotide sequences at the above locations are unknown.
gccacccggaaggaaaaaaccccccaaaagttctgcgtcgcagagcaaccctcattggttgggcagaaagacatcttcggaatcaaggcaacatcggcgaaaccagagaaactgagtgtgattattccaagcagtgctcctcccggtcatcttgcaaatcattctacccagccgtcattggaccacgcagttccagtgagacacaagccgtcgcctaattcttcgcactcaaagactgccagcaaagtaagggcacaggcggtggagcaagggcccagggaattcgctagtttacgaaatacagtcaacactcaaaatctacctcctccgaccccgattaatgcatcggctagtagcccctcgacaagatattctggttctccgggtatatggagcaggacttcaactcccacctcactgtcatcctattcccctgggattatccattctgcgaaggtcggtcctcgcttcaggcacccgagcccttccgagtctagactctccatcttctcacctataatcctgaagtccgattcacaagatgatccattggattcaggtggtgacgggtttccgagcataactgctggcgcagggttacacacgctgtcaatgtcaacgaagactcaatccgacaatcctcccaacagagatggttccgcgaagcctgctaccccgcctgaaaatcaactgccgactaaatcatcgacacagtccagcctgccaagaatgactcgatcaaaccttgcggagaattcagaggcatatgaggagcaaagcagaggtgcttccggggatcgcgggaatctcaaaggatcggcattaaaaagcgaggtcagtggttcagggcatgtaccttcaagacccagtagggagggtactcaccggctagagcttgaaccgtcacctgtgattcgtagcaacctccctcctggcgctgtggcgagtcataggagacatggatccggggctagctccgtcgcgttggggagaagtcattttgcctcaaacgcctgcgctgccacctcagttgattccttgcagtcaaggtcttctgcccgaccgccctcactcatacccagctcaccagagtcgatgcgcaaatcgccgcgaactttgttaaaagaacctaaaacaaaacaggatgcgatgagccccgcgaaaccacggagttacggtctcttttcgaagaagtcaaagtctgagatggaagtacaaaaacttgaggatcgacacattcgcaagggtccagcagctgggacaggccatgagggttatgggagatatgcacagcgtggtcggaagggaactgtcggcagcaacagcgatacaagagcaagatcaacgagcaccaatcgcagcacaccgcgatcggcctccagtcttcactacgaggctgccgaatccgccgcttggtgtctccncact

SEQ ID NO: 8079 - DNA, 1788 bp, A.fumigatus
ttgggggatatcgggcccaaaggggggggagggggaacaaggccagggggggaattccttcgggagggggccaaaaaggtttcaggaagtacggaatttcacgacggcggatgccatctggaaccctggtccttcagctgggcggtatccggcgccttggtggaaatacagcaggacattcctgccacagaaaggcaaagtgattcaactcagaacctgcgaatggctttgctcaaatcatcagaacgacgaatttctcatattgtatcatcgagccagatgtcaatgtccaaccgttctcaactatcgctgattgcatcaagacaactggataaaagactggagggaaattccacgactgacacgagccaactccgagatctccgtatactctataaccatgctggaatacccttgccatggaatcattcaatatacgtacgcaaatgcaaccgtatgttcctgctattcccgaagcgcaatatggtgatgcgacaaaatctctccatgccatgtcttttaagtacagaacccggtcactcaagactcgtcgatcgctcagaaggattttatgctggtaagaatttcagacatggggaagttggttctcattcggctcaaaagagacctcgtgctcttgcgtaccagatgtggtcggctcgcatggaacttcaaacgtcaaaatgcatccgttacaaccagagcccgcttctcggtcctccagggagccccgaatctggacttattggcagtttctcgtctgaacacgccgcgttgttggactttatcccaaggacctttggaagatgtatcgccgatccatccgacgcagccagtcgcgcgggatgcatgaaacaacacgttgatcacgacaaaggcgacatgtcgcaggaaagcgcacaagatttcgaagctgaacacagacgctataagccacaacttcgcatcgataatagttcatgtcgaagtgcagaagtcagagattcggggcttcaggctgcgcctcctggagccgttcagagctctccacgctcagatagtgcagagagaccacggagctcggacaaaaccaacaagaccaagaagctgcggaagagacatcaatcaacagctaggcacgtggcacatggagaggtacatttacgaagtctaagcacctgggaggcgaggctagcgcacgacctggatcgaagattggaatggctcttccaccagcttagtcctggtcgtaggccttttcactttgctttgcttgccaatcactggctaaatagagagacatgggttgtactcgatccaatttcacgggttcccattcaagcaagacgtctttggggagatccacgatttaattccccatacccaatacctcgctggggaccgagacccaaatatcccgagagcccttgcaaaacagccaacagacctcatttgaattcctggagggtcgctgtcaatcgcaatcgacgggcatcaggacttcaagacatcgtcaagggcctcgcgttacttgaagattccgcagatgaaccaccggatgggaaagtcgatccagcaagctggattcttcgaaggcccccgcaaggttttgcgaggtcaatcacgcagcaagataagtacttcgaaggaggagcaggttggcaagagaccctcggtgactggcaaagggtgcgccgtggttatcgaatacgtaaagcaatctatgaaggaagaaccaatcgaagccggacgaaggagatagcggttggacttcctcgttacttccaggccatcacaaatgaaccttga

SEQ ID NO: 8080 - DNA, 789 bp, A.fumigatus
  unsure (236),(244): Identity of nucleotide sequences at the above locations are unknown.
gggaatgctttccagacaagcttccagccaattccattgccaagggttggactgccaagtcggggaaatataaagcaagaatttaccctgaatacgaacaaaaccgttaaatcaaggaaagcacaagccgatctattcccagataatgtctcgcgcatcctcttatatgaaccttgctcacgtgagggtgaacgaagtcgtacttgtttgagtacaaaaggcaaaggggagcacancctcgagnacatccatgactttgtcttccgacttcctgttctagaataccggaacaagacatggtccaatttggatttggctctgcgactgaagaaggatgtcatcaaggctttgatatctcacgcacccgcgatacttggcaacaagttttctcatcatcgaccttcaaagcaacaactgaaacgctaccgcgaggttgccagtccatctcagctacttcagaaccaggacagtgcatcaaatgccccgtcgggcaaaacccagagcctagcgagttatgactcgaacagcgaacattcagagtcgacgtctcaacgctcagttcactcaggaacctccccacttgcgcgatcacaatccttaggctcaagtatgcttagcatccaggatcaaggcataccatttgactcgcgctctgcgagtgaagtggatgtcgatgctcgctgggaggtatgtctctacacaatgtcgtacaagtttagagaacggttaaaagctaaccaccaccttagcaatctcgtaggattgtcaatcctcccaaccgaccactaa

SEQ ID NO: 8081 - DNA, 183 bp, A.fumigatus
accctgcttgatcaaaacttccggtggagtcataaagataaagagccttcggtgtttttcgatgccaaaaatgtccatcgacaattgctcacgatcctaattggtgatacccccaagtttattttgtattttcattttgtatattttcaaaccttcacccaaagtttcaggcagcgccactga

SEQ ID NO: 8082 - DNA, 240 bp, A.fumigatus
gattcatcccctcaggaagacactgatctcgtatctgttacaattgtcgttccttttattcactctccctcatttcacagaatgcacccaacgaataccgccgcatggcagattgccgaaaaagccaagcctctggaggtcaggcccgccgcctacactcctcctaaggagaatgagatcgttgtcaagaatagcgctatcggcctggtcttcaccacggggctggaaggagccgcgcca

SEQ ID NO: 8083 - DNA, 636 bp, A.fumigatus
ttgtttgcctctacggaggttcaattgctgtttgtttgtctgattgcttacttgtccatcgtttacattcagagatctcgggtattagcagtctccaccccgacattgtccatcatgcgtttcaacgcagctatcactggcgctctcgtctcttcggccactttgatgggccaagctcatgctgaggagactgagaagaaggctgacgctacttcgctcgttgagaagcctaccttcaccgtaagtaacatcctgtcaatccagtactccccaccgtcgctcctcgtcgctgacgatcaactctctattagcctactaccatcgaagctcccttcctcgagcaatttaccgccgattgggactcgagatggaccccctctcacgccaagaaggaggactccaagtcggaggaggattgggcctacgtcggtgaatgggctgtcgaggagcctaccgtgctcaacggcatggttggcgacaagggtctggttgtcaagaacgtcgcggctcaccatgccatctctgcgaagttccccaagaagatcgacaacaagggcaagaccttggttgttcagtatgaggttaagccacagagtaggtcatatcagctcctggctatggcatggagtgtactga

SEQ ID NO: 8084 - DNA, 810 bp, A.fumigatus
  unsure (696): Identity of nucleotide sequences at the above locations are unknown.
gtcaaggtcctctacgaattctcacttacaatacttcaggttcacttcattttccgtcacaagaatcccaagaccggcgaatacgaggagaagcacatgacagcgcctcctgccgctcgtaccaccaagctcaccacgttgtacactttgattgtcaagcccgatcagtccttccagattctgattgacggtgaggctgtcaagaacggtaccctgcttgaggacttcgccccccctgtcaacccggagaaggagatcgacgaccccaaggacaagaagcccgccgattgggttgacgaagccaagattcccgacccggaggccaagaagcctgatgactgggatgaagacgctccttatgagatcgtggatgaggaggctactatgcccgaggactggcttgaggacgagcccaccagtattcctgatcccgaggccgagaagcccgaggactgggatgacgaggaggatggtgactggattcctcctactgttcctaaccccaagtgcaacgaagtctccggatgtggcccctggactcctcccatgaagaagaaccccgcctacaagggcaagtggaccgctcctttgattgacaaccccgcctacaagggcatttggaaaccttgcaagatccccaaccccgcctacttcgaggacaagactccttctaacttcgagcctatgggcgcttgnaagtttcttgattcttgcgtttgcagttgggtgcttcggtctgacaagccaaccaagttgggtttcgagatcttggaccatgccaaaaccaatttcttttttgaaaaccattaa

SEQ ID NO: 8085 - DNA, 192 bp, A.fumigatus
gtcatatcagctcctggctatggcatggagtgtactgacacctgtcttcaaaaagactcccttgtttgcggcggtgcctacatgaagcttttgcaggagaacaagaagcttcacgccgaggagttttccaacgcgactccctacgtgatcatgttcggtcccgacaagtgcggtgctaccaacaaggtatga

SEQ ID NO: 8086 - DNA, 372 bp, A.fumigatus
cctactaccatcgaagctcccttcctcgagcaatttaccgccgattgggactcgagatggaccccctctcacgccaagaaggaggactccaagtcggaggaggattgggcctacgtcggtgaatgggctgtcgaggagcctaccgtgctcaacggcatggttggcgacaagggtctggttgtcaagaacgtcgcggctcaccatgccatctctgcgaagttccccaagaagatcgacaacaagggcaagaccttggttgttcagtatgaggttaagccacagagtaggtcatatcagctcctggctatggcatggagtgtactgacacctgtcttcaaaaagactcccttgtttgcggcggtgcctacatga

SEQ ID NO: 8087 - DNA, 354 bp, A.fumigatus
  unsure (176),(207): Identity of nucleotide sequences at the above locations are unknown.
acctccaattgtcatcagcgtcaagcttgcagcatggctcaagaaattgaaaaaaccaacaatgaccatctggtccagtcctctgacccagagcaccccgcaaacctgattcctgagctctgccgcaaattctacaattggggttgggtcactggtactggtggtggagtgagtantcacgtttctggccgcgaaaagatactgacnagagcatcaattgaatttataaaactccgatccgtccccgcgaaccataattttcattggcaccttccagaagttcccaaaaggaattggaatccacccggcaccaatatcctttgttccctgaagttccctcaatccccaaattac

SEQ ID NO: 8088 - DNA, 510 bp, A.fumigatus
tccattcgttgcccatctgcctcttcatctaccatcaatctctaccaaatttgcctccacaatggcctccaaccgcgccctcgccatcctcgaccacgccgcctcaaaccactacggcgtgccggccatgtgctgctacaacctggaaggcatcctggccaccgtccgcgccgccgaagccaagcgctcgccagcgatgatcctcctcttcccctgggccatccactacgccgacgggctgctcgtgcacgccgcggccgaagcagcccgcaaagcatccgtgcccatcgccgtacacatggaccacgcgcaaacccccgagatcatccgctacgccgccgacctgggcggcttcgacagcatcatggtcgacatgagccactacgacaaggaagaaaacctgcgtctcacgcgggaactggtagcctactgccacgagcgggggatcgcgacggaggcggagcccggccggatcgagggcggggaggacggagtcgcggacacggctga

SEQ ID NO: 8089 - DNA, 954 bp, A.fumigatus
aggcatatatcccgtgcacctagaattctttgtactaatccattcgttgcccatctgcctcttcatctaccatcaatctctaccaaatttgcctccacaatggcctccaaccgcgccctcgccatcctcgaccacgccgcctcaaaccactacggcgtgccggccatgtgctgctacaacctggaaggcatcctggccaccgtccgcgccgccgaagccaagcgctcgccagcgatgatcctcctcttcccctgggccatccactacgccgacgggctgctcgtgcacgccgcggccgaagcagcccgcaaagcatccgtgcccatcgccgtacacatggaccacgcgcaaacccccgagatcatccgctacgccgccgacctgggcggcttcgacagcatcatggtcgacatgagccactacgacaaggaagaaaacctgcgtctcacgcgggaactggtagcctactgccacgagcgggggatcgcgacggaggcggagcccggccggatcgagggcggggaggacggagtcgcggacacggctgacctcgaaggcctcctgacgactcctgaggagagccgcgagttcgcggacacggggattgactggctggctccggcgtttgggaacgtgcatggcgagtatgggccgcgggggatccggctggagtatgatcggttgaagagcattcaggaggcggtgggggatcgggtcaagcttgtgctgcacggggcggatccgttcacgccggagatctttgcccagtgcattgagtgtggggtgtccaaggtgaatctcaacaaggtgttgaataatgagtatgtgcgggtgcagcgcgagaaatcggggcgggcgcccttgacggctgtgctggaggaggcaacgaatgagatgcagaaggctgttgaacggtgtatggatatgctggggtctacgggaaaggctgcttag

SEQ ID NO: 8090 - DNA, 207 bp, A.fumigatus
attggaatagcttcaaatatcaaaatatctaaaattggtggttacggtgcaattggtggttatggtgcggcgcaccctcaatgcggaagcggtgagggtgcgtatggcacggatatagctgtccccaggtctagtgctgtattgagaggtcaatatgtgcaagtgtgtagagactcggcgtttgccccgacagcagcagaagattaa

SEQ ID NO: 8091 - DNA, 216 bp, A.fumigatus
  unsure (49): Identity of nucleotide sequences at the above locations are unknown.
acggcagtccacggccaggtacacccagttccagatacggcgggagccntagacgccccttgccacctgctccattgtttgctggccccggagcagcaacggggcaagatacaagcatcgatatcggagatggcaacgatcctgaagatccgttcggaggaggaggaaggacgaacaaccgacacgagcaccgtggaagcattcgatcgttcatga

SEQ ID NO: 8092 - DNA, 231 bp, A.fumigatus
acaggtgctgaccatccgcaggcaaacttctacctggctttctttttcattgcaggatctctatcggacgagagaattgacccatttggacataacatgggaaaatacatcttctttgtcctgcggtacgcatgcatcttggtcatgtgcttgcaattcatcatttcgatgggtaatcgaccacaggggttagtgtcgcgactacccaacaatggaaaagcgtgttactaa

SEQ ID NO: 8093 - DNA, 324 bp, A.fumigatus
catccccaaagagcaaagaagctttacatgtcgggcatcatcgtctacagtataataatggtctacaccgcattctgtgctctctatctagtcgttctaaagctgatggccgaagctggggtgggcaaaaaagagcttgctgttaatgattcgctcttcatcaatattgtgggattcctggtctccactgtcgggctctacttctattcttcggtcctatatttggatcccgggcataatgtcacttcttttcgggccataactttgcgctggttgccaacctacattttgcacttctgcaaggtcttattgcgttttgtaaac

SEQ ID NO: 8094 - DNA, 1632 bp, A.fumigatus
  unsure (78),(188): Identity of nucleotide sequences at the above locations are unknown.
tccgcggtcgaagtgccgcagtattcatcgcgccctgattctcccctcagaccttggtctccagcgcgcgcggcggantggacaaggcccccggctccaccgtctgtcaccggctcgcagtacgaacgcgcagatctaaacggcagtccacggccaggtacacccagttccagatacggcgggagccntagacgccccttgccacctgctccattgtttgctggccccggagcagcaacggggcaagatacaagcatcgatatcggagatggcaacgatcctgaagatccgttcggaggaggaggaaggacgaacaaccgacacgagcaccgtggaagcattcgatcgttcatgagcgattcgaccatgatcacagatgaaaaggaagagatggcgaagatcaacctcaatgaagacgatgtcgtcgacgttgaccctaacatgcactatggtcccgctcctgaaaagcaaagtcgtcgaggagttcgagaggcccagatgtctaagaaggaagtccagctgatcaacggtgaactgatcctcgaatgtaaaattcccacgattttgcatagtttcttacctcgtcgggatgaccgcgagttcacgcacatgcgctatacagccgttacttgcgatccagatgacttcactcagagaggttataaactacgccaacagattggaagtaccatgcgcgagactgagttattcatttgtgtgactatgtacaatgaggatgaaacacacttcacccgcaccatgcatgggattatgcgaaacatcagccacttctgctcaagatccaaatccagaacatggggtaaagacggatggaagaagattgtggtttgtattattgcagatggtcgcaagaaggtccatccaaggactctgaacgcactggcagcaatgggagtctaccaagaaggtatcgccaaaaatattgtcaaccagaagcaggtcacggcccatgtgtatgaatacacgactcaggtatctctcgactcagatctgaagttcaagggagcagagaagggcatcatgccctgtcaagtgatcttctgcctcaaagaacacaaccagaaaaagttaaactcacaccgctggttcttcaatgcctttgggcgcgctctacaaccgaatatttgcatccttctggatgttggaaccaaaccggagcccactgcattataccatttgtggaaggcgttcgaccaagactcaaatgttgccggagcagctggtgagatcaaggccggtaagggcaagaacatgatgggcttgttgaatccgcttgtcgcaagtcagaactttgagtataaaatgtccaacattttggacaaacccttggaatcggtctttggatacatcactgtgcttcccggagctctcagtgcgtatcgtttctttgctctgcaaaacgatgccgatggcaacggaccgcttaatcagtatttcaagggtgaaacactgcacggcaaggatgccgatgtcttcacagccaatatgtacctggcagaagatcgtatcctgtgctgggaattggtagccaagcgggaagagagatgggttctgaaatttgtcaaaagcgctgtcggtgaaactgacgttccaggtgagcgctgcgtttga

SEQ ID NO: 8095 - DNA, 420 bp, A.fumigatus
ctcatggcctcatcagacaccataccggagtttatctcccagcgaagacgttggctgaacggtgccttttttgctgcggtatattccctcgtcaatgtaaaacaactttggaagaccgaccactctgttccgcgcaagattcttcttcagattgaggcgttctatcaatttttgaacctgctcttcacttactttggattggtatgtaaattagttccgcttactgaacaggtgctgaccatccgcaggcaaacttctacctggctttctttttcattgcaggatctctatcggacgagagaattgacccatttggacataacatgggaaaatacatcttctttgtcctgcggtacgcatgcatcttggtcatgtgcttgcaattcatcatttcgatgggtaatcgaccacaggggttag

SEQ ID NO: 8096 - DNA, 267 bp, A.fumigatus
gttcaatccggcggctctttcgatgtcgattactcagttgttggccctggagagaaggttatcctagacggaactaaggaacggcaaggcgactttgtcttcacagctcagagcattggagagtaccgattctgcttcaacaatgagatgtcaacatttgcggagaaaatggtcgactttgagattgctgtacgttcgggtccttggcatacacagtggctggatctctaccaggggacttatcacactaactggggggttttgtag

SEQ ID NO: 8097 - DNA, 384 bp, A.fumigatus
gtcgagaatgaggagcgcgcgcaattaccttcacgacaaggtgccagtcccgagcaagcatcggctcttgaagagtccatctacaaactgtctgctcagctgtcgactattgctcgcaaccagaaatacttccggacccgcgagaatcgcaattttagcacggttcgcagcaccgagaggcggatcttcaacttcagtgtgattgaaggcttgatgatggtgtccatggctggtctgcaggtgtttattgttcggttcttcttccagggtgcacggaaaggtacgtattccctttcctatgggggcgtgaaacccggcatcgtatttgattattgtctttcccgttccttgattcaagtccatgtctggctaacacccttgtag

SEQ ID NO: 8098 - DNA, 186 bp, A.fumigatus
actcgagtatcaacactgctctccaagaagcagcttacggacttaaaaataggtagcacggttctgcttagcatgccatttggctcttttgcacgacggcttgggattatactcgaccatcatctcttcttacgcaacaatgagtctgatatcccaactgccctcaaagagaatgcttctcaccat

SEQ ID NO: 8099 - DNA, 282 bp, A.fumigatus
aatatagatctcgatataactgacaactcgaatagcgctgtctacgtccagggtcgcgataaattcaacaacaacggccaatcctctcatctcggtgtcaaggctttcgccttcatgtggacttccgtcgctctccttttcctctcctgcgtgatctactgcatgggaggcgccgtcggccgaaaagacggaggatacagcggacgggaacagagacggcgtggtttcttcaattcccaccgatcaggaagcttgagaagcaacaaggaaaccgcaccgtaa

SEQ ID NO: 8100 - DNA, 315 bp, A.fumigatus
cacaccgcgataggagtaggtctagggttcctaggccttttctttacagccagcgcccttctgttgatgttcctcgcttttctcggaggagcaaggaactcgaaccctctggacaggatttactggcttgaagctgccacgggcaacatccctggcgcaccagccctgtcccgatggacatactggaatctgtgcgcagtgaacagcgagggacacaatgaatgtgggaagtcgtaccccgactacccctttgatccccctagccaccggaactttaatacccatgtcaacatccctgcggctttcattgggtga

SEQ ID NO: 8101 - DNA, 192 bp, A.fumigatus
tataattgcaacgcccaggttgcctttttctgcggcacatgttcgaaatcttcttcacgactctgttctgaccgtctaaataacgtcgtttgggcctttgatgctagtttcttagctttaccaagtaacttccccaattactttctgccgaaatactacgtccttcaagccctacgccgagttaagagatag

SEQ ID NO: 8102 - DNA, 360 bp, A.fumigatus
  unsure (12),(17): Identity of nucleotide sequences at the above locations are unknown.
gctcagtactcngcccntaagaatggtggtgacgtctttgtgcgtgtctgcgagggtgtccgcgaaatcaaggtcaccaagcccgagccgaagcccaaggaggagaagccccccaaggctgaggatgacgaagacgaagactctgactttgactcggacgaagatgaagaggaggaaattcgtgagattgtatggaagactgagaaaccgattgccgaacttgcggtcaagggcgtcaaggctggcagcaaggttgagctgatggttcacgtcaacgccgatctgggcatgcagatcactgctcgggaagtcggtggtcagaatgctgtccgtggcgccgtcgagtcgcccaaggcttaa

SEQ ID NO: 8103 - DNA, 429 bp, A.fumigatus
acccacctcacatttgatgtttcttatagctcatttgaacgactggagactcacgactatcaaatatcgaagatgcggatcctctactttcccctgctcgcatcgagcttcttggtcactcggactctcgcgacagacacaatcagtactaacgaggtatcgacttgtttagccagctccgacgttgaagtcagggagctatcagtaacctacactcgctccacgagagaagtcgttttcagaattgacgggacaagcaagaaagtacaaaatgttactgcatcattgacagtgactgcatatggcaaccaagtctattctaaggatttcgatccttgcaactccgacaattacgtcgctcaactctgccctggtatgtatcatcatcctgcgaaggccgttaatcagtatccactaatacatgcatag

SEQ ID NO: 8104 - DNA, 2970 bp, A.fumigatus
  unsure (732),(2854),(2970): Identity of nucleotide sequences at the above locations are unknown.
gtgcgcggacccttccagccccgtggtgaagactgttctcttacatctggatcgaccggtgtgccaaaaggagtcgttgttccacatcgagctgtttgttgcagcattcgagcccatagcgaagccatgaacatcaacacaacatccagatctttgcagtttgcctcgtacacattcgacgcctgtatctgtgagatcttcagcgttctagtagctggcggaacggtttgtataccatccgaagaggaacgtgtccatgatcttgcaggctttatcacgcgctcccaggcgaattgggcctttttcacacccactgtaattcgaacgctcggcctctcaccgtcccaggttccatctctgcgaactttggtacttggcggagaagtggtcaccgtgcatgatgccaggacctgggccggtcatgtctccttattcaatggatacggcccaacggaaacatgcgttttctgcgccaccacgcctatccatcctgacggcgtgacctacgggcggatcgggcggcctattggttgtgctgcgtgggtggtcagacccgacaaccacgacatattactccccccaggctgccccggggagcttctcatcgagggtccgatagtctcccaggggtacctcaatgaccctgtccgtacacaggaggctttcatcacccacccggcctgggctcagaaccgcaaactcagtcagaaccaatcttccgctcggagattntacaagactggtgatcttgttcgccaatcaccagatggcaccttggtatatatggcccgcttggacagtcaggtgaagatcaatggacagcgccttgaccttggggagattcggcatcaaatccactcagtggtatcagaagatgtccaagtcttcatcgatcttctgcctccgacttgcttgcccaatgagaaagccttgctcgttgcattcctggcttcaacgcgctttgaaccggaacagacaagcggtttcagcccccccatcaagacccttacgtcccagctcgagcaagatttaccgagactgcttccacgatacatgattccgtccgtgtacctaccactttcagcaattccgctcacctctggaggcaaggtcgatcgccaggcactacggaggcgcgtgagcaggatgagcatgaaggagttacttgtgtatactggagaagaacagggtacaaaactgcctgtttcaactgcggaagaacagcaaatgcaaatgctgtgggcggaggttctcagaattcccccggagaccattggagcatcggatcacttcttccgcctcggtgctgattccatcgacggcatgaaacttgttgcgttggctcagcgacacgggattttgattactctggccgatatatttcgctctcctcgattaagcgacctggcgacgctgcttgagtccccggctcatccagacgattccaagcatgatctgaagacaattattccggcattctcgcttctcaatgttcactcccgaaatacggtcctgaaagagattaaagcggactatgctctggatgtgtcacaaatcgaagatatctatccctgcacccccctgcaagaatctctgatggcagcctcgatccaatcccacggggcgtacgtccaccatttggtcgaaaagctcccaccctcaggcgaagtaccggcaatcatttccgcttggcaaagtgtcattaaaatgacgcccattctacgcacacgaattgttcagactgtatcggcgggtctccttcaggttgtcctcaaggagagcgttcagtggctgcatcgccgacaggccatccaggaatatcttgacgaagacgcgcgtcattccatgactctcggagatcccctactgcgtctggcttgccttcatgatcccggcacaccacatacaggtcatatagtgatcaccattcaccattcgatctatgatggttggtctttgccacacatcaggaagcttgtttatgcgactcaaaatgggcatccttgctcaacgtctttgcctttcaaccgattcatccactacctagaacagaaatccgatagtagggcaagcgattctttttggcagagcttcctttatcgttctcagccacttgcatttccacctttgccatctactggctatcagcccgttggaacggactcggtccagctgtctgtgcattggccatctacgttccctccctccgcattcaccctgtctacgtttgttcgtgttgcgtgggcgttggttctcgggtcctacagtgggacagacgatgtgatattcggactcagcctgagtggtcgcgacactcccattcctggcattttggatatcttaggtcccacgatctgcacggtaccgtttcgagtaaaattcagcggcgagagttttggcgccctgctggagagagcacatgctgactctgctgcgatgttaccatatcaacacattggcctgcaccacattcgccaactcgggccagactgtcagcttgcctgtgacttccaaacccttcttgttatccagccagcccgagatccgagcgatccagaaccccattcggaactgactttcacatcttcaggtggcctaacatatgccttcgcactcatttgccagccacatccctcgggcattgaattgcacggtgatttcgattcaaactgtgtttccagacctgtggcagaacgattgctgtctcaaatgaaatctgtcatgggtacattgatctttggagaccgaaggaagctcgccgcagaagttgacgttatcggcatcagtcagaaagccactttggccacttggcaacgggagcccttgcagcccggagaaggtcgagttgaggatntgatcatctcccgtgcgcagcaagccccggatgatctcgcgatacatgcctgggatggggagttgacttataacgagctggtcaaagagttcgcgacacttgcccgaaaatcttan

SEQ ID NO: 8105 - DNA, 240 bp, A.fumigatus
tcacactctacatacgaattttgtgctagacgcaagagaattacagtcgctgtcaaagaaagatacaacaaccagattgttagcgccggccagttgctatctctgaccggggaggtcaagcagaacatcacacgcgatgttgtctcagcggcggatccggcttctgcttatagccgcggtggtgttgatggtcaccatcttctactattcggtaccaccaccctaccctgcgagaactaa

SEQ ID NO: 8106 - DNA, 339 bp, A.fumigatus
cacttcatgctctactgtgcagtcgttattttctccaaatcctactgcccatatagtaagagggcaaaaactatcctccttgagaaatacaatatagtgcctgcgccgcatgtggtcgaactcgatcaacatgcaatgggacagcaacttcaatcgctcttggcaaagaacaccggccgacgtactgtaccaaacgtactcgtcaatggaaagagtataggcggtggtgacgacgtgaccgcacttgatgagaaggaggagcttgcctcgacgctgaagaacttgggtgggaaatggatacaggagttcaatcgtaagggaccaaacgaagcaggctga

SEQ ID NO: 8107 - DNA, 690 bp, A.fumigatus
ttaacttcgactatcgcttttctcgcctcttttctggacgtccagccaaggacgtcatggacgaggaggggatcagcatggaagaattcaagatggcattccagaaagggaacatgtttgcaagtggcattggtaagacaatgcagccgcttcctagtaatggggcttactcagtctgaccatatggaaacagctgtcgactacggtcttaccttcttcgttgcgaaggcgggagactccggcgaacaaggcgatggcacggatgttgcaagcaaagacaaaagcctccgggtagtcagcaagcagcacctgtccaccggaatctcggttggcatgagaatgccaagtttcaaggtgctcaaccaatccgatgctcggccatggcatctccaagaactgctgaagagcaatgcccgctggcgggtgatcgtttttgccggggaccttaccaaccccgagaatttcgaccgttatagccagctgggagaaaagctcagcagtccgacttcattccttcgcagatatacgccacgtgggcagccgatcgacagtgtcatcgaagtcttgactgtccatgccggaccccgcacaagcattgaacttttggacctgcccgaaatattccatccgtatcgcgagaagcaaggatgggattatcggtcttcaccacgaggctggaaggaccgcgtc

SEQ ID NO: 8108 - DNA, 204 bp, A.fumigatus
tatgcaaacttattctaccttactctcgataagatgacgaatttaaatcagcctgaggatcatgttgatgtgctcattgtcggggcggggccagctggcctcatgttggcgaactggatgagccgattaggaatcaagactcgcatcgtggacaagcgtagcaccaaggttggtccatttgatctcacatggaagacttactga

SEQ ID NO: 8109 - DNA, 1032 bp, A.fumigatus
tatctggtgcaggtgttcagtggccaagcagacggacttcaatgcaggacactggagatctttgattcctttgactttgccgacagggcctggagagaatcgaaccacatgctggaaatctgcctctggaaccccgacaaagacggcgtcattcgtcgatccgatcgcattccagatactatccctggtatcagtcgcttccagcaagtcgtgcttcatcaaggccgcattgaacggttcttccttgactccatcaaggagcacagcaatattaccgtcgaaagaggtgtgatgcccacttcttttgaattcgatgcttccaaagccgccgatgtcgatgactaccccatcactgtcaccttgcgcaccttgacagaggaagaggccaccccgaaacagcagcaggctacgaacggtgctgctgttagcgatggcctgttccgaagcaacctctccccggatgacacggacgacctgctacgagcagctgagctgaatagtcgtgcaaatcagacccaagtggtcaaggctaagttcatggttggctgtgacggtgcccactcgtgggtcagacgccaactagggtttaagctggaaggagattcgacagattacatctggggtgtgctcgatatcattcccattaccgattttccggatattcgaatgcgttgcgcgatccattccgcgagcgcggggtctgtgatggtcattcctcgcgagaacaaactcgttcggctatacattcagttacagtcaattgtcactggaggtggtaaagcagatcgttcgaagatcacaccagatatgattctcaagtccgcacaacgcattcttcatccatacaagctggattactcgtactgcgactggtggactgcatatcagatcggtcagcgggttggagacaagttttcgctagaggaacgtgtgtttctggctggcgatgcagttcatacccactcgccaaaggctggtcagggtatgaacgtaagcatgcaggacagtatgtctcatgtccgttctcagtaa

SEQ ID NO: 8110 - DNA, 303 bp, A.fumigatus
ctgactagtgaccactcagcttataacttgggctggaagttggcccatgtgatcaaaggctacagcgacagagcaatcctgaagacctaccaatccgaaaggaggcgtatcgctcaagacctaattaacttcgactatcgcttttctcgcctcttttctggacgtccagccaaggacgtcatggacgaggaggggatcagcatggaagaattcaagatggcattccagaaagggaacatgtttgcaagtggcattggtaagacaatgcagccgcttcctagtaatggggcttactcagtctga

SEQ ID NO: 8111 - DNA, 933 bp, A.fumigatus
cctcaagttttaaatcttaaactcaaacgcatacgccgacgtggtatccgtctggtaaaccgggaacgtcaccgaatcccccgaatagacatgtccataccagcccagatccttcggcccatccacctgaccataatgcacattcgacgcaacagggaagccccaggtatgcacgttcagcgtcccgctggtcggcaaccccagcgcagacagctgattcaactgcaactgccacgtccccgtggcgatgcgcacgccaaccagcacccgcgcaacccgatcgtcccccacagccgcatacgcgtcgagcttgagatccgccgacggaagcgtgcccacccggtgacccgtcatgttcagattatagtacttgtacacctggtagtcgccggtggggaagtaccccgtgcccgtggggtcgtagttgctgttgtccgcgttgggcttgctcagcaggctggcgagaaagtcatgcagcttccacccgctcagccagttgccgcgcaggccgaccgcgttgatccgctccagctggctgatccaccacgccgagccggcggggacctcctcgtcgagcacggcgtactcgttgatgttgatggggcgcccgggcagcccgtacgtcgtctgccagtagacgagccccgcctgcgcggagagcaagtcgccgccgccgccctccatgtgccaggcgtattggtcggggatgctcttgttggtcgcgacgaacgacgcccagttcttccaccagttgttgccggggaggggctcgcccgcggatgcgggtccggagagctcaacgccggcgagctcggagctaaccgcagttcagttcagtctatccattggagtgactcgtactgtggaatagacgccaggacttaccggagtcggtggaacgtgcgaccccacatctgcaggtactgcgtttga

SEQ ID NO: 8112 - DNA, 321 bp, A.fumigatus
gaacgacagacccgctttgcgtccgcgctctcaaactacaaaacctcccgccagcacggcgcgaaattcatcttcctgatccacgatctgtggggcgccgacggaacgcagaattcctctgcaccctacccgggcgacaacggcgactggaccagctgggacaactacctaacgcatcttctcggcgacatcaaggccaaccgcatgaccgacggcctgatcatcgatatctggaacgagcccgacctcagcttcttctggaatcgggatcaaacgcagtacctgcagatgtggggtcgcacgttccaccgactccggtaa

SEQ ID NO: 8113 - DNA, 819 bp, A.fumigatus
actgcggttagctccgagctcgccggcgttgagctctccggacccgcatccgcgggcgagcccctccccggcaacaactggtggaagaactgggcgtcgttcgtcgcgaccaacaagagcatccccgaccaatacgcctggcacatggagggcggcggcggcgacttgctctccgcgcaggcggggctcgtctactggcagacgacgtacgggctgcccgggcgccccatcaacatcaacgagtacgccgtgctcgacgaggaggtccccgccggctcggcgtggtggatcagccagctggagcggatcaacgcggtcggcctgcgcggcaactggctgagcgggtggaagctgcatgactttctcgccagcctgctgagcaagcccaacgcggacaacagcaactacgaccccacgggcacggggtacttccccaccggcgactaccaggtgtacaagtactataatctgaacatgacgggtcaccgggtgggcacgcttccgtcggcggatctcaagctcgacgcgtatgcggctgtgggggacgatcgggttgcgcgggtgctggttggcgtgcgcatcgccacggggacgtggcagttgcagttgaatcagctgtctgcgctggggttgccgaccagcgggacgctgaacgtgcatacctggggcttccctgttgcgtcgaatgtgcattatggtcaggtggatgggccgaaggatctgggctggtatggacatgtctattcgggggattcggtgacgttcccggtttaccagacggataccacgtcggcgtatgcgtttgagtttaagatttaa

SEQ ID NO: 8114 - DNA, 243 bp, A.fumigatus
gccgtgctctccatcagctcgagaacgctcttggcgggcatgcagcgtttatgggctttgtgggaatcgatggattccatgcgcatcgccagatatcaggttctcgccgtgtctaaggatttgacttatagtggagttttccctgcgggccattcggctgaacccaaggtaaaggcgtacggtttggagactttttatacctctcaagataggggggtgatcagacggtgggctttcaagtaa

SEQ ID NO: 8115 - DNA, 198 bp, A.fumigatus
aacaacaatagacatctatcgctaaggtcgacgtccttcgctggcctgactgagcctctgctcatgttgggcgtcttactaggccgtgctctccatcagctcgagaacgctcttggcgggcatgcagcgtttatgggctttgtgggaatcgatggattccatgcgcatcgccagatatcaggttctcgccgtgtctaa

SEQ ID NO: 8116 - DNA, 564 bp, A.fumigatus
acccggggggttgtggatgggggaattttgggcgttttctattataagggagtggttttacggggcccaccccttttcaagggcagggatatggatgcaaacttttgggaactctctagggggcggaagggccatttcctgggccagttggggggccccatattttggaaaaatttccccgttggttctgtttctaatagttcgccacgaacattttattcgccggttatccagttcccgagtttccaggtgctcgttcagggcggaacccggcgttttggcgctcgagcaggggcatcggatgtcaagactcatcctttcttccgacagacgcaatgggcgctcatccgccatatgaaaccgcccatgattccacaccagagtcgcggaacggacacggcgaatttccgtaatgtcaaggagagcgcaagtgtcgatattggcgggacctcgaagcccaagggcgtccctctaggatctggtcttgccactccccacggggaggtggctgatcccttcgaggagttcaatagtgttacgcttcatcatgatggagacttttag

SEQ ID NO: 8117 - DNA, 336 bp, A.fumigatus
gtctcgacatcaggcaggtccgaaaaccagaacatccagaatcccaatatcagctctctttatccgctaaggaacagaaccaccacaccctcgcaagttgacatgttctccttcgacgatgaccccgcctccgccgccagccgcaactgctcatcctcctccccaataacaaccgaaaaccctctcttgcgcgcgtcaaaccccctcgtctcggatctcgagcaggaagtcctggatgagtatacccggctcctggggaatgtgaacaaggtacgcaggccttccgtctacgcttacgcctcgtccccaatgcacgaatggccactagctagctag

SEQ ID NO: 8118 - DNA, 282 bp, A.fumigatus
cttgttcctcaggcgattgctctggagtacctgcgtcatggcgcaagggtagcagttaaccatctcggacgtccagatgaagagccgctgctggaggcaatgctgaaagacgttggcgagattactggaagcgaggggggacgattcatcacaatagctggagatgtctcacagcccgagacaggccgggactttgtcgcgaagacagtcgaggctttcgggcggctagacatttttgtgagcaatgctggagtgtgcaagtttgaggagttcctggagtaa

SEQ ID NO: 8119 - DNA, 561 bp, A.fumigatus
gcaatgctggagtgtgcaagtttgaggagttcctggagtaagtcaagttgctatacatgtctttgctgcaagccgtctgtacagctactgaccgttcaacctggcagggttgatcctccactcctcgggcacacggtgaacacgaatctctgtggagccttttacgccacacaagcggcagcacggcagatggccctggcccagtcaccacctggcggctccatcatcggaatcagctccatctccgcgctggttggaggtggacagcagacacactatacacctaccaaggctggagtgctcagcctgatgcaatcgactgctgtagcgctaggaaagtacgggatccgatgcaacgccttactcccgggaactatccggacccagttgaatgatgaggacatgagtgatccggtcaagaggacgtatatggaggggaggatcccactgggacggttgggtcaacctcctgatctggctggcccggctgtcttcttggcctgtgatgaattaagtggctatgtggtgagtgctgatccatatccctggctgtggctttag

SEQ ID NO: 8120 - DNA, 240 bp, A.fumigatus
tcgcagattgcatattcacatcctgatattatacgctttggctgcaacctctccccagaaccccttcttctgttcatcagtcaaccctcgtctctcaaggacattctctacaacgctcttccagcgattccaagagagttcattgccgcctccacctatattgcaaactggccagtccgatccaaacatgactcgctctggaccgaatacctcgaaaacaacatccgtccatggctgtag

SEQ ID NO: 8121 - DNA, 267 bp, A.fumigatus
ctagagtgggcaaaggttcaccttgcccctttcggagtgaagctgtacaagaattacgacgacatgctcaagcatgaaggcctacaagctgtcgttgtggcttctgccactgctgtacacgcggaacagacaatcaaagctatagaagccaacaagcatgtcctctgcgagaagccgctgtccacgagtgtcgagattgtatgttttctgtatttattgtttttttctgttttcatgctccttgttgctcctgcaacctccagctga

SEQ ID NO: 8122 - DNA, 750 bp, A.fumigatus
  unsure (186): Identity of nucleotide sequences at the above locations are unknown.
cgctgccagtcgcaaacggtcctcgatgcagccacccgaaagcctgagctcaaggtgatgtgcggattctcccggcgattcgacgcttcataccgcgacgcgcacaagaagatgacccagggctccatcggctcgccgtccgtgatgcgcagccagacctgcgacaagctcgaccccaccggtttnttcgttgcctacgcagagttctccggcggcatcttcgtcgactgctcaatccacgatatcgacctagcgctctggttctttggccaggacagcaaggtcaggtcagtctccgccgtgggcatcacggcggtcgagccggacctccgcaaacacaacgaccgcgataacgcggtgggtctggtcgagttctacgacggcaagattgcgtacttctacgcctcgcgcatgatggcggcgggtcaggaagataccaccgagatcatcggcacccagggcaagcttaccatcaatgctcagccggccatgaaccatgtcaacatcttcgacagcaccggcgtgcgtcgcgagatcccgcagaactactacgatcgttttgagcacgctttcgtcgcggaggctaatgagttcacggccgcatgcctggataacaaggacgtccctgtgaagctcgagggtgctgtccaggctgttcggataggatgtgtcctccaagaatctctgatcactggccaaaagatcttctttgatgaggctggcaaccgtatcgataagccgaggctttaa

SEQ ID NO: 8123 - DNA, 267 bp, A.fumigatus
caaccaattcgattcgacaagtatgacattaaccagcgattcgagtacgttttcagcgaagaagtgaatgatttcgatgctgatgactatcgaagaatcaaggtaactcactctacagggcacatcgtgcccattctccacttcacagcaagcaacgggttgctcatcctcagcgttgataagagtgaattacttgtcaatctccccaacatgaagcttctcaactatctgtcgataccaactgtctcgcagatacagaaggtatga

SEQ ID NO: 8124 - DNA, 414 bp, A.fumigatus
cacagtttgtacgacagggatgttcttcgtcgacactggactacgtgcgctaagcggttgcagtcagggcaggagattcccaaggcggaatctggaggtaaacataggcacgcctgcgatgtttgtgcccgcctgaaaaaggcgtgtaatggcctgcagccgtgtgctgagtgcgagtcacgcgggaaactgtgctcttatgaacgtttaactggaggtcaaccgccccggggcaaacgaagggagttgatgtctgtttattcagagcagcaggactgggagacgaaagatttcgggtatcagactctacttccgtcaaaagccagtatgcttgaagtccagagccagtgcaggagtattacctggggtatcaatcgggggcccatagcaaccaattcgattcgacaagtatga

SEQ ID NO: 8125 - DNA, 816 bp, A.fumigatus
  unsure (665),(788): Identity of nucleotide sequences at the above locations are unknown.
cctgacgcaatgcatctcctccgggttgttctgccgcttctgtccctttcacccgctggcctggcagctccggcctcgccagctgcgcctaccgtcacgatcgcatctcccgctgccaccattgttgggtcgtccgggaaggtagagaagttcaacgccatccccttcgcccagccacccacgggccccctgcgtctgaagcctccccagccaatacagaagcccctgggcactattgacggcacgggtagcgccaagtcgtgtcctcagttctttttttcgacggacaacagcgagtttccggggtccgtcgccggtctcttggccaaccttcccctcttccagaccgtgacaaatgctggagaggattgcctgaccctgaatgtggcgcgtccgtccggcacagctccaggcgcgaagctgcccgtcctcgtgtggatctacggcggcggcttcgagctgggcgccacggccacgtacgatgcgacctcgctagtggcaagctcgatcgacctgggtatgccaattgtctttgtcgcgatgaactatcgaacggggggatttggcttcctgccggggaaggagatcctggcggatggggcggccaacctggggctcttggaccaacgcctggccctgcagtgggtggcggacaacattgcggnctttggcggcgacccagacaaggtcaccatctggggtgagtccgcgggatccatctcggtcttcgatcacatgatcctgtatgatggcgacaatacctacaaaggggaagcccgtgttccggngcggcatcatgaacctcgggtagcgtga

SEQ ID NO: 8126 - DNA, 456 bp, A.fumigatus
  unsure (24): Identity of nucleotide sequences at the above locations are unknown.
ccttgtctgggtcgccgccaaagnccgcaatgttgtccgccacccactgcagggccaggcgttggtccaagagccccaggttggccgccccatccgccaggatctccttccccggcaggaagccaaatccccccgttcgatagttcatcgcgacaaagacaattggcatacccaggtcgatcgagcttgccactagcgaggtcgcatcgtacgtggccgtggcgcccagctcgaagccgccgccgtagatccacacgaggacgggcagcttcgcgcctggagctgtgccggacggacgcgccacattcagggtcaggcaatcctctccagcatttgtcacggtctggaagaggggaaggttggccaagagaccggcgacggaccccggaaactcgctgttgtccgtcgaaaaaaagaactgaggacacgacttggcgctacccgtgccgtcaatag

SEQ ID NO: 8127 - DNA, 219 bp, A.fumigatus
agcgatatcatcaattctcataatcatcttgactgtctcagctgcaagttcgatggcgctggtgctcaccaaaagtggctgcaggatgttctcctctgtgatgtcgtcgcgcacaccgccgctacggatactgacaccagcattgtgctggccttgagcgtggcggtgtcgcagctcggtgacaaccttgatcgaattcagaccagcgtactcggctaa

SEQ ID NO: 8128 - DNA, 669 bp, A.fumigatus
cagcttggcaacatgaaaggccaatctataaccgctttcataaagggtctgaaggtcatcctcgcccaaatggaggctcttccccagagttcctgccagaagaaggcaattaaacgagctgtcactcccctaccaaccatcgatatcgacctgggagacgatgagctcttcccatgcgagtgctctctacagggtataaactccctggatgtcacctacctcagcaatccactacgcagctcgctcaagaccaaggagtgcggcctggactatatcaggcgcgctcttgatgtcctagagcccatgagcacctgcacacggtgcactggaaaggaccacgtccgaaccttcctctatcgtttctgccgaacgatcttgcagagatgccgggtgttttatcagcatctggtacgcacgtacgagggcaaggaccaacaaccccttttgctggacgactaccagcttgcgacagtcgaggaacgggctgcgctgctttgcatgctcacctatgtcgagataaagcgattccacgtctgtgtgggtagcattattgagacactcggggaccagcccatgttcgatgaggattcgtgggccgtcatcaagggtcaggcctataagttggccgttgatacggctgagctacgtttcaaatccatacactgctaa

SEQ ID NO: 8129 - DNA, 309 bp, A.fumigatus
ggcgcgcgagagctcgcaggcacagaggctatatgctggaaggcgtttgcggatgccatggaggttattccaaccacgttagccgagtacgctggtctgaattcgatcaaggttgtcaccgagctgcgacaccgccacgctcaaggccagcacaatgctggtgtcagtatccgtagcggcggtgtgcgcgacgacatcacagaggagaacatcctgcagccacttttggtgagcaccagcgccatcgaacttgcagctgagacagtcaagatgattatgagaattgatgatatcgctctatcgagatga

SEQ ID NO: 8130 - DNA, 339 bp, A.fumigatus
cagtcgaaattgtcccagcgacggaacaatatgcggcgcaactatttgcctattgagactctgtcatcctgggcaaagctcaatggcatctccctcgagggaatcgctttccagaagctctatagcgaacacgggactgacaagggctccgcgatcgtagcgacagcggagaaaaaggacgaagaaggtgaagcaaacactcttctcacggttccatccgacctggcactgaccctcgagtacgttcacaaccatgcaaaaatcgatcgccatcttcgggaggtcctagatgctgttggcgactttggcagggtatgttacaggtcacgatcactatag

SEQ ID NO: 8131 - DNA, 540 bp, A.fumigatus
tatgtacagacagcgagaggcgcaattttaatctttttaattattcaaatcacgcatgcaagtccggaattcgtcaacaaacgccagaagatcgggatctcgaacccttggacagagtacatcaggtttatgccggcctctgtacttctaccgacattctactcagcagaagagcgcgagctgttacgcgggacatcgttacagacggcagtcgacgcgaaacttggttctcttgaaaaagaattcgaccacctccgccaagctacggaggaaataccctggtgtcaggagcattggtgggatgaggatacagggaaattcacattcgacgattggaagtatgtcgacgctgtgtatcggtcacgagtggtcgatcttcccaggagtggacatgcaattgtgccatgtgtagatatggcaaaccatgcttgtgaggactcggtgaaagccaggtacgatgaggagggagcaggaaacgctgtactccagcttcgaactgggaagaagctacgtgttggcgaggaggttactatatcgtaa

SEQ ID NO: 8132 - DNA, 240 bp, A.fumigatus
ttcattagctgtgtcaaaagtccaaccggaagtccagtccctaaaagatatctagtgatagtaatgattgatttcgaggatatctccactactcttcccatccccaactcacactacctccaatgggggactcataatatccagtcagttacggaaaagcacgaaccagctatactcgactcctcactaacatatattgagtcattcattggtggggtacgagtcacgactctggggtag

SEQ ID NO: 8133 - DNA, 396 bp, A.fumigatus
cccccacgcgacacgccgctaaccgaggagatacaatatacagttcctggaaccacactactgcagggccttttgtcgttgttgtccacatacattcgggacacgcatggcaacatggatctggccaatctgtcacagcttcagaccgaagccgtcaatccccggacggcgcagatcgatcagatctcgaccctggagatgtgccgattgatcaacgaagaggatcattgcgtcgcccctagtctcacaccatgcatccgccagattgccgccgccattgatgcgctcactccacgcgtgcgaaacggcggacgagtcatctacgtcggtgcagggacaagtggaaggtcaggattcctgtccaacacgtatctcgccgaaaggatgcgtaactga

SEQ ID NO: 8134 - DNA, 519 bp, A.fumigatus
accttcgacgcctgtggtgaagaccatcctgggtctgcctcacttcctcgtgaacctcgctggtcaacgtcacagccaacacagacggtatggcgactaccagcgcccccatacagagcccccagtccatcgcaaactgcgtcatggccggcttggccagcgcattcaagcgccacgccatcgcgcccccagtcgcctggaacgtcttgtacgcgccgacaaggatggccgccacggcgggggaattcgatcgcgcgcccatcaaccagtagcaaaatccctgccaaaaggcgtcgtaggccccatagaagatatacaggaaaatcggaccggtggacagcccgctctgcgtgtagtcgatgtcctgtttatgcccctgggccatgcgccgatcataccatttctggaacgcataccccccgccccagatggccatgccggtcgcgaagaggaacagccagcccacccgtgcgcggttctggcggttcacccgcggcatatcgaggatcaggccgatga

SEQ ID NO: 8135 - DNA, 420 bp, A.fumigatus
tcaacgaagaggatcattgcgtcgcccctagtctcacaccatgcatccgccagattgccgccgccattgatgcgctcactccacgcgtgcgaaacggcggacgagtcatctacgtcggtgcagggacaagtggaaggtcaggattcctgtccaacacgtatctcgccgaaaggatgcgtaactgatctagacgacagactcgggatcctcgatgcatccgagatccctccgacctttgctgctccgccatctcaatttgtcgggctgattgcgggcggtgatgcgctattcgacgagcacaagaaagggccgaagacagtgttccctcggggcaagccccatattgccacctttgaagctcaatcccccactggaaagcgtcctccggtatcccctgcatctgggcgttaccccctaatt

SEQ ID NO: 8136 - DNA, 237 bp, A.fumigatus
gagtgccaatccgggtcgtatagaacgtgcctgtggagaatgcagatatcctatccgaccagtagcgggctggagtcgtatagcgatctaccacaggatatctcttatgcgttagccatgtatgttatctacgaactgaccaagcatcgccgaagggatcgcctacccattggcctgctaactccgcattttggtcgcaagggacaaggccaccccggccttatcatggcgagataa

SEQ ID NO: 8137 - DNA, 1470 bp, A.fumigatus
tgccgccgtggagtcgggcggagtctcccaacagcggtcactgccatatcggatctacacacactcatggttccagatcttgctgatcagcttcatctgtttctgttgccccggggtatggtttccttcaactgcttcagtccgtcactaacgttggttgcagatgtacaatgctctctccggcttgggaggctccggacaggtcgacccgacagttgctgccaacgcgacagtagccctgctcgcggcaacagctgctacggctttgttcatcgtcggaccaatcttcgaccgtgtcggacctcgagtgtgcttgctgatcggcggatggacctactccttatactcgggaagtctattatgcttcaaccgtatgaacccgttccccctgcaatgaccaatactgactctgtagacaccgccaacggcgcgttcgtcatcgccgccggtgccattctcggggtcggagcgtccttcctgtgggtggcgcaaggagccatcatgacgacgtacgtgccggaatcccaaaaaggccgagccatcgccgccttctggatcatcttcaacctcggcggcggggtgggctcgctcgccagctttggtctcaattaccactcgcacagcgggaccgtcacagacggcacctacatcgccctgctgatcatcatggccatcggctggctgctcgggtccctgatctgtccgcccgcgtccgtccgcgtgcaaaggctgcagcccacggccgagacggagaagaactggcggcgaacggcccagttgacggcccagaccatgaacgactggcgggtcctctgcatgatccccatgtttttctgcgcgaacgtcttctactcttaccagcagaacatcgtcaacgggatgacgttcaacatccgcacgcggtcgctgaacgggtccctgtactggatcgcgcagatgctgggcggtctcgtcatcggcctgatcctcgatatgccgcgggtgaaccgccagaaccgcgcacgggtgggctggctgttcctcttcgcgaccggcatggccatctggggcggggggtatgcgttccagaaatggtatgatcggcgcatggcccaggggcataaacaggacatcgactacacgcagagcgggctgtccaccggtccgattttcctgtatatcttctatggggcctacgacgccttttggcagggattttgctactggttgatgggcgcgcgatcgaattcccccgccgtggcggccatccttgtcggcgcgtacaagacgttccaggcgactgggggcgcgatggcgtggcgcttgaatgcgctggccaagccggccatgacgcagtttgcgatggactgggggctctgtatgggggcgctggtagtcgccataccgtctgtgttggctgtgacgttgaccagcgaggttcacgaggaagtgaggcagacccaggatggtcttcaccacaggcgtcgaagg

SEQ ID NO: 8138 - DNA, 246 bp, A.fumigatus
cgttggttgcagatgtacaatgctctctccggcttgggaggctccggacaggtcgacccgacagttgctgccaacgcgacagtagccctgctcgcggcaacagctgctacggctttgttcatcgtcggaccaatcttcgaccgtgtcggacctcgagtgtgcttgctgatcggcggatggacctactccttatactcgggaagtctattatgcttcaaccgtatgaacccgttccccctgcaatga

SEQ ID NO: 8139 - DNA, 612 bp, A.fumigatus
  unsure (4),(15): Identity of nucleotide sequences at the above locations are unknown.
cgcnctgtcgttctncagacaaagtctggccagcggtcattggtgggcttcggtgtcctgatctatcagatgctcttgcaacagtcgcctttccgtggtgaagatgaagatgaaatctatgatgcaattcttgccgatgagcctctctatccaatccacatgcctcgggactcagtttctattctacagaaattgctcacccgtgaacctgagctgagattgggatccgggcccacagacgctcaagaagtcatgtcccatgccttcttccggaacatcaattgggacgatatctaccacaagcgtgttcctccgcctttcttgccgacgatcagcagccccactgatacaagcaacttcgatcaggaattcacgagtgtgacccccgtactcacacccgtgcagtcaggtaagttatcacccgttggtattggtggtttcaaggctaacgatgtcatttctagttctctcccaagcgatgcaggaggaattccgcggcttctcgtacaccgcggacttcgcctaggttactcggtgttgattgagaattatcgtgacattgccttcgttgctcattcgcccaaccaggtccttggaacctttgctttttga

SEQ ID NO: 8140 - DNA, 369 bp, A.fumigatus
caacttggggtcttgtgtcctcgtcgagggcgagtggaagatggtcataatgtgttggtttccaccactctcgccgtcgagtcactcttcccttgcaaggaccggtatctccccgactattcagaatcttccctatcctctcgccttgaggctatcagtgcttatgatgcggatacaacattgattcctcagcagacaagccattacgaatacggagctgagtctattgcaccttggagtgaaaccaatgtgagcaacaccctaccacagacacacacgacgacaacaggagatacagttactaaaccagcaaagcaagccaggaagatggcagaatacactgcaggagccagaattcgaaggaaaaga

SEQ ID NO: 8141 - DNA, 327 bp, A.fumigatus
ttgtcacccgaccagaaattgcgcatctttcacaagtcaaaaatcttgcctctcgaatcgcaggattctaccttactagtaagtactgttggacgattcacggctgctaatctcggcaatctacagatcgaattcccctccgtccttctcccgaacagcatcacatctggcagcattgtcgatatcacagtatcgcgcaaccatgccgctgaagctgctagcacttcagccttccaggcgctacagaagcggattctcaacacctaccgcgtgaagaccctgcccctcctgtcctccggctccgcaacgcaacaaaaaacctcctag

SEQ ID NO: 8142 - DNA, 201 bp, A.fumigatus
gactgccttagggttatagcgcatgtagaattgacttgtgcttttgacaagcttcctttgtacagtttgtccggtcatcatgcgaaggtgaaggtccggttctggggtttgcctcggtcatcagggcacaggctgttggcacatcaatatagcgttgaggctaagtcacagaagacagcaaatacaaatggtgagaggtga

SEQ ID NO: 8143 - DNA, 228 bp, A.fumigatus
  unsure (9): Identity of nucleotide sequences at the above locations are unknown.
aaatgctcngcaacggccgaatggaagccatgttcttcgaccgcgaaaaacgaacgggacccatccgaaggcaacctgaggaaaaaggtccggatcaaccagggcgaaatctcccccctctccctgggtgactaccagaaacaaaaggggcaacttactcctaaattaccctgccaaccaagccaaaaattcccagggccaacggcaaatgcccgaaccaccccataa

SEQ ID NO: 8144 - DNA, 468 bp, A.fumigatus
  unsure (280),(318),(346): Identity of nucleotide sequences at the above locations are unknown.
cgagtcgccagcatgcccaagaataagggaaaggtaagctgtcgctattactctgtttccctcccagagagtaccccgcttgcgaaagtttttcactgccatttcgtcgtatcagcctgtttggctgcgctgcacgaacgcggccatcacggtatagaaaatgacagaaaaatcttggattttgatattgccacggatttcttgatattttcctattggatgctaacgttcgtcttacaaggtggtaagaacaggcgtcgtggaaagaacgagaacgacnacgagaagcgtgagctcgtcttccaagaaaaaagccangagtatgcccaggtcctgaaaatgctcngcaacggccgaatggaagccatgttcttcgaccgcgaaaaacgaacgggacccatccgaaggcaacctgaggaaaaaggtccggatcaaccagggcgaaatctcccccctctccctgggtga

SEQ ID NO: 8145 - DNA, 282 bp, A.fumigatus
tatcctagggcggagaatgggaatcttgatcggttgcctcatcatgtacgcgatcgaagtagttgtcttggggtacatcgtcctgaccgtattaggatcctgggtgtcgttctccagagtattagtgccaactatggcatgttcctggctgcgcggtttttgatcggattcggagtagccatcgctcatggagcttctcctttgctgattacggaactggtgcacacccagcatcgcgccatctttactaccatctacaacagtaaggacaggttgccgtga

SEQ ID NO: 8146 - DNA, 825 bp, A.fumigatus
cctgcgatagctacatggtaccttggcgcgatcgtcgccgcctggctgactttcggcaccaacaacatcgatagtaactggtcctggagagccccgactgttgtccaggctgccccgtcgatcctccagatcgtcttcgtctggttcgtgcccgagtcaccccgcttcctgatctacaagggtaaggatgagcaggcactgaaggtgctggccgactgtcacgcaaatggaaatcaacaggacgaggttgttcaactggaaatgcaagagatcaaggagactattcgccttgagaaggaatttgagagcagcagctggatggagctggtccgcaccaagggcaaccggcaccgtcttatcatctgcattactgcaggattcttctcgcagtggtctggcaacggtctggtgtcttattatattgccaaaatcttgacctcgatcggatataccagctccgtgcagcagaacctgatcaatggctgtctccagatcttgaatatgattgtggcgctgacgatgtgtttctttgtggacaagattggacggcgcaagcttttcctggtctcgacggcgggcatgttggtggcgttcgtagtctggacgatctgctcggcgcggtatgccatcgcagggaatcacaatgcggccaatgccgtgattgcgatgatttacctgtactatgtgttctataatatcgcatggtcgggtcttctggtagggtacacggtggagattcttccttacagtatccgggctaagggaatgacggtgatgtggctctgcattgatcttgcttgtaagtggttccgacgtcgtgtatga

SEQ ID NO: 8147 - DNA, 210 bp, A.fumigatus
cggtctgcagtgttcttcaaccaatacattaaccccattgcgctggagaacctcgggtggaagtactatatcttctactgcgtgtggctgggcgtggagttgacggtagtttggtttttctacatcgagacgcgcaacacgccgttggaggagattgcgaagtcacttcggtcttcactcacgggagctggcaggccccgcgcttatgta

SEQ ID NO: 8148 - DNA, 282 bp, A.fumigatus
  unsure (117),(190),(254),(259): Identity of nucleotide sequences at the above locations are unknown.
acgagtcctcgctctggtagcctcgggttaccgcaccgaagcggtgacaatcataggccagcaggtcatggcgccgcggggcctgatcggactcggccaggacacgctggacagcancacggcggaggtgcgcgagatcttcgagctactcgtgttcccggcggcgtacccggtcctcgtgcactgcacncagggcaaggaccgcaccggtctgattgtgcttctgcttgctgctcctactgccggaagtgtcngccgnatgccatcgccgcggaactacgt

SEQ ID NO: 8149 - DNA, 570 bp, A.fumigatus
  unsure (407),(480),(544),(549): Identity of nucleotide sequences at the above locations are unknown.
atgcataccgatactgacgttgacaggaccgaacaccaaatggccactcgcaaatgtcgcggcgaggatgctctcgacccagaacaaccatctctacctccttcagaggcaaacgagcatctcgtggagatccccggtgtgcagcgctccctgatcagtctaacgggcagagcattcgaacgcgccctactatggcgcttggactggtataacctcatgtatgctccccccacccgcccccccacctctagccacctggtggaacaatgtacagctattgatgtctatagacgagtcctcgctctggtagcctcgggttaccgcaccgaagcggtgacaatcataggccagcaggtcatggcgccgcggggcctgatcggactcggccaggacacgctggacagcancacggcggaggtgcgcgagatcttcgagctactcgtgttcccggcggcgtacccggtcctcgtgcactgcacncagggcaaggaccgcaccggtctgattgtgcttctgcttgctgctcctactgccggaagtgtcngccgnatgccatcgccgcggaactac

SEQ ID NO: 8150 - DNA, 183 bp, A.fumigatus
tacaagatggaaatattgaagctggcatttgccagccctgagatcaaccctgtcaaccacaaagcacggtcgattcccgtgctgaatcccgttgatcgctatgggcgcgtcttcttcttctcctggtttggattcatggtggcattcctctcctggtatgcctttcctccactggtaagttag

SEQ ID NO: 8151 - DNA, 186 bp, A.fumigatus
cggatgggcaagatggccgacttaatcgactgccccatggtcaattcacaatcccccggtgaattcccggcccttaccaactttgggtgggtaagccctgcccaggccatttggacccggtccgggtccccacccggtgataatggcctcaaatatgctcaatccttgacattcacatcgggatag

SEQ ID NO: 8152 - DNA, 228 bp, A.fumigatus
  unsure (200): Identity of nucleotide sequences at the above locations are unknown.
agcgaccatgcagttatcttggcttgctctctgatgttctttgctcgacaggcgtttgcacaggcaatcaagacctcgtatccgaatcatttgcggctttccattcacgagtcagtggccggcaccaagctatcgatctccctgctgaacaccaagactggcttcaccactccatggcactgcagcgtcgctcggccgtnttcaccacggtgtcaagggccgcgatag

SEQ ID NO: 8153 - DNA, 411 bp, A.fumigatus
agattcagatcgcaattggaggccccatcacagtgcagtaccatgcatcactccgacagaatgtttcacaaggaagcagggatctctcatctcatcctggatatcatcctcgagcatgcgctcaacaagtttgaccctgcaccggaccgattgcagggagctgcgaagaacttcctgccgattattgaacgattcgtcgctgcaggcacgcggatagaggcttgtctccccgcattcccgttcaagtcggcgaacaaagtatacaaggtgctcggtagcctgccggataaagctgaagagctggctcttgaccgtctgaataccatgtgcgcgcgtgttcgcgaagtatacccgcctggccttcaagtggcgattatctcggacggcatcacatacaatggtaggttctga

SEQ ID NO: 8154 - DNA, 477 bp, A.fumigatus
ctcggttcgatcaggatcatagctaaccagtcgagccgtgcgcccttagacttgctctgcatctccgatcaagacacgtgggcgtacggagaggctctacgccagatggccgctcagaagcagttcatgtacattgtcttctccagaatcaaagacctgctcgatatccccctgccagaacagatgagtgaaatcgtctacgtcgctaactgtaccactttccgccgattgctcctcaacaagtacgagagagccgaccttgacatcgaccacgagattgcctcgaatcctgataccaagctgacctacctcgggtacaggaggttcctggagtctgatctcaagtatatcttccctcgaggggcgcatcggtctgcccacagctacaagcgagattgcaagtatcttgccaaacagatgctgatacgaggtgatgtgggtgaagcgaccatgcagttatcttggcttgctctctga

SEQ ID NO: 8155 - DNA, 834 bp, A.fumigatus
gctcaaacagttgcggccattaggtattacctcgtctgggatcaatgccctcgtctaatgagtaaagggaaactcgagcaggtctcggctgcttgtcaccatctcggattcttcaacaatgccggcctctcagcccactacaagctgtccgagtcctcgtctccagctgtagccgacctgcgtggtctcgtctacgctgcggcgggagatctgctccgtaagcatcgcatattattcgccattcccgtgaatgaaggcactccgaatcctcacttcgcctgtctaccttggatcgatctccgtcggagcattgcctttctcgaacgatctgtaccgttagccagtgcggccgaagagcaagacaaagagctggacgcaatcctcgaggagcagcacaacatcgacttccagactgactacggcactttgccgttttggcgcctgattatcctacgatccaagggaagaaacgatttcacagcctccttcatctaccaccatgccattggcgatggggtctcgggtctcgctttccacaaggcgttctgtaacgctctggaagctgcctcttcctctactttgcctcccgacagggctgagaacatcatccggccggatgagaacacagtggttcttcctcctctggaagaattgcatcccatgccaatcagcccgcgccagcctcccctcccaacagcaagccccaaagagtggacgggtgcctccatccacctcccgtgcaagtcccgctgggcgtctttgtacatctcgccgagcgcctccaacgccttcgtccaggagtgcaaagagatgaaactctctgtcacctctgct

SEQ ID NO: 8156 - DNA, 1815 bp, A.fumigatus
aagtggaaaacccaggaagtgttgcaggatcctggtgcagaatggttattaggaaaagaagaacttcgcgcatttcgcgctaaggcggttatttgggagagagatccacatattagtcgacatagggacaacgcatcttggagaccggcaccccaatttgccactccggtggtaaacggtgatagagctgcgggcgtgaacactgcaagccaaggcactgattacgacgggtcggaagagtcgtttcagcaggcacaaacggaacccgcatcccagatttcggccattgaaaatcttgttgccaatgacatgtgcttacccagccccagcttgtcgcctgtggctgccctgaatgcaatgaatgtggattcctcttttgagtcggcagaagaccaagagatggatacggactcaagcctcgataataatgcctctcgactttcaaacgtacggcacttggacgattcaaagacccataatctgtctccttccagatctggaaatctgccgggcgcttcagaaatccggcatgcttcgtctttgatggatatacccagtgtactggacttttttgactcggttccagaagaactgaaaacttacctgatgtatcagtttttgaggaggtgccccaagccaacgctgcattttgtggccgacgtcgtcaatccagctttgaagtgcgatttccttgcgcttcttcctctggagcttagtctcaacattgtcaagtatttcgacgttcaaaccatgtgtcgtgcagcacaagtgtccaagaaatggaggcatatcattaattccgatgagaagacttggaaagatctatttgacagggatggatacgttctcacagatggtgaattggaacgtgcaattaaagaaggttggggatggcagtttccacatggggatgacgactgggaaaaagacctgagttcgtctgcagtcataaaacctgaaccagattgtgctccgggacccgctttctcttccttgccaggagaatctggtgaacgggctctgtctgtaagtcgtcgaccgaaaaggaaggccactcgcatctcgggtcgcaaatttgcgaagagaaaaatttcctctagtaatacggattcatcagattcctcaggttggagaaacggagtaactgcaactgagggaccatatgcagccgcgaatgctgcagctgcagctgtcccatacccagaaattggcctaccgtctctcaggggtcttcatttgttcaagtccctctaccagcgccaccattcgattcataaaggctggatgaaaccgaatgtgaaaccgaaacacattgcctttcgcgctcatgatcgccacgtagttacttgcctccagtttgacaccgacaaggttttgacaggaagtgacgacacaaacatcaacgtctacgatacgaagacgggcgccttgagagcgactctggaaggccatgaggggggggtttgggccctggaatatcacggcaacactcttgtgtctggatccacagacaggtcggtgagagtttgggatatcgagagggcaagatgcactcaaatttttcatggacatacctcgacagtccgttgtctgcaaattgttctgccagtccaagttggtaccagtgctgacggcacacccgaaatgatgcctaaagaaccaatcatcataactggttcccgcgactctagtttgcgagtttggaaactcccgaaaccaggtgatccggtgtactaccagagtggaccccatgccgatgatactgattgcccttatttcatccgtgttcttactggtcatcagcactctgtcttc

SEQ ID NO: 8157 - DNA, 819 bp, A.fumigatus
atactgtgcttatccacccactctcctggtttacgtccatggcagacaaccatgtccaaaatggcagaattagaaatcatagattcaaagggacttcctcttatcaaaggcgattactgtcccgcaggacccggccacctacgagccccatgccccgttctcaactcgcttgcaaaccacgggatcattgcacgtagcggccgcaacatcaccgccgccgagttaaaagcggcgctccgctacctgggcatgggcatcgatgtcatcacaatcctcgtcaacggggcgttcaaagttcactctgacgacccgaagaaaggtgccctgctcggactacgagataaagaccagacgaacgaagacggtgtacccgtgctgaacctcgaccaggtgggccgacctcacgccgtggagcacgatgtctctgtaacccgacaggaccgcgccctgggcgactgcatgcgtgtgaatgccgaccttctggagcgattcctcgcggctccaaaaacagagaggggtttcagcgcgtcggctttcggtaagtatcgcaagactcggtacaacgagcaaaagagagacaatccggctttggagttcgataggttcaatcacttcagtggatgcgcggagctgggagcggttcagtgtatatttggtcgggggttcccgtatcgtgtgccagaggaatatatacgagtgttgtttggtgaggagcgtctacccatcgaggagggatggaagccaagacgattaccgctgttgttgcccgagcttgcgccggtgattctgaggatttcacattttgcgtcgcctttttga

SEQ ID NO: 8158 - DNA, 564 bp, A.fumigatus
tctctgcgagacgcccgctgtcctcccacagttcctgccacaatgtttactcctgtgcttcggcggttggcttcgatgaagtcccgcattccgctaataagcgggcttcatctcaactttatctcagtgcattacatctacatcatcgccatgacactgatcacttccattattctttatccgggaggtgaccttgcctatattgacatcctcttcttctgttccggcgcggcaactcaaagcggtctcaatacggtagatttcaacaagttaaaaacgtaccagcaggtgatcctctacttcagctccatgctcacgacgcccgatttttatccactccgtcctcgtcttcatccggctgtattggttcgagaaacggtttcaacacatcgtgcaggaaacttgagcgatgcgctctaccagggacgagaaatgccaaccttgagatctgaaaaggaacccactttcttttggaaagggagggaagcttgcattggtctttcccccaaatgtggggctggcccaaccaatccccaggaattcaatgaaaaaggtcccaaggcc

SEQ ID NO: 8159 - DNA, 654 bp, A.fumigatus
  unsure (278): Identity of nucleotide sequences at the above locations are unknown.
caatggagctcgctcgcgcagtttacagcctgtcctcccaaaacacttaatggtcgcatcaccttaaacttttatttttccagagatcaaatggttctatatcaactaggagactgctacaatgtagataactatgtaagtgtgcattacgttcagacattgcgaaatatcacccgttttagatgctcgctctctccatcctcttccaccattcgccggaataccccgttctttagctgcatgagagcccgtggagaagcgaattctaccactttacntgcgtcgagcaccagaatccgatcaaagtcagcgacggtactgatacgatgcgcaatcacaagcatcgttgttgacccttgcccaaagccggagcggatagacttctggatcaccttgtcagtagcagtatctacggccgatgtggcttcatccagcacaaggatcttgggtgcagtaagcatggcacgagctaggcagagcagttgccgctggccctgcgaaaggttcgatcctccctcggcgacacgagtgtcgaggggagacatgtgtgtcttttcttgcaaagattccggagatgatgactgccagctgggcgctttagccgctgtttctctctccgtcgaggacgtgctaccatattgtgctaaccattga

SEQ ID NO: 8160 - DNA, 1254 bp, A.fumigatus
  unsure (1),(1129): Identity of nucleotide sequences at the above locations are unknown.
nacaagctgctttcttcgtcacttagcgggctctggacgatccgttcctatcaaagggttgattcattcatcaatagaatgcatggactgatcgatcgacatgctcgtgtctattggaatctttgcctcttgaatcattggctgaatctccgtgtcagcatgagcggtgctctgtttacgactgcagcggctatgacgttcactctcctgcaagatctgaaagcgtcatcaaccggtttcgcgatcagttttatcattcagctgagcgcagcgcttgccatggcgatcagaatgtatgtcatgttcgacttggacatgaattgcgtggaaagagtgttggagtactctgagatcaagacagaacgatacgatggccaagatgccccggctgcatggccgtccaaaggccgtttgcaagtcgaaaatctatcggtggcctacgcgcctaaccacccattggttctccgcggtgtaagctttgcagccgagcctaatgaacgaatcgggatagtaggtcgcaccggagcgggcaagtcgtcgctggcgttggctctatttcggtttctcgaagctcaggaagggcgcattctcatcgatgacgtcgacatcagccagatcaagctccatcatctgcgtcctcgaatgggtattatcccgcaagatccgacactgtttgccggcacgatccggtccaacctcgatcctttccacgagcatgatgacagcgatttgcttgctgttttggatcgcgttcaatggttagcacaatatggtagcacgtcctcgacggagagagaaacagcggctaaagcgcccagctggcagtcatcatctccggaatctttgcaagaaaagacacacatgtctcccctcgacactcgtgtcgccgagggaggatcgaacctttcgcagggccagcggcaactgctctgcctagctcgtgccatgcttactgcacccaagatccttgtgctggatgaagccacatcggccgtagatactgctactgacaaggtgatccagaagtctatccgctccggctttgggcaagggtcaacaacgatgcttgtgattgcgcatcgtatcagtaccgtcgctgactttgatcggattctggtgctcgacgcangtaaagtggtagaattcgcttctccacgggctctcatgcagctaaagaacggggtattccggcgaatggtggaagaggatggagagagcgagcatctaaaacgggtgatatttcgcaatgtctga

SEQ ID NO: 8161 - DNA, 465 bp, A.fumigatus
ggtgatgcgaccattaagtgttttgggaggacaggctgtaaactgcgcgagcgagctccattgtcattgaatcttctccgcagtgagtccgcagtccgcacctgttttcgctttacaatcatctcacaaagaaccaccaccacaaagaccaagcacagcatggcacccccagctgtaaccgcattgcagcatctctccaatgccctcgcaactcccgagcaattatctagctcctcgtcgtccattgatggcgtcactcccgacctagaggcatctctccgatttgcgggcgcgcagcttacccacgcagctggcatcctgctacgtctgtcgcaggacatcattgcgcaggccatcgtgacttatactcgcttttggatcggccctgaagggggaagcatgcgtatttattcagtgaaggtttgtccgctaaggttcaattgctgtatcctcgtagctaactag

SEQ ID NO: 8162 - DNA, 759 bp, A.fumigatus
ctggcgattctcatttaccttccccttcgttctctatcatcaaaacctttggtagaaaatatatccattatggatatcaactcacttctttcgccagactcgaatcctcaatctgggcgttccacccctggaaacggatcgatgtctgccaacaatgctcctgccgcgacctcacgtccatcgaacaagccgctacggaaaggtcgcacaactcctgcacggccaaccatgacttcatctcctcttgcgcatcacgtatatgccccttcgcacttaaacgacccttctccgccggcgacgagtagtccaagtgtgggtccgaacataggaggaggaaatggcacgcctccatctgttgatctgcctccatcccgacaagcatccacgcctgggatggataccctcgcagatttggcgtcaatgcaacatcatcagccccagcgttccaatacctccattctgcgcggcacagagtcctatgagagccaactatcgccatccaccatgtaccctcatgttaacccgatctctcataatacgcctactcccaggacttcgtttgacatcgcaatgtcggagggcccgagggaaggcgctgctcggaggaactatgcggacacttctttgcggcccgatgctcaaaggatggcgacggagctcttcgctcagattcaagacaatccgcatatctacgaggcgcacgtgaattttatccgtctgctccacgagggctttgtcaaccatgtctacccgcccaat

SEQ ID NO: 8163 - DNA, 288 bp, A.fumigatus
aagaaagataaagcacggataacggccctcttttgttgcaatgcagatggctctgagaagctattaccatggtttattgatacagcgaagaatcctcgagctttccaagctgctggtgttaatatacggaatctgaatcttatctggcggagtaaccagaaagcctggattacaacattaatatttacagactttcttcgttggtttgataagcagatgagtggacggaatgttgtccttcttatagataacttctctgctcatcaagctactgtaacagagatttaa

SEQ ID NO: 8164 - DNA, 681 bp, A.fumigatus
tctagtggttatccactacagaatactcttattatatggcttcctgcgaactctaccagccgataccagcctcttgatcaagggattatccactgttggaagttatactggaaacaatactggattcgcttcatccttcaagagtttgagcttaattatgatttaattatattaatgaacattctacgagcagttcgatggggaatccagagctgggaatttgaactttctgggcaggtaatccagaattgctttcaaaaggctctagattctcaaccatcatatcaagagcctgtcaatccagcagttctggatgatatacagaatgctttctctcttcttaagctctctacgcctatccaggacctaatagatattgatacctttctgaaccccgcagaggaagctatccaggatactcatgaagatattaagagccagattctagctcagtatgggccagagcttgatgatgattctgaggaggagcttgaaattctaccacaaatatcacttgatcaggcattggaagcactaagaacactttgtttatatgaggagcagcaggcagagggcattcctagccttatatatgagctagataagcatgagcgtatcctttggggtcgaaagctgagcctacagactcagcgggatattcgaagctattttacaggctaa

SEQ ID NO: 8165 - DNA, 1605 bp, A.fumigatus
tttacccggatacttcacccgtgggcctgcactattgatccctccgccaccgtcgccgatgcctgtgtttcctacgtcaccattgattctctcaacgatcagatctacagccttctccaatcgatcacgcaagagacggattttttttcatactatcgcctaaatttattcaacaagcaatgcccgttctgggacgatgccaacagcatgtgtggcaatatcgcctgttccgtcaatacaatagagtcagaggaggatatcccgttgacgtggcgcgcggaggaactgagcaaattggaaggtcctaaagccggccatcccggccgcaaacttcaaaaggaacggcccagtgacaaaccgcttcaaggcgaactcggcgcaaacgtcggggaaagctgtgtggtcgaatacgacgacgagtgcgatgagcgcgattactgtgtaccggaagacgaaggggccagtggtaaaggtgactacgtcagtctggtagacaatccggaacgattcacgggctacgcaggtccaggagcccatatggtctgggataccatttatcgggagaactgtttcctgaagtcgcctccggagatggcactgtccccgcacccttctctaggcggcttgcaggccgtcaacgacttccgaaatgtattgcaaaaggagatgaaacggtctgaacagttgccgttcgacaatgagtgccttgagaagcgggtctttcatcgcgtcattagcggcatgcatgcctccatcacgacccatctctgctgggattatctcaacaaaaccacaggacaatggcaccctaatttgcaatgcttcaaagagcgtctgcatgaccacccagagcgcatttctaacttgtacttcaactatgcgcttgtctcgcgggcggtggcgaagctgcggaagcaccttcagaattacaccttttgcataagcgatccccttcaggacagggaaaccaaggagaaggtgtcgcagctgactgcgatcctcgccgatcggccgcaaatctttgatgaaaatatcatgttccaggacccgagcgcacccggcttgaaggaagagttccgcaatcgctttagaaacgtgagcagattgatggactgtgttggctgtgataagtgccgactgtggggcaagctccaggtgaacggatatggaacggctctgaaggtgctgttcgactacgacgagaccaagaatggcgaaaatccaccactacggcgaactgagctggtcgcgttgatcaacactctgggccgcatttcccatagtttggctgctgtacgaagcttccatcgtgccatggatcttggacagggccagactttcgccatcatggcgggaacgcccatgttgaagcaacatcctggcggtcggaaagcgaaggtcctctacaaggatggagggtcgacgttctattacgaagacgacgaagacgatttcaaatatgcgacggagagattaccatgggagaggagaccgtataaggaatcggatactgcttgggacagttttacggctgaattcgaggtggtgtggaacacattcgtctacgtcctgaagagttggtggaatttgccgaaaactttgtaa

SEQ ID NO: 8166 - DNA, 1125 bp, A.fumigatus
ctagcactctccttgcagccccgtggtgaagacacgttgcctatggatttggatgcggagggtcgcagactctttgacttttacgtcaacgagatgccggcttgctcctatggcaaccacttccggtctcctaaagctcacaactggtatacggccgtatttgttcccgagggcatgaaaggcccagtcgccttccagaacacgattctcgtccacgcggccaacacatgggcctgggtccgaaaccaggaggaaacaaagatgactctggtccatcgtaaccgggccatctccatgctccgggagcatctggctgcaaaccccggagacatcagcgacgtggccatcattgcatgcctcagtgcagccggcttggaggactttgatccccggccgggacgcaagcagatcagctggattcatatgagagctgctcgggagatgattcgagcgcgcggtgggcctgcggcgttcgagaacacccggctggggatgttgatcaactggcaggactatattctgtcgggctatgaaacccatgggccgagctttttctttgagcccaatccacctattcagtcagatcttaccgaagcttcgctgcccacttcctcctgtctttccaccgattttgagggcgtcccttcgacggcccgtcccttctcccccagagatgaactccaacaccaatgcaacgaattcatcgatttcctcaaacgctgcgagcaactcgccctccaccagcaaacacacaccaacccggccatcgcacccatgcgccacactgccttccaacctacctcccttctctaccagattctcgccgccccgccaggcgtccgattcaccgcctcaggcaaccgcaaacagttcgtcgcgcgcttcgtcgcgctgatcatgttgaacgccggtctatgggactatcgcgcatccgtcgcccacagcgagagcttcctgcacacgctcgagcaggccgtgctcgaaagcgaggtcaacatgagcggctcagtcgaggccctgctgcagatcatgctggagtgcaacgacgggacgcccacacccagcaccagtcccaacctcccctctgccttcgtgctggatgagcgcgagcctgccgcgccctga

SEQ ID NO: 8167 - DNA, 210 bp, A.fumigatus
gagcatgtctcggggagccatgttcaggatggtcaaagatgtggctcgcacctcctcaaaggggtccagcagaagatccacgagcaatcggataagactcgggtcgaatacttcgatgttgaccttccatcgaactttatcctcttccatattggcacgcctgaccaagttaacacggggatcaagaccggactgaaggaaaagatttaa

SEQ ID NO: 8168 - DNA, 810 bp, A.fumigatus
ttgcgcggtcccttccagccccgtggtgaagacataactcgttttgaagatgcaaaacccaagtcgatgaagcaagttctaacctccttggtcaaattattggcccaaagtcggcaagaacctagctgccagttgatacaagttggcctggtagatgctattctccctagtatcattctcggtgaaccgcgtgctccgcttaaggctttccttgtctcgcttgagattatcacacgcaagaacgctatcttgccccacgaattgatatccatgctccaagtgtggctgtcgaaaaacagcgagaaatggattcccatcctgcaagaggattgcaaagccttatccatggatgtaggagtgctcctactctccgatgaagattcctgcaacaccaagagagtagaatctagagggcttgctgtgcagatcctgctcctggggcttctgaatcaggcgaagaacccagagcttgcctcaagtgctggtgacactatagctgcattttttcaaaaactcaaaagtgatcttggtcttgcagaggataaccgcgctctgctttcagtctggatccctcccgtcaggtatatggttctacagaacctagacaatctggagcctatgtcgaactatgttcttcaacccctcttccacaatgacccctctggatttcgttccttcttggatagtctacctcttaagaacgtccttgccggtgatatggccgacgctgcattgccggaactgactgttctatttgcctctttacaagtggccaagaaggccggtttagttgacgaagactgtgagtga

SEQ ID NO: 8169 - DNA, 957 bp, A.fumigatus
atacgactgctgcgtactaactgctccctagatggcccttctaaacagggaactggcatgaaactctccttaccaggtgagatcattggccaatttttattccaccgagaattcagcatcagaatagcagcactctcactcctgatagcagcacctgccactacaaaacctctttcatctaccgcgatccgtgcaattctcaggggtttgccctctatgcacgctgagtctgactcttattctcgaggggagatcatcagcttgctccgtaaactgatcgtacgtttgaagggtggtatattggagaaccaggatggtccggttcaggaagagctgtccacaaataaaacgcagcaggcaaagtctggccggagcgattcggagactcgagcatgtgtctcaacctacattggtttcctcaaaacagacatgcggcccaccgcctcctatcctcgccatatcatggctctgaagacattaaatcttttccttcagtccggtcttgatccccgtgttaacttggtcaggcgtgccaatatggaagaggataaagttcgatggaaggtcaacatcgaagtattcgacccgagtcttatccgattgctcgtggatcttctgctggacccctttgaggaggtgcgagccacatctttgaccatcctgaacatggctccccgagacatgctcttaggtggccttctacaatctgcagaccgatcatcggccatgccattgcgactgatcgatgccctgacaaaagccgagcagttggccagcaataccagcagagctgaccatgctgataccgtcgcccgactataccatatcatcttttacgccacagctgagactcattcgggaggcggttcacagtggtgggaaaccaagaagggtgtggttgatctgcttttgacaaagctcgagggcaaatcttcaccacggggtggaaggaccgca

SEQ ID NO: 8170 - DNA, 249 bp, A.fumigatus
gttagacaccaggctagatatggactacagagcgcatccgggtctggaagtgcagggccaaacgccatgcttttcctcgctggtaatacgcagccttggctcgactggctccaacaactgatctcgggacatccaactccaatcgacctgaaacaaatcaccacttgccaaaaaaagtacccagatgaggcaagagccgtcaaagtcggcgtcaaccgagcagtgaatccatggacaagacctgcttag

SEQ ID NO: 8171 - DNA, 342 bp, A.fumigatus
aaaatttcctgtttttcttctaacccaattccgtccgtccccacttttgccctcttcccacattttcagggggaattatacttcggtttggtcatggttattcgggtctaccatcctccattggaatccctttccctttcccttcttccactggttctctttcatcctcctgcgttctttgtctcacaggttccctctgcattaaatattccctattctaacctttcactattggtccttcttttgattctctactccctcacgtctcctgtcgttaaatctttccttctcgtatcctctcgtctctactttctcctacttctctcgcacccggacttctga

SEQ ID NO: 8172 - DNA, 576 bp, A.fumigatus
tctgatcccttcctcattgcttcacatcaagcccatcctccaacgatgagtgaccccaacaccacagccgtccggcccgtcccccgagtcgggttcgcgactattatccttggactgattgtccttggtatcctccgctgggcatatgcgtgctacaaagggaaccagaagtacaagttgccggcgcgcgtccccggaatccccattctaggaaacagtctgcaggttcctgccgttcagcaagggccatgggccaaagatctggctgccaagtatggcgaaatgtatgtgggcgttccctttcctagcctcccgtctcgcgaggatgtcgagctcaagcacaagcgtaacaggttcacttgtcagtttggcggaagcacgtgggtctttctgaactcctcgcgggtggtgaaagaccttctcgagaagcgcgccgcgatctataactcccggccgccctttcccatgacccaggacaatatctcgcgcgggggccggatcgtgctgatgccgtatggggagcgatggcgcctggtccgacgggtcatgcaccagatcctcagcgtcacgaactag

SEQ ID NO: 8173 - DNA, 852 bp, A.fumigatus
  unsure (839): Identity of nucleotide sequences at the above locations are unknown.
ggtctacaagcgcgaggtcgacaaactggaacaacgaatccgagacggtacgcagcgaagatgcttcggggtgaattcctggcgagcaaagaaatcacgcagatggacgaggtgacgaagctcttcgtctttggctcgctcatggaggccggaagcgacacgtcgcgcgtgacgcttggccagatcatcgccggagccatcacatacccggactgggtgacgagggcgcgggagcaactggaccgcgtctgcggagcccacgccgagcgcctcccggggtgggatgatcgcccgcgcctcccgtatatcacggccgtggtgaaggagggattccgctggcggccgaacattgcggaaatcggcgccccgacggtgctgatcaaggatgacgagtaccaagggtctcggttccccaagggcaccgtgtttacttggaacgcgtgggccattgccctgagcccggatgagtacgagcagccccagcgcttctggccggaccggttcctgaatgaagatctggaaaatgcgctcaagggccatggggcatttgggcccggtatggtgcttccaaatcactgcagaaaacaattacattttcccgttaaccaaatgacaggacgccgggtatgtgccggatggaaggtccgaaaaacaaacgtgtggattgcaattgctcggctgctatactgctttgactttcacccagttcctggacaacccattgatacgatgcggattccgcaattggctggcaatgcaacttcattcgcggcgcgagtttctgtaccgagtccggcacacgcagaactcattcgcagaaaatgcgcccaggctgtcanaactcattattga

SEQ ID NO: 8174 - DNA, 1626 bp, A.fumigatus
aatcgtttctcgccaatcactgtagcctctggattgactttgggactgcgatcaatagggaacgggccatcggctatgatcctttcattcattctgcacggtcatctcccgtactactccataaatcgtccgcatcccgaccctctactccatgcgaaacttaaggacaatccggacttactggatgcggatgtagcggctctgaccgaacatttccaagcctctcggctgtcgtactccacgcaggctctcccagtcaatgttctgctggacacactcgtccggccgagcatcgatgtggatgtgggagatggtgaaaccagagtggaatggcgatacgtgcctgaaaaggccgtccctcacttggtattcggcaatgcgccgaaggccggtggtcaatggaatgacaacctggtatttgctagctgggatattcaaactttgagctatgcgtcaatgctgtccttgccgggatattcatttgctgagcattaccgtaaggtcaatggcaaggatcttcccgcattcacgcggcccaccaggagggagattatggactatttcagcgcctaccctgaggcagttgggattgatgactctttccacaataaccaaagtcttagcggtgtcacaagaactgcaaatggtttcttcatttcttctcacaatatccattgcaagcatctggtcttggcgagtggaatattctcggaagtgctgcagccgcttccgatgctacaaccccttcgatttctccagccgaccccggaaataccgctgcttgttataggatccggcttctcagccgcggatatcataatatctgctccgacgcaccagaaaatccttcatatatttaagtgggatccggaaggacatccttccccactccgcagctgtcaccagcacgcatatccggaatatgcgggagtgtatcgactgatgaaacgagctgctctggccgccgagccagctgcagccaaacgccttggcaaaccaaggcggacgacatcctctccgttccttgaaagtcgggcctgggatacggtttacgagggccttccaaacgcagaagtgattgccgtgaatatgcaatcggaagctgcagtggtaacttttaggctacccgacggaagcacagtagaacgaaccgtccgtgggctagtgtatgctacaggtcgtcgtggaagccttggctacctggataggccccttctttccgacgtcctcgggtgtcccgatggagcagaacccagccccatcatatccggcgagacattgagagcaaaggcgttggaggatctcgaagtcgctgatgacgtctttattattgggagcctcaccggcgattccctcatccggtttgcctacggcagttgcgtgcagacggcaggtcgactcattagagcacataccggggacgataaatccgagtgcaaaacgccaacctcttccagaccacaaagctcatccttgcgtgtgatgaacggcatggagggtcacgaaatctatcataacggcgattattaccaggaactggagaagatcgattctgaggccacaacccgccctccctcgagtctggagagcctatggagccggatgatgaggttttggaggtcatga

SEQ ID NO: 8175 - DNA, 780 bp, A.fumigatus
  unsure (753),(766): Identity of nucleotide sequences at the above locations are unknown.
ttgactagcgtccagttcatcgccgtcttcctgggatatgtcgcggtctctggcgtggccatccatcgatacgccaaatacaaaggcctcaacggtgatggcatttatgactcctccaacagcttttctctcgacacgaatacgcttattctgtttattttcgtgctctgtgtggcgctcgctttttcgtacgcgtactttctcggggcgcgctacttctcgaagttgttcatctgggtgactgggattctcaatattgtatttgcgctggcgactggcatctactatatcgcgcggaaacagtacggcgggggcatcgtgttcctcctctttggcgtcttcgccatcatctgcttcatcagctggatcccgcgtatcccgttcagcgcattcatgctacagacgtccattgacgtgtcccggaagtacggccatatgtttatcgtgagcacgattggcggtctcgtggctgtggcctttgctgcgtggttttcagtaaccctggtctcgatatatgtggcatatgagccgagcagctccggcagtaacccctcctgcagcgacggcggatgtagcagggcccgagtcatcgggctggtcgtatacgtcacgttcgccatgtactggtttagcgagtggctgaagaacacgattcataccaccatcgcgggtgtctacgggtcctggtacttctggagccagtcgccgattggcatgccccggggatcaacgcgggtgcactcccgcgcgttntttacgcaggccngcgatacataccac

SEQ ID NO: 8176 - DNA, 378 bp, A.fumigatus
attgatcttctttcctttctctattttcatcgttctccccttctcccctccgtcactacttggttgtttgttccccttcaaaggtataccatcatgagcggacagcttcgaagttactacaatcccagccagtcgtatggtgattttcaacctgggatgcaaaatccccaacaacagcctgattactacaacaataatgtgagcaatcatgggtacgacccaaactttcaacgcggacctgagcccaagcctccgaccgagccaccaccaacgtacaatcaggccgtctacgggtttgacgacgcgttcaagatcgagcgacccaagtaccacgatatttgggccggtctactcgtaagtggctgcacactcagttga

SEQ ID NO: 8177 - DNA, 234 bp, A.fumigatus
ctacaccaagcccttgaagtaagttttactgttgtcggtgcagcaatgctacgcatgtacctagatgacgagattggcatgaaagcattgtaccctcgacctgaaacctcgcaaacaaatcttcttccagccattctcaagccctgtaacacctgtgacatgctcacggcagtgttggagcgaggtactgacagtctggtaaggtacgtatttgatgcaggctttctgtattga

SEQ ID NO: 8178 - DNA, 1719 bp, A.fumigatus
gcggctgcgaatcctcggagtgactgggggctagattcgcggagagtcgactcagtggatttcctctttgaactcgttccatttcagattttctttccttcaatcagaatcatcagattcgtctcccacattctttacgagaaaggctgggaagcacaaagcaccttagcagtcgccaagacggacccgttttcgcccatctacttggggtggcggcccgtgcagtcagctcccgggagtgacgtctgtgagcctcaggcagcattacattacccaccttccgtttcgggatcagccccggagtgcacctgtcccttccgccagcaaccagaacagattggggaaggcacacccaacgatactctactcgattggctacaagaggcagtcggagcattccaaacctcatcacacgcctctacgtgcagcgaatcaggcgatctaccatcgtccatagtcgaggagaaacctttacagccgactacaaatcgtttccatatcatgatgtcgaaccaacctaccttctcaggtaaacctggggaagatgtggatctttacattgaccagtgtcggtttatgtgggctggtgtgagcttagaccctgaggaaaagaagcaggcaatagctactacgctttttgtgggcctgagagaagccgctcttagattcggccgtacattacccaagacggagaggaaggactgggagaaattagcccaacatctccgagcaaggttcccagaacaagagccaagcgaccggatacaggatgccatcatgaggctttcagagttacggcagggaacgaaaagtctgagggggtatattgacgaagtccaagagctcacaatgtctattccggatgattggggtcaatccgtcggttcaatgttcgcccggggactatcagatcccatgacgcgaaaagttctgaatgcttatatacaagctcagaaagcaatgtccaagacggtcaaaattgaagaactgattcgtatggcaagagcatgtgaagacgaggcaactgttgttgaggaggtgactgcatccagatcccgagacgagatgtttgcagacgcccttaataatcaaagccaactaattgggactctcgccgaacagctttcaaggatcaatctatcccagggtcagtcccagcagtcatctataagtcggcaacagcagcagtggcagaacgcaggacagagagtgtgcttcaagtgtgggcaaacaggccatatcgcaccaatctgcacgaatcctccattgcctgcagaggaacaacaacggatcagacaagaaaccatgggtcaaggccagggtcaacttcagtcgcagggacgatatagacagcctcagacaaatcgcagcgcttcagagacgaatagaccaattcagcctcaagggggagcatttggactggagtccaggcgtcgagtggacccaaccaccagcacaacttcggcagctattacgggagtagaatcgaataacattgcacgtgtccggtttgtggacagcgaaagtgaagaagtggctgaatggaatgccatcgatagagttaacgcagtgcttctcagctccctgtccccaatagatgtccacatcccgcaatcgagcaatgcgctagtggaactgcagcgagtctacgccgccggagatgaagacgcaggtggtaagcgggccaaggtggataccacgagcgatagtcaactctag

SEQ ID NO: 8179 - DNA, 252 bp, A.fumigatus
cgcattgctcgattgcgggatgtggacatctattggggacagggagctgagaagcactgcgttaactctatcgatggcattccattcagccacttcttcactttcgctgtccacaaaccggacacgtgcaatgttattcgattctactcccgtaatagctgccgaagttgtgctggtggttgggtccactcgacgcctggactccagtccaaatgctcccccttgaggctgaattggtctattcgtctctga

SEQ ID NO: 8180 - DNA, 489 bp, A.fumigatus
tgcacccagtgctttctatcacgcgtccaacgctacagctggagagaagactgtatacgcgtctcgcttaggaccacgctacgttctattcaattcactgatgtttgtatgcatgtgagtagtatagagctcatatcactcttcagctttctttcatgcctccccaccagctcaatccatattgtcagcctcaaaatggaaagtgagtgccagtgtgaaggtggcaataaggacttccctgctggaagcgtcatgaggaagttcgagaacgccattttcccaatcgcagggagtctttatcgcatgaagaagatcctctgggagcgttacaacactgattaccaccagcgcagggctgtgttcgaagccgaggaatgcaagaccaaggaccccgtggtcgtcaagttcttcctggagtgtgtcatctgctctttgccttatgcaagtcttctcgctaacttcgtcgacatagggcagacccattcatga

SEQ ID NO: 8181 - DNA, 225 bp, A.fumigatus
ccgaagcttcacccagtgtgtctctccagcaacacatactcatcccaatcaaaatacaacatccacacccctctcactctaccttcagactccgcaatccccagctccaacacctcctctctggcttgctgctctggcaacttcacagccagccatagttgccgctgttccagcgtaaaatatccactcacgacatcaagtagatcaaacggtccaccgatatag

SEQ ID NO: 8182 - DNA, 273 bp, A.fumigatus
cttcgtcgacatagggcagacccattcatgagagaagaagagagaggcaagcgaactatgaaagacgatgccgctaaccttttccacaacgaatgcgagatctggagaaccttgtcagatacgggctatactcccaagtactacggcaagagggagatgcatcaggacctggcttttgagaaccccggcgcatacctgtggatactggcttttggaacactttccggacctttaattttggctgacacgccctccatttggtggaagggtgga

SEQ ID NO: 8183 - DNA, 201 bp, A.fumigatus
aaggccgaggatgcagcaggagatgagactgcggtttcgacaaccgaagtcagtgctaagaatggggttgacagctctgctctgtcggatgccgtcggtggtgagagcagtgctcccaccaacaccgcaaatcccgaccagagcaacaataacgacagtattgtacccttgacgaatggggttgcgggcgatgcgtcatga

SEQ ID NO: 8184 - DNA, 1173 bp, A.fumigatus
tgtctctttttcattgcgatacatacaataaaagaaatctaccggtcgagttctatcgcacatgctgatgtgaatcctcccgctcagtcctacttcgtccgatgggtcaatgtcaagcccgaccataccatctcctggagcatccagccgcacaagaaatccctcaactttggcatcttcaagcatcccggccattccggtgtcctcagttctaccaatcatcctgccggcgactatcacagtaccgattcgagcgagaacttaccgtcggccgctgctgccgctggttcgcgaacctcggtcattgaaaagctgaccagtatcggcctcaagcaggtccgatggattggcaagtgcgaagcggacaagatcgtcaagggtacctacgatgtacctcacaatgagggtgggaactacgcgctggtctttgacaacaccttctccaagcaaatctccaaaacggtcaccctggtgctgctcacttatcctacacattcgggccctacgaaccactcgacaacgcagctcgctcgcgaggtagagtttgctgagaatgccaacgcaacggcgcgaaaccgaggtaacagcatcctttctaaagcgccatctcaagccgtcagcacgacctccgggacgacccatactggacttttgcacaagcgccgcaggaaacgccaccagggttgggcaaggcgatacttttcgttggacttcacctcgtcgactctctcctactatcacgatcgcaattcatccgcgctacgtggctcaattcctctttcgctggctgccgtcgcttgcaatgaaaagtcgcgtgaaatttccatcgattcgggcacagaggtttggcacttgcgggccagcaatgaccaggatttcattgcctggaagcgtgcgttagagaaggcctcctcgaaggcgtccgccgaggactctcacgcgcccgaggtgctgcttcgcgtgccttcccagcgcttcctcacaaatgccgcggaggaacgcgaatggatgcaggtggagcatctggtcagcaaggtatcggggtcccgggatgcagtgcgtcgactggccagagacaccgatccaaaatacttgaataattcgtcggctctgactccttacgagcggccccgggggtcgctcccccagtccccacccggaaaccaactgtga

SEQ ID NO: 8185 - DNA, 213 bp, A.fumigatus
gctatatataataatataactaggtactatataactaagcagtatgaaatactaaatctaactatatttagatttataaaggataaagagagaggccttactaggcttaaactagataaatatacttatagtagtcctagacttatagtatgtctgggggtttttagaatattaactatattaactgattttactaaattacaagattattag

SEQ ID NO: 8186 - DNA, 594 bp, A.fumigatus
gaaaaagcattccaccggccggccttcctgctcctcgtatcacaccaccagtccacaacagctacgaatcctctccccagaatgtgcgctctagtcacctattacccgcgcgaaccacttgacgaaacctgcgagaaggagaccaatcccccggcatgtctgctccccccctccaccacctcaacatccacctcctcctgctacgcctcgctttccctgctccccatccagatccacctagcaggtcaccaaaacccctccttctgggacgactacagcgcccaccccagcagaacgcggcatagatgccacctcttcttctaccccgagtccgaacccggcttcgcagagcacccgagctcgacctacgactggctcagctcgcgcctcgcctggagccgcgcgatggattgtctcaagcgcgggttcggctggcccggcgggagctggaagacgcctgatgtcgagacgatctgggaggaatactggcggactctgctcttcaatgcgggccgtcactccgacccggacggatacgccgccaggttcatgaagatgatgatcgggagtggtgatccgagcagtctgttttct

SEQ ID NO: 8187 - DNA, 1794 bp, A.fumigatus
tatttgcatgacggtttagatatacatatgcttgctgggtgctgctcgtcggcctttcaaccacatatccacataaaaatgtctcgtacagtggagttggggtcgcaacccactgcgatggctggctgtccttcagagcaacaacgcctggtgtcagagacgaatcaggcgcttcagttagccacccaatatagcaaagttcagaggagaccgggcggcaactggcgtggacaaaccgggatcaacagcatcgcaacaactgcagagcatatcttcatgcaccaggctcttggcagcaacttggatacagaccgagatgctttcatttcatggttttattctgtccagaactcagatggctcatggggcatcagccccggggaccgtggcgatctttcggttacggttgaggcctatcttgccttgagaattctaggtgtctcacggaatgtgcatcagatgcgcagatctcaatcctttatccttgcggaaggaagcatagcaaatgtttgctttatcacccgcattcatcttgcaatgttcggcctatatccttggaatgcggttcgaagtctgcctccggagttggtattgctgcctcaatatatcctcagcagtatatgctgctggccagctgtagaccttacagtgctgatccctctcctcatcctctgccaccatcgcccaatctttccattacccattcaggactgtgcagccagctcatatttgcatgaattgcaatgcaaaccacaagaaccgcaagagaatgccttttgcgctttcccgcctggcacttgcggggacactgcaccggcgtcaacctccacagacttgattgtacatctcctaaacttgctaaaatacatccttccgctgcgacgctatgcgcttgatcggagtgttgcgttcatccttcagaccgtgcgggaaatgggcggcgtcgggcctctgtcgcggccgctgcacatggcgatagttgcattggagctggagggttactcggtctcatctcgttctctacgcacgactctggacaatatcggacactttgtgtatgaggatgggggtggaaagcgggtcttgagtgtgaatacaaccttccgcgacagcagtcgcatgattacggggctccaagatgctggcatcgccgtgaatgccccatggttcaggacgtctgtacaatggctgcagcgttgtttgcttccagatgttaacagtgacacatccaagacttttgagactcgtgtctgtcatgtggatgatgtggcatcagcgattcacgcggtaattcgacaggatcctctcatgctccgctcacaccttgtcgccaacgctctccaatggcttctgaagcgacagaatgcggatggtggatggacatctctaagcagcagtcattatcgaacttcaccggacaagcttgtgcgtcagtcaacgccagacgtgactgggcatgtcctcgaaaccttcggcctgcttctgactgtgagtcgacgggacacgagagcggttgcgcaagggatattggtcgatcaggtcgcatcagcttctcgaagggcaatacactacctgtctgccactcaacaaccctgcggtgcctggtttgggtgctgcaccaggtatcacatctacgcgacaagcgctgtcctccgcgcattggcctatttcatcggggtcaaagagcgcaacagatggaccgagagagatgacagtatcaacgacgacgtgtctcaagcgatccactggcttgagagcgcccgcaatcgagatggaggctggggtgacatatgc

SEQ ID NO: 8188 - DNA, 336 bp, A.fumigatus
tttgctagcaccaccgtcggatccttccagccccgtggtgaagacgaccctgtgagtaggaaggaggtcgcacagtcagagtgcagattcgggccggcatacgcacctaacactacattccacgaagtcgtcggcgagttcgtggatatcaagtacgcagacggggagatcctctccggcgtgatcggtactgagaacgtaacattagccggcatcacggtgaaccagacgatcggggtaatggattacgcgggttggtatggcgacggtgtcacgtcgggcttgatgggtctcgcgtattcatctctgtgggttttatcggtcccattgttataa

SEQ ID NO: 8189 - DNA, 396 bp, A.fumigatus
tccactgatggtgtgtacagcgcgagcgcctacacgacgaataacaggcaaccacgtctctacaaccccattttcgcaaccatgtacgagcagggcctcatcgatcccatcttcagtatggtcatgaaccgcaatgcttccaatggcacagcagctgggtacctgactctgggtggattgccacctgtcgacatcaacgggaatttcagcaccacgcctatcctgatcacgaatatcaagggttatccaaaggattatgatttttacgccgtcaatatcgatggagtggcgctaggcaacaggagcttgccagaggctgccggtggcattcagtatattgtaaggatgtaccggggtagtttctggatttgggccaggctaataatcacagattga

SEQ ID NO: 8190 - DNA, 204 bp, A.fumigatus
tatcctctttatggtcattgcgtttgtatattcacgatgcacaggatcacaaattttgtcattgtcgaaatcacacctattgggatacagaacattggttggaaattctggatcgtgtggacaatcaccaacgcggcttgtcttccgattatatactatctgtacccggagaccggtgagtggagttcgaagctacctatttga

SEQ ID NO: 8191 - DNA, 621 bp, A.fumigatus
cagtgcacaggaatcaatatcatgtcctactaccttcctctggtgctgatcaactctgtcggcctgtcaaacagcatgtcacgactcctcagtgcctgcaacgcgacatcctactttgtgtttgcctgtgtagcagtcatcatggtggagcggttcggtcgaagaggcctaatgctgatgtcgacctttggccagtttgcttgtttcctgatcatcactatcctccttcgatttgcggagaacgacccaaagtatggtaccgcttcagtggcattcttctttctgtattacattgcgtttggaatcggcatgatgggtgttccctggctgtatccgacggagatcaattctcttcgtatgcggacgaagggtgcggctgtctcgtctgcgacgaactggtatgatagtatcctctttatggtcattgcgtttgtatattcacgatgcacaggatcacaaattttgtcattgtcgaaatcacacctattgggatacagaacattggttggaaattctggatcgtgtggacaatcaccaacgcggcttgtcttccgattatatactatctgtacccggagaccggtgagtggagttcgaagctacctatttgaaagaagctga

SEQ ID NO: 8192 - DNA, 216 bp, A.fumigatus
caatcgctagcaaaccgaacgctggaggacctcgacgcatactaccgttccaacccgccactgatcgtaacgggggacccggatgcgatctcaacaggtcggccattgaagtatatccagcatgaggatgaggagctacagcgacagatcaagcagaggcaggctacgggcgaggagggtaagattggctcagctacggtgcagcatgtgggataa

SEQ ID NO: 8193 - DNA, 300 bp, A.fumigatus
aacaaggttagtattgccaacggattcaacacatccaacagctcttgtttggccaaactgagactgccaccgtcaagtggggaggaaagctggtcattctggagaatggcactgaatgtctctggctttgcgctggtcaattggatcaactacgggctatcttccaaaggcggtgcgcttgcatggaggctccccatcgcactgcaatttttcttcatcttcatcctttatgcgactgtaccatggcttcctgagtccccaaggttggctgctcccgatgcaccccatgcccacagctaa

SEQ ID NO: 8194 - DNA, 240 bp, A.fumigatus
catcaagtagaacgtctcgagatgatcaaaatcgcccgtaacggcggcagcataacgccccggtaccagaaaatcttcaagcaccacgcagcccgcaaccgagtatctatccacacgcgcaccgtcatccgcagcaaggagttctgcccctcgtcgcagacatggcgtctcaccacagaccctcccattccggacctccccccaatcgactacatctactgcgcaacaggcatgaagtga

SEQ ID NO: 8195 - DNA, 183 bp, A.fumigatus
tcattttggaccgtcaaccgatttgaatctacggttgatggaatgtccagcgataaagcttgctgttctgatggctgggaagaaagactctgtcgtttactcatggttaatatatctctgtcatacctattgatgaagcagatcacatacctctctatcctgagtattagcctgagggcttag

SEQ ID NO: 8196 - DNA, 243 bp, A.fumigatus
gcgcttgctcttctccagagcattgatatctcgctctatgtcgttgctgcggtcgttatctactactttgccggcgacggggtgacatcacccgctcttggtagtgcgggccctttaatctccaaggctgcgtacggcattgccttgcctactgtaggaatcctgatcccgcgcagattttcttccccactagctagagaccagaaactgaccctagaagatcgtcatcgcaggtgtaattaa

SEQ ID NO: 8197 - DNA, 1437 bp, A.fumigatus
tctcttctgctggcccgactttgccccacgaggacagcacgattcctgaggacttcgacacccaaagtcgggccagctcacgagatgcagggagcgtccagacagcaggagaaccagctgctgcacaggacggtgcccatgctccccaacgcgacgatgcccataattccaacgaaaaacggccctgacgagaaacccccatggagcgaaatgaaaaccaaggctggaaaggagcggaaacgtctacctttggcgtgcatcgcgtgtcggaggaagaagattcggtgctcgggggagaagcctgcatgcaagcattgctcgcgctctcgaattccatgtgtctacaaggttaccaccaggaaggcggctcctcggacagattacatggcgatgctggataagcggttaaagcgtatggaggatagagtcattaagactattccgaaggacgagccccgggatatggccgcaatcggtagatcagtcgtccgaccgccccaaccaggtcaagcatccaagacacaaaagaagcgatcggcggacgaagcttttgcgtcggagatggaagaatgggcgcatgaggatcggagagcaccacaagacatatttcccatgcgccgcgagggcaagagcaacgacgcaacgggtcttttgaccgaaggcgccgagtttctaccgtcactggagattcaggaacatctggcggaggtcttcttcgattgtgtatacgggcagtcatacctcttacttcataaaccaagcttcatgcgacgattgaaagcaaggacagttccgcccgtgctgatcctggccgtttgtgctgtttcggcacgattttcgacacacccgcaacttagttcagatccacctttcctccgtggcgagaattgggcaaatcccgccgctgccatcgcgttgagccgacatgatgaaccgagtataaccattctgactgtttttctgctattgggccttcacgagttcggaacctgccatggtgggcggagctggtcttttggtggtcaggcactccgcatggcctacgctttacagcttcacagggagctagactatgatcctctgctgagtcaaggttcaggaaatggtgcacagctgagctttacggatcgggagatcaggagacgtacgatgtgggcatgttttttgatggatcgctacaactcgtctggtagtcagcgtccacctattggaaacgagaagtttctgcagatccagcttcctatcaaggagtcttcatttcaattggagataccgggcccaacggaggaactggataggaacgttccaaaccccgttccggatgatgtcggtcaattgtctaatgccaaggataacatgggcgtgtcggcctatatcattcgagctgtggtaatatggggtcgcatagtcgattatctcaatcttggtgggaagaaa

SEQ ID NO: 8198 - DNA, 183 bp, A.fumigatus
tttcttcccaccaagattgagataatcgactatgcgaccccatattaccacagctcgaatgatataggccgacacgcccatgttatccttggcattagacaattgaccgacatcatccggaacggggtttggaacgttcctatccagttcctccgttgggcccggtatctccaattgaaatga

SEQ ID NO: 8199 - DNA, 1728 bp, A.fumigatus
gagcggcactccgacattgatattaactttctcaactacgtatttcgcaacatggcgcgagaaggagactcaaatggcacattggccatgccccggctagacgaaatattgcgccatccagaagacctggataagattgcaggattgaaagccgaatactcgcgaaagaagggaacagttgactcacagctccgggaaggtcttcgacatcaattggaaacagtccaacgaagtatcaatgccttgactgagggccagcgacaggtcacgaagacgagagacgaacttcagactatagacaagctgtgcgcggaatcacaaacgagcgtcgacgacttttcgcggattgataaattggccaaagtacagcgaaacttcgaagcaactctgatgatgaagaagggcttggagaacttcagtatagatcttgctgaggtcgaggagctcttgcgacaggacgacgaggatcttgagaaccagccgaatttgttacgggtacacatgcagatctcgcgattgagggattttcgagacgaagcgatggaccagattcgcaaggcccaagatccaagcagcgaagccgcgctgacagactacttccaaggcctggattctgtcattgattggttcgatgagcatctcggaaccgcttgtatgaatctcatcccactagtgcagtcagacaacaggagtatggttgtccggctcggtgtgatcgttatgactgaggagaagaatgatgcgacggtgcgcgctcttcaggaggcgcaaaaggatcatcaggacttggctgggcggttcaagtccatgaacattggtcctaaaaccgttcgcggctacaaagagaaactcttgcaagcaatcgagctgtatgcagaaaaccagtttcgggaaactaaggaggcgtttttgggtgatcctgaaaatctggataagagcttcaagtggtacttcaacgacctcttctctgttcaacaaggcatgcaagcactgcttccgaaaaggtggaagatttacaaaacatatacgaatatttatcaccgaatgatgcatgattttctaattgacctcatcaatgaccctgatttaccagctgacaacttgcttgcgattcttcattggagtgaaaagtattataagaaaatgaaaaagctaggctggaagcaatccgagctccaaccgaacattcttgacgaccgtgagcctgagctcatcagacagtggcaaaacatcatcatcaaagctgtggaagaatggatggagcgtattaccgaaacagacaggaaaggactcgtcgagcgcattcccgattccctcgacaccaacgcagaaggatacttccgtacaaagacccttccagatatgtggcgtatgctgcacgagcagattgtggcttccggtgcttcctctcgaacagatgttgtagagggcatcattgatgctatgttccgagtgctcaagagtcgccaaacgaactggcagatgctcattgacgaggaatgtgggaaatataaggcccagggcggagaccaactcgaaggcctccagctattgcaggattggctcattgccgttgccaatgatcagatcgcctgcattgacgacaatgacgaatcgggacagctgggatacctgagcaaattcaagcgtgattttgagccatccgtggatccgagtcttcaccacggggctcgaaggatccgcgctaaggatccgcgcatgcgttaa

SEQ ID NO: 8200 - DNA, 315 bp, A.fumigatus
gataaatttccgcgagaccattgttacacttcgtatccaagcaccgcaagtacaaccgaagacaaacagacagaagccaattggtcccagcttccaaacactcaaaaaccgacgactgaacagaaaactcatatacctgtcgacatgagctacttccgtgtcaccctcctccgctccgccatcggtctgccccggcgaacaacagacgtcctcaaggccctcggactcaaaaagcgcatggcgacagtcttccacccagtatcgccatcggtaggtggtcagattctacactgccaggctcgccggaagagcgct

SEQ ID NO: 8201 - DNA, 2190 bp, A.fumigatus
ttctcctcagagggccttcccctggccgtaacactagctcttgcatttgccacgacgcgaatggtcaaggaaaacaatctcgtccgtgtccttcgtgcctgcgagacgatgggcaatgccactgttgtctgctccgacaagaccggtactctgacgcaaaacaaaatgactgtcgtcgctgggacctttggagcccaagagagcttcggtcaggacagaaaggaggatgctgaaccgccaagcgactccaccaccgtggccgagatcttcaagcaatgctcaactgcagtacgcgatttgatcatcaagagcattgcgttgaattcgaccgcgttcgaggaagagaaggaagggtccagagagtttgtcggaagcaaaaccgaggtggcaatgctgcaaatggcgagagactatctcggtatggatgtaactaccgaacggggctctgcggaaattgtccagctgatccccttcgactccgcccgcaagtgtatgggtgtggtctaccgtgagcccacggcaggctatcgtctcttggtcaaaggggcagccgagatcatggttggcgcatgctcctcgaaggtctccgatcttagtgcatcttcggatggtgttatggtcgacttgttcaccgaaacagaccgccagaagatgcttgatacaattgagtcttatgctatgaagtccctgcgcaccatcggtctcgtgtaccgggacttcccgagctggcctccaaaggatgcacaccgcgtggaagacgacccatctgctgccaagttcgaagatgtcttccgtgatatgacttggcttggtgttgtgggtatccaggatccactgagacccgaggtgccagttgcaattcaaaagtgccgtattgctggtgtgcaggtgaagatggtcactggtgacaatctcgcaacggccaccgctatcgcccaatcctgcggaatcaagacagaggatggcattgtcatggaggggcccaagttccgtcagctgtcagaccaggagatggacgaggtaattccccgcctgcaagtcttcgcccgttcctcgcccgaagacaaacggatcttggtggcacggctcaagaagttgggcgaaaccgtcgctgtcaccggcgacggcaccaacgacggacccgccttgaagacggctgatgtcggtttttcaatgggcattgcaggcacggaggttgccaaggaggccagctctattatcctcctcgatgacaacttcaagtctattgttacggcaatcgcctggggcagagctgtcaacgatgctgtgtcaaagtttctccaattccagatcacagtcaacattactgctgtcatcttgacctttgtctcgtcgctctacagaagtgacaatacgagtgtcctgagtgcggttcagctgctctgggttaatctgatcatggacacgtttgctgccctcgcacttgcaactgaccccccgacagaacagattctccaccgcaagcccgtccccaagagtgcatcgcttttcactgtgactatgtggaagatgattattggacaggccatttaccagcttgccatcacctttatgctctacttcgctggcgacaagcttctcgggagccgtctcggcaccgacaaacgtcagttgaagctcgacactatcgttttcaacaccttcgtttggatgcaaattttcaatgagtttaacaaccggagacttgacaacaagttgaacatcttcgaaggcatgttccggaactactggttcctcggtatcaactgcatcatggtcgggggtcaagtaatgatcatctacgtcggaggtgcagcctttaatgtgactcgcctggacgctgttcaatggggtatctgcattgtctgtgccattgcctgtctgccatgggcagtgatcttacgattgacacccgaccggcctgtggagattatcatcaacttcgtcgtcctagttgtgggcaccacattgcggccgattggcaaggccgtcagcgccatttcgagaatagtctcgtctatgatgtggcctgtcaagcgcgtcagccgtcgtgtcctgcgtcggaatgcggaagacgactccacgacagataaggaggaagtgcccatgacagatgtagagaagcagcatacgcccaaggcacctgcgacaccggtagttgtgcctcccattacaattacgagctcttaa

SEQ ID NO: 8202 - DNA, 726 bp, A.fumigatus
aaatcaggcatggagatccgcgtctcggtcctcgaatacgtgacgacgcgcatccaagccctccgggcccagcagcagaagctcagggctgccactgcaaccgcgacagcagcgtcggaaactccgtctcagcagcaagctcagatagacgggaaacaagcaaacgcaaacgcagctgcagatgcagcgtcacccgccccctccaccgacaccgagcacatgcctaccactctcgtcccgggctcctatgaaaacatctccgcaatccgcagcaataccatgaaattcttccctaatttcttcgcccgacaccagctttccaagattttcatttgcttcccggacccgcacttcaaggcccgcaagcacaaggcccggattatctccgagacgctcaatgctgagtacgcctacgctctgcggcccggtgggctcttgtataccattaccgatgtggaagagtatcatcattggattctgaggcattttggggtggagttgggagccgaggaggagagtgaggagaagagcaccagtccgaatgcgaatgcgaatgctggggtgagggaactctttgagcgggtttcggaggaggagctggagaaggacgagtgtgtgcgggttatgaaggaggccaccgaggaagggaagaaggtggctcggaataaggggaacaagtacgtggctgtctttcggcgaaagacggatcctgaatggcctgcatga

SEQ ID NO: 8203 - DNA, 324 bp, A.fumigatus
cccttcgattcgaacactccttttgtggaaaaggacgggtttgcgtggtgccttcaatgtcattctcggcgcaccgcgcctcgatgcctgggctgcaagaagcctgtccttgaggacattgtggtcagcgccgtcgggggccaatggcacaatgaatgcttcgtctgtcacgagtgtggcaacggtttcggtccggatggccggtattttgtgcgagagggcgagcccaagcgaacgtctaaaggtcggatcattgggggtccggtccaattggctgtatgtgagcgatgcgagagcatccgactgaaggcatcacccaagtga

SEQ ID NO: 8204 - DNA, 339 bp, A.fumigatus
gacgaaagggctcttggcagctcgcgaacgtcgaccaaggccaagcctgctgcgccaaaagaagaagatgagccaccagtggagacaacatcgaagggggcgtcgctccttagtaaaatgggctggtctgctggctctggactgggtgctcagggtacgggcatgaccgccccgatagccacggaggtgtatgcacagggtgtcggactaggtgcgcaaggaagcaagctgggtgatgcggtcgaagaagcgggacgcaacacacgaaaccggtacgatgagttcctggagaagacgaggcagacagcgcgggagcgatacgaacggttgggcaaatag

SEQ ID NO: 8205 - DNA, 762 bp, A.fumigatus
ctttacagattccttaacacgactgtcctcaagtctcttccttcttcttgcgccaagtttatctcattgtgcatacgccggcataaaattatcaccgtcaacttcacctacccgagtcaaccactcaccactccaccaaaaacacctcagctcaacaccatgctgctctctttcttcaaccggggccccagcccaagcccaaccacagactcaaagaagacatctccagcacaatcccaacaagggtccatcccgggatcaaccgagccccaaacgcaaccacaaccacaagcacaacaaacgcagtcgcaaccacaaaggcccctcacaaacctcaaactcctcttcggcggcgtaacctttttcgccctctcgctgctcatcacccgccgtgccttcactaagcgcgttatcgcctccataccaccctactggacgtcatcggtgtaccaccgcccccccgtcaacggcgcaggagacgccttcgaggccctgagcctcgcgacgctgaatgtgtgttcgtttgcgatgatggctaccgggggtgtgctttatgcgcttgacatcaatagtgtggaggatatgcggcgctatgtgaagaaggggatggggacggggacggtgcgggatgaggaggtggagagggaggtggaggagtgggttgctaaggtgttgggggagaagttcggggtggagctgaagaaggagaaggagaaggagaaagagaaggaagcgggaaatgttgaagggaaaggggagtag

SEQ ID NO: 8206 - DNA, 384 bp, A.fumigatus
gaccctttgaaccagaatccgtttgactttacagattccttaacacgactgtcctcaagtctcttccttcttcttgcgccaagtttatctcattgtgcatacgccggcataaaattatcaccgtcaacttcacctacccgagtcaaccactcaccactccaccaaaaacacctcagctcaacaccatgctgctctctttcttcaaccggggccccagcccaagcccaaccacagactcaaagaagacatctccagcacaatcccaacaagggtccatcccgggatcaaccgagccccaaacgcaaccacaaccacaagcacaacaaacgcagtcgcaaccacaaaggcccctcacaaacctcaaactcctcttcggcggcgtaa

SEQ ID NO: 8207 - DNA, 1890 bp, A.fumigatus
gtgaagacgagacgggagatcaatgcaatgagaacaaattacacgttgtcatgccggtgcatcgagactattctgcacaagagccagccagcaatggataaatcagaactggaccccgaaaaggggtttctgtgttattcagtactgtattggccggagcatgttaggctttcgcaaacggaatttgccatccgggaggagtttaaagatttcttccaaatccagctcgaaacgtggggcaggtggctggattattacagctacctgaaaggaagctcatatagagaattgtgtcctggccttgctcccattcacgttgcagcccactggggaattctccctttaatctcattcttgctcccagcgagcttggaagacaaagattcccgcggccaaaccccgctgcttattgcagcccaggctgttcagattgaagctatgcgtttcctagttgaacgtggctcttatgtgaattctgtgaacaattgtcatgaaaacgccctgcagatcacttgccagaacagtcagtacaacaactgcgcgatgacaaagttcctacttgaccgggggacctctccatatgtctgcgataaagaaaatatgacaccttttctttacgcaattggacaccaaaaagaagacctagcaagggtttttcttcagaacggattctacgtggacttcaggattcgaaggcggtgctggaccgggagaatggtgaacaatagcatttcatatgaagtggaccacagcccagaacaacattcgaacctaggcgtgcaatcaggtttaacggcgcttcatttctctgcccttaatgcttccgcgaaaatggcgaccttactactccaatatggggctgatccaaatgctcgttccgatactggtgacacgccactgcatctggcgattagacccaagctcctcgagcacaagtaccatgatccatggataagtggtgaatacgcagcggagtcgctgagagacttgatcacggattatgaaagtgaggcttatgatgtatacgaatccattgaccgatacagagtacacattattgaggtacttctctccagtgacagtgtcgatgtcaacttagccaacgaccaaggggactatccacagcatgtgattccctttgaaagggactatgcgtcatctattctatgcaaactcgttgcgaaaggcgccgatagttctaggctaaacggggccggccagagctgtcttcaccttgcgagcaaggcaggcaacttggaggttgttcgcaaacttgtaaatggaggccatgacattctgatgccggatatcgatgggttgagcccgtttcactatgcgctacgtggccgttatttacaagtcgtacgtttcatgtctacggcctgtgaaagcctgctttcgaagacttggcgttcacttgaccacttcggcaagaatcctctacaccatcatgtttcgtccatcttctgctcggctgagatgattgattttctcgtacaatgtggctgcaatgtcaacgacgttgatagggagggaaactccgccctcagtctatacatgagttcatcccatctgtatattgatagagagatcttccagctccttctggacaaaggtgccgacccgctctgtgtcaaccaccacaaggagaatctggcacatctcttcatgcactacagggaagaaggcattggaatccttcagattctgttaaagtgtggcgtggatctggcagcaagggatcttgaggggagaactgttatgcatcatggtgccattcctgggtgtgttcgaccaacacctccgagattttcttccagagcacggggttttggaccccaaatttcttggattttcaaaataagaagcccctccaataaccagaggaac

SEQ ID NO: 8208 - DNA, 672 bp, A.fumigatus
gtccttgttggttggatggcatggattatactgacaaactataaacagtctattctttctcacctccccgaacatgtcgactctgagaccgcaaagatcttcgttcttatctatgcgccaggcctgaagcatgcgcctaatcagggtggctcatccaatcctactctctccgtcacctcgtcctattctaacatcgctcctgaggaggccagatcgcctggggaaacactcagtggcgacctgtccactctcgaacctcgcccagctgatgagcaagaaggcgcctcaccatttttccgcactttatacacgcaggcgcaagccattgtcgacaaggagaataccatcatgccatttagcactgcgacgggctacgtgcaccttgtgcgtcacctttcgcccgacattgtctacgttcaggagtccttgacaggcaaacaaggcgatgcggtgcaacacatttctggctgggtcagacaggtcgtggtggtagttggagacgaaggcggccgaggcggcctaatcgacagtgaagacgaatcggtacttgccgagaagggtgagaagtggtggcagaaggaggggatgacgggtattggcaagcgaatcgatgtggttgatgtccatcgcactggtgaagactggcgacggagagtgtctggccacgactga

SEQ ID NO: 8209 - DNA, 228 bp, A.fumigatus
  unsure (125): Identity of nucleotide sequences at the above locations are unknown.
atgtctctgatcctatatctgaggagtgcttccacgcaatatgatatctgggaagcgccggactatccacctgaagtccaggaacagcggcactcaaggtcaatgctctcaagatccaatcccancaaccatcacactgttctccacatatctacgcgccaggggaaagagtttgagattgactctactgtcatttcagttcagactgaatcttcagggaacttctga

SEQ ID NO: 8210 - DNA, 1554 bp, A.fumigatus
gcaccggtcaacgaaagggctaccggtacccgttcgggcttctgggacattcccgggaataacgaacgggatattgaggatgacttccttaacaagttcaaacgccaccaaagccgatatatagtccgccagagcaaaaggctcggtccgagaagggaattccggctactaggtcaaggtgcagcaccacaaaataatcatgctcacaagggggagagccaagtcgacgacgttttcggggacgatgaagatgacgagagcggattttttagtgaaatccagaagcgaacttcagccgaaggacctccccccatcacgcgcaagagcaccagtcaagtcatcgattctattaatgcggtttcggactccatgttcagtaaacaattgccagcagccgcggagttgaacaacagtttggctgtgcccacagcagatggtgaaatcaaaaattttccctcagaagaagatcttgccgcacgatggcaggcggaactttctgatgatgctgacgaaactatgcccaccgaagatgatctggctgcccggtggcaggcggaactcgatgatgatgatgacgacttgctcttggatgatgatacgacgaatgcacaaagaccaccagaggctgccaatatagatcatatgaatgacacttcaatgcttcagagtccattcggtaccccggagaatcttgcgcggcccaaagtgcaaccggtctcctatacaccgcaccagccctctacatcagatttgctctcgggtattcctgcgcaaaatactgcggctcagcccaccaatgcttccatgtcaagttacttttcagcacaggctcctccgaaccctgtgacgactagggcagagagcttcgcagaacgttcgaaggaaggttacaagtcaccttatgacattccagaggatcttgcccggcctcgtcgggccgttgccaacagcagaacagttgttgcacagcccggtaccgtaccgaagccgcctccgcggagcagtagcatacctgcacctcctttgaaggcgtcaacagtttctcctgcaccgcttggaacctcatcgacagccccaacagcacctcagaagaacttcttcgaagagcttccactgccgcctcctaggcccaagtcgcggcctgcgagctctggaaggtatacacctaatgcccctgtgtctgcgccgtcactaccgcagtcgattccccctccagcgaatcagtattcgaacgttccgggagctccccagtccaatatcggacccccagatccaccccagttgcagcagccggaaaggttggacccatactcaaatctattagcgcccaatgtaccaagcgcaccagccgttccaagcactgcgtcgaggtactcgccaaggcctcccggcgtgcaggctggtgttaagccccctccttcgcccagatactctccagccccacctcagtctacgaatgctgtggcagcggcttcctacaaatggttatgccttacaacccgcgagtttcttagggccaggagctggttttcaatttccaaccacgcccaatga

SEQ ID NO: 8211 - DNA, 198 bp, A.fumigatus
agtgtcattcatatgatctatattggcagcctctggtggtctttgtgcattcgtcgtatcatcatccaagagcaagtcgtcatcatcatcatcgagttccgcctgccaccgggcagccagatcatcttcggtgggcatagtttcgtcagcatcatcagaaagttccgcctgccatcgtgcggcaagatcttcttctga

SEQ ID NO: 8212 - DNA, 921 bp, A.fumigatus
aaggaaatttgtctgaaaatggagaatgaggggaaatttggtggcaagaacacggagtttaaggcaagaggggagaatgccctaatccaggttccagacaggctggaccgagtcaggttatggaggttaaaccaagttagagaaatgggggcgatccccggtatcccggaatatcaggaatgggcaagagctcgcaacttttcgatcaaaagggggggcttacgagcttgcgggtacaccctgtccccgcggccggcagcttttccttcgttctccaccggccggtgcacaaccaacccctccgatgacccagcccgcgcccggaaagcagccaaacaccactcaatttgcccccttgccatacaatccggccgctcccgccgcaccagaacccatccagcaccgcgagaagacaccaccaccggtagacgccgcggacggcacaggactcgcagcggcggcggcggcggatcacggcgctccagtgacgcctccttcccagatctcaggaggcggaggaggctatggacctccgccgagtcacgctctgccctactctccccccggaagctacgcatcgcctcccccaagcgctggactcacgcactcgggttccttttcctcccaatcgtccgtgcacagccctccaggagtcccgtcatacaccccctccttcctcgcaggaggcggtccagtgccaccgggaatccagccaggagtaatgtccttcgccccgccccccgtggatccaaacgcacatctgcacgcgcacgggcagagtctctacggctccaatccccaggtccagccccaagttcaatctcaacctcagatccagcctacgtcgcccccgcccccgattggcggctattccaactactcctacgaaccaaccccgcagcccacagcaccgaactatga

SEQ ID NO: 8213 - DNA, 972 bp, A.fumigatus
accaagttagagaaatgggggcgatccccggtatcccggaatatcaggaatgggcaagagctcgcaacttttcgatcaaaagggggggcttacgagcttgcgggtacaccctgtccccgcggccggcagcttttccttcgttctccaccggccggtgcacaaccaacccctccgatgacccagcccgcgcccggaaagcagccaaacaccactcaatttgcccccttgccatacaatccggccgctcccgccgcaccagaacccatccagcaccgcgagaagacaccaccaccggtagacgccgcggacggcacaggactcgcagcggcggcggcggcggatcacggcgctccagtgacgcctccttcccagatctcaggaggcggaggaggctatggacctccgccgagtcacgctctgccctactctccccccggaagctacgcatcgcctcccccaagcgctggactcacgcactcgggttccttttcctcccaatcgtccgtgcacagccctccaggagtcccgtcatacaccccctccttcctcgcaggaggcggtccagtgccaccgggaatccagccaggagtaatgtccttcgccccgccccccgtggatccaaacgcacatctgcacgcgcacgggcagagtctctacggctccaatccccaggtccagccccaagttcaatctcaacctcagatccagcctacgtcgcccccgcccccgattggcggctattccaactactcctacgaaccaaccccgcagcccacagcaccgaactatgactatgccgtgcataagcagctgtaccgacccactgaggcggaggccaattcccatgctcagaagtatgcgcagaaagccatgcagaacccgggacagcggtcgcgaaagtttgaggatggtgcgtctcgggtggagagtagtgtgaataggtttctgaagaaacttgagaagagactctag

SEQ ID NO: 8214 - DNA, 354 bp, A.fumigatus
agcgcatgtccttccatcccggctggtgtaagaccaaacccttatctcactctgtccgcaatgatcgccgctggaatcgatgggatgcggagtcaacagcctctgcggggaggtgactgcgtgacatctgcatcagagctgtccccgggcgaacggcaggccctgggaatcaatacgatcctgccgaagtcactcgatgagagtttgaatgacttggagaagggccttggtttacgcgaactgtgtggccacatgatcatcatcacatatttgatggtcaagcggacggaggcaaagatactgcgccagatggccgaggacgatcgaaggaactggttgatcgcgaggtactga

SEQ ID NO: 8215 - DNA, 1374 bp, A.fumigatus
tgccaatgctcacgaattagctcaagcgctgcgagcgccggtctcatatcgattaatagtaagttcatacgctctcggtctttctctattctgaaactaactgttgtcgaggcactttgcctcatatggtatacgacctctgctactacgaacacatcgtccaaatctatattgaatgctcttcccaaaccgattactctcacgatcgtacagtttgcatttgtttcaatatggtgtctattgttggcgtatctgtcggcggtcttcccctggctgaagagcagtgttccagctctcaggaatggcatacgctacccgtctcgcgatgttattgtaacagccttgcccttggcaatttttcaattggctggacacatactcagctcaatggctacttctcagataccagtatcactggttcacaccatcaagggtctctcgcccctttttaccgttttagcatatcgagtgttctttcgcattcgatatgccaaagccacttatttatctcttgttccgttgaccctaggtgtcatgctcgcctgttctactgggttttcgacaaatttctttggcatcctttgcgcattactagcggcgttggtattcgtctctcaaaatatcttttctaaaaagctcttcaacgaagcttcccgcgcagagtcggagcctcaagcaagcggtcgaaagaagttggataaactaaatctcctctgttattgctcgggcctcgccttcatcctcacgttgccaatttggttcatcagcgaaggttatcgattgatttcagatcttatgcaagatggtgtcatctcgttatcagagaaagacaactctttggatcacggtgcgctcttcattgaattcgtattcaatggaatctcacactttgcgcaaaacattctggcgtttgttctgctatcaatgatatccccagtgtcatattccgttgcttctctggtcaagagagtcttcgtcatcgtcgttgcgatcgtatggtttggcagctccacaactagtttacaagctttcggtatcgcactcaccttcgttgggctgtatctctatgatcgcaatagtcatgacgatgtggcggaccgaagagcaaacgccgatcattttcgcaccaaagaaaccattcttcccttaagtgttcaaacaaagaaaacttgggattcaaatggctatgcctttccgccttcgagaaccggtgaaactcactcgatggacaactctgctgttttggcagcgaactcgaagaaagaagacgacgcattcgatcatgttcggccgaggggaagtagcacgtccaggacttggctaccacctggtacaaaacaagagtcaacttggcaaccaggcgacgctcagtag

SEQ ID NO: 8216 - DNA, 474 bp, A.fumigatus
tggtcaacggacagtgtgtctgtcctgaaggaacggccgaggcgaatgacgggtcttgtcaggctaagacgcagacgatgtgtacgtctggcctggagagtggtgagtccaacccttccggcgacacccttaaccgtcagacaacgtcatgatatgctaacgccgacggctctggtaaaggaaaatgctacaccttcaccgcggagaatggcaaccggctcggcctccgcaacgacggggtgtactacgccgcaccagacagcatggtccagcgctacggcaagttccagctctgcagtgacgagaaatgcacccccggccgcgccatcaacccctccgacaagacctacatcaaggatgtgtacggggatgtggcgacgggcgcgcacgcggggcagtggctcaacaatgcgcagaacggagcgcacattgggcgcactcccacctttgctaacgcgggtcagttcgtgctga

SEQ ID NO: 8217 - DNA, 765 bp, A.fumigatus
acgcgtatgtccaggcgtacggcgagacggaccataatgcgttctacacgaaccagaacatccagaaggcgtaccggcggtatgtcaaggcggtggtgtcgcggtatgcgagctcgccggcggtgtttgcgtgggagctggccaacgagccccgatgcaagggctgtgatcccgatgtgctgtacgaatggatcaagtcgacgagcgagtacatcaagaagctggataagcggcatatggtttgcattggcgatggtatgttcctcctccccagccgactttctccgtccatctcctctaacgacaacactgacaaaatgtgtagagggcttcggcctcgacctcctctccgacggcagctaccccttcacctacgtcgaaggcagcaacttcacgcgcaacctcgccatccccaccatcgactttggaaccttccacctgtacccggacagctggggcacctcccacgaatggggcgatctctgggtacaatcgcacggcgctgcatgcacggccgccggcaagccctgtctgtttgaggagtacggcgttacctccgaccactgcgcgctcgagacgccctggcagaagacctcattgaatacgacggggctgtccggggatttgtactggcagtatggggatacgctgagcacaggaccgtcgccgaatgacggcaataccatttactatgggaccgatgagttccagtgcattgtgaaggatcatgtggcggctatcaaggcgaagcaggggtgggtttag

SEQ ID NO: 8218 - DNA, 276 bp, A.fumigatus
agggcttcggcctcgacctcctctccgacggcagctaccccttcacctacgtcgaaggcagcaacttcacgcgcaacctcgccatccccaccatcgactttggaaccttccacctgtacccggacagctggggcacctcccacgaatggggcgatctctgggtacaatcgcacggcgctgcatgcacggccgccggcaagccctgtctgtttgaggagtacggcgttacctccgaccactgcgcgctcgagacgccctggcagaagacctcattga

SEQ ID NO: 8219 - DNA, 600 bp, A.fumigatus
  unsure (79): Identity of nucleotide sequences at the above locations are unknown.
cacaagacatcccatccagctttagttgaacaatccatcaccatgaagaccctcgctctgactctggctgccctgctcntgcaggcccctcccctccaagccaagatgtatcgccaaaacatcctcaccttcgaggtgagcaacgacgcacgcatcaacggccaaaagattgagtacaacgatccggactgcgaccaaggcatgcaatgcgtcgtgaccaagacctgcgcggcccagggcacgggccccaccctcagcgccgacaagaagcacttcgcctgctgcctggccggccagcgactgctcgggagccccgagacggcgtttgactgctgcgctgacggccacgacctggctggctcggcgcagactggctatcactgctgcccgacggggtattcctttgacggacagcagtgcaagcaggtatgcaagaacggcaggctgatggtcaacggacagtgtgtctgtcctgaaggaacggccgaggcgaatgacgggtcttgtcaggctaagacgcagacgatgtgtacgtctggcctggagagtggtgagtccaacccttccggcgacacccttaaccgtcagacaacgtcatga

SEQ ID NO: 8220 - DNA, 552 bp, A.fumigatus
tatgctaacgccgacggctctggtaaaggaaaatgctacaccttcaccgcggagaatggcaaccggctcggcctccgcaacgacggggtgtactacgccgcaccagacagcatggtccagcgctacggcaagttccagctctgcagtgacgagaaatgcacccccggccgcgccatcaacccctccgacaagacctacatcaaggatgtgtacggggatgtggcgacgggcgcgcacgcggggcagtggctcaacaatgcgcagaacggagcgcacattgggcgcactcccacctttgctaacgcgggtcagttcgtgctgagcaagtggccttgtggcaagtactgtctgggggggtttgcggcgggtatcgggcccgcttgcccggcggagatcccggccatgaccttctactcgcaggatccgcagatgtgtgtgccgtttgagttgaccgaggtgccgtgtgatatcaaggcgaatgtgaataattgtatctggaagaatggggaccagtgctgcaataaggtggactgtacctggcgtcctctttga

SEQ ID NO: 8221 - DNA, 1026 bp, A.fumigatus
cctctcgacgcgtctgctgtttgtctatccaccacagacataactacaaccacaaccaagatgaagttctcctggctcactgtggccagccttctcatgggccaggttgccctggccgcccccagcgcaaagacattcgccagcgcatccggaacgcagttcagcatcgacggcaaaaccggctacttcgccggctccaactcgtactggatcgggttcctgaccaacaacgctgacgtcgacctcgtcttcaaccacatgaaagagtccgggctcaagatcctgcgcgtctggggcttcaacgacgtcaacacggtcccgggaccggggaccgtgtactaccaggtgcacgcgaacgggaaatcgaccatcaacacgggcgcggacggactgcagcggctggactatgtggtgcacgcggcggagcagcacggcatcaagctcgtcatcaactttgtgaataactgggacgactatggcgggatgaacgcgtatgtccaggcgtacggcgagacggaccataatgcgttctacacgaaccagaacatccagaaggcgtaccggcggtatgtcaaggcggtggtgtcgcggtatgcgagctcgccggcggtgtttgcgtgggagctggccaacgagccccgatgcaagggctgtgatcccgatgtgctgtacgaatggatcaagtcgacgagcgagtacatcaagaagctggataagcggcatatggtttgcattggcgatggtatgttcctcctccccagccgactttctccgtccatctcctctaacgacaacactgacaaaatgtgtagagggcttcggcctcgacctcctctccgacggcagctaccccttcacctacgtcgaaggcagcaacttcacgcgcaacctcgccatccccaccatcgactttggaaccttccacctgtacccggacagctggggcacctcccacgaatggggcgatctctgggtacaatcgcacggcgctgcatgcacggccgccggcaagccctgtctgtttga

SEQ ID NO: 8222 - DNA, 1155 bp, A.fumigatus
  unsure (241): Identity of nucleotide sequences at the above locations are unknown.
gttcgacgatgccatgcgatacctcctggtccgcaacactccggccgtgttggcctcgtttaccgccgagatcgactacgccatgtcgaccgtgctgcaggtcccgcccaactcgtggacccgcgtgaagccccggtcgatcatgcccaaggtcgccacgatcctgtccggccgcgcctttgtcggcttgcccctcagccgagagcccgactggatcgagtccaacgtcaattacacgcangacgtctcgcgcgcgtggatggtgctgcgcttctacccgcactggatccggccactggtggccccgttcctgcgcgaggtcaagaccctcgagcagaacaaggcgctcatcgggcgcaagatcgccaaactgctcgccgatcaagagcgcggacgctctcgcccgcccaggagaagatccccggcggcgatatgatcgactggttcaagtcgcggtaccaggcgcagggcaaaacggccacggcgcatcagctcacgcgcgatcaactgctggccacctttgcctcgatctacaacctgtccaatgcgctgacctatgtcatgttcgacctggccgcgaaccccgccgccgtggatgagctgcgcgaggagctcgaccaggtcctgggccccaacgtcggcgccgagagcatcgacaagaccgccctcccgcgcctgatcaagctggacagcttcgtgcgggagtcgcagcggctgagcccaacctcgctggtcaacatcccccgcatcgtcaccgatccaaacggcctccgactgaagaccggccatgtgattcccccgggctacctggtgatggtgcgcgcgcagcccatcaaccagagtcccactctgtatccgaatccggagcggttcgacgcctttcggttcgctcgtctgcgccagcagggcggcgccaatgagaaccgctggcagcatacctcgacgggggccgataatatcaacttcggccatggcatctgggcctgtccggggcggttctttgccagtgccgagattaaggtggtggtggcgtatgtcattcgtcactatgatctacggctgatcgagggacggcctcatccgaagcccaagtatggtggattggccatcttcccggatgcgggggcggaggtggagttgaagccacgagtatag

SEQ ID NO: 8223 - DNA, 717 bp, A.fumigatus
cccatcgctgtccagcacccatatccgtgtgccagaaactgcgactgcatcatgactgtcctccccgactccgaaaacggctacctcctcaactacgaggatcaggagaagagacgcatgaacatgcaacatgacctgatcaaaacctacatgggtaaactgatcctggctcctctgccgttcgaccaacccaatctgcgagtcctcgacagcgggaccttcaacggtaagtcaccgctgtgtcgattcgatcccctcgagactaataggcgcaggcctctggctcgaagacgcctcgaccctcctccagtcccccacgctcgtcggcaccgacgtctccccaaccgccttcccagccaagcgccccccgaacaccgagttccacgtgcagtccatctcagacccctggcccaccgaatggcgcgactcgttcgacctcgtccaccagaaactggtgattgcatgcgtgcccccagacgaaggccggcaggcgctgtaccgactcatcgacctcgccaagcccggcaccggctgggtgcaattcaccgaacgcagtctaaagcatctgaccccggagcatcggaagcaataccctgttctcgcgcgcttccattcgctggtggcggagatgctgcctcatttccgcgggaacccccggccgggggaactggtgcgccactggttggacgaatatggactgccagaagtgccagataa

SEQ ID NO: 8224 - DNA, 621 bp, A.fumigatus
  unsure (426): Identity of nucleotide sequences at the above locations are unknown.
agctcacagtcgcagtatccagacacgccgttcgcactgggagtgcccggacagcagttagtggtgcttcctgtctctgagatcgacaccgtcaaggccctgcccgagaaccagctctccatcaagaagcaccattacaaccagttcctcggcgaatactcgtacatgggcaccaaggccgatgagttcgacgatgccatgcgatacctcctggtccgcaacactccggccgtgttggcctcgtttaccgccgagatcgactacgccatgtcgaccgtgctgcaggtcccgcccaactcgtggacccgcgtgaagccccggtcgatcatgcccaaggtcgccacgatcctgtccggccgcgcctttgtcggcttgcccctcagccgagagcccgactggatcgagtccaacgtcaattacacgcangacgtctcgcgcgcgtggatggtgctgcgcttctacccgcactggatccggccactggtggccccgttcctgcgcgaggtcaagaccctcgagcagaacaaggcgctcatcgggcgcaagatcgccaaactgctcgccgatcaagagcgcggacgctctcgcccgcccaggagaagatccccggcggcgatatga

SEQ ID NO: 8225 - DNA, 186 bp, A.fumigatus
acctcgtacaaggctattcgacaagtgaacgaaacactgtcgcactactgtacctctcctgagggtatgaccagactggagcacgagcagagttccccaaagggtgacactacttacctacttatagtgggatcgatcaaacaagtacacatgaaatcagtgtcaggacgttccttggatcagtag

SEQ ID NO: 8226 - DNA, 231 bp, A.fumigatus
tccaggagccccgggttcatcatgcgacaaaagctgttgggcttcctgctgatcatccgaagcgctttctacgtcttcttcgtctccctcatcctcttcatcctccccctcatcctcgtctccctcttcgtcttcatcatccgtctcttcttcagtctcctcttcctcggagtctgtcacttcttctccggaatctgtctcctcttcctccgtctccgactcctcctctag

SEQ ID NO: 8227 - DNA, 1344 bp, A.fumigatus
aatggttcgcatagcacgggtgtgatcattcacgagctggaacatttctcaaacggtgcggatgaagaccttgtccgtgagagtgttcgcgcccttgggcgttgcgcgcagaatgaccccagcactgcgaaatattgcttagttgttctactccgtcagataaccagccttgatgagactctagtatcagagtctttgaccgtgattaggcatctcattcaacaagacccggcttctcatgaacaaacagttatccggcttgtgaagcatctcggttcgtccagtagcccagaggcaagagcgaccataatatggcttgttggagaattcgcgggagtagatcccaagaggaatattgcaccagatgttctgcgaattttggtacaaaaattcgccgatgagccagagcctgtgaaacaacagattgttctgttaggtgccaaggtatatctccaccatctgctacgaaatcctccaaagcagcctacagaggatccgtcggtatcggaacccaaaatcaaccaggaacataacgagtgggcggatgacgccgctaaggaatcagaagtcaacgacaacaataaagaagatcagcgaaaagaagaaccgaaaggagaccaaattactctcctttggcgatatattctccttcttgctcgatacgattcctcctacgaccttcgtgaccgggccagaatgttaaaagcgctgttggccgacccttcttccaccgagctcgcgaatctcatcttgctcgcacgtaagcctgttccacatgccccaagcccatcggaaacgcggaaggaattacttctgggctcatccactcttatcgtggggcccgacgcaggtccttttgggctgagtggctatcacaatcttcctgactgggttgaactcggacaagagccggatcccagcctgcgagaatcagagatgaagccggatgtgaccgaaagagcgactatgactgcaggcggaaagcttgaccgggctctgatggaacacgagagcagggttgcagccatgaaacggcaacaaaacggccacgtgagagcaggtgcttccgcggcgaagactaaaacgcttgatcagtggctagaggaggagtcggagacggaggaagaggagacagattccggagaagaagtgacagactccgaggaagaggagactgaagaagagacggatgatgaagacgaagagggagacgaggatgagggggaggatgaagaggatgagggagacgaagaagacgtagaaagcgcttcggatgatcagcaggaagcccaacagcttttgtcgcatgatgaacccggggctcctggatcacgcggcttctag

SEQ ID NO: 8228 - DNA, 195 bp, A.fumigatus
aataaaaatataccactctggatggtgccctacgtgcgctatggcatggatcctcagttgctggttgcacagagtcagggcaaggcattcaggcacgagaatctcacgtggcagactaagcttccctgggacatggtggttgccttgaagcaagcggtatcctggggcagaatgaatattgactccgtgcgttga

SEQ ID NO: 8229 - DNA, 351 bp, A.fumigatus
gtagtttcgttggctggcggacagggagctggtgcggggctgaccacggttgcttgtgaacagctcctcgacatatgcgtcaagaactgcggttatccgttccacctccaaatcagtacaaaggagtttctcaatgagttggttcgtcgttttccagaaagaccgccaatgcggccctcccgggtgcagcaccggatcctggagtcgattgaagaatggcggcagactatatgccagacgtcgcggtacaaggaggatctgggccatattcgcgacatgcaccgtctgctgttatacaagggctacatgtttcctgagatccgtcatgaagatgccgcggtcctgatcttc

SEQ ID NO: 8230 - DNA, 501 bp, A.fumigatus
aagaccgcattgatgatcttatcaaattcctcatcgtcgctaactgctgatccggactcggcatctgaatcttctaatggcgtcggatccggtcgggcaatcttctcgggttgcggcttgtccgggacggaaggattctggaaggatttcgaattgaggattttggcgcggatctcggccatttgggcctcgtcttcggagtcatctgagatggcgtacgggtctcgttcttcctccgcttcttcctcatcctcgccctcgccctcactctgctcatccttctcctcgtcttctgcgtcggattccgccgatgcagctcgtctgtttgtatttcctactgtccacatatcgtcggcaccgccctctgcgcgattttcctcgtactcccgctcaatcttggccaaccactcttcctctgccttcttgatgtcctcttccgtcgcacaggcagcgtatcgtttcaacagtgccgaattgatctcgaggaaagcttcgccgtaa

SEQ ID NO: 8231 - DNA, 852 bp, A.fumigatus
cttttcaggccaaatgcaaagaagattctttccccggccgatcgtgaactattagagcagttcggagctgcagtggtagagtgttcctgggtgagggtcaaggaggtcccttggtcgcgaattggtggccggtgcgaacgactgtgtaagtgctttgttcccaatcgcatctacgttttcttgcaggacaaagagctgatgatttctcgatatacagtaccgtaccttattgcagccaacacagtgaattatggacgaccgtggcggttaaactgcgtcgaagcgttggccgcctgcttctgcatctgcgggcatgaagactgggcgcgagaggtgctcaagcacttcaattacggcgaagctttcctcgagatcaattcggcactgttgaaacgatacgctgcctgtgcgacggaagaggacatcaagaaggcagaggaagagtggttggccaagattgagcgggagtacgaggaaaatcgcgcagagggcggtgccgacgatatgtggacagtaggaaatacaaacagacgagctgcatcggcggaatccgacgcagaagacgaggagaaggatgagcagagtgagggcgagggcgaggatgaggaagaagcggaggaagaacgagacccgtacgccatctcagatgactccgaagacgaggcccaaatggccgagatccgcgccaaaatcctcaattcgaaatccttccagaatccttccgtcccggacaagccgcaacccgagaagattgcccgaccggatccgacgccattagaagattcagatgccgagtccggatcagcagttagcgacgatgaggaatttgataagatcatcaatgcggtcttc

SEQ ID NO: 8232 - DNA, 270 bp, A.fumigatus
acaaagctaacgcaaagaatggtccgtcacaagaaagacaacttctcgcgaggaggcaagaaattctcctccaacccccgcccacggccacgcccagtaccccgcgatgacgacgatggttcggctacgaacaggcctgccttcaaggccgcctgctgggatttaggacactgcgatccgaagcgatgctctggaaagaggctgatgcactttgggttgatgcgagaactggcgatcggtcagaagtttgccggggtggtgatctcgtag

SEQ ID NO: 8233 - DNA, 459 bp, A.fumigatus
ggagttatcgaagatctcgtagccctgaggtatgtatttttggctcacaatggtaatttggttatcattgtcctaacttcacaactctcacagagacgatatcgcgatcgcgaccgtgattcataccggcgacgtgaccgctccgtagacagacgcgacgatcatcgggatgaagatagctatcgatcaagccggagagatcgttctcgcgatcgacgtcgatcaagagatagaggtgatgaccgggatcatcgccgaaaaagtcgcgagagagattatcgaagcaggcgagatgattcccgcgaccgggcccggaggcgaacagacgattctgctgacttgaagcacaagtctagacgggacgatagtcggacgaggaatctggattccaagccgcgagaggtaagtccgactcataatgtttttgaaattatctataaacctgatgctaataagtga

SEQ ID NO: 8234 - DNA, 702 bp, A.fumigatus
gcctcgaagccatccacccctgcgcccacggctccaaccgaggacgagaaaagagcggaaagactggcgaaattagaagcctggaagcaaaagcaggctgctgagagagaacggaagcagcgcgaggccgctgcagctggtggagcaagaagcattctggaagagatagacagaaaatcgggtctgtcaccggctgttggctctccgcaatctccagcgacgcctaccacagatgccactcctactccatattccggcaaatttgacccgaaggctattgtacgaaatgcggcaccggccccaagtacacctgctgtgcttggtaacgatgttgccgttcctcagtctgccaaagcgtccgcttcctcatcctccatgaataatcatgtacaagctaacaaacctccagccgccaacagcactacatcatgtaagttatacattcccaccataagatttcttcaaattgctaatgttacttgtacagctacgtcgacagtaaaacgaaatgttggcggtttcgggttaggcgccaagcaagttgcagatgccgagaagtcatcagcagttaagactctcggttttggcgaagaggaatccaagcgaaagaaattggagcgtttaccgacccctccactagaagacgcaaaagatgacatgggggctgtgggtcttcaccaggggctgaaagagcgctctatg

SEQ ID NO: 8235 - DNA, 222 bp, A.fumigatus
aagcatacatccaaaatgagtagcaacaagccgtatgttatcaaaggcatccctgtcgacgccggccagatcattccagttcgtcgggacattgatgagtggtatgaagacaccagccgacagagcagaattcagctgtccatctttatatgggcgctacgtgagttccaatccatcgactacaaagatcgactttcctacttccaaattgcaggtctgtga

SEQ ID NO: 8236 - DNA, 294 bp, A.fumigatus
agacagtatctgcgctttgaccccgtcaatgggacttgcggcgagtacatgggctcatacatgtcgaatctgggcgggtaccttgcagacgagatggcgactgcgaactgcagcttctgcccgatcaaggagacgaatgtgttcctcggtagagtttcgtcgagttactcggatatctggaggaactttgggctcatgtgggtatttattgttttcaatatctttgcagcttgttcgctgtactggtgggttcgtgttccacgagacaagaagccagttgcaaaggccgagtga

SEQ ID NO: 8237 - DNA, 240 bp, A.fumigatus
tgcactgatgaagcgcccaacaaccagggtaaatctgatgatcttgctgggttgctggtctactttatcttaggtggtggagcaataccaacaattgctgcaagtaccgtttgcatcctgatgttgttcctaaggtttaatgtcccagcgggatatatctgttatgatctcacgtctttccggcttgttgctctggtggcaattgtgacagtgctctgccatttttcagtccaactgtaa

SEQ ID NO: 8238 - DNA, 1992 bp, A.fumigatus
aaccgtccgagctcgcgttcctccatgtcgcgtctgcagacagggaagactgaattccctaagccgacaccggcccgggccgagaaacaacggacctctcccgacaggactcaattgatggctcagtttgtggacgtcgggcgtaagttaatgcgccgaatggaggagctggcttccaaggatgagagacgggataaaacaccagcttttgttggcaaagatgccagatctgcggttgaccgagaccgttctgagagaatggcagaagcctcgcgatcaaaaacacggtccggggctgcccatgccgccagctccacagcctcggatgaacacagtgaaggatctactacatcctcacaggaggacgcgcacaactctttcgagaaaagggaggtacccccagaaatgctgtatagaccatcactctccgatttgctgcgcgatgcttcgacattcaatatgtatcgtcagcgcgcaatcgctcggcgcattctgacgcaatggttgaagaaggcggttcagacgcagcagactcaccgaaatatggaggtagtcgcggtcaatcgcgacaggattaccctcctacggcaagcttttgagacgtggcgtacaattgtccaaggtaaacgccgggctgctcagacagagaaatttttcaaacatctcgaagagcgtgctggacgcgccagggatctctaccttatgaccaaagctttcacacattgggcgcaaatcgcctctgacgaagttgcaaaaacgtcagctgcccgacggcatattcttcgtgttaagtatttcaacgcctggcgtgaaatcacagccgtaaacgagctgaaagctcagcgattcgcgctacaaagaccctttaatgcctggcgaagcaaggcccgagaagcgaaggaaatggagcaaagagcagtggctgtccataacaaaaaactgtcacatgcggtctactggcaatggttctggagtttctgtgatcggcgggcgccccagtggtacgatcatcgcctcaagcgacgttccttgctttactggctgcgaaagttccgcatgaatagggagcgtattcaagagatagacgcgaagaataagcatactgcgactgcgacagcttgtcagctatggcatcagagatctcaagctattgtcgctgcagaaaaagacgctatatctatgaatcgcaggcaagtcctgcaggaaaaactcgaggaatggagagtcgaggctcgattacgcccaattgcttctcgtgtctccgcgacgatagatagaaatattacccaaacggcattctcgcagtgggccagacggctccgaatgctcagagaagcaaaagaagtggatcgactgagggttatgcgcaatgcttggaccgcttggaatgatctgcttcgatgtcaggctctgactgcgcggatagaagagcgcatgaagatagaaatcatgtacaaatggatccttgcggaacggtttcgactgatgcaaaggattcgcgatcaacgaatcactcgcgatgtgttcgctaggtttgtgacaaacgtgcgtgacacatatacacgtttgttgcagcatgccgatgtacatgaggagtaccgcaacgaagaactcctccgatcaaaattcaactgctggcgggaacagcttgcgcttcagcggcaacgcgaagtggctgcggctgaattctatgcaccacgccttcagcaggaatcgctcgtggcctggcactcgaaacaccaacatacgacgaaattggagaggtgggctcgcgacgcacggttttacttcctagcaacccgaacgatcaaaaagtggcacaaggctacattggactctgccaagcgacgccgtcaggaggcctatgccaaaatgcggcgaaggatcaagatcaatcttgccctcaaagcgctaacgcactggcattcgagagctcagcacgtagcacgactcgagttttttcttaggagcacgcccctccgcgaatatatt

SEQ ID NO: 8239 - DNA, 285 bp, A.fumigatus
gaagctagcctgtatgcgaaaatccaaaagtgtgagttcattgtccctgaaaccaagttcctaggcattatcattggccaggatagcatccgcatggaccctgataaggtgaaaataattgtcaactggcaagttctaacctgcgttgctgatgctcaggcctttattggttattggttttggcaacttttaccggcgatttatcaaggatttctcaagaattattgctcccttagtgaacctgactgggaaggatgtcctatttatgtggaccacaacctataa

SEQ ID NO: 8240 - DNA, 234 bp, A.fumigatus
  unsure (105): Identity of nucleotide sequences at the above locations are unknown.
ggaagctatctgtactaccatgaacacttatacatccctaaccatgataagctaagagcccagttattacaagaatgccacgacaagcctgctgctggacacctnggaaagcataagttgtatgagttgatagcacgagaatattactggccgggcatgtaccgatatgttgatcgctggacccgaaactgccacacctgctgccgatccaccctgtcttgtgaagcccgttaa

SEQ ID NO: 8241 - DNA, 273 bp, A.fumigatus
cctgcgttgctgatgctcaggcctttattggttattggttttggcaacttttaccggcgatttatcaaggatttctcaagaattattgctcccttagtgaacctgactgggaaggatgtcctatttatgtggaccacaacctataaattaagttttgaagccctgaagaaggcgtttgtaaacgccccaatcttgaaaccattcaactggataaaagacgtcgtggttaagaccaactcttctaattacatgtctgctggtgtgatgtcctag

SEQ ID NO: 8242 - DNA, 219 bp, A.fumigatus
tatgacaatgaaggagtcctgcaccctgttacattcttctctaagaagctctcagtcactgagtgtaactacgagatctatgataaagagttgctcaccatcattcactgtttcgaggaatggcgccctaaactagagggtacaccatcaccgatcaaagttataactgatcaccgcaacctagaatatttcatgtctaccaagctgctcaacagataa

SEQ ID NO: 8243 - DNA, 222 bp, A.fumigatus
caagcctgctggtccgaattcctgtcccgcttcaactttaaaattatatatcgacccgggaagcaaggagttaagcctgatgctctgaccaggaggtcagaagatctccctaaagagggggatgaacggctacaacaccagagccagataattctgaagaaaaagaaccttgaccctgaaattcagaactcagtgaaactagaagccatcacgaggagctag

SEQ ID NO: 8244 - DNA, 504 bp, A.fumigatus
gcattccactgcagcatgaatgtgcataatgagccactctggcagtggccttccagcgtcccttctaatacttcgttgaactcggagtcaagccagtcacctcaaaaaccttaccagtccagtgacgaaaatccgactactgaatgccccgagtctcccaggaagcactatcccaatcggacttgtcgcatctgcttggaatcagtccctcctaccttctaccccccttcagaaaacttgccaggcttccttcagcccaagccgcgagttgtctatgagtcttctgacccagagcttggccgactgcttcgaccgtgcaaatgcaaaggttcttcgcgttacgttcacgagggatgccttcagtcctggcgccatgcaaatcctagttatggaaaaagacactactggcagtggccaacctgcgggtttcagtacaggttagaacgtctgaaatgggcgcactggatcagtagtgcatctaccccaaatcgtattaacttttga

SEQ ID NO: 8245 - DNA, 843 bp, A.fumigatus
tactgtgacctcaccatggaggaccaacgccgagacaatcgcatcgcccgccgagatgaacacatccctcagagtgaaggtcgtgggaacaacactcatcccctcccttctgagaatcctcaatctcatgaactagacagctacactgaggcctgtcgtgaccttgagaagcagctaaaagcccagatcaacctcattaagagacaccttggtgccgtgggcatgtcccagagcttggacgcgtcttctcagactgtccaagttggtccgtctgacgccatgcagggccagccgattgcctctgagtctgctgcccccattacacctactaaaaccctctcggcttctgcgttgaccagcggccacgctcacattcacactccgaacattggcaacagtgaggttcctgttgtgaatcaaggtctcgttagtcctgctgtctcgacttccagtgctgcaacgacctgtgaggccttccctgactactacgagtcctgcgagaagaatcctcccatcgttgacaaagcgcacgaagcagcttacaattacgctatctccaaggttgtcgaggaggcaactcgtttcaaaaagattgacaccaacgtcaccaatcctcctgtgctcaacgcagctactgatcctgttgtgaagggcagatctgccaccccgagcgcaaagaaagctctcgggacctttcagacatccaagcactcttccaccgtacccatgcccccaatccgcccttccctcactgagaccgagatcgcggaaagaaagacgaagctgcttgcagagatgaaggcgtttattgtcttcaccaccgggcgctggaaggacacgagt

SEQ ID NO: 8246 - DNA, 201 bp, A.fumigatus
ggtgactggcttgactccgagttcaacgaagtattagaagggacgctggaaggccactgccagagtggctcattatgcacattcatgctgcagtggaatgctcagaagctcaagtcacaacatattaaccaaatctaccagagatatggcgcgagagcatccagcgatagctcagatgatagaaatacaagggtgtcgtag

SEQ ID NO: 8247 - DNA, 498 bp, A.fumigatus
  unsure (458): Identity of nucleotide sequences at the above locations are unknown.
attctcctggctcagggtataaatacggcgcaaagagccattgatcgccccctatgtagccttcagacttctcgaaccaacatggactccaaaagaggcgtcgtggccgcggtgctggccttgcttcctctcgtttctgcgcaacaacccgccgcgagttctgctggtaaccccaagctgacgacatacaaatgtaccactgctggcggctgtgttgcgcaggatacatctgtagttctagattggggctaccactggatccacacggtcgatgggtatacatcatgcaccacatcgtccggagtcgacagcaccctgtgtcctgatgcggccacctgcgcgaagaactgtgtgatcgagccggccaactacaccagcgccggtgtgaccacctcgggtgactctctgacgatgtaccaatatgttcagagcaacggcgtatataccaacgcctcgcntcgcttatacatgtcatcaagccggccatgtagactggat

SEQ ID NO: 8248 - DNA, 186 bp, A.fumigatus
tccttttatttttttttttccttctcttatatctccggggattataggctaagctgtaatatgatctatgcaaagaacagcgcatgtcttatccacctgtcgtcgagtcttaaagagagaagtctttacgccttctactaccctcaaatggcagtaactaatgagcgtatatttcctctgcattga

SEQ ID NO: 8249 - DNA, 228 bp, A.fumigatus
agagacgccacctctcttttctgccacaccatggcgtcggacttacaaccacccaacgatcgtaagcgggttaaggtctacgagctgagggataatgactggttcgaccgagggactgggttctgtatgggacagattctcgacgtaagtccccgttgccgctcgcccagtcagcgcaaaaagcatcgcccattatcggcgcgaaagctgcacctggcctcacgctga

SEQ ID NO: 8250 - DNA, 351 bp, A.fumigatus
ttatgtccgttattagacgatgccttgtccgacgacctcgaaagctatcagtcaatcatgctacctccgcctgaacttgggaatcttccggacatcgatcacatcatgagggcggccagcatcactcaaggcggtcgcgacgcgctctctaaatttgtcattagagacgagtacatcccgaagctgatacctttagtcactgtcgcagaagatctggagagtcttccggatttgcatcgactttgcaacataatgaaatcgcttattctactcaatgacaacactattattgagacggtcgtcaccgatgatattatcctgggggtggtcggggcattagaatgtgcgtga

SEQ ID NO: 8251 - DNA, 216 bp, A.fumigatus
ttcatcccagatgatcccgaatttcccacccacaaggccaatcatcgacaatatctcgcagatcagagccgttacaaggaagtcgtccccatcaaggatcccatcattcgccgcaagattcgctacacatggcgcctacagtatctgaaagatgtggtgttggctcgaatgtcttcaccacggggctggaaggatccgcggtggcgctatgtatca

SEQ ID NO: 8252 - DNA, 1470 bp, A.fumigatus
  unsure (174): Identity of nucleotide sequences at the above locations are unknown.
ttgttgtacttcaaagatccagtctttcccgcccctgcagacgcctttaaagggttcgatcaaggccaacaccacggaatggcgaatccaatgggtctggacagcgaagacgaaccgaggcgagggacatccagagcaaatagtgtccggttcgatgaaagtgctattcatggntactacgggcaagccagccgatctaccagcgagctgccgctgaggactgggagcggcatgggaagccatccactcaccgaacgctcactgtcccaccggtctgatggccgacagagctcttcagggcattcacatcactcggctcggacgaatagtttagggctggagacgacgagtcgcttaatgggctccttcgtcggcggctctcctctgatacccccgccgggtatattcttcataggccctgtgcggtgtgtcattcgatgttggttgacgacaaatttctcacatgactcgcttctgtatgctgctgtctgttcaggatcgtatgcgtcgatacttgggtatccgatggtgcagaaactcggcttggaagatcttgtaacccatgaggatggcgtacggttcatcaagcttccgatgtatcttccggaggccagcgttcaccaggcctcatctcgtcccaacagccccgttccacagcttcccaccctgactatccgctttcttgttcgggacatggatcccaacgatccttccattcagattatcctcggaagcgatgttcttcgctctcataatgcggacattttgttctctcaggacaagatcatcatggtagatgacgagaggaataagatttccattcccctagtgcggccggaggatgactctgtgttcaagtctctctgcactgcatcggattgcactcgcgttgaacgctcgacaagacatgctttggaaaaggggccgacagaagtgagcggcgactccgcagttggggccattggggagctgagccgatcgcgacgatcaacctctgcgtccaccaccgcaagggcatccaccgaagagctagatgaaagtcgaaagacccattcatcgggttctcacgacgtgtctcctgtcgctgaaggtcaggaagattcaggcaagtccacctctgccatcgactttcaggcccacgagaccgccaagcctgaaaccgcaggtgtctggggtgcatggagacgggagatgaaaatcgacccggcatcgtccggcgcgagcaagccgtctcggggccgtacgatgaaagttctacggccgaccaagtcttctacacgggtgccaacagcgtcaagcggcctcggcactgacgccgcagcgtctcctcaaccaacgtcctcccgagcatcctcagacgaaagccgggctggcaaacagttggctccgaatccgatcggcggggcttctgcgtttggctggcttaattcatcccagccgcctaaacgcgttgtaacaatgcctaaataa

SEQ ID NO: 8253 - DNA, 465 bp, A.fumigatus
ccatgtccattcgtacacacatccagacacgatcggaaaagaaaaagaagagatcaaatcttcgaaaatacctccatcgcctccctcgtctcctccttcgcctccctcaccaacccactaacagccttgaactccgccctgcccgcatctcccaatatctcaaacaaaatcccctcactactcgtcacaaccgccccagcatcccgtagccgcgcaagcgccacccccctctcctccttattcatgctactcaccccatcaacaatcacatacaccctatgcccgcgctccagcaaatccagcgtcgtctgcgtaatacagatatgcgtctcgatccccacgatgataacatccaggggcgtctccccgcccttcacgttcggcagcagcgcatcgagctccggcgtaatcatcgagaaaagtgtcttatcgatgttggcgcgcacaagcggggtggagaggtag

SEQ ID NO: 8254 - DNA, 513 bp, A.fumigatus
accaccaagctcctcaaagcctcctcggcactcaacatccccatctacgtgaccacgcaaaaccgcccacgactaggcgatatcgtctccgaactccaaccctacctctccaccccgcttgtgcgcgccaacatcgataagacacttttctcgatgattacgccggagctcgatgcgctgctgccgaacgtgaagggcggggagacgcccctggatgttatcatcgtggggatcgagacgcatatctgtattacgcagacgacgctggatttgctggagcgcgggcatagggtgtatgtgattgttgatggggtgagtagcatgaataaggaggagaggggggtggcgcttgcgcggctacgggatgctggggcggttgtgacgagtagtgaggggattttgtttgagatattgggagatgcgggcagggcggagttcaaggctgttagtgggttggtgagggaggcgaaggaggagacgagggaggcgatggaggtattttcgaagatttga

SEQ ID NO: 8255 - DNA, 408 bp, A.fumigatus
gatgggttgacactgtcaagacttcctgctccaacgagctccctccccaggactccgactggtacgattgatatgaattgtcccgtgaccgaccaccatctaacggctgatgattgcaggtactacgtccgcgccgctgccgttgcccgtcacatctacatgcgcaagaccgtcggtgtcggccgcctgcgcaaggtccacggctcgaccaagaaccgtggctcccgccccaaccaccacgtcgatgcctctggctccgtcgaccgcaagatcatccagtctctcgagaagatcggtgtccttgagtacgatgaggagaagggtggtcgccgcattacccaggccggccagcgggatcttgaccggattgccaagaccaccgttgacgaggaggaggacgaggagtaa

SEQ ID NO: 8256 - DNA, 465 bp, A.fumigatus
aaaaagtttcattcctctcccgctgaatccatagtgtatcaaaccaactcatccatgttgccgacttgtatgttacttgaccggttcaactcaaagccacccagctttccttcttgtaacaacatgggggaattgtttctagataaggaaaacaccgagaggttcaagatgaagacatcagggactttttattgttttagtaggagactaatttactcctcgtcctcctcctcgtcaacggtggtcttggcaatccggtcaagatcccgctggccggcctgggtaatgcggcgaccacccttctcctcatcgtactcaaggacaccgatcttctcgagagactggatgatcttgcggtcgacggagccagaggcatcgacgtggtggttggggcgggagccacggttcttggtcgagccgtggaccttgcgcaggcggccgacaccgacggtcttgcgcatgtag

SEQ ID NO: 8257 - DNA, 1296 bp, A.fumigatus
caggcccggggtcttcgtacgcgaggtacaatgaacgaaaatgacgagaacgggccgtcgacgcgtctgacacgggcaaaggccgctgctctgtctgcaggagatgttccaacaaccactgcggctgccaaaaagccccttcagagcaagaaggccgccaccaattcgacgacaacgggaacacaaagaagacgtgctgcgcttggagatgtcagcaatgttacaaaatcggaaaacggcgaggccaaggaaacgaagaaagccgcgtctggcaaggtcggcttaacgtcgaaagctaccatgcagactggcggtattcaaaagctgagccggaccaactcatcgcgtaccgccttgggtgccaaagataacgcgaagaaggagaagcctgcggttgagggaaagcgtcccggaagtggctctggtatcggcagcacacaaatgaaacggacgtccagccagaaatcggtacaggagaagtccctgcaggttgaggaaccgccgcgcaagaaagtcgaagtcgagaagaagaccaccgagaagaagacaacagtggaggtctctacagcgaaggaagatgctgtgattgccactgagcccgaagtcgccaagaagcctgatgacgtagtcgacgacctggacactgaagatttggacgatcctctgatggccgctgaatatgtagtggagatctttgactacctcagggacctggagttggagacattgcccaaccctcactacattgatcaccaacccgacctcgagtggaagatgcgtggcattcttgtcgactggctgattgaagttcacacacgcttccgtctcctcgccgagacactttttctcgctgtgaacatcatcgaccgtttcctttccgctgaagtcgtcgcccttgatcgccttcaattggtcggagttgcagccatgttcattgcttccaaatatgaggaagttctttcaccccatgtggccaacttcagtcacgttgcagacgaaacatttacagacaaggagattcttgatgccgaacgccacatcctagccactctcgagtacaacatgagctatcccaaccccatgaacttcctccgtcgtatttcgaaggcagacaattatgacattcagactcgtaccctcggcaagtacctcatggagattagccttttggatcaccgcttcatgtgctatcctcaaagccacgtcgccgcagccgcgatgtaccttgctcggctgatcctggaacgtggggcttgggtaaggaccctcgcacttgtgaggcagagtgacttgtaa

SEQ ID NO: 8258 - DNA, 384 bp, A.fumigatus
cagacatttcatagatcgactgtacaaactcatacttcaaacataggtcaattgaatcccagactcatcaatcatcgggtccctcattatcaattccagcctatcatccattcaatctccaaacaaccccgcaaacaccatcccaccagcccacaaatccaccaactaacaacacacacccaccagcttcaaccacaacgtcgagcccatccgcaaggcaaaaatgtcctggttccagaaaacgttcacccttcccccccgctcccgcggctcgtacctcataaccgacgaagtcctctcccaacttcccgaaatccgcaactacaaagtgggcatgctcaacctctttgtccagcacaccagctgcgcgctctcgctgaatga

SEQ ID NO: 8259 - DNA, 558 bp, A.fumigatus
caacacacacccaccagcttcaaccacaacgtcgagcccatccgcaaggcaaaaatgtcctggttccagaaaacgttcacccttcccccccgctcccgcggctcgtacctcataaccgacgaagtcctctcccaacttcccgaaatccgcaactacaaagtgggcatgctcaacctctttgtccagcacaccagctgcgcgctctcgctgaatgagaactgggacgaggatgtgcgtgccgatatgagcgatgcgttggataggattgtgccgactgaccgcaaggggaatctctatcggcattcggcggagggggaggatgatatgccggtatgctctttgtcatttttcgttcgctgtttgcgaattgcgttacgggaatggagaatggggctgacgagtggtgcaggctcatatcaagtccgctcttgtgggggcgtcggtcaatattcccatcacgaatgggcggttggccactggtacgtggcaggggatttggtatttggagtttcggacgagtcggcacacgcgcaaggttgttgcgacgattcagggtga

SEQ ID NO: 8260 - DNA, 618 bp, A.fumigatus
acctggttctaccaaaaaggatggtgccgagttcatcggcatcgagaccggtcacgattagtgagtaaatggaattctcgaagtgatcgatcggaggagttaacagagtttagtgactgggagagagtgatcatcattcactcaagagacgcaaacaacatgtgggcgccgacccgtgcctttctctttgcgcacagtggctaccatgatcttgcatggggagacatccagaacacgcttaccaccgacgagatcaatgccggagacgctaaaaatccgaacggtgtacagaacaatgaccatccaaaggtttatgttgcttggtctaagcacgctcactttgatgaccgcaataccggctggaacgatcccatcagtcagtcaacggataatgcattccgcagcgatgactggtggtattatgttgacaagagctattatgtgagttttcatgtgttcttcacagcaggtttagagttattgacaggcattagattctatcagatgataccaccgctgctggcaaagctctcgggtctgcgaactggggcgatgcgactagtaaccctccttctgtgcatgcaagtgtgtgctctgcgccatgatggcagtaaatga

SEQ ID NO: 8261 - DNA, 270 bp, A.fumigatus
atcgactgtacaaactcatacttcaaacataggtcaattgaatcccagactcatcaatcatcgggtccctcattatcaattccagcctatcatccattcaatctccaaacaaccccgcaaacaccatcccaccagcccacaaatccaccaactaacaacacacacccaccagcttcaaccacaacgtcgagcccatccgcaaggcaaaaatgtcctggttccagaaaacgttcacccttcccccccgctcccgcggctcgtacctcataa

SEQ ID NO: 8262 - DNA, 186 bp, A.fumigatus
tcgcaacgaaagcgaagccagtcaacgaggccgatctataataccttcattgataaatcttctctctgtacgctcttcttccttgctctcatgcttctcaacaacagcttgcacgtaaacatgttagttataatcgcacaaggagaggtaatctggagaatataccgtcggcggagggcttcatga

SEQ ID NO: 8263 - DNA, 477 bp, A.fumigatus
ctcgttttcagggtcccggataaaccgtattctactcatcgcctactgatcggcacgcacacttctagcgatgcgcaaaattatttgcagattgctcatgtccaactccccaatccgtctgctccaaatccggacgactacgatgaggagcgcggggaaatcggagggtacggcggcagctctaagaaggcgcccatggaaatcaagttcaacatcgtgcagaagattgatcacaagggcgaagtaaataaggcccggtatcagccacagaaccccaacattattgctaccatgtgcacagatggcagggtcatggtctgggatcgctcgaaacacccaagtctgccaacgggccaagtcaaccctcagatggagctcatcggccatacgaaagaaggattcggtctcagctggagcccgcatactgcaggacaacttgctaccggtagcgaggataagacagtccgaatctggtaa

SEQ ID NO: 8264 - DNA, 261 bp, A.fumigatus
agatgcccaagacggcccaccagagctgtatgtatatctagcatcctttctgttgttcgtctattcgatactaatttcctatgcagtctcttccagcacggcgggcataccaaccgcatttctgacttcagttggaatctgaacgatccgtgggttctttgctctgctgccgaggacaatctactccaagtatggaaggtcgccgacgcgattgttggcaaggatttggaggatgtgccaaccgaggagctggaaccttga

SEQ ID NO: 8265 - DNA, 618 bp, A.fumigatus
ctgaacatttggcacagggatttgacgacatattcaaagggcaacaagttactgaagccttccagaacttacactcaccattcgtctattgtcaacgatgttcagtatcatcctcttcactcatcccttattggcactgtatccgacgacatcactcttcagattctagacatccgagaatcggagacaactcgtgcggctgcatctacagagggtcaacaccgcgacgccatcaatgccattgctttcaatccagccgccgagaccgttctagcaaccgggtctgccgataagacaataggtctttgggatctgcgaaacttgaaaactaaactgcactcgttggaaagccacactgactcggttacctcaatctcatggcatcctttcgaagaagctgttctggccagcgcaagctatgaccgtaagatcgctttctgggatctcagtagggcaggcgaggaacagacacctgaagatgcccaagacggcccaccagagctgtatgtatatctagcatcctttctgttgttcgtctattcgatactaatttcctatgcagtctcttccagcacggcgggcataccaaccgcatttctgacttcagttggaatctga

SEQ ID NO: 8266 - DNA, 630 bp, A.fumigatus
  unsure (49): Identity of nucleotide sequences at the above locations are unknown.
tcacgtatattcttcttgagttggatgacccttcatgtaccggatcgtntctcccccacatttacatctcccctgtgtgtatgcggatggggtcttgttgcatccttccagtcactggctacttcattcagcaccttcgtggttctgcgagcctttttaggcatcacggaagcggcatttggccctggcgtgccgttctatctctccctgttctacaagcgggaagaactcgctttacgaaacggactgtttatctcagcggctcccttggcgacttcattcgcgagtagtctcgcatggctgattgtcaaggtcagcagtaatggccccattgcaccgtggcggacgcttttcctggtcgaaggatttcccagtgtgtttgttgcggtctttgcgtggatactgatccctgactcgcctgagagcgctcgttttcttgagcccagagagagaatggtagccaagttacggctgggagagaccaggtccgactattgtgggcccgattccaggaagttcaattggagggaagtcgccaaggcgttgtcggatcccaaatcttatgtgacagctgttcgtggaagtcatatctctccagccttgagcttaactgacgtgcagctactatag

SEQ ID NO: 8267 - DNA, 741 bp, A.fumigatus
cgtgcagctactatagtttatgttcttcagctgcaatgtcgctttcagctccatgcctgtgttcctgcccaccatcatagaagagtaagccctggaatgagtaacccagttgatcaatgcactcattttaacagcatgggctactcctccctctccgctcaagccctctgcgcacctccttacctcatcgccttcatggtagtccttgcaacagcatacctatccgaccggcacagaagccgcagcccctacctcatcgcccacgccctgatttcttcattcgcctatctcgccatcgcggctacaggctactaccatgagcacctatccgccggcgtccagacctttatccgatacgcctgcgtctaccccgccacgtcaggcttcttctctgccatcaccctcatcatcacgtggacgatggacaaccgcgccgcaaaggaaggcaagggagccagcatggcgatcctcaacctcatcgggcagtgtgggccgctactcgggacgaggctgtacccgcgcagtgagggcccgtggtacgtacgcgggatggcgacgtgctctttcttcatggtcgtggtggctgtccttgcgatcgtgctgagagccatgctgcagaggggggttcgtgcagcggatcggaaaggagatgctgacggtgagatggaaacgcggcgggtccttatggatggaaatcagttcaatcacagtgttgaagagagatttgtgaatattctataa

SEQ ID NO: 8268 - DNA, 669 bp, A.fumigatus
atcgtcttgagaaaccacacccggaattcgaaaccgccaaaggccaagccgaaaaggaatacggcggcgcgctggactaccgacgcatcgacgtgcgcatcgaaccagaggtcagcgacgtcttcgccgaaatcgcctcccgcgataagcgactgtacggcatcatcgccgccgcagggcatcaaccacctgcagagcgcggtggagcactcccagtcggccctgaacgaagtcatgcagatcaactacaacggcgtgttcaactccgccacggcagcagcacgccagatgttcaattaccaacagaaggggtccatcctgctcgttgcaagtatgagcgggctcatcgccaacaagggcatgacctcgcccgtgtacaactcgtccaaggcggctgtgatccagctcgcgcggtccctggcgatggagtggggccggcgcgggatccgggttaatagtctctgtccgggacacatcctcacgcccatggtcgagctagtgtttgagcagaatccggctgcaaaagccacctgggaggcggagaatatgctcggtcggctggcgtgtccggaggagttcaggggtgcggcgctcttcgcgctcagtgatgccagtagctttatgacaggcagcacgatgatcattgatggtggtcatactgcgtggtga

SEQ ID NO: 8269 - DNA, 189 bp, A.fumigatus
ctgctccccggggtcaaggggttttcgtcgtacatctgtccaagagagctcccttcctccgctatggacctgctcaaggaggtctccgcctggggctttctccaaagcaacgccatcctttctctcttcataccactgccaaatcatgcttccaagggtctccctgtgatgctcattcttactatctga

SEQ ID NO: 8270 - DNA, 360 bp, A.fumigatus
cagcgcggtaccttccatccccgtcgtgaagactccgaagtcaacaaatatacccacacccccgtcaacgccgtctggttcgtcgttctcttcagcatcggcctcaactgcatcgccatcgggtcaacccaaacggccactgcaattttcagcatcaccgccccagcactggatatctcctatgtttccgtcatcctcgctcatagactctacaaggataaggtcaagttcgttgaggggccgtttacgcttggtaaatggggcgcagccattaactgggtttcgatcgtctgggtcctcttcataagcacggtgcttttcttcccgcctactgtgccggtcacggcgtcgaatatgtga

SEQ ID NO: 8271 - DNA, 1701 bp, A.fumigatus
tttcgcgtgcttttactaaccgaaaaccttcacaaagaacggccatcagatagtaagaatgagcatcacagggagacccttggaagcatgatttggcagtggtatgaagagagaaaggatggcgttgctttggagaaagccccaggcggagacctccttgagcaggtccatagcggaggaagggagctctcttggacagatgtacgacgaaaaccccttgaccccggggagcagttaatctatcagcaatatttggccaccaagagacaactgcaggatgcatcgcagactagaggccaagaaaacctcgagaacccgacagatgttcttgacgaccgatcgagctctacgtcggaagattcggagacggagcagcagggacgggtcctgaacttctctacctcattggctcatgccaaccgcaacaagctgggtcttagcgacgaagatttgggcgtgaacattcttctccgtcggaagaacgtctacgactacgacgtccgtgggaagaagggtcgcgaacgaatgttcccatatgtagctccaagaaagcgcggagatgagtatggagaattcattcggcccgaggaatatttacgagccgaagagcgtgaagaggcagacatgcaacagcgtcggtccgaagcccagaccaaattgggccaaaaacgacgatgggacgaggcaggtccgcacgggcgtcgagcctcccatagtggagccaagcggcaacaggtcgccggggacgctcacaagagggaggctggtggcgcggacgatctcagcacgaccgaggatgcggacggcggtgatgcggcgatatcatcggaggatgaagccgatgaacaatcgtttgaagggcccgcgaaagcggtgttcgagaaatccacgatcaccatcaacgcacgtctcgcttttgtggacttcactgggctccatgataagcgcagtctagagatgctgattccactcatccagccgcggaaactaatcttggttggaggaatgaaggaggaaactaccgccttggcaacagagtgcaagaaacttctcgccgcaaaagctggcgtcgatgtctcgtcgccagactcggccctgattttcacgccaacgaacggtgaaacggtcgatgccagtgttgataccagcgcttggatggtcaagctgagcacgaatcttgtccggcgcctgaaatggcagcacgttcgcagcttgggtgtagtaacactaacagcccaactaagagggccagaactcaaccccaaggaggaaagcgaggagtcggcaagcaagaaacaaaaggtgttgcaggacgaggccagttctgcagcaacatccaccctcggcgaaacaaagccagcggtggacaaatccgacgttttccctgtgcttgatgttttaccggcgaacatggcggctggtacccggtccatgactcgacccctacatgtgggtgatttccgactggcagatctacgcaaagtcatgcagagcgccggacataaggcagaattccgtggcgagggaacgctcctcatcgatgggatggtcgctgttcgcaaatcgggtactggcaggattgaaatcgaggcatctgcgcagtcgtcgaccatgaaccaagccacgggacgtggcgtggcaagctttctagcagtgaagaggaagatctacgatggtctggcagttgttgcgggaagttga

SEQ ID NO: 8272 - DNA, 207 bp, A.fumigatus
cggagcgccataacctcgctcagagacggctcatacaaaatccattcaaacctaaatcagaccaagtatgtagatagatcaactcacaacttcactgaacctaacgcagtgctccttaatcttcgtttaaatcctccgtcggaacctcttgtatatactcgttcgtccgcggaccagtatatttcctacagacaacagaagcgttaa

SEQ ID NO: 8273 - DNA, 600 bp, A.fumigatus
atcattgccatcatttttcaccatcatagctcacatcatcatagatttggcacacatatttcagtcatggctttttttctaaggcgcccgttcgccgttccaacggctcttcgtcaagcccctaaggctgcgaacaccgctcgcttcatccacaactcacccatcaagcctgttcagtcgaagcctctaggtccctgctcgtcctcaatcttcgcacagtccaaacagaccatccagaatgccttcaggcgcacctacatgcagcagtcttacggtacagctcagcgtggcgacctcacccagcgcctgctctacggtgcggccattgtgggtggcactgtcatggctacgaacttcatattcaaccgtgaaacaagagaggatggcggaatgcctcactacgagcgaagttatctgaatgaaacttttatgcacaccggacttggtgttggtattatcggtatcgccgctagagctttgcacatgaacggatggtcttatcgtttgatggccaccaacccttggttggttgctggtgttggtctagctgccagcatgggcacgatgtttgctacctactatacttctcccgataagtaa

SEQ ID NO: 8274 - DNA, 495 bp, A.fumigatus
cgggtatttagctacgtaatgaagtatggtctctgggctgccttcaacgtcactcaggctgcgcttctctcccctctgatgttcatgcaccctgccctgctcgctcgtgccggtctttacactgttggcatgatgggttcgattgcgttcgtcggtgccaccgcgaagcaggagaagtacctctacctaggaggtcctctcctcgctggtgtgaccatcgttgccctttccggcttggctcccctcgttattcccgccactgccgctcgtgctctgatgtggtccgagaagatctggttgtacggtggtcttgctgtctttggtggcttcaccctttacgacgtccagaagatcctgcaccacgctcgcttggccgaacgaggacttgttcgcagggatgtcgtcaacgagagcatcagtctggagttggacttcatcaacatcttcgttcgtatggtgcagatcttggccatgcagcgcaacaaccggaaataa

SEQ ID NO: 8275 - DNA, 276 bp, A.fumigatus
gcagaggataatggcatggggattcaaagtccaggcatcctcgtgtccaccactgggatcattaggactcgctatacctatactcgtgccttccaggctgtcctttttgagcctgattttctgcaaggtgtcaaagaccaggcatttgcccagattcgccgaattggccagagcagcccccaaacaacctgcattcgcttcgtcgtgcccggtatgcaatataagcagcaggtcttcacccgccaagagcaccgcagacagctgaagcgagcatag

SEQ ID NO: 8276 - DNA, 627 bp, A.fumigatus
  unsure (532): Identity of nucleotide sequences at the above locations are unknown.
atagcgacggatgtctcctttgatcgatattgttttccagtgatcagcatcgacgacgaccgccgacatgcagaccctgttcctttctctcctggcggccgccgtgaccgtccatgcctacggttctggtggcagcaactgggatcaggcctactctcgcgccaaagatgccctgcagaagctcaatcagaccgaaaagtggggttggtgaccggagtcaaatggatgggcggcccctgtgtgggcaacacatacaagcccgagtcgatcgactacccttccctgtgtttgcaggactcgccgctgggtatccgcttcgcaaaccccgtcactgccttcccggcgggtatcaatgccggtgcgacctgggatacccagctgctgtatgcgcggggagcagcaatgggcgctgaggcgaaaggacttggtattcatgtgcagcttggtcccgtcgctggacctttggggaagaacccgaatgggggcaggaattgggagggattctcagtggatccgtacctgagtggtgtanccatggagaagaccatccgaggaatgcaggactcgggagtgcaggcgtgtgccaaggtatgttctcctcgccaacagaaagaagcctcgtgctga

SEQ ID NO: 8277 - DNA, 303 bp, A.fumigatus
  unsure (246): Identity of nucleotide sequences at the above locations are unknown.
cactggctgggaaatgagcaggagcactaccgcgacacgatcagctcgaatatcggcgaccgtgcggcacacgagctgtacgtgtggccgttcatggacgccgtcaaggcgggcgtcgcgtcggtgatgtgctcgtacaacaaagtcaacggcacctgggcgtgccaaagcgatgccctcaacaacaagctcatgaacgaagagctcggcttccccgggtacatcatgaccgactggaacgcgcancacagcaccgtcaacagcgcggtggtcggaattggacttgaacatgccgggcagtga

SEQ ID NO: 8278 - DNA, 258 bp, A.fumigatus
  unsure (75),(242): Identity of nucleotide sequences at the above locations are unknown.
gagagaattggctacacagacaccatgaagacctttgcgatccttggagctttcttctcctctgccctcgctcanactctctgtgaccagtatgccacctacagcaacggccgctacaccgtcaacaacaacctctggggcatgagctctggctccggctcccaatgcacctatgtccatagtatctcccactcggggcttaccttggcatacgacctgggacgtggtccgggcggccgacnaccaagttccaaaacc

SEQ ID NO: 8279 - DNA, 300 bp, A.fumigatus
  unsure (264): Identity of nucleotide sequences at the above locations are unknown.
cagggaaggtaccgtattgattcttcccaccaaaatgatgaaaaagagctgatggaatggcgaatgcaggaacacggcgggatcgacctcattttccacacgaatctcttctcaagcaagacgatggatctcgcggtccacccgtcagaagtcaacatgtccttcctggatcccgtgagcggctcctgggcttcgatctccggcaccgcggcgctggttgccgaacaggagaccgtaaagagatactactcgcctgcgttgcangcgtggctgggtgatctgggccaaggtgtacattga

SEQ ID NO: 8280 - DNA, 288 bp, A.fumigatus
actactgatatagatatttcaccctgtctatctgtacaatacacaatgtcttccacgatcaacacaagcaccggcaacaagcccgttgacccctacaaggccaagagcctcgaggatccccctctccagcaaaaagtcgaggacatggtcaactttatcagcgagaccaaattcggcatgttgacgacgaaactgtccaactcggacctcttgacttcgcgatgcatggcccctagcagggaaggtaccgtattgattcttcccaccaaaatgatgaaaaagagctga

SEQ ID NO: 8281 - DNA, 558 bp, A.fumigatus
  unsure (545),(548): Identity of nucleotide sequences at the above locations are unknown.
tcgagcagcacaaacgacgacgtatatcccacagcattataccgatcaatctccgggaccggatgcggcgcaacggggaggatgatggcgtcgaccgaccggccggccagccggtcgccatcgcgcatccacatccccaacagctccttttccaccgcagaccgctgcgcctgcaactgcgccagctgcaccacgctcagcgccttgccgcgcttcacgcggccctgcagccacgggatcaacggctcccccgtgccctccagcagatccagcattgtcgacccatcatcgacgcccatcagccggcccgccagaccctggcacttggacagcgccggcgggacggggatgtcaaccacctcgacgcccgccgtccggcgcagcatctgcgccacctcctccagcaccctcgccaccggcggcagcggctgcacgacgccatccgacctcagcaccccaatcgtcacgtttctcctccggcccgaacgggggaactccccgtcccacaacgtcttcaccccacggccgaaggaccgagcatgcgntangccccccccc

SEQ ID NO: 8282 - DNA, 294 bp, A.fumigatus
tcaaataatccttcatctgccgaacggtccgaacctcggccagtcggtccaaagactccatggaaatgtggggaagttggggtcactactataaacatagagagctgtcgtctcaatacattcggtactgatatcacaacctatctctcatccatcggaatcaagatgtcagctgaagaacaagtccgcctcgataactttgactccatcttctccctcgatggcaaagttgccgtcgtcaccggcggttcaagaggcctcggtctccatgctgccagcgggtacgtctactga

SEQ ID NO: 8283 - DNA, 426 bp, A.fumigatus
gctatggttaggtttgcccccctactcacggccaaagcaacccgtgagtcgccctcgcgcgtcatcgtcactggttccgtcgctggcattggggtcggctctatcggcgaaaatgccacctttgcgtactccgcctccaaagcagccgtgattcacctggccaagaacctggcggttgagctgggtccccggggcatcctgtgcaatgcgattgcacccggcttctacccgtccaagatggccaatgggttgatcgagaagcagggcggcctcaagcagctggaggagcactcgcccaaccggcgactaggcaggccggaggatattgccgggctggtggtgttcttgtccagccgtgcggccagtcatttgaatggggctgtgattgtgactgatggaggggccgtcctgaagggaagactataa

SEQ ID NO: 8284 - DNA, 471 bp, A.fumigatus
  unsure (460),(463): Identity of nucleotide sequences at the above locations are unknown.
tggcgtcgaccgaccggccggccagccggtcgccatcgcgcatccacatccccaacagctccttttccaccgcagaccgctgcgcctgcaactgcgccagctgcaccacgctcagcgccttgccgcgcttcacgcggccctgcagccacgggatcaacggctcccccgtgccctccagcagatccagcattgtcgacccatcatcgacgcccatcagccggcccgccagaccctggcacttggacagcgccggcgggacggggatgtcaaccacctcgacgcccgccgtccggcgcagcatctgcgccacctcctccagcaccctcgccaccggcggcagcggctgcacgacgccatccgacctcagcaccccaatcgtcacgtttctcctccggcccgaacgggggaactccccgtcccacaacgtcttcaccccacggccgaaggaccgagcatgcgntangccccccc

SEQ ID NO: 8285 - DNA, 537 bp, A.fumigatus
ccgttgagatgcatcctgaccgcgtcaagcctccttcaggcgggctgctcaaaggtctacatcacctcccgtaaagccaaagcgtgcgatgaggccgtcgccgccctgaatgccctccccaataagcgtcccggcgcggtagccattgccgtccccgccgacaacgcacgcatggacgacctggaccgacttgtggccgaggttaagaagacaaccgatcacgttgatattctctttgcaaacgcgggcgctacctggggcgagcggttcgaaaagtatcccgagtctgccttttccaaggtcatggatctgaacgtcaagagcgtgttttatttggtgcagaagtatgtccccattagtttttggtgtatatcaactttaactgagctatggttaggtttgcccccctactcacggccaaagcaacccgtgagtcgccctcgcgcgtcatcgtcactggttccgtcgctggcattggggtcggctctatcggcgaaaatgccacctttgcgtactccgcctccaaagcagccgtga

SEQ ID NO: 8286 - DNA, 210 bp, A.fumigatus
gtcatccctttcttcctcctgctcaagagttccccactgatctggcacatagggaacgagaaaacggtggatcgacgtgtatacctcgactctcccctgagcattcaggtcgtcacacccaagcagcacgactacgagctctacagggccatggagattattgaccgagtagtgcgggcagaggagcacaagacagttgccaagctgtag

SEQ ID NO: 8287 - DNA, 714 bp, A.fumigatus
  unsure (10),(13): Identity of nucleotide sequences at the above locations are unknown.
ggggggggcntancgcatgctcggtccttcggccgtggggtgaagacgttgtgggacggggagttcccccgttcgggccggaggagaaacgtgacgattggggtgctgaggtcggatggcgtcgtgcagccgctgccgccggtggcgagggtgctggaggaggtggcgcagatgctgcgccggacggcgggcgtcgaggtggttgacatccccgtcccgccggcgctgtccaagtgccagggtctggcgggccggctgatgggcgtcgatgatgggtcgacaatgctggatctgctggagggcacgggggagccgttgatcccgtggctgcagggccgcgtgaagcgcggcaaggcgctgagcgtggtgcagctggcgcagttgcaggcgcagcggtctgcggtggaaaaggagctgttggggatgtggatgcgcgatggcgaccggctggccggccggtcggtcgacgccatcatcctccccgttgcgccgcatccggtcccggagattgatcggtataatgctgtgggatatacgtcgtcgtttgtgctgctcgactacccggcgggcgtcatccccgtgcggaagttccgcgagacggatctggagctgggccaggagatgacggcgccggtgctggggagctgggacaaggccaaccggctgttgtgtaagtcatccctttcttcctcctgctcaagagttccccactga

SEQ ID NO: 8288 - DNA, 201 bp, A.fumigatus
aacaatcatatctcaacttgtgaactcatttctaggcaaaataattctcttagttttctaaactctggtaactatgggggcctattcgttgaacacgtgccaacagataccggaacctcgcgaaatggctataaacaaccatcccgacacctcgccgaaatgttgtggactgctacccaccgcattcaactgtgcctctag

SEQ ID NO: 8289 - DNA, 1152 bp, A.fumigatus
tgcgcggatcttgggctccttggggcaatgttttcgaagacgatcagaaacgttaattgggatgtgccaattcaatttttcggcggccattatcatatccgcgactatgctcggtacgattctaaagcgtacgggctggcgagcggccgcttcatggagaccattgggtttttgtcaatcgacggtctgtccactagtaagaatcggctcaagcctgctcaagcaactcccagcttcaaccgacggtacattgataacaacctctactcgtttcaccatcacactggtcatgatcgggattcttttcccacagagcacggtccaaatatatcgcatcttattcagcagtccagggatgcccttgatctggatagggtgcacggttgcgctcctcgggacctctggatgacccgagtaaagtatccctctcatgacagtatatatacgtggctcgaggagaacgtgcttcctagtcaagtgaaggatgactctcgcaaagggaagcccgcgttggtcattgtcaacactggagccatacgcttcgacatatttaagggtccgtttacacaagatacgacattcattgtctcgccctttacgagcggcttccggtatatcaaggacatcccctacgacaaagcgcaaacggtagtagacattttgaacaagcagccgcaaattttgactgcgcccaaggaccacacaaaccacacaccatggactcttgcgccacctgagcaatcaatgcatatgcacgataagattgtggaaagcgacgatgtggctgcccattatcttactgatcagagtcggcttccaatgagcacaccattcacgcctaaggttttccctggctacaccactgtagatgatgggggtatagatggtgatgacactgttcattcgccaatatcattctaccgtgttccaaattgcattcaagctctcatcaatccagggacgtctgccgatccgaacacagtggatcttgtgtatattgactttatcgagccctacgtggcgctggccgccaaatttgcgagacttgatctcgattttgcacgggatagtgacgtctatatgcccttcgagactttaactgatcttatcttggactgggtcaaacataactggaaatgcgaagatgcatga

SEQ ID NO: 8290 - DNA, 1068 bp, A.fumigatus
  unsure (269): Identity of nucleotide sequences at the above locations are unknown.
cctgacttgttttctccctcatccaggcttcacaaacattcgatatctcctcctcatggaacacaagtcactctccgtcttctagcggcgcctttgaacccggccgatgtgaatcagattcaaggggtatacccaagcaaaccgcccttccagaccacgctgggcacaatggagccgtctgccgtcgcgggaaacgagggcgcattcgaggtcattgccactggctccaacgttaaaaatcttgccaaaggcgactgggtcgtaatganacagacaggacaaggcacctggcgcactcacgcacagttagacgaatcacaggtgatcaggattgaaaacaaagaaggtctgagcccgcttcaggtcagcacagtcagcgtcaatccggtgactgcctaccgaatgatcaaagacttctgtgactgggattggatgcgggccggggaagagtggctcatccagaacggagcaaacagcggtgttggacgagctgcaatccaacttgcacgcgaatggggcatcaaaacgatcaatgttgtgcgagagagaaggacacccgaagaaactgatgctctaaaaagggagctctacgatcttggggccaatgcagtggttactgaatccgagctgctatctggagaattcaagagcatggtgaatgaattcacccgccaaggaaaggagccaattcgactagccctcaactgcgtgggtggtaagagtgccactgccctggcgaagacccttgctccaggttcacacctggtcacttatggtgccatgtcaaaacagcctgtcactttgccatctggacttctgatcttcaagaaccttgttttcgacggtttctgggtgagcagatggggggataaacatcctgagctcaaggaaaacacaattaatgatgtgctgaagttgactcgagccggcagattcaaagatatcccagtggaatacatcagatggacctgggaaaccgaagccgctgagctggttgcgggtgtacaggagactctaagtggattccgcaaaggtaaaggcttgttaaaatacgaaggggacgaataa

SEQ ID NO: 8291 - DNA, 897 bp, A.fumigatus
tgtcgtctggacgcggttcttctgccccgtggtgaagaccatgttcagaagatcgatcgcaagaagttgggtatcgacgtctcgaccatcgagcaggagctctcggaacaggcggctggggatgcagaacaaacacgtaggctcactgcggaggaggaagagaaaattaagcgaactgctaccagacctgatctgtatgagcttctctctcggtccttggcccccagcatctacgagatggacgacgtgaagaagggaatcctgcttcagttgtttggaggcaccaacaagaccttccagaagggtggtaacccacgataccgtggagatatcaatatccttctctgtggtgacccatctacatccaagtcccagcttcttcgttacgtccataagattgcccctcgcggtgtgtataccagcggcaagggctcctcggctgttggtcttacggcgtacgtcacccgcgatcctgaaacccgccagatggtcctcgagtcgggtgccttggttctttcagacggcggtatctgttgcatcgacgagttcgacaagatgaacgaatccactcggtccgttctgcatgaagtcatggaacaacagacagtatctatcgccaaggcaggcattatcactactttgaacgctaggaccagcatcctggcttccgccaatccgatcggtagcaggtacaatcccaacttgcccgttcctcaaaatattgaccttccgcctaccttgctctcccgattcgacttggtatacctcgtgctggaccgagtggatgagcaggaagatcgtcggctcgctaagcatcttgtcaatatgtacctggaagacagacctgagcatgctgccgagcaagaaatcttggtaagtgcttttctgaccacctga

SEQ ID NO: 8292 - DNA, 621 bp, A.fumigatus
cccgttcattcactgcagccgatcgaattccttacagcctatatcacctacgccaagaccaaagtccacccagtgctcacaccggccgccggtaaagccttgtcggatgcttacgttaacatgcgtaagcttggagatgacatccggtcttctgaccgccgtatcaccgctaccactcgtcaactggagtccatgatccgactgtcggaagcgcatgcgcgtatgcggctatcgccggaggtcactgcggatgatgtggaggaagccgtgcgcctgatccgctccgccatcaagcaggcggccactgactctcggaccggtctgatcgacatgagcttgttgacggagggcactagtgccagcgagagacgcagccgggaagcactcaagcgtgccttgctgtctgtggtggatgatctgtgcagcggtggcggtgcagctcgctgggccgaggtcttcaggatcttaagcgagaacagcagcattgaggtggatggagcccagtttgcggatgcggttcgagcgctggaggctgaaggagcggtgagtgtggtcggcgaaggtgccccggcgggaatatccggcgcattggcggcgctcttctgtagaccagttctctaa

SEQ ID NO: 8293 - DNA, 393 bp, A.fumigatus
ccgaacaaactctatgccatccttacccccctgcagcagccggtgtattatacttctagcgattcgtctttggatgtttggacgatcatcgcggcgacgtctgaggatgcgactgttgatttcacagacacgggagataagacttgtctggtcatgcagatgagcgataacacttttcaagtgctcctccgcctgatgttatactttcggcgtaggcttgctacgcggaattttgtatatctttacctcctgattttgccaaagtgtacctttcttggtcatttaatttggattgcaatccgtgccctacaaatgcaaggcagccttgtaagtcacatccctagaattaatggggtagtcacctggagacttagatctcctataaatatatga

SEQ ID NO: 8294 - DNA, 333 bp, A.fumigatus
actcatctgtcagtcagcatggaagtttcaatactatcgttattcaaggcatatgccgcatacgtcacagttgcggtggtcctccttcgtttaattaccaatcggttccgtaggggccttgcgggaattccaggccctacaatcgccaaatggacccgtctgtggaagttgcacagtgtgtggaagggtaatcaccacactaccgccattgacttgcatcgcaagtatggaccgctggtgcgcattggtccaaagcatgtatctgttggagatcccagtgctattccgatcatctacggtctcaacaaagggttcacaaaggttagagggtag

SEQ ID NO: 8295 - DNA, 204 bp, A.fumigatus
aagactggattctatcccatccagtgcatatcatggaacaaaaggcctcagatgaaccttttctccacgcgcgacgagatgttccaccgggaacaaaagcggccggtggcgaatgcctacagtatgacctcgctgctcgagctggaacctgcagtagactcctgcactgagatcttcatcaatcagctggcgaaggttcgctaa

SEQ ID NO: 8296 - DNA, 339 bp, A.fumigatus
  unsure (203): Identity of nucleotide sequences at the above locations are unknown.
actcctgcactgagatcttcatcaatcagctggcgaaggttcgctaatagcaagaaacccgtcgacctgggcatgtggctgcaatactacgcctttgacgtggtcggggaattcacctttgccaagaaactcggctttctgccggaaggaaaggacgtcgacggcatgattgaagcaatccaggggatgctggtgtatgctantgtgtgtggtcagatccccgaggctcacccgctgctcctggggaatcctcttttcccgatcttcatgcccagcatggagacatggaaccaggtcctgaatttcacgctcaaggcgatcaactcgcgagcatcactg

SEQ ID NO: 8297 - DNA, 768 bp, A.fumigatus
  unsure (762),(763),(765): Identity of nucleotide sequences at the above locations are unknown.
atactgatcttgaaagggttcttcgagtctcgtaatgaccccaagaacgaccccgttgttctgtggctcaatggtggccctggctgttcttcccttactggattgttcctggagcttggacccagcagcatcaacgagaagatcaagcccatctacaatgactttgcctggaactccaatgcctccgtcatcttcctagaccagcctgtcaatgtcggctattcttacagtggcgccgctgttagcgacaccgttgctgcaggcaaggatgtctacgccctccttacccttttcttcaagcaattccccgaatatgccaagcaggacttccacattgctggagagtcgtacgctggtcactacatcccggtatttgcctctgagattctgtcccacaagaagcgcaacatcaacctgaagtccgtcctcattggcaacggcctcacagatgggttgactcagtatgattactaccgccccatggcttgcggtgagggtggttatcctgctgtcctggacgaatccagctgccaatctatggataacgctctgcctcgttgcaagtcgatgattgagtcttgctacaacacagagagttcctggatttgcgtccctgcttcgatctactgcaacaacgcgctccttggtccttaccagagaactggccagaacgtctacgatattcgtggcaagtgtgaggattcgagtaacctgtgctacaaggtcttcaccgggggtgcaagacgctcagtgcaatcaaanncngca

SEQ ID NO: 8298 - DNA, 516 bp, A.fumigatus
gttaccatgagagttcttccagctacattgctggtcggagcggccactgcggctgctcctcccttccagcagatcctcggattgcccaagaagagtgccgacacattggccaagcctcttcatgacctccaagagcagctcaagaccttgtctggtgaggctcgtcatctgtgggatgaagttgctagccacttccccaacaacatggatcataacccggtcttctcgctgcctaagaaacacaaccgtcgtcctgactcccactgggatcacatcgtccgtggtgctgacgtccagagtgtctgggtcgccggagccagcggcgagaaggagcgagagatcgatggcaagctggaggcctatgatctgagagttaagaagaccgatcctagtgctctcggtatcgatcctggtgtgaagcaatacactggttatcttgacgataacgagaatgacaagcatctgttttactgtgagttctaccttgatctcctggtctgcgtagctgaatactga

SEQ ID NO: 8299 - DNA, 360 bp, A.fumigatus
aaaatcaactgtgctggtaacctgaactcccttgaagtggagctgcccaacctctccagtggcaccaacatgaccttccgcaacgtcagcgctgtctctgtcccctctctccacaacctgactggtcagcttggcttctggggtgacaccttcaagtctttcagtgctcccaaccttaccgagactggcgacctggttttcaactccaacagcaagctcactaacatcagcatgccagctcttgagactgtcaacggtggtttcctgattacccgcaacgatgagctcagcagcattgatctgccttccctgaaggttgttactggtgccgttgacttcagcggcaagttcgacgagtaa

SEQ ID NO: 8300 - DNA, 306 bp, A.fumigatus
tcaaatcgcagagtgagcatgcccaaactcgagaacgtcaagggccagttcaacttgcagagcaccggcaacttcagctgcgacacctttgacaaggcccataatgacaaggtcattcgcggtacctacaagtgcaaggctgctgagcctaaccctaccaccaaggatggatcttctggcaccaccactagcagcggcagctctgcttccgcttccaagtccaatgctgctgacctcaacgctgctaacctccctgctctcggattcgccgccgtttttggagctctggtgcagtacgttttgtaa

SEQ ID NO: 8301 - DNA, 219 bp, A.fumigatus
gatatttatcagtggagacccgattggctgtggggtatcaaatccattgagcaacactggaaaagcctcatctggtggccattcactttgagcctcttagtctgtgactctctctctctttcctctcatttcctcctctcttacctgtctccagtctctctccctagagttcctccgcggcgaaccttccttggtcatttctccaagaactgtctgtaa

SEQ ID NO: 8302 - DNA, 348 bp, A.fumigatus
ctcaccatgtccctctgtttaaaccgccttacagaagaacggtatgtccatcaacccagcttaaattcgcgccgcgcaaacacatccacgactccgcaaccgacaacaacccaagagagactgacaacccccacgcgcaggaagcaatggcgacgcgaccacccgttcggcttctacgcaaagcctcatcggacaccccagggcgtgctggacctgaagcgctgggaatgcggtatcccggggaaagcgaatacgctgtgggaaggcggtctattcaagctggacgttgtctttccagatggtaagcctgcctgtgcctgtggtcgtgaccggtcggtccttgtataa

SEQ ID NO: 8303 - DNA, 276 bp, A.fumigatus
actgacgtcgcaaacgatacaggcaaattcgtccccccactcttccaccccaatgtctacccctcgggcaccgtctgtctctcaatccttaacgaagaagaagcctggaagccggccatcacaatcaagcagattcttctgggaatccaagacttacttgatgacccgaacccagagtctcccgcgcaagctgaagcatataacttattcaagaaggaccggccggcgtacgagcggcgcgtgcgccaggtcgtcaaggagaatcctgctctctag

SEQ ID NO: 8304 - DNA, 396 bp, A.fumigatus
gtgggcgagcatgggccttctagcggcgtgttgaaaactggctcgcgacgttacctcgcatatctacttcagtttcggctggtctacagctcgagtatttctcttgctcacgtcgcaatggaatccctcacgacccatccttctaccgcgcagcaggcccgggccttcacttcccccgcttctctgtcctttcccggtggtgccggtgatttgacacctccgtcttctgaaaaagaaggaaacataacgattggcgctcagggtgcgaatggaactgtgaacggccatcagcagggaggaaatgccgtcaatggcaatggggtgacgcccgctactcccgctgcaactcctggtgccaatgctccggggagtggtatcgtgcccaccttgcagtga

SEQ ID NO: 8305 - DNA, 474 bp, A.fumigatus
tcatgcgtatccgggaaccccaaaactaccgcgctgatatttgcctcgggcaagatggtcgtcactggtgcgaagtctgaagacgattccaagctcgcatccagaaagtacgcgcgtattatccagaaactgggcttcaatgccaagttcaccgacttcaagatccagaacatcgtcggttcttgggacatcaagttccctatccgcctggagggtctggctagtcgccatcataacttcagttcttatgaacctgagcttttccctggacttatctatcgtatgatgaagccaaagatcgtcctcttgatcttcgtcagtggaaagattgttttgaccggcgccaaagtgcgtgaagagatttatcaggcgttcgaattgatctatcctgtgctttctggtacggttattctttttttcggattcaagtcgaactatatgctaactattcgatcagatttccgcaaggtctga

SEQ ID NO: 8306 - DNA, 390 bp, A.fumigatus
gttcgtcacaacccgcgtgtgctggtacaccgacacgtaaggaaccactttctttaccctctccaaaataacgtggccgctaacacgaggacactgtactccaggcccactggcgacttcatcgtcgactaccaccctgactacgcgggcttgttcctcgccacaggcggcagcggtcacgcatacaagttcttccctgttctgggcgacaaagtcgttgacgcgatcgaaggaaagctcgagcctgagctgcgcaatctctggaagtggccggtcaaggtcgaccagagcgctttcgaaggggacgggagcagatccggggagcaggggcttctcctgatggaggagttggccaaaagtacgaaagctcagcggaaaagcgttttatga

SEQ ID NO: 8307 - DNA, 228 bp, A.fumigatus
tttgtctgcgggcgcgctcgagagacgactacggctagcacgaaccccaaggctgttcccatccctggcggcaacggcgtcacaatgcaagtaagtctgccggagaacgacgttcccgtccctctggagggccaggaagctttcagaacagccctcaaggagctacttcccagcttcgcggagcgtgagttcgtcacaacccgcgtgtgctggtacaccgacacgtaa

SEQ ID NO: 8308 - DNA, 780 bp, A.fumigatus
acaaccctgactcgtatcgggatatacccaacgacgaaaggggccaacgattgcggacctatctggtcttgtctattacagagaggtatgggattcaaccaactagatgtgccaaatcgatatgtgctgacaaacatcctcgaaagagcctatgccctgcaacggcgacatcccatcactttctgggggagaccggggttcaccatgcgttctgtccatgattttatccacaatgcaacacacagcgttgtttccggtatcatagttcacaacgaaaaagatgccgagggaatgctgggtctggcccgtttaatggagttgttcgatgccatcgatgaagaggtggttgattgttggaatcagcgctgcaacgtcaattcaggctattgtaataatctcaccgaggagaaggctttgtccatccatcaaaatctccgcagagtctgcgagtccgagcgatataagggatatgactggtttgaacgcaccaagtcagtccccggtgaggtccagagcgtccaaccgacaatcagcatgcgggagacacagtgtgccgatgtgtttatcacgaagaaatggctgcagaatcgggtgtgggtgttgtgctccactcacggtctcctgagacctgtttccgaccacccggagttgtctttcgaatacaccatcacggttgctgtggacgcgttgaaaatatgccagtcattacggcttagctcaatggaagctcatggaattggcctagtgagtacagtccatccgaacaaaaacctattttaa

SEQ ID NO: 8309 - DNA, 378 bp, A.fumigatus
gtacagtccatccgaacaaaaacctattttaatttttcgcgttactcacgtgcgcgcgcgcaggttgagaagctgtacgacattgcggtcagtgcgattggaatctctgccaatgtccgccagcctcttggtgagcattctacagcctcggtggctggctccatggcaggaccaggcgtcgcccctcctggaagcctagtgggagccatgtctccaaacacagcagccgtgcattctactcagtcgttggccgaggattttatgttgcttttgaatacactccgagggggcaatcacccctttatggaaaaattcaaggcgtatctgagttctttgcacatcgtcggggttgggtgcagcaactgggcgcaaacgtga

SEQ ID NO: 8310 - DNA, 1251 bp, A.fumigatus
ttgaaccaattgcgtggttatttatgctcggatgttctatttgagaatccgtccatctctaaccatctgcgcatttttcgatgctcgccaaacagtcgtgtgtcccaaattcgccagcaacaacagactcagctgttacgtaagagttcccagtcgtctctttcagacgcctatccgtaccagaggccgattacctcgcgggagacgggacagcatggtgttgccccgtcggtgcaggatcccacccagtggcctatcccccagcgtggggaggcctcagtatcgacggacgtagtaccgccgcgttcaaacacctcgatcgggccgtcgtggcctgcaacagatacctcgtcagtagattctcagaccaattctgccatcagttggaatgagcgcagcgatgttgagtactggctccccgacaatctagatgcgcaggtgcctgtattcgagtttccaggaagcaatatctacctaaaggcatcgctgccgtcgatcatccaaccggagcaggaagctgctggattgcagccgcatcatgtggacacttcaaacttggctctttctactatgggggtcatgccagccggacccgttccgacgagaacaacgtggccggcatcaatcgtcgaggccaacatgattccgtggattgaagtctactttgaccgtctgcacccgactttgcctgtattgaacaggtcctccttgttcattcgcatgctggcccaagaacatcgtagaaacccgcagttcggcgccatgctattatctttatgcgctttctccctgacgcaacctatcgagatcgacgaacggcccacttcctcgtcccgagccagccaggccagatcgatgatgaacgaggcgacgaaaatgcggagctgctctgactttggggaacatccaacaatcgaggctgttctcaccagctttttcctgtttggatgtcttttcggcagcaaccaacacaatgctgcgtggctccgactccgggaggccctagaccttgcagcgacactgggtttgaacaaccctgactcgtatcgggatatacccaacgacgaaaggggccaacgattgcggacctatctggtcttgtctattacagagaggtatgggattcaaccaactagatgtgccaaatcgatatgtgctgacaaacatcctcgaaagagcctatgccctgcaacggcgacatcccatcactttctgggggagaccggggttcaccatgcgttctgtccatga

SEQ ID NO: 8311 - DNA, 375 bp, A.fumigatus
gcagtccttcgtcacccacccggcagtcaaagtgccatcctgttggcgcaatggctcggccagtccgactctgacgcaaccgcggccatgatcaactctggaccggcgacaatgaccgattggatgctattggccatgagccagatgaatggcgagtcgcaagcgaacaaggtcggccaagcatttgcccaaaagctactagagatcggcgacatacatacgtcggctaccgtattgctgggtctgggtgataaaaacgaagctattgaagtctatgtctctcagaactgctacatggaagcgattctgatgacttgtctcctgacgcccacggattggcagcgccagtcatatctggtccgtcgatgggggtga

SEQ ID NO: 8312 - DNA, 873 bp, A.fumigatus
gtgctattccatccgatgacaagattgaagctaaacccgcaccgacctttcaggaagacttggtcatgggatgtcagaacgaaacacgtcacttatgagccgatcccgacgatagaaaaccctcgtggctttgctaattatggcccaactgctactcttttcactctcgggcccaactacacagtgcaacagtacgatttagataacccgagtatggttgctaacgtgcaacacattcctgctggggcccttactgcaactccagaagaacccaggggaggatctgtagactcacgagccttgcaggatccgccagatcttagagaatcagcgcgcatttacgacagccggccaccttttgaccaaagcggagtagacgccgtacggcagcagcgtgcagagatgagcagtccagtatcatcgcggagtcacgccaactccgtcagctcgaaagcatcttcagggaaatacaggatggtgccattttcagcaccaagtagatcgggacagacggctacatcgttctcgctagcttcagcaagtggaagagagactccgcagcagtctggggcctcatacacgtacgcctcctcggtctccatgtcgtcggtgaaaagctcccgtgcgggatcccgactacgaaatgaggtacaattcagtccaacagatcagcgtattgatctgttcccattcacgcgtgcgcgtctcaacgacgtaccgtatagaaaccatcgcctcatagatgagacacatctcacgccaaacgaccttcggcgacagatgctgagtgtcgtgtttggatgggatggggatattcaagacctgattagagacgagtgtgagttgagcatcttcacagctttgctctattaa

SEQ ID NO: 8313 - DNA, 1392 bp, A.fumigatus
  unsure (427): Identity of nucleotide sequences at the above locations are unknown.
cgcccacggattggcagcgccagtcatatctggtccgtcgatgggggtgaacacgttgtgtcccatgctcagcagcagctggcaattcgatgcttcatgtgtaccggtgtagagccatctgatccctggacttctcccgctgcgcagcaagctgcgtcttttgccgaaatcctttcaggccgatcgccgatgacgtctcctgagccacagcctttgcagcaacaatcttcgaatttccttcggccgactccgaattcacagccaaaggtgccacctagcaccagatcgaacgcgaaaacaccagccctcaagctgatcacgtcatttgattctcagcccggcaagttccgattcccgggtctgaaatcagacgatagaacaccaacaaacgccccggggattacacctatcgctgagtcggctgtangggggtctgctatatccccaggaggactcgggtcctacagagcgaataacattcaaagcctcaacaatgcgatgaacgcaaggacaggcacgcctgcgttcaaccggagccgcttgccgtccattggagaaacccccgttgatgttcatccacccgctttcttgtcaagtggcttgaataattccgtggaatatgcctcgtcggtggaaagcaccagccggctgcatgaaggaagccaaagtcaggatgaggaagtcctgtcgtctttgctgccttctgcacggtacaaccctgaaaaagatacatttaagccgagtccgcaaactgccgtccaggcaaactcggataagtttgcaaccattaaggtcctccctcccccaagccctggcgttttcgaggccctcaaagaacgctccgacagtcggaatggatccagagatcgaaagccgggtgttctccagcttcacctgttcgagcccggtgcttcagaaagtgatttgctaggtccacctagcagtactatgagcaatattcggagcccagcctcgacgctaaacagttacaattcggcgaaaagccccagtgtcagtgggcggagcatcgaccagtacatcagcagtctcgctgaggcgaattaccgctcacaaaaactcagtcggggaaggcgaaacacggatgattcagtcagccaaagctcagcacgaaagatcacttcgaggaatacgtcccaggaaaccactcgagggagaaacgagagaagatacatccagccagctaagcggtcaccgtcttctcctgttcccatgtccccagaggagatagctcgatacagcaagggcacaggaaccaaacatcctgccagcaaatcacgcaatagtagcagagtgaggaagccacgctctcgacactcatcggagcgtcgtcggcatcgttctgtattcgccacgggctggaagatccgcgtc

SEQ ID NO: 8314 - DNA, 240 bp, A.fumigatus
tctgttggactgaattgtacctcatttcgtagtcgggatcccgcacgggagcttttcaccgacgacatggagaccgaggaggcgtacgtgtatgaggccccagactgctgcggagtctctcttccacttgctgaagctagcgagaacgatgtagccgtctgtcccgatctacttggtgctgaaaatggcaccatcctgtatttccctgaagatgctttcgagctgacggagttggcgtga

SEQ ID NO: 8315 - DNA, 477 bp, A.fumigatus
tcgtcgtcggaggaaaattctccgctcatgtcatcctcgtcgaatccatcttccgaatcgtcctcgcttccttcagtctcttcagacccgtcggtatccatgccctcgccgtccttctcgtccgaagaaacctgcgactccttcctctgccgcttgctatccttcgcggaggtcctggatctctgtggtcgctcttcttcgctctcttcagatgcatcttcgtcctcgtcgcttcctagctcagaatcctcttcttcctcgtcttcactatcctcctcctcgtcgcttgagcgtggtctaaacaggtcgtcatcactctcggcttcaagcgcctctcggctgattttcgagccggcatattgttttccgagattgattgggtcctgcctgcgaagcctcgcctttctgtttgaggttaacaatctgatcctgatgatcacaaaccgtcaaaaagtttgtactcaccctacagcctga

SEQ ID NO: 8316 - DNA, 189 bp, A.fumigatus
tgcttgcagggtcttccgcgatccggcacaccaccgtcattcccgcgccgccgggggttaccagaaaagcgcaagatccgtgatgtcaaaaaagtgattgcggtatcgtcagccaagggtggtgtgggcaaatctaccattgcaggtatgaaacttttgtcttggatgccatccgaatatctcatatga

SEQ ID NO: 8317 - DNA, 723 bp, A.fumigatus
gacacatgctgttgggcacaggagctaatggatgtgctagacaactgcctcgtccctctgactaactatggcttgaaatccatgtcaatgggctacctcctcccacagccaaaaccggacccatcccaacctacaggcaacattcccatggacaccactcctatctcatggcgtggtctgatggtcaccaaggccatgcaccaacttctccattccgtctcctggggccctctggatgtgctggtcctggacctacccccggggacgggcgacgtccaattaacaattggacaggagctcattgtagacggcgccgtgattgtaaccacgccacaggacatcgctctacgcgacgccgtccgcggctttggtatgttcgagaaaatgaacatccccgtccttgggatggttcgcaacatggcctactttgcctgcccgcagtgcggtcatcaaacgaagatcttttcccatggtgaaagtcatggccatggctcggcggactcggactcgggcgtagttgccgagtgtaagcgcctaggcgtggaattcctcggggatatccctctcgatgccaaagtctgcgaggacgctgaccgcggagtgcctacggttgtttcagaggaaagtgatgaccgcagcgtaaggcgcaaggcttttctggatgttgctcacaggattgcgcaaaaaatgggctggaatggaggtactaatactaccatgtaa

SEQ ID NO: 8318 - DNA, 534 bp, A.fumigatus
cggtttgtgatcatcaggatcagattgttaacctcaaacagaaaggcgaggcttcgcaggcaggacccaatcaatctcggaaaacaatatgccggctcgaaaatcagccgagaggcgcttgaagccgagagtgatgacgacctgtttagaccacgctcaagcgacgaggaggaggatagtgaagacgaggaagaagaggattctgagctaggaagcgacgaggacgaagatgcatctgaagagagcgaagaagagcgaccacagagatccaggacctccgcgaaggatagcaagcggcagaggaaggagtcgcaggtttcttcggacgagaaggacggcgagggcatggataccgacgggtctgaagagactgaaggaagcgaggacgattcggaagatggattcgacgaggatgacatgagcggagaattttcctccgacgacgatcaagagggtgacgaggacggggatgacgacgaggacgaggacgaggaaactggtcttcaccacggggctggaagggtccgcgcatca

SEQ ID NO: 8319 - DNA, 645 bp, A.fumigatus
gattcaatacatcaactcaaccgactttatccccacaagccatttcgttcgattcgatcaacacccaaatctagacgagagaaacgtttgccgcaagtcgctgattgcattggtaacggcgcggacagtgcggcgacttggttagaggctaaagcagcaccgacgggtcaaatgtgcggtagcgtggcgaccaccctgtggaattatctcaaagctgatgactacgcggccgtcaagaacttggcttggacagctggctcgggaattgccctgaacgtcatcggtaacattccaaactactatatcaacgcgcttctggcgaagcaaagtgcgtctggcgaaccttctgatgcatgcggtcaaaataatgattccacatatgcttcagacgctgctagttcagtttatgagttctgcctgtcaatccagactgagaaaatggaaaacacagctacgcgatttgacgctatggactctaggagttcgtccacctggcctgctggcgtgcaaggaatggccaagtactttatctcccaacaggctgaaacttgggcgccgatttgcgcagcttatggcatcacttggaaacgcgacatgcttctgcgtttcaagacattaactgcttcttggtttgcaccatggtga

SEQ ID NO: 8320 - DNA, 396 bp, A.fumigatus
gaagtaaaactcctacagatattgtcaaaagtatacaagtcttcaagcaaaccaccagtgaagaatctttctttctttcttgccgacatgaggcctcaacttctgcttatctatgccgttctggctggtgctgaaacgactgcaactgttgatcaatccccccaagagcactttggactacactcacagttcatcgacaagcttggggctacctataacgtttttgtcaaggacttccatggcacgcataagattcaatacatcaactcaaccgactttatccccacaagccatttcgttcgattcgatcaacacccaaatctagacgagagaaacgtttgccgcaagtcgctgattgcattggtaacggcgcggacagtgcggcgacttggttag

SEQ ID NO: 8321 - DNA, 2655 bp, A.fumigatus
ccaagggtgagatttgaaaatgaaggcgcaagacctggggtatggcctttagatggaagtggaattctgcctgaaaataagttcgtgggaattaccaaagaagttccggaacccatggcggtacgtttttgtctcaccaatttgaattcggggggggaatcaggggagatacctaccggggctgtggtcggtttagttttaaccataatgttccgaaccagcagggttgtgagtggcattcgttggcatttgaacgaattcacaggacgaaatatgatagaagaaggtggaaatcctctaactctgaaggtgcattttgataactcagccgggaaccagcacagaggatttttggattgcgccttgtcagagacccaacaatggttcatggaagaagagtccgccgcatgtccatactgtcgttctcaggtgcctgaagaaagcgatgctggctggctaccctcgcgaacaagtagaccgcgtcccagaaggcacccgcagaagagaggattaacaagtagtaaaagggctagaggcaacatgcctgacacccaggaatcccccatctttccgatgcggcattctacaaggaagatctacgctcatgccagaacctctgtcgactgggatgaagatctacggccgagcgatgagcctgaaaagctcgaaagtcagaaaagtattggtgtcacatccatttcgtctcctttccccggagagaactttatttttggtcagacttccagtacagggacgaaaagaaagtcgaagcgcaagacatcgttctgcaagcgccgaaagacctccagaaagacgggtagggacaccggaaagggccggcatgagattgaagaaagtggtttgggccaagaatcagatctgaaaggtacggtggatgcaacctacatgcctgaggtgaacgctcagagcgagacttcaaaaggaagtcacaccaaggcggacagagcgtctatggatgacagtgatgaagagtgccctccccgacagcttgaaagtcttaccgacgaggcaccggaggctgcactggttgcagtcatggaagtatcaggggtcgagcaaagtgttgcattcctgatggatcaggcacaggagataggctgcccgcttattttcgagtcgtccaggggtacaggcgatcaacatgcaagccaaaggtccaatccgcagattcagatgccaagttcgaactatgaaggagatattatttcctatcctgacttcgaagagggtgagcttggaggtagaggagcagtcgtgggtaagaagttggcttctgcctttcatcctgattgcactttttacctccagggagaggagaaggaggatgataacactatccgtgacggagtcactggctcagtagacaaagaagatgatgaaagccacgcaatgagcgcttcggcattacagcataatgattttgaaacgcgtgcggtcaaggtacagtcccaggcggccatggggtctcggacgaaccgaacaacacatctctctccagattctgcacaagcagtggcagagaaacaaactagccgagaatatcctgggagtatacagcagatttcatcaacgaggctaacaagaaggaaaagtagggttgtccagacagagaaaaacaatgcatcgcggaagaagaaagcacagacaaagccctcaacggtggccagcagtgaaaaagaaaaccaggctgatgagattgaatgccaatcccaggaaatttgtggtctagggcaaaggaagcccggcttatatgctctgaagaagccaggccacggaaatcgcagagcacagacttcgactagagaaagggaaagggtcacgtctggttaccacagtctcaagttgatccaccggatacagaaacccgaagaaggaaattcatcagattcagacaacccgaagatactctctcgtactaagaccattccgaggctgactcccaggaaggccatagttgacaacaatgggagtccccggctggtctcacgacacattgctggatcccaatgctctacccacgcaaacctcaactttacgcaaagatctggaaaattgatgcgcgcaggaatgaatttggtttcgcaaagatctagcgaatctggatacgaggcggattttgatgagcaactagaacagattccgcttgagacacatgagatctcttcatttcgtacgaagatggatgctcatcgcgataaatatgttcacagaaattgcgaaacagcaacccacgaggaactttctgaaaatcctgtgactggttgcagagaagggttggtcgcgtcaaaagtcgtaaccgcatcaggaaaggagtttatgatgcgcttttcaacgaagccgcccaaaaagtccccaagaaggttggataggtcaaatgcagaaggcgatggaccgacacagctctcttccaagaaagaagggtgcttcatagattccagctgtgacccaactgaaatgagtccaagaagcgaggagttgcctcgtcaggctgacttagtatcatcattgcagtcactgtatgagagcgcccatgatatgctcctgattacgaacgaggtatgtcaatgccattatacaattcattatgaccgtgtattgctaatgcagcgcaaagcacctattgcacggacttga

SEQ ID NO: 8322 - DNA, 198 bp, A.fumigatus
aattggtcaacaaccctcacatcatgcaactcctcatccatcttcatcaattcggacatgacaagtcatacatggaacccctcgcacatgctcgatgtttctgctatctatctacactgcacatccaaatctctaggaccagtcctagccgaaatgcgtctgtcccccggtggagctctcctgacgatccctccctga

SEQ ID NO: 8323 - DNA, 282 bp, A.fumigatus
tcggccattggtataaatatcctaccccttcagcccactctcttcaccctcacttccccatcattctcctctatctgtcatctgtccattgacagcagcgacatgttttcgtcgctcttgaaccgtggagctttgctcgcggttgtttctctcttgtcctcttccgttgctgccgaggtttttgagaagctgtccgcggtgccacagggtttgttctcccgaccccccgcctcttacgtcgtgactgacgagaacaggatggaaatactcccacacccctag

SEQ ID NO: 8324 - DNA, 597 bp, A.fumigatus
ctgacgagaacaggatggaaatactcccacacccctagtgaccgcgatcccattcgcctccagattgccctgaagcaacatgatgtcgaaggttttgagaccgccctcctggaaatgtccgatccctaccacccaaactatggcaagcactttcaaactcacgaggagatgaagcggttgctgctgcccacccaggaggcggtcgagtccgtccgcggctggctggagtccgctggaatctcggatatcgaggaggatgcagactggatcaagttccgcacaaccgttggcgtggccaatgacctgctggacgccgacttcaagtggtacgtgaacgaagtgggccacgttgagcgcctgaggaccctggcatactcgctcccgcagtcggtcgcgtcgcacgtcaacatggtccagcccaccacgcggttcggacagatcaagcccaaccgggcgaccatgcgcggtcggcccgtgcaggtggatgcggacatcctgtccgccgccgttccagccggcgacacctccacttgcgatcaggtcttcacccctcattgtctcaaggatctgtacaatatccgggactaccaagccgac

SEQ ID NO: 8325 - DNA, 195 bp, A.fumigatus
cctgtcaacactattcttgatgttatccaggattactctgtacatccttactctgcagaaatgtgtgccgtttgtatctgcctcggtccagtgtcaagcaggaggtcagttcataattactcgtacccccatccccatttgcagcccggcaagatccgtaccaccaaattgcattgcagtatgacgatggagtag

SEQ ID NO: 8326 - DNA, 429 bp, A.fumigatus
acccgtttcttccaaacacccttccatcctgttattctcgaaatcgatgcaacgcacacgatattcgtcatgagtcaggagtatttccccggcaagggcgcatcggccggagagggatcctctcggcaccctcccgaggatgtttcctcggagaatagccctccttatccacgacccccgcctacgtacatgactgtcgggaatgggtcgacgtctgagagcgccacagctctcatggcttcgttgaatgcggattcgggctatggaggcagtatcgcgagtggaagtgtgatggatggtgatgagggggccgggtggcgagcggatatgatggttgataaaccgacgccggtgcctaacacctccagtattggtaactggaatccagctggtttcgaattttgttcgtgctgggatgataaggggtag

SEQ ID NO: 8327 - DNA, 225 bp, A.fumigatus
atcgtcgaatgggcattcgggaagcgcatgacgccagcggagcgtctacgcaagcatcaaagagcgctcgatcggacgcagcgagaactagacagggaacgaatcaaactggaaaaccaggagaagaaactgatacaagacattaaaaagagcgccaaaaatggccaaatcggagcctgcaagatccaagccaaggatctggttcggacgaggaggtatgtatag

SEQ ID NO: 8328 - DNA, 567 bp, A.fumigatus
gtacatccagaaattttatcagatgcggacgcagttacaggccatttccctccgtattcaggtacggcagcggttagagagctggcggatcagtgcgctgacattgacatacagaccgttcgaagcaatgaacagatgatgcagtctatgaaaggagccacgatgctcctaggaagcatgaatcgccagatgaacctccccgcgcttcaacggattgcgatggagtttgagcgagagaatgatatcatggaccaacggcaagaaatgatggacgatgccatagacgaagctacaggtctagaaggagaggaagaggaaggcgaagacatcgtgaaggaagttctggatgaaattggtgtcgacctcagccaggcggtatgtttcatccagtggtctacttctcattcttgcgctttactgacatttctaccacagctgggtgaaactccgtcggatattcagaagacatcagttggcgagaccagagttgcccaagcggttggagccgggggtgggactgccagcgatgacgatcttcaggccaggctggacagtcttcgacggtaa

SEQ ID NO: 8329 - DNA, 576 bp, A.fumigatus
tcgtcgatttccgtcgacacaagtgcatgtcgtagccgtcataccatccacggcagttcgcgaacacactcgtcgggcgtcattcatcgaacgaatgataacgggatgactccgcgtattctttctgagcagttggagactgcacattccagatcatctgccgcacggaattcaggctcccactcgaggtctttgtcctccaacaagaccgttactgctattcctccgagcctgttaccgtccgcacctgcgtcacctccgactccagcctctagcccgacccctcaccagagacctccaacgtggcagtcctcagatgaggacgatgacgcctttctcctgaattccaggatacattttacttctttatccagcgcgaagaagcagaggtttttggagggtgtactcggtctgtgcgatagtcagcttctcagctatgtgtcaagttatgtcgctccacggttaaggaaagatccttttcaagtcttcccaactgaactttgcttgagggtaagcttttccgttgacgaccgcttgactttgcctgatagaactgacctaagcactcttcattac

SEQ ID NO: 8330 - DNA, 525 bp, A.fumigatus
gccgcggagaacgagacttgggatgagtctgaacacatggagaagcgctggaagatggcgctgaagcggaaatatatggtcatgggtctggccactgttggagggggtttgatcatcgggctctccgctggtttgctggccccggtcatcggcgctggtcttgcagcgggcttcacaaccgttgggatttctgggactagcgctttcttagggggagccggtggcacagccttgatcgcttctggcgctaccttgacaggaagtactatcggcctaagggcttcacacagacgcactggggcagttcagacttttgagtatcgtcctctccacaacaacaagagggtcaacttgattgttgcgatttcaggctggatgactggcaaagtcgatgatgtccgcttgccattcagtacagttgatcctattatgggcgacatttattcagtcctatgggagccggagatgctccaaagtatgggtgccaccatcaacattctagcaacagaggtaagcgtctcctga

SEQ ID NO: 8331 - DNA, 1305 bp, A.fumigatus
gccttgactcagggtctgcaacaggttttaggaagcactgtccttatggctttaatggcatccctgcagctacctcttgttctcactaagttgtcatacttgatcgataatccttggaatgtctccctagctcgagccaacgcggcagggctgattttggcagactcgttgatggatcataacttgggcaagagacctgtcactctactaggtttctcgcttggggctagagtcattttctcgtgtctgaaagagctcgcagataagggcgctagcggcctggtccaaaatgtctacctcttcggggctccactcgtggcaaacaaggacgaattcatcaaggcacgcagcgttgtctctggccgctttgtgaacgggtactcttccaatgactggattctgggatacctcttccgggccacaagcggcggtattatgcgtgtggctggtattgctccggtagaagggattcctggcctggagaaccatgatgtcactaacctagtcaatggccacatggactatcgtgccgctattccacggctactcaaggaagtcgggtgggaggttctcagcgaggagtttgctgaaatcgaagacccagacccggagaatcatggcgagcggcaacgagagttgatccgcgaaattgatgaggctcgtaaagccgcagaagctcaacctgagaaaaagcggtttggactgttcaagcgtggcaagttagctgagaaaaagggatgggaaacatatgacgtgaaacgcaatgactcgtttccgcgtgaatccactgacagcaacggaaccggagccgtccttttcgatatcgatgcgatcagggcagaactcgcctcagagatgattgaggtcaagcagctcgagtctacgctcccacccatgaagctagatctcaattcaccgtcaactcaatcaccagctgctgctacaccgtcagagcatagagctcctaaggatggacgcgctaccccatccgttcctcagacacccgatgaaaattccaggggccactcggcctctcaaaagacgcaatctccaccaccccgccaggagcagatccatatggcttttgatacttcctacgataaccctccgcaacgttctcattcttcttttgaaccagcttcttatgatttatgtccgacgagaccagctttacgatcatctgtgacgatgcccactagtgtcggtgccagcgcgcttggcgctatggctctggagcccaatgcctgggctgaccacgacttcggccacggcgaagagggtgagatctcgatgaccttcgagtga

SEQ ID NO: 8332 - DNA, 435 bp, A.fumigatus
actgccccagtgcgtctgtgtgaagcccttaggccgatagtacttcctgtcaaggtagcgccagaagcgatcaaggctgtgccaccggctccccctaagaaagcgctagtcccagaaatcccaacggttgtgaagcccgctgcaagaccagcgccgatgaccggggccagcaaaccagcggagagcccgatgatcaaaccccctccaacagtggccagacccatgaccatatatttccgcttcagcgccatcttccagcgcttctccatgtgttcagactcatcccaagtctcgttctccgcggcttattgcatctcgagagcatcaatgacacgcttgtcaaagcgggcaatttgcaaccaggacacttccatagactgcccgaccctttccagcaaagatcgggatcgggcatcgttatacaccgccgggttg

SEQ ID NO: 8333 - DNA, 726 bp, A.fumigatus
  unsure (317): Identity of nucleotide sequences at the above locations are unknown.
ggaaaagcgtcgagaatttttagcacgcccagcataggggtcttaacggaaacgaaagcccggccttattccccgcccaacaatttcggcgacgataattcccggcccgcaagccaagcaggcggtactccgccatccgctgccggtgtacgcggcgcgtctcctcgtggtattgacccttttggcctctcgcagactccggttcagggcaacaccgatactgctggtggagcgtctctccagtccccctctcgcgctaacagcacttcatctccgagctccggcatgaaccctatcttcggaaaattagagggctntgaccaacccccgacctcaacttcctcccctggtagggcggattcgccctcttcgagacaggcagccgtcaaacccaatgctggcgcgattggttccgtcggcccgatcggctctcgcccagttcagcagtcaggcccttcccagatctccaatcctgctctgaacaagcgctccacgacccccttgccatccccccttggctttggcttcacgtccagtgacggagtcgcttctggagcgaacaacgaccgtgcggcctcttctgcctccaatcctgttgcctccacccccgccacaaacgccggcgcgaaggaatcctccggcggtgtcggtctgggctggggcaatggcagcggtgtatggggctccaagggtggcctgggggtccaggcctccgtttggggctaa

SEQ ID NO: 8334 - DNA, 198 bp, A.fumigatus
gtcctgaatgcaatgtttcgtggcaatttctgttttgcttatgtgcctgtcttccttgtattggaactttctacttacttcattagtcacgtgattgagttatctgttttcagccacaaggcgacctacgtcctcgctgtgtatgcacaagaggttgttgatgcactcctgggggatgaacacgttcatgctagatga

SEQ ID NO: 8335 - DNA, 894 bp, A.fumigatus
  unsure (553): Identity of nucleotide sequences at the above locations are unknown.
ttcacagatattatcttggctttttgtgacgttgagggcaattacttcattgtgctggcataccgttatacgacaatgcttagcgctcagttgatcaacttgtggaccatcgccgttgtcgtttttatctccttcctcttcgggcgcgttcggtatcatataacacagattttgggtattttgatctgcattggcggcatgggtgtcttgattgcatcagatcatatcacgggctcaaacggaggcgatgtttccagcggcaaccaaatcaaaggcgacctctttgcgttgttgggtgcgagcttatacggtctcactaacaccggagaggaatacttcgtcagcagccgccccgtgtacgaagtgcttggtcagatggccttcttcggtatgatcatcaacggcgtccaggctggtattttcgaccgtcactctttccaaatcgccgtctggaacagcagagtcggtggctattttaccggatacaccctatgtcttgcattcttttactgcatggcgccgctcttattccgcctctcctccgcggcctttntcaacatctccttgctgaccatgaatttctggggcgtctgcatcggcatcgaggtcttccactacaagatccattggatgtacccgatcgcgttcgtcctcatcattgtcggccagctcatctacttcctcggaaagcgagtcctcggcgaagcccgcaagccttggctcggcaagaaccaggaacgtggctttgcgggactcttcaccgcaaaggcgaagatcgactctgtccgcgctaagttggcttctaacaataatcataatgttaatgctggtggtgcccaccatgacgaccgcactgcggctacgattgatgagcgtcactcgaatgccgtttga

SEQ ID NO: 8336 - DNA, 243 bp, A.fumigatus
ctaaagagatggatattgttcattgaaaagggcagcaaagaatgtttcacctcctatgctcccttcgtagacttgattctcgaggatcatgaggctcttgccaagcatcgccatctggaggtgtatgatgttgctgtctttgtgacggtctgtgccatcagccagttatcaaagaaattaatgcctgtggctcaagctaagcatgacatatgctcccagaaccataagaataagaccccatga

SEQ ID NO: 8337 - DNA, 222 bp, A.fumigatus
  unsure (24),(192),(222): Identity of nucleotide sequences at the above locations are unknown.
cccagaggcaccatcaccccgttntgttccgtcaccaagatcgtcactgctctcgccgcgctcaccttcgtcgaccgcggccagtttgaccctaacgccaaagtcgcccagtactggcccgagttcgccgcgcacggtaagcaggacatcgaggtccgccatgtgctcagccatactgccggcctacccgcntgggatccgcccctgtcccgcgaagaatan

SEQ ID NO: 8338 - DNA, 756 bp, A.fumigatus
tacaacacgcccctggccacgcagaaactcatccagcaacaaccctggtggacgcccggctccgcctcgggataccacctctcgacccagggcttcctactcggcgagctcgtgcgccgcgtctcaggcaagtcgctgacgcagttcatcgccgacgagcttgcggccccgctcggcgcagatttccagctcggcgtcgcggagaaggactggccgcgcacggcggatatcgtacccccgcctgcagcaccgtttcctgccctcgatccgcagagtatcgctatgcgcgcattccgcggaacccccgccgacgccacggcgagtatgacgcctgagttccgccgcgcggagcaaggcgcgtcgggtggatttggcaacgcgcgagcgatcaacaagattgcctcgatggtgacactgggcgggagtgtaaacgggaagcgcttcctctcgccgcagacgatcgatctgatcttccaggagcaggtcagcggcgtggatctggtgctggggagctttctccggtttgggattggcatgggcttgccgacgccggagaataaggcgttggagtggatgccgcaggggaaagtgtgcttctggggaggctggggtggctcaattgcgattatggatctcgatcgtaaggtgacggttacttatacgttgaataagatgggagctgggacgctggggaatccacgaactgagaagtatgtcagggctgtgtatgcggcgctggatgcgtacaagccatga

SEQ ID NO: 8339 - DNA, 489 bp, A.fumigatus
  unsure (152),(320),(350): Identity of nucleotide sequences at the above locations are unknown.
cccttttttgaggagcacttggcttccggcgaggaacttggtgccgacatttgcgtcaacatcaacggggagaaccgttgtcgagctctggggcgggctacgcagacaatgcacgcacaaagccctgacccagaggcaccatcaccccgttntgttccgtcaccaagatcgtcactgctctcgccgcgctcaccttcgtcgaccgcggccagtttgaccctaacgccaaagtcgcccagtactggcccgagttcgccgcgcacggtaagcaggacatcgaggtccgccatgtgctcagccatactgccggcctacccgcntgggatccgcccctgtcccgcgaagaatantacaacacgcccctggccacgcagaaactcatccagcaacaaccctggtggacgcccggctccgcctcgggataccacctctcgacccagggcttcctactcggcgagctcgtgcgccgcgtctcaggcaagtcgctga

SEQ ID NO: 8340 - DNA, 705 bp, A.fumigatus
ccacatacaccacagcgacgaatctgccagcttggaacgacttgccggaagggcttcacaaaacctccaacctcccggcaggggaacacccgccactgccgggggcaaatatcagctcgcctttcccccaaccagtctccaaccctttctcagggtccgccaccacctggagccccgcctactcagcgcgccccttcagtccctcctccaccaaagggcacggctcctcctccccgagtgacctcgccacctactaacccaccaggcccttcatccgcggccaacccctacgcttccttgcctcagtcccctccaatgggctcaaccatgggcgttcctccccctccgtcaattcctcgggggccatctccctacaacgccccaccttcgatgccaccaccgtcgaacaggtatgcacctagcccggcaactcaagcagcaagcccgcaactctccactagagcgcctgttcctcctccaccgcatgcagctgcttcaccctatacttcacagccaggatcgcatcctccgccagcaaatccttatgctcctagcacgccaccaccaagtcaattgccgatgcagcaggcgccgccgccccaggctacatcctcgaggccaagcaccgcttcgtcgcaacggaaggctgctcccgctcctcctaagtaccgtaagtcatttctacttcttgattcccattcgtag

SEQ ID NO: 8341 - DNA, 1941 bp, A.fumigatus
caacgcgctatgtcgtccgtattacttgacacgtccccagagcggcgcgccgctaactgtttgaccaccctcccacccgcggtgaagacagagggcaagcgtgcatcgaagattaagatcactccgttcgaggttgacgagactgtcgcaaaatctacggagacgtttgagaatgccctcaaggagggtgaccttcggagcatctgcgaaaccagagcttctcaggctgcaagtgacgaggagaaggctgactggaaggtcattgaggccttgatttcagaaaaccctcgcaagagtttgatcgagtatctcgggttccaggatcaagacgacgaaactgctgataaactggcccagcttggcctgaataaggaagaagacgaggtgaacggaaagtcggccaaggaatcccgcgggtcgggagccaagaagcacaagcgcctgcagtcgatgtttgatgcgaaccctgaagctgacaacttcctgtccgatttagctgcatcgaagggagccaagaccaacaacccattccagatcttcaatggctctgagaccgaagcagacaagggcattactcgagctttgcttctgggaaactttgaaaaggcactcgatgtggctttgaaagaggaccgcatgtcagacgcgttcatgattgcaatctgtgggggccagaagtgcatcgagaaggcgcaggagcattacttctcgaagcaaaccgatgggccgaactacatccgcttgcttgcatccattgttggcaaaaacctctgggatgtcgtgcacaatgccgacctgtctaactggagggaagtcatggctgcgctttgcacatttgccgatgacaatgaatttgccgatctctgcgaggcccttggtgaccgcctggaagagcagattcgaaacaccgaagacaagagcctccgcaaggacgcctctttctgcttcctagctggatccaaactcgagaaggtcgttgctatctggatcgaggagcttcgtgagaacgagcagaggagcattgagacagctacagacgacacttccttctcaatccacgttcgtgctctgcagagtctgatcgagaaggtcaccatcttccgccaagttaccaactttcaagatacggaacgtaccaaggacgccgactggaaactcagcatgctctatgacaagtatatcgagtacgccgatgtcgtggccactcacggacgactgcaagttgcccagaagtacctcgaccttgtccctgagaagcaccctgaagccgagatcgctaggaaccgcatcaagctggcaatgaggcacgctacacctcagcgctcacaacaaactgttcccaccaccaggacacccgtcaacaagcccttgccacaagccagcatgtaccctgcgcagcccgccttctctgcacctgccgctgctcccgcagctgcaactactgctccccggaatccttatgctcccccaacggctgctacgacgcagcccgtaaatccttatactcctcccagcgcagctgcgacccagccgcagacaagcaactcatatgcaccaattggcggtggaggttatactcccgcaggatatcagcctccccagctgccaacttatggtactcagccgcttggcggctccgttccaccaccccctcgcgcttccaaccaatctcctgccactgtgaccacatacaccacagcgacgaatctgccagcttggaacgacttgccggaagggcttcacaaaacctccaacctcccggcaggggaacacccgccactgccgggggcaaatatcagctcgcctttcccccaaccagtctccaaccctttctcagggtccgccaccacctggagccccgcctactcagcgcgccccttcagtccctcctccaccaaagggcacggctcctcctccccgagtgacctcgccacctactaa

SEQ ID NO: 8342 - DNA, 429 bp, A.fumigatus
  unsure (142),(143),(144),(145),(146),(149),(154),(156),(160),(164),(186),(187),(188),(189),(222),(244),(278),(285),(298),(299),(319),(320),(321),(351): Identity of nucleotide sequences at the above locations are unknown.
ttcccattcgtagttctgactttgataagctcccggcgaccgctcccacatccccgcagacgccatgcctatttacgagatcctctccgccgacatgcagcgcgtgaagtctcgagcgccatcctccttcaaagcgcaaggnnnnnggnccccncncgcngccnggcccgggggccccggcccccnnnncgcccggcgcggcgcccggggccccggggcccnggggagcccccccccccccggngcccggcgggcccccgcggcccggccccggccgnggccccnggccggaggcgcnnccgcgccgacccagcggggnnnccggggccggaccgcccaacccaaggcggncggccgagccccaaagaaaaaaaccaaccaggaacgggaggccccccaaaccgcaaagaggggaccactcaaaggacc

SEQ ID NO: 8343 - DNA, 438 bp, A.fumigatus
  unsure (77),(107),(108),(109),(129),(130),(143),(150),(184),(206),(239),(240),(241),(242),(264),(268),(272),(274),(279),(282),(283),(284),(285),(286): Identity of nucleotide sequences at the above locations are unknown.
tcctttgagtggtcccctctttgcggtttggggggcctcccgttcctggttggtttttttctttggggctcggccgnccgccttgggttgggcggtccggccccggnnnccccgctgggtcggcgcggnngcgcctccggccnggggccncggccggggccgggccgcgggggcccgccgggcnccgggggggggggggctccccngggccccggggccccgggcgccgcgccgggcgnnnngggggccggggcccccgggccnggcngcgngnggggnccnnnnnccttgcgctttgaaggaggatggcgctcgagacttcacgcgctgcatgtcggcggagaggatctcgtaaataggcatggcgtctgcggggatgtgggagcggtcgccgggagcttatcaaagtcagaactacgaatgggaatcaagaagtag

SEQ ID NO: 8344 - DNA, 654 bp, A.fumigatus
ttatacaataaaaacagccaagcgtttgttgagttcacaacactccaagctgcgacagctgccaagcatcaaattgagaatttgaacgtctcaagtcaagggggccgcaaatacatggttcattatacgaaccctcacacaaatccattccgcacacttcctaaggacgctcctatgcgcaaggacaaccaggcgcgctcactatcaggcggtttcaactcgccgaatcagaatatgaattttggaatgaacaacatgggcggaggcttccgcggcggacggggaggtttcaacagccgcggcggcatgaacaacatgggaggctttgggggcagaggcggctttcaaaacacaatgggcggttttcaaggcaaccctatggtcggaggcttccagggcaatccaatgggagggatgcagaactacggctttaacaaccgtagcaatatgatgggcggcggcatgcgtggcggtcctggcggaatgcgcggtcgcggtggtatggctgggccgaatatgatgggaatgccagcgatgaatcccatgggtggtatgggtatgaatcctatggccggtgggatgaacccgatgatgggtggaatgggcggaaacatgggcatgcaaggtgcgtccagctggtgctcgatcacttag

SEQ ID NO: 8345 - DNA, 498 bp, A.fumigatus
tatcgcgatttatatctaaacacgatggccactgaagatgataacttcgatattgacatctatggtgacggcggtggctacaacaccaacgatcaaggagactatatcaaacatgaggacacggagctgatcctagatgcaccagagcagacacaaaacggcgccgctagccaggaccaaaacagtacagagcagaaagctcaacaggagcagggagacagcaccggtaccaacggtgaacacgtaacacaggcgcacgctgtccagcagcaagaagcttctcaagcagccccggcgccgcaacagggtgtaaagcgcaaggagcacgaggatcgcccatcggacccggacgctacaactgctttacttatttctgacttgtattggtggactactgacgatgacatccgtggctggatcaatgcagccgggtgcgaagatgaactcaaggatgtaacgttcagtgagcacaaagtcaatggtaaaagcaaagggtag

SEQ ID NO: 8346 - DNA, 462 bp, A.fumigatus
cggaaagtgtttctaagtgatcgagcaccagctggacgcaccttgcatgcccatgtttccgcccattccacccatcatcgggttcatcccaccggccataggattcatacccataccacccatgggattcatcgctggcattcccatcatattcggcccagccataccaccgcgaccgcgcattccgccaggaccgccacgcatgccgccgcccatcatattgctacggttgttaaagccgtagttctgcatccctcccattggattgccctggaagcctccgaccatagggttgccttgaaaaccgcccattgtgttttgaaagccgcctctgcccccaaagcctcccatgttgttcatgccgccgcggctgttgaaacctccccgtccgccgcggaagcctccgcccatgttgttcattccaaaattcatattctgattcggcgagttgaaaccgcctga

SEQ ID NO: 8347 - DNA, 765 bp, A.fumigatus
caaggcgcatcatgtaagttggtcatgtaccgtgtcttctgtccaatagggcatgctgacggttgtttactggcccagagattcaccggtcctcagattctccgaatgcagaggaaatatcccgaggtttacaaaaagacggccagaatctcgcttgtgtcatcgtttcttgcgtccttgctcttgggccacattgcacccatggacatctcggacgtctgcggcatgaacctgtgggatatcaagaagggtgcttacaatgagaaactccttggactttgtgcaggaccatttggcgtagaggacctcaagcggaagctaggtgccgtcccggaagatggaggtctacgccttggaaagatcaatcgctatttcgttgagcggtatgggttcagctcagactgtgagatccttccttcgactggcgataacccggctactatccttgctctgcccttgcggccgtccgatgctatggtgtctctgggaacttccactactttcctcatgtctactccaaactacaagccagaccccgcaacgcatttcttcaaccaccccaccacccctggactttacatgttcatgctttgctacaagaacggtggccttgcacgagaacatgttcgtgatgcaatcaatgagaaatcaggcagcggcgcgtcccagtcgtgggagagcttcgacaagatcatgcttgagacgcccccaatgggccagaagaccgaatccggccccatgaagatgggcctgtttttcccctag

SEQ ID NO: 8348 - DNA, 510 bp, A.fumigatus
aaacttgatccggtcggtggccttctcatttccttgatggtgattaaggctgggtgggccaatactacaacatccctactcgaactagcagatactacggttgatgacgacatcaaagactccgtgcgcaatgcagcatccaagatcctagccaaactcgaagatccacacgcgattcagatccgggacgttcagggtatgaaatctggacaaaactacctcatggagattgaattagcggtgccgggggcttggtcgctcagtcgatctcgcgagattgaggagaccgttcgacatgccgtcggggccggtgtgcgcggggtcaagcggctcaaggtccgatttgtcccttccgaactggagcatctggactttacggaggagtttatcgctccagaggtcatcagacaaagtagccccgagccgcaggagggcgatattgatgcggtacatgaggcgcatgcgcacgaccatcaacacaagggaaatgagaaccgcaagacccgttaa

SEQ ID NO: 8349 - DNA, 903 bp, A.fumigatus
  unsure (693): Identity of nucleotide sequences at the above locations are unknown.
atattgcctggtaaattatggtctatctcacccaatgtaaaagggtgggtgggggaccaggaggttaaaaaccatttcccccaggaaccatcttttccttatcctgaaattgcccgagaaagggataaattggtgagagacagcttccacctgacattttgccaattgaccatcagtctcgccttaaacccttcttattgtcttcggatcttcttctattcctatttctttaataatacgccccattttgtttcattctttttcctcaccctaccttcgtctgtgttgtcaccggctttcttatccgtatcgacgtcatcttatctccccgcggggttagattctcagtcattcaactctcatatcatgacttctcagggccctctatacattgggttcgacctctccacacagcagctgaaaggcctggtggtcaactcagagctgaaggtggtgcatatctcgaaattcgacttcgatgccgattcccacgggttctcgatcaaaaagggcgtgctcaccaacgaggcggagcatgaggtcttcgcacccgttgcgctgtggctgcaagccctggatggcgtgttgaacggtctgcgcaaacaagggctagattttagccgtgtcaagggaatcagcggcgccggacagcagcatggtagcgtttactggggcgagaatgcggagagcctnctcaaatcgctggattcaagcaagtcgctggaggaacagctgagtggagctttttcgcacccctttagcccgaactggcaggatgctagcactcagaaggagtgtgatgagtttgacgctttcttgggaggcccggagcagttggctgaggcgacgggtagcaaggcgcatcatgtaagttggtcatgtaccgtgtcttctgtccaatag

SEQ ID NO: 8350 - DNA, 300 bp, A.fumigatus
gaggaaagatgcaagcgcttttgcttaacgggtcttgcggttctcatttcccttgtgttgatggtcgtgcgcatgcgcctcatgtaccgcatcaatatcgccctcctgcggctcggggctactttgtctgatgacctctggagcgataaactcctccgtaaagtccagatgctccagttcggaagggacaaatcggaccttgagccgcttgaccccgcgcacaccggccccgacggcatgtcgaacggtctcctcaatctcgcgagatcgactgagcgaccaagcccccggcaccgctaa

SEQ ID NO: 8351 - DNA, 561 bp, A.fumigatus
acactgacatctctgcagtggtacgacccagatgcggtaacgactagaaatggggtcctggagattcgtttcgattcgttccccaatcacgagctgaaataccgatcagggatggtacaaagctggaacaagctgtgcttctccgggggtcgcctggaggcaagcatatccctgccgggtgccggtgatgtgtctggattttggcccggtttctgggcgatggggaatctggcgcggcctggatacgctgcgaccacagaaggaatgtggccgtacagttatcatgataaatgtgatgcgggcatcacaccaaaccagagttctactgatggcatcagttacctccctgggatgcgcttgcctgcctgcacctgcgcaggcgaggaccacccaagtcccggcaaatctagaagtgcgccagagatcgatgtgattgaggcaagcgtgactgctctgaataacaacccaaatgcagttattggctctgtctctcagagtttgcagatggcgccgtttgacatatggtacatgcctgattacggtaagtgttactcactctga

SEQ ID NO: 8352 - DNA, 225 bp, A.fumigatus
ccacaatggcttcctagaacggcggtgaaaggcatgcgagataaatctgggcctaagtgtaatccgagcgatcctctctgtctggaagtacgggaacgcccgttgctctcgaacatacgaagaggcctgatcgatccggacacgccggattccgccaaaaccaagaaagccgcagatgggaaggagtggatacttgtagtaagccgagggcccttttttttgtga

SEQ ID NO: 8353 - DNA, 189 bp, A.fumigatus
ctttttgtcacctctctagacggaaaactgacatctatgattcagttttcggacgaattcaatactgaaggtcggacgttttatgaaggagatgacccgttttatcaggcggttgatctctggtatggcgtgacacaggacttggaggtcagccatgagacatgtattgcgaactggagtaaacactga

SEQ ID NO: 8354 - DNA, 396 bp, A.fumigatus
cgaaattacattcgaaatctgctaactgacttcaggggcactaccttcctgatcgggccctttctaggccctgcactggccggatatatcggtgctggcagcaattggaaggcctcgtttggcgttctgacggccttctacgcgctgtcgacaatactgatctttctcttcggatacgagacttactatgctagaggacatcaatgtcagcgtaattcgcgcctgcagtcaatgtttggaatcaaaaatcacagcctacctgtcgggcgcactctggcccactggaccaagatccttgccatatacatcttcaagttcccgctcctcctgactggaattgcaacaatggtcaacttttgctggccgatcggtgggtggtctgatcctgcaacatga

SEQ ID NO: 8355 - DNA, 429 bp, A.fumigatus
aatacgctatgtgcccttaatcagcttctacgacaggaggaaaacactgcctctgagcagacaatgaccttgcaagtccctctgctcgggaggctgcacatccgtcgcaacgtgaagcctccacagtcgactgcgatcaacgcgaaagcatcatccacattagctccctcttctcatgctctgagtcaaggcaatgtatctgcttctttcctacagggcccggtcggctgtcaactgcccaccgtaatggacggcgcgactgttgtccaaaatggatggggatggaacgacttctcctggtctatcgaagatacccatcagagcctgttcaatgatgctttcatgggcgacagtatgggacaggccgctttgtggtataatacatctaataattcactttccacgtggaatacgttcaatatattgtga

SEQ ID NO: 8356 - DNA, 609 bp, A.fumigatus
aggccggcttcttatacaagagacacttgttctccccccccgcggagttcaacccactggcgcatcgccggcaccgcaggtggggaatcgaacttcgatcccatccgcgggttcttcaacgaggacggcttctttgcagaacgcatgggctggcacctcccgggcttcgacgatagcgcctggacgtccgagaactcagccacgtccgcatcatcggcgttgagcttcacaggtgcaaccgtccgtttcttccgcagcgtcgtccccctcaatattcctgccggcctggacgtctcgatctccttcgtgctctcgacgcccacggctgcgcccaaggggtaccgcgcgcagctgttcgtcaatgggtaccagtatggtcggtacaatccgcacatcgggaaccaggtcgtgtttcctgttccaccaggtattctggactaccagggcgataacacgatcgggttggcggtttgggcgcagacggaagagggtgctggcatccaggtggactggaaggtgaattacgtggcggatagctcgttgagtgttgctggatttgggaaaggcttgaggccgggttggaccgaggagcgattgaagtttgcctag

SEQ ID NO: 8357 - DNA, 216 bp, A.fumigatus
cccggttgcctttactttctgagtgcctggtacactcgcaaagagctgggcttccgcactgctgccctctactctggttctctgatctccggtgctttctctggtctcattgctgctggtatcaccgatggtatggagaatgttaagggtctccgagcctggtatggttctctatttctttttgcaccatcgagcgtagttgcgcagtcttgctga

SEQ ID NO: 8358 - DNA, 303 bp, A.fumigatus
ttgcgcagtcttgctgacttctctaggcggtggctcttcatcattgagggagccattactatagtggttgcgttcattgccatgtggatcctgcccaacttccctcgtaccactacatggctttcggaagaggaaaagcaactcgctacatggcgtctcgaggaagacatcggcgaagacgactgggttgattccgaacaacagtcactccttcatggcgcaaaactcgcctttaccgacctgaaaacctggatacttgtgagtcgctattctttacctctaactcgcaacggcactgactga

SEQ ID NO: 8359 - DNA, 423 bp, A.fumigatus
tgcagagtaagtgtcatcaatagactgagcctgtgccataaactgaccgttgtagttccatccaacttgatgttgaacaagttcggaaagcccgccatctatctcccctgtgcaatgattctttggggtatcatctctacggccacagctggtgcgcagaactttgctggactggttatgactcggttcttccttggtttcattgaggccgcttatttcgtacgtctctctaacaacgattaccatggccgtgattcctttgctgactgtattgtagcccggttgcctttactttctgagtgcctggtacactcgcaaagagctgggcttccgcactgctgccctctactctggttctctgatctccggtgctttctctggtctcattgctgctggtatcaccgatggtatggagaatgttaa

SEQ ID NO: 8360 - DNA, 477 bp, A.fumigatus
atgttacacatcttgtgtatcgtttcctccgcctccgtgactaacttcttcccaactgttgtggaaacactcaattacggccggatcgagaccctcctcctgactgctccaccttactgcctggcggtcatcagcgccttcttcaatgcctggcactcggaccgtacaggcgagaaatacttccatatcacagctcctctgtacatctcggtggccgcattcatcatcgccgcgaccaccaccggtgtggctccccgctacctctccatgatgctgatggtcccctccctgtacgctggttacgttgtggccctaggctggatctcgagcacccttcctcgtcctgcatccaagcgtgccgccgcactggctgccatcaacatggtcagcaatgccagcagtatctacgccagttatatgtaccctgaccatgatgcgcctcgcttcagtacgtcccaatacttctctatcatttga

SEQ ID NO: 8361 - DNA, 195 bp, A.fumigatus
tcattgctttctgaccgctttatagtcaccgccatgagtgtcaactgcgttactgcattcattgctattctctctgccactcttctccgaatcatccttgtccggctgaacaagaagcttgaccggggtgaggccctcaatgatggcagtgttcctggacaggccagttccagaggtttccgcttcttggtttag

SEQ ID NO: 8362 - DNA, 783 bp, A.fumigatus
  unsure (743): Identity of nucleotide sequences at the above locations are unknown.
tttctttattgttcgctcttccctttcattcttctttcaaccatcgctcttgattcttttcaaattctgagggacgacacgcggaatattttaattcctcatagtcttctttctggtatttcttcctgccatgaccaggcagtcatcccagaggttggtgtgagtcgtgcagcgatggcgatgcaaccatcctatccagctcctttcggggcggcggctatctcatctagtgcgggccaggaagttgcaagtacaatccggcggcaattcactgatgctgacgcggatcgtatcgtggagaccccactaggagagaaggcagacagttcagacacggcagggcctgattccgaggacggtattgatcaggaagggcatgacaagattacagctcttgcgcggagtctctcgcagatatctcagaagagtgcaggcccaaccaacacgtttctcgacccctccagcgacccggagctagaccccaactccgacaaattcagttcgcgcaaatggatgaagaatttgttgcacattaagacgcgcgatccagaccgttatccccgtcgtaccgcaggcgtctcctttcgcaacctgaatgcctatggttacggaacggcagccgactaccaggccgatgtagccaacatgtggctcaaagggttcgggtggcttcgaagtattcttgggtgtaggaatagggtccgcattgacatcttgcgcaattttgagggatttgtccgtancggcgaaatgcttgttgtacttggccggccaggcaggtaa

SEQ ID NO: 8363 - DNA, 1470 bp, A.fumigatus
  unsure (117): Identity of nucleotide sequences at the above locations are unknown.
ctgtgtcgcgcacatagtggatgttcaaccttcctcaagacgattgcgggagaaactcatggtttgtggctggacaaaggaactcacattcaatacgaaggtatctcatgggatganatgcacagtcgcttccgcggcgaggtcatctaccaggcagaaaccgaaattcatttcccacagctcactgcaggcgagactctgcttttcgccgcccaggctcgaaccccagcaaaccgtttccctggtgtctctcgcgaacaatatgcaactcatatgagggacgtcgtcatgaccatgctgggtctaagccacacggtgaatacacggatagggaatgagtacattcgaggcgtctctggaggcgagcgaaagcgggtcagtattgccgagactatcctgtgtggctgccccctgcaatgctgggataacagcacccgaggtcttgatagctctacggctctggaattcgtcaagaaccttcgcctgtccacggattatactgggtcaacagctatagtagccatctatcaagctagtcaggccatttacgacatatttgacaaggtcattgtgctctatgaaggccgccagatatactttggcaaagccagcgatgcgaagcgcttcttcattgacatggggtttgactgcccagacaggcaaaccaccggtgacttcttgacatctctgacgagtccttccgaaagattggtccggaaagggtacgaagccctcgtcccgcgcacaccggacgagtctgcggctcgatggagggaaagcgccgagcggcaacggctcctggctgacattgaagcatttgaaaacgagtctccgttgggtggcagcaaatacaaggagttcactgtctctcgcgcagcggaaaaagccaaaggtaccagggcgccgtcgccctacactctgtcgtacccgatgcaaattcgtctctgtctccgccgaggctttctccgtctcaaaggcgacatgagcatgaccctggcaaccgtcattggcaatagcatcatggcgttcatcgtctccagcgtattctacaacctggaccaaacgaccaacagtttcttctcccgcggtgcactgctcttcttcgcaattttactgaatgcctttgcgagctcgcttgagattttgacactgtggcagcaacggccgattgtagagaagcacgacaaatacgcgctctatcatccttcagcagaagccatcagttctatgattgtcgacttaccttccaaatttctggtttccgtcgtgttcaaccttatcctctacttcatgaccaatctgcgtcgtaccccgggacatttctttgtcttctacttgttctctgtaacaatcaccctgaccatgtccaatatttttcgctggatcggagcaatctcccgctcgatggcacaggccatggtgccctcctcgattttgtcttcagcgcacatgcaatcaacctcattgcca

SEQ ID NO: 8364 - DNA, 414 bp, A.fumigatus
atcaatgccctcctggaccagctcccacagaggactcagctctcggaggaaatggacacggtcttgaacagccttgaggacgtagtcaatctcgctatctgttgtgaaccgtccaatgccaaaacgaatgctgctgtgagcgctctcgtcgctgctgcccaatgctcgaaggacgtagctgggttccagcgaggcagaggtacaggcactaccagacgacaatgcaatgtccttcagagccatcagaagagactcgccctcaatataagcgaacgagacgttgacgcatccagggtaatggcgctcagcatccccattgagcgtggtgtgttccatcgccagaagtccatccagcagacgcttcgacagccgctcaacgtgcttcctatcatactgctcgatgtgttagtataa

SEQ ID NO: 8365 - DNA, 489 bp, A.fumigatus
agccgtgtcgggtcgaatggccgcctcgagatcctccatccggatcaatcgtttattttgaacgggcaaatatgtgacttcgaatccctcatcttgaagatgccggcagctgtccaagacacacttgtgctcagtctgcgatgtgataatgtgcttcttcttgccggaacgaccaaagaatctggccacacccttgatgctcatgttgttactttcggtggcgccactcgtaaagatgatttcctttggatccgccccaatcaatttcgcaatatattctctggcttgttcgacagccttctccgactcccaaccatatgcgtgagtcctggaatgcgggtttccgtagataccggtgagatagggaagcatagcatcgagaacacgaggatcaaccggcgtagtggcctgcatatccaaataaataggccgtgttccctgatccataacagttgcttgtttcaaaatacccgcagagggactcattga

SEQ ID NO: 8366 - DNA, 360 bp, A.fumigatus
tcagcatcatggctgtcaacaatgagattggtgttattcaacccttgggaagagatcggaaagctctgccgtgcgaagaaggttttcttccacactgatgctgctcaggcagttggcaagatccccttggatgtcaacaagctgaacatcgatttgatgtctatctccagccacaagatttatgggcccaagggtattggtgcttgctatgttcgacgcagacccagggttcgccttgagcccatcatctccggtggtggacaggaacgaggattgcgcagtggcacgctcgctcctcacctggttgttggtttcggtgaggcttgccgcatcgccagtcaggacatggaggtaagttaa

SEQ ID NO: 8367 - DNA, 882 bp, A.fumigatus
attatgtctagcgttacgccatctgtcttgagacaggcatctcgtgcctatgctcgtcgactttcgtcgacccagcatggctccctggcgaccgcgtccttccccagacgggcgctcgccacatccagtggtgccgcttcgagacggacatatgttaccgaaaccaaagctggaaacgctcaggtttcgatcgacacagccatcaaacaggagcagaagaacttcatcaagcagacaggtcttgagcctggaaaggttgaacttcctgcctctggcatctccggagatgcttcaatgagtccctctgcgggtattttgaaacaagcaactgttatggatcagggaacacggcctatttatttggatatgcaggccactacgccggttgatcctcgtgttctcgatgctatgcttccctatctcaccggtatctacggaaacccgcattccaggactcacgcatatggttgggagtcggagaaggctgtcgaacaagccagagaatatattgcgaaattgattggggcggatccaaaggaaatcatctttacgagtggcgccaccgaaagtaacaacatgagcatcaagggtgtggccagattctttggtcgttccggcaagaagaagcacattatcacatcgcagactgagcacaagtgtgtcttggacagctgccggcatcttcaagatgagggattcgaagtcacatatttgcccgttcaaaataaacgattgatccggatggaggatctcgaggcggccattcgacccgacacggctctagtcagcatcatggctgtcaacaatgagattggtgttattcaacccttgggaagagatcggaaagctctgccgtgcgaagaaggttttcttccacactga

SEQ ID NO: 8368 - DNA, 435 bp, A.fumigatus
cacatcgagcagtatgataggaagcacgttgagcggctgtcgaagcgtctgctggatggacttctggcgatggaacacaccacgctcaatggggatgctgagcgccattaccctggatgcgtcaacgtctcgttcgcttatattgagggcgagtctcttctgatggctctgaaggacattgcattgtcgtctggtagtgcctgtacctctgcctcgctggaacccagctacgtccttcgagcattgggcagcagcgacgagagcgctcacagcagcattcgttttggcattggacggttcacaacagatagcgagattgactacgtcctcaaggctgttcaagaccgtgtccatttcctccgagagctgagtcctctgtgggagctggtccaggagggcattgatctaaacaccatccaatggagtcagcattag

SEQ ID NO: 8369 - DNA, 945 bp, A.fumigatus
ctgcctgcgcggatgggcccgtcccttggtgaaaacaccgtggctcgatctattctgcgcaagcagcagtcgttcagtcaaccaaatcctcaatcgtccccgcacacgtattcttcttcagcttccccctctgacttctatcggcaagatcctcattatgggcaagatacaccgttctccgaaatggacatccctatcacggccatccacctgggcccagtcgaacgcaactgctcacagtcggtcccaccgaatatgcgttttgggcatcacatgggggatccaattcctcggccggcatccacaaaggttgaaaatcatcgtagacggccttctcataacaacaaccctgcgctctgtcctctggacgaactcgaggctctcggacccattgatactcccgaagatctcgatcggacgccccgagctgctcactgcaagacccccttcagccccgatggtccccacgccaatgatattattcacagtggctggatgaagaagcgaaaaacgacccgtctgctgcgtcatgaatgggaggaccaccacttcaccctacggggtactcagcttgccatgtacccggatgaagacgcttctcgacgcgactcgaaggcccttgaatacatcgatgtggatgactatgccgttgcctgctcatctctggcttccagttccaagttaaccgccgctttcaagaagactgttctgaagcgcagggacaacactcaaggcgaagctgcgtttgctttctgcttgatcccctcaccaaacgccggtagcgaccgcaagagcttcttcaatcaggctgctaagacgcaccgttttgctgtcaagacccgggaagagcgcattgactggatgagagagctgatgcttgccaaggcactccggcgaggccgagagagcggggccactctaaatctaaacggcaaccctctctaa

SEQ ID NO: 8370 - DNA, 258 bp, A.fumigatus
ttgttactaggggtgaaaagttccctgtttttaatggtgataaatctgtcatggttgaaaccgaaccccctgcggagactggttattctgatggccttggctgaaggggacgtcgactataagggctctgctctttgtgaaagacttagttctagctgtgatgatgcttattacaaggttgttcccagcaacacctatattacttaccctgagtatgtctatgctttaatgagaatggatgatttgacttttgactaa

SEQ ID NO: 8371 - DNA, 210 bp, A.fumigatus
tctaaggactatatcaccccactccaagtagtgactagtaggaacagcagagacgaatcccagaatgtgtcaattacttatagttgtagtgttaacccggcccataactccataaatagtaatagcaataagaagaagaagaagaagaagaagaagaagaagaagaagaagaagaagaagaaggagaagaaaaagaagaaaaagaattaa

SEQ ID NO: 8372 - DNA, 471 bp, A.fumigatus
ccacgtcgtgggtctcctggccggcgcgagcctgctgcaggccgcgcgggagcattggtccggaacactgatctgcctcttccagccggcggaggagcatgtccgcggggcgcgggcgatgatcgaggacgggctgtacgacaaagtgccccagccggatgtggtgctggcgcagcatctggtgcggatgaaggcggggacggtgagtgtgcgggcggggcggttgctgacggcggcggatgcgatcgatgtgcgcgtgtatgggcgtgggggccacggctcggcgccgcagtcctgcatcgatccgattgtgattggggcggccattgtgacgaggctgcagagtattgtgagtcgggaggtgacgccgggcgagttggcggtggtcacctgcggcagtatccatgccggccacaaggcgaatatcattccggatcagttggatttgaagctcagcgtgcggacgtatga

SEQ ID NO: 8373 - DNA, 1254 bp, A.fumigatus
gctcccaccagcctcaacggcctcattgaaagataccggccagacttaacccccttcgaagaaacctaccgacaaatccaccgctcccccgaactctccggccacgaagagcaaacctccaccattgccgcctcccacctgcaaggcctcggtttcgacgtccacacacacatcggcgggtatggcctcgcaggggttctacgcaacgggcccggccccaccgttctcctccgcgcagacatggacgccctccccgtggaagagaaaaccggcctgccctacgcaagcaccaaaaccgccaccggcccggacggcgagaccgtccctgtgatgcacgcctgcgggcacgatagccacgtcgtgggtctcctggccggcgcgagcctgctgcaggccgcgcgggagcattggtccggaacactgatctgcctcttccagccggcggaggagcatgtccgcggggcgcgggcgatgatcgaggacgggctgtacgacaaagtgccccagccggatgtggtgctggcgcagcatctggtgcggatgaaggcggggacggtgagtgtgcgggcggggcggttgctgacggcggcggatgcgatcgatgtgcgcgtgtatgggcgtgggggccacggctcggcgccgcagtcctgcatcgatccgattgtgattggggcggccattgtgacgaggctgcagagtattgtgagtcgggaggtgacgccgggcgagttggcggtggtcacctgcggcagtatccatgccggccacaaggcgaatatcattccggatcagttggatttgaagctcagcgtgcggacgtatgatgccgacactcgcgcgagagtcatcgcgggcattaagcgcatcgtcgaggcggaatgtgcggcggcgggtgccgtggagacgccgtcggttgacattgtgtcttccaccccggcgaccatcaacgacgaggcgacggtgcgtgcgctccaggagacctttggcgcctacttcggcgagaacctggtggactcggagcctatcgcagcgagcgaggatttctccctgctcgcgacggccgtcggggcgccctacgtgatgtggacgtatggcggcgtcgacgacaagacatgggcggacgccgtggccagggggacggtgaacgagctgccgagtaaccattcgccgttctttgcgccgtgtatccagccgactctgcggacagccgtggatgcgatgagcctgggggcgctgacctttctccggcaatag

SEQ ID NO: 8374 - DNA, 309 bp, A.fumigatus
ggccttgacgcagctggtgggatcccatgcgtccttgaccgcccgggaggggcgggccctgtcggagcagaaggccgccctcgagctcctggagggtatgtacatgcggacgctgtacgtggtgcacttttcggacgaggcgcgcgagtcgccgcgggatgtgcaggcggatctggaagacgcggcgctcatggcgtgggcggagtttctgcccgacggattcttagatactctggctggcggcggagtgggtgcgacgctgtcgtatgtcattctggcgtactttcatcttctcttctcgctgtttga

SEQ ID NO: 8375 - DNA, 510 bp, A.fumigatus
tccggaatgatattcgccttgtggccggcatggatactgccgcaggtgaccaccgccaactcgcccggcgtcacctcccgactcacaatactctgcagcctcgtcacaatggccgccccaatcacaatcggatcgatgcaggactgcggcgccgagccgtggcccccacgcccatacacgcgcacatcgatcgcatccgccgccgtcagcaaccgccccgcccgcacactcaccgtccccgccttcatccgcaccagatgctgcgccagcaccacatccggctggggcactttgtcgtacagcccgtcctcgatcatcgcccgcgccccgcggacatgctcctccgccggctggaagaggcagatcagtgttccggaccaatgctcccgcgcggcctgcagcaggctcgcgccggccaggagacccacgacgtggctatcgtgcccgcaggcgtgcatcacagggacggtctcgccgtccgggccggtggcggttttggtgcttgcgtag

SEQ ID NO: 8376 - DNA, 612 bp, A.fumigatus
gtgcgcatgggcccgctgcgagccatgacgcagtacggctacgcgaacgacgactggcgaatgtgtccgcgggacgcgctttgctccgtggcgtccatgcgtcgcgggtgctcaccgcgcctggttgcgttctgccgcggcgcggatgaggccttgacgcagctggtgggatcccatgcgtccttgaccgcccgggaggggcgggccctgtcggagcagaaggccgccctcgagctcctggagggtatgtacatgcggacgctgtacgtggtgcacttttcggacgaggcgcgcgagtcgccgcgggatgtgcaggcggatctggaagacgcggcgctcatggcgtgggcggagtttctgcccgacggattcttagatactctggctggcggcggagtgggtgcgacgctgtcgtatgtcattctggcgtactttcatcttctcttctcgctgtttgagtcggtttggtatgttcagggcgggtttgacggggagattgtgcagatccaagcgttggtggagatgtcgggcgagggcgagttgatgtcgctgatgcagtggccggtggctgttatcgctgtcaatcatgatcatcgcggttcatccgtataa

SEQ ID NO: 8377 - DNA, 861 bp, A.fumigatus
  unsure (551): Identity of nucleotide sequences at the above locations are unknown.
atcaaagataaaatggagctcccctcgaccatgaaagcctggctttactccaacaccaccggcggcctcgagaacaacctcgagctgagcacctccgcccgcacccccggcccaccaggccacagccaactgctgatcaaagtcatctcagcctccatcaacccggccgactacaaagtccccgaaatgcccatcgtcccgcggttttttgtgtcctatcccgccaccccgggaatggacttttgcggacaggtcgtcgccgccggccccggcgccaccgccttccaaccgggccaactggtctacggcacgacggcggcgcctgcgcagttcggctcgctgggcgagtacctgctctgcaagacggagcacgtcgctctcctgccggacggggtcgcacccgaccacgcggccaccgtcggggtcgccgcgcaaacggcgtaccagtctatcgcgccgtacgtctcggcgggggatcgggtgttcatcaacgggggttcgggcgggtgcgggatcttcgcgatccagattgccaaggcgctggggtgtancgtcacgacgacgtgttggaggcgcaatgtgccgttctgcaaggagctgggggccgaggaggtcatcgactacacccaggacgatgtgctggcggtactccgcgccccggggcccggtgtatgcgcacgccgtcgaccatattgggctgcccgaggcgctgtactcgcagtcgcatatgttcttgcttccggggaaggcgtttgtgcaggttggtgcgctgtcgatgctgacgtttgtgcggcgggtggtgtggccggggtttttgggcggtgggcggaggaagtatgtgatctttatgatgaagagtaa

SEQ ID NO: 8378 - DNA, 717 bp, A.fumigatus
ccaccgccaactcgcccggcgtcacctcccgactcacaatactctgcagcctcgtcacaatggccgccccaatcacaatcggatcgatgcaggactgcggcgccgagccgtggcccccacgcccatacacgcgcacatcgatcgcatccgccgccgtcagcaaccgccccgcccgcacactcaccgtccccgccttcatccgcaccagatgctgcgccagcaccacatccggctggggcactttgtcgtacagcccgtcctcgatcatcgcccgcgccccgcggacatgctcctccgccggctggaagaggcagatcagtgttccggaccaatgctcccgcgcggcctgcagcaggctcgcgccggccaggagacccacgacgtggctatcgtgcccgcaggcgtgcatcacagggacggtctcgccgtccgggccggtggcggttttggtgcttgcgtagggcaggccggttttctcttccacggggagggcgtccatgtctgcgcggaggagaacggtggggccgggcccgttgcgtagaacccctgcgaggccatacccgccgatgtgtgtgtggacgtcgaaaccgaggccttgcaggtgggaggcggcaatggtggaggtttgctcttcgtggccggagagttcgggggagcggtggatttgtcggtaggtttcttcgaagggggttaagtctggccggtatctttcaatga

SEQ ID NO: 8379 - DNA, 891 bp, A.fumigatus
  unsure (415): Identity of nucleotide sequences at the above locations are unknown.
tcaaagtcatctcagcctccatcaacccggccgactacaaagtccccgaaatgcccatcgtcccgcggttttttgtgtcctatcccgccaccccgggaatggacttttgcggacaggtcgtcgccgccggccccggcgccaccgccttccaaccgggccaactggtctacggcacgacggcggcgcctgcgcagttcggctcgctgggcgagtacctgctctgcaagacggagcacgtcgctctcctgccggacggggtcgcacccgaccacgcggccaccgtcggggtcgccgcgcaaacggcgtaccagtctatcgcgccgtacgtctcggcgggggatcgggtgttcatcaacgggggttcgggcgggtgcgggatcttcgcgatccagattgccaaggcgctggggtgtancgtcacgacgacgtgttggaggcgcaatgtgccgttctgcaaggagctgggggccgaggaggtcatcgactacacccaggacgatgtgctggcggtactccgcgccccggggcccggtgtatgcgcacgccgtcgaccatattgggctgcccgaggcgctgtactcgcagtcgcatatgttcttgcttccggggaaggcgtttgtgcaggttggtgcgctgtcgatgctgacgtttgtgcggcgggtggtgtggccggggtttttgggcggtgggcggaggaagtatgtgatctttatgatgaagagtaatcagcgggatatcgcgacgctgggggagtggatgcagcaggggaagctgcgcgtggaggtcgacagcacgtatgagttggaggatgcggtcaaggcgtttgcgaagttgcgttcggggagggcccgagggaagattatcattcatgtttctactgagtccagctga

SEQ ID NO: 8380 - DNA, 1122 bp, A.fumigatus
gtccaagtagtctatgctagtctagtgcccaaagtaaatacattcatttactggagttgccgagtgctattgccggagaaaggtcagcgcccccaggctcatcgcatccacggctgtccgcagagtcggctggatacacggcgcaaagaacggcgaatggttactcggcagctcgttcaccgtccccctggccacggcgtccgcccatgtcttgtcgtcgacgccgccatacgtccacatcacgtagggcgccccgacggccgtcgcgagcagggagaaatcctcgctcgctgcgataggctccgagtccaccaggttctcgccgaagtaggcgccaaaggtctcctggagcgcacgcaccgtcgcctcgtcgttgatggtcgccggggtggaagacacaatgtcaaccgacggcgtctccacggcacccgccgccgcacattccgcctcgacgatgcgcttaatgcccgcgatgactctcgcgcgagtgtcggcatcatacgtccgcacgctgagcttcaaatccaactgatccggaatgatattcgccttgtggccggcatggatactgccgcaggtgaccaccgccaactcgcccggcgtcacctcccgactcacaatactctgcagcctcgtcacaatggccgccccaatcacaatcggatcgatgcaggactgcggcgccgagccgtggcccccacgcccatacacgcgcacatcgatcgcatccgccgccgtcagcaaccgccccgcccgcacactcaccgtccccgccttcatccgcaccagatgctgcgccagcaccacatccggctggggcactttgtcgtacagcccgtcctcgatcatcgcccgcgccccgcggacatgctcctccgccggctggaagaggcagatcagtgttccggaccaatgctcccgcgcggcctgcagcaggctcgcgccggccaggagacccacgacgtggctatcgtgcccgcaggcgtgcatcacagggacggtctcgccgtccgggccggtggcggttttggtgcttgcgtagggcaggccggttttctcttccacggggagggcgtccatgtctgcgcggaggagaacggtggggccgggcccgttgcgtag

SEQ ID NO: 8381 - DNA, 207 bp, A.fumigatus
ctcataggtgctttcaaattcgacctcagcactgtttccaccatcatccccagaaggaccaccaatgactgtggtgtcacccccacctctcttgcggaaacccacacctggaggatggtggaagataggaggcgggtggataatagtattcttgacatcaacagaatgatcatctttataccaatccttcacgctggaggcatatga

SEQ ID NO: 8382 - DNA, 1170 bp, A.fumigatus
cgagatatcatgaagggtttggtcggaggaatccctcttgccctgctggtcgccgccgtcgccaacggccatggccaggggttaaaggaggacggccctgttacagtgatcggtggccccagtggtgacgacggtgggaacaatgttgctgtcgagttcgccgggagctacaattccggtgtgaaggacaggtacaaagacgaccactcagttaatctgaagaacaccgtggtcgcgcacgccccacctcatccgccagtgcgtggttcccataagcgacatcatcccgcggtgaccgttatcggaggtccgtcgggagacgacggtggtaacagtgcggaaatcgagtttgatagttcatatgcctccgccgtggaggactggtacaaggacgatcattcccacgatgtcgagaatcacatcattactcctccagtccacggctttcgcaggcgtggtgatccctcagtaaccctcgtcggaggcccatctggcaacgatggcgggaacagtgttgaatttgaatttgatagctcatacgcctccgttgtcaaggatgcgtacaaggacgaccactccgtcggcattgagaaccatatcacgcacccgcccccagctcctggtttccgtaagaggggtgacggtgacactacagtcattggtggtccatctggcaacgatggcggaaacagcgctgagattgaatttgacagctcatacaactccgctgtcaaggacgcgtacaaggacgaccattccgttgacatcgacgaccatatcgtgcaagctgccccatctcgcggtttccataagagaggtgggggtgacaccacagtcattggtggtccctccggggatgatggcggcaacagcgctagcttcgagtttgatagctcatatgcctccagcgtgaaggattggtataaagatgatcattctgttgatgtcaagaatactattatccacccgcctcctatcttccaccatcctccaggtgtgggtttccgcaagagaggtgggggtgacaccacagtcattggtggtccttctggggatgatggtggaaacagtgctgaggtcgaatttgaaagcacctatgagtcaagtgttaaggactactacaaggagaccattcagtgtcttcaccacggggctggaaggacacgcgct

SEQ ID NO: 8383 - DNA, 417 bp, A.fumigatus
  unsure (343),(347),(356),(357),(366),(367),(372),(405): Identity of nucleotide sequences at the above locations are unknown.
ccctgtccaccaccttatcaccccgcgcgtcctgtccggcatcagcagatacggccagttcttgaacaagttcgcgaacccccttctgcgtccgataaccctcgaaccgcaaacatgtcgtcgcgtttcttttacggcggtggtagcgacagcgactccagctcgtctgacgaggaggagctttacagcgatcgcgaggaggaggaaaagtccgaggaggaagaatccagcgaggaggaagatgagacctcggaggaggaggagtccgacgaggaaacaggtgcaaggaagttcttgaaggatgttgcttccgacagcgaaggaagaagaagaaagagattangtcnccgttgtcnnaagtgcccnnggatnaaaaattggatgaagcttgaaatcactatcaanctgaatgagaac

SEQ ID NO: 8384 - DNA, 696 bp, A.fumigatus
  unsure (182): Identity of nucleotide sequences at the above locations are unknown.
gcgatggtcgccccaacaagccaagctgcaccctttcattacgcagcagaagtttacagggcccttcgtaccgccaatgaatctgaaaattcctcgctcaacaaaaccataccgcctggaatacagcagcaacagcaggctgaggatggtagcaaacagcgagcagcccaagcggcacatgntcagtcagcggcccagaatgcatattcgatgcaaatgaatcagttccatacaccttctcatggccaacccccacccatgtacaacggcatgtttgccggccatcagcaaggcgctcatcctccatatcctgcccagccgcctggctacggccatcaaatgaaccttatgccaggtcagatgcctcaatcgcaatatgcaccgtctcagagtctctacgctcaagcaaccactagagctggtcgccaacgcgcatccaccatggaccatcagggaggaggaattccgccaactattcaacgcgttgccagtcacctggacccgaatgcccccattcgactccagcccagcccagcgtattacccgccacctcctgacggatatgtcgacaacaatgctcaacggcgcaggggaagccgtgcaggggctggtcaacgtaaccgagacttcattcggactctcgaggacggtgtcctcggcggcgacggctatatgaaccagagccagtggcactga

SEQ ID NO: 8385 - DNA, 708 bp, A.fumigatus
  unsure (670): Identity of nucleotide sequences at the above locations are unknown.
actgactcaagcagttactcgtctgcaatcgatatgtggtctcttggttgcatcgttgtcgagctcttccttggtctgcctcttttccctggctcctccgaatacaatcaggtctgtcggattgtggaaatgcttggtctaccaccgacgtggatgcttgaaatgggcaagcagtcaggtgaattctttgagaagacccaggacgagttcggtcgcaagacataccggctgaaaagcctggaacaatactcccgcgaacataacacgaaagaacaaccgagcaaaaagtatttccaggcttccacgctggaagaaatcattcggagctatccaatgcctaggaagaatatgaagcaagccgagatcgagcgaggttcgtttctccagacaactatatcttttcactcgctgacctctcgtccagaattgaacaatcgagttgctttcatcgactttgttcgtggactgctgtcaatcaaccctcttgagcgatggtcgccccaacaagccaagctgcaccctttcattacgcagcagaagtttacagggcccttcgtaccgccaatgaatctgaaaattcctcgctcaacaaaaccataccgcctggaatacagcagcaacagcaggctgaggatggtagcaaacagcgagcagcccaagcggcacatgntcagtcagcggcccagaatgcatattcgatgcaaatga

SEQ ID NO: 8386 - DNA, 423 bp, A.fumigatus
  unsure (35),(91): Identity of nucleotide sequences at the above locations are unknown.
gctaattcggattcatatcaacagcgcatgcagantgaccttcctggtgtgttctcagcatctccagtagctgacaatgtcagaacttggngagttcttcattcttctcgattcatccgtacatctgaagaatgtggtaatggagtgactgacatatccgtctgtaggaatgccgtcatcattggccccgccgataccccgttcgaagatggtacattccgcttggtaatgcacttcgaggaacagtaccccaacaagccgccaggtgtcaagtttatcagccagatgttccatcctaatgtctatggtactggggagctttgccttgatatcctgcagaaccgctggagccctacctatgacgtggcggccatcttgactagtattcagaggtatgttgaatattattacacaacacactag

SEQ ID NO: 8387 - DNA, 258 bp, A.fumigatus
cagatcatctgggcccggctcgaacaccatcaagggtttgtatgctccgtccgaagacatatgttcgaagatactcaccggtactgtacagtcgttgcgagattccgaccgcaaaacaaagtcgaattagcgtctggaggagaaccgattgttgagtttgaaaatgagcagtcatgtaaaatcaacgtgagtctcccttcaaggctgatgaaaggcaaggtttgctggcgcttgaagatattgaccagagagcgatag

SEQ ID NO: 8388 - DNA, 936 bp, A.fumigatus
tccaaagaaggctccggagccttcaccttcgatcgagtttttcccatggactcgaaacaaacggacattttcgactactcgatccgccctacagtcgacgatatactgaacggttacaacggtacggtctttgcttatggtcaaacaggtgctggaaagtcttacacaatgatgggttccgatatcgatgacccggagggcaagggtatcattccgcgtattgtcgagcagatcttcgcaagcattctcaccagcccaagcaacatcgaatatacggtccgagtcagctatatggagatttacatggaacggatccgcgatctcctggtgccacagaatgataacctgcctgtccacgaagagaagtcgcgaggtgtttacgtcaaaggtctgctcgaggtctatgtctccagtgtgcaggaagtctacgaagtgatgcgacgaggtggtgcggcaagagcggtggctgcgaccaacatgaatcaagaatcctcccgatcccattccatcttcgtcgtcactgtctcccagaagaatttagagacgggctccgcaaagagcggccagctcttcctagtggatctggcaggtagtgaaaaagtcggcaagactggcgccagtggccaaacccttgaggaggccaagaagattaacaagagtttgagtgctcttggtatggtcatcaacgcgctgacagatggcaaatcgacacatatcccttaccgtgactcaaagctcactcgaattctacaggagagtttgggtggtaactctaggacgaccctgataatcaattgctctcccagtagctataacgatgcggaaacgatctcaacgctgcgattcggtgttcgcgcaaaggcaatcaagaacaaggcgaaggtcaatgctgagttgaccttcggtcttcaccacggggctggaagggtccgcgca

SEQ ID NO: 8389 - DNA, 675 bp, A.fumigatus
ggccatctttcattcacaggaatcttgttgctctcttccaccacccttgataaccgagttgatatccgagaagtcaacttgagggctgacaccctgtgtgtaaagattgagggcaagagtgaccagatcgacattaccagttctctcaccatttccgaaaagagttccttcgacacgctgagcaccagccatctgagccagctcggcggcggcaacagcacagccacggtcgttgtggggatggacagagacgacaaacttctctctctccgtcatgttccggcagaaatactcaacctggtctgcaaatacgtttggcgttgtcatctccactgttgctggcagattgaatattatggggctttcttcggtagggccccaagcagccttgacggcctcgcaaatctggactgcgaactcaggctcggtgtcggagaaggtttcgggagaaaactcgaactgccactgggtaccagccatctctggatcgtccttggttatcgagcgggcgtacttggtgcatcttacggcaatctcaagactctgttcgcgggtggttccgaaaactattcggcggaaacacgggctggtagccaggtagatgtggaggatagctttctttgcgcttttgagggaatcgacagtgcgacggatgatttcttctctgcaaggtga

SEQ ID NO: 8390 - DNA, 405 bp, A.fumigatus
gccagctcggcggcggcaacagcacagccacggtcgttgtggggatggacagagacgacaaacttctctctctccgtcatgttccggcagaaatactcaacctggtctgcaaatacgtttggcgttgtcatctccactgttgctggcagattgaatattatggggctttcttcggtagggccccaagcagccttgacggcctcgcaaatctggactgcgaactcaggctcggtgtcggagaaggtttcgggagaaaactcgaactgccactgggtaccagccatctctggatcgtccttggttatcgagcgggcgtacttggtgcatcttacggcaatctcaagactctgttcgcgggtggttccgaaaactattcggcggaaacacgggctggtagccaggtag

SEQ ID NO: 8391 - DNA, 453 bp, A.fumigatus
ccggtcggttgtaatgttgtagtcgaccaagttgaagcgagggttcgacttgaggtggtacgcctcctcgaagagctcgacgatttccttgggccgcagctcccggttcacggcttcggtcttcttctgaacgatcttgctgaactcgacctgcagagcgcgcgggagatccagctccagactgcgcaggatgacccaggcggcaccacccttgccgctctgggagttgacacggatgacagcctcgtagttccgcccaatgtcctgaggatccagagggaggtatgggatgacccattcgtcgtcgtcggtggcgttggcactttcgcgcagcttgaatcccttcttgatagcgtcttggtgactgccgctgaacgcgcagacaaccagctgaccaccgtagggccatctttcattcacaggaatcttgttgctctcttccaccacccttga

SEQ ID NO: 8392 - DNA, 828 bp, A.fumigatus
gatggtgatcagaagttccggttctttaagatgctcgtcgacatcggctacacggaaatcgaagtatcattcccctcggcatcgcaaacggacttcgacttcactcgacgtctggtaaagacacctggtgtcgttcccgacgatgtctggctccaggtcctgtcaccttgcagagaagaaatcatccgtcgcactgtcgattccctcaaaagcgcaaagaaagctatcctccacatctacctggctaccagcccgtgtttccgccgaatagttttcggaaccacccgcgaacagagtcttgagattgccgtaagatgcaccaagtacgcccgctcgataaccaaggacgatccagagatggctggtacccagtggcagttcgagttttctcccgaaaccttctccgacaccgagcctgagttcgcagtccagatttgcgaggccgtcaaggctgcttggggccctaccgaagaaagccccataatattcaatctgccagcaacagtggagatgacaacgccaaacgtatttgcagaccaggttgagtatttctgccggaacatgacggagagagagaagtttgtcgtctctgtccatccccacaacgaccgtggctgtgctgttgccgccgccgagctggctcagatggctggtgctcagcgtgtcgaaggaactcttttcggaaatggtgagagaactggtaatgtcgatctggtcactcttgccctcaatctttacacacagggtgtcagccctcaagttgacttctcggatatcaactcggttatcaagggtggtggaagagagcaacaagattcctgtgaatga

SEQ ID NO: 8393 - DNA, 1047 bp, A.fumigatus
cggagagagagaagtttgtcgtctctgtccatccccacaacgaccgtggctgtgctgttgccgccgccgagctggctcagatggctggtgctcagcgtgtcgaaggaactcttttcggaaatggtgagagaactggtaatgtcgatctggtcactcttgccctcaatctttacacacagggtgtcagccctcaagttgacttctcggatatcaactcggttatcaagggtggtggaagagagcaacaagattcctgtgaatgaaagatggccctacggtggtcagctggttgtctgcgcgttcagcggcagtcaccaagacgctatcaagaagggattcaagctgcgcgaaagtgccaacgccaccgacgacgacgaatgggtcatcccatacctccctctggatcctcaggacattgggcggaactacgaggctgtcatccgtgtcaactcccagagcggcaagggtggtgccgcctgggtcatcctgcgcagtctggagctggatctcccgcgcgctctgcaggtcgagttcagcaagatcgttcagaagaagaccgaagccgtgaaccgggagctgcggcccaaggaaatcgtcgagctcttcgaggaggcgtaccacctcaagtcgaaccctcgcttcaacttggtcgactacaacattacaaccgaccggtcacagtcaccggcgcccccggagccgggcaaggccctcaacaccaagaatctcaagcgtcgcttcaccggtatcatcgaaatcgacaacattcaacacgctatcactggcgttggccccggtgccatctcatctctggcgaatgctctgtcgactctaggtatcgatctcgatgtcatcgattacaaggaacactcgatcggtctcggtcgagatgtgaaagccgccacgtatctccagtgcactgcagccggcagcaaagaacaagtctggggtgttggtattcaccaggacgtggtacaagccagtttgatcgccctcctcagcgctgcgtcctcggtacgtttcttattacacttttcctccccttaa

SEQ ID NO: 8394 - DNA, 189 bp, A.fumigatus
tttgataggcttaaagatccctcaaaaaaatacaagcccttcaagcctctgcatctccctaaccgtcaatggcccgataaggttatcgacaagccgcctcgctggctggctactgatctgagagatggcaaccagagtctgcctgatccgatggtgaggacctcgttcattttttttggacgcctctga

SEQ ID NO: 8395 - DNA, 294 bp, A.fumigatus
tcgccctcctcagcgctgcgtcctcggtacgtttcttattacacttttcctccccttaagatttccatcatctctaatagattgctcgtacagttcctgacaagccgtgccggctcccccgctccattccgccctcaacgctccaacacgctcacagacgaagatctgcaagccctcgagcagctcggcagctccaatgccgccgccatcacagcctcgaagctcacaaccaacgacagtgccaagccaaaagttgatctggacgcgctgaccgcccaggcgaacagccagtaa

SEQ ID NO: 8396 - DNA, 918 bp, A.fumigatus
acaatacatttcgtccttcctatttttttttatctactgtctttccctttccttatacaacccctggtcataccagacatggccagctacagtacctgcgcggaagtcagccccctctgtccagtggaggccacgacatacggctactatccaaacctagcaggcaacatcttcttcgctgttttcttcggcatcctcgctctcttccagctcggcataggcattcactaccgcacatggaccttcatggtggcagtcgccgtaggcgctatcctcgaactggcgggctacatcggccgcgtgctcatgcaccgtaacccatgggactcgtcagccttcaagctccaaatcgtctgtctagtcctcgcacccacgttcgtcgcggcaggcatctacctcaccctgaaacacatcatcctcgccctgggcccggagcactcccgcctcaaacccgccctcttcacctggatcttcatcggctgcgatgtgggctcgctcatccttcaggcagcagggggcggcgttgcagccgcagcggggaatacgaacgtcagcctgctgaaggcaggagacgacatcatcatcgcgggtatcgcgttccaggttgcgacgatgtccgtgtgtgggttccttgggctggagttcttcatccggtattcgaaacgaggggctgggttgtccggggagaagacatccgtcgggaggaatatcaaatgggtcattgtcggcgaggtcttcgcttacatcaccgttctgatccgttgtatctaccggtatgtttataccttctcccgtttaccttcccgatcctcttgcaggacactaaacatggcgaccagcatccccgaaatggccggcggatggggcaaccccttgatgcagaaggaaaacgagtttctcgttctcgacgggatgtaa

SEQ ID NO: 8397 - DNA, 441 bp, A.fumigatus
tattcccttgctgtctcactcctttccttgatacgccctccattcgtttctgttctacgcgccaaagaacaaggcgtgagaagactctcagtactggttactgaaccaaaattgtttgctacctgcatcgatcattgctggctcagtgatcatatcgcaggcagtcagttgaagatggcttttcttcgcactcccatcgtgctcttgctgacgcagatactgctcttcctgggcctagtcaatgcagttcctaccccggaatctcttgatgtgcatggaaatttagctcgagatactgcgtcgagcttctgggtggctaatattaagcgtcaaggcgccgtggctttcggccagagctcgggttatcaggtttaccgcaatgtgaaggactttggcgcaaagggtaagtctccttctaccgagaccagagtattttcctaa

SEQ ID NO: 8398 - DNA, 1296 bp, A.fumigatus
gtctccttctaccgagaccagagtattttcctaaccgagaatgttggtgacggagtaaccgatgatactgcggcgatcaaccaggccatatcttccggggattggtgcgggaaaggatgcgattcctccaccaccactcccgctctggtttactttcctcccggtacatacgttgtctcgaagcccatcatccagtattactacactcagatagtcggtgatgccgttgatcttcctgtgatcaaagcatccgccgactttacaggcatggcggtgattgacgccgacccgtacgagaatgacggctccaattggtacaccaaccagaacaacttcttccgcgccattcgcaaccttgtcatcgacctcagggccatgcctatgaacagcggtgctggtatccactggcaagtcggtcaggcaaccagcttgcagaacatccgcttcgagatgatcaggggaggcggcgacgccaacaagcagcaaggtatcttcatggacaacggctccggtggtttcatgtccgacctgaccttcaatggcggcaactacggcatgttcgttggcaaccagcagttcaccacccgcaacctgagcttcaacgactgcaacacggctgttttcatgaactggaactgggcctggaccttcaagtccatctccatcaacaactgccaggtcggtctcaatatgtccaacgcgcctcagaatcagacagttggctccgttcttctgctcgacagctcggtaaccaacactcccacgggcgttgtcaccgcgttcacgcaggacagtattcccgtgggcggcggggtgttgatccttgagaatgtcgattttaccggctccaatgtggccgtggccggtatcagtgggaacaccatcctcaaaggcggatctgttgtggctagctggattcagggtaacacctacagtccagcaaactctctcaacaagcgggccactcagggcaaggttcgcgtggtgacagagacggtggtcgagaccgtccttgcttgccctgcgcagcacagtgagaccctagagtccgccccggcaagaacagcaactgcggcagcgtcgacagaggctcgccaatcgaatgcagatgcttacgagtcgactcaggtagcaggccagcccagtgcagccaagactacccctgtggtgtaccccactctgtctggtggcctttccaagcctggttttagttctggttcgaccatcagctctcaagggccatcgagtggaaacatgccgtcttcaccacggggctggaaggatcagggtggtcta

SEQ ID NO: 8399 - DNA, 249 bp, A.fumigatus
ctgaaacaggacgtactgggtgacgttttacacgtactatatcccgtcgacggcttcgattcgcacatcgacggtcacgactacctcgacgattgtctcggtgaaagcgacggacagctcggacgcttcgagctcgtttacgcggctgtcggcgacaatgagcttctatacacctgccggtgcgacgaatccggtgaccccgacggatgtgacggcggccagcataccgacgatcgtgtcgggggatga

SEQ ID NO: 8400 - DNA, 429 bp, A.fumigatus
aacaggacgtactgggtgacgttttacacgtactatatcccgtcgacggcttcgattcgcacatcgacggtcacgactacctcgacgattgtctcggtgaaagcgacggacagctcggacgcttcgagctcgtttacgcggctgtcggcgacaatgagcttctatacacctgccggtgcgacgaatccggtgaccccgacggatgtgacggcggccagcataccgacgatcgtgtcgggggatgatggccgcagtaacggcaattcgggcagtggcggtaacgggggggttggcatttcggtcaacggggtcattggagggccgggaggtgatctcaatgctgccaatgcaacccgcagatttggatgggagaccgcgttgactctgtctatcgtgctgggaactggacttttgatgatatatctctga

SEQ ID NO: 8401 - DNA, 681 bp, A.fumigatus
acggtatacgacgagatcatacccgtacaaacagcaacgaatcgcactccagcaaatctatggctgatggatcgtccggatctgatcgcaacattcaccaagattgaactctggcgacagacgcaattcaggaagatagtatacattgactgtgatgttgtggctgtacgggctccggatgaactcttaacattggaggaagatttcgcggccgcacctgatgttggctggccggatattttcaatagcggtgtcatggtccttcgacccaacttgcaagattactatgcgcttaaggcgctcgctgagaggggcattagctttgacggcgcggaccaggggctgctgaacatgcattttcgaaattggcataggctgagcttcacgtataactgcacccccagcgccaactaccagtacattcctgcctataagcatttccagagcaccattagcctgattcacttcattggggctcagaaaccctggaacttgcctagacaagtgttacccgtggattcaccatataatcagttgctgggaaggtggtgggctatttatgataggcattatcgccctgttgtaacggtgggttttgacgttctctactgtgacaccttcccctcagccacctttattgctcacgacgcttcaggttcccgtacgctccctgccgagtag

SEQ ID NO: 8402 - DNA, 1146 bp, A.fumigatus
tctctggtttattattatatccgttctctcattcatcgccccgctgtctgctttggtgaagagcacattcggtcaccatcgattctggctacatttgactcgtgcaagcatattattcagatcctacagctgcttgacgaaaggcgtctttgtctctcgatcagtatcaaccggaaagagctggtgttcacgtctggtttggggcttctgtggcaaaacacgggactcaaacgcgaaagtaaactcctcaaggagtgccagaagttgctcaccgcggttattgatcaactcgaacccgagtcggctcaggcagcagcagagttcagctcggtagccagcctgctggtttccttcgacagtgacaagcgcgggacctccgtcaagaatcggtctatgtccccacctgcacacaagccgcttaagtcacccaagaagcagctgcagtctctgaaagcacggtcgactagcgatgaggcgccaaatcaggcgactgaatcgctatcgcgcagagcgaccatttcgggtactagtctcggtgtccctcaccgtcatcttcgatctcccagtcgggttagcttgccatctgagaattatcccgctccacaacagtccatgaacagggcttactacatgtcaccatctacgacacatgaacacacacagaccatgtcgagctcggctccctcgaatgccgccgcgggtccgatgagtatggctgactgggaatttgttctgagtgacatggatcacggctattcgaacatatttaccggcatttatgggggcaaagaatgtggtgaagacagtggtccatttgcttctttaaccacgggctgcgttccaacggatcaaagtcccatgccgctgtctgcgtcaaccaaggatgtccctggtctgtcacctgaagcgtggtcggcgagcagcaacagcgacatgttaccgaaccacgaggtcaaccccgcgccgcagagcgtcctcagtttctccgacgagagcataaatgccgaggatagcttgccatatcatgatttgcagctgcctgtggacgatttagacccattccggggcatcatgatcccggcagtggacgacgagattgatgaatttggaatgactcacggttgggaccgacggctggccgtctaa

SEQ ID NO: 8403 - DNA, 354 bp, A.fumigatus
tttcgtctagacgttttcacaaaaggactcaaagagcagggtcggcctctttctgtcatttccactcaggctttgacagcctcacctccggccatctctcatgctcgcattgatcaagccattaaaaccaccccacgactagtctctgaccagctcatcaatatcttcttccaagaatgggcgcctctataccccgtcgtccatcggccgaccatactcaaagcttatgaaaagtatctatcgaacacagagtctgtgcagggcagtacacatgacatggtgcaactgaacctgattttcggaattgctgctcttgcttctagtgtaagaaactgtgtttggatttgcatgtag

SEQ ID NO: 8404 - DNA, 822 bp, A.fumigatus
tcggttagttccccgtctaccttggatggttcgagaactcgaggaatgttttactcacaaagccacagtttcaccgctgctttgactggacttccagtcctcttacgcgaagaggatgtccgtactgaataccctgaggacgttgatgatgagaatgtcacggagaccgacttcttgccgactctgcccggagagtcgactcgcatttcgagcgcccttgcactatttggagcatctcgagttctgaacaaggctctggagtatattttcccttcggacggtggttatgaggtagtggtgtcgaagatgcgctcggttgccgagcaattggacacttgggtaaagacactgcctgctcacctgcgtctcgaattctcccaggacaaaccaagtacaaatatcacaagcagccggtcaccccttctggtaagttgtttgggccgtcgctcccaacgactttgcagtacgctaacatccgctctacttagtctctggtttattattatatccgttctctcattcatcgccccgctgtctgctttggtgaagagcacattcggtcaccatcgattctggctacatttgactcgtgcaagcatattattcagatcctacagctgcttgacgaaaggcgtctttgtctctcgatcagtatcaaccggaaagagctggtgttcacgtctggtttggggcttctgtggcaaaacacgggactcaaacgcgaaagtaaactcctcaaggagtgccagaagttgctcaccgcggttattgatcaactcgaacccgagtcggctcaggcagcagcagagttcagctcggtag

SEQ ID NO: 8405 - DNA, 363 bp, A.fumigatus
tcacgaaccaaccaggatcccacattctttgaagacaactggtcgtcaacactcgagtccctggcaaacagtatctctatctcgacattgcagtgctacgtccttgcccagatgtattgtatgaccaagggggactacacaggtcttctacgctatcgcggcctcgccgttggcctttgccatcaactaaggctccaccagagccaaaagcgattctcttccaacccgctcgttgccgagactcgtaagaaggtgttttggtgtcaatacgtccttgatcggttagttccccgtctaccttggatggttcgagaactcgaggaatgttttactcacaaagccacagtttcaccgctgctttga

SEQ ID NO: 8406 - DNA, 552 bp, A.fumigatus
agactacagacgacggagaattcagtctattacatcacacatcaaggcgtatatcgcaaaatgccatctttacaacagaggaaactcgccttcattggcggcggtaacatggcctcggccattatcggaggtctcgtaagccaggacatgaaccccgccaacatcaccgtgtccgagccttgggatgtcaaccgcgaaaagatcgcgaagttgggcgtgcagacgaccacctccaatggtgaagctgcagccaacgcagatattgtgatcattgcagtcaagcctcaaaccaccaagaacgtctgtcaggagcttgccaccgcctggtcacagcgcacgtcactccctgtggtcgttagtattgcagcgggtattacgctcaatagcatgaaagagtggctcaggacgaacgatggccggactgcgcatattgtccgcgtcatgcctaacactccggccctggtcaaggaaggcgcatcgggtcttctggctagcgacgacgtgacggcagaggagaaggagcttatcggagctctactccagagcgtctgc

SEQ ID NO: 8407 - DNA, 219 bp, A.fumigatus
cttacgaggatatccatgcttacaatgatgttgaatggcaactttctagatatcgaacaacttgttcagagccagcaatacctgaaggctatcaagagacagctgccgcttattattcgccgcaaaatggtccttcacatggaactccaatggcagaagattgtgtgggtcggtaaagaacagcaaggccagtcgagcaacgatcagataactagatag

SEQ ID NO: 8408 - DNA, 420 bp, A.fumigatus
cccgtagatccgctgggtccgctcggagacaagcccaccgacagtctcgctcccgtcaacgagcaagcaccaataccgccccagaaggagccttttgcaggtcgcggtgctcgtccgacatcatctacatcgcgaacatctagtgctggtgggttgggagactcggtacatctggaagaggatggtgcaggatttaggggaccgccccctgtacagcctccggtagatgcggacgggacgaagaggcaatctcaacccagtatcagcattgaagaggctgcgaagccgacattcgaaatcaccgtgggtgatccgcacaaggtgggggatttgacaagtagccacatcgtctaccaggttcgaacgaaggtaacctccccactccacatttccattcatgcatgggacgcaaggctctga

SEQ ID NO: 8409 - DNA, 450 bp, A.fumigatus
tacgcagcacagacaacatcaaaggcgtaccgacaaccagagtttaccgtcagtcgcagataccgcgatttcttatggctctacaattccatgcacaacaacaatcccggggttgttgtgcctcctccgcctgaaaagcaagctgttggccgtttcgacacgaactttgtcgagtctagaagggctgcacttgagcgcatgctcaacaagattgcggcacatcctatcctccagcatgatgctgatctgaagatattcctggaaagtgaatcatttaatatggatgtcaagaacaaggagaatagggaaccggatctaggccaaaacaagggaatgttcagctcctttggaattagcgtaggtggaggtggaaagttcgtagaacacgatgatgtgagtttcttgtggtttgcatacagtcaagtcattaagctaactcgagtcgaatag

SEQ ID NO: 8410 - DNA, 504 bp, A.fumigatus
  unsure (461): Identity of nucleotide sequences at the above locations are unknown.
tggttccacgataggaagatatatatggacgcgctagagaatcagctcaaagctttgctgaaggcgattgatgtcgtggtcgcgcagcgcaagggattggcagaagcggctggcgatttttcgtcttcacttcatgctttggcagctgtcgagttgtctcccgccctttccagtccattggacggactttcagaattgcagttgcgcatcaaggaactttatgagcgccaagcacagcaggatgttctgacactaggaatcaccatcgatgagtacctacgcattattgggagcgtcaagacagctttctctcagcgacaaaaagccttccatagctggcacgcggccgagtcagagctgcagaaacggaagcatacccaggagaagctgcttagacaaggaaagacgcagcaggatcgcctcaatcaagccaactccgatgtggccgacacggaaagatnatgcaccaggccaagctgctattcgactacatgggccctttga

SEQ ID NO: 8411 - DNA, 192 bp, A.fumigatus
ctgcgaggtggccatccgccctttgatcagagactacgatatttttccagtgctgagatgaccatcatcatcaaccacatccgagagttcatttccaagccccagatccactcgcaacctcctattcgtttctttacgaacacaggctttttgggggggggggagtcatttttttttttggttttcttgtga

SEQ ID NO: 8412 - DNA, 207 bp, A.fumigatus
tggtggacagagttatgtgctgatgctcaccaacaaaacatcatcatcattattaccttggcaaacgccgccgccattttagacctttgtctttgggtcattttgcctttcttccttcttttggagggggtctttgggcccatgcaactgcgagtctgcggtgggacccaggcgcacatgaacaggccaaccacacttcgtttttag

SEQ ID NO: 8413 - DNA, 1248 bp, A.fumigatus
acacgcctttacagagccaccagcctcttcctaatcaatctttccgtgctcattgttttatgcgtttctccggctatctgtacagacaagagtcctagggccatggaaactaccgagcccattttttcagctgtctccagcaacgctcaccagctctataccctgctgcaatgcatcggatttgttccaaaggccacggtgcaaattactccagacggaatccggttttcggcagaggagaccagggtgatacagggacttgcctttctcgacaaggcgctcttcaccagttataccttcaaccctccaaagaccccaaacaatgaggccaatgacgcagacaatcatgacaacaccacagacaccgcatactacccatgtttcgtggtctctctgtctgccctcttggagacactgaaaatctttggcattaatgaggcaccgtctggaagcttcagcagagcagccagcgtccaaccgcccaaccctgcagcctcaagcgcatttacattccctgcactcctcctcgcccgttcctgcacaatacagtacactcacgaaggcgctccgctgagcatcaccctctccgaaacaggggtcaaaacgacctgcgatctgacaacttacgaacccgaagacaccgacaccgacatccctttccagcgcgatggcatagtaatgaaaatcatcatgcgttcggcatggctacacaacgccatcacggagctcggcgcaaccaatcccactgtcctcaagctctcggcctcggcgacacgagagccatttttcgctttgtcaggctccggtggccccctcagcgaatcgacggttgaattctctattgaacggcagaaccaaaacaatggcccgtcccaaacccataaggtactcaccgatgatggctcgcgagcgcgggcgaagagggctaaactcgcacctaccgtcactgaaacctttctcgtcagccctccatcttctatgggcactcgcatcaaccagaattatcgtttctccatgatacaaaaggcggctcgtgctatggcagtagccaataaagtgagcattaggggggatagacaaggcgttcttagtcttcagttcatgattgagttcgacaacaatggacatggtggcgcacctggtggcatgcggtcttcgggagcaagtaccgggggcactgtgactttcgtggacttccgttttgtaccattacttgacgacgatgatgttgatctagaaatggattag

SEQ ID NO: 8414 - DNA, 237 bp, A.fumigatus
gaacgacgaaaatatccccgcgagccattcattattgcccactcaaaactcgatttccacctcgtcgctcttctaagacagcgggctatgcggggaatgaacatcagccgccgcgtcggattaacattcactagtgaggctcaccttttctgggaagggaacgatcctcaacggtggcttccccagaggttcatcttcggtctacaacaaacactgtcagaagggcaacagaaatga

SEQ ID NO: 8415 - DNA, 198 bp, A.fumigatus
ctcagcttcgtgaaaatttgcctttgtatgatgattgctattgccatcatcacactgggattcattgttgctctcaacggcagcaagaagcttgtccagctgggattccaggtttgtcaaatggtcttcgagtacttcagctgctttttcaccccttacagaggtcagaaaactctgtcagatttgagtctcaggtga

SEQ ID NO: 8416 - DNA, 198 bp, A.fumigatus
attgtatacttaagggcggatccgtccagtcccgtggtgaagacggaggctttcatccgggctgcagaggaaatgatgaccaaggacctggacgataatatgaagattggtcaaaatggtgcagagtggattatcaagcatgcacttgcaaggcacaagtcaacagctacggtcctgacgcattgtaacactgggtaa

SEQ ID NO: 8417 - DNA, 645 bp, A.fumigatus
atggattctatcagctcgcttgcaacttcgggctatggaacagcactgggtgtgatacgatcgttggcttcaaaaaaagcactggaacatgcatattgcaccgagactaggccttacaaccaaggcagccgcctgacagctttcgaacttgtccatgatagactccctgctacattgataaccgactcaatggtagctgcactgcttgctagtacgaaagctgaagtggacgcaatcgtggttggggcagacagagtggcagccaatggagacacagccaacaaaataggtacatatggtttagcagtactagccaaatatcacggcgtgaaattccttgtcgccgcgccacttacgacaattgatctcggcaccaaatcaggtgaagatatcgtcattgaggaacggccatcagctgaagtcaccaaaatcagaggtcctgtcgatggagatcatccagctgatattgtgaagttggaaactgtgcacattgctgcaaagggtatcgacgtctggaatccagcattcgatgttactccctcaacactcatcgatggcatcatcactgaagtcggcgtcatcgaaaaggaagccgatggccagtttcatctggagcggctattcatagataactcagcttcgtga

SEQ ID NO: 8418 - DNA, 252 bp, A.fumigatus
tctagcgtattcagaattggcgtcggttcttggcgtgttttcaaatcaaatttcgctcaactctacgtctttgatttggcacagggggtttacttcattaccccaataatctcttcgctatctgggatgttctcttgtctttatgctatcattggatggctgctatctttctggactgcctttctatggttaagtgggtataagactaccactttaggatgtccttaccccgcgttttactaccatgtatga

SEQ ID NO: 8419 - DNA, 258 bp, A.fumigatus
tttgaaaacacgccaagaaccgacgccaattctgaatacgctagattaactgcacagcaggataagtgtcatctcctcttgttgtcaacttgcatgttgcggggagtccatgtgcctcctattctgtctctcactgtttctgaggtatacaaggacctgcaccctatcgaatcttcacggtccagtaattccagccgactagctcgcaagttggcaccacctggtgtagcaatgctgggtatgcctagtgctacataa

SEQ ID NO: 8420 - DNA, 282 bp, A.fumigatus
  unsure (179),(226): Identity of nucleotide sequences at the above locations are unknown.
ttccctcaatttgttcgaaacggcaaaaccccaaaggtgtttataccgggaaagcccacgaaaaagaaatcatggccggtgaggtggcgggtgcgccagttgtttgtttcagtttcacaggatcggactgtgaagatctggtccactgaagagggctctgttgttgtgtccttcggggntcacaagagaggagtttggtctgtccgttttgccgcaaaaagatccnctcagcaggcggaggcggggcagacccacagggctgatgccacaggtctgggatag

SEQ ID NO: 8421 - DNA, 1065 bp, A.fumigatus
  unsure (158): Identity of nucleotide sequences at the above locations are unknown.
acgtcaagcttggagttgtctgactacagctgtcttttgacgtttgaagggcacacaaacagtgtagtgaaagtcatctggctcccgccttcagaactgtccatcaaagctgaagacgcagaggaagatgatacggatgcttcggcgcgcaaaatcgntacccagccgaaacctctaatcgcatctgcggctgccgacggattggttaagatctggtcgccttataccggcgaggtcgagaccaccctcgacaatcacgaggatcgagtgtgggcgctagcgagccctacaccctccggctcgcgtgccgatgtcaaatcgtcaccttctcaaaaagccgctactccgtacgcgctcgcctctggctcggctgactccaccgtcaccttttggactgataccacctctgcgacttacaccgctgcagtcagcgccaactctgcccgcattgaacaagatcagaagttgcaaaattacattagagcgggggcttatcgcgaagctatcacattagcactccagcttaaccatcccgcacgactcttatccatcttcacaaccgcaatcgatgctgcggataatccgtactcatcagactcagacaaagacgagcgtgtcaacagtttgactggtgacgcatcgatcgatgaggtccttcaatcccttgatccgtctaatctccgccttcttctgctccggttgcgtgactggaacactaacgcgcgcacttctcgagtggcgcagcgaatcttatatgctttgttccggtcatatcctgcttcaacattcgtggagctggcgacgtcaagcatggcaaagcgaggcagtgatcgtcgcaccgccgcaggcatgagggatattctgcaggctttggccgcatacacagagcggcattatcgccgtgttgaggagctgacggacgagagtttcctggtcgaatgggtgttgggtgagatggacggcggcgtaggacttctaggaggtcccggtgtctccagcacgagcgaggccaatggtgatcaagtacatgaacatgaaaaggatttcatcatgttgggggtatag

SEQ ID NO: 8422 - DNA, 1077 bp, A.fumigatus
ctgaatcaaaagcgcgacgatgcaaacggtgggaccgaaccatcttctcctttctcacggaagcgccggactctggactctcaacgcagttctcgtcggtacagcacgggaactggacgtggtatcttgggtgttgaagacatccaggttcatccagctacaatgagacaggagatcattgctgccagtcggaatcgcttcgatgacgtgtcttccgaatcggacagtgaccagcgagaaggtgacgaaggggacggccagccgtcggagcgaacgaatcttcttggcagcaaggacagagcgaccaactacaccgatgagagcgatacagcttataagcggcaagaacccattggtgatgacgacatccacaagtcccacaaccacgcgcaaccaaagcccaaggaaggcaagcatggtcacggacatggacacgatcttaacatgcgtggggtcttccttcatgtgatgggcgatgcacttggcaatatcggtgtgatcgtttcggctttagtcatttggctgaccgactactcatggcggttctacgtcgatcctggtatctctctgttgataacagtgatcatccttgcatctgcaattccgctctgcaaggccgcgtctcgcatccttttgcaggcagtgccggcaggcttgagtattgatcacatcaaagaagatatcgagcgtcttcctggcgtcatcggatcccatcacttgcatgtgtggcaactcagtgacactaagcttgttgcttcgatccacatccaggtagacacggagatcaagggtgaaggatccgagcgttacatgcgtcttgccaggcaggtgaggaaatgcctacatgcctatggaatccattcgtccaccatccagcccgagttcgccccggacagcgatgcggaggacactcaagcgcttccgtcgtcgtctcgtggaagcaatgatgaaccctcagggtccagcaagctgccaagtcaagccccaagtgtccgggacggagatcctcaggcgtgtcttcttgaatgcggcgaagaatgcgcccaaaagggccaatgctgcccaaagaagtcgtag

SEQ ID NO: 8423 - DNA, 228 bp, A.fumigatus
cttttcgctcctagatactattattgtcccgtcgaggtctccttagccaacgacgaacgagatggcataacgttgccaaccacggcctacttgtatatctctgcccttctatcctactcatcagttacactcctttacttgcattttttgcagcatgatacccttatctgtttgagccgccaaaatcttcctgctttacttttgtgttaccgcgccctcctgttctga

SEQ ID NO: 8424 - DNA, 498 bp, A.fumigatus
tggcaacgtgcggaaaccctcggtgccctggtgaacggtgtcttcctcgttgcgttgtgtttgtccattttcctcgaagcaatccagagactcgtcgagccacaggaagtgaagaatccgaagctggtttgcactgttggatgcttgggcctcctttcgaatatacttgggctcgtcctgtttcatgaccactctcacgcccatggacatgcagatgaccactcaaacgaagatattgaagacgtcgatgcggcggaacaagggcttgctcatggtcatggggaaactactgtggcggacaagcgggcttctactgctactgtaaatactccccatccactctctacactcctctggctaactgaatcaaaagcgcgacgatgcaaacggtgggaccgaaccatcttctcctttctcacggaagcgccggactctggactctcaacgcagttctcgtcggtacagcacgggaactggacgtggtatcttgggtgttga

SEQ ID NO: 8425 - DNA, 264 bp, A.fumigatus
gtggtcatctgcatgtccatgggcgtgagagtggtcatgaaacaggacgagcccaagtatattcgaaaggaggcccaagcatccaacagtgcaaaccagcttcggattcttcacttcctgtggctcgacgagtctctggattgcttcgaggaaaatggacaaacacaacgcaacgaggaagacaccgttcaccagggcaccgagggtttccgcacgttgccactaatccagagaaaacgattagccttgctcttgttgatctga

SEQ ID NO: 8426 - DNA, 204 bp, A.fumigatus
cacatacccctgttcgtgatccttttcgagattgcaacgttgtatctggttagattaaagcataccttgttcttcctaattaaggccctggctcaagtgttacgtcgcctgctccagggcacccaacaccttgcacccttctgcaataataatcgtgacattatctgcagatccatcgtctcatgtcgagtttggccgaaatag

SEQ ID NO: 8427 - DNA, 507 bp, A.fumigatus
agtgtatccaacaaatctaccgatgtagtatgcaagcatggtcctgctgaatgcataggcgacatgctcattctctgtgctgcaaatctccctttcccaccagagggacgaagcatgcctcgcaccccaacgatccgctccctgggcttcgccaattgtctgatcagttcctatgagaagatcccagagcgctcattcgtcgagcagtgcgctttggaacatggcatcgattttgatgccttaaacgagtgtgccagccagcagaacgatgaccctggccatcacggaggggacaaggatccccttagcggtatcgcgctgctccgcaagagtgccctgtacagcgaggcgcttggtgtcagaactagctgtaccgtccggctagatgagcaagtgtggtgtgttcgtgacgacggcctgtggaaagactgtgcccaaggaggaagaggtagtcagatttctgtccttgttgaggagatcgagaggatttggagagagcggaattaa

SEQ ID NO: 8428 - DNA, 315 bp, A.fumigatus
cacaaaagtcatatttccgtcgaatacagcaacaacatggtcaatcccaaccaaaagaccggtgctgaaactcatacggatgagcaaaagcgacacttttatgacagcctcactgaagaccagaagaagaagcagacctttggcgaatgggtgaaagaggcatacaatgaccaatatgaaaagtggatgccgtggctcgaggagcagtatctgaaatggttcggcaagggcgataataaggcttcatatgtcgccaaaggtaagaaatctccctttctcatctatataagaaaaatgaccttgagcatctcatag

SEQ ID NO: 8429 - DNA, 219 bp, A.fumigatus
gcccggctagattccctctccaagtccaaagtctccggcattaaacagattgaccaggtgcaagacgatgtccacaatctggccggcaaccagctcggcgaaaacggattccttgcccctgtcggctacatgatctccatagaaggaatcattcgcgccgagagaaacggtaaagacgatgatggctcatataacggtccgctcggcggcgtctcagaa

SEQ ID NO: 8430 - DNA, 246 bp, A.fumigatus
aaggagcagaacatcactcctctcatcttccctaccacttgtttcattcagaccttactcataatgagattccttccttgggctgttgccattctctcggctgtgtgcgttcaggcaaatgaatggcacgcctactaccggctcacctccgatgcatatcaagccaagttcaacgaccttgtgggccaaggctaccgcttgaactccgtcagcggttacgatcgcaacggccagcctaacttcgcc

SEQ ID NO: 8431 - DNA, 258 bp, A.fumigatus
acatgtcttcctctccagaatacgtctttacccgggactacttggacaacaaccggtatgtttattccagcttttgctatcctgactgcttacatttgcagcatcaacctgcagcattatctggtcgtccaacttttcggataccgcattcacccctcgattcctgtcaaggatgtgaacaacctacggatcgcagacgtaggaacaggcactgggtatgtcaagctcgacttgttagatggcagcttctcacactga

SEQ ID NO: 8432 - DNA, 342 bp, A.fumigatus
cgacgatgtaatgcaggagacatgcgctatggcggcgtaggcctccatcaagcgcgagtcatagctatcgacccggtcatgatccagacatgggccaagttccttctcgccatcgcattcatctacatcttcagcgtgattctccccaaactcgccgtgctgagcctgtacatctctatcttcaatcgacaccgcgcctcccgcattacctgctacgtcaccggcttcctgatgatcggcaactgcatcggctgtgcggcggcgggctttgcagtctgcacgcctctccggaagctatgggaaccgcaggtggacgggcactgcgtcaatatcaatgcgtgg

SEQ ID NO: 8433 - DNA, 735 bp, A.fumigatus
atggcagcttctcacactgacagaatctggctcaccgatttggccgatgaattccctgcgactgtccaactagatggacttgatgtctccttcgatgcggctcctccacgggactggctcccacccaatatgagccttcaccattgggacatcaaggccaaagtccctgagcacctggttggtgtctatgacgtggttaatgtccgccatttcgtttttgttctccaacaatctgacatgaaaggtgtcctcgacaatctattcaaacttctcagtacgtcagacagtttctacaattttcgtatctctaacagctggtttacagagcccggaggttatcttcagtggactgatctcgacatgtcttcacttcgtgtcgagaaaatcaacccggacatcaaggcggacgcgaacgtcaagttaatgcaacttttccaggccaatgatacccgtcttcgtaccgcgtggggtgcaagtctgccctcgcattttgcacagagcggattcaccaatgtgaaatctgatgtgagggatgcaccaccccatttggcagttgcactgcatgagtgtgggatgttggccacggaggtcttagcgcgaaacaaagtaggtgggaacgagcagatggtgcagcaacttagacaaaccctggccgaggctgcaaaggagactcgtcagggatctgttctggctttgactagacttactgtcgtcggtcagaagccgagccagtag

SEQ ID NO: 8434 - DNA, 255 bp, A.fumigatus
  unsure (21),(48),(49),(50),(51),(52),(53),(55),(56),(57),(58),(59),(60),(61),(62),(63),(64),(65),(66),(67),(68),(69),(70),(71),(72),(73),(90),(91),(92),(93),(94),(95),(96),(97),(98),(99),(100),(101),(: Identity of nucleotide sequences at the above locations are unknown.
aaacttgggggagtgggcggncttttttgtgtggggtgggggggggtnnnnnnannnnnnnnnnnnnnnnnnntactcgaccgtagaggnnnnnnnnnnnnnnnnnnnnnnnaaaacaaaaaaaaggtgttttttgggccctccccaccgtggggactttattccaaccccgtttcctgtatgacaaagaggccaaccggggcccccccggggttgggaatccctttggttaagaaaaatagagacaccccttga

SEQ ID NO: 8435 - DNA, 525 bp, A.fumigatus
aggcaacgggcagcgcaaaggttgaaacctcaaacaggtgcctgcacaaccgtaaaaattccctcgacccgtcggagagtggctccccccggtttcacagaaactctcggtgcgccaaacacaaagaagggtaaccagaccccagcccggccccgcccccggttgtttgcttctcgcgaaggggccaagccgcacaagcccgccgttcggcccgaagaaaccataccaagccaaacggccagcgtgcggccatgccgcgcaaccgcaaccaagttagggcgcatcacagtgggcaaaacgaaacccgccgaggcgcttgcaccggctcccgccgttgcagacccccccgcgacccttacagcgcaagacaagaagattcgaggactactgaagaagatccgggcgatcgaggagctgaaaatgcgacttgcgagtggggagaaactggaggatacgcaggtgaagaagatccagactgaggacgcagtgcgcaaggaactcgaagctttgggatacaatggataa

SEQ ID NO: 8436 - DNA, 480 bp, A.fumigatus
gtggcatctttatctccatttgcaggtcctgggcctgtaaaaactataattattctagtcgagatgtccactccggagcaaagttcaccgaggtcgcccttgcgagcggcacagcggccgactcgtgtgctagcctgcgtcctgtgtcaacagcgcaaggtcaagtgtgaccgacaatttccctgtgctacatgtgtgcgagctcaaatgcagtgtgtgcccgcaacacaagcccggcgacgtcgccgggtcccggagagggagttgctggaccgcattcggagatacgaagatctgctgcgccagaataatatccaatttcagcccttgcacaattctgttgcggaacaggcctcgtccagtagagaaaatagacgtttcgatacagatcacgatgagaaattagagcgagattcgcagaaagaggagaccccggggacagagacaaaatatgaggccaagtcagcttcccatccatag

SEQ ID NO: 8437 - DNA, 612 bp, A.fumigatus
acccggcaaacgactgacgcttccaagatctctgttagacctcaaacagatcctcgctctctgtcgccaatcctgggcgtcgccatccgtatcgcactgcgcatgggtatccattccgagtccagctacagcagatgtactattctagaaggtgaaatgcgccgccgactgtggtggtcgctcgtcctgttcgataatcggatttgcgagatggctgactacaaggcctcaaatctgcttcccacctgggactgtaagattcctctcaacgtgaacgattttgacctccaaccagagatgaagaccgggccgaccatgcacggcaatccctccgaggccctgttcgccgtcgtgcgcagcgaggtgggcaatttcacgcgccgcagctcgtttcatctggactttaccaacccggcattgaagactgtggccaaggaaaatcctcttcctgcggccgggagtctgcctgcttttgaaaggatgattgaagagaaatattttgcctcctgcaacccagagaaccctcttcattttatgaccatctggaccacacggggtcaactggcgaagaatcgtctggtcttcaccgcgggggtgcgagggtccgtctaa

SEQ ID NO: 8438 - DNA, 483 bp, A.fumigatus
caatcagaaatgtacgatatcgcgacgcaactcgtcatgaaatgggcgcgacatggaccgaccgttccaatcatggtaaccgacgatttcacccggttgaccttggacaccattgccctttgcgcgatgggaacccgtttcaattctttctaccacgaagagatgcatccttttgtcgaggcaatggtgggcctgttgcagggatccggtgaccgggctcgtcgacccgcgctgctcaacaatctgcccacgagtgagaattccaagtattgggacgacattgcctttctacggaacctagcacaggaattggtcgaagcgcggaggaagaatcccgaggataagaaggatcttttgaatgcgctgatcttggggcgtgaccccaagactggcaagggcttgaccgatgagtcgatcattgacaacatgattacattcctgattgctggtatgtcctgtaccaatttacttctaacgctctag

SEQ ID NO: 8439 - DNA, 945 bp, A.fumigatus
  unsure (776): Identity of nucleotide sequences at the above locations are unknown.
ctcacgatactaggccacgaaacgacctccggcctgctctccttcctattctactacctgctgaaaacccccaatgcatacaagaaagcgcaagaagaggttgactctgttgttggacggcggaagatcactgtggaggatatgtccaggttgccgtatctcaatgctgtgatgcgggagacgctgcgtctgaggtctacagcccctctgattgctgtacatgcccaccccgagaaaaacaaggaggaccccgttaccctgggaggtggtaaatatgtgttgaacaaggatgagcccattgtgatcatcctggacaaactgcaccgcgacccccaggtctatgggcccgatgcagaagagtacaagccggagcgaatgctggacgagaactttgagaagcttcccaagaatgcctggaagccgttcggcaacgggatgcgtgcctgcatcggccgccctttcgcctggcaggaagctttgctggtagtggctatcctgctgcagaattttaattttcagatggacgatcccagctacaatcttcatataaagcagacgctcaccatcaaaccgaaggactttcatatgagagcaactctgaggcatggactggatgctaccaaactcggcatcgccctgagcggcagcgcggaccgtgcgccgcctgagagctcgggagccgcgagcagggttcgcaagcaagccactcctccggcgggtcagctcaagccgatgcacatcttctttggaagcaacacaggaacgtgtgagacgtntgcacgtagattggccgacgatgccgtggggtatggatttgctgccgacgtccaatctctggattccgccatgcagaatgttccgaaagacgaaccagtggtgttcattacggcatcatacgaaggtcaaccgcccgacaacgctgctcactttttcgaatggctcagc

SEQ ID NO: 8440 - DNA, 279 bp, A.fumigatus
tacgcacaaggccccatctaccgactgacaacgtttggctggtccagagtattcgtcagcacgcacgaactcgtcgatgaggtctgtgacgaagagcgattcaccaaggtcgtcacggcggggttgaatcagattcgaaacggcgttcacgatgggttgttcacggccaatttccccggggaggaaaactgggcgattgcccatcgtgtgctcgtgccggcctttggacctctgtccattcgaggcatgtttgacggtatggtgcctgatcagccgtga

SEQ ID NO: 8441 - DNA, 234 bp, A.fumigatus
tttttctttttcctttttgagtatcgactagtacttttttttcttattttcttcttccggctagaggaatatttttatttttattttattctatttatttttttttttgttttcttgactttctttctagctctattcgacagactatcgagtcattctccatcaaagctcctaggtacccacttaaccggtcagtgcctcgatgctcctcagactggatctgtattttcctag

SEQ ID NO: 8442 - DNA, 1098 bp, A.fumigatus
gacgttggacacccttttcctcgaggagccttccttgagccgatatcgtacagaaccatggcgcagtcaaccgtctcatgctatttacctaactttggtgctacctgtgatggcccgaaacgtcctctttccttgaaactgcgaacagatgctctccaaagctctggattgctgtctgcatggcgcgaagggcaattgacccagttgttgcaggcctcgtgggccctaattctacatcgctacacaggttctgaggatatttgctttggctaccatcagattggtaacgtgtctcaggatctactacagtctttagaagccgtggatcctgccctttgcaaagtatcagtcaaagaaggcatctccctgaaaatgtttttcgaccaattcaagacacataactctcccgacagtcctctcgagatagacagaagctcacgcaaagcctctgaaaatgctcggctttacaacactatcttaatgatacaaatctgtcatgattccaacggaacttcacccgccatcccactaccatccagcctgccaatagcgcttcctcaggaggtgagtactgagagactggtcctttatcttcccgtgcaaccttctgaaacatatttgcagagtcgggttcgacttcatgtcaaagttctacaggacgaggtaaacattttcttcgaatggtggaacaatgacatgcccactgcgcaaatgaaaagcattgctggtgcttttgggcacatcctaacagatctccttgcagcaaacgatacagcagtggacgatcttgacatctttccagaaaatgattggtctcgggtatgcagcttcaattcagtgcttccaaaaaagcacgaacgctgcatccatgaaatgatctatgaccggactcttctccagccagagaatgaggcggtctgctcctgggatggtagccttacctacaaagaattggatttgctttcgtccaaggttgcatatgatcttcaacaaagaggagttggcccagaggtctgcgtggccctttgtttcgagaagtcggtaagtgctgcaggccaaatgatagagcttcccgcgtaccgtcatttcattatctga

SEQ ID NO: 8443 - DNA, 378 bp, A.fumigatus
ggccggagcactaatctaacagtacttctccttacagccggcgatgcaatcaatgcaactcaatgggatgccgcccttgccaaagtaaatgatctcattgcacaaacaagcttaaccgagaaggcgtcgatcgtcaccggcactgtcggttttggagagctctgcctgtatgatgggccgcagggtctgcacttcgcagatctgcgcagcgtctttccctcggagttggctgcagcagccccatgggatagatgctacttggacggcgatggtgagcgatgggagccgagtttcgtggcaaaggtgcccatgttatgcttggatgagtcgacttattcatggaagataggacgtggagctaacagaggctctatctag

SEQ ID NO: 8444 - DNA, 501 bp, A.fumigatus
gctggacttccaagggtacgttatgtcagacttttttgcgacgcattctggactgttcgccatcaacgccggtctagacctaaatatgcccggctatctatcggaggctgctttcaaccattcatacttccaatgtggtttcctggtattcgtaatggaactattcctgaatggcggttgaatgagatgatccgtcaaatccttacgccatactactattccagccaggaccatgagtaccctacaatagacccatcctcttacgcggtgaccgcagcaacctacggtatccttcctgctggtgaggtcacaccagcgggtcgagatgttcggggtaaccactctttgttgatccgcaaaataggctcggcaggtactgtgttattgaaaaataaggacaaaacacttccaattcggccagcctgggtcattggagtcttcggtaacgatgccccagacatcaatggaggtcttcttcccgaacaacaactacgggcctaa

SEQ ID NO: 8445 - DNA, 198 bp, A.fumigatus
tgttgcctctatctgtcgcagaactgtcattatcacacactcggatggtgtaaatataatgtcctggcagataatgagaacgtcactgctattctcgcagcgcattactctcggcaagagtctagaaattccatcaccgacaacccagccttaattaccttaggcttctataaaaaccagccaatcggaagtcgctaa

SEQ ID NO: 8446 - DNA, 225 bp, A.fumigatus
gacgtggagctaacagaggctctatctagtccctcagccggttcccttgggcgcagcccattggttttgggggggggaagggtaactgggaaggattcttccctgatccttctctcaggcgttgccatgcaggagtctattcgcagcgcgcaggctgttggtatgcaggcctgtgccaaacactatatttggcaacgaacaataaacccatcgtacgaatcctga

SEQ ID NO: 8447 - DNA, 249 bp, A.fumigatus
ttacaacagagtcaagctgacgtattcctgcgaaaattctccctccttaagaaaaatatgagagatgagctggacttccaagggtacgttatgtcagacttttttgcgacgcattctggactgttcgccatcaacgccggtctagacctaaatatgcccggctatctatcggaggctgctttcaaccattcatacttccaatgtggtttcctggtattcgtaatggaactattcctgaatggcggttga

SEQ ID NO: 8448 - DNA, 345 bp, A.fumigatus
aagcacgcgcaagggatgagggctctcgcctggttttatctcacagataaaaaactcattgtggagggaaactttaacagcatctatcctcggcctgatatttgcttggtttttcctcaagacccgagcccaggatggaattgctggcagagtctggaagcagactggaatttgattctcgtcgtcaataatgttgcctctatctgtcgcagaactgtcattatcacacactcggatggtgtaaatataatgtcctggcagataatgagaacgtcactgctattctcgcagcgcattactctcggcaagagtctagaaattccatcaccgacaacccagccttaa

SEQ ID NO: 8449 - DNA, 858 bp, A.fumigatus
  unsure (496),(498),(508),(521): Identity of nucleotide sequences at the above locations are unknown.
cgatccgtagacaaggtccacactccatttttcaaggccaagcccccgtcgacagtatgcacatgcgtggcttggctttctcccactgacattgctgttggctgtgccaacggttttgttgccatctggagcattacagcctccgaagaaacccctacagcctctctaccttacttctacgaaccaattcaccgcacttacattctgaatctggcgtcggcctacccaactcatcctcacctgctgtgtacgacatctatggacggagaaacccgtctgacctcaatcgccgattaccagaaggacaccgtggaaacgacccgtatgcgaatggcgtcgccccatgctgcctactctcccttgctccatgccttcatctcaagcgacgagaacgattttgctcgactcctggccgtgcggcgcttcttcaccacaacggccatggcaaggctaccaagtacggtctccgctcttgcgccgtgcagcttctggcatncnagcgtcctcntgggctgcgcagncggtgaagtcattgcgacaaaccccatccgccgattagtgcaccccaaagagaaacagtggcagcagacctggttcacccatgaatgggcacgcgggcaagatgcagacagcgcggggacgagtcgattcatcgacggctaccgcgctgagagcttcagtctcttgcgcaacatggtgggtgatcgtaggatggtcaacggcacaatgatgattaccatttttgacgaaccgaggcacgttactgcattaacgtggaatcccaaccagctgtgtgcgggatgggccagtgctgggttgggatgtggattgattcgggttgaggatttggcaatctga

SEQ ID NO: 8450 - DNA, 231 bp, A.fumigatus
ggactcatatccttccacggcgggctgatagatgctgggggtgctctcatgctatactccgtcacccacgtcgaggtcatgggtatgtgtgctttgtgccaacgtgccatgcgtacgatgcatgctaacgagaatgttgacaaaattctatttcatgtcctcctgtgcctggctctctccctaacactaatgcaggcccctgaacaaatcagaactgctgcatccagatag

SEQ ID NO: 8451 - DNA, 672 bp, A.fumigatus
ccgggcacgtcaatccttcatcccaggtggactttaaaaggccatgaaagtcgcaatgagtcgccatgggaattcttcacaacatctgcagtcactgtcttctcatactctcttccaaccgtcatgtctgatctgcccattccttcttggctggatgtctcaacagcctcgttcctgtctacgcccgaagacacgacggacacgctagatcctcgctctctttttcccgatgaacaggttgcgaacaatgctccatcatacgataatggaagcagtggcatcctgtgcaatgcatctaatgccctctttgctgatcccctactctacgaagattctttcctcccgtctgaaattgacagacaaccccccgtccaattccaggcgcaaccaaccaatcaaatgccgccatcccttgtggctagcagtcccggcttccggaccgtgtccggggggcgtggcttccgccgggaaatgctgcagttggagtcggcgccgcctaggactattactcccagcgatccttatcttcctacaaagcccgctgctgcggagcaatgccccgccagcaatcacacaaaggccacggtgaaatccaatgggtctacccattctgctccgaggacgagaaaaaggcatgcatccattcgctcacaactctctcatggcaattga

SEQ ID NO: 8452 - DNA, 543 bp, A.fumigatus
tccgcgccgtgcttgaccagcgcaacggcgatctcaaagtgccctgcggccgccgcgctgttcaacggcgcccagcccgttcgatcgggggttgtgacatcggcgcccttggcaaggagcagttcaacaactgccagatggccctccgatgccgccgcgttgaggggtgtccatttatttgctgatgcttgcgaggtgtccgcgccgtggtccagaagaatgcggaccacatcagtgtggccgtcctttgcggcacaatacaacggcgtggcgccgacttcaccaatgatagcgttgacatcggcgccgcgcttgatgagagtctcgacaatttctgcgtggccttcagaggccgctgatgccagtggggtccatccactcgtagtaggtaagttaaagtccgccccttggtcgagcaagtactttacaatatggagatggccactattcgccgccacgttcagcggggtccactgctttggatgcgttgtgtctgatatgttcactccatgttcgacaagcacctttaccgagccgagttga

SEQ ID NO: 8453 - DNA, 1920 bp, A.fumigatus
  unsure (18): Identity of nucleotide sequences at the above locations are unknown.
aagcagtcgctccttgtngtcctggacatggagatcaaggatctcgaggcggcagtacagtctctgaagaagctgtctatcgtctctagcggggagatagctgaaaggcagaatatgatcgtcgccatggaaggcctaatcagttccgcaaagtcatttaatacgtttatgtccgtggcaccatcggcacctaccgtgaatcaggaagatggccatggatccgcaccgcttccttcgtacgcacaggccatggcacctgatgatggggctgagtccgaagacagtgccccctggccatctccattcaatgtggcggctcgcgagggaaatttggaagaaatcaaaaggctggttgcggctggtgaggacattcttgccaccggtgagattggccagtcgcccgcatactcggctgctgtctcaggaaacactgaaatcctagagtatctgatcgaacacggtgcagactacacctctggcaacgaaaatggcttcacaccgctcaacgcagccgccacgttcggccatcctgacgcggtgcttgctctcttgcaccacggagcagatccgaatgtcccctctgtggacggacagagcccaatctactccgccgccaagctgggtcaactcggctcggtaaaggtgcttgtcgaacatggagtgaacatatcagacacaacgcatccaaagcagtggaccccgctgaacgtggcggcgaatagtggccatctccatattgtaaagtacttgctcgaccaaggggcggactttaacttacctactacgagtggatggaccccactggcatcagcggcctctgaaggccacgcagaaattgtcgagactctcatcaagcgcggcgccgatgtcaacgctatcattggtgaagtcggcgccacgccgttgtattgtgccgcaaaggacggccacactgatgtggtccgcattcttctggaccacggcgcggacacctcgcaagcatcagcaaataaatggacacccctcaacgcggcggcatcggagggccatctggcagttgttgaactgctccttgccaagggcgccgatgtcacaacccccgatcgaacgggctgggcgccgttgaacagcgcggcggccgcagggcactttgagatcgccgttgcgctggtcaagcacggcgcggatcacgccgtcgcggactctcggggccacaccccactctactcagcggcactgcacggccatcatgctattgttgacctcctcctcgaagccggcgccagtatcaacgtgacgaacaaggacaaatggacgcctttgcatgctgcgtcggcgaggggacatcttcaagtagttcaatctctgatcgcctgtggggctaattccgcaacccgtaacatggatggttggagtcctctcaattctgcggcctgtaatggccatctggaggtagtgaaattgcttctaagacacggcgcggctgtcgatagccgcagtgatgacggctggagtccgctaaccgccgctgctggaaatggacacacggccgtggtcgaggccctgctggatagaaagacggatatcgagacaagcaatgatatcggatggacatcccttggaattgcagcgcgagagggctatccggagacggtaaaggttcttctggcacgcggtgcagacaagaatgccacgaatatcaacggctggacggcgttgcacggcgcggtggaaaaagaccaactcgaagtggttacgcttctccttgcccagggtcttgacatctctgccaagtcgaacactggatggacaccgctgaatattgctgcgagcaatggccgggcgacaatcgcccagttcctgcttgcctctggggctgatccaaacacgccgcaggatgtcttcaccacggggctggaaggtccgacgcggtcattatca

SEQ ID NO: 8454 - DNA, 237 bp, A.fumigatus
gcagtgattggcaagtactccgtaaaacgctatacataccttagtatttaccgtagaggtggtccccaaaagaagaatggatccagcgacagtccggagtacaacctagaagtacctagcagagatgcttcggcaaccaataaatacatggagaaaagtaagttcggtggatttctgagtctggacctggagcggatggatggatctatctggcttaaacagtcgatcaagccttaa

SEQ ID NO: 8455 - DNA, 858 bp, A.fumigatus
cctaaccatggactttctctgatgaggtttcttgtgtccggcaatagttggtcgcggtctggtcagctgttggcttcaggttctgacgatctgcatctcaacatctattcgtaccagccggaatcctcgtccgcaccgtttacgctcaacaccaccgtttacaccggccacaaggcgaacattttctccgccaagttcatgccccattcgaatgatcgcacgctggtgacttgcgccggtgattctcaagtgcgcgtcttcgacatcgagtattccgcaggtaacagcaatgtcgccgccacgtctgccttttctgcgtcagcccggagccgtcgcttcaacaatttctttagcaatgcgcgctacttgaatgaaagaaataccaattgcagagtctatcggagccacgcggatcgggtcaaaaggattgtcaccgagtcgtctccgtacctcttcctcacgtgttcggaggatggcgaggtgcgtcagtgggatttgcgccagccctcttcggcctatccgcagccgcgcggaggacagggcttcatggcgtatcggccgggtctggagcatgacgattcgaatgtgcctcctccactgatatcgtataaacggtaccatctggacctcaacaccatctcgtgctcgtcgagtcaaccgcattacatcgcgctgggcggcgcccatttgcattgcttcctgcacgaccggcgaatgcttggacgggatcttcttgcggaaaagggccatccagggggtctttccgacagcggtagccaccacgatgatgaactcatgggacaggcgacgagatgtgttcggagatttgcccccgacggtaagagacgaatgcgccca

SEQ ID NO: 8456 - DNA, 1113 bp, A.fumigatus
agggctgttgtaacagtcaaaaaatcgcagggtgatgtcaatgctgccgccgacattctttgcgagctgcaggtggaaaccttcggttccatgacaaggcgtgagaagaccgagtttatcttagagcaggtagctctttgcatagaacgtggcgattggtcacaagctgcgatcttgagtcgcaagatcaacaagatatactttgcgcgcaagccacagaagtcagcagaggaaattgaaaagctcaagaaggcggccgaggaaagagaaaagacacgcgctcctgatgaacctcccatggaagtcgacgaagacgtgacagacctgaagctccgctattacgagcaacaaatcatacttgcaaatcatgactacaagtatctagctgtttgcaaacactaccgtgaggtccttgacacggactcagtgcagaatatcccggagcaactgcgagcagtaagccgatacctaccctgtcttcttatgtggacactgacaataattaccaaagtgcttgcccgaatcgtctactacattgtcctctctccatacgacaatgaacagtccgacctgctgcatcgcattcagcaagattctcgactctccttagttcctgttgaagctcgcctcgtcaagctcttcaccgtccccgagctgatgcgttggcccatggttgccgagcagtttggtccacatctctgcaacacggatgtgttcaatgcgcaacccagccagtccgtggaggatcaggcacataagaggtggcaagatctccgcaaacgcgtcattgaacacaatgtccgtgtggtagccaagtactacactcgcattcagatgggccgtctgactgaactccttgatctggccgaggaagagaccgagaagtacatcagcgagctggtgacatcaaaaaccatctatgccaagattgaccgtcccgcacgactggtcaacttcgccaaacctcgagatgccgatgacgtgttgaacgaatggagcagcgacatgaagagccttcttgggttattggaacgcatcgaccatttaattaccaaggaagaaatgatggccagaattcttccatcccgcggggagataggcaaggcccgttga

SEQ ID NO: 8457 - DNA, 882 bp, A.fumigatus
cacattcttctcatcatggcgccccgtcaacccctcaaactcctcatgctgcacggctacacccagtccggcaccctattccacgccaaaagccgcgctctcatcaagcacatcacaaaggcatttcccctccacgaagtctccgccatctacccaacaggtcctacgcgcctcaaccccgccgacataccaggctacgagccgcctgcagaggggtccaccgtagaacaacagcaggagcaaatcgaagcatacgggtggtatcgccgctcaaacactgctgacccacccctctacatcggccttgaaggcggcctggatgctatcgccaaggtcctccgcgaagaaaggcccttcgacggcgtgatcgggttctcgcagggggccgcaatggccgccatggtagcgtcgctgcttgagcccggccggaaggaggcattcgagcatttcgctgatcccaaggttgcgtcggaggggttcgaggtcaaggagcctgttgcgggtgtcgcattccctgcgtcgtttgaggaggcgggccatccaccactgaagtttgctttgtgttatagtgggtttcggtcaccgggaccgcggtatcggccgttctacgagaatccgcctatccaaacacctattctgcatgttctgggatcgttagatgctgttgttgacgatacacgcagccgtgcgctggtcgaagcctgtgctggtgatccggaaaaagaggggaaggttgtctggcaccctggtgggcactttttgcctagtcaaagaccgtatttggatgctgcggtgcggttcattaaagagcaactggaaggaaagcaagcgaaggccgatgcaaaggaagacgacgttagggatatggatttgccattttag

SEQ ID NO: 8458 - DNA, 531 bp, A.fumigatus
gaagtcctgcctttaaggcagggattgctacagctatcaggagtcaacgcgacagccaagatgtcgaaatcaccaactgaacatgtggaactttcgccgacgaagttggagaatgcttcggacgccctgtacgaggcctacgcctccaagggccctgaatggcaccagcagatgacccgacgattactccgaaaggtcgatctgcatctcctacccttcttggtggtgatgtacctgctgaacttcctggatcgaaagtatgcttctgtgtctcagcataagatcaagctgacctctttgaagcaatctctcacaagcgcgacttgggacattggaaaaggacttggggatgacagggaccgacttcaacctggcgacgagcattctgttcgtcggatacctgctcatgcagctcccgtccaatctgctgctgacgcgcgtgaagccgtcgtggctgctgggtggcgcaatggcgatctggtatgttccctcatggttttgtcgaatcggtctgaccagccaggggcataa

SEQ ID NO: 8459 - DNA, 438 bp, A.fumigatus
ctcagctcagtcatgagaatcaacgtctttaccatcctgtcccttctcttcgccagcaatctcgccatggctacaaccagatacaccgagccgatccccgagggaatccccgtcctcgagacccgccagcaactcaacgacatggcagaccaatatcccacggggactctggacgatcgaaacgggggctactacctgctcgaccacgacggcgccgtcttggccgttacgtctgatgcgctatgcgaggaactggacgcctcgatggaacaagcgaggagatttcatgccgggaacttggacgacgaggccgatgttgttcctaggggtgataatgcggctgcgagttgctctcacccgcgctgtcatacccatgctttgtgtcgcacatatagtgactgctatgtttgttcgtcgagcaaacattggtgtttttga

SEQ ID NO: 8460 - DNA, 390 bp, A.fumigatus
  unsure (297),(304): Identity of nucleotide sequences at the above locations are unknown.
agcaatctctcacaagcgcgacttgggacattggaaaaggacttggggatgacagggaccgacttcaacctggcgacgagcattctgttcgtcggatacctgctcatgcagctcccgtccaatctgctgctgacgcgcgtgaagccgtcgtggctgctgggtggcgcaatggcgatctggtatgttccctcatggttttgtcgaatcggtctgaccagccaggggcataatatccgcagctcatgcgggaacgacctcgttcaccggcttggttctggcgagattcttcctggggtntgtggangcgcctttcttcccgggggcgatcatgttgatgtgcgtatacacctgaagcccagaaagcgtaaattgcccgtgctaatgttgtag

SEQ ID NO: 8461 - DNA, 462 bp, A.fumigatus
gaatcaacgtctttaccatcctgtcccttctcttcgccagcaatctcgccatggctacaaccagatacaccgagccgatccccgagggaatccccgtcctcgagacccgccagcaactcaacgacatggcagaccaatatcccacggggactctggacgatcgaaacgggggctactacctgctcgaccacgacggcgccgtcttggccgttacgtctgatgcgctatgcgaggaactggacgcctcgatggaacaagcgaggagatttcatgccgggaacttggacgacgaggccgatgttgttcctaggggtgataatgcggctgcgagttgctctcacccgcgctgtcatacccatgctttgtgtcgcacatatagtgactgctatgtttgttcgtcgagcaaacattggtgtttttgattatggactggtgctgccgcttggggaggtggatgtctga

SEQ ID NO: 8462 - DNA, 219 bp, A.fumigatus
acacggctggcccaggcaggatacgaggtggccatcgtcgaggctggtggctggtatgaggactcggagcccataatctcatccactccagcctttggtttcgcgaacaatgcggccaatgactggggcttcatggtcgagccccagccggggatggggggaagagtcttcggctatccccgcgggaaatgcgtgggaggctccagtgcacgcaagtga

SEQ ID NO: 8463 - DNA, 489 bp, A.fumigatus
acggttacaggcttcatccagaaatgccactaccagacatcatacacctatatcaaggcacgtctcgtcggttttggcagaccagagtcaagattggaataccggacactccacagtacatcgttccagtcgcttcatttctccattctgaggaacaaaagaaaaacatctgaaatctccatcatgggttccctggcgcctaccattgtccctcctggtggcctcgtcttggttaccggtgtgaatggcttcttggcctcgcacattggcctcaacctgcttgagcgcggctacaaggttcgaggcacggtgcgatcccaggagaaagcggattggattaccgaagccatcgcgaaacgctatccagaaccctccttccagacggcgctggtgccgaacatctctgccgccgtgggcctccaacgatgccatccgcggcgtcaatgggatcgcccacgtggccagcggacctggtccttcggggagcga

SEQ ID NO: 8464 - DNA, 195 bp, A.fumigatus
gaggagacgccctctggccataatcctaaggtagatatacaccagtacaagtggcacgtgatgctcggttctcagcgctctgcggtgggttcccccgcacggaacgtcaagcggattagtggagaagcacagtccaaggacatgggcaaaggtgctcttttgggtgcaggggcattctctggtcttacaaactag

SEQ ID NO: 8465 - DNA, 366 bp, A.fumigatus
cggccttggttttttcgcccggcaaaaccaaggccatccccgcccaaaaccacctttttccagggcaaggcacccggcccaaacccaggctatatacccaaagtttcttccaatccagatttcccccagccaaacaccatgagggtaagttctcccattccactccgcccccctatcccaaatacctacttgacccccgtacagatattcgacccccaaagcgccgtcctcaccaacatcgaggttctcgcctatataaccgccaacccaccccgacgacccccgaaccctcccccgaactcccgcaactgggtccctagtcctgatctccgcgaccacaatacagtcgttcgagaagtaggttga

SEQ ID NO: 8466 - DNA, 1275 bp, A.fumigatus
  unsure (46): Identity of nucleotide sequences at the above locations are unknown.
aagaaatacggccttgtgaaggattatcatccttaccgtaagggcntggaggaggccttgcagaaatactctcagagagtgctctttgccgcaggcaaggagtgtttccccaacatgaccgtggacgccgggtgcgtcaccgtaccgcagtccagcttgcccccggatgcctatggctggaagaccgatactcacccagagggacacttaacccgaccgcggtggctgaagcccggtacggtgatcggccaggctgccgatctgaagttaatatacgccgaagtactgcgcttcgtggaggagaaccggcacaaccgcagtgactatctggctctgacgcagatgtacggacgccaggagtacgtgcgagagctagaaagacggagaagttccaactggttcaacgagtgggtttaccgactgattggcatttccgaggctgcgaatatcacgggtgtgaacccacacctcgagacaggtcatcgctacgaatacggaatcggcgttgattttgaatcgcgtgtattcttcaacacacacaaatcgaagaaggatgtcgaatggctccaataccacgatattccccggacttcttccgtccagatgaagcacggcattcctcgggagaggcgtctgctgcttcctcccgatctcgccagtccgagactgcgcaatccctttgttcaacccttgttcggcaaagacgaacaggtcaaaccagagttcaactccaccctcgacgctcttccaaacccacggaatcatacatggcgtaacatgcccttgctgacgaatatccactcggcgtctgtgccggccctgatccatctcgacgaggaaaagccagccgaggatgacaaagcgtggccggtgaagcaccccgaacgattgatacgagatacctggtggtacaacatgtggtaccagccgtgggctcgcgcccttctccgcaagtacatgcgtagccctactggattcgatgctgcgcaatctgccctgctgggaggtcaagactggtgggatcttcgcggcggcaagggaggcgtttggacggacaagggagagtggctcgactatgcggaggtctgcacgggcttcgaaggagaggttttcgacgatgatctggggcaatggggccacgaaggcggggacccggacgagcctgtgtacaaccagttcggcaaactggtcaaaggcaaaggtgaaagcgaggacaagcctggtcaggggaaagatgactctgcggacagacaacctggccgaccgcaaagatga

SEQ ID NO: 8467 - DNA, 723 bp, A.fumigatus
  unsure (98): Identity of nucleotide sequences at the above locations are unknown.
ggacctgtacgtttgcgacccttcggcaaagcaccacggattcaagtcatgggacgacttcttaacttgttttttcgcgagggggtcagaccgttggngttgcttaagaatacatggtcctgccaaggcatggaggcgcagccctccaagtggctcacaacgtcaaagagcgagacatgtctggatcaaagaacaaccctattcggttcgcgatatgctgaccacgacgagttcacgccgcagtttgtcggcggaactgtctaccaagcgttcttgagcgcgctcagttatcaccgctggcattcgcctgtcagtggcaaggtggtcaaagcatctgtcgtggaagggacgtactactccgacccgttgtttgagggcgtgggggatccgtcgccccatcagatcgacctctccggccaggtcaccgcccaggagtataacagcgccacggcaacgagagcactgatcttcatagaggcagatcaccccgccattggcctcatgtgcttcatgggcatcggaatgtgcgaggtttccacatgcgagatcacagtcaaggaaggtcagcatctgaagaagggcgaccagctcggtatgttccactttggagggtcgacgcattgcctgctcttccggaaggacgtcaaggtggagggattcccggatccttcgcgaggtcagaacgtgcctgtccgaagctatctggccaaggttcagccttag

SEQ ID NO: 8468 - DNA, 837 bp, A.fumigatus
  unsure (658): Identity of nucleotide sequences at the above locations are unknown.
aacagcgtcggaaaatggatgccctcgagccacgccgcacacctggaatggctcggcggagtcatcacacatgttgacaagaacacgtcccatcaattgcaccccgttctgcaagaattcaaagagctgatcgaaaccaattcgcgcgtctacctgctcatctctgccatgttcgccgagatccctcgtaaacggccatacaggaccgatccgacaggctgcgcccagatccgcgactaccaccacctcctgcaagtcttgaactaccttctgacgacggcccctagctggaacgacttttcgcatcgcgttggtctcgttggtctccccatcaatgcagtgctggactggagcatggggacgcctagcggctacgccgcatatctggatcccgaaatcaacaggatggtcaagaagattctcagtgcgtggggagactacctcaagtctcccaagtccgcctcggtcctcaacgacacttccagcggctggttcggctccacggccaggtccgatctggaggaagtcggtaacgttggcgagaccagccattcctttgaggacctgtacgtttgcgacccttcggcaaagcaccacggattcaagtcatgggacgacttcttaacttgttttttcgcgagggggtcagaccgttggngttgcttaagaatacatggtcctgccaaggcatggaggcgcagccctccaagtggctcacaacgtcaaagagcgagacatgtctggatcaaagaacaaccctattcggttcgcgatatgctgaccacgacgagttcacgccgcagtttgtcggcggaactgtctaccaagcgttcttga

SEQ ID NO: 8469 - DNA, 294 bp, A.fumigatus
gatctacgctcggggctgtctactactcttctcggttctctcgttgctgtgggctcttccgaggtcgcctgccatggctactgtaggtacagcaacacaagagttttctctttcgtattaagaaataccattatcgttcaagtctatctgaagtctatgtacgaagtgcgcagaatgcttctttccgcctataaactcgtcttccccctcgactcatacccaatcagcagaaccaccaacccacctacaacaaacaaccccccgctcacatacaccggcacactggtcttcaga

SEQ ID NO: 8470 - DNA, 261 bp, A.fumigatus
aggcgtaccggcgccagtttggtctttaatctagatgtcacgcagtggaggtcagcagatgaaaatgagggtaagggagatgctatggacggttttatttgggtaagctttagccacggccacgaaaaagaagaacaaagatggaagggaaaagcaagatgcgcggctgtagcgctagccggcttgcagtgcctggaatatcagcagacgcaaaaaggaataattaccatcttttgggtggaacccttggtcaacgtgtag

SEQ ID NO: 8471 - DNA, 189 bp, A.fumigatus
actgccagtcccgcaccgaatgccgcttcgccgtcctccgcctcggacactaagaagttgaataccgaaatctatgttgctgacggcgattacatcaaagacattgaaatcaatgacctgcgcaaccgctacacgttgaccaagggttccacccaaaagatggtaattattcctttttgcgtctgctga

SEQ ID NO: 8472 - DNA, 195 bp, A.fumigatus
aacccgccgctgtacctccacgtaaccagcacgaccaaagaaggcctcgaaaaggctgtggccctgatcgacgaactgatgcagaaggagctaccaaatctcgttgatgagagacgattccgccggcgtgagccggatcaagttgagcgcgatgaatacggccgtgtatgctctcgttcacttgttcacatctga

SEQ ID NO: 8473 - DNA, 234 bp, A.fumigatus
gaaggcgctaattgcgtacagcgtaaatggcccgaggaacggattccggttgacctagaaccgatccctggattcaatctccgcgcccaagttgtcggacaaggaggtgcatatgtgaaacacattcaacagaagactcgttgcaaggtgcaaatcaagggtcgtggctccggtttcttggaaccaagcaccggcagggaaagtgatgagcccatgtttttgcacgtagcgtga

SEQ ID NO: 8474 - DNA, 465 bp, A.fumigatus
gtctgctcagcggcttggatcttgcccagactaactgatttgacccttgcagctgatttcggtttctgcgccaaacttacggaatcaaagagcaaacgtgcaacaatggtcggtactccttactggatggcaccggaagtcgtcaagcagaaggaatacgggcccaaagtcgattgttggtcattgggaatcatggccattgagatgattgagtccgagcccccctatctgaatgaggagccactgaaggcgttgtacctgatcgccacgaacggaactccacgcttgaagaagcccgaaaagctgagtagggagctcaaatccttcctcagtgtctgcctctgtgtcgatgtcaacagccgcgcgaccgccgacgaactcttagaacatgacttcctcaagacaggctgcagcctggcaagcctagctgaacttcttcgttggaagaagaacagcggccagtga

SEQ ID NO: 8475 - DNA, 264 bp, A.fumigatus
ctacccagaaaggcagagcattccccgaacaatacaccttgggaggattgtctccccctcctccagaacccacttcccagcatccaatctaacgctgctcccagctcaaacctcctcctccttccaggttctcccacgaatgggaaggctgccctcctccctcttcccggaaaaaacaaatataaccggggagaattaacccttcccaaccctccaagtttaaatttttttgggatcccggccaaattcggaaaatataaccac

SEQ ID NO: 8476 - DNA, 237 bp, A.fumigatus
gtttggcgcagaaaccgaaatcagctgcaagggtcaaatcagttagtctgggcaagatccaagccgctgagcagacttactaatcttgacatgaccagcgcgatccagaaggacattatcactcttgatatcacgatggataatattctgaccatgaaggtgggccagacccttgcaagtctgggtacacagtcagcatcccagcaactcccgttcagatattttttgcacatttga

SEQ ID NO: 8477 - DNA, 330 bp, A.fumigatus
ctggtcgctccgacatctacttcctccggcggtcgatacgaagttcagtcggtcggtcgaaagggcacgtcgaagcgcactgataatgaagctcctcaaatgcgaaaatcacttgggactacacgggctacgactgacgaggatgtcttggagaaatgggacgaaggtctaagtgacgacagtaattcctcctccaacgacgaggacaccatagagactcagggtatcctgcccgagaaccgaccttcattggtatcgtttgaggtgctgaatgccttccgcgagttaaaggaccagttcgacgagaagttccatgctatctttgcttag

SEQ ID NO: 8478 - DNA, 384 bp, A.fumigatus
tgtttgaagctgcagaaatcttgcatacaggatacgtttgatacagcctcccagttgatcacataccttaccgacatgaatccatctggttcgtcttccattggtggtaacaggtcggaagagtctacgcctcgaagagtctccggtacagtgtggcacccggctagagagtggcttgaacaggacgaggaggaagacgacatggattatgaaccggagtccgaggttacggaagatagagatgaggatggatatgaaaatgaagatcaaaatgaagatgaagatgaaggtcacttcggtagctttgcccgcaatggactgctgtttttatcatacgagactaatcttgggtcgaacgatttgaagaccctcacttgcgtctag

SEQ ID NO: 8479 - DNA, 438 bp, A.fumigatus
gttctcgacctcctgcgacggaaaaggagctttgtattaatttggtgggcctctcaggatctgatacctggttccgccgcagacaagattattcattatgactcgcgatgttattcgggtcaattttctgacgacggtaacttcttcttctgctgtgcgcaggacttcaaagttcggatgtacgatacatctaatccattcgagtggaagtactacaagactgtcgactatccatttggccagtggaccattaccgatgcgagcttgagtccagacaacaagttcttggcatatacatccattagaaatatcgtctgccttgcaccgacagacccagctgaccaatccgacccctctgtgttggacctgtccttaggccgtgttgggcgcggcttccacgacagctcgcatagtgcggtgcgcatccccataaaatga

SEQ ID NO: 8480 - DNA, 270 bp, A.fumigatus
tctactacgctacatagtactatcacatacattttctttctgaatcacaacacatttgcctacctggaaaatggctcccccgacgagtcccgtcacccaaccaactctcgcacacacagtctcaaaagtgcttctgtggaagcctcaccccattcttttcaacagattttcagtgaaattgttgacaagattccaaaaatcaaagagtttaccgaacttatctacgaaaacataactcggaagatggttcattggtctgtcagtcactag

SEQ ID NO: 8481 - DNA, 204 bp, A.fumigatus
aagctgctattttgggcgaaaacaatgatttatgtattattcgattacctaggcgcaatggacagctgtagtcttctgatgtgtgatgcgttttcactgaggacaatcctgatgtatatgcagcctaacaaggatatggtagaagacattgatatcatcaaacgcgacacaccagcttttgaccagaaactttcttttccttaa

SEQ ID NO: 8482 - DNA, 810 bp, A.fumigatus
tcagagagaacacagctccatcgcaaaaacatgatgccagcattcacagtcccgcacgtccgaaaattaaccagcatcttctgggccaaagctcaggaaatggtgcgctgcatgtcgaacgagctccgcgcagactccttcgcccggatcgacttccgcgagtacatgtctagggctacactcaataacatcgggctggcggggatgggccacgatttccagacgctcaagcagcccgataccgacctgcgcagccaccacaggaaactgatcctcgacccgactcgcgtgtttagctgggtggggctgctgagtcggtacttcgacatgagactattgatgagggtgccgcttaagaagttgatcgagatctcgcaatcggcgaagtacctccgtgaactcacgacggcggttattcaagggagaagagagcagctggttgtggctgagaacaacaggggtaaggatatcatcactgttgctctcgcaggcggtgtttttgacgaacaccatgtagtcgaccacgtcatgacctttttaaccgcaggccacgagtccaccgccacggcttttgaatggacgatgtacgagttaggccgccggccggagatgcagagccggttaagagacgagctgcgagcgacaataggcacagatctggcggccgttaactttggattacgggtccagaatctgccttacttgaatgcattctgcagtgaagtgctccggtgctatcccttgtcgccgattatcgtaaaatcgcaccaaaggaattttcaccagacggcgccaaggataagcgggagg

SEQ ID NO: 8483 - DNA, 345 bp, A.fumigatus
cgtcgaagaattctgacagggaactacccagtcctgttccccgataacgcatgggttcctctgcgggaacttgccgaaaccacccctaacgacggtctcctccgaatctactctgcgttgagcggcgaggccctcctggtgacaagcccgccagccatcagagacatgctcacagtcaatgcctttgacttcacccaccaggacctcgtcaagattgctatcagacgattcacaggtagcaatcttggtttccttagcaatgatgaattcaaggcatgtaaacaacacattgcccctgggctagtagctgatcagagagaacacagctccatcgcaaaaacatga

SEQ ID NO: 8484 - DNA, 696 bp, A.fumigatus
  unsure (76): Identity of nucleotide sequences at the above locations are unknown.
tgcttactagattcccagcagcacatcaagcattggaatttcgtcgctaattttccggtctttttcctgttcctgntacttatttattttcctactatgtccgagctaccgtccagtcaacccgccatcatcgagagcgatgatggtacactcggcctacgcaacgatgtccaaatgccatcactagaagacgacatgatcctagtgaggaacgccttcgtcgccctaaacccaattgacaccaaaatggtcggcaagcttgcaagtcctggcgcaatagccggaaaggatttcgcaggcgaagtcgtctccattgggcccaaagtccaaaccgccgcacccatcaagccgggtgaccgaatctgcggcgcagtgccggggatgcactctctcactcctgcggtgggcgcgtttgcgcagtatgttggcgcgacggatcttactgccataaagatcccggaatacatgtcccttgaagaagcagtaaccctgggaagtgggattgggactattggacttgcgctgtttaaatcactggatgttcctggatcgccttggttgccggctgacaaaccggtggatgtgctggtgtatggtgggagcactgcgactgggactctggctattcagttgctcaaactgtacgttacagtatcagtctgttattctcttagaagtaaatacctactaacttaa

SEQ ID NO: 8485 - DNA, 447 bp, A.fumigatus
ccttccagatcgggcgtgaatcccataacaacctgctcaccgaccaagttcgacctcgtgaaatcctacggcgccactgctgcgttcgactaccgtcagaagacatgcgcagacgatatccgcaagtacactcgaaactcactcaaattcgtcctcgactgcatttctgagccagagacaatgcagttctgctacaaatgcctcggccggtgggggggggggggggaatacaccgcattggaaccttaccgtaagttcgtacatacccggccgaagacggttgtgccagattgggtgcttggcccgacgctgctggggaaaaggcttaactggccagagccgtttggtggggaggggaacgaggagtacagaaggtttgggttcaagtggtttaagctggtgcaggagttggctggatcaagggaagttgaagacgcatccgcataa

SEQ ID NO: 8486 - DNA, 849 bp, A.fumigatus
aggatatattctccagctcgctctccccgaatgcacccagcaaacacgaaagatcctatttgggcaacagtggagagctctgcattcttcatccgtgatcaccatactggcaatgagattattatcttcggtgacgtcgaacccgactgtgtctcgcttgacccacgcaataaacgcgtctgggaggcagcagcaccgaaaattgcgaccggtaaattgcgcgccatcttcattgaatgctcatatgacgattctgtcgaggatgcaactttatacggtcatctatgtccgcgacacctaattgcggaactgacgttgctggccgggaaggttatggaagcccggcacccgcgcatggcgatatcgagtatcggaaagcgtaaacactcagactctaacaggtatggcggcagtggtggccaagtgagcccgaaatccaagcgtttccaaagcttctccgttgcagctggcaagagggccgacatggattctgttacggttgacatgcgaccacgattctactcaaccgcggaaggcttggctgagatccctgagctggttcatgacgagccgacaccgagctaccacgagcctgacgatgtaagcgatactgaaaattcggtggatcctgcaccacagtccaccagccctggagaagctcagaccagtgactctgggcagcttccgctgtcgggtttatctatctacatcatacacatcaaagaagatctgaccgatgatatccctccccgagaacgaattttacaacagcttcgatcccgaggcgaagccgctagactaggctgcgagttctacgctccccatcgcggagaaggcatttgggtttga

SEQ ID NO: 8487 - DNA, 420 bp, A.fumigatus
ctgacatcttgtctcatgaagggtcccacgggaggtcctcgtgaagacagcctcactggacttcttgtccgatcaacgtcgacgaactggtcgacgaattcggtgattgcggttgacgcgggtacccttgtttcagggattattcacactctggagcaatacaatgcggaattaagagatggctcgtatatgatgaatgaagggccttttgccggcctcagaatgccctacaagtctgctcaagccaatgctgcacatattttccgagacatcattggagctgtcctgatcacacatgctcacttggatcacctgtccggcctggcgatcaacacgcccatgcttgaagcaggaaacgggcccaaacctttggccgctctacccgtcaattgtcgctgccataaaaaaccatatgcttaa

SEQ ID NO: 8488 - DNA, 576 bp, A.fumigatus
acctgtgctctgtcaagaatacaaattccctggcccagagcatcgatcaagcgagcgggcatcaattcctttggccatggaggaactagctgccatataatcatcgaggatgcccagcaattgttggacgcacgaggaattattccccatggacgatcctttctatccacctcaacgagttcatggatggatgaagatgatgacgaggatcatgcagcctcccaatccactccatgcacctctcatattctgcttatctctgcccaggacccgttatcactacggtgcaatgaaagagagattctaaggcatctggctagcctggatgtccgagttgacttggggaacttagcttatactctctctcatcgacggagtcatcattgccatcgagcctatgcagtggtaactagttccgctctctcccaggcacggtttgtggatgggaagatcttggcccgggaacctagaattggcttcgttttcacggggcagggaagccaatggccccaagatggggactgcactcatcaaatcattccccgaagctgcgaggcgcatcaagcccctggataa

SEQ ID NO: 8489 - DNA, 441 bp, A.fumigatus
cccctgaagcgcatgagaaggagcggtgataaggcggagatggatccgcaaaccatttccaaatacttcataggattggaagacagggtccatattgcttgtcataatagtcccaccaacgttacacttgcgggggtcctttccgccttggaggaggtgcaggcacgtttacggcaagacgatcatgcatgccgtatgctacaggttgatatcccttaccattccaagttcgtcgcggccactgcagaggcatttgagcagttcactcttcaagagaggccgttggtgcaagagttaggctgcagcggaggcgtcacaaatgctgtcgaccgtcactggcagccgattggagggccggacttgcaacagctcatactggagagccaacttggagtctccagttttattccgtcacgcaatggaagctatcctccgtcatga

SEQ ID NO: 8490 - DNA, 354 bp, A.fumigatus
gctgcagcggaggcgtcacaaatgctgtcgaccgtcactggcagccgattggagggccggacttgcaacagctcatactggagagccaacttggagtctccagttttattccgtcacgcaatggaagctatcctccgtcatgatcaacaccccgatattcttattgagattggcccaagtgacacactgagacgcccagtcatgaaaccaaagcacagtctcggccagggagatgggcccctgaaggacactgacatccagtatctatcggctcttcataggggcgacatgtcggccgaccacatgttacacatcgtctacacgccgggcatggaagtattgagtccccccgga

SEQ ID NO: 8491 - DNA, 306 bp, A.fumigatus
aactgcacagacgaactgacccacgcaagggaccctgaagttgttcgccggccggaattttcagagcccctgagcgcggccctcgagctcgctatcctagctgtaatggaaaatcacagcgttcgccctcactgggttgtgggacactcttctggcgagattgcagctgcctatgtggctggatttttgcctttagaggatgcaatcaagattgcttacttccgtgggcaagccgcgcagggagcctgcgataccgtgaaggagaggatgggtatgacccctgaagcgcatgagaaggagcggtga

SEQ ID NO: 8492 - DNA, 219 bp, A.fumigatus
cttggagtgcccggaattgagccttcctctatggacaacacgattttgatcagacctgatagtccagacgttgcttcggaatcgccaaggttactttttatctacaatgcgggtgaggtcaaccatctaaatggatactttgtggtcgaggaccttaccgagcccacgatgagcggatcgtccatgctcgtcttcacacacagcacggcgccgatctaa

SEQ ID NO: 8493 - DNA, 1380 bp, A.fumigatus
ctcgcgatggcgatttctgcaacgatatctggtgctcatgcgattcttctagcaacgcagttctgtgccactggcaatgtcgttcatctgccactcctccacgcccaatttcccagctatttatccttggagcgtctcttgcgcattatcttgacctttcttccggagagcatagagccgcaggcgtatacctctgtgcttcaagaactagtgtccggttcctcgatcgggccgactgaaggtgacgttgatgtatctgccgtccaagaccttcccgagactgttgcgagaaaacgagtccggaagcttcgtctactgccgctgagacaccctgatgacgaggatagcgagccttctgacctcttaactcaatttcttatccatcggtcgcatcgcatagattccgagaccggtcttcagccacttatccttgaccttcttctgccattctaccaacgctcgaccacagtgcgcacgtggttgatttcaagcattctgccgctcctccgattgaactgcgagtattacccgagccaggatgagatgttttccctgaatacattagagtcgatggacgatgcaaccgcggtcaacgttctgctctctatgacgagtccaagaaaagacaagatggacatcgcgaggaacctccgtggactggtgggtgcgtggatctatggcagcaatcgtgcgaaacggcgcaggctcagtgaggctgcaaatcagagtgcgatatccctttccccggacaaccaccgcccgaagacgacaacagattctatatggcaacaggtaaatgaatggctgctgtcgcatagcttggtggaacatgatactacagtcaacgcctttgttcattgggatgggcccggggatgtggaccttggaggctacgaagaggagaatcaacaaccaacacaggacgaattgaccgaaatgcggactcggtatggccagactggccttgccgttgtgtacgcaaaccctgatacgagcagttcctctctgggaaggttcaatgcagattgttgcgagggtggctcagttactcaatctccaggactctctgtttgttctccacaaggattcagcgctcccttcggtgactttcgatgcgggcgagatcccgtccacatcaagagtcacattgttacaaaatgccttactactgagttcgaatccgttgacgcttccgtctgtttcgtcggtctcgttcttgagcgcactacttctctctttgcaggtgctgcatggaatgggcgtttcaataccctgcaggcaagctgcaaacctgtgcttgcacagcaccgaggacatgcaacttgcagagcttcgcagtacggttggttcggttgccaagcaggtcactcctggtcgtga

SEQ ID NO: 8494 - DNA, 423 bp, A.fumigatus
ttgattacttacctcgctccatgcaacggcgactgtgccaccgtggacaagaccaccctgaagtttgtcaagatcgccgctcaaggcttgatcgacggctccaacccacctggtgtttgggctgatgatgaaatgatcgccaacaacaacacggccacagtgaccattcctgcctcctatgcccccggaaactacgtccttcgccacgagatcatcgcccttcactctgcgggtaacctgaacggcgcgcagaactacccccagtgtttcaacatccaaatcaccggtggcggcagtgctcagggatctggcaccgctggcacgtccctgtacaagaatactgatcctggcatcaagtttgacatctactcggatctgagcggtggataccctattcctggtcctgcactgttcaacgcttaa

SEQ ID NO: 8495 - DNA, 303 bp, A.fumigatus
accacacaaatgacagctgcaacagctaacttctattccagttacggagggtaccttgttaaccaatacccctacatgagcaaccctcccgacaccattgcctggtccaccaccgccaccgacctcggctttgtggacggcaccggctaccagtctccggatattatctgccacagagacgcaaagaatggcaagttgaccgcaaccgttgcagccggttcacagatcgaattccagtggacgacgtggccagagtctcaccatggaccggtacgacgccgaagagaagagaacataatgtga

SEQ ID NO: 8496 - DNA, 696 bp, A.fumigatus
  unsure (515),(607): Identity of nucleotide sequences at the above locations are unknown.
ccgacatcctgtacacacattacgggccgaacccagcctctcaggacggcaacggttggggccagtggacacgcgcggatcacctatccatcggaatggaccgcaccgttaagaacgggacaaagttctcgggccagtaccccgccgaagtcgcagcgatgtacgaaaatatcgagaccacacccgacaacctgctgctctggttccaccacgtcaactacacccagcgtctgcactccggcaaaaccgtcatccagcacttctacgatgcgcattacaccggcgccgagacggctcaaaccttcgtctcacagtgggagtcgctcagagaacgcattgatgcagagcgctaccagcacgtcctcactcgcctcatctaccaagcggggcattcgatcgtctggcgtgacgccatcaacaacttctaccataatctctcggggatcgccgacgaaaagcagcgagtgggacaccacccctggcgtgtcgaagcggaggacatgcagctcgatggntacgtgccatacgccgttagtccgttcgagaccgcgtccaaatacactgctatcgtcactgcatcaaatggcaccaccggaacagcgagcgntacgctggacttcaagacaggcacgtacgatttgggcatcaactactacgatatgtacgggggcaagtctcactggacggtgtatctga

SEQ ID NO: 8497 - DNA, 1137 bp, A.fumigatus
tccttccagccccgtggtgaagacctggacaggaactccaagatggtctgcaccagaatccttggaaagcatgcttccgtcaagtccaccggctgctcgaccgactcgtcgatcattgtcggcacggtcgaggcgtatcggcaggtctgcaacgctggccgccaggtaccgcaactcgacgtcgacgggttctggctcagcatcagggaaaagtcagtactgattgttggccagagtgagcgaggggctttgtacggtgcatacgagtacctttcgatgctggcgcaaggcaatttctcgcaggtctcgtatgccaccagtccgcatgcgcccatccgctgggtcaaccagtgggataacatggatggtagcatcgagcgaggctacggtggaccttcgatctttttcaaggatggcgtgattcgtcaggacctctctcgtgtccagcagtatgcccgtctgctggcttcggtacgcatcaacggcatcatcgtcaacaatgtcaatgcgaatgcctcacttctcatgccctcgaatatggacgggttggctcgaatcgccgatatcttccgtccctacgggattcgagtcggcatttctctcaacttcgcgtctccctcgactcttggcaatctcagcacctacgatcccttcgactcctccgtcatcgcttggtggggcaacgtcacggatcagctgtacgcgcgcatcccggatatggcagggtatctggtcaaagccaactccgaaggccagcccggcccaaccacatataatcgcacccttgccgacggggccaacatgtttgcacgcgccctcaagccgtacgggggtgtggtcatgttccgtgcctttgtgtacgaccaccatattagcgaagacaattggtacaacgaccgcgcgaacgcagcagtagactttttcaagccgcttgatggcaaatttgacgacaatgtggtactgcagatcaagtacggacccattgacttccaggtccgcgagcccgcctcgcccctgtttgccaacctgttcaagaccaacacatcaatcgagttgcaaaggaacccaggagaatctccgacagcagtcacatctggtgtacttgcctccactctggcaaacgatcctggggtttga

SEQ ID NO: 8498 - DNA, 1455 bp, A.fumigatus
  unsure (1059),(1151): Identity of nucleotide sequences at the above locations are unknown.
actttttcaagccgcttgatggcaaatttgacgacaatgtggtactgcagatcaagtacggacccattgacttccaggtccgcgagcccgcctcgcccctgtttgccaacctgttcaagaccaacacatcaatcgagttgcaaaggaacccaggagaatctccgacagcagtcacatctggtgtacttgcctccactctggcaaacgatcctggggtttgatctccgtgtcgaccagaaacctcccctggtgcgagacatcatctcgggacagcgatttgacagacccttgggcggctgggcggcagttgtcaatgtcggtaccaacagtacctggcttggcagtcatctggccatgtcgaatctgtacgcttatggtcggctggcctgggagccgacgctagattcggaggacatcgtccaggactggatccgcctcacgtttggcttggatcgccgcatcgtcgatactctcacgcaaatgtccatggagtcctggcctgcgtacgagaactactcgggcaacctcggcatccaaacgctgaccgacatcctgtacacacattacgggccgaacccagcctctcaggacggcaacggttggggccagtggacacgcgcggatcacctatccatcggaatggaccgcaccgttaagaacgggacaaagttctcgggccagtaccccgccgaagtcgcagcgatgtacgaaaatatcgagaccacacccgacaacctgctgctctggttccaccacgtcaactacacccagcgtctgcactccggcaaaaccgtcatccagcacttctacgatgcgcattacaccggcgccgagacggctcaaaccttcgtctcacagtgggagtcgctcagagaacgcattgatgcagagcgctaccagcacgtcctcactcgcctcatctaccaagcggggcattcgatcgtctggcgtgacgccatcaacaacttctaccataatctctcggggatcgccgacgaaaagcagcgagtgggacaccacccctggcgtgtcgaagcggaggacatgcagctcgatggntacgtgccatacgccgttagtccgttcgagaccgcgtccaaatacactgctatcgtcactgcatcaaatggcaccaccggaacagcgagcgntacgctggacttcaagacaggcacgtacgatttgggcatcaactactacgatatgtacgggggcaagtctcactggacggtgtatctgaatgatcgcgttgtgggacaatggcaggggaacagcgaggatgtgctgagccatacgccttcgatttatctggatggacactcggctacgcgcattaccttccgggacgtgaagatccacaagggggatcggctgaagattgtgggtaagccggatggagtggaaccggcgccgctggactatgtggtggtgctgccacaaggaattgtagattag

SEQ ID NO: 8499 - DNA, 378 bp, A.fumigatus
gcggcttacaaactaccatacacatctcaaatgatggcacagctgatgcaacagaaccaaaaggtcctcttgctgatcccatgctcaattacagaagtcctacttaggatcttcgatcatgaatcttcttccggaagaaggtgcaaaggaaaacagcgaggaaaggaagactatctggccggcgtggtcaaattgctgtcgtctgcgtggtgtaccatacatcatatatttctcttccgttgcttgtgtaagagacgtgagtatgttcaccgatgcattatcttctatgcaatctctaaactaggatcttattcaccaatcactctgcagacattcttgatggggacgagccaactgcgcgacagaacacaactatga

SEQ ID NO: 8500 - DNA, 456 bp, A.fumigatus
tgccgatcatttctccaaggaatgtctgtcctgggttcccctcatagtttacggccaggaatgcaaggggctttcccatcaagcagtgatcgacccaatgttttgattatgagctgcttaaatacatcccgcatattcgctattcttttccgtccacctccatcaccaccactctctgaaaattccatcatgtatctcacccagagcctcacactggtgtccctggcgacagccaccctcgcattccagatccccgactccaaaccaccctccactaagcacaccgacgaccaaaccaccagccccgttgtccgcgacatcttccaattcccagacaacggctccttcattgacaacatcgccgtccgcccagacggcaccctcctgctcacccgcatcgacgtccccgaagtttgggccgtggacccgcaaaccggctccggggagctagcctaa

SEQ ID NO: 8501 - DNA, 846 bp, A.fumigatus
tccttcgcccagcaaagcagcgacagcgacagcaacagcaacagcgacatcaccgccgtcttcggcatcaccgaagtcgagcatgacgtcttcgccgttgtcgccggcaagttcgcgctcgagggcttcgccgccgagcaagggtccttcggcgtctggaaattggactttaacgataacagcaactatgacgtgctggagctgccgtggtggggcgaagggaaatttcccctgaccagaaacacgcccagcgaggtcagcaagatagtcgacatccccgaggcgaaggcgctgggtgctagtaccttgtacaagccccgtcatgatgcgcggtacctgcttatctcggatagtcctgacgggatgatctggcgggtggatctagactctggggagtatgcggttgcgctgcaggacgagtcgatgctgcctgcgccggatgcgcccccgatgggggttaatgggatccacgtggtgggggagtatctgcactatgtaagtgtgacgaagaaggagtatcgccgggtgaagatcgatgagaacgcgaatgcagccgggccgtttgagttgattacgagtgagatcgacccggatagctttgatattacggacgatggaaccgcgtactttgcgacgaacccggagaacacgattgtcaagtatacgcctgagggcgagattgtggattttgcgggcggcaagaattcaactgtgcttcctgggccgacctgctgtgcgttggataagaagggacagacactgtatgttggcacgaatggcggcctcatggctccggtaggtgggacttacaaggagccgggcaagattgccgctatttcgctttga

SEQ ID NO: 8502 - DNA, 330 bp, A.fumigatus
atacatcccgcatattcgctattcttttccgtccacctccatcaccaccactctctgaaaattccatcatgtatctcacccagagcctcacactggtgtccctggcgacagccaccctcgcattccagatccccgactccaaaccaccctccactaagcacaccgacgaccaaaccaccagccccgttgtccgcgacatcttccaattcccagacaacggctccttcattgacaacatcgccgtccgcccagacggcaccctcctgctcacccgcatcgacgtccccgaagtttgggccgtggacccgcaaaccggctccggggagctag

SEQ ID NO: 8503 - DNA, 402 bp, A.fumigatus
gtagctcgtatctctaacagagttggtagtgattccgcgtatggagacgtcgcaggcttcttggttgcagacaccacgaacaagctacttgtggtctctttcagaggaagccgcacgatagacacatggttggcgaacttggactttggcctggacagtatcagtgatgtttgcagcggatgtgcggtacataagggattctggaagtcctgggaagtcgttgccaatgcactaacgaccgagctaaactctgcccttgcaacttacagtggctataccgttgtctttactggccatagcttcggcgctgctcttgcaacgctgggggctgctacgttgcggaaagcagggattcccgtagagctggtaagtcatcccttgtcaaatcaggtaagggcgtaa

SEQ ID NO: 8504 - DNA, 306 bp, A.fumigatus
ttgaagtatggttacggatccccgcgtgttggaaataaggccttggcaacattcatcaccggacagggttccaattaccgtgtcacacacacaaacgacattgtccccagactcccgccccgagtctttggcttcagccacattagcccagagtactggatcacgagcggtgacaacgctcctgtcacgacgtctgatgtcacggttgtccagggaatcgactcaagcggtggaaatgcgggcgaggattctaccagcattgaggcccataattggtatattggccatattgatggttgtcaataa

SEQ ID NO: 8505 - DNA, 189 bp, A.fumigatus
ccgaccacaggcgctgaacatttagttgctacgtttaagggacatggaggaaacctaagtggatatttagattctatcatcaagtcgttgcatattttgcgacagatctatctacagcccatgcagaaactcattttcatccgctggaaactcaaacaacgcactgtctatatcatgccaatcatctaa

SEQ ID NO: 8506 - DNA, 303 bp, A.fumigatus
tacagctggcctcagccgatcggattcaaattccctcttgatctcctgcagagacagtcgggcactatgttcactaagaagtctatcgtgaccctccttggaggcctgtcggtcgcactggctcagacttcctctgagcagtatctttctctctcggagattgaagctgctcaggctactgtgctgcctcactcacctgtctctaatgtcaagggtcttgcattcgaccgctttgttaacatctggttggagaacactgtatgtgactccttgctgaactctaattgccagggattacgctaa

SEQ ID NO: 8507 - DNA, 1527 bp, A.fumigatus
aggtcagttctgagaacctcgttctgtgtgcttggcttaccgtcaacggacttagatggcgccgagttccaatctctccactctatgattttccagctatcctcaaaggtaattattgggagaaggcgaaatgcagtatcacaggcggaagaagcgaagctccaacagacctccctgctggttataagacaacttcttcaagggcccggaggtgaagagattgctgagtcgggcattgactccttcttggttgatcaactgtcttctgtcctcgacgaaggaggtagcatcgaattacaaggggctataatagacacccttctctcggcgttgaaggtccgattcgcacaagcatacctaccaccgccccctcccaggccgaaacatcagcgtgcacagtcccgtgagcggctcacaagtccgtcacttctttcctttaccagtgataaggctgatagaggtgctttgcctcctgttccacctcaacctccttcccgcctcctagagtgtcttctcaaaggcatcagctctaaaagttcgagagatatcgtggagaagtggactctactactttgtgaagttctccctctatattcaggatccctcttccagatcctgctcatgttagtggaatgcttctgtaaggagatccaattatcatatacgaatctccagctctcttttagacaaaccgacggttggccagaagatcgttcagagcatgtcaccattaccctacttactggacttgagacgtgcatagcggccgctcacgaacgccttcttgtggaggaagcgaacgtaccagctgccaaaagccctgaccacgctcatgggttctttggcaacatggtgtcaggggtttttgcgaccgactcaaaccaggggcggtcaaccgcagcgaacaacagattaacagtattattatgcttccaggatgccgttcgattgtgcttttccatatggtcctggggtgctgtggaacgaagtggtccaccccaggatcccgagtctctcgcatccttccaatacacctctctgcggatgagaaacaggtctcgtcgaatacttgagcatcttttcactgcggaggcccttgaatgcttagagacgatggtagagatgtggtcaagagcagaccctgacacatcaccactaattcttagtttgctccacactctggacggatctcgcccaaagatcaccattccagcaatcttcaatgccatttatacacgaaccaaccctgctgcccttgaaccccaccgtaaatctgccttgacatcaaacctcactgaatcggagctggcgggttttctggtcacttatgccaggtctctggatgatgatgtactcgacgaaatttggacagactgtacaacatttttgcgtgacgtcttgagcaaccccttcccccatcgacagatacttccccggttagtggaattccctgctattctaggagccaagatggagaatacaaccttccggcaacaatccaacgatgagaaaggacctaggggttag

SEQ ID NO: 8508 - DNA, 270 bp, A.fumigatus
ggtttgtatcgatttctgatatctcttagggtgtttcgcatcgtgatcttgcgacttgagaatcttctcttgcgaaaagaaacactgtcagaaaatgagggcgataacgttgtcatttccactgacgactataaagagtgtaactaccttctacggacaatctacaataccctctgctctctgtcgcccaatggatggatgtctcttcttactcagacattgaatcctgtggataaacaaaaggatggtgcttctgaaggtcagttctga

SEQ ID NO: 8509 - DNA, 654 bp, A.fumigatus
agagtaatcgcaacagtcacgtacagaagtgcacgtgaatgggaaaagcggttcggaggcaagcgcgccgacgccagcaaacagccggccttgtgccctgacttccttattgagacctatctcgatcatgctggcgagaaattctgcctcgagtacgacccaaatagtctgctctacgtctccaaagccatggacctgttcgacctcagccggtcgcagcgggcagagactgaaaagcgcagacgggagtttgaggctcgtatcgcccaaggcggcaagacactccgctacaacgatgcctcgtgcagcttgacattgcccgaaaagccttacgaggagcaaccatctacaaccgactccggctcctcggcggacgaggcagtcgccactggcaaacaaccagatacaccacccgccgatctcgtcgcaggtctcgcgccgttgaagaaccaccccgtcttggtcatgggtgttgccagtgatatcctcttccccgcgtggcagcaacgtgagatcgccgagactcttcgcgcggctggaaataagaacgtcgaacatatcgagctgggcgaggatatctccttattcgggcatgatacgttcctgcttgacttaaaaaatattggcggtgccgttgagaggtttttgcgctaa

SEQ ID NO: 8510 - DNA, 1800 bp, A.fumigatus
  unsure (1603),(1604),(1643),(1703): Identity of nucleotide sequences at the above locations are unknown.
accacagcaccaacaggaggaactgcgccgccaggaggagctgctgaatcacccataaccacagtgccatctggaggaactgtgccaactggaggtgctcctcattcacccataaccacagcaccaacaggaggaactgcgccgccaggaggagctgctgaatcacccataaccacaatgccacctggaggtgctactcattcacccataaccacagcgccaacaggaggggctgctactgggtcacgcccaggtacttcttcggccggaggaattgcttcgactgttcccccagtgtcttccccaaccggtggaggtgtccctacctctgagggaccaggattctctcctgctgggggtggtgtgcctgccagtgcatcaaaccctttcacagccttcgtgcctccatccgagtctccagttgcgtctaaggtcgggacgcaagcctgtccaccatgtcccactcctgctgcaccaacctgcgcaccctgtcctgctcctggcacaagtactactactttcaccgtcaccattactgaaacagtttgcactggtcaggttactcaaggaggaggtggccccactgcatctccaggtgttcccgccatttcacctctattctctgcaacgggtcctggagccctaacttcgacagccgcagggccaggcggtccacaaggtccaaccgcgacagaaacacatctttcgattgcccctcacgcccccggcggagcggcaggcgcaaccgcaggaccctcaactcagccaacaacttcggcgactggggttcccagtgtaccacaaattcccggaggtggaggtggaggcgcagccgcaggacctgcaacaagtctgccggtgacttcagctaccggggttcctaacatccctcacggtcctggaggaggcccaagtggattccccaacactacttcaagccaagttgtagctacgaccacagaaaccattggttcaactgttcccctgtctactcacgggggtggagccgcaacatccggtgctgctcaaacttccaggctttctgtgactacaggaatcagtttcgcaaacgtcacacgcactcccagtggcggacagactgggttgcccagtgtgactttaatccctgccatacccactggccctggtatctctaacgttactggtactgttgggggaggcgtgtcagtctcaactcctactagcgctacgatctctgccacaccaaccagaccaggcggaacagcaccaccaggcggaggtgtgcccatttcaactcctattattgctacaagcctggctacaccgaccagaccaggtgctgtctcaactcctattattgctacaagcttttccacgccgagcggacctgaagtggcaccaccagctggaacagtagtaccaggaacagcagcaacaccaggtggaatagtggcacctggcggaggagtagcaggtggtggaacagcagcaccacgtgaaggagtagcatctcgtggagcaccagcaccaggtggtggagtgccaacagttgtgatatctggcggaaggtccactgccacctctactactaccatccaagtccaaacgttatctgttttcnntagcggccttccctttccgcaatcccaggggaatacggntacacgtccggtaaccacgagcacagtgaccggagtaaggccaccgcagtccactcccgntattgatccaaagaagcggacagtggcagaaaagacagacatcggccggcctgataagctcaaggcaaatcctattgtgttccggcgtcggacttga

SEQ ID NO: 8511 - DNA, 213 bp, A.fumigatus
atttgggcaggcgaggtccctatgttgagaactactggcttcgacttgatctgcgtctctgtcttcttctttcctattcccctactacgagaattgttttggcacgtacgatatgtggacagtaacactgtcgttaccgaggaagaaatgcagaaatatcacattgcgagaacagcccccttctttttgtaccctaccgcgcgtgcattgtga

SEQ ID NO: 8512 - DNA, 786 bp, A.fumigatus
  unsure (109),(169),(208),(209): Identity of nucleotide sequences at the above locations are unknown.
gatggacattttcaagtccgacgccggaacacaataggatttgccttgagcttatcaggccggccgatgtctgtcttttctgccactgtccgcttctttggatcaatancgggagtggactgcggtggccttactccggtcactgtgctcgtggttaccggacgtgtanccgtattcccctgggattgcggaaagggaaggccgctanngaaaacagataacgtttggacttggatggtagtagtagaggtggcagtggaccttccgccagatatcacaactgttggcactccaccacctggtgctggtgctccacgagatgctactccttcacgtggtgctgctgttccaccacctgctactcctccgccaggtgccactattccacctggtgttgctgctgttcctggtactactgttccagctggtggtgccacttcaggtccgctcggcgtggaaaagcttgtagcaataataggagttgagacagcacctggtctggtcggtgtagccaggcttgtagcaataataggagttgaaatgggcacacctccgcctggtggtgctgttccgcctggtctggttggtgtggcagagatcgtagcgctagtaggagttgagactgacacgcctcccccaacagtaccagtaacgttagagataccagggccagtgggtatggcagggattaaagtcacactgggcaacccagtctgtccgccactgggagtgcgtgtgacgtttgcgaaactgattcctgtagtcacagaaagcctggaagtttga

SEQ ID NO: 8513 - DNA, 1596 bp, A.fumigatus
ctccggggcgggcgtgaggaccacatccagtcttctccggactctgcgagcaaagggcgacggaggcacataacacaagaaggagcaattggatccgcaatttgtcagcttccgcaacatggtggcgacgctttacctggttcagccgttgtccgttcctccagtcgttggtataactacgccgggcagggcacgatgcgtccgagcctcgatgtccttcgaggcctcctcgttcagctggtctttgacaacaacatgctcagagctgccgccatgaaagccactgcagacaccgtatttcgcctatccggtctcggtgccggaggtacaagccctatcctggtcggcccgagtatccccgtccagcctgacgccggcgcgcatgaccagggcacgcctcgcgaggcctggggcctcaagtccggactctacacgccccgtcaactagtcgaagggtttgcgccactgctggacacggtggtgttccggctcggtccagatccaccgaacgccagaccagcgcgggcgcaactgcttgacaacctagccgctaatcttgacatcaacacccgcgaggccacgctgcgcttccccgacactgatctggatgcctcccgccaggaaatcgccgagcaggccagacgcatcggacagacgctcgtccaatacgcgcgcaaccacacgggcgggcccttcaatcccgacctctcccttcgcagcccctgtgagggccatctgctcatcccgcccaatgtcgacctaatgttcggccgtcgcagtcagtcgcatctgatgcagctgttcaacgagtatatgcaccagatggtcctcctgcgtgacgccctgctgccgttccagaactacgaggatgtgatcatccctgtcgatggccgagccgcgagaggcatccggcatctcgagccatcccggtcggagtttctcacccacctgctgaccaaggaggtcacccaatcggcaatcatcaaacatgcccaggccctccttgctccaggccttctgtcccattccagcctgaccccttcgcccagggccggccccggctacgggttccaatatgctcatggcctggtcctgcccgcgttcctggccggtgggccaacgccgttccatcttctccagtatatccccgccaagctggtcgacgacgccccaaaaggtgtcatcttcgactaccggatccaggactactatctggcgcctcgcgtcgacatccccgccggcaccgagaagacttttccggggcttctgtccgagagatacccgtggccaatggctggggcaccccagcactcggcgtacaaagcaccaacattggagtcgttccaccgacacccgacgcgaactcgtcatcccatgcggtccggcagcttgagttgcaattccagctcgacaacggcaagtgcgtctcggttgacctgggacaggttgcgcgtggccaccgatacgcctacctggcgtccagtgccagcacctccgcgacgtcatccaacggtatgcacggcgcgacgtccgccgtggtccacgacgccgcatccgttctcctggagacggagcacgaaaaagacagcctcgtga

SEQ ID NO: 8514 - DNA, 705 bp, A.fumigatus
gacttccaaagaagccgatcgacctcagccaatcaagaaagccacatagtagccgcaaaatgtctgcaggatacggctgtgatgcggaacttctggcatttctcgcaacagctctatgccgacctccctcccatcgatgcgtacctcgcacttcaccgcgactacgtggcacctatagtggggccagtcctccatggcacgctgaccacaacggaggccttggctctttggacgggttctacaccatgggttgccaagatccaggcactccgtcaaggtaaggaggtggcggagcggctctttagttacaccaaaagcctttgtgcaactcagcagtcaacgctcagcagtctcacggcagacgagaaacaaatctcagctcatctcaccacggaaattttgaggcgatatacagcggacactctgggccaaccgaccccatttactgatggcgttgacacggcggctgggggtgccagccttgccggtggaagcgcgaaaaatattcctcagggcatcacgaacaatctgtcattggcagcttctgccagctttggccctgcggagtcactcttcgatcgcatcaactacttcgaatgctttaatacagcgttgcgaatgatccagactgcccaagcacagcggatgatcaaagctctggatgtcatcgcccaaaagcttcgagattgggaattgctttaccgg

SEQ ID NO: 8515 - DNA, 234 bp, A.fumigatus
tcaagcattccgctgggttccatcgccccacagcactgggagcatagcagtgatgacaatgacatctctacttgtacattttgcgtcctgcttccatggaacaaatggcagcattggcaatgctcaatgatgggatactctttgcttcttacgaacctattggacccttataccctgtttgttccccttcaacgcctaaaggctgttctggggaaaggcaagcacacaccctaa

SEQ ID NO: 8516 - DNA, 1041 bp, A.fumigatus
caacttgatcagatgctccgcaatgatgaagtccagaggcatacactcctgtccgagatgattaccagggtatccggtttctcagcatggcttctgccgtcttttgcatggtccggaggccagtctccgccacggcttgccccagtttggccatcaaccgctcgtcgccgtgttatcaaaatgaccgtactggtagctctcttctgccttgtcacatggacactatgcactcgcataccgcagtattccacgcaggggacacaacagccacaacagccggaaaagacaccacaccctcaccctcagcctgaagacgctttcccacccacgcatgcgacggacttgaaaatccacgatccgagcatcatccacgtcgatggcacgtactactcgtacagtgtgggcaggcatattcgcatccaccaggctcccagtctcgacgggccgtgggaacgaaccggcgccgtcctcaacgcggacagtgtgatccccaagggcgaccggaaagccccctgggccccgcagaccgtccaccacaacgacacgtactactgcttctacgccgtcagtaactccggatgccgtgacagtgccattggcgtcgccacatccaagtcccccggtcccggcggctggacggaccacgggctgctcgtgcagtctgggacaggaaagggctcggatgaacacccatttactagctccaataccatcgatccgagtgtgttcgttggagaggacggtcacggatacctgatgttcgggagcttctggtcgggcatctggcaggtaccgctggacgaaagcctgctttcggtggctggcgacacgagctccgaggcacgacagctggtgtatatggagaaggcgccgctgccggcgagcaagcatcccaacccactgtgccgggagccgtcgggtgcccggcccattgaggggagttttctctcataccatgagccctggtattatctctggttcagttacgggaagtgctgcaagttcgatacgaagaatctaccacctccgggaagagagtaa

SEQ ID NO: 8517 - DNA, 651 bp, A.fumigatus
cacgatatatggggactctggccgcactttagatcttcgtggcaagatataggtattgcttcatgctgccgctcaaaaaactccggcatcatgcgccgtgcacctcgtggccactctgccaggggccgagtctctggcggccaacccaaggcacgcgaggaaggagatgaaatacctgaagtctaccaggaaatgcttgctgaagcagaattgcggaacccaaatgtttcggaagcggaccgtcctatcaagagacggaaggttggagctcagggagctacaactcttaatgaggtttctataccccaagtaccactgtcaatggaagacagccggcaggtacagactgactatgacgaacccacgtcagaagaatcggatatggagtgggaagaagttgaccttcagcaagtcccagctcagtcgactcagataggtccggtgacagaggtcgataatgaaccactccagatcactcttgagggccatgaaggaaagagacggaaagtaatttcaagacaaaaatcactcaccgctgccgagaaaaagctccgattagatattcacaaagtccatgtgctctgtctcctgcgtcatgtgcaaatacgaaatctatggtgcaatgacgacgaactacaggtacgcaactaa

SEQ ID NO: 8518 - DNA, 348 bp, A.fumigatus
  unsure (181): Identity of nucleotide sequences at the above locations are unknown.
catctcaaaggccctggattcaccgctcgagcctcgccttacccggtgttttgggttgaagcattcaatgaagcagtccagaaatgggtccctgtcgacccattggttaccaaatcgattgcaaaaccatctaagtttgaaccgcccttcagtgatccatcaaattccatggtttatgtanttgggtttgaagaggatgcgtccgcaagagacgttaccaggcgctacgcaaaagctttcaatgcaaaaacacgcaaaatacgtgttgaatctactaaagatggagagagatggtgggcaaggaagaagcttttttacgaaaaaaccattcttgggagaccgagatga

SEQ ID NO: 8519 - DNA, 456 bp, A.fumigatus
gaaactattatgttcgacgcggaagtctttttgtcaaaagaagacttttgcaagcaggctaggacaatgcagggctctcgtgactttggtgctcagttgttctgtgctcttctacgctctgcagctgtggaagcgaggctggtctgctcactccagcctttgccgttttctgggacgacgaagagcatgacgccaaacaagcgagattcacagtacattgttatatcatctgatgaccatgaaacgtcagcagatgatcgacagatgcctggcctctcgccgacaccggcgtcaaggtcccgaagacttggacgacctcaattcactccagcgcgttcacagaagacctcgattccaggtaacatgtccacctctattccgcttgcctactcactgacatctcaaaggccctggattcaccgctcgagcctcgccttacccggtgttttgggttga

SEQ ID NO: 8520 - DNA, 183 bp, A.fumigatus
caaaaagacttccgcgtcgaacataatagtttcctacagggatgtgagaagggtgactactgcgtggagctttgcacacataccgctttttgcttcaacttttccggatcatctacccaatgcgctcgcttcaagcctggtctagtcactctgaaccttctgctaaaagcatcactggcctga

SEQ ID NO: 8521 - DNA, 2082 bp, A.fumigatus
tggcttctgtatctcatttgtgaggatgaccctgaaattgtcgccctcgcgaccaagatcttggctcgtttgatagtcatccacggcgatgtctacagtaagaagttctccgagaaaactggaggctatattatcatgcgacatcgtctgagaagctggtggaaggtacccgccatatggtgtatctgtctcagcatcctccttggtctcgatgtcggcggtatgaagctggatcagccattcagccggacagggctgatagagatcctatcgtcaaattcccagccccgagttgcttttcctgaaatcctccccgtactcatggaaatgatgcaattgggcttacaaagtgtaatatcaggtgatgagttatcttctggtgtccatggcaagtctctgcaaaagtctgaagttcggctggaatctcctcccgcgtcattgactatacgggtgactgaactgacaaagcaaatatctctcttggacgccgttgttgggttgtttgctgatttacatcagaactctaccgacttcagggactttgctgcgcagtcagattacgtccagtggttgctatatgtgacatttccggttgtcgttggttcggacattccaagcacggactttgaactcaagtctcgtgctgctaaaaccaattctcatgatcatactttgcctgttcgaccgcgttcaagtggaacagcaggattgcgcacaacaacagttgaagggtctagcagtcgtgaaagacaagctggcccattgcgacgcggatcatctttcatcctcgtctcgtcagatagaaccaagttctcgccttcatttgcacgtatacacaaagctttcataccgttcgggtctccccctgacatgacagctacagaccatcctcttgtgcaagcaattctaagcctagttctatccgtgttctgcgatcaattgctggagcgaaaggattttgctggacttggtttatacctcaagacgccgacgagcactttggagcaacaatcttatttcaactcctggatattgcggagcctccttaccagactgcgagatgttacaatctctaaaccgcaagttcttctggaaccgcgagcgctttctaacatgggacgatttgctacccatattggagaagcagtatatgagggctggttcattgacggtgcaactcatgctctggaatttgcgggcgcaatcctggaatatctccagcagtcgaatgtttcaagtctgaagagtgtaaggctatgtagccaagcggtcacaaccatacgatccactctgttccgtgttgttctgcttaaattatcagaagtggatgacagagaggcctgtgagttcttgagtcgtttgagctactggcaagtggtcctgctttccgaaggtgaagtgcaatcagattatctgcggctattgtgctacctcctctacacaaaactgatcagccaagattggaacgttcgccttgctgcagcgggcttgtggagagtcattctcgtgcaaaagcccgctgagatgtctggtattttaagtcaggcggccattcccttgcagaaacggctttctgatggctttgaagcccttgtaggtatggaggacaaagcttttctacagtgggtcgatggtcatcaagatgatctcaatgcaatgtttctcgggttgctgtccaggtcatgggagactttcgtccaagaagagagctcaaatattgactctacaactcgtgcaagagcctccaagcgccaggagaaattacgacactggaatcaattagaaaggctcagtgaagaagtgacacgtaaacatgagacaacctttcctcattgggtctcgaacatatcggcgtctgagtttttgaaacatcaacgagcgctgcaggatcagcaggataactcagtgtttatgtggaccgcattctctcatatgaccatggatctaaagcggtttggaggagttcttgcagaagacaaggataggaaatggcgcctggaccagacagaaggacgaagccgtatgcgacttcgcatggttccagatgaggtgccgcccacaggaggcagaaaatccgcgata

SEQ ID NO: 8522 - DNA, 654 bp, A.fumigatus
tctcgcattgcgaacaatccgatgcctgatcttagacctttgccaacagtacaagggcgggcacccggggtgagtaaacgatgtcccgctaacgatgccggcaagcaggggaacctgacattcttcctcaccaggggcgccatgggaatgactgcgattggcattgcattgtggaagtattgcatgagatacgtcccaacgaaccccaacttcttcaaccgggatcgctttgtgctctccaacggccacacttgcctctttcagtacaccttcctacatctgacgggctacaaggccatgacgatggaccagttaaaatcgtaccactctgagcgggaagattccttgtgcccaggccacccggaaattgaaattgacggagttgaagtgaccacaggccccctgggccaaggtgtcgcaaacgcggtgggcctggccatggcaacgaagcatctcggtgctgtctacaacagaccgggattctcacttgtggacaatacgacatggtgcatggtcggtgacgcctgcctgcaggaaggcgttgcattggagtcaatccagctcgctggccactggagactcaacaatttggtcatcatctacgataacaaccaggtagcgttggctccgtattttccaatatggccgtactga

SEQ ID NO: 8523 - DNA, 699 bp, A.fumigatus
  unsure (683),(687): Identity of nucleotide sequences at the above locations are unknown.
aggatcactgctgccctcatgcgtgctcgctccagcaaagagaaaccgacctttatcaacgtacgtaccgtgattggcgtcgagagcaaattcgccggcgacgccaaggcgcacggtgccgccttcggcgaggacgaggtcgcgaacatcaagcggaaacttggattgaacccagatgagcatttcgctgtccctgacgaggtatatcagtttttcagtgacgctgggggaagaggccgagccctggaggagggctggaatcagctcctactcaattactcaacggagcacccggagatgtacgaggagttcaggttgagaatgctcggaaggatgacacaggactggacaaagctcatcccgtcaaaagaagaattccccgcgtctccaacagcctccagaaagtctgccggcctctgttgcaatcccctggcggcgaagctcgagaacatcatggtgggcactgccgatctgactccttcggtaaacatggcatggaagggcaaggtcgatttccagcatgtaagccacagccccgtccccaggaatattcatccctttactaatcaaaactgctttgtccagccggagctcaagaccacttgtggcctaaatggcaactacactgggcgatatatcgtcttcaccacggggctggaaggatccgacggtggcgtctattncccncgggggttccat

SEQ ID NO: 8524 - DNA, 723 bp, A.fumigatus
aaccatggcggttttcgctcttgtggcgatgagcattatggaacgcactattcgtcggcgatgattgtctgctcgtatctcattcgcctgcagcctttcgtaaagtcgtatctcctcctccagggtgggacattcgatcacgctgaccgtctcttctattccattggaaaagcgtgggaatcggcctcccgtggcaatatgtctgatgtcagagaattgacccccgagttcttctaccttccagaatttctcgtcaactccaacaaatacgacttcggtcttcttcagaacatgacaacagctatcgattcggtggaattgccgccgtgggctaagggcgacccgaagatcttcatcgcaaagcatcgcgaagcgctggaaagttcttatgtaactgaaaacctgcatcattggattgatctcgtttttggctgtaagcagaaaggagaggctgcaattgaggcggtcaacgtcttccatcatctttcgtaccaaggggcgaaagatattgataacatcgatgaccctgtggaacggctggccacaattggtatcatacacaactttggccagacaccgcaccaaattttcactcgacctcaccctccgagagaagatacacgacataaagttccacgactcgaccgcctagctgaatcgcttacacagcttcctctctccctgctaggtaagtcttctggcctgttgcggttatggccttga

SEQ ID NO: 8525 - DNA, 648 bp, A.fumigatus
caagcacagattctcggtcatttcgagcatttgcatatcgggcaattgtcctgtacaattttcgcagactctcgaacattggtcacctcgggcacagattgtgttgtatcgatatggacatataactcaactgctaaatcggtagacttgcaacccgcaggatcactttttggacatcgcaatcccgtcaatgttctcgccgtctcacgctcgttcagcgccctactttctgcctctacagatggccagattatgctctgggatcttaatcagcatacttttgtccgagagctcccagctagcggccccgttgacgtaagtgatgcccgcaaattgacaaaacgaccctgcagttttcgacaaaggttgacctcagcccagtgtgctcggataaatgatgtaacgggagagattatggtttgccgtggaaaccgcatcagtatctatacactgaacggagcgctgttgctcgaacaagacgtgtgtgaatcgattgacgatcgtgtcatgtcctgcgtgttctacgaaggcgtggataacgagtggcaagaacgcgagctcatcttcacaggtcatagaaagggggtggtcaatgtaagatgccctgacttctttttgaaaactgtcctttccctcccttcgggttga

SEQ ID NO: 8526 - DNA, 321 bp, A.fumigatus
ttacagctacgaactataactgcgccgtcacgcctcacaagggtccatccgagtccgacggctgtgataaaaacaaaccaaagccgctgcagttcccaaatactgattcttgacatccaccccactaacattccattccacggatttaagcttgcatgccaactcactcccgaagtcgggaccgctatgggcggtcgcgacagcgaccgggaagcacggtatgactacgactatgcgcgacggcgctacgctactgatgacgacgacgattatgacgatgacgaactcgagcacgacctcaccgagcgccgatacagacgg

SEQ ID NO: 8527 - DNA, 594 bp, A.fumigatus
  unsure (291): Identity of nucleotide sequences at the above locations are unknown.
cagcttcaaagtatgtgccaccccatcgacttcagtcacccgcatttgatactcacatctaccggcaggaatcctgaggattgtctcccacctaccacgtcttccgcccacgctcgccattattcacagccagacacgtcgaggaactcaccgacctcacgcactgagggttgcgccggtcacttgacccaaccggacaataccagtcatggtgaggcgcacgactcgccagacaatacggcaaacgcgcagcatccgtcggctcttcccccgcatcccccacccgccccntccccctcgttctctcggccccttcctccccctggccccaatcgtccacgaggagccactcgcaagacaagtaagggcggaggtgttcagatggtcttggaagaagggggtagttggagtgagctcgccgaccacagctctacccttccggccgagggctacgataatgcctcagtcaagggaaagtcctccaatagtggtatgctcgcttttttgagccgcaagaaggggcgtgacagaagcccgaaacctcaggaaccaggcgtcttgggcaaggaaggagcgaggcaaattatcagttga

SEQ ID NO: 8528 - DNA, 210 bp, A.fumigatus
atacttataccactgcatcttctcttttcaattgtttgtctttaccattgcttatcaatggatttccgaccggacttcccacagaccatccgtatcacccagtcaatctccgagaaccacgtgtggcgtgttatgcttaccatctatttcgagccgaaaacaaccaatgtagctctctaccatcaagctacctttgctctccccaattga

SEQ ID NO: 8529 - DNA, 183 bp, A.fumigatus
catttggtcggccctatctggagacctaagcaattctggacctccctcaaaacagtgcagcatctctcggagcctaagcggagtgcttaccttctcccatgcattacttgggcaatgtcacccagggaactgataaccttgggactgcaacgaacactgaaccagccattggtaggacattga

SEQ ID NO: 8530 - DNA, 363 bp, A.fumigatus
gtcaacccgagccaggttactaactctcttctccagctcaaggaaatctttgccgattaccaacctgtttccgccaagatcgccctgcgtcccattcctcgtttcatgatcaagaagctccaggctcgcaacgagcgtcgtaagggtcgtggctttggtttcgtcactctcggctctgaagaactccaggagaaggctgtcaaggagatgaatggcaaggagattgagggtcgtgagattgccgtcaaggtcgccatcgacagtcccggcaaggaggatgacgccgttcccacgggtgagcagactgaggctgccgctcctgctgctaaggagcaggagaacactcccccagctgctgcttaa

SEQ ID NO: 8531 - DNA, 744 bp, A.fumigatus
  unsure (239): Identity of nucleotide sequences at the above locations are unknown.
tttctgtacagcgaaagcacctccattcctgtgaatccccgcactaaccgccctgtcggctatgcgtttgtggatctcgccactgctcacgaggccactgctgcgatcgaggaactctccggaaaggagattcttcagcgcaaggtctctgttcagctggcccgcaagccagagcctgccgaggctaaggcggagggtgctgcaagtggcggtgaaggcgccagtggcactgaaggtcncaagcggacaggtggccgtgcccgtggtcgcggtcgcggccgtggccgtggaggtcgcttcggtcgtggaggtcgcgtaagtttcccttgcacttttgaactggtgtccaccgttttgctgacaatatggacccaagacccaacgggacggcttccggttactaatgaggctccccaccaaagtttcccggtcagggttgaacctcagacagaggtcgccaacgagggtacaaatgccggtgctgccgagtcctctaagcagggtggcaagcatggtgttctttgtcctcagaagcagcgcggcccccccgaggatggcattccttccaagaccaaggtcatggtagctaacctgccctatgatttgaccgaggacaaggtacgtatctcccttgagtcaacccgagccaggttactaactctcttctccagctcaaggaaatctttgccgattaccaacctgtttccgccaagatcgccctgcgtcccattcctcgtttcatga

SEQ ID NO: 8532 - DNA, 204 bp, A.fumigatus
aatgatatccacagctttccccagacctctttcactcgagaaaagacaacttttgccgaaaagagcatcttcacgatggttacctatgaatataattatccatgcgcattggccatcacccctgcaccatcactgaccccgactgacttgcatcagccgagaaatgagaaatttgttctggattggaacaatcttgacatttaa

SEQ ID NO: 8533 - DNA, 186 bp, A.fumigatus
ggagagatgaacagaatcttacatagcggaattactagcaatctacatataattatttcagtcttgccccagtggattactatgcctaatattcttggcagtgagattgatcactctttccccgccagccccgcctttgataagcgccgtcagacagaccaccctttcaccctcttcttcatatga

SEQ ID NO: 8534 - DNA, 1515 bp, A.fumigatus
tataatgtggtggacagaggaagtcaccgaagaggtgccaccaacggaaagagtccaaaccagcaaattggggcggctttcaggacctgtggcgaaaccacaagaaaccttaggagtctaggaatagggccaaagtcctggtctggacggaggctcctccggtccacacttctgtcaagagattcgcccaagcagggaaaatcagacagcgacgcaagcaaccccctgaggctggtacacgtccagacacgggatgtactgaaaacagagggaatcgagacaaaacgctacgcggtcatttcgtacacctggagccagttcagtaaagaggagttgctggaatgggcaacgtcacgagcgatgcagctggggtacgagtacatatggatcgaccaatattgcattgatcagaagaacaagcaggagaagaacaaggagatcaagcgcatgagagattactacaagaacgcggcacaggttctggtgcttgtccctgacgtgacgagcttggcaagatttgatgtggcatcaaccgaccagttgatacatgtggatgcagccatcaacgcgtctagggatgtattgaagcagttcgtatcttgcgagtggctgaagagagtctggacctttcaagaagcatgggtggctagacaatgcgtgctgtgtaccaaagagcagatgcttgacggcacggtgatggatgccttacttggcttgctcaagtacgaagctgtcaacagacccagagtgatgtgcatcaccagcaagtcaatagcaaacccggtggttgcaaaccctaacacagtcgtctgggagggagtactcagcaaccgtcagactgtggtaggatcgatagaccggtggatattacaaagtggacgacgcgtatacgaaccgccgcggctcacgcttgtccaggcctgggaagcctcacagggaagaaacacagtgaatgaagaagacagagtatacgctctgctgtcttctatcgagggcggagaccgagtaacagtcgagcgcggacggtctctgctggctgtcatccaggactgtgtggaagcgggtattgtcactgctgatctgctagccggcaatgatccctcgacggtggcagataggtgctggatgccggatctaacaggatcaggaccgcagcatcctttgcgggtggcaagtgcgagtgagaaacagcagcaactggtttggcgagggggcaaggtgtctgtgaaggggaagatttttggctttgctgacgtgtccgtttggctacgcatcgcactcgtgaagactcaggatccgatccaacagtctgaagggagcgaccgaccttggattcaattcgctctctccacgcggcagaaaacttggacaccgaaagacctgatcaagtctgatttccttttagtgcagccaatgcctgggtgcacacagaccgtcctggtttctggtaaaaagctagcggacgggtcgtttcacaggtcttcaccacggggctggaaggatcacgggggtcaa

SEQ ID NO: 8535 - DNA, 387 bp, A.fumigatus
tcggtatggatgacccgaatccaccgtcgatgcggacggaggctaatgacaacaggcgactattatacggggggatcgctgaaccccgcgcgctcgcttggcccggacgtgatcaaccggagcttccctggttatcactggatttattgggttggaccgctgctcgggtctctgctggcctgcggattctacaccttcctccggatgttcaaatacgagtccgtcaacccggggcaggactatgacgagtgggaggctaagcgaaatcatggatcgttcgatggcaatggccgagagtcaaccgccttttcggattcgaccgctggcgcacagagtcagtcgcctcgaggtgtaaatcgaccggtcagcggagcggaacaggtttaa

SEQ ID NO: 8536 - DNA, 942 bp, A.fumigatus
acatcagtcttcgtcttctctgtatcaagcaaagatacaatggcgttcggtaaacgtaatggagaggagcggcgtgtcctccatcgcacccagagtcagcttcccatgctgggtctggcggacagtgctcgaaataacctgattgccgtggtgggagagtttgtcggcacatttctcttcctgtttttctcatttgcaggaacccaggtctccaacacacccaagccggtggccggggcccctcccaacacgtccaaccttttgtattctgccctatcgttcggtttctccttgacagtcaacatctgggccttttatcgggtgacgggaggtctcttcaatcctgtagtaagtccaacccatgaattacaacacaacggatcagctctctcagaacaggtctccttggcgctctgcctggtcggaggcatgccgccccttcgaggcgtcctcgtcttcatggcacagcttgtaggcggcatcgccgccgccggcgtcgtcagcgctctgttcccgggtgacctcaacgtcggaactcggctgggtggaggggcctccatctctcagggtctatttatcgagatgttcctcacagcgcaactggtgttcgtcatcatcatgctggccgttgtgaagcacaaatccactttccttgcgccggtcgggatcgggctcactttcttcgtcacagaaatgatcggtatggatgacccgaatccaccgtcgatgcggacggaggctaatgacaacaggcgactattatacggggggatcgctgaaccccgcgcgctcgcttggcccggacgtgatcaaccggagcttccctggttatcactggatttattgggttggaccgctgctcgggtctctgctggcctgcggattctacaccttcctccggatgttcaaatacgagtccgtcaacccggggcaggactatga

SEQ ID NO: 8537 - DNA, 921 bp, A.fumigatus
ggactgtgtcggaacaagccgctggggcttcacctgttctcgtcgagtcacgatcggccgtctggggagcgcaggtattcagacagtgcgttggaggttgaagataatgcgaaatcaggcagagaagacctcattgatctgcgagaatcgcaagaccaatcgcaccatgacgctcatcccgagaactccgtagcggtacagcggacagacgagacgccagactttgatactactatccacacgccggaggtcttccttttcgattatgggacagttgttatatggggcatgtcacctgcacaagaatcacgattcctatctgacgtttctaaatttgcaaactcgattttgagccccgaagatacgcaggttgagaatttcaacttttactatgctcgcgagtaccaggcacggatatacaatgactttatctctctccgtgatcctcgaaaccatatgattaaacttgccatctcacatgcattgtctcaatcagtcaaaacatctctcttcgaagatctcgtctcggagaccatctcgaataccgctccactaccggctcaaattgcccaaaccggcagtgtcaacatgacgcgaagacaaatcaacatgcagattggagaactgttcatcctacgaataaacatccacttacaaggctctgtcctcgacagtccggaactgatgtgggcggagccgcagctggagccggtctaccaggctgtccgaagctatttggagatggaccaacgagtcagtctcctcacagagcggctggatgtcattgcggaccttctggcagtgctgaaggatcagttgactcaccgccacggtgagtatctcgaatggatcggtaagtcccttacttccagccgtcgtgtcaacccctgtttagctcaccaattacagtcatcatcttga

SEQ ID NO: 8538 - DNA, 339 bp, A.fumigatus
ggggctttttctgttttctttttctttcttttctttctcttttttttgttcttcgcccattctagattaatttccctttctttctgtttcatttcacaggcagctattcccatatggaaggagggcctattctacattgatttctcacaaaacgggatgttggcgctcgttgtaacgcttatgatcagtgcctggatgcctttttcctgtttacttgaaaaccagtcaaggaggtgcctggagttcgcagctagacagcagatggaagatagtctggccacacagtgcgccccgctctcgaactactcccaagcctcgtgcatattgggtagcaaataa

SEQ ID NO: 8539 - DNA, 201 bp, A.fumigatus
gaacgatgcttcatcatggacgtcccagacgacatgctcaatattaacagcctgtctaatggtacatacaaagatggttgcctcgatataagcaagaaagatgcaagggtcccgaacgaagatgaccaactccagacccagtcctcaactccctacgcaaatacttccggcgctaaatatgggccgcaactgatgcagtga

SEQ ID NO: 8540 - DNA, 315 bp, A.fumigatus
aacctttgccaaaggacggaagaacaatcgataaatgataacccagacagcccgcaccacggtcacagcgacaagaatgcctacaatctaccatgtgataaacatattgacgcttggggtcctacttcaacaacttcagaaaggaaatcaacagggtggttgaagaatggaaaagcgaccaagaagtcgggcgattaccaaggatatgtagcgaactttcattctgaaaagcatctcgatcatccagaaggcgccaagataccagcaggacgccaaccacgtttcctaaataatgctactgacaatgttcagtga

SEQ ID NO: 8541 - DNA, 891 bp, A.fumigatus
catctcgcagcctctgccgaccgtcgaccggttgatcctccgcctgtggttgaattgcgaatcttcgagtctgatcccaatgatgatctgcacaagaccgacataaccttcgcctacaacgccaacttcttcctattcgctacgctggagaccgctcgtcccatggctcaaggacgactcaccggacctccaacatgcccggtcctgacaggagttccggtcgcaggtgtagcgtacctcgaccgtccacagcaagctggttatttcatctttcctgacctgtccgttcgtcacgagggtagatatcggttgagcttccacttgtacgaagagatcaaggacatcaaggatgcggacaaggacacgccaatgcctgaccttaactcgagtaccaacttgaccaagccatcggcaccaaaggcgcatctgaacttccgtctcgaagtcaagtcggtcccgttcaccgtctacagtgccaagaagttccctggactggccacaagcacatcgctcagccgcatcattgcagagcaaggctgccgagttcgtattcgacgggacgtgcgcatgagacgccgcggtgagaagcgcaccgacgattacgactttgatgatgagagggcctttgctactcggtcggacagatacaccacgcctgacatgtacgcggcgaattcggccgagcgtgctcgttccaccagcatcagcaccaccgctgatacctccttcccctatggctctgatgcacagagacggccgtctgcgggcgactacggattccaaggcgcgcagccataccaacgatccatgccagcagcctccgcggcacccgctccagctcccgtccacagcccagcaacttcggcgcagacatcttcatatcaggtcttc

SEQ ID NO: 8542 - DNA, 963 bp, A.fumigatus
tttgtcgtgtgccttagacagttaaacttaacttccccggggagtacgtgcgtcgccctgatgccgctgacgcagcccctgcggtgcagggccggtcgtccatcaccaccaccaccatcaacttttgtccgccgccccgtattcagtggacggtctgggatcatttccactcctggtgcgcgtctcttacccctgaagcgagtcttttgcacatcaacgatccttcagcgccataagagtcccctctcctccaatgctcgcgtccgctcccttccacgtcgttcattaacaccattcgcaaagacaatatctaccccgaacctcataaccacttcattcatggctactcaaaccagagaacacggtggccatgggggtcattctcaccatcaccatcatcatcacggaaatgtttacctcacctctgcgaacaaaagcgacgctggagtccgaatcacgcggattggcctggttgccaatctcgctatggcaattgggaaattcattggcggctatgtcttccattcgcaagctctgattgccgatgcctatcatgcccttaccgatcttgtatccgactttcttacactaggaaccgtcgcgtggtctttgaagccccctacagagaggtttcccaacggttacgggaaaattgaaagcattggtgcactgggcgtgagtggactcctgctttgtgggggcgtgtttatgggcctgaattcaggacaagttctcctggatcagttctttcccgaggctgcagaggcgatcgctcactccggagttttgggtcatggccactcgcatgctcacggggtccaggcccttgggccgaatatcaatgcggcatggcttgcagggggttcgattattgtgaaagagtggctctaccgtgccagtgagtacccacgtcccgaattccaaattccaatttctgcctccgttactgtggttatcagctaa

SEQ ID NO: 8543 - DNA, 189 bp, A.fumigatus
atctcatttttcccgctgtgtatatctctacagaataacatgaactatacaaaattatccatcaattattttggagataccccctcccagacatgggtacagccaagaagaacacagtgtcctgagctaccgcaaccttcgaatcgaaccccagctaatttgctgcctctaatttgtcgtgtgccttag

SEQ ID NO: 8544 - DNA, 219 bp, A.fumigatus
acagttaaacttaacttccccggggagtacgtgcgtcgccctgatgccgctgacgcagcccctgcggtgcagggccggtcgtccatcaccaccaccaccatcaacttttgtccgccgccccgtattcagtggacggtctgggatcatttccactcctggtgcgcgtctcttacccctgaagcgagtcttttgcacatcaacgatccttcagcgccataa

SEQ ID NO: 8545 - DNA, 303 bp, A.fumigatus
gtacccacgtcccgaattccaaattccaatttctgcctccgttactgtggttatcagctaaccgctgcggggttgctatttctagcgatgaaaattgcaaatgaacgcaaatcttctgtgctcgcgtccaatgccgtacatcaccgcatcgactctctcactagcatcgtcgccctgttcacgatcggcggttcttacatgttccaagacgcgtcttggcttgatcccgtcggggccttctcatgtcttcaccacggggcggcaaggatccgcgccaagcgtatagaggaatgggaggggcgc

SEQ ID NO: 8546 - DNA, 486 bp, A.fumigatus
aacccatgcagatactattccgtgacaatctataaccagatcggcattgcgggcgacgaaacgctcaagtaccaggctatcaattcaatcattgctttggtcgccgagtgcctgtgcatggcgttcattgatcgtttcggccgccgctggactctcatcggtggcaacctgggcaacatggtaaccttcatcatcgcctgtatcctgctggcgcgattccctcctgaggccaacaacaccggtgctcactggggcttcatcattatgacctggttgtacaacttctccttctcgtgcacctgcggccccctttcgtggattatacctgccgaagtcttcgacacgcgcacacgctcgaagggggttttccattgccacaatgacatcgtttgcgttcaacaccatgatcggtcaagtgacgcccatcgcaatgacaaatgtgcgctaccgctactactatctcttcatcatctgcaatttcactaa

SEQ ID NO: 8547 - DNA, 243 bp, A.fumigatus
ttgctcccatgctggccagacagatctaccgatgcttccccactctttaagaggggcaactccgcccgtcgtagctcgtatagcgtcatagcctactgcttggacctgcccaactatgcgattcctcgcggctcggagctcaagacagattataaatctttcttttgccccttaccttccatgttctctcccaaggccctcgtccctcgccgcagctgcattccaatccagaacatcagctag

SEQ ID NO: 8548 - DNA, 408 bp, A.fumigatus
cctggttgtacaacttctccttctcgtgcacctgcggccccctttcgtggattatacctgccgaagtcttcgacacgcgcacacgctcgaagggggttttccattgccacaatgacatcgtttgcgttcaacaccatgatcggtcaagtgacgcccatcgcaatgacaaatgtgcgctaccgctactactatctcttcatcatctgcaatttcactaatgccctggttttctggctgcttctttccgagaccaagaaattgcttcttgaggagatgaactacctgttctccaacgctccctggatcgtgcctgtaactcgcacagaggattataccccgcacgacttggagcgcaaggtcgaggcacagcaagagatacaggctgtttttgcgacgcatcacgagtga

SEQ ID NO: 8549 - DNA, 303 bp, A.fumigatus
gttgaacatgcctcagtccatcttgtcatcgaagttctgcgcggactgaccaatcgtagtgccctcgcctacgttaacgaagctgaagtaggccagggcatcagggactcgggtattccccgcgaagagatctggatcaccaccaagcttgataacacatggcatcaccgtgttcaggagggaattgactcgtctctcaagagccttggtgtcgaatacgtcgatctttatcttatgcactggccttgctcgacagatcccaatgacaagtcgaagcatcttcctgactgggacttcatcaag

SEQ ID NO: 8550 - DNA, 726 bp, A.fumigatus
agcgtcgtaggtgaacctcgcagccagtgtgagaaagagcaaggcgcgaagaccagcgaagagaactctcacgatggcctgtttcaccaagtctatgagtggcttcagcaagaaaaagtaaaacaaaaaagccgccggtcgaagttgagagggacaggcgagggtgtcgaaagtgatggcgatgacgattactacgatggcattgtggataagaccgcctctcacgactccgaaagtacatttgctctcgacaagctcgaaaaaatcctcgttcggtacgccgcttcccgcattgagggctcctcatcggcctatccactacgaggaccgacccgcaagcgttcccgcatcaagggtctgcgcagaggctctgcatctgagtccgaccagtatgatcttgacacggcagttcccgctgttgatgcagtactggacaattccaagacgctcgcatacacaggcgggaccgccgaagaagacgatcggcgattgaaggataaggaagcttggctgacgttcaagagcgagattgttcgccttgccattacgcttcaaatcaaaggttggcgaaagtttcctcaggagctggctggcgagattgaggtaatcagattgagtggcgccttgaccaacgctgtgtatgtggtcaatccaccaaaatccctccctccacctaaaggcgaagatgggtcttattctcttgttccccgaaaagccccgccgtaa

SEQ ID NO: 8551 - DNA, 516 bp, A.fumigatus
gctgcaatttttcgtcgcttaagccggaaagacatagggcccaaggtactggggacgttcaactacggccggttcgaggagtttttggaagcgcgtccacttacgcccaaggacttgcgtgttccggagaccatgaaacagattgcgaaacgtatgcgcgagctgcacgaagggatcgaactgcttgaagaggagagagaaggcggcccgatggtcttcaaaaactgggacaagtgggttgatcgctgcgagcaagtcatcaactggctggacatggaaattcagtctgaccacaacgaggccaaggcagcttcggaaccctggcgccgtcgcggatttgtttgtggtgtcccatggcctatcttcagaaaggccgtcgaaaattatcggaaatggcttgtatccagctgcggagggatcaaggagatcaagcggcagttggtttttgcgcacaacgatgtaagccattcctttcggcaaattcattgtcttttgattgtccatccactaacctag

SEQ ID NO: 8552 - DNA, 375 bp, A.fumigatus
gctccacttcctgaagaaaccagacgagactatggcgcgtgttcaactctgctcagtggggtgccctggggaattgtacaggcaaaggtacccggtatggaggaggggattgcggcagccgcagcggcgaaagcgtctaatggaaacggtcacagcagtgaatcaaacgggtcagcagtggcagctgctgagcaaccagcgcagcctgcagtcgacgcggacgtggacgagggggacgagtttgactatcttgcctacgcgcaggatcgggcgatgttcttctgggcggatctacttgcgctgaatttggtcagggaggatgagctcccacctcagatggtggagcatgtcaaatctcgcatgatcgactattag

SEQ ID NO: 8553 - DNA, 1002 bp, A.fumigatus
aggctgtctaagaagaagcaaagctcatatgtttatatgtttcaagcccaatgcagacaagtgtttgagtttacagagatcgacgacatctaccccgcattgttaaacctccgacgcccaaccttacctttcaacgccaaagtcacccatgaccacctaaggccccttcagaagctcgcgcaagatctaaaggcaggtgcgcaagcactcgaaaatgcatataaactaggaactgggtacgacgatctggctgtggtcctcctggagccaagcgacaaggcggacactcactgctttgacgatatgctcaacgcctcaatggctttaaaggcggttgattcatctatacgccatgcatttaatgggcaccgtagtattcagaacacaattatcctagatatacgggcatttcgaagcgattcaattcgtcgaacgcagggcgcctcagacaagcttgaagctgacgagcttgcctataccgccttcgaacagatactctgcaacctaaaaccagacgttatccttgtctgtcagtgccaaactaatacgaatgaagtgggaagccggtttgctcggcaggcttgttcatcaatcgacgaggctacggatataaccgtgcttcgccttcccaggactcaacatgaatcggtgatggtgaagagttttcacccaatgtatcttgagtacatgcgtgaggcgccaaacgacagcgcgacaaaggcagtgttgcgagaatatttgtttgacgctggatttataatcgcatcgaatgcccttgctggacgaagcataacgggctttggtttgcataaccttaaagcttgtgcgagagatggcccggcatttattgccacgccccagggtgtccgcatctcatacctgtggactagcggatcagacattgcaagtactgaactggttgaggcgcttaaaacgttgggaatatcctctaaggtagggtggtgtgtgagtcactgtagagtcaggctaatggattcatag

SEQ ID NO: 8554 - DNA, 1125 bp, A.fumigatus
ttgcaagaagaagcatctagggtgcgatcctgcccgaccttgtcgcaggtgcgtcttgtcgggaaaggaggtaagccaatctatcttagtccacctgagttgcagttcgttgctaaggtgaatgctggtgcaaaaaaggctacctgtgtggatgttacgcataagaaaagaggaagaccgccactgaaggctgaggatgcgtctctcaggacgtacacaacacaggcagaaaatgcggtgacatctggagagcagcagcctcctctagccagacgcactcatacacataagtccaccggctctcgcgaaattcgacctgtgacagacctccagatacctggtacaccacacgggacagtcgggtttagggctgcgccaggtcaccctcacaggtggtcgacttctgtatttccccaggcggtggatccttcaatatcgatgcagtcaaaccttgggcataggcgattttcttcttctggttccataccacagatgacagccgcgacacagtcgggaatcatgcctctcacaagtggtttcagtcctgtgctcaatctcggtggctcgcaaatgggcgcacgacgggctttttcttcatatactcaccagggattacctcctaccacatctcccccgcagtatcagcaaccattcggtgtgcctatgccgccatacaccgtgagtccgagaatggtgagccggttgccgccgggcgacactcgcgaagcatacccggaatctccagtccgattgccccccattttccctccagcgatgccgcactcccgtcccgcaccacaggcacatcggttgagcgatccttacccagcggtgtggtcccctcggctccgtgaggagctgatgcagccacagccacagcagcagactaggggttcgtcgccgcacagtttgatggagccaacttcttctgccgcgcaaacgcgtcacgcagcactcgaacacggccacggagaagtagctccgcatcaatcaaattcaattatacaaggagcacaaactctttcagtgcagtcgtctccaactcgtcctcgggacgaacaaccagctgggggaaccgatacagacgacccatgcccgcgaagatgccagagatggcttggatga

SEQ ID NO: 8555 - DNA, 753 bp, A.fumigatus
acccttccagccgtagttcctctacagcaacagggaccctcaacctaccaaatgcaatcactcgtccttcccccttcagccctcaccagcacacaatttggacatccaaggttcagttcagcctccgaacggcttgctcttaagtacacgctaccgacaaatgctcgtctgtgcaattcccgggatcttccacccgtccaccctatgtccagctcggtcccggcagaagacccgctggagactactcgacacgtcaaaccgccccctcatacaacaggactgccgacagttacggctgtgccagtgaccgcccccgcggtgacaccggcgtctgtctcagagacggctctggcgtcgggatcttcaggccccgcggcaggccatacttcagcattccaacaatatgtggcccggaccgctggagaagagatgcgaccaccgttcatcttcaatgaaactgtccctggttcccaagcaccattggggaccactgaacaacgaggagcacaagagtcctcgacggcgtttccatcctcgagtcgtggaacctcgccaactggcacaaccactagagcgctgctgccaaaagggacgagacgcactaaagctcacgtcgcatccgcgtgtgttaattgcaagaagaagcatctagggtgcgatcctgcccgaccttgtcgcaggtgcgtcttgtcgggaaaggaggtaagccaatctatcttagtccacctgagttgcagttcgttgctaaggtga

SEQ ID NO: 8556 - DNA, 204 bp, A.fumigatus
ttgatagacttactgatgtcgaagggaaacatctccctatgtccctcagtgtataatatccccactgttactcgtcttcagctttttcttttgatcattgcagccctctttctatcatttcaatcaacattagctgcacggccatctctttttctagactttgttcccgagcataccttccctgtgatttgctttgattcatga

SEQ ID NO: 8557 - DNA, 588 bp, A.fumigatus
  unsure (399),(504): Identity of nucleotide sequences at the above locations are unknown.
atctatcgcgccctctgtcccagtgcacctctccctcgcgcgcgcgttgccgcagtccgcaccctctacgaccctacacaagagccgtccgccaacacagtcctcgatgcgggcgctcttgtactgtattttcctggacccaaaaccgtcacaggcgaggacgtcctcgaactgcatcttcacggtgggccggctatcgtaaagtcggtgctggcggctattgcccgcagcaatcggccggagagtacggtccgctatgcggaaccgggcgaattcacacgcagggcgttcatgaacaatcggctcgatctgccgcaaatcgaagcattgggcgatacgctcaccgctgatacggaacagcagcggcgccttgctgttcggggtgccagtgacactctntcgagacactacgaatcgtggcgccagcagttactatatgcgcggggggagcttgaggcgttgatagattctcccaagatcagtatttcgcagaagtcccccgangaaatttgtccccccccgtaccacgaacaggtcctgcgcctgcaaactccgctggagaatgcctctttgaaaaatgcgtcctaa

SEQ ID NO: 8558 - DNA, 597 bp, A.fumigatus
tcactactctcacaatggaacaacatgcctagtcgtgccagctacagcttcgttccactacaaggtggaggccaagaacggcccatggacatccacaaccacgaagatcaacgcgagattctgctagcggcgcagctgtcgcggattgtctgccgcatgctggaggtcgaagggttccggaagctggaacgggacttttacaacatcaaatggaaacaaatctctcaagagacacacctgcgtttcctgaatcaactcggacatatccttctgtctctccggtggcgagtgtcctggtggaagcgcctcggagacggcggccgcgaacccgacccttcgaagcagcattatgaggaccgagtcgagctgctttgccgaattctctatgtctactacacctgtgtgcaggctaagcttccttcgtggtcgaccgccgatgtgcccaagggcgtctggtccacttacgctgattcggaaaatgcggtgtgggacgacttccccttggatccgagcgaagatggattcaagcgctggatggaacggggccgcgaactcattgagcaagccggtgttccgaaccgcgtctcgaagatttag

SEQ ID NO: 8559 - DNA, 420 bp, A.fumigatus
gtacgcttgcctcccctggacgcatttgtaaatccagctgctaacatattggtatcagaaaaagatgtgcatcgtacggatcgcacgatacctctctttgcaggagaagatatccctcatcccgatccagactccccctttgcggacgtagggacgaacgtacatctagagcagatgaaggacatgcttctcacctacaacgaatacaatcctgatttgggctatgttcaaggaatgagtgacctcttagcaccaatttacgcagtcatgcaggacgatgcagtggcattctgggcttttgttggattcatggacagaatggtatatcccacacatatccgtcccaaatcaacactgcttacacagaccaggaacggaatttccttcgcgatcagtctggcatgcgcgcccagctcctaa

SEQ ID NO: 8560 - DNA, 780 bp, A.fumigatus
ataagccaagggcacgatgcaactgcttgcccacttcaacccggtgccagtgcaggacgagacgccggaatgattcccttaatgaaagcactcagggaaactagatggaaggtccttgagcagctcagcaagattaccacgttcacacggcggacggcgaacgaacttccgataaacaccatgatccctccacaagtccgtcgcctaatgaagtctcctgagattcagaccttgcaggatgagttcgatagcgccaggctctacttggctcgatgggccatgagtattgctgagcagagtgaacgagaaagggctcagcgcatatggactgcacgggatgtcctggaaatggaaaatagctctgtgggtgattttgagattttggagcttgaaactggaacaatggcgatacaggaacgacgcagaactgtcactttgcaggaatgggaggacttctttgatgccaccacgggaaggctcaacgttactgtagatgaagtgaaggagagaattttccacgggggccttgatccaaatgatggggtcagaaaggacgcatggcttttccttctcggagtgtacccttgggacagcagccgcgacgagcgtcaagctctgatgaactctaaacgtgatgaatacatccggctaaagggtgcttggtgggagagaatgattgagggttcttccactaccgagcagtatgagtggtggaaagagcagaaaaaccgcataggtacgcttgcctcccctggacgcatttgtaaatccagctgctaa

SEQ ID NO: 8561 - DNA, 846 bp, A.fumigatus
cctcttagcaccaatttacgcagtcatgcaggacgatgcagtggcattctgggcttttgttggattcatggacagaatggtatatcccacacatatccgtcccaaatcaacactgcttacacagaccaggaacggaatttccttcgcgatcagtctggcatgcgcgcccagctcctaaccctagatcacctggtacaacttatggacccccagttgtacctccatctccaatccgccgacagcacgaacttcttcttctttttccgaatgctccttgtctggtacaagcgcgagttcgaatgggtagacatcctacgtctctgggagacattgtggaccgactatttctccagcagcttccacttctttgttgcgttagcaatcctagaaaaacatcgtgacgtaatcatggaccacctgaaacattttgatgaagttcttaaatatggtaagcacgtcacctctaccctaacgcatgtgaccagcctaatattcaacctaatagttaacgagctctcaaacaccatggagcttgttcccattcttacccgcgcagaatcccttttccgacgcttcgaacgcacagttgaagcaatagacaagaagaataacttccccgctccatcaacccatcaacgaaaacccacgcaggaatctgctctgaacaagggcaagtcgccgcaacggccacaaagcgtcggatacagcagtggtgtcagtgccggtccggcgagtagtagtgctgccggagataatgccgagtccaaggttatctcgcccgaattgaggcagcttctgagcaaggaaattctgtggaaacagccgcatccaaccagttcaaagtga

SEQ ID NO: 8562 - DNA, 1878 bp, A.fumigatus
cttaagagcctgccatcttttcagagcaggggagttgccgaacttccatcacaacaaaccactcgatcgacgagaagcgcgagcctcagacagcccagtgatgaacctacatcacaacctgctactagatctactaggagtgcgagcagacagctcagtgctgagcctgcaacagagtctaatactcgatccaccagaaaggcacgcaccagacagtccagcgccgaaccttctacacagaccacgtcccgctcccgtagtcgacgtgccggcaatggcgtaatggcgtccatagaggaagctccgacaactcagactcgaacccggaagacctcgactcgtcggtcgacgcgacagtctactcaaaaaacgtctgatgacgaaacagacccgaccgatgccgaacaagcgtcccagcctggatccgttgtcgatgaaacgagcgccgcacaggaatccctggaactccaagactccgagcccatcccttcgattggtgaacatgctttgtctgagcctaaagcatcggacagtgagttgtcctccattcctttccctgaagcagttgttcctgagccctaccccgagccttaccctgagccttggccctcctcaccatctctctccccctcaccccctctccctcatgtttcactgccatcctcgcctttactcccggacacggaattcccacataggagccgagctgcggcaccctctccggaggccccatatccacagggagcggaatcgccgaagaccttcgtcaaagatgtctccggtgctcctgcagatacctggtatctggatccgctcgaggacatgagcgacattgggtcgcccctttcggaacggtctcacacaccggacctcgagatggaggattctccccctctcaggtccgtgcttaacgagtcacttctggcagacattgatgcctgcctcgcccgccacatgcaagtggagttggcggcagcgcataatactgccagagatgacttggacagcatcatggccgacgaatgtggatccgatgcagatgtcctcttgttgtcctctgaggagtacaacacccagccacctgccgtgacggaggcctcaactgggtcaacgatcgctgcgcggttgttcctcgtggccatggaagggatagagttcgaggaagagcgatactgccgttcgccgatgtcggtctgcggtcagtcctcttcggaactcgatgactcccccatggtcgacgaggaacacaccgccccaatcgacgtgtcgtggatctcctcaggtgaatcttctcgcgaaggttccctgtctcctctgcctcctgtcgatcgcgacgaggaggtcccgattccgtcgattgttgcggctgtgtcgtcgccaattgacaatgaggttgctgccctgacccggagtttctctggattgtgcttggcggatacagcctacggcggcacgccggcagcatccgcaactctgttgctgagctatatgctggcatcaacaggtcaagtccagcaggacgcgaccttcgatgtcccgactgagtcgggtacgacgtccaccttcagtgatgggcggttggtgtcggtgaaggtgtccgagctgatcccgggcccttcacgatcccgtccggcggccgcggaagttgacaagtcacgtcaagttagccgttccgcgaggaagaactccgcgcgatgggcgcgtgtggctctctctccgattccagaggagtcggaggtgatgagctcccgctcaggcttgggtgttggtgccaaagagagtgtcgacccaccatcgttgtctctctcggctacttctcacctgttggagttgttgggttgtcggagagtcgaggcaggggcctcaggaactcgcctt

SEQ ID NO: 8563 - DNA, 597 bp, A.fumigatus
ctcggcaatctatattcccaaccccgacaatgcatcggatgcgtaagtccttattatcttatcctccttgtgagatggtcaagttcaagttctcacgaaagtgtgaactccaggtacgagccttatgctcgcggggcaaaggatgacgttttcatcaagaaccctgatggcaccctctacatcggtgcagtgtggccgggctttactgtcttccccgattggcacaaccccaaggcatttgactactgggccaacgaactcgtcatctggtcaaagaaggttgcgttcgatggcatctggattgatatgagcgaagtatcctctttctgcgtgggcagctgtggaacaggaaagctacatctgaatccggttcacccaccattccagcttctcggtgaacctggcaatgtcggctacgactaccccgaggccttcaacgtgacgaactctaccgaaacgggctctgcctccgccgcctctggcaatcaggcttcggctgcttctgctacccaagccgccacgacgttcacatctacatcgtatctgccggacaaccccacccgggcgttcgcgacgtcaactaccctccagatgtga

SEQ ID NO: 8564 - DNA, 1194 bp, A.fumigatus
ttaatcatgttcaggagggccatgaccttgccgtgcacgccatttctcccaactccacccatgtggaacggcgtccaggaatacgatgttcacagtctgtggggccaccaaatcctcaatgctacctactacggactgcgccaggtcttcactgagaagcgacctttcatcattggccggtctacctttgctggctcgggcaagtgggccggtcactggggcggtgataacaactccaaatgggggtccatgttcctgtccatctcgcagggtctgtcgttctcgctattcggtattcccatgttcggcgtggatacatgcggtttcaacggcaacactgacgaggagctttgcagccggtggatgcagctgtcggccttcttccccttctaccgcaaccacaatgtccttgcggctatcccccaggaaccctaccgctgggcctctgtcgcccaagcctccaaggccgctatgaagatccgctattccctcctaccttacttctacactcttttccaccaggcccacaccaccggctctaccgtcatgcgcgctctcgcctgggagttccccacggacccgtccctcgccgccgtcgacactcagttcatggtcggcccttccatcatggtcgtccccgtgcttgagcccctcgccgataccgtcaagggcgtgttcccaggcgtcggcaaaggcgaagtctggtacgactggtacacccagaccgccgtggacgccaaacccggcgtcaacgccaccattcccgcaccgctgggccacattcccatctatgtccgtggaggcagcatcctgcccatgcaggagcccgccctcacgaccagagacgcccgtaacactccctggtctctactcgtcgctctgagtggcaaccagactgccttgggctcgctgtatcttgacgacggaagcagcctcaacccgtcccgcactctcgatgtcgacttccaggctacagcctcgagcatcaaggtctcggtcaagggtacctgggaggagaagaaccgcctggataaggtgactgtcctcggcgtgactgagaagccttctgctgtgacgttcaacggccgcaacgtccaccctggctcagtgcactacaatactaccaccaaggtgctgtctgtgcagggattgcacagcagtcttcaccacggggctggaaggagccgcgccatt

SEQ ID NO: 8565 - DNA, 258 bp, A.fumigatus
gattcctctggaatacatctggtcagtcggatttctgagtttctacatattgtcctagtttcttttatttaccttcctgccaggagcgacatcgattacatgcttggctaccgggactttgagaatgatcccgaacggttctcctacgatgaaggcgaggaatttctgaacaaactgcacaagtcgggacgacactgggttcctatcgttgactcggcaatctatattcccaaccccgacaatgcatcggatgcgtaa

SEQ ID NO: 8566 - DNA, 408 bp, A.fumigatus
agatccgctattccctcctaccttacttctacactcttttccaccaggcccacaccaccggctctaccgtcatgcgcgctctcgcctgggagttccccacggacccgtccctcgccgccgtcgacactcagttcatggtcggcccttccatcatggtcgtccccgtgcttgagcccctcgccgataccgtcaagggcgtgttcccaggcgtcggcaaaggcgaagtctggtacgactggtacacccagaccgccgtggacgccaaacccggcgtcaacgccaccattcccgcaccgctgggccacattcccatctatgtccgtggaggcagcatcctgcccatgcaggagcccgccctcacgaccagagacgcccgtaacactccctggtctctactcgtcgctctga

SEQ ID NO: 8567 - DNA, 483 bp, A.fumigatus
tgtacgaagtcgacaagcttacaatcggctctccacagcaacatctatggacagcatccgttctacctcgacactcgatactacaccaaaggcgcgaatgggtcctactcgcttgtcaacgccgacgaggcggacttgtcggaggatcatgaatcattctcccacggtgtctttctgagaaacgctcatggtcaggaagttctcctgcagccccgcaacattacctggcgcacaattggtggtagcatcgatctgactttctactccggtcccacgcaagcggacgtcacaaagagctaccagctctccactattggacttcctgcaatgcagcagtacagcgcccttggataccaccaatgccgctggggctaccagaattggtctcagctcgaggaagtagtcaacaactttgagcgatttgagattcctctggaatacatctggtcagtcggatttctgagtttctacatattgtcctag

SEQ ID NO: 8568 - DNA, 354 bp, A.fumigatus
acctggcaatgtcggctacgactaccccgaggccttcaacgtgacgaactctaccgaaacgggctctgcctccgccgcctctggcaatcaggcttcggctgcttctgctacccaagccgccacgacgttcacatctacatcgtatctgccggacaaccccacccgggcgttcgcgacgtcaactaccctccagatgtgattaatcatgttcaggagggccatgaccttgccgtgcacgccatttctcccaactccacccatgtggaacggcgtccaggaatacgatgttcacagtctgtggggccaccaaatcctcaatgctacctactacggactgcgccaggtcttcactga

SEQ ID NO: 8569 - DNA, 204 bp, A.fumigatus
ccacttagttgtcaccggtgccatgcgcataagatcaagtgctctggagagcagccatgcgctaagtgccgcatggtgggtaagtcggatgagtgcacatacacccggcgtgatcgtcaggtcaaagtgagcgaaaggtactcgggggatattccttacttaattacagtttccaaaactctcgaacgaacagcttgttgctaa

SEQ ID NO: 8570 - DNA, 186 bp, A.fumigatus
  unsure (126),(174),(175): Identity of nucleotide sequences at the above locations are unknown.
caggagagcaatcaaccatgctcgacaagttataccctcctcctagttgaccctgacgcccccacacccgacgaccccaaatacgccttctggagacactgggttatctcggggttgaaggccgangaaggcgacagtgggaccgcattgacggaatatctggggcctgggccnnaagaaaagtga

SEQ ID NO: 8571 - DNA, 540 bp, A.fumigatus
cgactactgtcctatgaagaacccaaatatacagtcaatgggcagaccaagtcttccttagataccccgcacatcgtgtatcatcaaattgcccaagacggcgcatcctctatttttccgccagtcacatcctccatctctaacccacaagcattcaaccgactatatatcatcgtaaccctgccattcacaccgtgtcctacagaatcaacactatcgctgaccaaaatgtctctcgaatctcacacccagcagctcacgcaatcgctcgcccaagccaacctcacccccggcttactccccttcctacccccagatttcaaccctaccacccagctgcacgtctccttcaacgataagcccgtatccttggggaatctctttcgcgcgagcgaatgcaaaacagctccaagcgtatcttttcccaaagaggtaggtcgtactttgccaatagccctatctccagccccgcgcagtctaatcggaataacaggagagcaatcaaccatgctcgacaagttataccctcctcctagttga

SEQ ID NO: 8572 - DNA, 345 bp, A.fumigatus
cacttacaaccttattattatcaaatctactacaagactacaaacggatcaaccacaaagcaaatcatcatgccaaataacaacttctcctcctcccaagacgctggcgtcactggcgccgcgaaattcgtcacctccactgtgggaaatactgtcggcggggtctctcgcactgttggtggagtgactggtgcagctgctcgaggagttggcggcaccatcacaagtgcaaccggaagcgcaggaaagcctgttggagatgcgttgggaagtgtcgggacgggcgttgaagatgcggcgaaccgagttgcaaagggagttgaagatgctgggcaatggcggtaa

SEQ ID NO: 8573 - DNA, 1401 bp, A.fumigatus
ggcaattgcaagttcggagccaagtgtgcgctggcgcatatccttcctgatggtcggcgcgtgaatcgtccaactcccggtatgggaatgggtggaggccatctcaatcttggaggacgcgtcaaccctcaagcctatgtcaatcaagattcggctttgacaaactcggtcctctcccaacagcgcttgggtattcatgatcctcgctacgcttcgcaactgccgcctcaagaggattttagtactctacagcagcagcagcagcagcagccacacccaccgccgttcgacgccatccctaccatagatgcaggtttagcctcggatgcgggttcgaagtatgggtcgccagcggaagacacgcgtttccctatgtctccgagtcaccgttacctaaccgctcttgacgcacagctcccggcgtcgtttgacagtcaaggcatttcgcacgtcgctcgttatggccccgttgccgcgtccgtgccatcgaagttcgggttggatctggcctctcctccagcgcagagaatgggtggtccgtcagatgtacttcgtaatctccgtgacacagcgtatgggtctgacttcaggaaaccctcatcgttcatggggtcgtcccccccgggcatttccgaagatggggtaggaccgagatttttacactctgctaggccagtgaagtcgcgcatgctttcggccagtgttcctcgacccacagcgttggatgactgggacgacagcaacttccccatggaggaggattatctgccgatcaatttgcacgatgatgtcctcacccctcaggagaaactccgacgcctatcgcgcacagatcatgatctcagttccagccaccgcgatttgagtggactcggtatgaccagcacgagcttctccaaggtcggttctccactggcatccagtccatcacggtttggtgccttatttgccaagcaacgccagcagaagaaggatgaagactcccatggtacatccttttcgcacatcggctcgcctcttcgtgagtcctccctcaacctaggtaccagtcccagcttgggccccatcggaagccgacagatctccggcgatgtctctccatatgtgaccagccctggcaggcagtcgtcgacatccatgatatctcagcagctgagtagcatgtctcttcaccctgctccaacccgccactctcctgcagtaggctccaacagccgcctggaccgtacaatctcgtcgcctgtcagcacgagcaagatcgacgaagagcagagtgatctagtattctccatggaagaagaagacagcaccaaacggaacagtacttcttgggccaccaataaggcggaatctaacgatggggcatcgaccccaacaagcaactcaggtttccagccatga

SEQ ID NO: 8574 - DNA, 471 bp, A.fumigatus
ggagaggcacaaggtgcgatgatggtcttcttctgcttgcccttgtggttgatgttagttctgatgcgagaaacatcagaagagcagccacctcatgatgctaacaatggctgggaagaaatccgactgtcggcacgatctttttatctgcctttaagattacttttcactgactacgtcatactatctttaactgtgtacacctccttcagctacgctactgttttcagctacttttcaagtcttcaacacgtcttaatgttggattatggatttggtacgcggcaggcaagtctaggcctccttagcctaatcgttggcaacttctgtgcgattattttgtgggtggtcctggagaaagccgtgacctcatcagaagagaaattaccaggcaaggtcttccagcctgagaaacgcctctatgcgggcgtcattggtggtctgctcatgtgtctcgcggagatatggtaa

SEQ ID NO: 8575 - DNA, 396 bp, A.fumigatus
ctttccacgatcgcttacattatagatatctatccagctgaagtcgttgcgtcaggtaagcagtctctgcgttcgtccatacaaaagtcttacaaaaaatggttgtatctagcaattgccgccaatggggtgtcaaggtacacacttggagcagtcttccccctgttcactttgcagatgtatgaaaaactggggacgacgtgggcgagctgtctcttcgcgataatttcttgcgtcttgattttcattccattattcgtctgcaagtacggtgtccggctaaggacgacaatgacagtgggtgcgacgcatggcaattcgattaatcgagacgccaagaacgttgacacaactataacagagctctgctatacggaactcagtgttgctatatga

SEQ ID NO: 8576 - DNA, 237 bp, A.fumigatus
cctcaaataatctgtctatgctcattaaatccaaaccatggcccagaaatctaccagatcgtccacacacagaaacccaagccgctccgtcccctcttcgtcggcctcgtcactcaccagcacggacatgggtgtggaccgcaaggtctacattccgctgtgcttttgcctgatgtcgtttgcggttatggtctatgtcaattgattgaaccaaacacactcgaagacaacgcttaa

SEQ ID NO: 8577 - DNA, 210 bp, A.fumigatus
gccgcgggaggaagccagcggcactacattattacaaaccctgacaggcctcagggccgtcaagcatcagacacttgtctgcgggacaatgtccgcaccttctatcctctatatattctttcctttgtttacacagtatatagcttctggaccttgttttctttcgaaactctgaatatcaggcctgagcatatttcagcaattgtttag

SEQ ID NO: 8578 - DNA, 1551 bp, A.fumigatus
agcctagtcgacgcggtcgctggcctggtcgagaaggatatcgatttcgtcttcgatgccctggacggaaagacaacggaacccaaggaccgagaggaagaaaaagcgaacatgcccaacgggaaagccgtggacaagaaacatgatatcaactaccgtgacgaaccagtcgcattcttcttcgtcctttttggcttggcattcgaagctctggttgaccaatcgacaacgccatctcaacgcttagatatcctgcaagccctcaagagaattttgcggccagtcatatctggaaatgcaatctatcaggatgccatcttttccgagacgatggacacttttgaccggctcgcccttactgagggaacccccatccagaccgtgattgtcgaaatagcacgaaacctctcactggaccacccatcagcaaaggctggggatgcgcgcagcgatcatctttctgatgatatcgagcagctttttgagctcacgcgaagtatcatccttgttctggctgggctgctaccgaatctgggcgagaacacttctgtggcccgattcaacgtgacgtcggatgactccttgtcgctgatccggttagccctttcatctctggttcaagttgcctccatctttccctccatcatccgcaatgacctcaatgcatgtattttgcacatcttcaccaccattttggcgaccgggctgtgtcaagcggaagtggtgcctcaggctcttccgacgtttaaacactttatccatggcatcatccatcccaaggcctccgtgtcagatgaagcccaggatcttgccatcgtctctcaccagttgcgcggttgtctcacacgcttccttacgactttgacgatcgctcagcgacgggagtccgagtcatccctaccatgtgctaaaaacacacttcttgctattacaattctgttaacaaccgggggccacatcctgcctcctcaagatcctgccatccctcgtgtcctgaatgagctcctagactgccttcaggacgtcggtcttgccaatgttgctgcaggctgtatccgttctatcttacttacctctacatcaagatcaccaaccaacgacctcattgccaagtatctccttccccgtctcatagccttcttggtcggttgtccccttgacaaaggggagattccaagcgaccctgagaactcaaggacagtcattgcacgtacgctagtctcgtacgccaccagcgctacctttgctgcaagtgaactgcccacagcattctccattgtcatgtccgcgcttctcgcacgcgccaaacgcgagagttacccggtctacagagaaaccgccgctcatctactagagcttgctcgagcggaccaggccacgttccgagctctcgtagcctcgatgaagccagaccagaagggcctgcttgaagaaattcttcgaagttcagatcctggaacgggtgctggcgctgggagagctgaaacaaatggtgcgcagtcggaggcatcgcaaagtatgccgagtattgcgctcagattggatttctaa

SEQ ID NO: 8579 - DNA, 342 bp, A.fumigatus
  unsure (39),(111),(159): Identity of nucleotide sequences at the above locations are unknown.
actttataccaaagcttcaatatgaagaacgtctctctngccactgttctcctctctctttccggctccctcacagcagcctggaacgtcaccgcatacggcaacgccggntgcaccggctacctgacctccatcgcgggcgagcagggctggggctgntactggctcagcggcgtcaccaagcccatccaggcgatgagtgtcgaggatcttcctgagggatggaggttcatcgcatcgagtggcaccgcctgcgatgcgtttcaccaggccggtggcaacggatgctacacccagagccagggattccagtcatttcagatcattgggtcgagcagctga

SEQ ID NO: 8580 - DNA, 1641 bp, A.fumigatus
tggtggacggtatataagaatgcccttttagcttcaaacagtttactctcacttgatcaacacttcaccgtctcccctaccaatactgtcgattttcatactaacttaacccgtcaagctccttccaagaccttcgaaaatcacaagatggatatgcaggaggggtcagtagcttctgctaacaaccctgagaatgcagctgacaatttcagcccgctgagcatgcttcccccagaatgcctcgtgaatatcctcgaccacctcgacaccgccgacaacctggctgtctcaaatgtctccaaagacctgcgcaaatgggcaaaacccctcgtcttcagggacattctctgggcatacacatctacgcctctccgacgggtccttctgcttctggagcagatcttcctcaatccgcagtgtgcagggtatgtcaagcacctccagctcacttacaccggaccggcctggatcatgcccgatccggatattgactttcgacagcatgccacgagatttgcctttgttagcaggaaagctatccagttcgtgagccagatcgggcttttcgacacggtaggttacgcggcgttgctataccagggggattattatgcgtatgcagcagttctgatgtttcaactgcataacctgagagtgctcgagttggactatacgtacactctggtcggtggctaccctggtctgtttcttcaaattgcgctgcgctcttcgttcgaagggatctccaggttcaacaggctggagaagctcaaatatggcggcgacgttccccaagcggagaagcttgacgatgaggcagaggaagcagtggctgccattcccgtactcgagaacacggatcagttcgccccctggtttgccctgcctaagctgaaacacgtggagatgtggcttagaagtacgtttgagctcgataaatacaaggatcagctggcgggtagagagctcgaaagcctcgttctggccaggtcaagcgtcgacgctgccgatatcaaggagattctcagcgcctgcccgaagctcaggaagttgcacctgggagtctcctacaacttggtctcgaagttggcactccttgacagcaaggaactagccgacgcattgaagccgctgaaggatcgcctggagacattatccatcggtctcgatactgacccaagcttcgttggcggattctcctgggagcaggacaataccttcggcagtacgctcacggatccattcctgatgctgttcagcgagttcacgaagcttcaagagctcgaagtcccaatgccgcttctcctgggatggttctcaaacgagaactgggcggatttccacaagtacctgcccccaaagctacggcacttagtcatgcgcaacgatctctctgggtttgacaactacacgtgggacccgtacgggatggtatttgcggtcgaccagcggattgtcgagacgaagaaacgcattcctagcctggaacgggtgacgcttcgtgtctgggctacgaatcctcgtcggccaaacgaggacttcctggctgaagcggcggatatggctcagtcggttggggtgcagtgtgacttggtcgtcgacgagctcggctcggggctttgggttgcccgggcatcctga

SEQ ID NO: 8581 - DNA, 210 bp, A.fumigatus
ttgattggcgcggcccttccaccccgtggtgaagacccactagctgaattcaaccagtctccagaagaatttttcaatccttgtcaacaaaattggccggtggcttttgtgttcaaggatgatctgctgttacaccaaccaaaagtagccgatacttcgggatttttctctacttaccatcccggctccagcattgtctcggcgacataa

SEQ ID NO: 8582 - DNA, 1587 bp, A.fumigatus
tctcctccccgtggtgaagacaagaattatattatcctcaagaaggacaagctctacgtgaagcacaacgtgctcagcgaagacatccccatcgttatccttttgagagccatgggtatacacacggagcaggagatgctgctcctagttgccggtgtcgacagtctctaccaggatgactttgccatcaacttcgaagaaagcataaaattgggaatctacactcaacagcaagcgttggactggatcggtgcgcggattaagatcaaccggaaacagtcatcgtatcgccgaactcacattcaagaagccgttgaggctatcgcctctgtaatcatttcccacattgaagtcaagaatatgaacttccgaccaaaggcggtatacgtcgctcacatggcgcgtcgagttctgatggccaagaatgacccctccctggttgatgatcgtgactacctaggaaacaaacgtctcgaattggctgggcagcttcttgctcttcttttcgaagatctgttcaagaaattctgcttcgacataaagatgaacatcgataaagtgttgaataagcgcaaccgtgctgaacaattcgatgcgtggactgtcatgagtatgcacagcaaccatatcactcagggcatgaaccgtgccatctcgacgggtaactggagtttgaagcgtttccgcatggagcgtgctggtgttacccacgttctgagtcggcttagctacatcgccgcgttgggtatgatgacccgtatcagcagtcagttcgaaaagaccagaaaagtcagtggccccagagctctgcagccgtctcaatttggtatgctttgcccagcagacacccctgaaggtgaagcctgtggtttggtaaagaacttggcgctcatgacccatatcacgacgaatgatgaggaaggtccaatcaagaaccttgtttttatgctcggagctgaagacataatggccttgggtggtaaacagttatacatccccggcagttacacaatttccatcaacggaacgccgatagcactcactcgtcgtcctaagtatttcctcaacgcttttcgcagattacggcgcatgggtcgtatctcggagtttgtcagcatttacatcaaccatcaccagtgtgcagtacatatcgccactgacgatggacggatttgcagacctctcatcgttgtggaaaatggcaggtccctcgtcaaagaccaccacttggagaaactgcgtgatggcacgatgcagttcgatgatttcttggctcaggggttggtcgaataccttgatgtcaacgaggagaacgactccttgattgctctttatgaaaaggacatcacagataccacgacacatttggagatcgagccctttacggtgcttggagctgtcgctggtttgatcccgtacccgcaccacaaccaatcgccccgtaacacatatcagtgtgcgatgggtaaacaagctattggagccattgcatcaaatcagttccttcgtatcgattctatcctttacctcatggtgtacccacagaaacccatggttaaatcacgcacaattgaactggtcaagtat

SEQ ID NO: 8583 - DNA, 246 bp, A.fumigatus
gaccgcactgacctggcacaggagctggcggataaactaggagtcaagctgtcgcaactggcactggcatggtgcctgaagaacgaaaacgtatcctcggtcatcacgggcgcctcacgaccggagcaaatcgtcgacaacgtcgagagcctgaagctgctcccgaagctcactccggaagtgatgtcccagatcgacgagtatctgggcaacaagccggcgcaggatcccgctcgacaggactaa

SEQ ID NO: 8584 - DNA, 201 bp, A.fumigatus
ctgcggcgtcaactttttcgacacggcagaaaggtatgcctctcacgcctgtgcaatgatccaagctcacgaagcagctatgcaaatggacaatccgaagtcgtcatgggacaagccatcaagaaattcgggtggaagcgaagcgacctggtcatcagcacaaaggttcgtcctgggccaattgtgtgtaactcaggctga

SEQ ID NO: 8585 - DNA, 621 bp, A.fumigatus
ctcaactggggcatggcaaatggtgaaatcctcatcaacaaccatggtctatcacgtaaacacatcatcgaaggcacccgggcgtcgctggaacgcctgcagctggaatacgtcgacatcatctacgcccaccgaccggaccgcctgacgccgatggaggagacggtgcgcgctttcaaccatgtgattgagaaaggatgggctttctactggggcacctccgaatggtcggcagacgagatcgccgaggcctgcggcatcgcccggtcactaggtctcattgggcccatcgtggagcagcctctgtacaacatgttggatagacgcaaggtcgagggggagttccagcggctgtactcgcgctgcgggatcggcctgaccaccttctccccgctgaagatgggtctcctgagcgggaaatacaacgatgccacgacgcagcctccccctgggtcgagattcgccgagagcaacgaccgcttcgccaacaaggtccggcaaaattatggtaatgacgaatgggcggcgactatcaagaagattgtcggtctgaaggcaggtattcattctccccttcctaggaccgcactgacctggcacaggagctggcggataaactag

SEQ ID NO: 8586 - DNA, 402 bp, A.fumigatus
gactatatagaggtcaccttcaactgcatgaaacaagcatatgactgcggcgtcaactttttcgacacggcagaaaggtatgcctctcacgcctgtgcaatgatccaagctcacgaagcagctatgcaaatggacaatccgaagtcgtcatgggacaagccatcaagaaattcgggtggaagcgaagcgacctggtcatcagcacaaaggttcgtcctgggccaattgtgtgtaactcaggctgacagatgtagctcaactggggcatggcaaatggtgaaatcctcatcaacaaccatggtctatcacgtaaacacatcatcgaaggcacccgggcgtcgctggaacgcctgcagctggaatacgtcgacatcatctacgcccaccgaccggaccgcctga

SEQ ID NO: 8587 - DNA, 606 bp, A.fumigatus
ggtgagactgtgatcgatctaggaagtggcggcggcatcgatgtcatcctcgctgcgcgcaaagtcggtccaaagggaaaggctatcggagtcgacatgaccaaagtgagtattcacgtctacagagcggattatacgcttccggcgagtgacttacttccaatctaccagaaaatgctggctctcgcccacgaaaacgtcgaaaaagcaggcatcaccaacgcttcctttgtcgagggattcatcactgctatcccactcgaggattcgacagctgactgcatcatcagcaactgtgtcgtcaatctcgtgccaaaagagcagaagagccttgtctttcatgagatgttccggcttttgaaacctggaggtcgagttgcgatcagtgacatccttgctcggcgggagctgccacccgaaatcgcgaacgatttggcgctgtatgttggctgcatcgctggtgcaagtcaggcccagcaataccatgcgtatctgaaggacgccgggtttggcggtacgtcaaccaacccacttgcgactgaccggaagatgctgattctatgcgcagagtattcaacacgggcctggaaggtaccgcgaatgcgt

SEQ ID NO: 8588 - DNA, 1131 bp, A.fumigatus
  unsure (58): Identity of nucleotide sequences at the above locations are unknown.
gatattcgacaatttccaagccttgaggcgaaactgcccaaagaaggcgagaaggcgnccgcgggaggtacgacattgattcacgactctgtgactccggacgacatcgcaaacgtcgtgtctcggacaaccggcatccctgtcaacaagctcatgggtggagacgtggagaaactaattcacatggaggatacgcttaggcagtcggttcgtggacaggacgaagctctcactgccgtcgccaacgctgtgcggatgcagagagcgggtctgagtggtcagaatcgtccgctagcatcgttcatgttcttgggtcctaccggtgtaggaaagacagaactctgcaagaggatggccgaatttttgttctcaactgagactgccgtcttaagattcgatatgagcgaattccaggagaaacacacaatcagtcgccttattgggtcgcctgccggatacgtcggttacgatgatgccggacagctcacagaggctgtgagacggaaaccatacgcagtcctgttgttcgacgagtttgaaaaggctcatcgtgacatatccgcgttgctactgcaggttctagacgaaggcttcctaacggactcccaaggtcacaaagttgatttcaggaataccctcatagtcttgacttcgaacctcggtgccgacatcctcgttggcgcgaacccattgcattccttcaaggattacggcaatgccgagctctcccctgacatcaaacaggcggttatggaagtcgtgcagagtgcctatcctccagagttcctcaatcgtatcgatgagttcatcatctttaggagactctcacgagaggcgttgcgggatatcgttgatatccgaatcaaggaactccaggcaaggcttgatgaccgccgcattgtcctgcaagtcgacaacgagatcaaagattggctttgcgagaagggctatgatcccaagtatggtgctcggcctcttaatcgtttgatcgccaaggagattggtaatcggctcgctgataagatcatccgtggtgaattgacctcgggacaaactgccgtcatctcgttcaacgaggacaagaccgcgcttgaagtcacagcagatggtgcgaaggaggaaaaggcatga

SEQ ID NO: 8589 - DNA, 276 bp, A.fumigatus
  unsure (255): Identity of nucleotide sequences at the above locations are unknown.
ttgttaaggaccccaaaaaatttcaggaaggccctaaaggccaaccaaagaggatttgcgaaaataccaagggtttggaaaaagaagaggccagagattgagtccctcaagcgcacaaagaaagaacttgaacgtgctcggtttgagctcgaccgagcttcagagggagggaatttttgcgaaagctggagaattgagatattcgacaatttccaagccttgaggcgaaactgcccaaagaaggcgagaaggcgnccgcgggaggtacgacattga

SEQ ID NO: 8590 - DNA, 186 bp, A.fumigatus
  unsure (186): Identity of nucleotide sequences at the above locations are unknown.
catctcctcttttgtatattagaaagtaacttgaagaagaacaaattgcatgaacagatgaattgtctcgtggttcggaactgtaacaatcaggaccatatggaccctggaagcctgaggcttaagactaaccaacaacggaggcaagtcaatgcttcctggatcaacattattatcagcatttgn

SEQ ID NO: 8591 - DNA, 474 bp, A.fumigatus
gatcgtgtcggcgtcaaactctccccctacagtcagtatctggggatgggaacaatggacgagcttgtgccacagtttgagtatctcattgcccagatgcggcggttggatgtcgcatatctccatcttgccaattcccgatggcttgatgaggaaaagccccatcctgaccctaatcatgaggtgtttgtgcgtgtctggggtcaatcctcacctatcctgctggcaggcgggtatgatgcggcatcggcagagaaggtgacggagcagatggcggcagcgacttacaccaatgtggccattgcttttgggaggtactttatctcgactccagacctgccctttcgggtcatggctggcatccagcttcaaaagtacgatcgtgcctctttctatagcacgctatcaagagaaggctaccttaattaccctttcagcgctgaatatatggcattgcataatttccccgtctaa

SEQ ID NO: 8592 - DNA, 1512 bp, A.fumigatus
  unsure (416): Identity of nucleotide sequences at the above locations are unknown.
tcgagcttgggtttgaacgagggaaagcggaacacatacaggaataaactcaaatgttgtcgaaatttgaggagaagcccaggccggcaatgggcgcatcatggatgtggaagaggagggttctgcgcttctctgtcgcgctgctcatcgttgctggttttacttatcaactgtgggccgcgcgccgtgtatatgcccgaagaacccccgaaaattatacagaatatcaccatcacctcgggcgtcaagtgcgaacccgactttgacgtgctccgccgcctggatgttcaaaaactttctcagtatgaacggcgtgacatgttcgtcgcccgttcctcggagccggagctccccatccgacaacggctcaacatccccttccttcagcaaccatcgtcgggcgatgaagctcgtangatgggtctgccgtcgcaggaacaatgttacattgaacccccagttacggtggaggtgcctccatcacctgcgagtgtggatgcttcgcatatcgactttggcgttgctacgactttagaacggctgaacgactcgttagacgccttcacccactgggctggttacacacgcacgcgtattttcgccttggtcgaaccggatgaacgagtggaggaagtccaagccaaggcggatagcctggggatcaacctgtttgtgacacagtcggaggaggagtatcaaactcgatatttctcattggtggcccatctggcgaagaacatgcgcccgcggacacgctgggcctgcgtgattgacgatgacacttttttcctgtccatggccgccttggtggatgcgctggccgaatacgacgacacgaaacccatgtatattggaggtctgtcggagagtgtttcgcagattggcatctttggcctgatgggattcggcggcgcgggcgtctttctgtctcgtcccctggtgcagcaattgagcaaccgcgacgtcttcgaagcctgtcaagctatgcctcacaccggggaccggaggatctcgctctgcatataccagcacacggagacgaagctgacggtggataatcgactgcggcagctcgacatgcgaggcgacgcgtcggggttcttcgagtccggacgcgaaccaccgctatccgtgcaccactggaaatcatggttccaggccgacatggctaaactcagtgtcatcacgaatctctgcggggataagtgcttcctgcgccagtggcagttttcagacggctggaccctcaccaatggcttctccatcgccaaatacagtaccgagatcgacttagacgataagaccatggaggtctcatgggtcggcgacaacggagccgtcgacgagtcgttcatgcacgcgctcggtcctctcaggcccaaggacacgggcaaattcagctatcttctcgaggactcggtgttccttggcaaccaagtgcgccaatggtacgtccaccgcgacgcggagaagggcgatcagatcatcgaattgatctggaagatggcgtag

SEQ ID NO: 8593 - DNA, 1473 bp, A.fumigatus
ataacgccaccgcggatccttccgaccgctgtggtgaagacggcacaatggaaagagaaaaaagtgttcgaggtcgatgccccgtctctgtcggaggttcctcccagcaccctgtcatccgcagagcttcgggagaagtatccaaagttcttcggaaccatggcatatccttacatgaacggtactctgcacgctggccacagtttcacggccagtaaaattgaattcatgaccggcgttgcccgcatggagggtaagagggctcttttccctcttggcttccactgtacgggtatgcctatcaaagcctgcgcagacaagcttgcagatgaagtccagaagttcggcaagaacttcgaacgctacagtgaagaaagcgaggagcaggatcccactgcagttgcagcccctacgcaggaaatcaaagctgagcaagagaagttctctggaaagaagagcaaggccgccgcgaagaccgtgaagatgaagtatcagttccagatcatgttggccatcggcttgccacttgaggagatccacaagttcgccgatgctaaccattggcttcaccacttcccaccccttgccattcgcgacctcgacagcctcggtgctagagtggattggcgcaggcagttcgttacgaccgacgctaatccttactacgactctttcgtgcgctggcagatgaaccgcctccacgagctcggcaagattctgtacggcaaccgctatactatttattcgccgaaggatggtcagccttgcatggaccatgaccgcacagagggtgagggaattggtcctcaggaatatactgccatgaagttgcaggtgaaggagtgggccccagaaattgctgagctggtcaagggaaagatcgaggatgatgccaaggtttacttcgtgccagccactttgcgtcctgagacgatgtatggacagacttgctgcttcctcggtcccaagatcaagtacggaatcttcagggtcaaggagaaggaatactacatcgtgaccaagagagcggcctggaatatggccttccagggaattttcttcgacagcgaacactttcccaagacgcaggacgagctgccactcgtcctagaagcgcctggttccgcctttgtaggcacccttgttaacgccccactgtcgttccacactgagggtgtgcgcatactgcctatggagggtgtctctgccaccaagggtaccggcgttgttacatcagtcccctcagatagccccgacgactacgctaccttggtcgatcttgccaagaagcctgaatactatggcatcaaaaaggaatgggctgaactggaaattttccctctcatcgagaccccaacatacggtaacctgaccgcccctacgcttgtcaagaagctcaagatcaactctcccaaggatgtcaaccaacttgcacaggccaaggagttggcatacggcgaagcctactactag

SEQ ID NO: 8594 - DNA, 420 bp, A.fumigatus
agcgcggctccttcgacccccgtggtgaagacgggctcgaagaccgcaacgtcacgtcccatgttacagccaggaaccacaccaggtccaccgacaagggcagcgccaacgttggatagaatgcctccgtacaagttgggcatgaccatcacgtcgaattgctggggccgagaaacggcctgcatggatgcattgtcgacaatcatgtcgttaacttccagagtagggtacatctcggcgaccttgtggaaagtactgcgaaacaagccatcggcgagtttcatgatgtttgccttatggatgcaggtgaccttctttctgttgttggcgagagcaaatccgaacgcaaatttagcgatgcgctctgactttgcacgggtgatgatcttcagcgactcaaccacaccctgtactgactga

SEQ ID NO: 8595 - DNA, 792 bp, A.fumigatus
tgcaaaggtgatggtatcggtgcggaagttgccgagtcagtcaagaccattttcaaggccgacaacgtccctattgaatgggagcaggtagatgtcagcggtgttgatacaggcaacaagcattcggaggagctcttcaaggaatcaattgcctctctgagacgcaacaagctcggtcttaagggtatcctgttcacccctgttgagcgctcgggtcaccaatcattcaacgttgctctccgtcaggaactcgatatcttcgcttctatcgttctgatcaagaatattcccggctacaagacacggcatgagaacgttgatctctgcattatccgtgagaatacagagggagaatactctggtctcgagcatcagtcagtacagggtgtggttgagtcgctgaagatcatcacccgtgcaaagtcagagcgcatcgctaaatttgcgttcggatttgctctcgccaacaacagaaagaaggtcacctgcatccataaggcaaacatcatgaaactcgccgatggcttgtttcgcagtactttccacaaggtcgccgagatgtaccctactctggaagttaacgacatgattgtcgacaatgcatccatgcaggccgtttctcggccccagcaattcgacgtgatggtcatgcccaacttgtacggaggcattctatccaacgttggcgctgcccttgtcggtggacctggtgtggttcctggctgtaacatgggacgtgacgttgcggtcttcgagcccgtcttcaccacgggggtcgaaggagccgcgcta

SEQ ID NO: 8596 - DNA, 420 bp, A.fumigatus
  unsure (382),(384),(398),(408): Identity of nucleotide sequences at the above locations are unknown.
catatcaagttgacaatacgtgtaccggactatgtcattggcgatcctttccgtctgcgtcagatcattttgaacttggtcggcaacgccatcaagttcactgagcatggagaggtcaagcttacgattcgcaaatcagatcgagagcaatgtgcccccaacgaatatgcctctgagttttcggtctcggacaccggcattggtattgaagaggataagctggatctcatctttgacaccttccagcaggcagatggatccaccacacgcagattcggcggtacaggtcttggcctttctatttccaagcgtcttgtcaacctgatggtcggtgatgtgtgggttacatccgagtacggtagtcttcacctgggggctggcnangtgccactcagttntcaaaggggnattcaatgccgg

SEQ ID NO: 8597 - DNA, 2586 bp, A.fumigatus
  unsure (557): Identity of nucleotide sequences at the above locations are unknown.
agggttacttctagctcgcgtgagcagtgcgccaaactaccaggagagcctagccaagcaaaggcggcatttgaatttgagttggaggctttaattcgacgtgttcgccatctagagtttcaagttgtcagtcatcaaccatacccccgacctgcccccgagttacctttgtcttccaccaagaattctgattttctctggcttttcgggctatctcgcctgtcctctcatgaaggagctgcttctaactcttcttgcggcatgcagcaggaaacttcaagacgtcgtcagagaacaaggagaatccgccgcgaagcggaagacaatgaggctgatgaggcgctcgatgacgacgacagtgatgatgatgttaactcgagaactcgactcgttcgcgaggaagacatcagttatctgcggaatcatgtacagaaacaggcagaggaaataagcttccaaaaagacatcatcgctcaagttcgcgacgagcttctgcagcaggaggagcacacgcgacgggcattgaccaaggttgagaatgaagatgtagtcctgtnggaacgcgagctacgcaagcaacagcaagccaacgaggctttccagaaagcccttcgggaaattggcggcatcatcacccaggtcgcaaatggtgacctgtccatgaaggtgcagattcaccccctggaaatggaccctgagatcgccaccttcaagcgcacgatcaacacgatgatggatcagctgcaggtttttggtagtgaggtgtccagggtcgctcgagaggtcgggacggaaggtatccttggtggacaggctcagatcactggggttcacgggatttggaaggagcttacagagaacgtcaacatcatggccaagaatctcactgatcaagtgcgtgaaattgcggcggtgacgaccgccgtggcccatggcgatctcagtcagaagatcgaaagtcgtgcacagggcgaaattctggaactgcaacagaccatcaacactatggttgatcaactgcgcacattcgcaacagaagtcactcgtgtcgctcgtgatgttggcaccgaaggtgtactgggtggacaggcccagatcgaaggcgtccaaggcatgtggaatgagctgactgtcaacgtcaacgccatggcaaacaatttgactacccaagtgcgagacattgcgacggtcaccaaggctgtggccaagggtgatctgacacagaaggttcaagccaactgcaagggggaaattgctgagctcaagaacattatcaactccatggtggaccagctgcggcagttcgcccaagaggtcaccaagattgccaaggaagtaggtacggatggtgttctcggtggccaggccaccgtaaatgatgtggaaggcacttggaaagacttgaccgagaatgtcaaccgaatggcaaacaacctgaccacccaagtcagggagatagccgacgtcacgactgctgtcgcgaaaggtgatctaaccaagaaggtcacggccaacgttcaaggtgaaatactagatcttaagagcaccatcaatggcatggtcgaccgattgaatacttttgccttcgaagtaagcaaagttgccagggaagtcggcacagacggtaccctcggcggccaagccaaggtcgacaatgtggaaggcaaatggaaggatctcacagacaacgtcaataccatggcccagaatttgacgtcgcaggtacgaagtatttcagacgtcacgcaagctatcgcgaagggtgacctcagcaagaagatcgaagtccatgctcaaggagagatcttgactctcaaggttacaatcaatcacatggtggatcgtcttgcgaaatttgcaactgaacttaaaaaagtcgctcgcgatgtcggcgtggacgggaaaatgggcggtcaagccaacgtggaggggatcgcgggaacatggaaggagatcaccgaggatgtcaatacaatggctgagaacctaacttcgcaggtgcgtgcgtttggtgagattaccgatgctgcaaccgatggcgatttcactaagctcatcactgtcaacgcttccggggagatggatgaactcaagcgcaagatcaacaagatggtctccaatcttcgagacagtattcagcgtaacactgctgccagggaggcagatgagctggcaaatcgaacaaagtccgattttctggcaaacatgagtcatgagatccggtctcccatgaacggcatcattggcatgacacagctcactatagacactgtcgacctgaagcctcacacgcgcgagatgttgaatgtagtgcataacttgtcgaacagcttgctaacaatcatcgatgacatactcgacatttccaagattgaagcaaatcgcatggtcattgaaagcatccccttcacagtgaggggaactgttttcaacgctctcaagacgctggccgttaaggccaacgaaaagttcctcagtctgacatatcaagttgacaatacgtgtaccggactatgtcattggcgatcctttccgtctgcgtcagatcattttgaacttggtcggcaacgccatcaagttcactga

SEQ ID NO: 8598 - DNA, 291 bp, A.fumigatus
  unsure (11): Identity of nucleotide sequences at the above locations are unknown.
ctcgcgttccnacaggactacatcttcattctcaaccttggtcaatgcccgtcgcgtgtgctcctcctgctgcagaagctcgtcgcgaacttgagcgatgatgtctttttggaagcttatttcctctgcctgtttctgtacatgattccgcagataactgatgtcttcctcgcgaacgagtcgagttctcgagttaacatcatcatcactgtcgtcgtcatcgagcgcctcatcagcctcattgtcttccgcttcgcggcggattctccttgttctctgacgacgtcttga

SEQ ID NO: 8599 - DNA, 717 bp, A.fumigatus
caattgcaaaggatcggaaccgtgatatcaagcctgaatcaaacgtgtgaagaaatgcgacaacacattgtccgagccaagcaggatacggcaccagtcatcgaggaagcatctgcactgatgaaccagaagaaggaatcggagacaaagcaacaacttctcgatgcgtttgtgaagcactttattgtcacggaagatgacctacttgttctcacatcggcagaggaaccaattgacgaccgctttttcaatgtacttgatcgggtaaaacaagtgcatcatgattgcgaagtcctcctgggaggggagaaccaacgactgggcttggaattgatggaaaagagctccaggaatctgaactctgcgtatcagaaactcttcagatggatacagaagaaattcaagtccttaaatcttgaagacccacgaatcagtagttcaatcaggcgcgctttgcgcgtactggccgaacgaccgagcctcttccatagctgcttggacttcttcgccgacgcacgagattatgccttgtccgacgcctttcattatgccctaaccgacaccgtctccggctctgggggtgatcgcaacgtgaaaccgattgagttctctgctcatgaccctctgcggtacgtcggtgatatgctggcatgggtccactctacgactgtatccgagagagaagccttggaagctttgttcgtagcagagggcggg

SEQ ID NO: 8600 - DNA, 249 bp, A.fumigatus
  unsure (200),(238): Identity of nucleotide sequences at the above locations are unknown.
gcatcgcagtttatctctttcttttgcttctgtttctccaagaataatattatttgttattcttctttgatgacaattacttattattatattgttattctccgcctgtctctcatattatactcccttgatacttcatactgccgttctcagtcaatttatatatctgtccacctcctcccaatgtactgtgtcctgtnttcagccccaggggccgaaggttcgcgaattagccgcnaaccccaagat

SEQ ID NO: 8601 - DNA, 213 bp, A.fumigatus
cacgagactgcattctccgttccaggtctggccaacttaagcgcgtttgacaaggctgaattcaagatggcggttcaaaggacgcccaatgctgctcaaggcttgaccaattggactttggatggcgtctattactcatttggcgttagcattcaagttcatcagacatctctgtcccacatactcaggctgtccgggagagacatggggtag

SEQ ID NO: 8602 - DNA, 192 bp, A.fumigatus
taccttactcctgtcactttggaccatgaatttcctgatatagtgtctggagttaactttacaaaatgcttgctcgagcctccctacgtccattccatgttcaagctcattcctaacatgttcctgagcagcatctctcaagccatacttgaagactcttgtcctacctccaaaaacaaatgcttgatctga

SEQ ID NO: 8603 - DNA, 477 bp, A.fumigatus
aagctcttttccatccggttagcatatgtatttacaccaatttatcttcatctttcctgcacgcaattacggaggaatatcgtgttcgactcatctcccaccatgtctctcgccttcacgaatcaaccgcccgaggagagggtcccctacgccatccctcaattggaaggtgaacgcattactatccccggtagcaagggaacctttcgcattcttgcatcgtctaagcagacaaatggattgatggcagttttccaaagtggtgctgtgttatctgatgtccccggattccactatcataaccaggcacacgacgtctttcttgtaacgaagggatatttgaaactgtggaacggggataagtgtcggattatgggaccgggcgatttcgcatatgtgcctcctgtgagtagaaatcatgttttccgttttgctagtgctttactgacaaccctctttacagaaagtcattcataa

SEQ ID NO: 8604 - DNA, 756 bp, A.fumigatus
caaccctctttacagaaagtcattcataatcccgagatgcttgggcctcataccgagatctacggtctgatcactcctggtgactgggtagatttcttccgctatgtctcggaaccatacaaggggatcctggttcccgaggacgacaaccgtgacctaaagtccatcctcatccccaaagtcatggccgcaaaagagaaatttgacgtggtcttccaacccaactaccaacctcccgaggtgggtgaattcactaaggatgacgagaaaattccagatggccacgaaccatactttctgcgctctaacacaggcccgaaatggatgctgggtggtgtgatgtccagaccctttatcaccacgaaacaaagcaatggcgtctgcgcgatctcgagcatcgagtcgtccaaggtgtacagtgagggtctgctttctaagtacatgaccttcaagtctgtcgatcactgtttctgtgtgttggaaggtacattgaccgtacgtctcaagggttctactgacaccgttttccgtgagggagagacggtggtggttcccgctggtcaggcatttgctctgcgatttgacagcaagtatgtgcgggtgtattcattcactgatggtgatggcattgagtcgctggtgcaccggcttggaaagccgttcgagggatccgtgctgcctgataaggagcccgaatgggagcacactcaagtacaacctgttgctacagagctcaatgtggaaattgaactgtga

SEQ ID NO: 8605 - DNA, 414 bp, A.fumigatus
  unsure (32),(33),(37),(55),(57),(58),(60),(61),(62),(66),(82),(83),(84),(85),(87),(88),(89),(90),(91),(92),(93),(94),(96),(97),(99),(100),(101),(102),(103),(104),(105),(157),(187),(206): Identity of nucleotide sequences at the above locations are unknown.
ctgtcctcggaatatccgggacattttcttgnngagngcaccccccaatcaaagncnnannngggnaggaagcgaggacgannnngnnnnnnnnannannnnnnnaaaatcaatctcaacgagcgatacaaatatgcgtggatgatgcagcaccagnttcagccatcttttcgaacccccccacagngtccaaagcgacaacgtgntacgcaggcatgcgacagtgttcgcctgaagaaatacaaatgcgacgaattgtatccttgcactcactgcaggagtaagtatgtcacatatactggtttcaatatgataagaggattgatcatgggcagaaaacaagctcgaatgcatctatcagaggaattaccggcagcgcgaaagcgaccggtcagccaggtattttcccagtag

SEQ ID NO: 8606 - DNA, 852 bp, A.fumigatus
cataatacaaacagattgatcgcgattatgcttggccgcctcaagatgaacgttgaccaatgtatcgacgcatacgttcgaatctccaagcaggctttctccaggaagaactatttacccatcactctacagggtgagttcagggcgcgcttcgacagcaagacgctcgaagaggccctgaaggccgtagtggtcgaacaaggcctggacgaggatgctctcctctgggaccctgatacgtcctgccgcgtctttgtctgcacactgaagaaaataactgggaaggtcgtcagcttttcgagctatgagcattgggctggtcagtctagcttgtacaaggttttgaggatctgggaggcgggaagggcgacttccgccgcgccgtcgttctttgatccgttggtgatattcgatccggtccttaggtttgaacgggtgtttctcgatggtgcgcttggcgccaataactccgttgcacaaatgtggttccatgctaagatgctctgggaggaagacctgaagagtcggctggggtgtctggtgtctttgggtaccggcatgcggtctgagacggagtttaccgggggatttatccaagagctgaagctgaggaagcgtactctgacggattcggagtttgaagcggacacatttgcctatgagcattatgatctagttgaggaacatcggtacttccgattcaatgtttcgaatgcattgggggatattgggctggaggaggtacagaagatggacaagatcgtttctgagacaaggacgtatcttgctgatgatgctgttcgcgaggagattgcgctgtgtgctgcaacattacaaaagaggcaagtttga

SEQ ID NO: 8607 - DNA, 252 bp, A.fumigatus
agatgtcagaactgctggtactcgaatatcattctggaagtcaagttagatatcaacaatctttacataatggacatggaaaagcagaccgacaaggagaaattgaatctcctctgcctagacggcggaggcgtccgcggtctctcctctctctatgtgcttaaggatatgatggaagcaatcaatccatctaatccgccaaaaccatgcgaaatcttcgatatgatcggtgggacaagtgcaggcgggtga

SEQ ID NO: 8608 - DNA, 588 bp, A.fumigatus
  unsure (198): Identity of nucleotide sequences at the above locations are unknown.
ggcttcggaaggaggacccagtcaatggttctgttgggaaagttggccaggataccgtttgaagcaaacgtccgtattcaagtgtcggcgagcaacttgatggtggcttctccggtgttcaagaaagctctgactggcaaagggaaggaaggttcaacttttgttggtaccggatcagtcgtgattaccactgagggntgggatgtagaggcattcttgattctccttcgaattcttggtggccagcatcacaaactcccaaagagggtgagcctcgagctcgctgctaagatcgctgttcttgcagactactatcagtgcaacgatctcgtcgggttcatccgcgatgcgtggattacctgtctgcgggaagaacttccagttacctactcacggaacttgatcttgtggctgtggatttcttggtacttcaatatgcccctgaagttcaagaaagcgacctcggttgccatgtcgcagagcaaggataagatcgatgcactggagctgccgattccagcgcgcatcatttgtaagtctgtaccaatcctctcagtaagagagattgctgaccacgaatctagatga

SEQ ID NO: 8609 - DNA, 1554 bp, A.fumigatus
aaccagacaaagacaacccctccactgcatccatctaaaatcggtcacctacagcacaagcataccgacaccagcaaagagagcagtggcaatgtaggccccaaactgccagttgccaaccttgacagccatggggctagcggcaacacctgcggctcccttggaagtctcacttgcgctgccggagccggagctgccagtggcaccggcggtcacggacccagtgccagcagttccggcctggctgatcagagaggcgcaagagcccgaagcatcagcacccttcttggtctgggccttgccatcaaagtcacaggcggtcgcggccttgttgttcttcttgtagtactggttcatgacgaaagagagcttctgcttggcgctgcagacgctgtaagctccgtagtcaccgctggtggagttggagttgattccaccgcacacaccggcggcgcagagatagtcgaacaggtcgccgtactccttctcgtccacagaatccttcacagtgcaggacagagtctcgaccatgcagtcacacagctcgctgttgggactaggaggcagcttgttggaggcctcccacttggcaccgaccgaagggcaggtagggacggcagtgttggaggcagtgtagcttgcactgttcacaccggtggccgttaccttctgcatctgaacggacaggtaggagaaatcttccttggtcttgacattgtcgccgctgaccgaaaccagaccgtagtcattggcctcctggaagtacatatagacaataccaccgctccagacgtcgttcatctggggaccgtacagagcggcgacatcggtaaacttgcggggcttggggtcaatgcagccgtactcggagaagaaagcagggacagggtacttggaaaattcctcagtgcggtccttgtagccagacttctcgaaggaagaatcaccgcaccactcgtaaatgttgtagccgaacatgtcgatagagctctccttatcaccgcagacaaggtagtcggccaagtcggcaccgatgtgggcgtcctcgtcggtggcgtatccgacaagcagggaggagcggtaatccttcgacttgatgtacgacttcatgtctcgcacggcagccttcacgtaggcaatcgaattggtgttgttgttgtcattggcgacctcgttacccgcgaaaaagccaatgacattgctgtacttggcaaaggcgtcaatgacgctggtatagcgcttgtagaggtcggtgttccaggcagggtccgcacggttgatggactcagatggcgcggacaaatccgtaatcaggtagatgccggcgtcgtccaggagcttcatacattcatcatggtccttcgtgggatcgacagcataggtacggatgacattggtgcgcagctgcttcaggtagggaatgtcacgcttgcagttgtcaacattggccagaggatcggtgtagtcggagttctcggtagatgtgccgttggcctggtactcctctgcattggattagtttcggggggcgaccggttgatgggatttctctga

SEQ ID NO: 8610 - DNA, 1467 bp, A.fumigatus
tccaatgcagaggagtaccaggccaacggcacatctaccgagaactccgactacaccgatcctctggccaatgttgacaactgcaagcgtgacattccctacctgaagcagctgcgcaccaatgtcatccgtacctatgctgtcgatcccacgaaggaccatgatgaatgtatgaagctcctggacgacgccggcatctacctgattacggatttgtccgcgccatctgagtccatcaaccgtgcggaccctgcctggaacaccgacctctacaagcgctataccagcgtcattgacgcctttgccaagtacagcaatgtcattggctttttcgcgggtaacgaggtcgccaatgacaacaacaacaccaattcgattgcctacgtgaaggctgccgtgcgagacatgaagtcgtacatcaagtcgaaggattaccgctcctccctgcttgtcggatacgccaccgacgaggacgcccacatcggtgccgacttggccgactaccttgtctgcggtgataaggagagctctatcgacatgttcggctacaacatttacgagtggtgcggtgattcttccttcgagaagtctggctacaaggaccgcactgaggaattttccaagtaccctgtccctgctttcttctccgagtacggctgcattgaccccaagccccgcaagtttaccgatgtcgccgctctgtacggtccccagatgaacgacgtctggagcggtggtattgtctatatgtacttccaggaggccaatgactacggtctggtttcggtcagcggcgacaatgtcaagaccaaggaagatttctcctacctgtccgttcagatgcagaaggtaacggccaccggtgtgaacagtgcaagctacactgcctccaacactgccgtccctacctgcccttcggtcggtgccaagtgggaggcctccaacaagctgcctcctagtcccaacagcgagctgtgtgactgcatggtcgagactctgtcctgcactgtgaaggattctgtggacgagaaggagtacggcgacctgttcgactatctctgcgccgccggtgtgtgcggtggaatcaactccaactccaccagcggtgactacggagcttacagcgtctgcagcgccaagcagaagctctctttcgtcatgaaccagtactacaagaagaacaacaaggccgcgaccgcctgtgactttgatggcaaggcccagaccaagaagggtgctgatgcttcgggctcttgcgcctctctgatcagccaggccggaactgctggcactgggtccgtgaccgccggtgccactggcagctccggctccggcagcgcaagtgagacttccaagggagccgcaggtgttgccgctagccccatggctgtcaaggttggcaactggcagtttggggcctacattgccactgctctctttgctggtgtcggtatgcttgtgctgtag

SEQ ID NO: 8611 - DNA, 1146 bp, A.fumigatus
catcgatattgcaatagcaccagccgtcgatccttccagccccgtggtgaagacggtgaactgacggagggtgttggtttcttctcggtctcgtacaatccagatgatggccgtcgcagcagtgctagtgtggcatacatccaccctatcttgcgcggtgaggaaaagcgccccaacttgactattcttaccaacgcgtgggtgtctcgcgtgaatgtcgaaggagacaccgtcaccggtgttgacgtgactctgcaatccggtgtcaaacacaccttgcgagccaagaaggaaactattctttgtgccggtgctattgatacgccgagattgatgctcctctcagggctgggaccccgtgagcagctgagttctctggggattccggtcatcaaggatttacctggtgttggtgaaaacctcctcgatcacccagagactattattatctgggagctcaaccgtcctgttccccccaatcagactaccatggattcggatgcgggcatcttcctgcggcgcgaagctcccaatgcggctggctctgacggccgtgccgccgatatcatgatgcattgctatcagattcccttctgcctcaacacggcccgtctgggctatgaaaccccagttgatgccttttgcatgacacccaacattcctcgcccccgctctcgtggtcgtctctacctgacctccgcagacccctcggtgaagccggcattggatttccgctacttcactgaccccgagggctatgacgccgcaaccatcgtggccggtctcaaggcggcgcgccggattgcccagcaggctccgttcaaggattggattaagcgtgaggtggcgccgggacctaaggtccagactgatgaggagttgtcagagtacggtcgccgtgtggctcacacggtctaccaccctgctggtaccaccaagatgggagatatctctcgcgatcccatggctgttgtcgaccaccagctcaaagtccgtggcctgaacaatgtccgtattgcggacgctggtgttttccctgagatgaccaccatcaacccgatgctgacggtgttggctatcggagaacgcgctgctgagctgatcgctgaagaggctggttggactcgggaacagcccaagctgtag

SEQ ID NO: 8612 - DNA, 342 bp, A.fumigatus
gaggagcatcaatctcggcgtatcaatagcaccggcacaaagaatagtttccttcttggctcgcaaggtgtgtttgacaccggattgcagagtcacgtcaacaccggtgacggtgtctccttcgacattcacgcgagacacccacgcgttggtaagaatagtcaagttggggcgcttttcctcaccgcgcaagatagggtggatgtatgccacactagcactgctgcgacggccatcatctggattgtacgagaccgagaagaaaccaacaccctccgtcagttcaccgtcttcaccacggggctggaaggatcgacggctggtgctattgcaatatcgatg

SEQ ID NO: 8613 - DNA, 426 bp, A.fumigatus
tcgaggaggttttcaccaacaccaggtaaatccttgatgaccggaatccccagagaactcagctgctcacggggtcccagccctgagaggagcatcaatctcggcgtatcaatagcaccggcacaaagaatagtttccttcttggctcgcaaggtgtgtttgacaccggattgcagagtcacgtcaacaccggtgacggtgtctccttcgacattcacgcgagacacccacgcgttggtaagaatagtcaagttggggcgcttttcctcaccgcgcaagatagggtggatgtatgccacactagcactgctgcgacggccatcatctggattgtacgagaccgagaagaaaccaacaccctccgtcagttcaccgtcttcaccacggggctggaaggatcgacggctggtgctattgcaatatcga

SEQ ID NO: 8614 - DNA, 393 bp, A.fumigatus
cagaagccaatgaagctctgcggctttccggacggtgtctatgactggacgaacggcgagcgcatcgtcaagacgggagcccgcttgaccctggagggatccgacaagatcgcaggtagttcggccaccctgatcgagtgcatcaacaacttccggcgctggtctggcgcctctatagctgatgccattaacgctgccacggcgactccggcgcgcttattggggttacaaggcgtcaagggttccctggatagcggcgccgacgcggaccttgtcgtgctgagcgaggaagacgaccctgagtcgcccacgctaactgtctaccaggtgtggaaacggggagtcaagatccatgactctgataaagaaatagcgtctacaactacagtatga

SEQ ID NO: 8615 - DNA, 327 bp, A.fumigatus
gtgtccaaggataacctcagaattctcgctggctacacggaccaccaacttcccttcaatttcctcccgcagcacaagcaaacatccgaaactctgcaccgcaccagggatgtggatcggttcgtcttcgcatgcttgataagaatcattggctcttccagtgatgaccatatggccaccatcggtcactacatgacgaaatcgggcagtaacaagaccatgctcggaatcgacctctggatcctgagtcttggtcagagcggaatccggagtcggggtgggactggcgctgtgagaacggccttggtcgggcggctcagacgatga

SEQ ID NO: 8616 - DNA, 1584 bp, A.fumigatus
ccacgtcggtcgccgcttttgttttacaagctgtcatccagcatggcgtcaagagccaatgcctcctctccaacgaggcagaaaaatcacgaggacctctccgaaacgacgtcaggtgctgtaggagaggaaggcgccgtgactcgcgcaccgaagtcaggaatggagagttccactggcttcgagagtgaagaccgagtgtatccaatccggtcggtcatctccgttgatccctcaacggtctctcagtcgcaacagcaggcggagagtaatctgagctcacccgccaccggagcgcgagaatggtctattatcaatgccgagacctgggataagatgcgagcgcagacaaaaacaagcgcaggtaatttttccgctactgagccacctccaccagcgccggatactgcaggttcatcgtctgagccgcccgaccaaggccgttctcacagcgccagtcccaccccgactccggattccgctctgaccaagactcaggatccagaggtcgattccgagcatggtcttgttactgcccgatttcgtcatgtagtgaccgatggtggccatatggtcatcactggaagagccaatgattcttatcaagcatgcgaagacgaaccgatccacatccctggtgcggtgcagagtttcggatgtttgcttgtgctgcgggaggaaattgaagggaagttggtggtccgtgtagccagcgagaattctgaggttatccttggacactcacccaagtgtctctttgcattaccaaacttctgtgacattttggatgaagagcagaaagataatctattggatcatcttgatctcatccgcgacgatggatttgacccttccgtcgatggccccgaggttttccttttgtctgtgaagctcccttctggtaaaccccggcgattctggtgcgccacccatctcagcccagccgactcaaattcgattatctgcgagtttgaattggaggacgatcgaatcaatcccttgagtgtttccggactaactaccccggtgacgccgaccgatactcttggagtcgaaccgacgccggagcaactcgaacacagcacagtcaatatcagtcaacccctgcgattgctacgaaatgcgcgtcggagacgaggcgaggccgctgcaatggaggtgtttagcatcttgtctcagatccaagatcaattgggtcgtaccaagtcgctggattctttgttaaacacgaccactggtttggtaaaagaattgactggttttcatcgtgttctgatctatcagttcgacaccgaatggaacggaactgttgttgctgaactggttgatcccaaagcgagcgtcgacttgtacaaaggactctgctttccggcctcggatattccgaagcaagcgcgtgacttgtatcggatcaacaaagttcgcttgctgtatgatcgcgatcaggtcacatcgcgattggtctgtcggacgctggaggacttgcaaacgcctgtagacatgacacattcctacttgcgtgctatgtcgcccatccaccgtcttcaccaaggggccgaagggcacgcgaatgctttaggggaa

SEQ ID NO: 8617 - DNA, 231 bp, A.fumigatus
gatatctctccgcactggattgtcagcgatggccagaaattccagactgacagcttgcagctcaagcttgatagggcgaagcaaagggaacaggcaatcaggaaagggcagatggcggatcccaatcaacctacctcactgaatcaagccattacacccgtcggtacctgtacgagtatgtgtcccgtcctcaccacggggctggaaggatgcgcgctgagagattcattt

SEQ ID NO: 8618 - DNA, 849 bp, A.fumigatus
ttattccagttcgttctttcagctctcttccatcacatcccacttcctgttcaaagcaacctccgcagacagaccatgaacacggccatcatcactggcgccgcccaaggcgtgggcctctgcattgctgaagcccttgcccaacgcaactatcgcatcgtgctcagcgacatcgacactgaaaagggccccgccgctgcctccaagctcaacctcactcacggcgagggcactgccgccttcttccattgcgatctctccaatctacgagaaattgatgccctcctctccttcaccatcgagaccatgggcggattttcggtgctgataaacaacgcggggtaccttcgcgcgccgttcctcgcgctctccgcgcaggacatccaggatatgatcacagtcaatctgacggcgcccatttacgccacccaacaggctatcaagtactgggatgggcttcaccagggccaagccggatgcgtggtcagcgtgacctcctcctcgtcgttcaagacgtatgcgagcatcgcaccgtacggggcggccaaggcaggcgccgccatgtttacctttgcggctggggcgtttcatccacgcgtgagggtgaatgcggtggcgccgaccgcaattgcaacgggctttgacaagaatcgcatgcgggtagagacggaccgcacgggcccagggtatacacccgaggaagagatgcgggcaatggggttgaagaggttgcagccgcaagaagtggcggaagcggtggtgcgatgtgtggaagacaaggggctgtatgggaaggtcctgtacttggatgcggtggaggggatcaaaatacatgatggatatacgtag

SEQ ID NO: 8619 - DNA, 450 bp, A.fumigatus
agtgcgctaccttccagcccggtcgtgaagatgcctcgggtttccttcaccaaggggaccaccttgcaagggcactatatcccgccgggcaccgagatagcattcaacctcatcgccatgaataaccgcgaggacgtctgggaggaaccggagaggtttctgccggaccggttcctgaaggattccgatttgaagcgaagtgtctttgccttttcgtatgggacgcgcagctgtatagggcgccatctggcatggatggagatgatgaccattctggcgaatctgctaaaggactacgattggagtttaccagaagacagtctgtatggaccacatcatgtagatgagaaggggattcccattcgcatgccgtccaagtgccatattgtgtttgcgccgacgcatccggacagagactgtcaattggtgataagccggccaaagacctag

SEQ ID NO: 8620 - DNA, 297 bp, A.fumigatus
agtagcctgaatataacaaagatcactaagttactctacgtatatccatcatgtattttgatcccctccaccgcatccaagtacaggaccttcccatacagccccttgtcttccacacatcgcaccaccgcttccgccacttcttgcggctgcaacctcttcaaccccattgcccgcatctcttcctcgggtgtataccctgggcccgtgcggtccgtctctacccgcatgcgattcttgtcaaagcccgttgcaattgcggtcggcgccaccgcattcaccctcacgcgtggatga

SEQ ID NO: 8621 - DNA, 1467 bp, A.fumigatus
  unsure (186),(235),(240),(1313): Identity of nucleotide sequences at the above locations are unknown.
gagtcgtctgctatcagattgttcctacctacttctttacctagcatctttcgcattttgatttctctgttcccttttacaacgctctgctcatcgctagtcggtccagagactcagtcacttcatgacacaatggccgtcgccaccctgatctctattctcttcgctgttttggccctccggctntgctacctgctcatccatgctctgttcctctccccccttcgccatatcnccgcnccgttcatggcccgtgtgacatcgaaacgcccgctctggcatcttctcactggcaaggcggaaatcgcagcgcgccaggactattccaccttcggggacatctacctctgcaaacccaacacagtgtacctctgtgacccccacgatgcctgtacggtgctcagctcgcacgcattccgtaaaacggatatgtaccgggtgtttgaatacgagggcatcccgaacgtctccacctttactgatcccgcacaggcacagcgccgtcggcgacaactgcacccattcttcaacaatgcgtatctaacacaaatggagccagtcatgctgaaatacgggatccaggctctcaaagcgcgctgggatgcccagctggccagacacaagaaggtggaggtgaattaccggttcgatacccaactggccatgtttgacatcactggcgcgctagtgttcggtcgcgagttccacgccctggagacgagcaatctcgtgtatacaaaatgggtcaacaatacgctgtcgtacatgctagtgagccactacttcccatgggtaaagcgggtcccattatcctggttggtgaggggcctcaaacagtcctacgatgacctagtggcctttagccagaagtcgattgccatccgccaggcagacctgcaggcggggcgtccgaagcctgcagacctgctgcaggcgctcctcgacgcggaagatccagattccaaggcccctatgaccgcgcgcgaggtgcaggcggagagcattgccatgctggttggaggcagcgagtcgacctcctctgtcatctcctgggtgattcactttcttttgctctacccagagcatcttcaggcggttgtggccgagactcgcgccaacttccccgccgatcacaccatcacattcaacgagagcaaggccaacctcccctatctcgaggcctgcatctacgagactctgcgttgtatcccgacggcgagcacctcctttccccgtgtctcagaccaggccatcatcctgaagggctactacatacctgccggtacagaaatcgccactaacaagtgcgcggnccatctacaccagccctcctggcaggatccagaccggttttaccctccgcgttttctcaaccagggagacataccacgaaacccggcggaatatgctcttcgttgcctaccggacgccggttttgatttggccggaacctggcttgggccgtaa

SEQ ID NO: 8622 - DNA, 258 bp, A.fumigatus
tcccctccaccgcatccaagtacaggaccttcccatacagccccttgtcttccacacatcgcaccaccgcttccgccacttcttgcggctgcaacctcttcaaccccattgcccgcatctcttcctcgggtgtataccctgggcccgtgcggtccgtctctacccgcatgcgattcttgtcaaagcccgttgcaattgcggtcggcgccaccgcattcaccctcacgcgtggatgaaacgccccagccgcaaaggtaa

SEQ ID NO: 8623 - DNA, 189 bp, A.fumigatus
tgccgggaacgaaccctaaaagtgtatatcaccagaatcaatgagttgattcagccagcaggtcagttcttgggtcggaagcgtcagtgtctccagatattcagcgacaagtacagtgctgccttcccttcacctgttgaacgcgactctcacaatgcgaatattggaaagtatcaggctaatgagtga

SEQ ID NO: 8624 - DNA, 939 bp, A.fumigatus
cggggttcgtgggaaaaccaggagaatcccgggagaggattacggggaaggcaacgccggagggccttggaacctaaatcagctcacggggggaggatttatacgggcagtggtatggcgtgcatccctggacaacatacagttgctccatcgtcggaatttgagactggctcgaagctccttgcggtgcgtccggcaaaccggaacaagaaaccaccaccaccaccacctaaaagtcatcatgggaagttgatcaaccccagtcctcatgcgacctcctctcagccccagggggtaccccctcggccaactaagcggttctcctaccacggcacatcgtcggagacatccctttctttaacaccagatacacctcccagcaggtcatctcagccgaggattgattattttactccactacatgataaccccgctcctcaatcagcagaaacactcagacgtagccagtcacagcacaagcggccgccgacgccgccgctgagtagacggcacagtcagatgagaagatccaaaagcactatgtccagaacgaatctgtctcggctatcaatgccagctggaaagattgaggtgaacgcatctcctccttcgagtccaggtcctcaagctcaggagcccaggacagctccgccgatggcagatgaggcagaacctgatcctggtcaacgtgagccgccattgtcgaggcgagcgtcgcaggtgaacccgctgccacctcctcccccaccgaggagggaccgagtttccagcaaccatagcaacagtaggagccagtctgcacagaagaagcaggcagaggatgaggactttatccctcgtccgtcgaatgccaatgatatcctggccgatttgtcgcggcttcagaaagaagtggatgatctccgtggtcactatgagagccgcaaggtcagtcactag

SEQ ID NO: 8625 - DNA, 1056 bp, A.fumigatus
gtttacgcaagtgcggttccttccagccgcgtggtgaagatgctacttgaaacctctgcaaagcctttaacttgccacagagtgcctccaagcttcctcgttggtgagggtgcaacggactttgcttatgagcaaggattggtcatactgcctcctgacgggctcatatcgcgcttttcgaaagagagatggcaccgctggctgcaggatctcgaggctgctgaactagtcgaaagaaaacgggatccttcacgtttccgcatggaagaagatagagcatccttccttcgtcggccaatgctgaatcgtaatccagcccgcctcattgacaatacgcgtttacgcccacatctacccagctctcccttcaccggagtcgacttgctgaacccccttcctcgtctccaggctcttggaagcagacaaaccatagctcctgcaccaccagctatgccttcgaaccaaggacacggcatgggtcctgcaattggacaacctatggctgtggcaggtggacaaagtatggcttctgcacctgagcaaggtatggctgcctcggccaacacccatgcagatggtgcgactttccgcgcgtgccctacaaaagcaccttgtgcacctgacacttcgacgactgctcacccgggcgctgcagacgaggatgaagatatgatcagcgatacagtcggggccatagctgtagactgttatggcaatattgcggcaggttcttcgtctggcgggattggcgcgaagcatcgcggtcgaattgggcctgctgcgctggtgggcatcggcacctatgtgattcctgtggatcccagcgatcccgaacaagtatcagtcgcttcagttacatcgggcacaggcgagcacattgctacaactatggctgcgcagacgtcagctgcaagactctattactgtcaaaagaagtgtaaggacggtactttcgaaagtgtatccgaagacgaagctatgaatgcaatcatagccactgagttcatgggtgagttattgtattccatattccttacgaccattgatagagaataa

SEQ ID NO: 8626 - DNA, 228 bp, A.fumigatus
attatagaaggcgaagaatggaagatagcttttagaataaagtttagatattttaaatacctagttatactatttagattaattaatatactagtattatttaaaaggtttattaagaaagtactacacaaggttctgcattactttatagtagtctacctagataatattttaatctttttagaaaatagaagtaaatatatagaatatattaaagaggttctataa

SEQ ID NO: 8627 - DNA, 684 bp, A.fumigatus
  unsure (376): Identity of nucleotide sequences at the above locations are unknown.
gaagacgacttccccgttgacgttcgctacaacggcaacaaccaacaattcgctcccccacccggtactagcgatggccggcccccagctacggctctcagcgaaaaggaggaccacgaccagccaggcaccggcacctccaatcgccacccctcgatcctccgcaaagggatgaacaccgctgccgcgcgcgcccgtggcgaatcaatctcccgcaaacacgttgacttctcactcggcatgcgtgacgtctcctcgatggatgtcatgggcgatgtctttgaaggccgcggccgccgcgttgacgaagttgtccgcctcgcgaaccgcgaaaatgacgaacggcgcatccaggaagtagaggaggagggagaanaagagcgcaggagccgcgcctcattgtccaagacccgcacttccaactccggccccagcgtccgcgccgccaccggctccgatggccgccgttctactgactcccacggtggccacagcatctcctccatcagccgcagccgcttcttccaccatcgcacacaccccgtccaagagcaagaggacatgatggaacaggggcggtctgacatcggcccggcgctgtcgcagatccgcaccatttcaccttctgctcgctcgacagacgaccggggtagcactatcaaccggcaaccgacaggacattga

SEQ ID NO: 8628 - DNA, 216 bp, A.fumigatus
gatagaagtcaggttttcttgacagttcactacatggcaaggcattgcataccaatctgctttacgatggcgcatcttctttgcatcaccaaagacctgtttcaatatgcatcttcacttgtcaaattatcctctcctatcaagagtgtcacctctgcctctcctcacttgattttcgtctcccttttgctcttttatctgatttgtcaaggctaa

SEQ ID NO: 8629 - DNA, 471 bp, A.fumigatus
ttgaccgggaagaggctgacgagacaggacgtaacgtgtggcctcctcgccatcttccaatacggcctcctcacctccgcccgcgaaatcttcaacccccgcttcaacctcacttccgccctcgtcagcggcctcttctacctcgtccccggcgcgggattcctcctggggagtatcatcggcgggagactgtctgaccgcaccgtgaaacggtatatcgctcgccgtggaggactgcggctcccgcaggatagattgaacagcgggctggcgatgctgtgcggggtgctgccagtcgcggtgctggtttatgggtggacacttgagaagagagccggaggcatggcagtgcccatcatcgcggcgttctgggctggagtcgggctgatgggctcgtttaacggattgaatacgtatgctgctggtgagttttctatggggaaggtgaaggtgaatgtgaaggtgatgtga

SEQ ID NO: 8630 - DNA, 507 bp, A.fumigatus
cgtagcgcggatccttcgaccgctcgtggtgaagacagcccggcgcaggtgcacgatgaacaattctcggacccagactaccagacggccaatatagagctcgctcgtattgtcggcgaaactattgcaaaactctacagccgacgcaaatacagcgagacgttcctccagcgcgtgcagaagctactgaaagcattgaaaaactgggtagatacactacccgaccatttgcgactgaacgagaacgaccctgagatgaatccgaaacatatcagctctctgcatctggctttcaaccaggtattgtatttggcctcctctttcttcgaaaacaatactgacttggacagtgtgttgtacttaccacccgtccgaccctcctccacctcctcatcaaagtcagcgagtccgagaccgaccccacgagcaaggaccatgccatctcacaacccgtctggacgctgggtgaagcgtgcatacatgcagctcgccacagtcactccctga

SEQ ID NO: 8631 - DNA, 1398 bp, A.fumigatus
gagggactgctcgacagagcggggggtcataccaaaaggggacacgcccccacatcgtggcgcagtttacattttgtgtcggaaagccgcgtttccataaccgagcggttccttggtggcttcagaaacaagggctggacaggaaaaacggggatgcgcgccaaggctctattccgactgacggatgactggctggacatcacacccactctggccttgcgctccgaccaagtagagccaaacgacgagcgggcatggcagcgtgacattgccaagtttctgaaaaaggctccgtcgcgtgtgcgcgacacacatcgcctgcgcgagacggccgtcgcacggattcctgctgaggccggcgacgggtactttcaggttgtactttgtcagggccccaaaaaaaaggttctttgtacgagtccagtgtttcgcattctttccacctctcttgaaccgagctcgattcggggcgctagtttggctaccctcccattggaggtgggtgcgatggtgctggggctatacgcgcagacagcggcgcagaccgttattaacccggccacatcgctcgtacaatcaacaattcaacctcttaagccctcctgggtcacacagactgctgctgagacagcctacgggattggcatgtccatgcgatcaagcgatgacgacagtactcagggccctgcggcagcaatggcccgcggtcaacaggaagcgatctctttagagacaggaccgagtccgccataccccatgagcttcaaagcgcgagctgaagccattcaaggagaaagtgtctatgacatgcaacggatgcgactcagtaaggttcccgatctgattttggaccggctacatggtttcttcttcggctgggcgcgacttctattcgccagagagaatggcgaatggacaggttctcaatggtatcaggccatccttgcaatccgcaacctagatctttctcagcagacgcatgtgaacatgtcccaggtgatgaaacgcgtcaccaccgttcgcttcctggaggaggttgaactacccgttcagtcccgcgtcgaggtacgtgtactcggttttcttcggcccgatatgccgccgccccgcggaataactgaggaggaattgcttgaagccagaaatgccgcggctgaagcggccatgttggcggatgcgtgcgacgcgtcgtacgcccagaacgtcctggatcatccagcttggggaccagacagtcaaagagaagccggagttgttggtcgtgccaaagaaggaattgaaaacatatgggcgcgtggccagaaggtcgttgaacgggtcccactgcattggctgggagtgagatctcctacagcagagatcttcaccacggggctggaagcatccgcgctaacgaat

SEQ ID NO: 8632 - DNA, 447 bp, A.fumigatus
aaaaggctccgtcgcgtgtgcgcgacacacatcgcctgcgcgagacggccgtcgcacggattcctgctgaggccggcgacgggtactttcaggttgtactttgtcagggccccaaaaaaaaggttctttgtacgagtccagtgtttcgcattctttccacctctcttgaaccgagctcgattcggggcgctagtttggctaccctcccattggaggtgggtgcgatggtgctggggctatacgcgcagacagcggcgcagaccgttattaacccggccacatcgctcgtacaatcaacaattcaacctcttaagccctcctgggtcacacagactgctgctgagacagcctacgggattggcatgtccatgcgatcaagcgatgacgacagtactcagggccctgcggcagcaatggcccgcggtcaacaggaagcgatctctttag

SEQ ID NO: 8633 - DNA, 342 bp, A.fumigatus
caaagcatgcaaaacacaaatcataggttggcatacctcactctcaatagcactggcttcatcgtcactctcggtggcggccataccacctcctacaccaatcccgccatcccgggtctgaatacctctcctcttggccaagttttcttctctcttctgctttctgatctcaacctgttgctcttcacgacgacgacgaagctcgtcaggccggaactggttcctggccttgaactgggtgcgacgatgctcggggatgtagcgttcggccatggttgcttgggacacaagaggggtgaaaacaaagcgcaccaaagaaagtggggagcgaatctgagatga

SEQ ID NO: 8634 - DNA, 306 bp, A.fumigatus
aaatcgaaattcaatgaaatggtcaacaagtcggctgctcgccacgtcagtataactactgccctctcctcttcggggcttgtaagtgtgattggagtggtggtggatgtcttcgggacgcccttccagtcaagtcgttcctggtgtatcacattcaccctcaaagacactgactttggcaacggacacgtttgggatgggctgaagatcaagtacttcaaggctaatcaaagtcaactcccgcctgtccgagtgcacgatgttatcctattacgcaacatcactgtaagcgatttggctctatga

SEQ ID NO: 8635 - DNA, 255 bp, A.fumigatus
ctcaacgtggagctcccggagatggtgaagggtgtcttctccgaccagatagagtcgcagatccaggctacaaccaaattcagaaagcttctctccaaggaacgcaatcctcctattgaacgggttatcgagaccggtgttgttagccgatttgtggagttcttgcgctcccctcacaccttggtgcagtttgaggccgcttgggccctgaccaacgtcttcacctcgggagtgccggaccgcgctagtttacaa

SEQ ID NO: 8636 - DNA, 549 bp, A.fumigatus
cgtcttttttgtcaagagcttatctcaaagcgtcttttttctttccctcctttctctgagatctttccctcatctcagattcgctccccactttctttggtgcgctttgttttcacccctcttgtgtcccaagcaaccatggccgaacgctacatccccgagcatcgtcgcacccagttcaaggccaggaaccagttccggcctgacgagcttcgtcgtcgtcgtgaagagcaacaggttgagatcagaaagcagaagagagaagaaaacttggccaagaggagaggtattcagacccgggatggcgggattggtgtaggaggtggtatggccgccaccgagagtgacgatgaagccagtgctattgagagtgaggtatgccaacctatgatttgtgttttgcatgctttgctatctgtctcgagttttctccgcccgcagacgcatccatggtctttatttgtttttgttcactatacgctccacaacagcctttttcaccgccccccccccgttgctgggctaagtgggatccgccgtctcagttga

SEQ ID NO: 8637 - DNA, 288 bp, A.fumigatus
aacgcacagcgttggattttccggcccgcgtggtcgaagacaacattcaccggggatggctccgccaaagaccccgactttcaaggatccaagttcaaagtatcacctcacgtcgatcagacggcggtctaccaagcagtattcggcagactcaacgcaggtggctgtgtgggtatctttccagaaggtggcagccatgacaggccgaatctacttcccttgaaaggtatagttctttccttcgatttgcctcattacttgcggaaacctcggctgattgaactctag

SEQ ID NO: 8638 - DNA, 1194 bp, A.fumigatus
gtgattcaagccgctcgtcgcctatataacaccaagggaaagaacctcccgcttcctatggtggtcgagctcaaccgccgccttgtcaaaggttatacccactataaggatgaccctcgtgttatacatctcagaaaggccgttgccgactacaacaagcaactccgtcttctaggcatccgtgatcatcaggtagagtatgcgaaattctcgtggattcaggtcattgctaccctgatctatcgtctgggcaaattagctctcctgaccatcgggacactgcctggcttgattcttttcgcacctgttttcattgcaacgaaatacatctccaagaagaagtcgcaagaagcactggccgcatctaccgtgaaacttcaaggacgtgatgtcatggcaacctggaagctactcgtcgcccttgctttcgcccccgcagtgtatgcattctacactgcaaccttcacttggtgggcgtattacaaccgtatccaggggcttgttcctgtgtggatgcctttgtggttgattgtgcctatcgggatgatcttattcccaaccattactttcgcagcgcttcgcatcggcgaggtgggcatggatatcgtgaaatctctgagaccattggtgctctctttgaatccttcctcagccaatactcttgtgaagctgcgcgaaagacgcgctgcacttgctcagcaagtcactgaagtcataaataccttgggcccagagttattcccagactttgatgctgcaaggatcgtcacggatcccttccgtgaagaccaccgaccagccggaaagacaggagttgatcattcagctgtgcctgaaatcagaagaactagcgcaacagatacggaagtggaatctccaacacgggaacctcttcctcgcaatgagtcgttccacaaccttgccaacattggctttttctctacgcgaccttcgagccgttctcgaagccgtagtggttcgtttggaggtcgacctggctcctcagggcaacagttgaagccactgagccaggtgacaacgaaagacgggtttgaagaagtcagctcgaagattcgcgacgctatgcgcgaacgaggcgaacgcaggcgccggagaagcgaggatggaagctgggacatggccagctctggtccaggcacgccttcgagtgaaggaagccgaaaagatttataa

SEQ ID NO: 8639 - DNA, 360 bp, A.fumigatus
actctagctggtgtggcattgatggcgctgggtactctggcggacaatccggactgtggcttgaaaatcgttccatgcggaatgaactatttccacgctcataaattccgttcaagggccgtgattgagtttggtaaccctatagaggtaccacgggaggtggttgatcagttcaaacgaggtgaaaaaagagaagccgtcggcgcactgctcgacaccatttatcagggtcttgtatctgtaactgtaactagtcctgattatgagactttgatggtcggtgaacccgcctttttcggaccatggtatctgtggactgacgtgtttctaggtgattcaagccgctcgtcgcctatataa

SEQ ID NO: 8640 - DNA, 540 bp, A.fumigatus
agcgcgtttccttccagccccgtggtgaagacagtctatccagaaaattcgcagtaccctttgcagggtgagagcgcctccgccaagcctggcgaccacattacgatgcactgtaagcagcagcgccatatctcgtctagaccctggacatgcagatctaatcatccttcagacaaatacgacgactcgtctcgcaactacacgcagacgctctccgtgaacgggcaagtcgtttccacactctccaccagcgacggatatgcccagggctggggcagcgctgtggagtgcgccgcaaccgactgcggcaccgtcggtgctcactgtaagttaacgcggcaactggctgttcagaatcacgggctaacgtgcactgtacttttagcctggattgacaccaagattatcctggacagcccggatcccaactacaaaaacaccaactacaagggccagggtgtcacgggcgagatgtccacttccgatggtggcaagacttggactgttagcacgattaacatccctcagtttactttctaa

SEQ ID NO: 8641 - DNA, 201 bp, A.fumigatus
agagaaacagcaacttctcaaagcatacgaggaatccttcgacgattatcggacggtcaagagggaattggtgcactccttttccaaggacaggttaaggattatgaagccttcttgaatgcgacctcatcctacgacattgttatacatggcgctgccaagatccgtgggcgtcacagatacagatatcaacatacatag

SEQ ID NO: 8642 - DNA, 195 bp, A.fumigatus
ctgcgcttcctgatgaatagcataggttatcattcagtgttttatctagcaagtcagttaagtggcttttgttcaggcgatcatttcctgcgcgagcacatactactgcgaattaagaaatattctaagggtggtctagatgttcgctatacagacaaatgctctaagagcagcctacttatgcttgagtactag

SEQ ID NO: 8643 - DNA, 798 bp, A.fumigatus
tcgtttatagattattcaagcatctgctgctttgtaggcaccaacagaggcaacttggcaaccttcaagatcctgcccggagatgatggggcttacatgggtcaattcgccggcgtaactcagctcgatgacaaggttttgaatatcatacccattgatgcggatcagggtacccccgcgctagccacagcaagcatagttgcaggcctcagaactggcgccaaacttaacggagtcgtcattgctgttactgtttccggttgcaggatttttaaacctgcaacatccaagggcgcgcacaagtcctgggatgattatctttgcgatgccgcggccgttgtgaagacagaaggccgtggttacagcctcgttggactattcggcgatggtaatgctagggctttttctatccctggacttaaggaaataggctgcaccagtatccatcaaattgccgacatgagacgtctctcggactcgactgtctgtcctgacggtagtgttctgacctggacaggtccctcggaagtagccgtgttcagtgtttggggctctggaaccggactgtatggacctctgtcccttgatcctgtctttgttcaacggaaagaacgacctgctaacaaacatgatagacgatcatcggactgtcgactcttcaacccacaggcagccattcctgcacgtcctacgattacgaacttgcaatggatctccggcacacaatatgtgtccccggccgacatggatcttctgagtatgtgcattcgttgcagttgcgataacaagtctagatag

SEQ ID NO: 8644 - DNA, 300 bp, A.fumigatus
atatgcaacagggggcccgggactgctgtgaagcatagccatgtgggtttcgttgctgccggttttcaaaacggcagctttgtcatcatggacttgcgcgggccagcagtcatccatactgcccaggtatccgattttgcgaagaccagcaaacgtggaagctttctcaagcaccgcgctactgaaagcacagctccggagtggcccacaagcattgagtttggtgtgttgaccctggagggtgaaggtaagatctatcctcttgagctatgggtgcaggctgatactgatcgtttatag

SEQ ID NO: 8645 - DNA, 831 bp, A.fumigatus
tctatgtcctgcggcggcgttgtgaaaaccgagagcgacgggctgtacaagcgcaacatcaaggcgctcattctgcagacctaccgtcatgagcaggacggccaaggccaagccgcgagcgaaaagtcccacgcggaggccgagttcggcttcgacggccgcgtcgagctgctcattacccggacccgcagccgcaaaatcaccttcatcgagccggttgcccggctggggttcgggctggccgttcgctccgccctgagagtggtcgagaccccgtacgtctgggtccagcagcatgactgggcgctggaggcggatattcccctcgagccgctgctggagatcatgcagggaagcgaggccgatgacgcggtgccggtcaaatatgtctcgttcccctcggtgcggatgaagcggtatgcggtctcgccgcatgtcacggaccatgcggcgctgcgggaactcaccacctccttgaagcgggattttgtggttcggtctccgtctcggccggagcggaagattgcgctgacgccgctgtttttctggttcgataaaccgcatgtggcttctaccgcgcactatctggcccgggtgttcccgacgccgctggcgatgcgccgcggggagttcatcgaggataaaatcgggcagcgggcgagggcgcagatgaaggaagggcagtgggccaagtgggccacttggctgtactacccggatgagggagacttgctgtgtctgcggcatttgatggggcggacttggagaggatttgggggtccgatcaatgtcaaggatggttttcatattgctacggatgacgagtcttaa

SEQ ID NO: 8646 - DNA, 270 bp, A.fumigatus
atctgcagaggctactccgcccacgaacacacagtcctgtacagcaatgtgcgtctttcctcggcctccaccgcacttccccacgatattgtcatcgaggccttggtctccctcgtcatcgtctccgcgggcctcgtgctaggcgcagagaaactcaagccgattagctggagcgaatgggctggggagattgagagggaaggcggcgccaggaatccttatctgcggctggaagagcgatacagtttctgggatattagggtgagctga

SEQ ID NO: 8647 - DNA, 201 bp, A.fumigatus
acgtatacttcatggcttgccagggtctatgcagtaggcgaactcttcgcttatggggccatcaatgatagccgacgcaccactaatctagctggcaagtcggagaagtggaccgtgagagtcagtcatgagtcagatctagacaacctatgctccgcgcagccatgcgctagtggcaagccgcctgcaaaggggacttga

SEQ ID NO: 8648 - DNA, 555 bp, A.fumigatus
aaccttgcgtgctgtcactcgcgtccttccgtcctccaactacctccttccgtcatcactccggagcctcgctccaccatcaacacccaccttctaggcgtgattatctactttagagacgcaatgaactcccgcgagcattctgatatgcctccggctacatcttacccgtctcccaacgcggcgcaaatggctcagggctccatgccgtactatggaaatcgccagttgaccgccgacgaacttttgtccgccgagctctcgcgcgagacttccggaccaggcctgaacgacggttcgagtaacggcgtgcatcacggccaatcgatggttatgggctcgtccaaccccggtgccactgatatgggtcgcccttcatcgccggaccaacaccaacaacatatgctgcagttcactcccggtcagcaggtgggcgtcgatccgaatcatgatctgagttatggagaccagagcgctagaaggaagaggtcgaagatttctcgggcctgcgatgagtgtaggcgcaagaaggtaggagttctatacctcatttag

SEQ ID NO: 8649 - DNA, 423 bp, A.fumigatus
  unsure (156): Identity of nucleotide sequences at the above locations are unknown.
caccaattgttcttagcttactcttcgttcctggtcgaaatggtcactcttgccgccatggagcacaatgtgtgccaatcgaatactggactgggtcgcatgatcggtgcgaatttggttgcttctctcgaacgtctgggacagattgaggacctncggaagccctatgatgcagcccgagaaacaccatcgcacgggttcttcgaaagccctgcaaaccaactctactgggactgtccgctgctcatcaaacggcatatctttgtctacagcccttatgaagataattactggccgggggaggttaataatgagctgcttaaagcgactatggagtcccgccctgcgacgccttttgatctccacagtttaaccgtagctttcatgacccttgttaaagctacttgtcttaccggacacaac

SEQ ID NO: 8650 - DNA, 627 bp, A.fumigatus
ctgactataggcagttactatgccaagattcacaccatcttcccaatcctgccgcattcgaaggaccggctgctagagattctccatcaatgcagtcgcgaggtccaggaagtgtttttgtacgctctgtacactgtgacgcgcacgaacttggaccgggtgctgagcaccttcgagagagtgacttcgtttgataatgcgcaggatcttctgttatattacactcggcagccggccctggttcgtccaactgccgtcaacctggtatggcttcaggctacgctgctcatgatcctggactgtgactcgcgtggtcccgagaacattgtcctcaaagatggggtgcctaaacattctttgattcagtccgccaccaaactcggttctgatatggcgaagagtcttgatcaattgaaggctaaacggtcctcagacgccgacgtggactcagatgcaaatcttgtgaggcgcagttgggtatccctagctatactggcgcggtggtatgccatcagtgtagccgatctgagcgtcttggtgaaccaggagataggtggtcgggaagatgaacgcgttcttggatctgtcaccgcagggattggtggtacgtcttaccacattatctaa

SEQ ID NO: 8651 - DNA, 588 bp, A.fumigatus
caaagggtgagaagcgcagcgccatctgctactcggcatgtaggaacgaagttgctgacatgggttatcagttatatcaaggaacttgcggagcgtctacacactctcgaaagtcagatgcagcctgctatggtgcacccggacatgcagtaccaggccatgaatgaggtgtcgcctccccgaccctaccaggaattctccccaccaatggatgccggctctattggacgtaagaagacgtattctgtttttgagggactgccggctggactacccaatacatcttattctcagcctcagttcaaccccagaagttcgcaaaatgcattcggtttgtctgccttacctgcacaaggtgatgttactaaactgactttgatagatgctggcgagacctcgacagatccaatgaactcttcggttatgggaaacactgcacccaaacctggaaatctgttctggtcaacaaatgagcatgagattccacatggccttgacatcccggacgtgtccaaacacggtatcgaagaggacatgacgcctttggacgtcgatggaggtgctctcaatgcgtatgtttattcatag

SEQ ID NO: 8652 - DNA, 387 bp, A.fumigatus
tgcatcttgacttcgttttccactatacatgcctttctggataacttttctctgttcttccttccccctttcacatatacaatcaagatgaagcaattcttctttggtagcgattctaagagccgaaagccacggcctgtcgaggataagtggatcgtggaagagcgttccatcgataaagcccgtcctctgagagtcgttatcattggatcgggcatttctggaatcatcgcctccattcgcttcagacaacggatccccaacgtggatctctgcgtgtatgagaagaatgaagatatcggcggcacctggctcgagaacagatatcccggttgtgcatgtggtaaggctcatcattttgttgcgcgagttgtctggcgtcaatga

SEQ ID NO: 8653 - DNA, 246 bp, A.fumigatus
cgaccgacgtttacgatgttcgcagacatcccagcccatacgtatcaagctacttttgagccaaacaaagaatggtcgacgttctatgctgccgctccggagatccacgcgtactggaaacgtgtggctgaaaagtatggttgcatgaagtacatcaagctgaagcaggcagttgttgaagctgtctgggacgactcgaagagcaagtggcaattaaaggtcggcactccgtccccggtctgctga

SEQ ID NO: 8654 - DNA, 210 bp, A.fumigatus
ggcaaaagagctgcggtgataggaaatggatcgagcggcatccagatcgttcctggcatgctaccaaaggtagctcacatcgaccactacattagggggcgaacatggctctcccccacctttgcccgccaacatgtggataaacgagggggagctgaactggagaactgtttgtcaacccatccagttatgcagttgaaagagtattga

SEQ ID NO: 8655 - DNA, 756 bp, A.fumigatus
gtgcttcttgttgaagatgccgtgagcatcggttctaatgctagggcagaaatcgaactcgagttgcaatcagtccacggtgtgacgctacttggcacacctgaacagatcggcgcgagagaggtcttcctacagaatatgaagcgccgactctcaaggaagcctgaaatgtgcgaagatttgataccctcgttcccccctgtgtgccgacggctcactccaggcccgggatatcttgaggccttgacggacgacaaagtggacgtcatcacaagcaagatcatcagagtcgatgcagagggaatcatcacagcagatggacaacatcatcccacggatgtcctcgtctgcgcaactgggttcgacactacgttcaacccgagattcccagtcatcggacggaacggtgtcactctagccaatcgctggcagaagacaccagagacctatctctccttggctgtcgatggattcccaaactatttcatctgcttggggccaaacgcggcactaggcgagggtaacctgttgcttctgattgagaaggagattgattactttacgctctgcgtgcagaagatgcagcgtgataacatccgagcgatgagtgtgaaaaaagaagcggtagaaatgtttactcgctactgtgaccagtacttctcaagaacggtattcagcgagaaatgccgtagctggtacaagggagggaccgaggatggcagagtcattgcattatggcccggtacgctctcttga

SEQ ID NO: 8656 - DNA, 210 bp, A.fumigatus
ccagccataggttcctcgctgcattcaatgaaagctcttgcgcatcctcgttgggaggattacacgtacgactatgtcaatgacaatccaaacggctggcttggagacggctggacggagaacgaaaagttgaagaagatcaacgtggattatctgaatgatgacgaaattgattttccaacaaatgtcatcgcggtattggatcagtga

SEQ ID NO: 8657 - DNA, 255 bp, A.fumigatus
  unsure (132),(155): Identity of nucleotide sequences at the above locations are unknown.
atgctctcccggcagccgcaagaatcattctaccatctcagtaagcgagcaaccgtcttcctttcatcagcatgggctgcactcgtccccgtggacgtctcggattcagaagatgttccttatccgttacanacctcccccggacttctccctgnactcgaattatggtttccactggtcccttcttgcttggcttcctcccagcgaaaaatcctccctccccctgtgggcatgccctggtcctcctctttctaa

SEQ ID NO: 8658 - DNA, 432 bp, A.fumigatus
tcttcttcgaatattctgggaatgaaagcacgagatgatgctaacgggacatgtacaggaccaaggatgaggctgtatgtcacgatgtcattcgcggagactgagagttaccagctgacgtgcaaccaacagttgctctatatgaactacaccggtgtcgtaacaatggggcctgcggaacaggctgtattctctggcaatgccgaggacggcgcgacgccgtttggaaactcctttactcactttacctttgaggtgagatcgcatcccgcatattatctaactttccagaatctaacaggactacagaccggtgatgagcgctacaaggagttcgagaaccgagtattcgtcggccagggccgattccgagtcgagaagggtaagcccgttgttgtcgaatataaggtcagccaggtcgtcaagggttag

SEQ ID NO: 8659 - DNA, 189 bp, A.fumigatus
ccaaagcctatgactggtggcactgtcaagagtgatcccggttacccccttgctcttgatgccgagtttgtcggtaccggcaacgactacatccatgcggacccggacaacaagcacttgcgcttgaatgcgcacggagtcatcaagttagtcttcttcgaatattctgggaatgaaagcacgagatga

SEQ ID NO: 8660 - DNA, 198 bp, A.fumigatus
atgttcaagaacaagcttcagtttcaggggacctacccagaagtcaatctcaaggttcccgctaccaccaaactccctgtcgccgacctggaaagtaacggtcatcttatcaatcctatgcaatgtctcatgggacctttctctccaatgtgccctgagctggatgttgtgaaccggccccggctgggaaccaaccaa

SEQ ID NO: 8661 - DNA, 258 bp, A.fumigatus
ttacacgtcccgggcagacgcagaatctttactgcgctgactgatgcggcatgcatacaggagtcttccaacggctcgacattcgagctaggtgtcttcgagtatataaagtgtatggccaaagtggctctaacccttgacgacctggctgaccttatattcgacaacaacgggcttacccttctcgactcggaatcggccctggccgacgaatactcggttctcgaactccttgtagcgctcatcaccggtctgtag

SEQ ID NO: 8662 - DNA, 327 bp, A.fumigatus
attggcccaagatcccctggaggtggaaggtatgagcattgcatatgggcattgggtacgggctgggcggtgtcagctaacagcttctttgcagtgcgtaaactctccgaggctctggctcaggtgaaggatgaacaatcgtacattgtcgttagagagcgggtacatcggaacacagcggagagcacaaacgcccgagtgaagtggtggagcattttccagcttgccgtgctcattggtgagggtatcttccaggtctggtggctgaagagattcttcgaggtgggtgtgacgataccaaacagacctgtgaagagttgcaactga

SEQ ID NO: 8663 - DNA, 324 bp, A.fumigatus
ctttctgctgcactacaggttgaggaccccctaaagaaccgccagtacttcagacaagccgtatcatcagaggactactcgttcaccgcgcacgccgacggaaagtacgtttactgtttcagcaacgagggttggacttcgaactcaaaggaagtgtccttcaacgtccacggaatcgtctacgtaccggaacatgaattggcccaagatcccctggaggtggaaggtatgagcattgcatatgggcattgggtacgggctgggcggtgtcagctaacagcttctttgcagtgcgtaaactctccgaggctctggctcaggtga

SEQ ID NO: 8664 - DNA, 642 bp, A.fumigatus
ttgtcgtcgggccgaacacggacagatctccgcttgtgcatcaccaacacatgtcgattcgttgtgcacaccctagaaaaaacagacctcccagcgaaacattgtcccccgagttctcctattcgtccaacaggggtctactttacccgcccgttcagttccgtctctcttgctcagtcaccaataagtgatctgtcaacgatggccgattcatcaactccatcacagccttcagcgccgccgtcgtcgcaaccaccaccttcatcccagatcggttcacaagagcttccatcatcatcaacacaggcaacagtaccaggggagttatcaggtacttctgaacccccggttgtaccgaaagaggagcccaatacgacggatgtcgaagcccttgacgcctccatcgagcaggatattgatatgaaccctggtggcattaccaacgctgcaggcgcaagcgatggagataatacgatagggaaccctgttcaagatgcaatgcctacatctgtcgacgctatagcagcggcagtggcgccttcgaagaaagagacgagtttgcgcgagtttctgggcaagatggatgattatgcgcctattgtaggtcttacatttgtcattttcctcttgccttacttttga

SEQ ID NO: 8665 - DNA, 222 bp, A.fumigatus
gcagtacccatcacgctcccgtgccataatgtcgctcgccgtaagcgccagatgtcgatccagcagcaacaaaacaccatcgaacggaaaccccatacccccatcagaatcacctatatgttcttggactggttgtacgtgaaccgcttgcgggtactgccaaatgccaacggtcagcttctgcgtctgcttctgtgtaactgttgggacatctctcaatga

SEQ ID NO: 8666 - DNA, 474 bp, A.fumigatus
atcccagacgcggtaacagctcactatctcacgctcgccggcctcccacctccaggaaacggaccgaaccaaacgcccccacatctcgcccgactcctcgctctcgcaacacagaaattcattgctgatatcgcggcggactcatatcagtacgcccgtatccgagcctcgaacagtacatcagccagcaaccccatgggcagtctgaacgctgcctccggtttgaatatgcccggcggtgctggatccggcgccagcaggcggcgcagcaggcgttggtggcggcgacgcaggcaaaggcaaagcgaacacacatctgggcattcagcgtcctggttttggcggtggtggctccggtggctctgggcaaggtcggacggtgctcaccatggaagacttgggcatggctgttgcagagtatggagtcagcgtcaagagaggggagttttaccggtagagaaggctgggtcctga

SEQ ID NO: 8667 - DNA, 231 bp, A.fumigatus
atatgcccggcggtgctggatccggcgccagcaggcggcgcagcaggcgttggtggcggcgacgcaggcaaaggcaaagcgaacacacatctgggcattcagcgtcctggttttggcggtggtggctccggtggctctgggcaaggtcggacggtgctcaccatggaagacttgggcatggctgttgcagagtatggagtcagcgtcaagagaggggagttttaccggtag

SEQ ID NO: 8668 - DNA, 621 bp, A.fumigatus
ttgagacaccacgaacccaacaacatcaagccccatactcctcgaactctcacaagccacatctcattcaagaccacagtagcaaaccttacaatgaaagtcttcagctccatccttgttctcctgtttgcgatcttccacctctgcctcgcagaagaccacccagaccggttccccgaccagaaacaggtcgacaaagacaactacgaggccgtgaccctagccgcagcgcaaaagggtgtccagctcgagcacggcaaacgctacgccttccgcgagaaatgggcccccgcctacggcgaatacatgtgtctgcctgactactcgcacgtgcggctcatcgtcggccagttcttcaactctaacacgcgctctggacggcaggctttctccgccaaagcctttgaaatgatcagcgacgaggccgagacaaagctcgggcagacacccgtcggtgggaaggttgagtctcaggtgaccgagaattggtgggcgaaccactattacaactacaagaagaaagagtgggtgcgcgtcagcaaggacagcaagtacgagtttctcggagaaacgacggcgacggatgcgtatatcgagaaccaaggtatgtggtttgactga

SEQ ID NO: 8669 - DNA, 1089 bp, A.fumigatus
tctgatggtcaatcgcaactcgttatctgcggccttgctgttccctgtcgacgaggatcaccctatgtcgtgaagatgtcggacaatgcgtcgataacgccccagacaatccccgcctcccgatctatctttcccaaagggcccaattttactctttctgacttctcaagccgcgattacatcgttaaagagtttgtcgaggcactttctgacagtactacctcaaatcgacgttctacggttggacctggtcctggcaaccagctttttgatcccaaaccactgattcgagcattcgaacatgctcaacaacgacttggtgaactttctggagatttggaaattaaagagaacgagctatcggctgcagctcggagagctgaggcacagcatgcgcaaaatctcggcacgctgggtagaaagttgaagcagaccatcgattcctttcaacaattggatacatctctaaatggagcagccctatcgggaggcgaactccctggggcgaccgggagtatggctgttgaaacaggaagaaggctagaggagttagaccgacagaggcggcgagcgcttgatgctcatttcctgattcaatgttgggatggagtaagtaacagaggagagataacacttttagagaacttaaggaagtcggggactggtgaggccaaagtcaggtcggcgcatattgcgcgacagttgctcaggataagtcaaagactcgatccccgcagttgggatgaattgagagcgaagaaaaacgatctgtaccgaaatgatgacgattctgttgacgagggcacaagggggaataccaatggtattcatcgaaacacgagagagataattgaaaagttctctgagactctcgagaaagatctcctgaaacagttcgatgatttctaccgcaaggcaaatttcgagggcatgagagactgcgcgactgtgcttcaggacttcagcggaggcgcaagtgtgaccgccttgtttgttaatcaacaccaattcttcattgatcgaagccagttagtgacagaagaactggggggcgatttggacagctgggaacaaattgggggatcctga

SEQ ID NO: 8670 - DNA, 801 bp, A.fumigatus
aggtggtcgtgcaggaagaatcagccatcatcaaacgagcattccctttttatgagcaggtgctgggcaaattcccaacaacgcgtctttcagcagtccatccagcagagactggaaatggttctggagaaagctaatggcatctcgtctttagctttcctccgatcgctacaaagttctcgcagctacattagcggcctggttgatgatctcaaggctcacggcttgactgaacatccagatcctgtttcgtcccaaacagccttgatattagatcagcagctggaggatttgttcgtgccctactttgttggatcatcttacattgaaagggagaaaaaatcactcgaagagttgtacacgtcattgttgttccggtttactacttttcacgctcggaggaaacgagcagcgacgacgttcatggcatcgatttccaagtctggaactgagctcctttcttccgctcgggacgcttacgtcaatcgccttgagtcctcggagttcacgcccactcaaaagaagatgctccttcaattggccgggttgaaagagcaaagcgactctatgaaacccactgagatcaagttgatggagaaggatggtctccctaatatttcctatgccaagaggatgttgaaatggctggctgaagcagttggacggggtttggaactgggctccaccagcgaaacaccaaaggatgtgtctgctttgttgagtctgctattgtctttgatgggcgagggctatgtcgaggtgtgtcttgacgctgtttttgaggccgcaatttcccagggc

SEQ ID NO: 8671 - DNA, 1416 bp, A.fumigatus
  unsure (754),(1387),(1393),(1405): Identity of nucleotide sequences at the above locations are unknown.
gcaccgcctgccaaaattttgcccctttgtatggggatcatttacattattcatgtgaagctcctatgtccgcgaaataacttaatcgatctcttctacaaaactagacaatcaacgatgcgtacttcgcgcacttcgaaagagacagcaagttttcttcaggctctctcacctcctacgcgacgccaaacgcgtagctcatcgaggacaaatgtccttcagcgctttgccttcaatgctagcgcaaatggccaagctgagactgcgcctacgacgacaggagctcagtttcagcagagtgacggtgacgatacttcgtcgctctcttcagttgatactgtggacatcgaggatatcttggaaccccctctgaaaaagaggaagagtagccccggcagcccgtccaccaagagaacgacacgagcacccggtagaaccatcacaaaacgcgaggccatcaaggtggaacctgcgaaaccaaaatcacgtcgtgtaccagcccgcaagattaagggcgagaatggttcaatcaagatagagccgccatcgaactgggagaccatctattccatggtcaagaaaatgcgtgagaacaatccgacagctcctgtggatactatgggctgcgcggagctctattggcgatcatcgtctcccagagacaaacgatttcaaacccttatggcattgatgttatcgtcccagaccaaggacacagtgacagccgtggctatgcagcggttacacaccgagntagggaacggaagagccctagcagaagatcccatagttaagaaagaagagcaagaagatattgacctcaagtcatcacagcctctgaaagatagcactttgaatctcgagaatatcttggcagtctctcctgagaagctgaacgagctaatcaggacggttggcttccataacaacaaaaccaagtatatcaaggcagcagccgagatactccgagatcagtacaactctgatataccctcgaccgctgaggagctcatgaagctgcccggtgtgggcccaaagatggcatatctctgcatgagtgctgcctgggggaaggacgaaggaatcggggttgatgtgcacgttcaccgtatcacaaatctttggggttggcacaaaaccaagacacctgaggagacacgcatggcattagagtcctggcttcctcgggataaatggcatgaaatcaacaagttgcttgtgggcttaggacagacagtttgtctacctgttggccggaggtgtggcgagtgcgatcttgctggaaccaagctgtgcaagagcgaagtcagaggacttctctcaaagaagaatgcaggagtgaaacccaaggatgaagttctgaaggatgatggcttggcgtctggangggcanaggtcaaggtanaagggaggtga

SEQ ID NO: 8672 - DNA, 225 bp, A.fumigatus
gttactcaggtcagccgccggtcgccgtcggccaaccgacactattctaccctcgcactccacagccacataccttcccttcgacataacgtcatcgtagtatctggctcaacaatgctaacgtatacggatatttcaggcggcctctggggcctcaaaatcaccatcccaccgaactaccctctcgcgccgcccaacatccgcttcacgactcgcatctcccac

SEQ ID NO: 8673 - DNA, 702 bp, A.fumigatus
  unsure (403): Identity of nucleotide sequences at the above locations are unknown.
gcggccacttttgatcaccaggaagtttcttgttcaggtactgatgtatttcagcttgacgaggacgttatcactatctcatcaccctcccttcgaagcgccctggttctctccaccgccgacaggcgctggattgacctccttacacagatcataaacgacacctgggatgaatcacatcctcagcgaccgaaggatcacggatacatgggttccgaagagttcatcagactccaatttgaggagtatctacttgcattgctgtcctccatgaaataccacgaggagctgcattcttgtagtagcggtgaatctggtcagaggagtagggcgcagttagaagcatacaatatcgagggtgatccggctttggacttcaatccggatttcctggcacactggncaaactacttccaattatgccttattttaaaacgcttaacgtccgatgctcttttattctcaaaccgttggagcctccgtcaatccctgccgcggggtggttctccaccattaggagggaccggttcagccggcgggctattccgccaacagggttggcgggagcctttccaccctgggaccgaatccggggttgcgatggaaaaagcccgccgcaagggcttcttccaaccaaggaccaatccttccgccaaacccgggttcaaggaaaacaaaagttccagcgcctggcaatttcca

SEQ ID NO: 8674 - DNA, 351 bp, A.fumigatus
ctatacacgatcggaaacatcaaattgttcctcaccgtgattaaatacaccccgcaggcatggatgaactactgccgccagtcaacaaaaggcttctgtatgattgcagttctgatggatttcacagggggcatgctctctctgatacaattgattatcgacacttccttacaagcagattggtccggcgcacagggaaacgctaccaagcttgtgcttgggaatctcacgatcttttttgacatcattctacttgtccagcattactgtctgtactcgcgcaaatcaaggagcactggggcgcagctgtctgagcatgatccgcttttgagaacagggaacgatagctag

SEQ ID NO: 8675 - DNA, 828 bp, A.fumigatus
ggagatataggctttgcagatcttcactgggtaatgaagggttcagttctagcatactttctttgcatgtgttctaatcacttggcttgcagaatctacgctctagggtcggcagttctgttcggcacctcatttcccgcagagatgaggagcaacgttgctcccataggtttcattttgggaagtattctgattgcagtgggacttggaggtgttcaagcttcagcgcagccttttatcggtagggggtgccccagccttgtgttcgctcaatttaaagaagaccctactcacttcctgcttagcagaccaatatacagagcaaacctggcggataagggttgcaaagaacggcaagcaagtagtcgaaattcccgaagtgactatccagtatatttacaatgtgtattattggtatgtagagtcgacagtacctttcaaaacagacgactttctttactgactggcatggatcatcattctaggatggtcaatgtcggttcattgggaagcattgccactacattgatggagaggtacatcggcttctggtctgcatatctgctggatctatgtgcggtgatgattgcagttgtggttgtccatctggcaaaaccaaagtttggtatgatacaggcatcgtcctctcagttattatcaacgattgctgatcccgagagaatcaacagttcatcctgtcgcacaagcgtccgtccttccccatgccgctcgctgcctatggtatgctgctcggggtggtttcagcctagatgctgcacgtccagagtatcagttggagaaccaccacggaatggtaccatgggataa

SEQ ID NO: 8676 - DNA, 450 bp, A.fumigatus
cgacacaagatctcgtttagccccgtcaaccgtatcagtctgggattcatcatcatgtcagtggccatggcatattctgcagtcgtgcaggcaatcatctatcgctccgcaccatgttactcccacccactgtcgtgccctgcgtcgtctgggggccacacccccaaccacgtgcatgtcctgcttcagctgcccacatttgtcatcattgcgctagctgaggtgttttgctggccgactggatcagagtatacctattcgcatgccccgaagagcatgaagtcggtcctgcaggcctgctatatcagtaccgccggagtggggtatctgttgggaatgactttgtcacctctagctaaggatcctttacttgtggtgctctggtcagcgacggctgcgatgatgtttgtgacagcctgcgcttttcgggtcgcattcaggaacttctag

SEQ ID NO: 8677 - DNA, 516 bp, A.fumigatus
tctcactggcgcaagaagaaggacgttgttggaacctcagtccgcactattttggctaacgtgttcatgcaaacggtcatcttcctctacttgatggataacagtgaaaacacttcctggatgatccttgccagccaaggcttcggtatcttactggaggcgtggaagatcaccaagacagtgaatgtgcgtcttcgtgcaccgccagccgggtctttctactctttcctcccttacgttgtggtattcgaggataagcacaagctttcggaaactgagaagaagaccaaggagtatgatgaaattgcattccgttggctctatatcattgctgtgcctctccttggtgcatatgcagcttacagcttgatctacaacacgcacaaatcgtggtattcctacattattgaaacgcttgtcggcagcgtttacgcatatggctttttgatgatggtccccagtctctatatcaactaccgtctgaaggttggtgcccctcaattcaagcccctgtag

SEQ ID NO: 8678 - DNA, 333 bp, A.fumigatus
tatcgtcaacagtctgttgctcatatgcctggcaaggccttgacatacaaatttctcaacactttcatcgatgatctgttcgcatttaccgtcaagatgccatggctccaccgtcttgccactctccgcgatgatgtgattttctttatctggctctaccagagctataagtacaaagttgattacaaacgggtcaatgaatttggacagggaggcgacagcgatgaggaggctgaggagccggcagcagccgaatccgagaagaagttggaggcggtgtctgaagcgtctggaagggacaatgctgagaagtcggcacggaagaggaagtaa

SEQ ID NO: 8679 - DNA, 1011 bp, A.fumigatus
cttttgattgcagttgcttatgtgccttcgaagaagcgatacactgatgctggtcaactggccaaaacaatcgcttcgcacgcttatgaaagcggcatcgccccatctgcacttgagcgattgatccacattttgacactaaaaaatctccttgatcaagggacaatcactaccttgatcaaaaatctctatccgattgacatgatctcttccaaggttgtcacgcaggtcgtctgttgcctcggtcccagcaagaacaagccgagtccggctacgcaggcttccctgctgcgatggctcatcctcgtctacgagttctgcgaggacaggtcgcacctcgctaaactttatgcggtgctgttcaatcaccttgatatgatcagtctccgcaagccgttatgccatttgctttcaataatcacaaggcggaagcacgtcaagccatttaggatacaagctcttatggagctggtcaatgctgcaggtgcggaagaaaaagagctcatcggtttgctaaacgtcttcaaaaattattatccagacatcattgtgggggacctgggggctttgagacggagaggcttggttttcaagcatcccgaccccgagtggactagtcacgcaaagcttcttcaagacagaaatatggagcaagtacaagcggcacaatcatcaagttttcaagtagttcatcgtggggcggcgaagagagggaaaatggaagtgatcgttcctgttctccagacatcgagggtgtcatccaaccgtacctctttagaagagctgcgcagcgtcgaccacttgattggaaagctcgaccgcattgaacttccaaatcagataatatccgcaatggcagacaacatagcccagaaatatttatttttggttcaaccggagtctgcaaggctccggttagatgattggctgagcagcttttttgacgaacagttggagcatgctcaagacgaagaacgaggctcgtcagaatctctaggttacatcttaagt

SEQ ID NO: 8680 - DNA, 282 bp, A.fumigatus
aggttaaaactcatgaagataaaagtagattttgctgatggcaaaatatatctaagttttcattcaagagttatggtatatagctcctccggcatctcgcagaaggaaaaaaaagacgtttcgagtcattcttacttcctcttccgtgccgacttctcagcattgtcccttccagacgcttcagacaccgcctccaacttcttctcggattcggctgctgccggctcctcagcctcctcatcgctgtcgcctccctgtccaaattcattgacccgtttgtaa

SEQ ID NO: 8681 - DNA, 501 bp, A.fumigatus
caatttgccagattaaacgaacaaggctaccccctcggcctccgtctcctcgatctactcttctaccgctctatgtcctcctccacctcgacctctctatcaagctcctcgacctctgcttcccctcctaatcgacctctccgtattcttcccctgcttcatctcattcatgggccgctttggcgcctgctcttccaacgccccgcagacgccctcgagcattctgtgtccccggaaacacccaacgagtacatgatcacggacaatgacccgctggtaaacacatacattagtgttccgaaggagatgaacatgctcaattgcgctgcctttgtggcggggatcatagagggggtctgtgatggctgtggttttgaggccaaggtcacggcgcataatcagcctacggagatgtggcccgggcgaacgatcttcctgttacggtttggcgagagtgtcatggagagagagaaggtgttggaaagggcaggggtgaaataa

SEQ ID NO: 8682 - DNA, 411 bp, A.fumigatus
agacaggatacgggacgctttggagagggcttcaacgatcgaccccgccgtcgggacggtgcgcctctcggtatccgtgacgagcgattcctacctgaccgtccggaggatcgccccaagggtcccacaggagccaacgccagtgccgtacgcgagagacgaaggtcgcggtcaagatcgtattcaccaaggcgagaccgtcaccgcgatcgcagggacgacagacatgatagccggcgagacaggtatgggggcgatgacctctatgctgatcgtgaccgccgtgaccgtagtcgtaaccgagatcgatcaaaagaccgatacaggccggaaaccaacagccgcaggaaacggagtccttcgccatgcgacgaccgcgacaagcgacggcgtacagacgatgctacatag

SEQ ID NO: 8683 - DNA, 201 bp, A.fumigatus
tatgcaatacgacatctcccagagtcgtcgcaaggctcgtgcattcccgctgtggtgactccatcagacaacggctcagcgggcagaaaaccacccacttatttcacccctgccctttccaacaccttctctctctccatgacactctcgccaaaccgtaacaggaagatcgttcgcccgggccacatctccgtaggctga

SEQ ID NO: 8684 - DNA, 231 bp, A.fumigatus
ttatgcgccgtgaccttggcctcaaaaccacagccatcacagaccccctctatgatccccgccacaaaggcagcgcaattgagcatgttcatctccttcggaacactaatgtatgtgtttaccagcgggtcattgtccgtgatcatgtactcgttgggtgtttccggggacacagaatgctcgagggcgtctgcggggcgttggaagagcaggcgccaaagcggcccatga

SEQ ID NO: 8685 - DNA, 189 bp, A.fumigatus
cccgagctaacgagagagataagacggcaaatgtgcggacgagcgggccgcaagggcaaggacaataccggtgagacgtatctgatatgcggaaaagctgatatacaagctgtttgtgaccttctcgaagccgatatgccggccattgaaagttgtctagcaccggagaagagaggtctaaaacggtaa

SEQ ID NO: 8686 - DNA, 510 bp, A.fumigatus
attgttttaattccgttcgtaaagagcatggcggcactaactgtttgcagggttcagagtggagggtcgctaaaagaagacaacccagaacagatcaaacaggccaccatctatcgacgggcctacacagcttttcaactgcgcgacttgagtaacgaggtgccgctgtcgacaattgcgagccgctacaacatcccccgtggcgctgttcagacgctagcgcagcaatgtcacggctttgcggcaggcatggtgaagttctgccagcgcatggactggggcatgcttgctgctgtcctagatcacatgcgtgatcgactggaagctggagcgcgcgcagacttacttgagatggctcaggtcacatatgtgaaaggctggacggcacggctgctccgagaaaatgggtttcggaacttaagagacctggcgggggcagacgcgaaggatcttgtcccggtactgatgatggtatgtcaattggttgtttttaagcatgcgtggggttga

SEQ ID NO: 8687 - DNA, 477 bp, A.fumigatus
tggatgatcagggcgcttttggaagctattgcgacggggctggtttccggttgcgaggcaatcaaagaatatgtgaaatgcacgcttttatatcggacagtggacaagaagattgcctcttcgattatgcagtcgtcactgcaggaactcattgacgaaggactattagtcttcaaagaggatgaatcgtacgcggcgactaaacttgggcaggccgtcgtggcctcggcattcgctcccgaggacggtctttttgtatacgaagaattaaaacgagccttacgggcctttgtcatggatggtgacatgcatgttttctacatgttcaccccgatccaagtggcgatgaacacccagatagattggctcattttccgagaacagctggataatctcgacgaaagtggtctgcgggcgctgcaatttgtcggtgttcagccgtactttgtgaatctgatgtgcgctgaattgttttaa

SEQ ID NO: 8688 - DNA, 258 bp, A.fumigatus
agaacaccatcctcaagggcgttggatttcatcgtaggtgctcacattgcttgcttatgccgacgacctaactcggctacagacgcaggaatgacaactgaagagcgggaattgatagctcaagcatatgatcaaggggttctgaaagtgattgtggccacgtgcagtctggcagcgggtgtcaatcttccggcgaggagggtgatcattaatggtgcacgcatgggccgagagttggtcggaccggcgatgctgtaa

SEQ ID NO: 8689 - DNA, 546 bp, A.fumigatus
agacggaatgtacagtcctcgatcgaggactctacattccgggcctatctcaaggatccctacttcctcaagtctattctgcccttgtcagatgacctggtttgcatcttgagccgcattttcgagtgtgacccttccaagagaattaccatcccggagctccgccagttgatcctggattgccctcaattcactctcaacccagtgattccctgggttgctccccatggacccttgccttacgatgtcattagtggaccacaggtccctgtgtctgtccctgtgcatgcattcaacccgcagccatcgacatcctcttcggactcgtctcactactcgaattactccgagtctgccgcatccgatagttcttgctatacggaagtattcaccgatatggacagcgttccatcgatgtcttccgtcgagtatgagccggagacggattgccggggcgacctttctctggactccttgacatgcaaggacatctcggaggccatcgttgtccaccagtcagaccctcagacactatgcgtctgctaa

SEQ ID NO: 8690 - DNA, 588 bp, A.fumigatus
ataaccgacaaacaatgggacacgatgcttgcggtgcacaacacggcgccgttcaagctgattcgggccgcggcgccgtatttccgggtcaaggacggggaggaccgggtgattatcaatattagttctacgagtgggattcatggaaatgcgtacgtctacatctccccatctgctgtggatatatcgtgtgctgatggttgctgggtgacaagaggacaagccaactacgcgctcgccaaagccggcctggtgggactgaccaagaccatcacgaaagaatggggccctgcgtacggggtgcgggccaacacgattgcgtttgggttcgtcaagacgcggttgacggctgcgaaggaggagggcgcgttcatcaccacgccggacgggaccaaggttgcactggggatccccgggaagcagctggctgggcgcaaaggggacgaaaagcaggcgtatccggatattccgctaggacggccggcgagtcccgaggaggcggccagggcgattctgggggtttgcagtccttacttttcgtatgtgagcggggagacgatccgggtgacgggaggtcgtaatacgtga

SEQ ID NO: 8691 - DNA, 249 bp, A.fumigatus
attgctggttacaccacccaccttatgaagcgtatccagcgtggccctgtccgcggtatctctttcaagctgcaggaggaggagcgtgagcgcaaggatcagtacgttcctgaggtctccgctctggatgtttcccagaccgagtccggccagctcgatgtcgatgccgacaccaaggaccttctcaagtccatgggcgtaagttctgttctcaacgcggttgttcgtggttttaaagcagtccgttaa

SEQ ID NO: 8692 - DNA, 510 bp, A.fumigatus
agttgccatgagtcccgagtcgctggagcaatgactgagcatgatccaccaggcaatgagcggccatgtcagtcctgcataaggcgcggctgtgccgactcctgtcgcgatggcgagcggaagaagccaaagtatctcgaggagggctcgtaccgagtcttcaccatacagtacaacgtaccctgttacaaacattgtgcatccaccacgttaaatcacacattctcctcccgggatgcggggtttcagttacggacgccgagtccaaattcagggcaaacggcatgttcctaccaagacttcagtccgtggaccatctcggcagaggatcccttcatcggtttggacttggatgacgcgcaattcgaactagaggacgccttcctcttggagtctcctcagagcgatgggatcgaggcagattcacaaagggatactctgcttgcgtttgcaataggaagcgggtggtcaagtacatttctccagtcggaatatgaggaccctgtatag

SEQ ID NO: 8693 - DNA, 198 bp, A.fumigatus
gaagcgggtggtcaagtacatttctccagtcggaatatgaggaccctgtatagcatggccgtggatttatcagcgtttataccctatgatgacacctacatgtatttcttgcagtccgctttaatcaccctaggcggtaggctcggattccacaatgatattgtctgctttgagaaagatacccacatgttagcctag

SEQ ID NO: 8694 - DNA, 261 bp, A.fumigatus
cggccatccagacaatactcccctgtgcccaagcgtgtcatggacggtagcgagcctggcgacactgtggctgccgctgttctttcaggagcccctacagaccttcaagctcgaactgttaggtacatatttagattttcctcaatcacccgccgctttctgaccatgcaactaggatttacaagccttcgaagcctgcaacgcagtccggtacctggcacagccatcactggagaatggactgggacattctgcatatag

SEQ ID NO: 8695 - DNA, 351 bp, A.fumigatus
attttcctcaatcacccgccgctttctgaccatgcaactaggatttacaagccttcgaagcctgcaacgcagtccggtacctggcacagccatcactggagaatggactgggacattctgcatataggccaccgttgggagaaccctctgatgggttggcagtcttccggcgattttatgcagggtactcacctgaacttcaagactaaggaagatgccatcttgttcgcgcagaagcagggatacgaatacttcgttcaggaacccaacgagcgtcgcttcgtccctaaggcatatgcaaacaacttcattcacgaaccaaagaagcttaagcacatcaggaccaagtga

SEQ ID NO: 8696 - DNA, 195 bp, A.fumigatus
tcgtttatcgattgtacggttcactcgcctgtattcaaggttagtagaagtgctacatggtgttcatattcccatattctcatcattattcagaagtcttaccggaatattaacgcagtctcaaaattagacaagatgagctacatcgccccgccgaggtctctcgaccttgattccccccaaggtaaggaatga

SEQ ID NO: 8697 - DNA, 291 bp, A.fumigatus
tactctgatccggagggtggctacttcgtccttgcaaacatgtcttccgtcaaactcccggaagattacccattccctccccatgttgccagccgccctcgtgatttcaaactttgttggtttctgatccacgaagtcggggtggcagccatccctccgacggaattctacaccgatgcgaatgcccacatcgccgaagactaccttcgcttcgccgtctgtaaaaacgatgatgtcttggagacagcgaaggagagactccgcggtctgaagaaatacatctctaagtaa

SEQ ID NO: 8698 - DNA, 1599 bp, A.fumigatus
  unsure (1199): Identity of nucleotide sequences at the above locations are unknown.
aatatcagcccagagcagctcattactcgcttatctgcgattaacttgatacgcgcaagaaccatcactcgcttgtctccaacagagtccctctcctctggagacaccttcagcccattcagcgaccgttttcactcgtcaagcgggcattctgcagagtcgaatcccagtccagttgtcgtcatgcagccggtaccaacgttgcgaaagagaaagaagaagaagaagaagaagaagaagacgaggaacaggaatagaggcgtgaacagccaagattccatggctgaaggcccctctggcagtagaaacgagacacacatatgccggacacctcatgtcagacccagtgtggactcgtacattcaagcccagggcgagaaggacaaccagcagatgagatcgccagaaccgcctgagccagctatgtttcagagtaattggacttctgcagactgcgctccatcccacaatgaacttcaacaaggtgacgcagacctgcagccaggccctggcactgttggaaagccttcgagtgccatgcttaacctgggagaaaatcctggtagcagtgtcacttcactgcatgacaaagtgatatctgctggagaagcctctcctgtgccatcctcctctcaacatcctggtgccaacaaagacagtcgcaggcccgcgaattcagcaaagaaaatgcttcctagcatagaagaagccgcaagcgaagctacacaggattccctgagcaatgatgcgtctactttcatgatgagaagcaaaagcctatcagccagaacgcagattcgagacacctctccatataagactgcaagcacgatattgacggctgacgaacatgccccgagcaagccagagtcagagaaggactcttcaagcgttacaaaccttgacattgagcagagctcgcagcagaccccttattctaaagatcacgagtcacctcatttcagcaacagtcactctcatccgtcgcccccggcagagagtgacatttcaacgctctccacacccaaggcttacaggaacgtctccagtcagagaccagacgctttcttttggcaacttgatagccatggatttccttgcgcaaaacaaagctgcgacaagcgatgcaatctctgggacggaaggactgtcatctgccctaagtgtgggccattctccgaagttcgttattgctgtanagagcatcttctccaggatatcaaatggcactgggtctactgtggacaaatgaccttcaccgagccctgtcgcgagaactcagttcctcgagacgtgcgagatggcccaccactactgccctgccttcatccctatgatactccagagcgtcatcgccaggccgtgtacttcaacgtcaatattcgtgaaggagattattttgtcttctcagactatgcagattgggcgcaagcaggagttcccgaaatcaatctcgagatgcggtgctcccatcgagtcctctacacaatcaagttcgaggatcgggagaagaaggatagattccgacgcatcctcgcagcatgtctgttcagtaagccatggtcatcaaccaagcgcgcctctgagattgcctgctga

SEQ ID NO: 8699 - DNA, 1878 bp, A.fumigatus
tccagcacgggcaagccaaaggggacagtgataccccacagcgccatgttcgcggcctgggatggaatactttacgctaccacccaggacaactcccgaaggataatgtggtcgctaaactacaccttcgatggttcgttctatcctctctttccgactctggcaaccggccgcacgctgtgtgtcgctccacagcacaccatcgtcggcaacctcgccgatgtcatcaccaagctgagggtcgaccaaatcaacctaacacccaccatggccagcctgcttcacccggacgacgtgccgacgctggagatcttagctacgggaggggagcccgtcacgcaccacatgctcaatgtctgggcgccccgcatcaaggtgtacacctcgtatggcccgacggaggcgactatctgcgttacgacccggcaggtcactccagacatgaacattcgcaacgtcggccgcccattcccaaacaccaccgcattgatccttgacccggacaccatggaggaactgccgtctggcagcgttggggagctctgcattgccggtccccagctggccagaggttacttgaatcgccccgaggcgacaaacaaggccttccagggcactgccgatcaacggttctatcggactggagacctggctcgactgctgcccaacggtgagattgagttatttggacgcaaagacgaccaggtcaaaatcaacgggcaccgaatggaacttggtgaaatcgagagcgttatcaagcaaacgaatgtcttccgccagtgcgccgtcatcgccgcaacggtcctcaagaaaaagcagctcgtcgctttctgctcttcctcagtccagacaccgggcgaggcaacaggggaagatctgcttctggccccaactgagttgcccgaggttgatcagattaaagcgcaactgaccactcttccccagtacatggtcccgacgatatggcttcctgtctccaaactccccagccttacctcagggaagatcgatcggaagcgactaacagctctggtggaaggcatggctgacaacgtactgaagagctacctgccacattccgaaacatcggagatctgctcagaagcagagcgggaattgcagtcgctatggtctgctctgttcgatacgccggccgaggatatccacgccaattccaccttccatgcgctcgggggggactccatctctgcattgaacctgggcagtatgcttcgtcgccgcggatacaaaatacagatcaacgatatcctgtcccgctccacattgcgggaacaagccgccctcatggtccagggccaaccaaatggggacagcactgctgctgaagctgtcccgcaaccagtgttccagccaccggaagctgtgtacgaacgcctcgtggagcttggtgtctcgagaaacgatgtggaggacatttatccttgcagcccgggccagattgagttcttcacgcaaggagagaagcctgaccgcttctggcagttgatggccgttcgcacgctccccgatgacttggattttgatcgttggatctatctgaccactcagctcacgaagactaaccagatcctgcgcgctctgtacctgcagactgacgccgagaatccgcagacgctggtccaagtggtgctcaagcaccccgttctcaatctcgcctatcgatcctaccgcacagaggaagaaaagcagagcatactggaagctgaatggcaaaggccgtttgatcccgcgaagccattcgtacggtacacgttgcttgaggactcccagggcacacgcagcctggtcatcaacctgcatcattcctcctatgacgtcttcaccgcggggctggaagggggcaggtcaatcaaaagg

SEQ ID NO: 8700 - DNA, 261 bp, A.fumigatus
gtccgcttgctaattgaagctccatgcagctgggaaacctactacgcccgaactctcgctcacctctccagtaaacaccagccaaacgcccgaccaacccccaccgccgacgcagatgccgactccgccgaatccgagtccgagactgaatctgtggatgacgatgacgacccaggcacatcgtggttctccgagcacaacgccccggaaaaagtcctccgcttcctaacggatgagagcttccccgcgtcttcacccacg

SEQ ID NO: 8701 - DNA, 963 bp, A.fumigatus
ttgcatgctttacagcccttggtgaagactgccttcgaatacctcccatccgagaccgagtctccggtcacgccctgcagtgactcctcccggccagaatatatccacgtaggctgggaccataactccgagattctggacgacttattaccactgtgccagttgatcgattcccgtgtttctcagggaaagaaggtcctcattcactgtcaactgggcgctagccgatccgcctctctagtaattgcctatggcctttacaagaaccggcacctggactttaattccatgtacgagatcgtgaagggacggagtcgctgggttgggcccaacatgagtctcatctatcaattgactgattttcgctcaaggctgcagcagctgagtggtacgtccaagcctgcgccggaggaatggtttgtgaatggaccccgaagaggctcagaaccgcagtcatcgagatctgagaggacaaccgaagcgagtctcactcctccaagcagtagtagctgcaactcaggctactctaggatcgcaacccctgccagctggtcacagacatcctcgggtactctctctgttccctcgacagagcgagccacgcccccgtcagtcagcccctggaggatccccaagtctctgtctcacaagcgaagcttgtctcctcgtcccttaccccttcgccagcgattcgaaacggcacagacagcggctaaggatgttgggacgcgttctctggcaccggcagatgccattgaaaaagacactgtcgaggatccgctaaacttgttttctccacggacgagccaattcctggcgccatctctcgctcctccattcccggatgggctggaagatcgcctccctggtggtcctcattttcggacagagacggcagatcctcggtctccccctcctgggaacgagcgacttataatgaggaatattgatgaatttttataa

SEQ ID NO: 8702 - DNA, 213 bp, A.fumigatus
tcttcattccttttcattttattcgccattcacttccgctttcatttgatcttccagtatttacccttatgtctactatactttgatgactcgatgaccaaagcaggctttgatgtcgtgatttgcattcttattcccaacctttatctgcattttttttttctttttgacaagtgggtgactggtcgactggaggccttattgttgcattga

SEQ ID NO: 8703 - DNA, 516 bp, A.fumigatus
gtacccgtgcgccagtctcacatcctgagtcctggtattcttaccatcttttctttccgcgagtctagttgggcgttatcggatatttccaacggatcaagagaaactgaaactcccttggccatggcggaacccacccatcagactgaagccaagaaaaccatgaccggattcaagcccttgtccaacgccgaagactattccctgcctgctacagccagcgatttgtctccacgggcagaggctgccgtggcgaatggtctttccttggagactgccgacgaagaccatgaggaggtggacgaagactatgtcgcagtcgaccctgacgagattagtgacttctcatattggctccggcgcccgcctgtgcatcatcgcaccaagttggatgagttgcatccgtttgtccaaaccctgacggtttccaatgtcgatgattgtgtcgaggtcgagaatgctttccccgagaacgagcgctgctcccgcgagaaagtatgtgatctggtcaattaa

SEQ ID NO: 8704 - DNA, 186 bp, A.fumigatus
gctgctccacaagtccactcactcactttttctaggctttcccgccgaaccggaaacccctctaattttcagcccttccccgtcatctccgccatcgctgttactacggtctacctaggtacccgtgcgccagtctcacatcctgagtcctggtattcttaccatcttttctttccgcgagtctag

SEQ ID NO: 8705 - DNA, 315 bp, A.fumigatus
tgtgaccctgtagcttcaaggacaacatggcaaagtccaacatatataaaggtcccgagactgactcctttcccgttcaaatcagtccacaagaccaaagcaacacccactccaactcatatacttcgcaccatggcacccgtcttgaagaagtacaaggccgcagcagtgaacgctgagcctggctggttcgacctcgaggagtccgtccgccgtaccatccactggattgacgaagccggcaaagcgggttgcaaattcatcgccttccctgaactatgtaagtcaccccttcgtgttcctcggcggcactga

SEQ ID NO: 8706 - DNA, 315 bp, A.fumigatus
gcaatgtgcacatctgggtattccgtctctggactaacagcgacccagctggtcacgcccgcgtatgccatcgaaacagggactttcactctggccccatggcagaccatcaccgccgaggggctcaagctcaacacgcccccgggtaaggagctggaggaccctcatatctacaacggccatggtcggatctttggtccagacggacagaatctcgtcgcgcatccagacaaagattttcaaggccttcttttggttgacgtaagcagagcagtccatggtggtgtgtttgctttctcgggactaactggatag

SEQ ID NO: 8707 - DNA, 270 bp, A.fumigatus
attgacctggacgaatgccatctccccaaggcactggctgattttgtgagtctgactgaccctgcaccaatgagcgaagctaatacatcccagggaggccactacatgcgtccggacctgattcgtctgctggtcgacaccaatcggaaggacctggtcgttcatgaagaccgtgtgaacgggggtgttgcgtacactcgtacggtggaccgggttggactgtcggcgccgttggacgcgatgaaccagggacctgaggatgagaagtga

SEQ ID NO: 8708 - DNA, 690 bp, A.fumigatus
gtcaccccttcgtgttcctcggcggcactgattaccgactcgacagggatccctggctacccatattgggcctggaaggtcaattaccaggaaagcctgcccctgctcaagaagtacagggagaacagcctcccctcggattcggaggagatgcgccgcatccgcaacgccgctcgcaccaacaagatctacgtctcgctgggctactccgaggtcgaccttgcaagtctctacacgacgcaggtgctgatctctccctccggcgatatcctcaaccaccgccgcaagatccgggccacacacgtcgagcgcctggtcttcggcgacggtaccggcgacacgaccgagtcggtgacgcagacggaaatcggccgtgtgggccacctgaactgctgggagaacatgaacccgttcatgaaggcgtatgcggccgcgttgggcgaacaggtgcatgtcgccgcttggccgctctacccgggcaaggagacgctcaagtaccccgatccatttaccaatgtggccgaggcgaatgcggacgtaagcaatgtgcacatctgggtattccgtctctggactaacagcgacccagctggtcacgcccgcgtatgccatcgaaacagggactttcactctggccccatggcagaccatcaccgccgaggggctcaagctcaacacgcccccgggtaa

SEQ ID NO: 8709 - DNA, 240 bp, A.fumigatus
tatcagtcaccttggaggctggccggtatgtggagcgacgcgactatcaaggatgtaatactgattttcatggttcagacatggcttgacgattctaccccgcccccaggtgatttcgccaactgcaaagtgtgcaacagtcctatgcttctcctccttgagttgcacggtgaccttcccgatcatttccctgatgatgagagacggttgtacatatctggatcttcaccacgggactag

SEQ ID NO: 8710 - DNA, 1578 bp, A.fumigatus
ccttttttgcctcgctcatcagtgcggaaaaacaaccacttggcacacctcacaacagcccaaaacggattgcaattatcggtgaacaactcgaaatctagtttttccagtagaagactaatatcaattcaggaactggggctgcaggatcatcaactgcgtactctttgcgcaagcttgcagattccctgcaactgcccagttgacataacggtctatgaacggaactcatatatcggcggccgttcgacaaccgtcaacgcgctggatgatccgaagtacccagtagagctgggcgcttccatcttcgtatcggtcaactataacctagtgaacgcctccaaggaattgggacttgctgtccgaagcgccgaccaagctcgccccagagagtctgacgatacgattggcgtctgggacggcgagcaatttgtgctggtgctacaggacacctatagctggtggaatattgctaaattgttatggcgctatggattgtcacccattcgcactcagaacctaatgagaagcacagtcaacaagtttctccgactttatgactcgccttatttcccattcagatcccttacttcggctgcggccgcagttgacttgctaaatacaacggcagtcccaggagaagcttttcttcaggacggcggcatatccgcggagttttcgcgagatgtgattcaagcaagcacgcgagtcaactacgggcagaatctacctctgatccacggtctcgagacgatggtgtgcatggctacggacggagcggtttctatcgagggcggcaattggcagattttcgatggcatgctgaggtcctcagaggccaatgtcagactcaatcacagtgtgacgtctattcaacggaatgctgatggcactctggctgtcgggttcaaggctaccgaagtagaagaaaactccgtgttcgaagaggtggttatcgccggtccattgcaatattcaggcatcgctatcgaaccacccctccagcacacccccgatcaaatcccctacgtcaagctccatgtgactctcttctcctcaccacatctgctttctccacgattcttcaatctcccgtctaacaaacgcgctcccgagaccgttctcacgactcttccccgcggggtggacttgggctccaacaaggcaggcgtcggcccagccggcttctggagcatcagcaccctccgcactgtgcaagctccgcgtagtgacggtacccatgagaaacaatacgtatacaaagttttctcacctgagcgtctcaacgcgtcgttcgtgggcgctatcctcggtctcgagaacaaagaatactctgttgatgcgccaattggcgaccttccaaaggatgatgtgagctggcactatgagaagatctggaacccctacccgttcctctacccgcgggttaccttcgaggacacaatgatagcgccgaatctctggtacacaggcggcattgagagcttcatctcaaccatggaaaccagcgccctgatgggtaagaatgtggcctcgttgatctcgcaggtctacacgctggggcggaagcatcgcgtc

SEQ ID NO: 8711 - DNA, 720 bp, A.fumigatus
ccccgtggcggcacagctgctgctctcatttgccgcgatccatggaacctccaacctcctggcgcaggcgctcatggacctctgcacggcaccagacctaatccgggatattcgcgcagagattacatccgtgctgggtggtgcgggattgacccgggccgctttgtaccggctcaaactgatggacagcgcgttgaaggaaagccaacggctggcgccgaacagattgtgtacgtccccttccctgccgccccgtctggaatggccgagattaatctccgggtttctttgacagtatccatgggccgcatcgcgcagagcgacatgcacttgtcggatggcctgcgtatcccccgaggcacgacgctcatggtgtcggcccacgccatgtgggaacctgagatctacccggaccctcggcgatacgacggctaccggttctacaagctacgacaggtaccagggcaagagggccagcaccagctagtgtcggcgacggagaagcacatggggttcggatacgggaagcacgcttgtcctgggcggttttttgcggcggccgagatcaaagtagccttgtgtcatatcctactcaagtacgatctggaacatcggggtgggggcccgccgccgcgagtctggagtcagggcattcacctgtttcccgatccgacggccaggattcgcgtccgtcgacgaaaggaggagattagcctgtga

SEQ ID NO: 8712 - DNA, 654 bp, A.fumigatus
gatcagcccctgtcaaacggctctcaaactcgtcgcgcagatggcatccaaagcctttattggaccagagaatgcggggatcccaagtggcacaacgtcattatcacctacacgcacaatgtctaccgagcagcacaagcactgcacttttggcccaagttcctacgacccatcgtggctcggttcttgcccgcatgccaaaccttgcaggcccagattgccgaggcgcgagagatccttgaacctttggtggcccagcgacgagccgacagggcctgccgagccgctcagggcaaacctgtgccgtctcgcgcggatgtcatcgactggctggaagattcgcatggcgatcaaccctatgaccccgtggcggcacagctgctgctctcatttgccgcgatccatggaacctccaacctcctggcgcaggcgctcatggacctctgcacggcaccagacctaatccgggatattcgcgcagagattacatccgtgctgggtggtgcgggattgacccgggccgctttgtaccggctcaaactgatggacagcgcgttgaaggaaagccaacggctggcgccgaacagattgtgtacgtccccttccctgccgccccgtctggaatggccgagattaatctccgggtttctttga

SEQ ID NO: 8713 - DNA, 213 bp, A.fumigatus
gacgatcatatagagtccgttggaaatgcgtattcattcgcaaagccatgcaagcccgccaaaattagtccagccctcgtgcccttgctgatggggtccaacactggcggcatatacgggactgttcctcccagcgccgccctggtgattctcagctctggtgcgtacaacggctgtagttcgagaacgcatctagacaaaatgaacgaatag

SEQ ID NO: 8714 - DNA, 684 bp, A.fumigatus
ctgtgcccgacagaactgacagtgtgcaggctccttcccgaaagcccccggtatttgatcagtaaggatcgccacgaggaggcctttgacatcctgaccaaataccatgccgagggtgaccgcagctcggtcatcgtgcgagccgaaattgcgcagatccaacgcaccatcaagctcgagctcgaggaggccaagcagacgtggtgggatatgttccgcaccgctggtatgcgtcgccggttgttcattacggcgtttttgggattgttcacccagtggtcgggcaatactttgatctcgttcgtgccgctgttttgccttcttgatatgtttttgctaatcaatgccagatactacctgagtgacctcctggacatggtcaacattactgacggtgtagtcaagtccaaaatcaacatcggcattgcgtgctggggtctcgtctgcggcacgacgctggcgctgactgttcctcgattcaaacgacggacgatgtatataacgtgtgcctgttcgttgctctgcgtatatatcgcctggaccatctccatggaacgcttcctggctacccacgccaaagccgccgccatcttgaccattctcttcattttctgctattcgccggcttacaacctcggttacaacgcattgacatatagtaagccatccccttgtgcaagatga

SEQ ID NO: 8715 - DNA, 279 bp, A.fumigatus
tacataccgactgactggtcagcctacctgattgaaatcttcccctactttggtcgctccagaggcctctcgtggttccagttctacggacgagggtcgaccttctttgcaacctatgtgaacccggtcggcttgaagaatatcggctggaagtggctgctggtgtattgctgctggttggctttcgagctggtatttatctatttgttcttccccgagacgtatggtagaactctcgaggagttgtctttcagtaagtttcacctctggggtggctag

SEQ ID NO: 8716 - DNA, 405 bp, A.fumigatus
atagctgccattgcctatttcgctatatatggacctactaatctctcaatgtccctcactgttctgcattcggatagctccaaagatgagactttcttggggttcgatggactttgcagacgggcctccagctcgatcatcatcagtgaatcaatcccaagagcgtcgagctctacatctggcttgactgaggtaatatgggcaccacatgtttcggcgattatggacgcaatcagtagcttatatgcaggcgttgccggtgttattggcatagcgacagagtcaactgtctctgcttccgagataggtgtggctcctgattggcctatatcatcgctgcacagttgctctatgtcctcaacggtctcacactcctccagagctgatatgtcaattgaggtatga

SEQ ID NO: 8717 - DNA, 2145 bp, A.fumigatus
agacgaagtcggaaatcttggacgttcccaagggcctatcaaacgaaagcaatggaccccatcttggatcaatggacagaagtcgctaagacgctcgaaatctcatgtccgagaatctccattgtctccaacgtatttggccgccttatccggcctggcgaaagagctttcactttcgagtattttgccatgcattgtcgccagactgttgctttcaacgcagggattgatgaactctctctcagtgacatggagcctgaattgtcccgatgggtagaaatcggacctcatccgtctttgctgccaatggtgagcacgaaattggacagagacattacagatcttctaccctcattacggaaaggaactccagcatctgccgcaatcgctaggctcctatgccatttttaccaaaccacaaccgcgttaaattggcgaaaggcattcgatgaggcaagcttaaccacccttccagccatgccattctcagggcaagaatttggtatctactatccacatgagagaactcagaaaaacttgggtgaaggtgatcagaatactgagtctcacactgggcacaccttcctgtccaggattattcaacgtccatcggaggcgaatagggaggccatttttgagactcctattgcagtcttcaaggattatattctcggtcaccgtgtctgcgagtctgctctctgtcctgcatcagtataccacgagattgtcctagctgcttccaagtgggcacagctcgatcagggtgaagatgtcatcaggacgctttcgaatgtgctatactcggcacctttgctatattcagaagactcttccgcaatcgttagggtttccataaagcctagcggagaccacaaggctggctattcgtttactgtggcctcatacaacgcaggttcggatccacagcaacaggtaattcactgtcaggggcagctgaagatacggtctactgcgcatgctcaaaagtatgcaagactggtgccattgatggaaaggcaaagggaacggtttcagcgcatcgaccaatcgagcacccaggtatttctccgaaaagccatgtatgaaaaagttttcacacgggttgtcacatattccgaattatatcagatggttcagtctgtgcgcatcgaccaaggtgaagcactcgcagtttgtcgtttccccaattcacaaagggagccatctggggcaagcacggtcctgatggacgtcctccttcacgttgctggtttcgtcgccaatctcaatattgagaatgaagaagtctgcatctgcaaggaggtcaaatctgctaccatgactcgtggattccctttcgcagatacagctttcgaagtctattgcaacaatctcgaaatcgctgcatccaatgtggtcatagcagatgcatacgccgtcgattcacgaggcgtcattgctgttttcaagggcatggtcttccagcgggtgaaactaacgagaatggctcaggctctccgcatgacagctgtgagatctggtcacacacatcaatccgtcccattaaaaagagccaaactggtagctccggaaacatcggctcgtgactcaaagcctcctgacctgcttgcagacaagcaacgagctatcagggagatcattgcgaacacttgcaatctagaagcatcgagcctagctgcagacaccagtcttcacgccatcggttttgactcgctcatgatgattgaactttcttccaacctatcagctaagcttcatacctcaattgacatatcagctctggaggagtgtgagaccgttgaggacatagagcaactgtgcagcgatgatataggccaatcaggagccacacctatctcggaagcagagacagttgactctgtcgctatgccaataacaccggcaacgcctgcatataagctactgattgcgtccataatcgccgaaacatgtggtgcccatattacctcagtcaagccagatgtagagctcgacgctcttgggattgattcactgatgatgatcgagctggaggcccgtctgcaaagtccatcgaaccccaagaaagtctcatctttggagctatccgaatgcagaacagtgagggacattgagagattagtaggtccatatatagcgaaatag

SEQ ID NO: 8718 - DNA, 207 bp, A.fumigatus
ggcagctttctccgagggttctggcccttatgggagtacccagctcttataggcaagctcttctatatatatcacatcggtcaatcctccaaggcctactgggtgccttttcagcatggtggcctctctagtgaatatgtgagcttctaccttcccggtagttatttaattgcagcctgtttcagaggcaaatggccccgtgattga

SEQ ID NO: 8719 - DNA, 357 bp, A.fumigatus
tgtgagcgaacgaacaggaagatcccatggcgtctttcacggcatcaaaaagcacggcaacggaagcgtctacgcgccgttgaccgggtagtcgacaccctgagcgccgccttgcgacgaaacggccagagcacaaaagccattgatcggtggtatgcggaaatgcctcgggaggaagaaatgttgcccaaggacaaatacacgctgttcgataagaaggaaaagacttatcggaagggtattcacagtacgtttgtctcgacattgtcactaacatgttctcaaggcggatgtatgaggatgctgacaattttctttaagaactgcccaagtggacaagagtcagccagcgcttga

SEQ ID NO: 8720 - DNA, 333 bp, A.fumigatus
agagagttttggtgccactttcaaagagtccgtcaactctgggcttggacggcggcggcaatagcggcgacggaacgacaggaaaggtgggctggacctgcgcctctgtttgtatgtacttactccaaaattactgttactatgcggagacaagacatcactgattttatttttataaagactaatatgctagttagctgtcatattatctatatgatggcctgggactcggcaaggaaaatatcatcctctttcagctttgtttggcccaagtaccaggagaccgtatgctcatatgcggatatcctccttccttcagatgtactgttataa

SEQ ID NO: 8721 - DNA, 453 bp, A.fumigatus
cgtgacggcctcgctgtctggaatcaggtgcatgtgaaggatctcgctcgcggttacctaactctcctacactggctggaacagacctcgtgcgaggaggttgccgagaacccttacttcttctgcgagaacggcgaggagctctcctggggacagtgtgctgcggagattggtcgcatcctgtacaaggcaggcaaggtggccgatccgacgcccaagaccatccctactgagctctacaacgatctgtttggcaagtattcgggtcttgtgatcggatccaacgcacgtcatcgtgctaatcgactccggaagctgggttgggagccgcgggagaagaggacctttgcctccttggcggaggacgaaattccgctcattctgcaggaaacaggggagtttacagggtatgctgctccggttgcatcaggaaagtttgagggcaagaagtga

SEQ ID NO: 8722 - DNA, 942 bp, A.fumigatus
  unsure (809): Identity of nucleotide sequences at the above locations are unknown.
actagcttagacggaaacatgcatgagtgtttgctcatacagccacggacgcttacaaggtcaactggatcggtgggattaattaactttgaagtaatcaatcccttgtactccagatgtactagggcactggtactatggacacctacgacagagaatgctgggacccccgagcagcgtatcaaagcatcaagccattccccagttttggcgctcttctcgacgcgccgcgctttggtaagtcgacaaacatggaggagaaatcaatcgacgaaacacatcccagggactcccgatgcagaaaccatcccaatccgccatcaacaactccttcgcaaacttggctggcgtctgcttcccttgtgcgcattgatctacctgttgaaccacctggattgctccaacatcggaaatgctaaggtcctggacgctgaaaccggtgaacaaaccggaatgaccgacaccggctattcaatcaccctgacacagtttgctgtagcatatgcgctgttcgacgtgccctccaactggattctaaaacgctatgctcgccccgcatactggctggggacgctaatgctttgttggggtgcagtgacccttggctttgcgagggtggataacaggttcacggtcatggtgctacgtgtggtgatcggagtactcgaggcgggaaatcttccttggaatggtctgcctcatcaccttctggtaccgacaggaagagcgttccatccgcattgccttcattctcgcaaccgcgcgacgcttgccggagcctttggacgctgcatcgcctgcggtgtggngttcttaaacggaaaaggcgggctcgaggagtttcgctggctgttcatcattgaaggaggatcaacagtcctcatcgctcctttggtgtttttggggttttgcctaactacccatccacggcgaagtggctaa

SEQ ID NO: 8723 - DNA, 1335 bp, A.fumigatus
ctggtccttaccatatccatgcattactgtcaatcttcagcgaaggttttcggagcaaagggcgagaaacgctggagacatagcgccaagttgctggtttctagtctagcctgtatcgaaagcaagcagcgttcagtcaacatggcgtatccttttcgccgggctggagaaaagctgaagactgtcgcgaagatggatacgtgggtgcgagatcaatccagagagcagagcacaacgacaaaacctccgacccggtgctatctccttgaattgccaacagagctgctgctagagatcatctcgcatctatctgtaatacctgaaacatgcctggctctgacctgtaaacgattgtttgcgatatccggagccattttcacatctgtaaggtacagaaattgcctcatcagctttgcccatggattgaagtccacctcgctaatctggccctccagattcagtcaggattttgcacctctattccaccattaccgaaacggacacaacttcgtcaccacacgatggcaactcatcagcatcctagagaacagcaggtggtgggcctgctcgaagtgcttgaagctccatccgcgagatgctttctcctctcgggaactcaagcgcaaaccggaggaccgagcatgtctgttgggtaactttgcgggcatagttgacctgtgtccctgcaagaaactgacgtttcgggataagatggatcttgttgaactattgaaagtgcgacagcggtcggttgccgacttacagtctcaattcggagccagcattcaacagcggttctgctggcattcctgcactaaggactatggccctacgcaactacagattgagatctatccggagctggatgaccaagatcagttgaggatcaagaccgaataccgattgacaacggaatccgggaagctaggaaaggaagaatacataacgccccggttcggatgtgctcatcgatcagtcgacctgtggctctccagtgtatgccagacgaccgtttgccaaagcctcgatagcatctgcgcgtcatgcaagcggatatcaatttgcaattcttgcaaatcagtgctcaagtgtcctcgaaggcaaccttcccgtgttgaccaggactcaggcaaggcaacttaccacttctggacggaaagatgccttggtgggacgacatcgacgccagatcagatgtgggcttctcaacgtatacatcccgctgagaattcggttgaagtcgacaattgcagcgaggcatgcccttggactgttcgggagcatcccccttctgtcttcaccacggggctggaaggatccacgggggctctataa

SEQ ID NO: 8724 - DNA, 1371 bp, A.fumigatus
ttgctcacttggccttcttcctctcttctcgggtattcagcttctcttcgatttcagcctacgaaaagaccacagctagctgctcagaaacctaaaccgaaaccagcgctgcccaagtcaaccccaggcgctgcgtctgcgccggctcctcccgtgaagaccacccttgcggactgggcagcaaccgaagaagacgacgtcaatggattctacattggcgagaagagacagcgcggcgggcgtaaaaagcgcaagaagaaccgggaagcgcaggcgttcgtccaaaattgggatgacatctacgacccttcaagaccgaacatctacgaagagtataagcatagtgacgagcagattgctgaggtgcgcgagtggaaagatcgcctctacgctcaccgaatggcacgatcgccgagcaggagctcgcacagtgccgatgaatcgagaccaatgaacagtaagcttttctttgcatggcgttcgactgttaagaatgctcacgaattttttgcagaacaatttgcgcctccgcagagttttgcgcctccgcctaatcttaacgatatccctcctgcaccgctcgatgaagctacaggagacgatgcatttgctcgacgcgcgcgcatgacggcaggtcaatccgatgcattaatgtctggtcgaacgccacctgcgcctccccctccgccagaagaggcacctgctccaattccggatgatcccaccggtgaagacgcctacctgagacgggtgcaaatggctgctgcagctcagcctacgctgcaggcgcccactcgcccgccacctcggcctttggatgcactgcagccagcttctgccacaatctctcgcgcgccggtccgatataccctgcctccacctccggaagatattcccgccacagaagcggagcttgaagaagtctttgcgaaggaagagcctgcgggggatgcacccgacgaagaagacggccagcgctcactccggccgggacaaaagggattcgccgagaggttgctggcgaagtacgggtggaccaagggatctggcttgggtgccacggggtcgggtatcgttaagccgttgcaggtcaaagtcgagaagcaaaagaagcggccagactcggaaggtggtggttttgttactcctgctggcaggggcaaaatcattggcggtaagaggaaggcggaggaagaggagggcaagttcggccgtatgagcgaagtcatcatcctcaagggtatgcttgatgggatggatgtcgatgctgagctcgagggtgatcaagacggggggttaatccaagagattggtgaggaatgctcagaaaaggtgcgcttctctatccatgactgggttgctaccatctaa

SEQ ID NO: 8725 - DNA, 333 bp, A.fumigatus
tccaagagattggtgaggaatgctcagaaaaggtgcgcttctctatccatgactgggttgctaccatctaacactgatcagtacggtcgtgtggagcgtgtcttcatttcccgtgaatctgggccccctgtgccggtctttgtcaagtttactaatcagttgtcggctttacgtgtgagtatttccgaattcagaagccatccaagtctggacactgacaaaatctgtcaggcggtgaatgccctggaaggccgagtgttcaatggcaacacaatcacagcccgtttctacgacactcagaaattcgaagaagggatatatgacgaccggtag

SEQ ID NO: 8726 - DNA, 513 bp, A.fumigatus
tcaccctcgagctcagcatcgacatccatcccatcaagcatacccttgaggatgatgacttcgctcatacggccgaacttgccctcctcttcctccgccttcctcttaccgccaatgattttgcccctgccagcaggagtaacaaaaccaccaccttccgagtctggccgcttcttttgcttctcgactttgacctgcaacggcttaacgatacccgaccccgtggcacccaagccagatcccttggtccacccgtacttcgccagcaacctctcggcgaatcccttttgtcccggccggagtgagcgctggccgtcttcttcgtcgggtgcatcccccgcaggctcttccttcgcaaagacttcttcaagctccgcttctgtggcgggaatatcttccggaggtggaggcagggtatatcggaccggcgcgcgagagattgtggcagaagctggctgcagtgcatccaaaggccgaggtggcgggcgagtgggcgcctgcagcgtaggctga

SEQ ID NO: 8727 - DNA, 1584 bp, A.fumigatus
gccggaaacattattatcaaccttatcgacttacttctttggcttctttgtccaaactcatgcaatgaaatcgcgtctggccgcaaaggccgtgcagcccctctagaagtctacaatatccttctctacttgcaaagggatcttctcctgttgatccttctcccctccctccacagcgtcatggcggcacaaacccggagcctggatcagcttgtcaagggttctccagctcctggaagtcttccagagtccttatccagaccttctggtcaattgaacacccttcagccgccgttttctcaagatgcctcggatccctcctccccaccccgttcatcgaccccggatctgctctcgacgttgccctcatcccctcctcaaatctacctgaacctcctcattctcgaaagttctctgcgagcccagtatctggcgctgcgggaacgccgacggcagaatacctttttcctgctcctgctagctgcttggattgcttactttgcttacgcgctcttccttcgtccgcgggaagatggcagcggggtgggcggctccatttactggatggtcgaaatgggggaaaaggtcgcacttctaggaggaatcgttactgcgttgttagtctggggaacaggacagtgggaacggggagtgcgatggccacggcgctggctcgccgtcgccaaccgcggcctacgcaccatgaacaccaagatcgtcatcatccggggcccctggtggcaggaactgctgtcctacctttcctttctcttcccattcaccttacctttcttccctgctccaaccgggaatttccactacatcgagcgcccgtcgtcggacaagcgtggtagtcggcagcactaccagcagtactacaacaacgtcgacagcgaatcgggccttgtggaggaagatctcagccccggaggtgattacatccgtctccttcttctccccaaatccttctcgcccgaattccgcgagaactgggatgattaccgaaccgagttctgggaaaaggagaacgagcgacgcgctcagctgcgccagaagttgcgccagaaggagcgccaactcgctcgacaagaaggtggctggttctggtggctagggctcgggttgggctggaaggcctcgcaacgccgacgactcgtcgccgcaaccctcaagtccagcgacggagacaaacatcgtcatcaccaccatcatctctctagcatctccaaacacgcgcacgacctcaaatcccccacgcgacgtggcccgcgttcagagtctcattcccgcaccccatcccgtagtacgacgccagtggacatcgatgatcgtccgccatctcgctcttccgccagcagccgtcctcgccggggaagcacaaccccatcttcgactgcctcggaacagagcatgcagctacggaaaaagaagggcacgaaatcactttctcgcgggctgtcgcctttgacccaagcgcagatcagggagggcatctacaatacgtcgtcgctctcgtccgacgattcgttcctgggcgagagtcgcgagaccacacagtcgcgcgaagctagtccctcggtgtag

SEQ ID NO: 8728 - DNA, 408 bp, A.fumigatus
acaccaagatcgtcatcatccggggcccctggtggcaggaactgctgtcctacctttcctttctcttcccattcaccttacctttcttccctgctccaaccgggaatttccactacatcgagcgcccgtcgtcggacaagcgtggtagtcggcagcactaccagcagtactacaacaacgtcgacagcgaatcgggccttgtggaggaagatctcagccccggaggtgattacatccgtctccttcttctccccaaatccttctcgcccgaattccgcgagaactgggatgattaccgaaccgagttctgggaaaaggagaacgagcgacgcgctcagctgcgccagaagttgcgccagaaggagcgccaactcgctcgacaagaaggtggctggttctggtggctag

SEQ ID NO: 8729 - DNA, 375 bp, A.fumigatus
tattgcgcggcccttccgccccgtggtgaagacgttatagacacggatgatatggggttcggagatcaacgtaagttacccaatggaccagaatcagcagcaacgctaacagtaccagcggggggctcgcccgatcgcatcggtggctcatggcagctccgtcgcatcagcagcgtcgtggtcaacgggaatacctcgaacgtggagaccctttatcagagggatacgcacaagagcatcattctctccacgccgctgctgctgaccctcgagaagggctcgcataacactattaccgtcggaggattgtacaatggatttgattacaagggggcagacctggataagattgtggtttatccgcctgaaccttga

SEQ ID NO: 8730 - DNA, 798 bp, A.fumigatus
aatcatatacatgcaattgctataaggcccccccatcatcctcgccattattttcatcagttgccagcttcgaaaatgggcgagcggatatacgaacttgaccgacaaggcgacatcacctttgtcgtctacgatgtcccagactccctcccgcaaactctcgaccaactgcaaccctttctgctggacggttcaacaccagtaatcacctcccctgcagcagcagcagcagcagcagaagaagaacaaaccactgagaacgaacaaccccaagcagtccttaaaatccgcgcctcctccaagcacctcagccttgcgtgcccccaattcacccgcaccctgcacagcggcttccaggaatcccactccctccatgaaaaaggccatctgacgcttgaaatcgacaactgggatcccgctgcctttctcgtgctaatgctcatcctccacgggcgcacacggcccgttcccaggagactaagtctcagcaaactcgtggacttcgccatcctggtcgattactacgagtgctacgaggcggtcgaggtcttcactgatatgtggattacggcgctgaagaagccctctccggcgatgcgtctgacctcgcttgcccaggcggaggaatggctgtttatctcctgggtgtttcagcaccagcagatgtttgcgcaggcgggcgggtatctgctgcggacattgaccggcagattctgttccgagttgcccgttccgaggcgagtgtgcggtattgttttcgaattttttctatctgcgggttcatgggcaggtagctga

SEQ ID NO: 8731 - DNA, 186 bp, A.fumigatus
tcacctcccctgcagcagcagcagcagcagcagaagaagaacaaaccactgagaacgaacaaccccaagcagtccttaaaatccgcgcctcctccaagcacctcagccttgcgtgcccccaattcacccgcaccctgcacagcggcttccaggaatcccactccctccatgaaaaaggccatctga

SEQ ID NO: 8732 - DNA, 1890 bp, A.fumigatus
  unsure (1818): Identity of nucleotide sequences at the above locations are unknown.
aagctgacatcggcctcaaagaagctgcagaagattgccgcacctttcccccgcccttacacgtccggcaagtcgcctgttccctttactgccgggaccaaaggaaaggagaaaggagctcataccagacataatgctaatgatttaatctcgattactcgcgaatctgacacctgggatgagtggggtcatgtgcgcttgatctactatccttcggctccggctgaacctgccaagttggcatcggagaatgcgcaaggtggactgctgtcacaacctcccactacaccgacacctcttcggagaagtcacacccatcctactccccagctcggtcgtacgccagttgtggaggattcaccgggctccatcaccaattccccctccggaaaacctgaggaagcattgcgcggaggcaaagttcttgacatcccttactccagggtgtcggcatcaaaagctgaagatcttctcgctgggcatttggatgagctaccggatgagtcgaagtacgaactacttcacagaatccgtaccgcccagggtgtggcctcatctaatttcactcgagagcaaattcttgctatccgaattctcgcaattaccaacttagcttatgtctatcctgagtcgctgttccaacagaggatcctgcagtatgataacgaacaaccgaaacgccttcagcttgcctaccagttgggcgagctagtccatctcggtgcaagcggcgatcttccggtttcccgtactcttcagaccttggccctaaacgcccttgatgctttagcaaagcacaagtcacgagctattgacgtttgtgccgcactgagtgtcaatgtcaatcatggggttctcatgttcttgactcgcaaagctgttaacgaactagcatcggacgaaagggacaaggatgaagcctaccaggatgaatggcgggatgctctacttgctcttctgcgtacgcttcctggttcaagcactcggactccggaaactcttgtttcagctgggttgataccaatgtttgttgatatcctgaatcttcgcaccgagaaggctcgccgcgtttattcacgtgtcatggaattcctcgatacctttgttcatgcggtccgtgatgctctcgcgacgctcacgaatgccaagggctttgacgccatttcagaccttattgattacgagaccaagacctcttttgagaatgtctccagaggtgctggacttcccccgcagcacaaaaccccgtcgatcgactatcagattccatatttccaacaacaaacccttcgatggatgttccgcttcgtcaaccacatcatgcaacacaatggcggtggctttgatagagtcctacggaatttgattgattcgcctcaattgctgacctccctccggctcgtattcgagaatgctcgggtattcggatcacatgtttggagcaacgccgttaacatcctgagtagcttcattcacaatgaacctaccagttatgccgtcattgccgaagcaggattgagcaagagtttcttggaagctgtgacttcatctgagctcaaggctccagagaaacccccggttgtcgagacggagagtgctgcacctgagacccagcctggtgaccaaccaacccctctgccatctgatgccgtgagtagtccgtcgccacatggcgaacagaaagaccgagaatacaacatggctagatcgaaggatgcacgtctcgcccctggaatcatgcctgctgcagaagcactgtcctgcataccctctgcttttggagccatatgtctcaactcatctggtcttgagctcttnccagggttcccttttttccccggaaaaaacgcgttggaaagcttctttgagatttttgaaaatccccagcac

SEQ ID NO: 8733 - DNA, 2343 bp, A.fumigatus
  unsure (2260): Identity of nucleotide sequences at the above locations are unknown.
gacaaatctacctccatcatgcctaaaaatcgccccgcgacgtccggttatgcccgtcttgctcaggaggaagaagatagatcgaacgatgcatactattattcggaggatgaggatgatttgcacggcccttccggtacgatatcgcaatccgcctcacgatacgccccgatctccgcccgagcccagatgactcctgccttctcttcgccaccaggacaccgacggagatcaagtggacactacccccgtgggcgccgaaactctggcgtctacattaaggccatcaatgcgcgtctcgagcgttgggccgaggactttgcttcaaaattcaagatcaacagagtcaaagggaagacactggaacaagagaaacttgagatctaccattctgttttccaaccaccagatggtgtcagaccgatttctgctgaagctctcgagtcggaggaagttgaacgggcgcagcgacaagcgcgagaggaatttgaggccgttgttgaaagtgtccgtaccgccattgagttgggggtgcatcctcgaatgatatcccagggtagctcgggaagttattttgcccgcaacagtgaagggaagattgtaggcgtcttcaagccaaaggatgaggagccttacgcatctcgcaatccgaaatggaccaagtggctacacaggaacttattcccctgcttctttggccgtgcatgcttgatccctaatctttcgtatgtctcagaggctgcagcatatgtcctcgactctcgattacggaccaacctcgttccatacaccgatattgtatatctatcctcgaaatctttctactacgacttctgggatcgacgaaaggcttggatgggcaagaaaccgcttcctccaaaggcaggtagcttccaggttttcttgaagggttacaaggatgcgaacctctttctgcgcgatcatccctggccagaacagaccaacactgggtttcgtgccgaggacgctccaaagcgtaagaagcgaccttggaacgaggcttgtcgtccgtcggggatacactcggacgatgaagacgaggacgatgaaaacaactatgcgtcatctccagcgccgcgggacgagagtggggagcgacgcttttactggactgaacagctgaagcaatccttcagagaggaattggagaaactggttattttggactatatcatgcgcaataccgatcgtgggttggacaactggatgatcaaaatcgactggaagacagaggacgtttctattgttgccgagccgcccaagtccaacgggagacaacaggacgacgatgatgacgagcacatgcctccagctcgtcctgtttccaccagtcctgggaggactggcaccgcatccgcatcctatccgtatagacggcatgagactatggttgcagtgagtcgcactggaacaccgctcaattcaacggagccacaggcgactattcagatcggggctatcgacaacagtctgtcgtggccgtggaagcatccggatgccgtaagttatattgtcttcccccgtcttcagctaagatttgctaatttgacacagtggcgaagcttcccttttggctggctgtttctccctgtttctctaatcggccagcccttctctcagaagaccagggaccatttcttaccacttctaacatccacagcctggtggagtgggacgcagatggcacttcggcgtgtcttttcgcaagacgccgattttaaggagagcatgttcgcaaggcagattgcagtcatgaagggacaagcctggaatgtcgttgaaactttgaagcatccggaccatggccccttggaactgacgcgaaggactagagtctgtgtatgggatgatttggtagatgttccggtcgctatcccccttcgtggacagccatccaccgatgctcaaaagcgtaagatgaggcgctatgacagtgacgaccgacatgacgattacgatccagacaatgaggaaatggacattggcgctgccatgtctctgccgtcgcaaccacaacatgaccttttaggccttcattcccctccgagcgagctcccgaatccgaatcgatttgagctttcgcgcggccgagaacatgaggaggggccaacgcaggatcgtagccccgtcacactaggccgtgacagtgttgatggtcttggtcttggtagagacacggatcggaattgggctcctctcccttccagacccgaccacaaacgtcatcgcaaacagagcntcatgtcaagtgcgcatggtcacgcgcaatttgtcttgggcagtgaccaccttcaaaggccacctcggctatgcaactgctga

SEQ ID NO: 8734 - DNA, 207 bp, A.fumigatus
aaaaatcaaaaattggactcacgggggattgaaccccggacctctcgcaatctaggtctaaagacctgcatttacaaatgcaaagcgagcgctactaccactgagctacaagcccattcgttggtaaaattcaccattaatatcttatgtagtgggaagacagtagatggctgtagccttatatctggaagatggataacaggctaa

SEQ ID NO: 8735 - DNA, 183 bp, A.fumigatus
agacaacagctccgtacgtcttatttgcgcaactcacaccacgttgaaggcaaggctaaggtcggcatttcggatgctgccctatgtggatctgcagagtatggggaaaggtgtctgtttgtactatatgcaggggtgatcattctattccctaagaagctatctcaaacacaggagtcatga

SEQ ID NO: 8736 - DNA, 405 bp, A.fumigatus
tccttgcttcattattccattcattcatttatccattcattcattctttctcattctctcactatgagatatacctctctcttcaccgccgtcacggctgcactggctagcaccgccgcggccgttggcgtctccggagccgccgagggttttgcaaagggcgtaacaggaggtggaaatgcctcccctgtctatcctaaaacaaacgatgagctggtctcatacctcggtgatagacaggaccgcgtcatcgtcctcaccaagacgtacttgaccctaagtcctcacaggatgaagatgaacgggaaaacgctaacatgtgggcacagtttcgacttccgaggcactgaaggatacacgagcggaaccggctgcgccacctggggcatcaatgccagaatgtca

SEQ ID NO: 8737 - DNA, 630 bp, A.fumigatus
gtacggagcactccatcacatgaacgcggatcaaaactgaccgaagtagatggaggagccgttcgaggatactcgatgctcatcattctccaggaactcatgtaccgcatctacgtcgagactgaaggcaaacccccgcgccgagaccagatccccaagccctgcgaccacttcgacctcatcgttggcaccggcacgggcggcctcatcgccctcatgctgggtcggctacgtctcgacctggaaacctgcaaggaagtctatgtacgcatgacccggcgcgttttcgaaaccgacaagaccatcgccggcatcccctaccggtcgaccttgttcaaggcgtcgaaattggaagaggcgatccgggaatgtgtgcgggaacatacggtattcgaggccgaggggaatgatatgcccaatgccagttcgcgcaactccattgccagcgcgccctacagtcccgccgcgattccgcagcgctccgtgagtagaggcagtttcagcacgtctggcgcttcgcatccctcgacgccgatcagtcagcggcattccgctatcatcaacgggctacggtgggggaacccggatgctctgctctacgataatcgggaaaatcggacaaagacgtaa

SEQ ID NO: 8738 - DNA, 471 bp, A.fumigatus
atcgtactgactggttttagtgccgtgacggcgttgtacaaaggcaccccccgcaacggatccgcggtgctgctgcgatcatacgactcgcgtaaagagcctccccccgaattcaactgcactatctggcaagccggccgcgccacgtcggcgacaggtctggcgtttaagccgattcaaatcggacagcatgtgtttatcgatgagggtgcagggacatataatccggcgccgcaggtcctggatgaagcggctgtcaacgagtgggcctgggcgggaaatcggggtgtttatcaacgtgggtaccgggcaagcgtccgccgggcacccacagtcggcagcatgagtggtgggaagaaatattttgggggatgctctcggcacatttgcccaggccccgacgaacgactgatcccccaagaatccgaagggggttttgccccaaaagggaaaaaaaatttccccaatttc

SEQ ID NO: 8739 - DNA, 501 bp, A.fumigatus
ttgtcatcggtcatcatccggctaacatcatccaactccccacaagccgccaaaagcgcagtccgagccctggcagacaccctgcgcttggaagtcctccggcacaactccgccaggaccacctacacaatccacatcgcctttccagccgacttcatctcgcctgggttcgtcctcgaacaagacaccaaaccggacctcacgaagcggatccagggcaccaacgtcgccactttcgcgcagctggaggagaaattcccgtcctcggagaaagtggcccaggggatcgttgcgcgggtcgaccgaggggattttattatctgcgaggattcattggctgcgagtcttttgtttacgaacatggttgggttgagccccaagagaggacttggaattgtggattcgttgtggagcgtggtgatggggtggtttgtggtgccggtgttgaggaggaggtgggagaagatgtgcagggaagatgctattaaccggctacgatga

SEQ ID NO: 8740 - DNA, 348 bp, A.fumigatus
catcatccaactccccacaagccgccaaaagcgcagtccgagccctggcagacaccctgcgcttggaagtcctccggcacaactccgccaggaccacctacacaatccacatcgcctttccagccgacttcatctcgcctgggttcgtcctcgaacaagacaccaaaccggacctcacgaagcggatccagggcaccaacgtcgccactttcgcgcagctggaggagaaattcccgtcctcggagaaagtggcccaggggatcgttgcgcgggtcgaccgaggggattttattatctgcgaggattcattggctgcgagtcttttgtttacgaacatggttgggttga

SEQ ID NO: 8741 - DNA, 1995 bp, A.fumigatus
gtcctgtcccatctcaaagtgccagccaattctgttttgaggccgccaccgcatatcagcccttcgaagaaaccccaattcctagctaccggcggcagtgctctcaaagatctaggcatgacacgattaaaagctactagggatggtatacttcaagcaggacatcatccacagaacgatcatggtctacgtgatccaagccagaattcaagcaaaacatggaggccatatcaaggtcgttgggatccaaacaaccccggttggcgctccgcgacagcgattccttccagatctgacaatgctgtgtcgagcggttcgcggaagaatggtacacgacgtaatgccagattctttgacagaatgtcaaaaggagaaccgtcaccgtatactccacatctgtcaggctctcaacaggctcaagttccgcacatacaactacagcagcccttcaatgcgccgtctgctactccgcaacttgaccctaatgtcaactcgtttcccgttttgcctatgaattcaaatacatcagacacttcaaacaacacgactatgcagctgccgtttctcccgttacacgtaccacattcacaatcggcacaatcgcagattttgcccaataacctctcgttcaccccttacggttttccgccaatgccagacttgaatagccccgaaaagatactgcctttcatgccttcagtggccccattccctcccctaaacttgagtgttttcagtccagcattggcaccaccagttttcggcggatttccgttctgtcccttcgacccgatgtaccctacaacagttggccctactggaggcagttctcagggcccaacactgcaaccgttgctcccaatccctccgcgtgatcggcggtctaaaaccccggagcctcctgtgccgactaaggaatatctgacgcaatcattattggccccgaaactaaatcctagccgccagcctctactagtcattcttgacctgaacggcactctgatctttcgaaagcatcgacgtctccccccttctttcgccaaaaggacaggcctggaccagttcttggacactttgttgaaaaactacaaagtcatgatctggtccagttcgcaaccagagacggtaaacgcggtttgcgagaaactgtttcctggagagaaaaggaagtcactggtagctgagtggggccgcgataagttgaatctttcgagatctcagtacaggtcaaaggtgcaggtctataagaccttagagacagtatggagcaatcaagagattcaagcctcgtatcccatctcccatcagaacggtcggtttaaaacgaagaaaaaggcggcgcagggaaaatcgcgctgggaccagacgaacaccgtcctcatcgatgacagcaaactcaaagcactcagcgagccctacaacatcctcgaaatcccggagttcacgaacgctccaggtatcgacgagtctcacatattccccaaagtccttgaatgccttgactccctagcgcagcacgacgatgtcagcaagttgctccacctctggaactcgaagctcgcgacaaacatcacgacgaacagcacaattcttgatcttgacatcggagtaatacagtctccacagcgacaaaacggaagttctttaatcacaccctcaacaccccaggaaatagcccaggcgcgcaaggaacgtcgaagagctcgcaaacaggagaagaaagcggcccgacgggctgcggccgctatcggcaacgcacctgcgaatgtacctacttccgctgctgtttctgccataacagctgaagggatcaatgatggggttactgcggttgacagcaccccagcaacatcaggtgacgacagtgctattttgacagctacagctgtgccgcaatcgcataccaggcattctccgtctcccgtttcctcagtgcaatcggaaaactaccttctcgatcgcctagaagagtcgttgaatgttcgccgcgactga

SEQ ID NO: 8742 - DNA, 234 bp, A.fumigatus
ctagacacggtgcaatttgggcctagtgaagcttgtcacttaacattcatggcgactttcaaatccaccatctacactgacggcgtgcgtcaagcatattactggatacataagatgaacatcaaactgctagggtcaagaagtgcttttggcttcttcatggctagactaactactatcattccacatctcaagatatcattagcatggatatacaatatccatgcattttag

SEQ ID NO: 8743 - DNA, 294 bp, A.fumigatus
  unsure (179): Identity of nucleotide sequences at the above locations are unknown.
gtttataaccggcatcacaattttcaatctggttggcaccaggcgataccctttaccaaaattaattacaacgatcgatttaaaacggatactcggaagtgtaagcttcaaaatttcgatttcaaatgcctgcgtcatagcacctctggtatcatagaatcgactatagagacaaatcnagaatggtggtataaaggcaggaccaaggagagcgcaacagataacaatttccggcgaaagatacgcgatcaaaggccggctgcttattatgactttccagcggtctgtgtctga

SEQ ID NO: 8744 - DNA, 783 bp, A.fumigatus
cggtatgtggtgctatttgatatcaccagccttgctttattattgacgcgctttggcgcagatgatcttcctgtgattcgcgagaacattcgcaagggattcctggagactcagtccaaagtgaactcttgggtccagaacctcaaaaagcgacttgacggtgaggacgtcgacgagggaccatctaaccagcgctatggtgaaggccaaggttacagtcgaccaagaaggagtggtgatatgggtcgtcgcagcggtgaccgcgaacgttacgatgctgaccctcagttgttgagcgacgacttctctgcgctggaactgagagactctgaaggtctgtccagtcccgtgaaacggattcttcccgcgaccatcgctaatttgactgcagcacctccaccccaaccaccaaggaggccacttgctaacccaaatctgtacaaatcagcttctccctcacctgacaggcgtaaggtatctttccaagagggtccaccatcagagatcggcaatctttatgacacgtccgacccggccaaacgcacgtccacgggaagcaaatcgagcaagtggcagccgctggccacagtggagccatctcctgtcgcagagaatgatccgttcagtttgggagacagcgaagatgagagagataccaagggcagagagcagaatcatgctgacgaagctgatcgtatcaagagggctacagcagaagcgatggccggtgaacttggtaccacaaaggttaacgatcagacacagaccgctggaaagtcataa

SEQ ID NO: 8745 - DNA, 1434 bp, A.fumigatus
tcgacgcaagattggacttcccgaatagcgtggctgaagatcagccttccgtgcgttattattacttgcttggagtccttgaaagtatgtcatcctctgaatcctcgtcagtgtccggaagtggacgtcccgatgcagggcggttgccaagcgaagatcaaggcgatgcctcgactcgatacccttatctcacatcttgttgcggccaaacgatccttgtcgtcaattaatcatgtgtggcgagccaatgaaattgtcacagccgctcgtgctgcattagaagaatgtgtggtcgtgtccgcgaggacggcctttctccgtcgggggcttaacaatcaactgcggctgttgtatagtgtccgaactgaagtggaggagatctcccttcgtggacgctcggaatttgcggctgtcttgaaggacctcgacgacgcggatacgcgactgagacgcaccttagagcttcttcgggaaacaattgtccaccctgcctttcgtcctgaaggagaagatccaaagagtctgcatgactttgttgatgagcgaggtgtagaggaacttcatgcagctttgaagagctcaatagatcgcaccactgcggcacaagcacaactagactcctccaaccatgcctttgatgacgagctcctgtctattaaggaagctctggggacctataggaccgctgcgaaattagcctcgtcgcgctcctcctcgtctgcatcttcctcgtcgacatccaattccagcctgccctccatatcaaccatgccatctatgttgcattcgctggaaatgcatgcacaggaaatggccaacctactggaatcgttagtccggcattttgatctctgcgtaacagctgtcaaacacaccgaagggggcggggctgcagcgaaatctatcacgggtgatatgcccgttggcgtacccgtcagcggccgtatgggctcaaacattgaagaagagataaacaacaatctgaatgcaccattggacccactaagcaattccgagtatcaagaaatggtgaatgtcctgttcaaggatgcagctgaagcggaagatgttgtgatggagattcaagatcgaataggcgaaatggaatctgttctggagaacgtattggctcaacgagacgctcttcggtccatctacaatgccacaacggacatttaccagcatctttcttctcttgggtcaacacgcttgccgggctatatcgctcaggcgcacaacttcacgcaggtgtggcacgaagagaatgatcgtataagtggtggcttggcagatctttctgatttgaactcactttacaatggcttccttgacgcttatgacggtctgattgtcgaagtaccgcgtcaaaagcatgtgcggcaacgcgtcgagaaagtctccgtgatacaggcacaaacgggatcaactttatga

SEQ ID NO: 8746 - DNA, 1071 bp, A.fumigatus
ggtccagcaccactgcacagcttcaacacacgacagcaagcgcagcaagcattggtatcccatgtcctcatgaagctcgtgcaaaaactatcgggctatccccgtctgcttctcgcgggtaatccctccaagattgacctcggtcgactcctactgggtattatcagcgcagtcgcttcaggagtcccatttcccctgatcggaattctgttcggccagctcctcgacgacttcaacgcagtgacctgcggcgagtcagaatcatcagactctgattccgcctatcaacatgatatcaacggcaagattctgattattgtgtatctggccatcgcccagtttgttctaatctacgtccacctctcctgctggagtctgaacggcgctcgactggcgcaacgcctgcgggaaacttatctacagaacgtcctccgacaagaaccatcctacttcgacaagctaccccccggtgagattgcatcgcgacttaatggcgacatacaggctattcgatccggcacgtcggagaaagtggggatatgtttgtcgagtctgtcgtttttcatcaccgcatacatcgtcgcctttatcaaagatgccaagcttgccggaatgctcgtctcgttaatcccggcatactttctcatgtcgttcgtcggaagccactatatcgagaagtacacgggtcgcatgtcggactacgctgcgagtgccgcgtccatcgcttccgaggcactttccaacaccgtcgtggtgcaagcctttggggccaatgcgcggctggaggagaaattttccaaggcactcaaggctgcagagacggaagggttgaagaaggcgacggcggttggcatccaatctggagtgttatacttcattgcatattctgccaatggtctggcgttctggcaggggagccgaagcatagccgagtctgtgagtggcaatactcacggtgccacggtaggggctacgtttacggtgattttcattcttgttgaaggtgagttcgattcaatcttgggtagtgagcgtcttcaccgcggggctggaactgaccatcgatccaca

SEQ ID NO: 8747 - DNA, 201 bp, A.fumigatus
cctacctataggttaataatcctacccttctatattaaggtctcttctagtttaataggtatggcttctagtggattctattaccccctagcttcctttattaaatatttagcttcttattatctatctaggagttattactatagctcttttacttcctctatagtattactagacctagtaataaaatatttaaaatag

SEQ ID NO: 8748 - DNA, 249 bp, A.fumigatus
aatagtatggtgtctctaaggttagggataggggtagtggtagtagtaacccgtgtcatggcattaataatatgctcttgcctagtgattatctgctataatacctctaactttaccttaaattccctaatctattactttaatataataacttccttaacttttacctatatagcctatttatatttctacttaatctttattacctcttctctatataaggagttgctattatatattatctcttaa

SEQ ID NO: 8749 - DNA, 285 bp, A.fumigatus
tggaataatgaaccgcctgcttcggtctgcttccataccctattcctcatcaggtcgtcttccatgcatctcatgtctaatgtccagcgtctagtgctgtttgtgcatcaggtcggtttattccgtctccgccgactttcagcccccgctgctaactccatgaccctcactcggaaaagccgtctaatctcctatccccatccactctcaacactccaagggtgccgtcgaccaggccagcactacggagtaagacccctcaactatcccaagcacgcttcctga

SEQ ID NO: 8750 - DNA, 219 bp, A.fumigatus
tggtgctcaatcatccgagtgcaaaagcccactgtggataactcccttcccccaggatccagagatcagacgagcggagaatccccactggcaaccggagataatggctcatggaacggtgaaggagctaaagtgattcatccattcgcatctatgatctcgtattggctttccttttatgtgattcctgacactttatgcattaggatcccttcataa

SEQ ID NO: 8751 - DNA, 264 bp, A.fumigatus
gttgctaccatcgctcgtgcgcacgacctccgtgtccatcttcggtcataccgcccccctggtatcggaataatgccctcggccgatggttcttcctctgctcgccccaacggtaccagctcccggtcggatcagcttgcatggtataagtcgcagtatgaacaattagaggctgagctagcggacttccaggcctccagccgtgagctggaggcggagctggagaaggatatcttcaccacggggctggaagcatccgcgcta

SEQ ID NO: 8752 - DNA, 585 bp, A.fumigatus
aaacgtcattcgcccacattcacccgagcccggctggtcaccattccaaagcgcttgcctcctgctctaccactccgaaatcctcatcgggacccagttccgatgtcacaatcgacccccacctctcccacttcctccacttcctcctctttgaacggcagacgatctgtggcgtcccaccctgataactcaactgtaaatggctttgcccaacttcctctccaccctaacaattattcctcgtcaagtctcctgtcgaaagagacccctcaatcgcacaaccatgtgtctgctgagaaagacgaatttcactccgtaacaagcgctcaagcatcggacgacgatgaagccgagcctgataccgcgaccgtcaatggctttcaccgggaaagttctaatgaagacatcatctctgactccgctcagagtgaacacgcagctttgccagcagcagaagcagttgcaaataccgcaacgcaggagcctgcttccaagcctgaatcaaacgatgcgacttttgaagagacaaagtctgtcgccgaaagtggaagccacagaacttcggagcccgctcaacccgcgtaa

SEQ ID NO: 8753 - DNA, 1770 bp, A.fumigatus
ctacgatcttcattcagttctcgtctggttcccctacaggcttccacgagcgacaagctcactactggcagtcgagctgctgctattgcctttgtttcatatcattcgtcagacacactgcttcgatcgaggggtattgctgtacatcctattccgagccaggcgaatccgtttgctttgagcctgtcaacctgccaaatgacgtctattcttctcgccgcttctattgcgggcctggttgccctctacctctaccatgtcaaccgagcaatgaccaaagtcccggaggaagctcgtctgttatctcctcgccgatggaccgctgaggagatcaaggaagcttatcgaaaggcgattgaatccccggtagatgtcagcaagagccttcctccaaagcagcatagacgatacatcgttgtgggcggatcaggtatgtcaaccttaccaattgatgcaaggcaactgctgatcacctcaggacttgtcgggaattggatagtaacccatctgcttgcgcgcggcgaagacccgactgctattcgcgtcctggatcttcagtcgccccgtcagcagatcctcgaccagggagtggggttcgtcaaggttgatatcactgatgcagaggccgttcaggctgcattcacgcaaccatggccgcaacaggacactagccttccattgaccgttttccacaatgctgccgtgattagacctggagagcgacacaaggcctttctccaattctgcaccagggtcaacgtcgacggaacccggaacatcctggcagcggcaaagaaacatggcgcaagctgtttcatctcgacctcgtccggatccgtgctcctccgccgtccatcgttctggattacgccctggaccaattggcccaaacgcgttgtgcagatcatcagtgacgcggcagagacgccaaaagagcatgaccaattcttcggcaactacgccgtgtccaaagccgaggccgagcgcatcatccgcgctgccgacagcctcgaatccaacttccgcacgggctgtatccgacccgccaatggcatctacggagttggcgacaccaccatcacgggaatgtatctgatcaagggcggagttcccaggtacgtttcctccctccctcagggaagagacttgcatacaagcctaactccatcaaacagttggacctaccccgtcatccaaagcttcgtcaacgccgaaaacgtctccatcgctcacctcctctacgaacagcgtctcctcgatcacaccgcatccccgaccaaactccccaacatctgcggccaggccttcaccgtcccggaccccaaccccgccatcgccttcagcgacctctacctcctcatgaccaccctcgcaaagacccccatccgcttcccgcgcgtcgctcctgtccctatgctgcttctttcgtatcttctagaatggtatgccctcctccagcatctttacttgccccgtctcctaccaaggatcacgggtgatctggaacagctccagcccggtctgttcgccatctcggacgtgcatacctttgcggacgactcgcgtgcgcgtaaatccccggccgaagggggtctgggctacgttgcgcccatgacgactctggacgggatgtgcaagcaggtgctggagtggaatcggagtgctggggcggagaccgttgctgcggctgcggatcgtgggaagggggtggttggtgtttctgaggaggggctggatgtaaatctggtggttccttcgaagaagttgtga

SEQ ID NO: 8754 - DNA, 558 bp, A.fumigatus
ccaattcttcggcaactacgccgtgtccaaagccgaggccgagcgcatcatccgcgctgccgacagcctcgaatccaacttccgcacgggctgtatccgacccgccaatggcatctacggagttggcgacaccaccatcacgggaatgtatctgatcaagggcggagttcccaggtacgtttcctccctccctcagggaagagacttgcatacaagcctaactccatcaaacagttggacctaccccgtcatccaaagcttcgtcaacgccgaaaacgtctccatcgctcacctcctctacgaacagcgtctcctcgatcacaccgcatccccgaccaaactccccaacatctgcggccaggccttcaccgtcccggaccccaaccccgccatcgccttcagcgacctctacctcctcatgaccaccctcgcaaagacccccatccgcttcccgcgcgtcgctcctgtccctatgctgcttctttcgtatcttctagaatggtatgccctcctccagcatctttacttgccccgtctcctaccaaggatcacgggtga

SEQ ID NO: 8755 - DNA, 216 bp, A.fumigatus
  unsure (58),(59),(60),(61),(69),(72),(93),(95),(96),(99),(103),(105),(107),(109),(110),(111),(112),(195),(198),(211): Identity of nucleotide sequences at the above locations are unknown.
ctgcaagaggttggtttggttccatgggccggccagacgcacccctccccttctttannnnaggattanaanaggagggctcctggatggtantnnggnaaanananannnnatctccccaacgtgggcgatttgccagattggtacagcgatgcccggtttgcccaggtcttcaccacggggctggaaggatanaanggtggtactattncccac

SEQ ID NO: 8756 - DNA, 369 bp, A.fumigatus
aacagtatccccgatcctttggggtgggctagtcgcctcgttaatctcaccgaaacaattcaattcaaggctaggctcctacaactggagtgttccattatggattgtttagtcaaggtggcccctgtcgtcccgtaccttaataaagcgctccctgattttgctcaagctaagctagaatgctcgctggtcgagtattcaactgtatccccgcctcagatgtacaatgttgatatgtcgatccggcctggaaggtttggttcgaggagagccaggggggaaatgatcaagagccaggatatggggaccacttactgtcctggccaggtggccggggcaccgggtattgcggatggtatccaacgatag

SEQ ID NO: 8757 - DNA, 1053 bp, A.fumigatus
catgtcacgcccgagatgctggagtccgtgcaaatacatctcgaagcggacaaagtgggcatgaccccggcggagaagtccaagctcgtgaatgctgcgaccgctgtgtacatcgacatggctgtcgaggaaatgcggagccgcggactggccccgaaggcggattatcgggttcactggtggaaagtcatgcaggactttgtggattctggggaggggcaaagggtcctccaggaaacctctttgacaaaccaagaactcgaaagggtgattgccaaactcggcatcgaaggcgaggtgattgccagaatgggcccagagatcgtgaacatcctgaccggcaaaacccacgccctggcgcatatcatgagagacgacctgctcttccgcgtgtatctctctgacgaaggtaggcgcgccaaccgctacatggcggaatacgccagacttctcacctcacagcgacgagatatccgaatcctggagattggggcgggaacaggaggcaccacgtcggaagtcctcaacctctgcagccccaatggcgaatcattctgtgccgaatacatgtacacagatctctcgccgggcttctttaatgctgcgaagaccacgctgaagaaatgggagtcccatttggccttccaggtcctcaacattgcggatgaccctgcaggccaaggcttcaaagagcacacatacgacttgatcattgctgcaaacgttatccatgcgacggcacgtcttacgaacactttgagcaatgttcacaagctactaaagcccggcggtgtctttggccttgtcgagcttactcgattaactcctttctataacctcacctttggttcgctttctggatggtgggctggcgttgacgaggggagaacagagagccccttacagtctcctcagcagtggaatagcttactgaagcagacgggcttctctggcgttgatctggccgcgtatgatctccctgggccagagagacatagctgtctgttgctgtcgacggcgctgtctaactccgttactactaatgggcattga

SEQ ID NO: 8758 - DNA, 219 bp, A.fumigatus
actcatctctcaatgactgaaaccctccagaagaagcgcctgctgcgcatgacggtggcgcactatcggcagcccaacgtcagcgaagaagagttctatcaatgggtgactgaacagcatgccgcccgtgccgccaaactacatgcgaagaacgggatcgaggggttttgtatcgtgagtagacgaccaatctggaggcgagtgatgaatgccaagtaa

SEQ ID NO: 8759 - DNA, 312 bp, A.fumigatus
  unsure (263): Identity of nucleotide sequences at the above locations are unknown.
tacttcaccccccagtcgtttcgtgactttacgtcggaactcaacaacgcgcgtggaaacccctggcgagttcgagactttgacgctcaagtcgattttttcttccgggacatggagacgttttacaagggggcggccgacgcggatttccaggcaatacaggcagaagaggggccttttgttagcggcgagagggccgaaatcagcttcggctgggttgagacgtacgtcagagagggtcaagtcgtcaacgtcgatgaggntgggaagcatactttcctgccgttcaaggatatgagtcaggcaccgtaa

SEQ ID NO: 8760 - DNA, 231 bp, A.fumigatus
  unsure (56),(57),(58),(59),(60),(61),(62),(63),(64),(65),(66),(67),(68),(69),(70),(71),(72),(73),(74),(75),(76),(77),(78),(79),(80),(81),(82),(83),(84),(85),(86),(87),(88),(89),(90),(91),(92),(93),(94: Identity of nucleotide sequences at the above locations are unknown.
gcatcaaagttcactctcatacactgtgtacacgttaaaacatgtctccaccaccnnnnnnnnnnnnnnnnnnnnnnnnnnnnnnnnnnnnnnnacacactcctgaactggggaaaacccccgggcgtttcccccacctttattcccccttggcagcaacttccccccttttcgccaagctgggcgtttattttcccaaaaaaggcccccccccaaattcccccttccccc

SEQ ID NO: 8761 - DNA, 411 bp, A.fumigatus
aatctcccccagttgaccacctaccccggtcaaagtggcatagatcccgtccccctggtatggggcgcgcccgatgccaaatctcgtggtccggtcatcgtcacccgcagtgcggggatgctcaagcgacggaacgccataggcgcccacggcggcagctacagcatctacaacgcgctggcgattgcggcaggagacctggacgtgaacttccgtccggacttccggaatagtgaacccacgtttaacttcccctggcaaccttcgtgggcggacaagacaaagatcgtctccatggattccgtttggggccttgatatcgtccaacccatttcccttaagggacctgggaaggctggctggggaattcccggccctaccgatgggctgtttaccccgggccaaatttga

SEQ ID NO: 8762 - DNA, 621 bp, A.fumigatus
ttcttactgactgtcctcacaggactctgggctggtcatgtgggaacgccacgtctcttgaagctcttcgataaatataacatcaaagccacatggttcatccccggccactccctggagaccttcccagaagaatgcgcccaagtgagagatgcaggtcacgagatcgggttacacggctacagccatgaaaatcccagcgacatgactcccgagcagcaaaaggacgttctggacaagacgtaccgcatgttgacagacttctgcggcagaccgcctcggggcatcgtggcgccctggtgggaaacgagtaaggagatggcggatctcctgcttgcgtacggaatcgaatacgaccactccatgtcccatcatgactgccagatgtactggcttcggacaggggacacttggaccaagatagactatagccagaaagcggagacctggatgaagccgctggtccgcggccaggatactggacttgtagagatccccgggaattggtacattgatgacttgccgccaatgatgttcatcaagaatgcgcctaatagtcatggatgggtgaatccaagggacatcgaggatatttggaaggtctgttacctgggaccgtga

SEQ ID NO: 8763 - DNA, 399 bp, A.fumigatus
tcaagtgcggttcctgccagccgcgtggtgaagacagaacatgttccctcgtctatagggcctatggcaagagacctctcgtcactcgcttatgtctgccgcatatttgcaaacgctaaaccgtggaagttggaccctaaatgcgctcccctcccgtggaacgaggatagctttggagatgcactatccaggcccctcgtcgtcggcctgattctggacgatggagtcgtgaaaatacacccccctgtcgaaagagccctccgagagctatccgctaaattagaatctcggggccatgaggtcgtggtctgggacgcatcggatcatttcgactatatcaagctcatggatcaatactatactgctgacggatgtgaggatattcggcgcgacgtatag

SEQ ID NO: 8764 - DNA, 489 bp, A.fumigatus
gtcgctggggagccttacatccctcacgttgaagccctaattaaccgtgggaaggcgatctctgtctatgaatactggcaactcaacaagcaaaaaactacacttcaaaagagatatcttgataagtggaatactgttcggtcgcagtcagggaagcaagtcgatattctccttggtccaacgatgccacatgcggctgtcccccatcgcagtgtgcgttgggtaggttacaccaagatctggaatctccttgactaccctgcactcacctttcctgccgatcaagtgcgggcagacagggatcgattgccagacgagctctatcgcccaagaaacgagctggacggctggaattggggcctctatgacccgctgacaatgaacggccacccgataaatcttcagattgttggtagaaagctcgaagaagagaaggtcttgggagcggcaacagtcattgagaagatctggaggactgccaaaacgtag

SEQ ID NO: 8765 - DNA, 873 bp, A.fumigatus
acccggtggatccgggagccacctaccgttgaaaatgttcaggaccgggggtgtttaacggagaatgtgacgttaacagcctgcgcattgaaaaaaggctgtgagggagatgattgtaaaaatcgggtctgcatcggcgacgactgcactcccacgggctgcacaggggatgattgtaccgacggtcattgctcgggtagcgactgtcaggaccacggttgcatcgggcccgattgtgacagcagtggttcaggaagatgctttggtctacagtgtctctcgtggggttgtatcgggctcgactgctcgtcgatcgatttcacctgcactggttcttgctgccgcatcgtgacatgctccggacgcgattgtgtcaatggaatctgcacaggtcaagattgcagatcggaagacaacgactgtgaagcagaaaaggctgattcctgcaccgattggatatctagtacactggtcacgcccgcctcgacctactccaccaccacgataacgacccgctgtgatacaattactgcgtgttctgctaaagctacgaccaccactagcaccgtggacgaagatggactaattgagggcaccatcaccgacttccaatgggcaacgacctccgacgatgcggatctgaccagctacctcgagtccgactattcttccttctggtcggcctttgattctaccagcaccactacaactacaacgaccaaacctacaacaacgacaacaaccacctcatcgcgtccgacagagaccagctacgattgtaaaggctcaattagatgtggatcgtttgccaaccttcacagcttctgtaatatggcaaagggcttcctaactgaggacactttatacgggtaa

SEQ ID NO: 8766 - DNA, 216 bp, A.fumigatus
agacctgcaccaacctacttaatttttcttttagaaacagcagtgtggcacctcctgtacatcactgacctcgacgagttcctttgcttgctcgactacttcgactgtatgtccggcgagtgcacaggagactgccgcggcaagaccaccaaggccagcaccggcaatgataatgtggagatgagcttgttcagaaacctatttggacttagttaa

SEQ ID NO: 8767 - DNA, 648 bp, A.fumigatus
gttggtgcaggtcttcagataacccccaacgcctcacgacttttcgaatactggcaacttcccaactccatctggcaagccgcagctgagcccacggcgctcaccgtccatcgctataccggcccgattctcgccaacgaacccgtctttcacaagaatatccgcgcaaagtatggcgccccgttcatcgacctgcatagagtcgatctgcagcaagctttgtttacccgtgcaaaggagctcggcgtcacattccatctcaacgagagagtcgactccatagactttgctacaacaacagtccaaaccctagcgggcaatcgatataccggcgacttgattattgctgccgatgggctctggtctcgctgccgcgagtgtttcctaggcaagaaggatgcgccactgcccactggcgatctggcctacaggatcgtgctgacggcggaccaaatctcggatccggagctgagagcatgggttgagaacccagagtgccacttctggatcggccccggtgcacatgcggttgcctactcgctccgcaatggacgcatgttcaacattgtgctgcttgtgccggataatctgcccccccgagtctcccggcagtctggttccgctctaagaaatgcggaagcactttga

SEQ ID NO: 8768 - DNA, 246 bp, A.fumigatus
tctgcccccccgagtctcccggcagtctggttccgctctaagaaatgcggaagcactttgaaggctgggatccagtgtttgttgcccgcctttctcctccctttgcttcctcttccggctcccttgaaactgaacattaacagtcctgaatctgttcccggaactatgttccactgcggtggaacaattgaaaacgaagtccccgggagttacccgttatataatcaattggccctacccggttga

SEQ ID NO: 8769 - DNA, 231 bp, A.fumigatus
ggctctgtatcccctccatcagccacctcaaagggctttcgcatattcacgacggaccctttcgcgaaaagttatgagacgaaagagggaaatattgccatcattgagatgctgttctcgacatctcttgttgcgctcatcctctcaccccgtcgtcttcaaatcactaatactaaggtttgtagttcatcactggacaactgtacattcttgaactctgttccccgataa

SEQ ID NO: 8770 - DNA, 207 bp, A.fumigatus
cgccaatctacaatatgcgaattaaccttccccacgaccgtactggcggtcagattgaatcggaaacgactcgtgattgtccttgaagatcaaatttatctttatgacattcaaacaatgaaactgctctacaccatccagacatcgcccaaccccaacggtaagcgatgtaatccgcttcttgcctttgagtcgagcgctttctaa

SEQ ID NO: 8771 - DNA, 495 bp, A.fumigatus
tgccagacagcaatctgcgcgctatcaccgtcctctgacaattgttacctcgcataccctctcccacaaaaggcgccgccttcttcgttcaatccgccgtctcatactcctccggggactactcatgtatcgccgacaagcggagaggttctgatattcgatactttaaaactagaggccataaatgtcattgaggctcaccgatctccgctggcttgcatcacgctcaacagtgatggcactctactggccaccgcttctgacaagggaaccataatccgcgtcttctccgttcctgatggccacaagttataccaattcagacgcggttcaatgccgtcgaggattttcagcatgtcgttcaataccacatcgaccctgctctgcgtctcctcttctacagagacaatacaccttttcaagttgagccatccaacatcatctccagacattcgtcttcaccaaggcgccgaaggtaccgcaaatggttaccca

SEQ ID NO: 8772 - DNA, 846 bp, A.fumigatus
ttgttctattctgttcctggcagaggtctccctgacctatatggatgtcaagtccgccaatgctgtgttggcctgggcctcaaagctcaacaatggttaataccgccaatataccacatcatttccatcaagctaacaggatattcagattctcagttttgtatattggagcagttcttccctgacggacccaatcatccttttgcttcaacaatgatgaagcacttcaacaaacttggagcgcccttgtactcaatccacgaatatcgttcactgagtgagcaagaacagcgatttagaaatgccggctgggcacatgcgcaggctagaagtctctgggatctctggtcagataatgaatttgtcggaagttctctacgagcatggctcgatacagtcgaaccgttcgatgagtgggaagagtttgcactctttgcctcgcattacttcttgctcgtcgcttttacgaagccacaaaccatggttcaggagttacaaaagacgccggcattaactacggagcccgatatatcctcacaatacgtgctgcttgcgggcaacaacccgagaggcgggcagaggaggttcggggccctcatcccggacagtgaaaattctatgggtcaccattcaggtttaggccgccagactcgtgatgtttcgacagatctctacagcacgtgcaagggtatgactaccccgcaacttccattccctccacgagaggtctctgctcggatgtgtcacacggtgactagcctgcgcgggggtgactgcttgctcgtcggtgggagagcctcaccagcgaacgcatttcaagattgctggttgcgacagggagtgtag

SEQ ID NO: 8773 - DNA, 222 bp, A.fumigatus
actaataacagcagcattgtatccaaacggagcgtcgaattactatactatcccaagccccatttcttcagatattttgtgaagagacctccgagacgatcgcctttgattaatcgtggatactggcttcgcatgcatgctatggcggagtcggttcggcagttcatgaagcagccgtcggataaacccaaattcgtattgaatcttggatgtggattgtaa

SEQ ID NO: 8774 - DNA, 450 bp, A.fumigatus
gtcgtagagaactaccgctgtgctggtcggacggaggggaggtgttctcttcagtcgtatgctaagttgggctgtcgtagtgatccattaccgtttatactcctgagtaccgataaatccttgtgtagtacgacgaggttcgtggatatcgactacgaaaagctgatggtcaataagaagacagcaattcgcaggacagacgagattacccggcttcttgagaatgtagaatttctctcggatgaaagtccaatccagatccgcagcgagcaatacttggcgatcggttgtgatctgaagaacctcaagaagctagatgatgtgctgaagacagagcttctcccgtctgattgttctattctgttcctggcagaggtctccctgacctatatggatgtcaagtccgccaatgctgtgttggcctgggcctcaaagctcaacaatggttaa

SEQ ID NO: 8775 - DNA, 501 bp, A.fumigatus
gatcggctactgtcaggggctgggatttgtcgttggacccttgctgatgcacatgaccgatgcggaagcgttctgtgtattagtacggtgggtttccactcacagactgttcttttcgaggcccgagctgattgcaacaggttgatggatcattatgatctgcggacatgctaccaacccgatctatccggtctccatttgcgcgtctatcagttccaaaacctcctggcccgccaccgtccctctttgttcgctcatctggaatccctcaatgtggagccgatctatgtgtctcaatggttcctatcctttttcgccgtctcctgtcctcttcccatgcttctccgtatttacgatgtcattttcttggaaggggcgtgtgagaccttgatgcgggtcgccctgtcgctgatgcagaggaacgagaagaagatcatggcctatactgagtttgaagacgtgatgcaattcttgctctcgaggagcctgtgggatacgtga

SEQ ID NO: 8776 - DNA, 777 bp, A.fumigatus
ctgatgttcaacagatacgcttgccatgccgacgactttgtcaatgactttgtctcgctgacgtcgctggtcacgaaggaaagtttgcaggccttggaagccagctacaatcagtcgcaaggggtgccaaccggcatcactttccctcagatgcaggcggcggcgtcgagattcctgggccggttctgggcgggatccggctcgcaggcgaagtccttcaatctcaaccccaacaatggcagtatgtctactcgcgccagtgtccgccggtctgcatccaaacagagcatgacctccacgctcaattcgatagaatcaacatccgacgcgagtacggctccgacggagctctcggcagaaccgcccaagccacgggccaagtcggccatgtcgcacaacaaagaccgtgatctgcactcccagatcgaggatctgctgatggcgctcagcgatctccagcggcagcatgcggatcttacacgggagcttcagcaggagcgcgaggaacgggaggaggaccagcaactggcacagtccatgctgaagtacatcaaggagattgaggccgacgatccgccggctgagctgattcgcaaagcggaagagcgattcgtggcctcgggcagcgccaagcgcgtctcgattccccagacgaagcagcaactccgggaggatctcaaccggtggaaagagatgcacgagatcgaagcgggccggtgtctcgatctgacgcgtcggtcttcaccgggggctgcaagtgcagcgccattcaagatc

SEQ ID NO: 8777 - DNA, 699 bp, A.fumigatus
caccattgtgctgatccttcggctgctggcggtgaagacgaatcgactgctcttcttttggctcggttggagcaggagaacaatgctctagcgacgaatcccaagtctgtgagccggcaccgactgcagacaagggcgtcgcgagcgcagtcgctgcaccaaatcaagcggttgattaacgaggaccctcgatcgtctctgcgatactctcagctgcctcctcctcccatgactgagctcgagttctgggctgccttggtcgcggattatcctcagacggcccagcgattgccgactttgacgtccaacaaaatccgcgggggtatccccccgccgcttcgaggcgtcgtgtggcctagcttggctggggctcgagattcttcattactagtcgaatacgagagactgtgcggcgaatccagtccgtacgaaggtttgatcgggaaagacattggtcgcagttttcctaacgtggagatgttccgggacccccacggcgaggggcagcagatgctggctaaagtcttaaagtgcttcagtctttacgacactaagatcggctactgtcaggggctgggatttgtcgttggacccttgctgatgcacatgaccgatgcggaagcgttctgtgtattagtacggtgggtttccactcacagactgttcttttcgaggcccgagctgattgcaacaggttga

SEQ ID NO: 8778 - DNA, 396 bp, A.fumigatus
  unsure (375),(388),(389): Identity of nucleotide sequences at the above locations are unknown.
ctatcgccactctgccaatactcagccgacgatggacacatgactccctggcatatggcacatcttggagggattgcccagcgagggccaggattcttgatggtcgaggcaacagcagtcgaaccggaaggcaggatcaccccgcaggacctgggactatggaaagactcgcagattgagccattgagccgcgtgatcgagtttgtccacagtcagaaccagcttatcggcgtgcagatcgcacacgcaggtcgcaaggccagcaccgtcgcgccatggctctcggccaacgataccgcctccgagaagatgggcggctggccaggccgcgtgtcttcaccacggggctggaaggagccgctctatttgcaaagnggccgctctattnncgaatcc

SEQ ID NO: 8779 - DNA, 201 bp, A.fumigatus
cgctatccgggagaaggctctgaagctcggggccgtcaagtgcgagattgccgacctccgccgtatgtatattcgcgcgatttgcctgggtgcttagcaatggaatctaatggcgatgtaggggagtttattgagcagctctgcttccccgctattgcctgcaacgctatgtacgagaacgtctaccttctgggtatgtga

SEQ ID NO: 8780 - DNA, 558 bp, A.fumigatus
gacttgcagacatacatcgtgccagacaccatgccaaggcctaaccctcgtatcccagcaaacccaagaacatgttcggatctgaaggaattccttcggccacttcatacagaagtcgatacgctatataagctatcttatcgcctctctttgtcatatcagaagttagcttcaacctcattagacgagtttttccccacagcaatcacatgtctccccacagggcacgaaacgggccgctatctagcggtctatgttggtctatcgtatctaagaatcgcctttatcgacctgttgggagatcagcaggtcgagggccactcacgcgtaaggcgaacactggagaaggcatggcctattgaagagcacttgcgacgagatcacgccccggatctgttcacttggattggtgactgtatcgctgaagtggtggcggatggcctcgccaatccgagtgagaagatgccctgtgagttgattacaggcatttctctctgttttcctgtcaagtatatgatcatccctccgtctggtccaatgcaccatatatctaattag

SEQ ID NO: 8781 - DNA, 1314 bp, A.fumigatus
tcatccctccgtctggtccaatgcaccatatatctaattagatatgacaggcagaaatctttagatgaagccgtcttaatgccgacgggaaaagggtttgccttgaattcagacctgaatcttcgccaggcgttgctaagtggatatgaacgtcacacccgtcgccttgatgagcaccagggaccaatgccagctaagaaacggaagctgtactatctgccttcgttaagaatcgcagtcatgaccaacgataccgtggcgactctcgcctctctggcatactttataccttctttgcccaacacgcgcgtggtcatggggctgatcgtaggcgccggctgtaatgctactgttccttttagaattactgatctgcatgagttaaagactcgccatatccgtgctagggagcctgatgcgctagaaacgctagtttctactgaatggacactttctagtgcggctgctccgttgcatgagcttggtatcacaacttcgtgggatacggagctggatatgcattcccagcgaccagggtttcaaccattcgagtatatggtcggtgggcgatatatcggtgaattggtccgaatcatctgctacgactggttcaatcgatccctaggcatggcgcggtctgcgctgcccctaaaactagtcaaggaatattctctcacaacagattttctctccctctttgtggcgtccaattactccaatgaacgcctagcaagcgatctatcaaagcgtttaccacctccccccacgagcagttggcgttggacgcctaacttagcaggtgatgttcgtgccattgcatcggcagtgcaggaccgagctgcttctttggtggctgctgcggttgttggccttctcgcctgcactcgggagatacagctgcggagtccggattctctaagcgccaagatcgatcagcatgcgcatattgcaccaaagggtactgaaccatatgatttacacagtaggttttcgtccaaatcaggctggagaaacggaccagaagaactggccgtagctgtctcggggggcgtcatccaacactatccccattataaggagactgttcagagatatatcgatcggctcattttatgtgcaggaccacaggaaggaggtagaagcgttttccttcgcgaggtcagcgacgggggaataattggaatcggggttctagcaggaacagcctcaggagagattggggaaatcattggttcctcgttacagaaagagaatacttctcatggcgacccgaaaactgcggataatgaagcctcgcccagaaatcaatcctga

SEQ ID NO: 8782 - DNA, 237 bp, A.fumigatus
agcgattctgactcggcatgtacccatcggtaccttatgctggatgatttcacggccacagataccctgtccgctttggacgcagaattgcacttacgggcctccctttgccgccaaagggatgtgatgaagttcagtattctaaatgaagatcacgattatgtaaagttcgatggcattggagatgaaagtacagcagtatactctctagtatattcgatctcatttgatcgctaa

SEQ ID NO: 8783 - DNA, 468 bp, A.fumigatus
accatagcaacctacggctacctggacggcgaatacatcttctctgccgctctactgctggtcatggtcaatgcggccttcccacacaatgagacaaatgccagaacaatggatatggcgctgaatctgttgcgtagtatggctgatcgcggtaatacctacctggggtctcgtcactccttgctgctagaacttcaagcctccattggatccaaccaagtggctcaaggacgggttgatttcaatgctcccgtgacacctatcagcactcagcagcgtagtccccctcagaccattggtataggagaagatgcaagggtcggtccctcagactggccatcccagcagcatatcaccttcaatcttgatatcaacgacgacccaggattgtgggaagaggtcctcggtcagatcgatattgatatggacaccgactggattgagaatactctgagaaagcaagactga

SEQ ID NO: 8784 - DNA, 459 bp, A.fumigatus
cactttccgttcccaggcaactgtctgtactacgccctgtccgatcaattgtacgggagcccggaccatgccgatcagattcgtcttcagcttgcggaccatattgctgctcaccgagattactttataaacttcatagtggcttctggtggagagcggagagctcctagacgagcagctgcatccagatattcttcgtcgtccagatattcttcttcctcttcttcctcttcttcgtcggcaagtccggcacctcccacgtctgaggacatcgaacgcagcttcgagtcgaaattggagggctgtcgaaagaatggcacatggggtggctccgaagacattcaagcattttgccagtcattcaaagtcgacgttcgcgtctatagcacgaaaggtattcagacctttcgagatgtttatgctcggggcagtgaagagagcccatctaacatagcctaa

SEQ ID NO: 8785 - DNA, 1491 bp, A.fumigatus
tcttccagcccggcggtgaagactgaactcgggcaagtcttcgacgttataattgaagagatagagaagaccgtttctgagactgcaacaaacatcgatcaaggaccggcctcccgcgatgcttgtgcattgtacaggtcgttagtccagtataccacagaacacttgacatttgaggatccgatcgatagattggggtttgtcaaacgagtccagagtctcattgcaaaactgaatgagcaacttacggtagcgttgagtgacgagcgtcacagggattatctcactcaacttgcgtcctacaatcttgtgtttgcgagccaggcgtttcaagtggcttgtcatcctcttgttgatcggaagattgcccatgagagctcagacatggttaagtttgctgccagacgggttctgggcttcgtcggaagccgaatggcacagctacagatgcgcacgttccttcaaaacaacaaatctcctacaaagcgtgaagcgggcatccgggcggatcaatctgccctcgaggcctatgtgattgtgcgacatgtgttgcagtccatggatgaactcaaaggttgcttcggtgagttgattgccgaagcctacttgtcagctggaggggatttgagtaactcaagcgatatcgatggtttcgagaatggatggctaagtttgttcatttcgttgccgctcaacgaatttgattcctgcgggttggtcaggattggagcacgcttccaggaagcccatgacaactggctgatggtgaaacgattgctctcacccgttctcgataactacgacaccaacgctgaaacacaaccaatctcatgcaacaattactgcagagctcttttccgaagatgctaccatctgatcaatggttggggctggcgagattgcaggcctataatgcaactcttgtatgacttctttgcgaaaaggcatctctacgatctgaagctcgaggaaagcttcaagtctccttcttttctcgatgaacttgaccgcaacccttcctttgatgtccagccaggtgacccatcttttcatatctttttgaagattctggcaaccgggctgcgatttttgccactgttctgtgacaaaaaacagatccgaaattttgcttggcgactgctaccgaatcacgatggaaggtatcccaaggaaaagcccatttctcaatcggacttggatgccgtgaggaaccatcatgatcttctgtgtacgctcttctttgctgttcctgatgggtgtcggccaagactggagatcattaagacccttgttgaccctgccatttcccatcgtgaaacgtgcaacatcagcattcgggcatggagcagactcgtacgattcaagttgtcaaccgacgaggatctatctgggctcgaaccatttgccgattggctttgttatttcctcggcgagtttttacgacagcactccatcgcacggaaggagattgaagcccagaacattatataa

SEQ ID NO: 8786 - DNA, 933 bp, A.fumigatus
acaaccctttgccccttcaggaggggtccatggagggttattttacggatttgcccaaattccaaggccccggggttctcaagaaccaggagatctacgccattcaaggaggtttctgtctgcggccgaatccgtccacgccaggtaaagggtaccaggggcttgaaccatacaaaggataaaggaggcgccagcgaagccaagttcatcgtccgatttttggagggcaagttgagacttggcctggcagaaaagacagtcctcgtggctcttgctcaagcggtggtggcccatgaggctgctgtgagaggcgaaaagacaccttctcccgagaagatggcgcagggtgaagctgtccttaagacggtatacagtgagctacctgcttacgaagtcatcatccccgcaatgctcgagcatggtctgttcaatttacccaaggtttgcaagctccaaccgggaattccaatcaagcccatgcttgccaaacctacaaagtctatcaccgaggtgctgaaccgattcgaaggaaagaattttacctgcgagtacaagtatgatggcgagcgagcgcagatccattacgttgcgcctgatgtagttcaccactaccccggggcaaaaactaccctgcaaaaggattccaagggtctcagtgcgattttctcacgaaactcggaagacctgtctaagaagtatcctgatgtgctggccaaactcgagacttgggtcaaggacggggtgaagagctttgtcttggactgtgagacggtggcttgggacacggtgaacaagaaggttctaccatttcaacagcttatgacccgtaagcggaaggacgtcaaagccgaggatgtcaaggtcaaagtttgcatttttgcatttgaccttttgtttttgaatggcgaagtgagctcccccatagcttattag

SEQ ID NO: 8787 - DNA, 246 bp, A.fumigatus
cctactgtcaagcagacgttacgcgaacgtcgcgagcttctgcacaagtcattcgaggttgtcgtgggcgaattccaattcgctcagcatggcgacacaaatgatctggaagagatccagaatctgctggacgagagcgtcaatgtgtcatgtgaagggctgatggtgaagatgttggatacggaagagagtggttacgagcccagtaaatcgaagccggaattggctaaaggtattcttcattga

SEQ ID NO: 8788 - DNA, 549 bp, A.fumigatus
caggtcaagaaagactaccttgcaggcgttggagactcccttgacctcgttgtgcttggtgcatactatggccggggcaagcggacatcagtctacggagctttcctgctggctgcatataattcaagcacacagacttacgagacgatctgcaacattggcacagggttctcagaagcgcttctggaagagctctataaagaactgtcgccgttaacgatagaccggcccaaaccattctactcgcattccaatgttcccaaagatcaacccgacgtgtggtttgaaccacggttggtctgggaggtgaagacagcagatctgaccctgagccctcgatataaggctgccgccgatgaattcgtgggaacggcgggtggtggaaagggcgtttctcttcgctttccacggtttatcaaatcgcgcgacgacaagaagccggagcaggcgacgaccacgagagcagtggcagagatgtatcgcaagcaagaggccgtcctcaaagaaaacaccagcaaaggaggtgtggatgatgactttgagtattga

SEQ ID NO: 8789 - DNA, 207 bp, A.fumigatus
gagtctatccccatcgacgttatcaaccaaccatcatcaaagaccaactatctcgatatccactttggagaaaccaaagaccatcgagaccgaggcaaccatgaggatgattacttagattcctggtccaatgaattcaacgtcgcagggacaaagagccaagacacccacactcgtgctagcttgggtttgtctccccatcaataa

SEQ ID NO: 8790 - DNA, 183 bp, A.fumigatus
cacaaccctttgccccttcaggaggggtccatggagggttattttacggatttgcccaaattccaaggccccggggttctcaagaaccaggagatctacgccattcaaggaggtttctgtctgcggccgaatccgtccacgccaggtaaagggtaccaggggcttgaaccatacaaaggataa

SEQ ID NO: 8791 - DNA, 504 bp, A.fumigatus
gacgcgggttttccagccccgggtggaagacgtaggggtccgcttattttctgcttgctgctgaacatgttcctatcgatgcgcgcaaaggatgaccagtcatccctcgtcttctcgggtgtcttctccatagtttggattggagaggctgttgtgaccttgcagatcaagttgcttggtgggaatatgtatgtttcacctttcaatgttatggagctccggattatactaacggttacgtcctcggttactagttcgttctttcaatccgtctgcatcatcggctacactctgttccctctggtcatcgctgcaatgctcagcgcattgggccttccgactattgcccggataccggtgtacctagcgctcattgcatggtccttggctgcaggtgtgagcattttgggtggttccggtgtaatcaagaaccgggtaggcattgcggtctatccgctgttcgtattctacatcgcgatcggctgcctttgttttatcagttag

SEQ ID NO: 8792 - DNA, 183 bp, A.fumigatus
attgttaggatccctggccggccgtatcgatcctccaatcttctaactgataaaacaaaggcagccgatcgcgatgtagaatacgaacagcggatagaccgcaatgcctacccggttcttgattacaccggaaccacccaaaatgctcacacctgcagccaaggaccatgcaatgagcgctag

SEQ ID NO: 8793 - DNA, 207 bp, A.fumigatus
gacaatttaatgaccactaccttcgctcaagaggatggataccacgatttcgatgcatctatgacggaagggcttcgtccaagtcaatcttcatgtcaacccctacgatgtactccaatcaactggtatgatatctgctctcaatttgaaagtttccagtgcaattcaatgcttctaaagattgactacttccatactcccctttaa

SEQ ID NO: 8794 - DNA, 258 bp, A.fumigatus
gacggaattcaattctgcttatttcctgtggttagttccataattattattaacagcatccccatccttcacaatcagctttcctcggtcatccgacaacttacatccttgacttgccttggcttcattcacaaaccagctttggcagcaaacctgcctagctaccagggtagccccggtgttcctaactcaagctccggagttaaggtcagcaggagcaagaagcaaggcacaataggtacctacctacctatctag

SEQ ID NO: 8795 - DNA, 582 bp, A.fumigatus
tttacagtagatttcgatacatatacttgggtcctgtcaagaatacctactgtcttcagacacatcttccctacatcaatcaagcaaaacaataaccacaatatgcgactctcaactctcctcctccctctccttcccctcgccctcgccaacccaaaccccaacccagtggccgctccagacccccaatccacaggcggcggcctcctctccgaactccccaccatcctcaacggcgtcaaagagcttctaagcgaggataccctcaacgacctgcaaaccatcgtcaaaggcggcgctgtgctcctgggcggcgacaacccggccaatatcgccaagttgctctcgaaagataatgtcaacaagctccaggacgtcattgataatgcgcattcgctgctgacgccgaactttgtgaatgagacgtcgacgttgattggggatgcgacgccggtatgtttcttttttcctcgttccttgaagttgatgctgactgttatagctggtttcggctgtggagaagttgctaggtgggttgttggcttcgttgacgtgattggtatggagtctgggtgtatatga

SEQ ID NO: 8796 - DNA, 378 bp, A.fumigatus
cagcgtcccttcacaatgtccctcgacgagacgctcgccgaaaaaaagccacaaacaccaaccaccaacagtatcaagtcagaaacaaactttcttgatgcgctggatagcctcgaaatcctcccccagattctgcaagagggcatcctcttcgctggatcagggacagcgcttcttctccaagcagccacgcccgagattcgcaacgatcacgacaaagccaacaacggccccaatgtagccaccgagctcggcaatgccctgcaagcaatgttgagctacgtttcctgtctggtgtttgcgacacggcaagagaagaagacactgctcgacatgctaaatcgaggccagcctccccttcgcggcagcgagcattaa

SEQ ID NO: 8797 - DNA, 510 bp, A.fumigatus
tacgccgcggcgcccgacgtccagctctggatcgcggcgacgctctacgccacggcaacagacttctaccagcgcatctacggccgggtagactaccggacggctgaaaaggcctacgcagagtttggtcttctcgtccacacattgggcctgccctcaggtgtctggcccgagacacgccagaagtcttggacgtactgggacgaccgcatcgagcggctgacggtcacgccggacgcaaacatgtttgccaaggatcttttgcatgacaaggctgtgccgcggtgggtgcagatgctgaagccgtttctgcgggtggtgacgatcgagatgctgccgccgaggctgcgagaggagtacgggctcaagtctacgatggggacgcgggggttgtaccgcagcacaatggggttttcgaatgcggtctatcctgcgctcccggtgtcgttgcggtcttatccgttgcggtactacctcaatgagctaaggaaacatttgaatgttgtttag

SEQ ID NO: 8798 - DNA, 387 bp, A.fumigatus
tgccactctcacgcgtccttgctaacagcatctccaggctgcgggatcaaatgtgtgatcgcgaaatccttcgccttcatctttcaacggaacatgcccaatctcggcctgttgggcattaccatgcctaacgagtcgttctacgccgccgcgaaggatggctcggaggtatcaattgacctccttgcgcaagtcatccacattgaggggctcaggtttgtattccaattaagtcaaatggaacaaggactgtaccgccacggtggcattacttctgcctttcgaaaattcgggaacagactcttcgaggagctcacagcggcgaagaatatagggacaagtcacatggaagagaagtgtcatgcacctagcgcgctacaatggtaa

SEQ ID NO: 8799 - DNA, 702 bp, A.fumigatus
gcaagggtaagtccacatttgtccgtcaagagatcgaataatgaccgtatagacctcaacttcaaacccaacgaatacaacctgctgctatccatcttctttattccgtacgtgatttttgcgacccccggtgcgatgcttggtaaacgctacagtccggcgcgcgtcctgcccatcctcatgttctgctttggctctttcaccatgctctcggcgtcaaccaagaactttgggggcattttcgctcttcgctggttcctgggcatgtgtgaagcccccttcttcccactcgtcatctactacctgaccacattctaccgacgcggcgagctcgcccgccggctggctatcttatatgccgcctccaacatcgccaacgccttctcgggcatgatcgccttcggcgtcttccagatcgagggctcctccatccccaactggcgctatctctttatcatcgaaggcggcgccaccgtgctcttctccatcttcgccttctggtacctcccgcgcagcgtcgccgaggcgaaattcctctccgaagacgagaaagccctcgccctccaccgcatccaggtcgactccagcgccatcgtcaacgacaagttccacctccgcgacgcattggttatctttaagcatcctaccacctacgtcttcctgtgcatcgaaatctgcccgaaatcttcaccgggagttaca

SEQ ID NO: 8800 - DNA, 600 bp, A.fumigatus
ttgcgggtcgcctgtccacgtggtgaaaacggcagaccaagagcgcaaagatttctcgtgaaaggagagtcggacgggtcctcggatctcatgccaggagagaaggagtacgagatagcgtgcgcggatcagaacttcctctcactgaaccacctccatactctcagcacggaagatgccatgacagagctagtcaagtacccgggtatcggtcccaaaacggctgcctgtgtcattcttttctgcttgcaacgcccatgctttgcggtcgatacccatattttccgtatctgcaagtggctaggctgggtgcctccgggtaaagctaccgaggtcactgctttcagtcatcttgaggttcgcattccggatcacctgaaatactctctgcaccaacttttaattcgccatggaaagacttgtcctagatgtcgagcgatcaccgggcagtcctccgctggctgggaggatgggtgtgtgatcgaccacctcgtaactcgaactggaaagaaaaaagagggaaacacgaatgtgcctgtggctagcaagagaaggactggacgaaagattcgcgctgagactgatggaagtgacgaatga

SEQ ID NO: 8801 - DNA, 894 bp, A.fumigatus
gaggaaggttcttcggacattgctcaagtgcgttcgccagccttgaatacaggttcgagtgaggaagtggaagctaacaatcgattcgaaattcgcagatatgttctcgaccaccaagatgagatcctcgctgcgtgttgcctggattcgggaaaaacaaaagtcgacgcttcattcggggagatcctcgtcactgcggagaagctgaaatggaccatcgaccacggcgaaaaagccctgacaggtgagtcccgcccgacaaatttcgtgatgatgtacaagaagaacgtggtcacatacgagcctctgggcgttgtatccgcctgcgtctcctggaactatccattccacaacttcatctccccggtcatcagcgcgattttcgcaggaaatggtattgtggtgaagccgtccgagcaaactgcgtggtgtaccatgttcttcctcgagattatccgaggcgctctatcgagctgtggtcattcgcgagacctagtacaaagcgttgtgtgccttcccgatgtcgcaggcgccctgacatctcacccggatatctctcagctgacctttatcggttcccgccccgtggcccacaaagtgtgtgagtccgcagccaaggcattgacaccagtcaccgtagagctgggcgggaaggatcccgccgtcatcctggacgacccgcggaccgtgagtgaagtatcctccattgcctcggtgctcatgcgcggcgttttccagtccgccgggcaaaactgcattggcgtcgagcgcgtcatcgctctcccaggcatatacgacaagctcctcgataccgtcgcccctcgcatccaagccctccgtcttggctccgtcctcctcgactccagaccaaaagatgcccggcagaaacccaac

SEQ ID NO: 8802 - DNA, 405 bp, A.fumigatus
aaagatggggccactcttctggccttcctctaccgggttccgtccaggtacgaaccacacatcctccgagagaggctctgggaatcaattgagctgcaattgattgcaaagatggactctttggcttcgctcgttccacctgctttggctcccctcatcgacaccctggcgaccaatgcacagcttcttggcgtcgcagtaatctctgtcgcagctatctatctgggctacgctttcgttttgaacagcaaggaggcagctgtgacttttaatattccactaccggctgaggttcgcgccaactggaccggcaagaaatgggaggatgtgcagggtgaggagaagaaggtgcttgaaggtcaggtccgaggggtaggtttatttcctctgcgcattgacgattga

SEQ ID NO: 8803 - DNA, 513 bp, A.fumigatus
caatcaggtgcgagcggcttcacgtccatcccttcttaccttctaccaaactcacaccacgcagaccacacaatgcgtttcaccaccatcgtcactcccctcctggcgagcgccaccctcgcctccgccttctgccacaactccatctcctgcatgatgggcggcgactccacctgcaacaacgtctgcgtgcgccagggtaaccccaacggcggccgctgcctcccccgcgacggctgccccggctacgacatctgcgcctgctacccgaacaacaagcgcagcgacgaggtgattgatgccgacgagcccctgcgtgaagccctgaagaacatgggcatcgaggaggataccgtggagaagttggaagctagagatgcctccttggataagcgcagcatctgctgcagcttccccgacccctggggaggactctgctgtgaggatcactgcagctacattggaaagcctggtggacagtgctccgacaagggtgtttgcacctgcaactag

SEQ ID NO: 8804 - DNA, 567 bp, A.fumigatus
ttgaatctagcgagcgtgaaagccagaaatctcaaaccgattgaaccaagccttgatggaaccagcattctaccccttcaacgaatacacactccctgtaactgcctagttgcaggtgcaaacacccttgtcggagcactgtccaccaggctttccaatgtagctgcagtgatcctcacagcagagtcctccccaggggtcggggaagctgcagcagatgctgcgcttatccaaggaggcatctctagcttccaacttctccacggtatcctcctcgatgcccatgttcttcagggcttcacgcaggggctcgtcggcatcaatcacctcgtcgctgcgcttgttgttcgggtagcaggcgcagatgtcgtagccggggcagccgtcgcgggggaggcagcggccgccgttggggttaccctggcgcacgcagacgttgttgcaggtggagtcgccgcccatcatgcaggagatggagttgtggcagaaggcggaggcgagggtggcgctcgccaggaggggagtgacgatggtggtgaaacgcattgtgtggtctgcgtggtgtga

SEQ ID NO: 8805 - DNA, 675 bp, A.fumigatus
ctggccttcgaagcatgcgcggatcttgctaacgagattcttgagaagcgcaacatccctgatcgcttcaccggcgcgcagctgattcaggacttcgttggtcagaacttccgcgggatgatgatttctcttcaagccaagtacaagttcgagatgtccaaggaagagcttgaggagtacgtcataaaagaagaggatgaggtcatcggcaagctcaacgaaaaggcacagccttgcgctggtgccaacgagcagctgaaggagatcttcgagtccaagaagtatgaccttgctgtcgtctcctcctccgccctccgccgtgtcaaagcctccatcaagaaggttggacaggacaaatacttcgatgacaacctcatcttcagcgctgctagctcccttcccaagcccacttccaagcctgatcctgctatctacctacatgcccttgaggtgtgcaagaagaagcctgaagaagtggttgccattgaggacagcaagtctggtgctttgagtgccatccgcgccggtattcctgtcattggctacgtcggcagctaccctggtgatgaaaagaagcttgagatgtcccagcgtctggaggaactcggtgccaaggtgatcatgaaggactggagcgagttcaaaaattgccttgaggagatcgaaaaactctaa

SEQ ID NO: 8806 - DNA, 204 bp, A.fumigatus
caccagggccggggccccgcgcacactagcttctatagcttgaactgtgacttaaaatcaatctaccaattcccctctgggaatatagcacagtctatcaaggtccaagtgacatctcttgcagatcttcaagctctattgggttcctttctgctatctaaactctttaagcgaccaattggtcggtccgtgctgcatgcatag

SEQ ID NO: 8807 - DNA, 282 bp, A.fumigatus
actactgccagactcttaggacttaatcgtgtacctggtatgatctttgatttcctctctctctccaatgccgagactcgagtctcgatgcatgtgatgactctacttccctcgaagcatcagacactaaaaccgtccaccgcgccagtgacgaaatgcatcacacaatgcgatctaacgacagactcaacaggctgtctttactttcattatctgatcaagcagaaccattctgctgtgttgtatttttttttttttttttttagcattacaggtacatga

SEQ ID NO: 8808 - DNA, 213 bp, A.fumigatus
tttcgtagcacatgtattctaacatccacccatccatatctagcaacaagagatttcggctgtttctacaatccaagagagaatcaatcagtattttatttcatattatgtattcactccacattactttcacaaaaggattacaccgagcatctagctagacaagttatccagggcacatacaagaaacagaactcgtttaagagtacgtag

SEQ ID NO: 8809 - DNA, 1137 bp, A.fumigatus
agaacacctctggtacgcgctgttttatttacgaataattatgagaagaggacattcccggcacttctggacctactccttgacactgtctcattcagggactggttcggcgccaccattttccatcacatatcggaaactaccaggagtaaagggaaatggaagagctctcgatattactgcgaagtcctgttggacaaattgcataatacctgctcgcaagacgaaatcgacctgctactctcctgccaggactcaaatggggatacagccgctctagtcgcagctcgaaatggcgcatttcgcttggtcaatctgcttctggggcactgcccgcgagctggagatctggtcaataagaaaggcgaaacggccacaagcattacccagagagcgcatctccccgagcagaatattcctcccccgccatcttcaataacaatgggaattgatcacacggaaggcgatctcactgtcctggaaacccccgaccagaccgatgctcttccggccgaagcttcacttgccacctcagccttacttgccaagattagtgccatcatggccgaaactaataagaagctcgccgcttgttatgggcatacgaaatctaatgaaccagtctcagacgacgttgcgaatcccgaagctttgtacgagcagttggaagtggatcggcagaagattcaggagcagactgccgccttggaagccaaagagaccgaaggagaaccggttgaggcccagcttgaacgatatgagcgactcagaagcacttatgaatctcttcttgaacaaattcaacaagtccgcctgaaagagcgactaacatcaatgcccccaccagcaaaggagaacatgatgccctcatcgagcgatcagaaccaattattaatcacttatcagctggcgcgacaactatgctccctacagaaagcgcgccgtgcagcagtcagggatctagcccagcagaccgccgatgcgggggtaagcaccaagttcgatgtgcatcgaaggcttgtcgcccttgcaacgggcctaaaggaggaagagttagaccctatggctgcggagttggccgagacgttggagtttgaccgaatgaatggaagggggcccgggcggcgaatcacctga

SEQ ID NO: 8810 - DNA, 384 bp, A.fumigatus
cccgctgcaaaggtgttctacagcattggcttcgccggtatcatcttcagtgtcgatgtcattacggccgatacgtcgacacttcgcgaccgaggcctcgcctacgcctttacctcctctccctatatcatcactgcgtttgggggtcctgcggcggcggagcacttttacgactcgaactggcgatgggcatatggctgtttctcgattgttttgcctgtcgttgccctgcccatgttttgcctgctgcggtggaatcggcacaaggcaaagaagagtgggcttctgaaagacaaggccgacagtggcaggacgtggatggagagtatcaggcactatatcatcgagtttgacagtaagtatttagggacatttggagattaa

SEQ ID NO: 8811 - DNA, 948 bp, A.fumigatus
tccgtactaatggtcgtagtactcggtgtctttttcctagccgccggccttgtcctttttctcctgccgttttccattgccggctccactgaggacgactggaaatcagcctccatcatcaccatgcttgtgatcggtttcgtctgcctccttgtcttcgctctagtcgaacgctttgttgctcccgtccccttcctcccctgggctctactcgcctctcgaaccgtcctcggtgcctgtatgctggacgtctgctaccagatcgcatactattgctggttcaactactacacatcctacctgcaggtggtctacggcaccagcatcaccaccgccggctacatcaccagtattttcgacgtcgtctcgggagtctggctattcatcgtgggcttcctaatcaagaaaaccaaccgcttccgctggctgctcttcatcgccgtcccgctctacatcctgggcgtcgggctcatgatctacttccgcaagcccagctggtcggtcgggtacatgatcatgtgccagatcttcatcgccttcgcgggcggcaccatgatcatctgccagcaggttgctgtgctggccgcctcggaccacgaccacgctgcttcctcgcttgccttcctgaatgtgtttggcacgatgggaagcgccgtggggagcagcatctctggtgcgatctggacccataccctgcctggtgcgttgcagcgtctgctccctgactcggtgaaggcggactggcagacgatctacgattctctggaagagcagctgagctatgagagggggacgctgatccgccaggctattgcccttgcgtatgccagtacgcagagcaagatgttgattgcggggacggctatcatggcgctgtcgctcgtttggatgtttgttattcgggatatcaagcttaccaagacacagaccaagggagttttgttttag

SEQ ID NO: 8812 - DNA, 189 bp, A.fumigatus
gtcccacatacaaaggagccactgctggagaaccaagtctacagtaatcagtctgactggttggacgaaatgaatcagatgctcatacagaactcaagtgagttgagaactattcgggaactggcggtcattgtgtctcatcaaagctatcagactttcaggagaccgagggtgctcctttgctcatga

SEQ ID NO: 8813 - DNA, 222 bp, A.fumigatus
tccgtattgtccctccgatttcatgtcagggagatgagggcgagttatggcagttggccaactacccccatgaacacatgcaaatataatatttgcaggagtggcatggactttgaaactgatctcaaatgcaggttttttaagtgctatccacaacttacagcattttctagtagcgcttatattgttctcacctcctcgacttttcttgtgcttcattga

SEQ ID NO: 8814 - DNA, 1266 bp, A.fumigatus
atagcgacgtacacgagcagacatgcacatcagccaggtaggcggactccgttgcttgcaaagaaacaggaaactcatatctcagtccagctctacacataccccatcaaatccctccgcggtgtgtccctatcggaagcaactctcactcgaacaggattccaatatgatcgccgcttcatgctcctcaaggtcatccccgaccagaatggcgcctacaccctcaagaacatgcacgtcccccattttcccgaaatggctctctttacaacggacatcatctacccagatgaagagaaaggtataccgggccggatcatcgtgatgtaccacccaccagcggacgatcgtgtcgacgaccaagacaaagccacgaaaacgctaacgatccccttgcaacccgacatacgaggcctgcgacaattgagcatcgagatgcaccagagcccgacgacggggtacgacatgggcgatccgtataacgcatggttcagcgagcggttcgggtacggcgtcgtactggcctacctgggcccgcattcgcggcgtgtcctggggagtttcgcgccggggaagagtcccgcccacgcggtggacaagccggtggtttcgacgcgctcgcttgttgggctggcggtcttgacgctcgtgctgaatggtgtgcgtgtttcggcttcggcttcgggggcggtgcagctcacaagtgacgagctgcggaagcattggccgggtgttgctgcaacggttgtcgcggggttgctgtcgtggatattattgcgggggttgtcggcgggccaagacgacgagtcgattacgtttgcggatacggcgccgtatctgcttacgtctgagacgtccgttgatgagctgtctgcgcgctttgagggcggcgagcgcatggacgtgaccaagtttcgaccgaatattgttgtttcgggggcagcgactccctttgaagaggacttttgggctgagttgagagttagacaaggcggtcgtgcggcgaggttgctgctcacggcgaattgtgtacggtgccagagtattaatgttgactatgcgactgggaagatgggaaagggggagacgggcagtgctctgaagaagttgatgaaggatcggagggtggataagggggccaagtatagtcctgtctttgggaggtatgtgttcttggatcctggctcggacaaggcgatgattcaagtgggagatgaggtggacgtcctgaggacgatggacgagaggacggtttacggtcagtag

SEQ ID NO: 8815 - DNA, 495 bp, A.fumigatus
cgcggatccttccgagccccgtgggtgaaaactggcccaatcaacaatggcggtctcggctacaacatcgtgtcgggcggcaccgacaaccacctggtccttgtcgacctgaagaatcgcggcgtcgatggtgcccgtgtcgagcgtgtccttgaactctgtggtgtcgccagcaacaagaacactgtccctggcgaccagtccgccctgaagcccggcggcctgcgtctgggaactcccgccatgaccactcgtggcttccagcctgaggacttccgtcgtgtcgctgacattgtcgaccgggccgtgatcatcacccagaaactggacaaggcggccaaggagagtgctgccgccaagggagtcaagaaccccaacactgtcaaggccttcttcgactacgtgggcgagggtgacgagatctccgagattgtgctgctgagaaaggaggtggaagactgggtgggcactttcagccttccgtgggatgattaa

SEQ ID NO: 8816 - DNA, 414 bp, A.fumigatus
acatggcacacggagaaattgtggccagagctggttagtttgcagaaattattgctcatttgttcgcatgctgacttgatagatacaactgcatccgacgaaacaaagactgattctaaggcgagtaagaccgactctgcgtcggataccaataccgcggactcaacggcgacggactctagcagtggaaaaaagacctctactggaacggccaaggagaccggcacacagacggagtcgggaacaagtaccgagactgctacggacaaatcgggcaagaacagcaagactaagacctctaccaagtcgacctcgatcgatccacgtctccctgctggcggaacgtcgatgttgattcccaccgcaggtgccacaacctactacaagattggcgactatgtgacttttgcctga

SEQ ID NO: 8817 - DNA, 318 bp, A.fumigatus
aactatacctctctgttggtgacgccgtctgcggtgaatgttctggcgacctgcaccatgaacagcgcgacctatacgctgacgagcaacatgagcgtcgaggagactggaaaggtagtgtgggatacgggcaagtaccaggcgaatgccacggtcccactgctgactgcgacgtacacgttgtacgtggtcgacgtggacaaggatattggagacaccgcaagccccggccaccttggctcgcagaacggttaccttttcggcatgtacagtccgcaaccttatactcctctcaacggtatgctcttatttttgtag

SEQ ID NO: 8818 - DNA, 357 bp, A.fumigatus
gcaatctttctcgggaatccgagaagtgagctactgggtgtgaaggaaaggccccacgggagatctgaatctgttctcgcaaggcttcttcgaattggcgccgggcttgccggtatgtgtgccttccccatttacttcgtattccagtatactgactatgcatcagggtttattccaatgattggctatcatcatgttctcatgataatcattgctgtggcgatcatccttctctgtgagttctctgtctgccacatgtgcggaatgtcgctaacttgtcctagccttactactggccggatgttcatcatcatcaccacaaataccggatatctttctgatatctttatactatga

SEQ ID NO: 8819 - DNA, 342 bp, A.fumigatus
cttgtcctagccttactactggccggatgttcatcatcatcaccacaaataccggatatctttctgatatctttatactatgagcggtataatccagtcttcgacaaggcgcaggtggaccctggcgtggtaacagcgacggcaaatatcgttggtggtgccgaaatggaggtccgcgtgggatatttcggtatctgcgtccaacccgcaggcggagcctacatctgcaactccaacgccacggcattggctgagattgtaaccgtcgaccaagatccattgaatctaatctgggtggcatcgacattcaaagacgcagtggtgttcccatatttgctgtaa

SEQ ID NO: 8820 - DNA, 1380 bp, A.fumigatus
agaatattcttattcaagctcgccaaacccgacaaccgcaagcaactcgtcgttgactcaggtttccgctgccatgtcacccaatactcgcgcgcaacagcaaccgccccctctcctttcgtgacccgcatgcgcaagttcctcaaatcgcggagactcacatctatcgagcagattggcactgaccgcgtcatcgacttctccttcagcgatggcatgtaccacatgttcctcgagttcttcgccggcggcaacatcatcatcactgatcgcgagtacaacattctcacgctcttccgtcaggttcctgctggagtgggcgaggaggagatgagagttggactcaagtacacggtcacaaacaagcagaattaccatggtgtgcctgagatcacgtttgaacggattaaggagacgctggagaaagcgaaagaggcttccgcgcaggaaggaacagcgccaaagaagtcgaagaagaaaaacgtcgatgtcctgcggaaggctttgtcgcaaggattcccggagtatcctcctctgttactcgatcatgcgttcgcggtcaaggaggtcgatccggcaacgccgctagagaatgttctgggggatgatactctcatggagcaggtcaatggtgtgttaaaggaggctcagagtgtgacgatcaaactctcggcgaaggaagatcatccaggttatatcgtcgcgaaagaagataaacgtccatctgcggagtctactgctgatgctggggatccgtcagagaaggcaggacttttctacgaagacttccatccctttaggcctcgccagtttgaagggaatccggaggttaaaatcctcgaattcagcacttttaacgcgacggtggacgagtacttctcctcgctggagactcagaagctggaagcgcgactcacagaacgcgaggaggcggcgaagagaaaacttgatgctgtcaggcaggagcatgagaagcggctcggtgccctaaaagaggcacaagaaatacatgtccgtaaagcggctgcgatcgaggacaacgtctaccgggtgcaggaggcaatggatgctgttaatgggctgattgctcaaggcatggattgggtagagatcgcccgtctgatcgagatggagcagggccgaggcaatcctgttgcccggatcatcaaattgccattaaaactctacgagaacaccatcactttggtccttggggaagccagcgaggagcaggatgcagccgatgatctcttctgggatgaatctgaggaggagtctgaaagcgaagagcaggaagcagctcggaaagcctctgaaatgctgactatcgacattgatctcgggctttccccgtgggcgaatgctactcaatactacgaa

SEQ ID NO: 8821 - DNA, 252 bp, A.fumigatus
ataagaatattctctagcgaggagatcagtatagatcgatcatctacagtatttgttctgatcgacctgacataccgaggaaaggtcgtatatgttcgaaactcgaaggttgaccagctccgaggcgagttcctggcaaatgacctgtcgtcgtgtgagattctgcgcattcagcatggcggtttgagctgcgagggacgtaccttgacgtctagggatgagaatcgttgcttcattttcctaggcaattga

SEQ ID NO: 8822 - DNA, 942 bp, A.fumigatus
agatacttatccaccccgaaactaccaccaccgaagaacaccgactttgttccctccagtattctggtggagcctacaaccacgactcagctctcaacggctgagaccgctactggcaccaatcgacccgctcaattgcctggatccatctcgccagccaatggtctgaccagccctccaccagactctactttgattcagctcggcttcaatggcaaactccgatacagcttcgttgccacaaccccgctctcttcatcgcagatcttcttgtacattccacagggactgatctatgctttggagattctcggcaaagatattgcgatgttcgccatccagccgtacgacaactcggctagcacgggttacattgcaaccgttgccttggcttatattcctacagacaaggttgacacattgaggaagctgctccgcagtccattgtccaaactctaccaacagcccaacgagtcggtcaagaccctgttctcgatgatcgatccttctatccctcttgttgttggagaatccggctcatctagtggcagcggattgtatagcgacagtggaatcagcggcagtggtagcagcagtgatggtaatggcagtggcagtaactctggcaacgatgcggatgccggtgccagtcgcagcgcttcggctcgtgccagctctgttggcatcggcgttggtgtcgtatgcggcgctgcagcttatggtgcgggtatgttctgggttgctcgtcgctaccgcaagaagcgtcaattgcatcgccgctccaattccactatggagcagacgagtgaaggtcgtggggccggttctctcttcgccgctggcggtcgtctttcccgcaacagccagaatagccggggaagtggccggggccagatgatcagtgctcctgtcatggccgagaactccctgggctggaactaa

SEQ ID NO: 8823 - DNA, 411 bp, A.fumigatus
cagctgggccttgccgtcgtccccttcctcccatacatcttcgacgaacccgtcggcgaagcagtggaatggtccttccggaccgctctccgcgcctacgcaggcgaggacgccgtccggcccttccccgccccggccacggcctcagccgctcaccccgcagagacaggcgcagatgcaccttccgtatcgcgatacctcaagacccaagcggagaagaactcatccgtggcgctcggagccgacggttccgtcgcagcgagcgcgaatctctcctgggaggagtacaaggccgagcggcagaaggccaaggaggagcgtaggcggcagcgcgaggccaagggctggacgggaccgctcgcttggttggggctcgggtcggactcggactcgaagagtaaaaccgagtaa

SEQ ID NO: 8824 - DNA, 924 bp, A.fumigatus
tgtcgcccacgaaggctacaaagcctacctgcgcaaccggcacgtcctcgccccacccggcgaggcctacaaggacgccaaagacctctcggccaacgaggtcgtcatgggcatggcaacaggcgacatgggcagtcccagcgccggcaccgatgccgagctcgctccctggccgacaacccgcatccccctcatcgaggactaccgcatggtaatggtcaaacgggccgtgttccagagcatcgcaagcatggggctgccggcgttcacgatccactcggtggtgaagtactccgggcaaatgatgaagaacaacaagaacgtctttgtgcggacatggacccctatcggcgtatgttcccctccacccgagcagcgttagggaagtccagcacagctactaatgtgaattgcaatgacagctgggccttgccgtcgtccccttcctcccatacatcttcgacgaacccgtcggcgaagcagtggaatggtccttccggaccgctctccgcgcctacgcaggcgaggacgccgtccggcccttccccgccccggccacggcctcagccgctcaccccgcagagacaggcgcagatgcaccttccgtatcgcgatacctcaagacccaagcggagaagaactcatccgtggcgctcggagccgacggttccgtcgcagcgagcgcgaatctctcctgggaggagtacaaggccgagcggcagaaggccaaggaggagcgtaggcggcagcgcgaggccaagggctggacgggaccgctcgcttggttggggctcgggtcggactcggactcgaagagtaaaaccgagtaatgggtctctattttcctttaatactaaatttgggtgggcgggggcggggcgtttcatgggtttcatgcgccctgcacttgagcttgtatgttga

SEQ ID NO: 8825 - DNA, 459 bp, A.fumigatus
tctttgacccacatcgtagggttcagtttatcaggccttctgcaatactcgggcttagttccagcccagggagttctcggccatgacaggagcactgatcatctggccccggccacttccccggctattctggctgttgcgggaaagacgaccgccagcggcgaagagagaaccggccccacgaccttcactcgtctgctccatagtggaattggagcggcgatgcaattgacgcttcttgcggtagcgacgagcaacccagaacatacccgcaccataagctgcagcgccgcatacgacaccaacgccgatgccaacagagctggcacgagccgaagcgctgcgactggcaccggcatccgcatcgttgccagagttactgccactgccattaccatcactgctgctaccactgccgctgattccactgtcgctatacaatccgctgccactagatga

SEQ ID NO: 8826 - DNA, 423 bp, A.fumigatus
cgcaccgcttacggcatctcatggacctatctgtttggtgatgtcgcccacgaaggctacaaagcctacctgcgcaaccggcacgtcctcgccccacccggcgaggcctacaaggacgccaaagacctctcggccaacgaggtcgtcatgggcatggcaacaggcgacatgggcagtcccagcgccggcaccgatgccgagctcgctccctggccgacaacccgcatccccctcatcgaggactaccgcatggtaatggtcaaacgggccgtgttccagagcatcgcaagcatggggctgccggcgttcacgatccactcggtggtgaagtactccgggcaaatgatgaagaacaacaagaacgtctttgtgcggacatggacccctatcggcgtatgttcccctccacccgagcagcgttag

SEQ ID NO: 8827 - DNA, 1020 bp, A.fumigatus
cacattacgagatcaatgtcttcatatgatgtgcttgtcaccgggtcggcaggccacctgggcactgcgctcatgctgtcccttcctgagcttggcttcacaccttttggcatcgatatcctgccctcctccaccaccaccagggtaggatccattacggatcgggctttcatcagctccgtcttgatgtcccaccccatcaagcacatcctgcacgctgcaacattgcacaagccgcacatctgcagccatcaaaacgaagactttgtcgcaaccaatattcttggaacgctagtgctcctcgaagaatcggccaaatctccccgccagatcgagagcttcatcttcttcagcacgaccagcaccttcggcatggcactcagtcccaagccgggatcccctgccgcatggatcgacgaaaccgttgtcccggaacccaagaacatatacggcgtgaccaaggtcgcagcggaggatctctgtgcgctgatccacaagcagagtggcatgccggtactggttctgcggacgagtcgctttttccccgaagaggacgacgacgagggacgccgcgcggccatgtccgacgagaacctgaaggtgttggagttggcgtatcgcagatgcgatattgaggatattgtgcgggcggcggtctgcgcgatggcgaaagcgagggatattcgctggggaaagtacattatcagcgcgccgccgctcttcaagaatgatgcgcgtacgctcgaccagctggaccgtaacccggccgaggtgtttaatgagctgtgtcccgaactaggggccgtgtttgagaagaaagggtggaagcatctttcgaggatcgatcgggtgtacgattcgagcaaggcgatgagggagctggggtgggagccacagtatacatttgcaaagacggtggagaggttggcgatgggcaaagagtggaggagtgacttgacggcgaaggtcggcaggaagggataccatgctgtgagcactggtgtgtataccaagcgatag

SEQ ID NO: 8828 - DNA, 309 bp, A.fumigatus
  unsure (268): Identity of nucleotide sequences at the above locations are unknown.
gatcattgcttaagtgggacgacctcgggtgattctccgcgagacttgagcatcatcgcagagaatgagatcgacttcttgatggaggacatcgagatatactctggaggaacaccggtatcttcaactcccctcctgggctcctttctccccagtttgcgtcttgctacactcgctaattctagcgtcaaactccccggcctcgcccaacccaacctggtcgaagaaatccttgatcgtgtgcccctcgcacgcttccaggtctgtnccgtggctttttatagcaccatacgaccgttgcatagctag

SEQ ID NO: 8829 - DNA, 825 bp, A.fumigatus
  unsure (11): Identity of nucleotide sequences at the above locations are unknown.
acaggaacatntctcggcgttcttgatactcttaaaaacatgcctacagaattgcctcccggaaccgtggggaatctcacggcagagcaggaagcgaaactgcaggaattctggatactgcttctgaaggtttttggcgttaaacttgatgcgctggagtcagctaaggaagcatcgaccagcgcgtcgcaggagaacaagaaagagtccaagcgacgattcgggctcttcggccgaggcaaggatagtgaagatggcactgcgagcgagaaatcggcagaagggatcacaaccaacctcgcttctatcaatatttctgatacagacgataagtatggtcagtcgaaggagtttcagcaaactctagttgacatgtcgcctgaggacattcggacaacattctggactatggttaaacaagataaccccgattctctactgttacgctttctacgggcgcgtaagtgggatgtcaagaatgctctcgtcatgtttatctctactatccgctggaggttgatggacgtgaaggtggatgacgatatcatgaagaatggcgagcaacaggccctcagacagtcgcagagttccgatcctattgaaaagaaggctggtgaggaattcttgacgcaaatgcgtcggggtaagagtttcctccatggcgtcgacaaatccggccggccaatttgcgttgtcagggtgcgcctgcataaggctggtgatcaaagccaagaagtcttggaccgcttcactgtctacacaattgaatcggcgcgcatgatgcttgcgcctcccgtcgaaacagctgtgagtctcaaatcttag

SEQ ID NO: 8830 - DNA, 195 bp, A.fumigatus
ccgacttctcattggcgaatatggtatgaccacgatcttcaatctgccataaacattcacttacctcggcaggattactccccggtcaagttcatgatcaaatgcttcgaggccaactatcctgaatcattaggggttgtgctcattcacaaggcgccttggatcttctctggtttgtcttcgttcctaaattga

SEQ ID NO: 8831 - DNA, 513 bp, A.fumigatus
aagccgtatgtactgaagtatttctgcacaggaatctggaacatcatcaaaggatggcttgacccggtcgttgctgctaaggtccatttcacaaagaacgtcaaggatctggagcagttcattcctcgagatcgcatcatgaaggagcttgagggtgatgagaattgggagtacaagtacctggaatgcgaaccggacgaaaataagccgatggaagacactgccaaacgtgacaagctgttagcagagcgacatgaactcggcaaagaaatccaaaatgcgaccatttcatggattgcggccagctccaagggagacaaggatgctgtggctacagctaaggataagagaaaggaccttattgagcggttgagggagcaatactggcagcttgacccttacgtacgtgccaggtccctgtacgatcgcttgaatgtgatccaaggtaatggcaaaatcgacttctattcagcggagagcatgtcgaagggaaatgcggccagcagccaataa

SEQ ID NO: 8832 - DNA, 294 bp, A.fumigatus
  unsure (284): Identity of nucleotide sequences at the above locations are unknown.
gaagacatatgttgcatccgcagggatgcagctatcgcatcggttatataccttgagcaagctatcgctaagactccagggtccgcggcatctctgctcgggagcctgctacaaggccaaggcagcgcccctcttcacgtcattgaattggggtctggctgcggtattgtgggtatagcgctagcagagctcgtcccgcattgctcggttttacttacagatcttgatgaagttgaggagattgtcatgaaaaacatagccgttgcagggccagcttcattgtncccgggttag

SEQ ID NO: 8833 - DNA, 660 bp, A.fumigatus
ccccagatccgtgaacaatccgtgaaattcttcggccaaaacccatcgactgataataatcgcaacagcgcttgtgctaccctattcaacttaaaaaccaggaatctaactattctcacgatacatctctgggctccctgtcaaccaccgatgtcaatccacatccccctccgccgcagcgcggtcactaccgcccgagtccagacatccaccacctatatctgctcccaatgtcgacatgccacactcctccggcgccccaagcgcccctacaccttcacgcagctcatcaccctctctgacggcagcactttcacacaccgcacgacgtcgccgacacccgtctaccgctcgactcgagacacgcgcaattcgctgctctggaacccctcgtccagcaagctgatgaacgtcgaggaggacgaagccggtcgtctcgctgcatttagagccaagtttggtcggagctgggatgcgaatacgcctgctgaaggggacacagataccgaggtcgccgctaagggcaaggaggcggctgatgctcatgcagcagcagctgctgaggccgcgctggccgaggaggaagacgacaatttgcttgacctgataagttcgtttggacaggagatggagcaggaacctccgaagaagaagaaatag

SEQ ID NO: 8834 - DNA, 825 bp, A.fumigatus
attctcaggcccttcaaaagtttgaaatctcgtgcacgctccattctagcaatggcgtcacgtaggtcgaggtctccttcgaccccttctgagggtgagatcatcgaatcaggttcagagacgaaggcaactacgtcgcaacttcctcttaatggcaccagcgttgaccgtcaaaccagagtcagtacatcgtccgccctcagatctccagcatctgtaagcagatcgccacgccaacggaggtccagggcgaggacttggtcgcgttcacgatcgcgatcccgctctcgctcgccctatcgagaccaccgagggcagaaacgtcgacacgcggatgactataacgagaggcgttatcgaaacgaaccatctcgacgcggaggtcccaggcataacgatgacagacactataatcgcggccctgcttcccacatacgctctagaccttaccatgattatgaccgagatgattattacggtggtggtctccggtacacggacgactatgatcgacgcggggataagcgacctcggacgcgaagccgatcaccctaccgggaagtacgaaaacccaaacagtactcgggcgacgaatgggattctcatagagagggcagcgtggcatcccgcgatactgaaaggcaaaggtcatctactgaacagttagtgagcgagcgagggaaacctccggtcgtcgctcaagactctagacaagatgctgaagttcgaaagaatcaggtgctgcaggtcccttctcatccctcctcacttgttgaagacaggtatggttgccctggacctcttttgaggttcatgcatcgctga

SEQ ID NO: 8835 - DNA, 711 bp, A.fumigatus
  unsure (99),(260): Identity of nucleotide sequences at the above locations are unknown.
ataactgggacgatccagaaggggtactataatgtccggcggggtgagttgatcaatgaacgatatcatgtcaagcagaatttgggcaagggaatgttntcatccgtggttcgtgcaacagacgccaaaaccggcggctttgtagcaatcaagatcatccgacagaatgacaccatgaggaaagcaggattgaaagaaattggcatcttggagcagcttcgcgaggccgacccggaggataagaagcacgtcatccgttntgagcggcatttcgaccacaagggccatctgtgcatggtctttgagaatctcagcatgaacctacgagaggtcctgaagaaattcggacgggatgtgggcttgaacctacgcgccatccgagcgtatgcacaacagatcttccttggactcagtctgcttcgcaagtgcaatatccttcatgctgacttgaagcccgacaacctgctcgtgaatgagcagcgtaacgtgctcaaagtgtgtgacctggggtcggcttcaccggccacggacaatgaaatcacgccgtatctggtcagccgattctatcgtgccccggaaatcatccttgggatcccatacgaccatgcaattgatgtttggtcgatagggtgtacgctcttcgaactgtacacagggaagatcttgttcaccgggcgaaataacaaccagatgttacgctcgatcgtcttc

SEQ ID NO: 8836 - DNA, 486 bp, A.fumigatus
actaattctgctttgttaatagcctctccacaactgtcggctgccgaagcacccaacgatagcgccggtgattcgttcccagagtttggaaatgatactgatatagctaatcacgatgcacctacggacggtgcagataaagatgagccatctgctgcggattacgatccgaccattgacatgaaagcagaaagacagaagcatgacgcaggagactccaatggagatgtgtcttcggctcgctacgacgaaacacagaccaccaagcaggatgttctgatgccagatgccccccaagcccagcaatccgaatccaaggcgaaagatccttatgatatgttcgcagaggacgacgatgacatgttcgcggaggataaggaggaaaccacgcaacctacacatgcctcggccgtgccggttcctcagccgcaggaactcgacatcagcatgatgaataactgggacgatccagaaggggtactataa

SEQ ID NO: 8837 - DNA, 525 bp, A.fumigatus
tccccatgttcttcgactgctaactctttccttgactctcattttcaggttcgcgccgtggcctatccgaatccaaatgtagtaatttcggcttctcgagatgcgaccgttcggttgtggaagctggtatctaccccgccgcctgtttatgattccaccgtatcctcccacggctcggccttcgtcaacgctgtggcatactacccaccaacatccgaatttcctgaaggtctcgtactctctggcggccaggatacgataatagaagcaagacaacccgggaaaactccagacgacaatgctgacgcaatgctcctgggccatggtcacaacgtctgtgcattggacgtgtgcccagagggaggctgggtaataagcggcagttgggactcgaccgcgaggctgtggagagtcggtaaatgggaatgtgatgtggtcatggagggtcaccaaggcagtgtctgggctgttctggcctatgataaagacacggtcattaccggtgcgtctatcgcttccagataa

SEQ ID NO: 8838 - DNA, 1035 bp, A.fumigatus
  unsure (1007): Identity of nucleotide sequences at the above locations are unknown.
ccaggctgtgccgacaagattatacgaatcttcaatacatcaggggatcttgtcaggagcattaaagattctcgtgatgtcgttagagctctgtgtaagcttcctgcttcacatccctcaggcgcacacttcgcttccgcaagcaatgacggaatcattcgattgtttaccttacaaggggagctgatttccgagcttcttggtcacgagagcttcatatattctttggatgtcttgccgacaggcgagctggtcagttccggagaagatcgaacagtaaggatatggaatggcacacagtgtgtgcagacaattacccaccccgcaatctcagtgtggggcgttgctgcctgtagagagaatggcgatattgttacgggtgccagtgaccgtgtcacacggatcttcagccgaaacgaagagcgagtggcaagcccggaggtggttcagcagtttgataaagccgtcaaggaatccgcaatacctgaacagcaagtcggaaagatcaacaaagagaagcttccaggccctgaatttcttaaacagaagtccggcacgaaggaaggtcaggtacagatggttcgcgaagcagatggtagcgttacagcccacacgtggtccgctgcttcgcaagaatggattgctgtcggtacggttgttgattctgctgccagcagtgggaggaagatcgcatatatgggacaagattacgactatgtcttcgacgtggatgtcgaggatgggaagcctcccctcaagcttccatacaatatttcgcagaacccgtacgaagcggccacgaaatttatccaagataacgagctgcctatgagttacctagaccaagtcgcgcagttcatcgtccagaacacacagggcacaacccttggacaacctgttcaagaacctgcgcccaccggcgccgatccctggggccaggagaggcgttatcgccctggagatgccatagcgacagcggtagaccctacgcctgctgtctacacgcncgacggctggaaggacacatcttggtat

SEQ ID NO: 8839 - DNA, 183 bp, A.fumigatus
ggcctgagtgaaaatgcctccccgaatacaaaaccagctggtctcgggctctctcctcccttacctctcctctacttcctcgacctcttcaacctcttccacatgtatctccaagctctcacaaacatgctcctctcgtcccttttgctcctcgcccgctgctcagaccaggctgcggaatga

SEQ ID NO: 8840 - DNA, 1176 bp, A.fumigatus
ttgcgcggacccttccaccccgtggtgaagacctttgcggccgccatttctatggcaggtgatctattacctatgatgagtttgcttgtcatgttctcggtcgttgttttctttacggatcgtccgctgcgggctccggttgccttcacatcgttgtcaatcatggagactctgcgttctcagttcgtctggctctcaaacatcagcagatattcggcccagggtgcggagtcgcttcgtcgagtggatcacttttttgacaccgcaggcgagatcagacgtcatccagacggaccgttggagctcaaacacgcaactttccggcgaacaccgatcgcagattttcgtctacacgacatttccgtttccttcaagcagagtgccctcaatgtcgtggcaggcccaactgggagtgggaaaacttctctgctgctgtcattgttaggtgagactgtacttgagtcgggaactgctacctgccctcaggatgtggcctatgtaccacagtcgccatggctgcagaatgataccattcgacagaacataatatttcacagctcgtttgacgaggcccggtacaataccgtcattgaagccagtggcctcatccaggatcttcagcagcttcccgctggcgatctcactctagtgggtgagagaggcacgtcgctgtcaggtggccagaagcaacgtgtctctctcgccagagctctgtattcgcgatcatccacattgctcttggatgacatcttttccgcgctggacacacatacaaccaccttggtttatgacaagtgtttccgcagtggtctattagccgacaggaccgttgtacttgtcacgcacctgccggctgccctgaaggacgccgatcaaattgttcagctcaaccatggcagggcttccgtgattaaaacggcgtctgagtcctccagggcgcaaacacggagtgtactagacctcgtcgaagagtcagaacaagacgcagcaaccagcggtcctccaacaactgcagaagggtcttctaccgaatcagaagccaccgtcaatgtcttgcctttcgcagaccaatctgtacagacaagtcgcattgtcaaagaaatgtcggctacaggtcgcgttccacgtacattatgtgagtttataccagctgagccacgtagtcatcgatgctaa

SEQ ID NO: 8841 - DNA, 1176 bp, A.fumigatus
acctcgtcgaagagtcagaacaagacgcagcaaccagcggtcctccaacaactgcagaagggtcttctaccgaatcagaagccaccgtcaatgtcttgcctttcgcagaccaatctgtacagacaagtcgcattgtcaaagaaatgtcggctacaggtcgcgttccacgtacattatgtgagtttataccagctgagccacgtagtcatcgatgctaatatttccctagttttacgctatatgctgttgtttgggggagtctcgtatgcaatggccatgatgctggcaactgtcacggtgcaatttgcatacttttcaatcacatactggctgtctatttggacaagcgcgtatgagaaatacgaccatcctaactcactgttctacctagccgtgtatgcagctgcgatagtatcctttctgctccttcaaatcacgaataatcttctatatcaacacgggagctggacggccgccaagaagatgcacaggaaactggtggaagcagtgctctccgcgccgatctcttggttcgacgagaatcctatcggacgtgctataaaccgctttggaaatgacaccaggtcaatggatactgttttgattgattggctgcgcatgtccattgaaaatggactacgcttcttgctgagaatagcgagtatcgcctcgatcatgccgatttttgcgctcccagccgctgtggtttgcacgataggctttctgattggggagatgtacactcgggcccagatttcgatcaagagattatgctccatcaactactctcccatattctcccatttcaccgattccctggctggcatgactgtcatccgagcccgagaaggcatgacgggggttttccagaggctgttagcggaaaagcttgcagttcatgctcgttccgcagaggcccagtacaactgcaaccgttgggtttccgtccgatcggatttatgcgcagcgtcggtcgcagcatcggcgggatgcgtagcgtatttctggtcggggtccgcgggcctcgttggattctcattgactaacgccatcggccttagtcagaccattctaacgttggtccgcaccatgaacgaccttgaagtccaactgaactcgtttccaacgaataagccgaatacgccgaaatccaacctgaaagaagaaaccgaatga

SEQ ID NO: 8842 - DNA, 204 bp, A.fumigatus
agtgagatcgccagcgggaagctgctgaagatcctggatgaggccactggcttcaatgacggtattgtaccgggcctcgtcaaacgagctgtgaaatattatgttctgtcgaatggtatcattctgcagccatggcgactgtggtacataggccacatcctgagggcaggtagcagttcccgactcaagtacagtctcacctaa

SEQ ID NO: 8843 - DNA, 723 bp, A.fumigatus
aaacggtggtgcaattcagggcattattcccgaaggctgggtagacggaaggttagtacatctcacattcctgctcctcaaaagacatccaagctaacatcttatggacacagctccctccgcgaggtcccagaccaccaagaactcttcctctccccgaccacactctcaagcttcattgtcgaagtcaaccagcgcgtcacacaagagcaggcactatcaacgctagacgcgcaggccgccgtccccggcggcattcccgccacccacgagacaatcgacaaagcagcagtcatgtaccacctgcgtgacctgtgcgacgaagacgacacactgcaggtgatcatccccgcgacagcggtaacccccgccaagatccccgcctctgcgcgcgcgcatgcgtacaagggcgtcgtgcagatgacgacgccgaagcggcagcggagggataccaatacggggaggattcctgtttcggttgggggtgcggcggcggggtctagtgcggacgggccgcagacgtcgcgggtgacggtgcattatctgcttgtgcggttggaggcgcaagagtcggatctccttatattctttaatgtcccgcacgatgagtttgatttgtcgggggatccgcggggtttgtctaaggaggaggaggtggctactgaggctattgatcgcttggtgcagactttggaaattagggactgggcattgtttgcttag

SEQ ID NO: 8844 - DNA, 330 bp, A.fumigatus
acagggatgcatctttgtctaaaattgattccatgtgcaaagacatcattgaagtccacattcactaacctgaggtcagatgggctgcaccaggattcagctacttccagagaatctggtacatcaagcacaagacttgagaagtctcagtatcggcttagagaagatgtcgaaggcctggaagacaacgccctcgaagtgtactatcctctacaaaccggggacgagtcagattgtggccgctactggttggttcacaagcctgggtatggaggatactcgaccatatggctagctcgtgacctgcaaagggccagatattgggagtga

SEQ ID NO: 8845 - DNA, 639 bp, A.fumigatus
  unsure (170): Identity of nucleotide sequences at the above locations are unknown.
acctttcgaaaggggattgaagtcacttgctgcttgagtttattgaagtctggccacgttattgacttcgacaatctcgccatgcgtcttccatacgtctttgattccccccctaccagcactcccgaagaggcggagatccttgctcgtgtcaaagccagacgtgcccntggggacctcttaccacttgatcgtgcacttctgcactcgtttcctgtggcagatggatggaattcattcattggggcaatacgaacaaaaactaccttgtccacgataatcaaggaacttatcatttgccgcgtggctgttctgaacggagcctggtttgaatgggaacaacacgcacctttattggaagaaggtggacttggtgacgagggaatgcgtgtggttcgtgacattcatgcagatatttcactgaatattgaagaaaaggccctgagtccggctgaaggagctgttctaaagtacacggacgccatgacaaagacagtcactgttcccgacgaagtgttccaggagctgaagggatttttcaatgagagggaaattgtcgagataacgacaacagtggcagcgtacaattgtgtcagccgatttcttgtcgccttgaatgttggggagaagaacccttaa

SEQ ID NO: 8846 - DNA, 225 bp, A.fumigatus
tgtgagaggaatcgccagcggagctgcaatactgatttccattccctaagctttgcagaatctccgagtctgtccagcagtaagtttgattacttcaagtatcttctagacgttcatgaaatcttccgtgttcatatcgccagccttcaacatgtgagtatcaagtgtatgaccaacggctttggtctgcctctccagcttaggctgaccagctccaaattgtga

SEQ ID NO: 8847 - DNA, 471 bp, A.fumigatus
gggtgcaccatgacttgtcaggataggccgtattcaagagatccacataacgatatccgcataacgttatactccaaccttaactggaagcataacgatgcacattccatcaattgtccacaatataaatacactctttcggcttctccgctgatcttcaactacagactcaggaaaaagagatcattacctaaatatccagaaaccatcatgccttccggattcgccagcaacaacctttattgggagacagaggcacctctgcaaaagggcaaacccaccgttcttttcatccatgcttcatggatgtcatcggctatgtgggaagagaccatccagcttctcgcaccacagttgccagaggtcaacctcctccgcgtcgacttgaatggccacgggaagaccactgccggccgcaaggaatataccctctggaaccaagctgaggatgtccttactctcttggtatga

SEQ ID NO: 8848 - DNA, 624 bp, A.fumigatus
  unsure (323): Identity of nucleotide sequences at the above locations are unknown.
gggattcgcaaaaccgatacagccaatagcacagctaatatcccacagagagagcttgaactgtccaacgtactgatcgcggccatctccatgggctcgatgatcgccctccgcctggtgctactcgaccaagctagattctcaggcctcgtcctccttgcctccaacgcatcagaggcgaccaacgctcaacgtgatgccttctaccagcttcgcgatatctgggttgcgacacctgctcccagcgagcagatcatgaacgccgcgatcctcagctggggcgggaatcctgatgtcgagggaccgcgtgcgactcgtatcanacaagactggattcagcgtcattcaggcgctgagaatgtggagcctacactgacctcgatgatggaaagagatgcggtgcttaatcgactaggggaatttcgtgtgccggttctcctgattcatggggaggatgataaaacgtatccgctgcaggatgccgtggagattaaagaacggcttgttaacgcagatgtgcgcttggaggttgtcaaggacgagggtcatctgttgattcacttgagggaggctaaggatgtggctgaatggatccagggttttgtacagaaggtccttaaatga

SEQ ID NO: 8849 - DNA, 198 bp, A.fumigatus
aacgatcaattgaactggcttggagcggagactgattatacgggcccaaactggggcatcggtttcgcaaaagctaaaaccattgtgttagcctcgccagactaccaggtcatccatgggcagccgctctttggagaatggccagaatgcagtccaagcaatccagtcctcggaggccaccaagggctctctgtctag

SEQ ID NO: 8850 - DNA, 675 bp, A.fumigatus
cctcgccagactaccaggtcatccatgggcagccgctctttggagaatggccagaatgcagtccaagcaatccagtcctcggaggccaccaagggctctctgtctagcgtgcagctcgacgtcacagaccctacctcaactgcatctgccgcaaagcaaattgaagcgcagttcggccgtgtcgacgtcctggtcaataatgccggtgtcttctcacaatcccacgtaaccaaaacggcaatggaggagacctttgcggtcaactctatcgggcctgcactggtgtccgaggtctgtaatcccttattgatgaagtcagctcgcccgtactcgattttcatctctagtattctgggttcgttgtccgaggcggctgatccctcgtcttcggtgcattattatgacggcgtcgcgtatcggatgagtaaggctgctctggatacgttggttgtacagcagcataagcagtttagccccaaggggattagggtttttgctgtgtgcccggggttggtgaggtcaaatctgagagggaagagtgaggaagatgtgtccgcgggagggagggcgggcgatcccatggttccagcggagatgatactggggataattcaggggaagcgagatgctgatgcagggaagtttttgcgtggtgacatggtgttgaattggtga

SEQ ID NO: 8851 - DNA, 306 bp, A.fumigatus
tcagacattgacagatcaggctggagtggcctcgcggccatcaagacctatctccaggtcaacccgtccagcaaggtgatgcttctggaggcggcctcgtccattggcggcgtgtgggccaagcatcggctgtacaaaggcctcaagtccaacaacatgctgggcacctacgagttcagcgactttcccatggaccccgccacgtttggcgtccagccgggccagcatatccccggccatgtcatccagcagtacctggaaccaattggcggaacttttcaggttcccggaacgcattcgggttaa

SEQ ID NO: 8852 - DNA, 1863 bp, A.fumigatus
agacatcggaatgcatttgcgttggcagtttccatacctgccatagccattcaagcagagatagttcttcaagcagagacacctccagtccctcaggcagagccgattgcagtgactgagttgcctttacctcctgtggcccccagcaaccacagcggcgcctgtacaaagagcatcaacccacatgggactggttgcataggaattacctcggacaccttccaagccggcgattttacgcccgacgggaaccacgttcttgcgaatgtcgaatttgttggtgcgccaacggccccggacccggccagcgtttacactggccagcaattgattgctgtcaaggttgatgggtcactcttccctaatggggatccatggaagtgcctcagctgtggcgtccctgcagggcaagcacaaagccttgatcccgcaagggattaccctcatgctgctcgaaatggccgccaagctttatggggccacaacatactcgactgtggtgatgctctcctcgtgagcgatgaatgtactccaaacaaaacacatgtctatcccatttactggtccagtggaagtatgcgagagttgcggatgcatccggatgatgtccacatgggttggagctctttcaccaaaggaggccagaacgccttctttgggcgtttgctgttcaacccaaacccaacgaccggaagtcctgtcgttcctcggtatgaattgatagatgtgaacattctggtcgatccaaacggccgcccctcgatcatggcggagggcacgcagcttagattacatgacgaggcaattgttgttggcgagctgcgcggctttagtggcgctggggacgagattctctacattggcccgactagagaggcgaacaatgtggacctcttcgcagtgcatgtcacatccggtgctgtccgtcgtttgactagccacccggagtacgcagatcccattgccttttctcatgacaatcaatggttcgtggtcatggatacccggggatccaaccgccagatgtggatgtcaggcatgcgatatgtgcccccgctgatcgacctggtcaccatgacagcagcttggtctacccgtaacaacggtgctcgtcgcttcttccagccaattttggttgatagatatggagatcgaggatcatactttggccaacaggtcaacgctgctggtaacggcacaagcggcagtgtcaacgatcccaattggaacgggcgcgcagaccctgcattctctccggatggtacaaagatcgtcttctggcaatcgttagtaattcctcccgcatgcggtgatccgaatcctcttccttgtcccgtttccactgccccaggtggccgtacataccgggtgatactggcccatctcaccagtcggcaaccagcggctcctgcacctgtctataaagtaccagatatgattccctgggcgagagctttttctcccggcgctagtacccctccaccataccaattgacagctggactttattctcttcccggaaaagtgcacggcatagcgcaggtgcatctcacggcttacccagggttcggaggcttcaaaactgtcgctgtaaactacaccaactacagcgacgacggccggcatcttatccatggccgggaaacggtgactctgacattgtctgagtcaaatccctggtggaatcatctggattggtactcggatttgacccaaacaggcgccgtacaggctaccaagcggaccggccccggggggttccaattatctattgatgctatgcagaatattttcgaggcaaatggcacgctgacaactacggtaggtggagttgtctatttgcagccggcaaatgggacatga

SEQ ID NO: 8853 - DNA, 186 bp, A.fumigatus
ttgctgtcaaggttgatgggtcactcttccctaatggggatccatggaagtgcctcagctgtggcgtccctgcagggcaagcacaaagccttgatcccgcaagggattaccctcatgctgctcgaaatggccgccaagctttatggggccacaacatactcgactgtggtgatgctctcctcgtga

SEQ ID NO: 8854 - DNA, 483 bp, A.fumigatus
cgagtctctataaccattggtattctggtcagttattggatcaactatggcacaaactacatcggagggtctcgctgcgccccggatgctcctttcagcaatgggtccaaatttgatccctatcgcgatgtgccatcgggcggctgtgacggacagtctgatgcgtcctggagactacccttggctcttcagatcctcccagccatgatcctcgggctgggcatgttattcttccctgaaactccgcggtggctaatgatgaaggagcgatacgacgacgcgttgaggtcactgtccaaactgagacgaaaagccagggactgtccggaacttgttaatgaatacctggaaatcaaagcttcaatcttgttggagaacacctttgcgcgagaacattttccgaacatgtctggccttcgattgcatgccgctcaggtgggtgttcttaatcagagctcttccgtttcggagcagttttactga

SEQ ID NO: 8855 - DNA, 276 bp, A.fumigatus
acctcactcctcgctaccggcgtctacggaattgtcaactgcctcagcaccctgccagcactcttcttgatcgataaagttggccgtcggcctttgttgatgtttggggccacgggtacctgtatttccctggccattgtgggtggcatcatcggcgcctatggatcagacttggtcaatcacaaatccgctgggtgggcggggattgcctttatatacatctacgatatcaacttttcatactctttcggtctgtgccctcgtctcgtcatgtag

SEQ ID NO: 8856 - DNA, 675 bp, A.fumigatus
aacaagatcagcactcttgaggtaatcgactgtacggccagaatgattgggaggactatggacaatactcccaggggggggttttccctcatctaccagaacccctatcttctgggagttgcatcagtaagcccactttctatagggaagggcggccagagctatcctgactattatctacagttctcaacccttggtggcttgctctttggctatgatcaaggtgttatatcgggggttattacgatggagtcgttcggagcccgcttcccacatatctacacagatagcagcttcaaaggatggttcgtgtctacgcttcttctcggtacggtgaacgtcctgatcttcccctccaagaacaatactgacgccctattagctgcctggtttggctctctcatcaacggacccattgccgatagacttggacgcaagctatcaatcaacctagcagttgtagtctttgtcattggttcagccatccaatgcggcgcagtaacaatcccgatgctctttgccggtatgtttcaccatttgcaagacacgtcaaggtatctgatcgcttgtagggagagctatcgcaggtctggcggttggtcagttgaccatggtggtgcctttgtacatctcagaggtatgcaccctcatctgacagaggaaggagaagaataa

SEQ ID NO: 8857 - DNA, 273 bp, A.fumigatus
aggacgtatggtaatgcctggatattaagccgtgtccatcaatcaacccagagcgaaacgcttatctgtgggacaccggaccatgtgaaaagcatcggggcctccgagttattcaaagttaacacgaggctgaagtcaatgactcagaactggtttgtgactagtgcactgctccactttatggacattgagaactgcctgtctccctgttcgttaacaggtattgagtttgcgggacgtttgatgaattccccgagtacctcacgccaatag

SEQ ID NO: 8858 - DNA, 201 bp, A.fumigatus
cagttatttcaaacacgctggttgaaggtcaacgtacaaatcgactatctgcccttcgcagggaggttactgcacacttttacttgcgagaagtcagacactacctcgaacctgcctgacccagcgactgcggtgcatttggcttcagtcaaactagcacgtcttgttcaggatccggctaagcagcttgaaagtgagtag

SEQ ID NO: 8859 - DNA, 321 bp, A.fumigatus
ggaagtactgacgcacccctattttgtgtccgaggagccagctccgcaacaagctatcgagtaagtttgctaggtatctctttcagttggactatgactaacagttgcaggttggaaaatatcgagggcgactggcacgaatttgagtccaaagcactgcgcaaggagaaggacaaggaagctcgtcgcgcagagtatcagaaagataaagaaaaaaggaaagcggctttgtcggcgccgcaaagcgaaagggagacgaagcgcgtcagacaagacgtggaggaaaacttacaaccctcggcccagcctgttgaacagtaa

SEQ ID NO: 8860 - DNA, 405 bp, A.fumigatus
tatcggccaccggagcttcttctcggagagaccagatatggtcctgctgtggacgtttggagcgcgggctgtgtgttcgtcgaattgtttacaaagaaggctgtctttcctggagaagggggcgaaatcagtcagcttgaaaagctctatgcctctcttggaacgcctacgcgggctgaatggcctgatcttgtggagatgccctggtttgagctcatgaggccgacggagcgcaagaagcgagtctttgaagacatataccgcgaagtactgtcacctgcggctttggacctagtttctcagatattccgatacgatcctacaaagcgaccctcagctgaggaagtactgacgcacccctattttgtgtccgaggagccagctccgcaacaagctatcgagtaa

SEQ ID NO: 8861 - DNA, 357 bp, A.fumigatus
tgggaggaatatccgtactccatagtagcacaaccacttctcaaaaagtgctcaactccccataaatccctcatctacacaatgtctttctcaaatcttgtgtcggatcttgcctttagggatgcttatgatgatcgcagctctcaaatatcccattcacggtctcaggccaccgctcggtcatacacaagcacagctgctacaagtgtcagtatttctggagacatttcaagccagctgcatgccggatatagccatcctttgacgagatcatggcaagctgaaagacaattgaccaaggttcgtggcgtcagagtcgtcagtcaaattatccacgctttgaagactaccacatag

SEQ ID NO: 8862 - DNA, 930 bp, A.fumigatus
ttgggctcttttctgatttcaatgcaggaaatgctcatctacccattattcatcaccgacaatcccgatgaagagacaccaataccatcactgcctaaccagcatcgccgatgtttgaaccgccttgttcctttcctcaggccacttgttcaaaagggactgcggtcggttattttgtttggggttccactacacccgaccgcaaaggatgccctgggtactgctgcggatgatccttcgggcccggttattcaggctatccgtcttctcaggtcacgcttccctaatctctatattgtgactgacgtttgtctctgcgaatacacatctcatggtcactgcggcatactacgagaggatgggacactggataacgcccagtctgttgatcgaatttcagatgtcgctcttgcctacgctactgctggtgcgcactgtgtcgctccatccgacatgaatgatgggagagttcgcgctatcaaactaaagttgattgaagcaggcttagcccatcgcgttctcttgatgtcctacagcgcaaagttcagtggttgtctctatggaccattccgtgacgcagccggttcttgcccctctttcggtgaccgcagatgttatcagctgccgccgggaggccgtggactcgcccggcgagcaattcagcgagatgtgggtgaaggtgcagacatcataatggtgaagcctgcaagtagttatctggatatcatcagggatgcaaaggaacttgcaaaggatatgccaattgcagcgtaccaggtcagtggtgagtatgctatgatccatgccgctgccaaggctggggtgtttgatttgaaatcgatggtgtttgaaagtacagaagggattctcagagccggcgctggaatcattgtgagttattttgtaccggaattcttagactggctttag

SEQ ID NO: 8863 - DNA, 693 bp, A.fumigatus
  unsure (295): Identity of nucleotide sequences at the above locations are unknown.
acaggaaccgcccccaggcacagggttggaatgtttcttggcatgagcattcagttgtcccatcgcaccgtaagtgaagaatcggagaaggacaagttgattcgcggcgagctttatcgccctttcgatattcaccttgtagaggagcgcgagcgatgcaaagcagccatctggcggttcaacaatgcttgtaatcctgtttcgggcttgagtgcgaaggaacagaatcgcctgctgaaggaggttctgattcctcctggttcggttgttgtttctccatcgagcgtgggaccantaagacccgccggatttattgggcaaggcgctgttgttgagtcaccttttcaatgccactatgggttcaacattcacattggtgaggacgttatgatatcagagaattgtctcttcgtggatgactgtcctatcactatcggtgctcatacatggataggtcctcgagtcactattctcagttctatggcccatgcaaacatgcaagaacggaagggctctcaaagccgctaccaaggccgtcccgtcacgattgaggaggactgttacgtcggcgctggttgcactatatatcccggtgtccgtcttcggcgtggtgcctatgtggctccgggcgaggtagtcaaaagtgacattgtagcctatggttttcagggtctaaagccaagctacatgtga

SEQ ID NO: 8864 - DNA, 186 bp, A.fumigatus
atgagggatttatggggagttgagcactttttgagaagtggttgtgctactatggagtacggatattcctcccatcagtccctgccccttggcacccatcatattctgcccaatgacatttggttatgcaagtgcgctctatgtattatgaattataaactactataccagtacagagtatcgtga

SEQ ID NO: 8865 - DNA, 237 bp, A.fumigatus
acatcgtcgagccgttctccgattgccctcgcggattgtcattaccattactactatctgtcaaatatcctccactccgtcggagttaccaacaaaccaactctgagcgacaccaagcgggtccctaaacgtggtttcactttcgtactctacttctccttgtcttcgatactaattatctgccaattaatcgatctatccactttccagctactccgcccaccttttgaccgctaa

SEQ ID NO: 8866 - DNA, 222 bp, A.fumigatus
gagtactctcattattactcatcttattcatctttgagctgttcatctacaattctgactaagagtggtgccacttcaccgacgtcgacaatcaagcgtggcgcagtccatactgttcttgtggcccttcaagtgttggccctcatcctgtccaactcaaacattttgcttgtgcctgttccttttttggctttttttttcaaaattttccttttgatttga

SEQ ID NO: 8867 - DNA, 315 bp, A.fumigatus
aagcccaacccatgctcagaatcctcggcgttatatataatagtcgctgacaccaccatggcctactgctatttggtttccccccagtcgcttgtggccatggtcccttatattcaactatcatggcactactgtctaagtgctggcttattaattacctatacctcatttaccttgaggagaggagccatttttagcttttccttagaccatcttgtttactctaactctataattgaccctgttaaagcactcttttttttttttttttttttttggcaacctcattttgtttgtaccccttgttgggattag

SEQ ID NO: 8868 - DNA, 438 bp, A.fumigatus
acccgctccttcccacctctaaagctgttctttctgaaggccgagcagcgccatcactggaggccagcaacgacttactccagcagagcggggctcgcatcgcagcagccacagatatccaggtgcaggttgtctccatcaggattctcctcctgctcgccgcccgatcatttgccgcaccatccgagtacctcaaactccacctggacgtcatctcttctgccatcgacgcctcgctcgactccccctatgacgagggaacccatcttatcgaccgagaatggcgctggcaactctggtctttcatctgcttgttggactggacctcccccggcatctaccacaccagcagctacttcatccggccagagatgcaccgcggcccaccttccaaggtccctggcctcccagaccacgggagctacccctctgccatag

SEQ ID NO: 8869 - DNA, 1320 bp, A.fumigatus
atatccgcctctgcgtcgctgactagctttatcgatgtgcaccaactcgtccgcgatgtcgaggaggtccagcatctacggcagggtttggacctctccagttcctcggctttgctgggacacctcgacatcaaggtttccatgatactagcctgtgccagtctcgcggccgtggacctggatcccgggaaagcgcaggagctggggctcgccaataccgacattgacgccctggtccgcgatctatggaaaggctcgcggacactgatatcgcgttcggacctagacccgctccttcccacctctaaagctgttctttctgaaggccgagcagcgccatcactggaggccagcaacgacttactccagcagagcggggctcgcatcgcagcagccacagatatccaggtgcaggttgtctccatcaggattctcctcctgctcgccgcccgatcatttgccgcaccatccgagtacctcaaactccacctggacgtcatctcttctgccatcgacgcctcgctcgactccccctatgacgagggaacccatcttatcgaccgagaatggcgctggcaactctggtctttcatctgcttgttggactggacctcccccggcatctaccacaccagcagctacttcatccggccagagatgcaccgcggcccaccttccaaggtccctggcctcccagaccacgggagctacccctctgccatagaaaaagtgcactgggatcgtctcagccagacgagacattacttggagtacgcactagccctggcccacctctcccgccgcgcggaggactgcatcgtccgtcctggtccggtatctcccgcccaggctgccgagctctgcaccgagctcgacgccttggacaacaaactctctttctaccaattgctcggcagcacggccccagatggcggcactttcagtaccggcggtagaccggtcgatgcaacctccatcactggggacctagccaccgacaaagccagcaccgagcaccggcgcttcctggcgcgcgcccccgtgattcaaagcatgcacctgagcctagagctcggcctcatccgcttcaagctcttccgccacgaggtcttccacctcatgcaggcgccaagcacctcagggaccttgcgcatgatctgcatggacgcctgcatggacgcctgtatcctcgtcctcgcgcagtgctggagtatcggtaaccgcgacgtgcccggtgtccaggcgcaggcgcaggcgcagtcgcagatgtcgcttgacccgagcgaggaggtcttcaccacggggatggaaggatcagcg

SEQ ID NO: 8870 - DNA, 264 bp, A.fumigatus
gctcaactccgagtccacggcccccatgcatcggtatatactactttcaattattcgcatccccttgcctctaacactggagtcacaacgttctttgacattagtgaagcgctgtttccgccgcagttctgtactaagttcaacattatacagtcgattggggtcaactacattctagcagacgaagcatatgagcgacagcatctccagccaatccttgcagcatcgttgaccatcggcatgcagatctgcatagcaccttag

SEQ ID NO: 8871 - DNA, 357 bp, A.fumigatus
caggcgcattatccgctccacgtcatgcgaggcaagaatacgggcaagcagcgccgatccatcaagaagcaacagactgtcgcagaactcaagcaccttttcgatgctccaggacgtggatctgtgatgccgcgtcaggtgctctggggcgacctgtgtctgactgcattcccccatgagctcaactccgagtccacggcccccatgcatcggtatatactactttcaattattcgcatccccttgcctctaacactggagtcacaacgttctttgacattagtgaagcgctgtttccgccgcagttctgtactaagttcaacattatacagtcgattggggtcaactacattctag

SEQ ID NO: 8872 - DNA, 291 bp, A.fumigatus
tcttggggggattcggcgggaggagtctactccttgaatgggcccccaagtattatggcggcaaactgcacaataacaaggacattcccattcccagagtggcgactaccaccagcattgttcggcggtatcgccttcaccatgggctggttctggtacggctggacagggtggacacgctcgatccactggatggcacccacggcttctggggtattcaccggattcggaatttatgtcatcttcctgcagtgctttaactatctgatagactcgtacctgcaattgtga

SEQ ID NO: 8873 - DNA, 249 bp, A.fumigatus
tgtgtacccagtgcggcatcggttttcgctgccaacaccatccttcgatcagctgtcggcgctggtttcccactcttttctcgccagctctttacgaacctcggagtgcaatgggcaggaacgttattgggatgcttggcgctcattatgattccaattccgctggcttttatcaagtttggtcccaggctaaggcggcggagcaggtttgctccatcgccagttgtgtttgaagagaaatcgggttag

SEQ ID NO: 8874 - DNA, 435 bp, A.fumigatus
agctttggcagtcatgatactttttttgttgctcctctattctcaggcgctgatgacacattttcagatactgaacgctcagcatatacacagaaagtcgattttgctaaactccgctcagagctgctaaacgcagattcgaccgaagcgcagttgactagatcatcccacgaaaagattgctgcggatcttgcgaaactcaactcgcgactgcgggacgagattggacgaacccaagcctctgttcgccttgatttgaaccttgaaaaaggacgtatccgagaagaagcgaacggccaagagatgcgcatcaaggagactgaaacacgaatcgagcaagaagttgcagggctgcgagagcgcgttgaggctgtgaagttctcgaccttgcaatggcttatgtatggctcctttgctacatttgctcaaatctga

SEQ ID NO: 8875 - DNA, 1923 bp, A.fumigatus
  unsure (120): Identity of nucleotide sequences at the above locations are unknown.
attttccccaacaaggccagggggtcaccattaatgggaatcttaacaaaacaggggggcccggggttccttggggccaatcttcgccagcaatatacttccaacccgtcaggtcatttnggtggtatcccaggggccattcgttgttatgctttcccattctccgaacactcaatagcattgcagatcggactaccattgcaaagtcagccgaaactgaacaaggagactcgtttggccgagctgctcttttccaaggagcatgtggggtgcttggctcagatcattgggcaagattatacatcttatcaggcacaggcttccattgaactggctgcatcgttgattgggaagttatgcaccgaggaggcccacaagactgtcctggctgactcgggggtgttggatgctcttgctgtcaaggtcgcctcgtttgtcgtcgcccaggggttcgttcttcctggcgcagaagagcatgtccaggagccgggcgcattggggtctttgccccctccagcacctcccagtgccaagctcgctccaatcctccgtgcggtcacggtgatcatcgagcactccaagtggcgagccgaacatttcctttcgtcgccaggtattgtgactgttttccccaggcagttacccgaattcgctccctcggacatcaaaaagggcccctgggggtcaacatatttctccggttctgccgtcccccgacatgccgggattagcccccttgagagtctgctgccatcggttccattatccaccccgacggcaccggcgaatgcatccaatttcccacctttaggtcaccaaggggcacgccgtcgcccaagccactcgttccccacctccttctcgctttttgagtccacatcttctgacgacgacgagaattgcattgtcccctggctactgaacatggttcgcgcggagaacggcatggttcgcttgatggcagctcgcctcatcacagtccttttccgtcttggcctggcaaagaaacatcgcgtctccctgctctcctatctgttgatcccgatccttatccgaatgctcgacaaagactatgaaataccaggcgataacagtgtcgagtacggtggtttgattcctgccaccacgcatgtaaaggaggaagctcctgcagtactggcaactctcgtgattgatgatcaggaattgcaaaaacacgccgtcgatggtggcgcgatcaagcgattatcgcaattgctgaaggagacctacaatccgattcacgagaataccaagccaatgtggcacccagacgccgacgaatctgctccaaattctgatacgcagccactagaatgtagacttggaccaccggggttctcgccgactcattgtcatgtcatgcgatatcgggagaatatcttgaaggctcttgcggctcttgttcctttcaaggatgaatatcgcaagctcgtgtgtgagaacggagtggtgccatacatcatcgactctctcaagccttgccctgacgagctgccagtggacccatcgacgcccaagaacactgccacggatggcaatcccactccgactctcttggccgcttgtggtgctgcgcgaatgcttactcgttctgtgagcgtcttgagaacaagtttgattgatgctggtgttgcagctcctctttttgttctgatccgtcatcccgacatcgaggtgcaaattgctgcgacgtctgtgatctgcaacctggcattagactttagtcccatgaaagaggtcagtccttatccccttaaggatgttatagatttcgacttgcaactgacccaagtaggcaattatctcagcggatattctcccggtcctatgcgagcacgcgcactcgccgaacacaaaacttcgtatcgagtcgttgtgggcactgaaacatgtgtcttataa

SEQ ID NO: 8876 - DNA, 357 bp, A.fumigatus
gtcttcaaagttgaaacctacatttcataccccaaggataacaggagccccgagaaggccgttgttatactgagcgacattttcggtatctatatcaacgcccagctgcttgccgacgaattcgcttccaatggatacctcgctgttattcccgatctcttccacaaggacgctatcaagctcagtgacatggaatccggaaaggctgatcttcccgcatggcttcctaagcatcagacccccaccgtcgaccctgttgtcgagtctacaatcaagtacctcagacaggacttgggagtcaagagaatcgctggtgtcggttactgcttcggtggaaaggtaagctccatgctttga

SEQ ID NO: 8877 - DNA, 369 bp, A.fumigatus
agcccggtaagatcgacgtcggttacacagctcatccctcctttgtcaccaaggaggagctcgctgccatcgctggtcctctttctatcgctgcctccggtaagttggtccgcgaggatgtgttgggttaatatcaagatcatgactcacattgagaatttgttagaaatcgacaacatcttcaccactcagctccgtcacgagtccgaggacattctgatcaagacgggtcagccttggcagatcaatctgttcagcggcgttacacatggcttcgctgtccgtgctgacttaagcaacaagcacttcaagttctgcaaggagcaggccttctaccaggctgttgcgtggctccagcagtatctatag

SEQ ID NO: 8878 - DNA, 417 bp, A.fumigatus
caattggaggttgggatgccggaggcaaggtcttctccgacatggtgtcgaccgcggaaaatcgggctacattcattaagtccgtggtccagttttgccagactcaggcattcgacgggattgatatcgactgggaatgtatgtgcccttactgctcgttaccggattggtctcaccacagctctcatagaccctgttgccgacgatcgtggtgggcgagcggaagattttgccaactacgtcacctttgtcaaagagctcaggtccgcggctggacggcttgggatctcattgactctgcctagcagctactggtatctcaaagggtttgacgtggtcaaccttgaaccgtacgtcgattggttcaacttcatgagctatgatatacatgggacctgggatggcaacaatgcgtaa

SEQ ID NO: 8879 - DNA, 765 bp, A.fumigatus
cggtcaagcagatacaccaagcaggttgtaaatcctcacacaaacctgaccgagatatcacaaggccttgatcttttatggaggaataacattccctcgaagaaagttgtgcttggtcttggcttctatggccggtcctttactctgtcagatccatcatgcaatactcccggttgtccctttgcttctggagcgaatcctggcgaatgcacaggtcaggccggcattctctctaatgcagagatcaacagagtcatacggacacacgaccttacaccagtcatggataaggctgctggtgtaaagtacatcacctgggacaataaccaatgggtctcatatgacgacgccgacaccctcaagataaagatggatttcgcaaacaagctcgggctgggcggaactagtaggctgccccgttcaattttcactgctgaagacagaactgtttctgactcccatgtagtggtctgggctttagatctggacaacgcagactcccaatctgcacagtatctcaactcaggggggaatatgaccaacacgaatggttttagtattgcaaagaaggcagccgatactcagcaggcagtggctgcaaaattggcgttctggactccctgcatgacagaaaaggagcgaaaggtcttgggctgccctggtggtaggtgtctatcctcaccctgcggatttaccgacagcgctaaattctcatgtcctcgtagggtaccacgagctgctagtagggcatggaaaggtgtatga

SEQ ID NO: 8880 - DNA, 333 bp, A.fumigatus
  unsure (271): Identity of nucleotide sequences at the above locations are unknown.
agcaagatatgtgatcagcgctgccctaagggttacatctatctcactcaaaatacgcacccagccggcgacaagaaggactgtgcccatggtacttacatttcagtttgttgcgaagatatcgagaccattgcgcaggtatgccccaatcagtactccagcgacatcatcttctcgggtagtttttcgaatatgggagcagtggactcctcgttctccctgaagagcgccaccagcaaaagaaacaaccccaggctaacgaactttgttnttgagaatgatccaactttttcctccgtggtccgattccgaatattatttccacacatttga

SEQ ID NO: 8881 - DNA, 327 bp, A.fumigatus
actctcattcaggttttcatagcaattggaggttgggatgccggaggcaaggtcttctccgacatggtgtcgaccgcggaaaatcgggctacattcattaagtccgtggtccagttttgccagactcaggcattcgacgggattgatatcgactgggaatgtatgtgcccttactgctcgttaccggattggtctcaccacagctctcatagaccctgttgccgacgatcgtggtgggcgagcggaagattttgccaactacgtcacctttgtcaaagagctcaggtccgcggctggacggcttgggatctcattgactctgcctag

SEQ ID NO: 8882 - DNA, 213 bp, A.fumigatus
tccttggtagcaccactcgcggatccttccagccccgtggtgaagactatccgctccattggccttgctactgcactgctggctttaagtaacagcttcgccaatgctcatggatcgcatgcgagcgagcagaacccttcctcagactgggcgactcgtcatatgcaaggtagctctctacatcgtcgtcattccattgaaaaccaccattga

SEQ ID NO: 8883 - DNA, 243 bp, A.fumigatus
acggttacccgatctcggattcgtcccggacaccatggcgatattgaatacgagtatgaaatccatcatttcgagagatttcacggggaggacgccaagttagaggatctcacccatccggaagatatcgagcatttccgaagacatgatgaggaagaagatgccacggatagacttgaacaactggaacgaatgccgatcgtcgaggcgaacatcccgcagaaatttctcagacggtcatag

SEQ ID NO: 8884 - DNA, 372 bp, A.fumigatus
aaaccaccattgacaatttacttgacagaggaacaccacatcgattccttcgacgcaggttctttcttcaccctccatgactacgattcctccggcgcttggacccctgatgaagtccgaaagacatatggcatggacgatgagtcaaattctggggtgaccgaggagcgcaagcaacaggcgcttcgcgaggtgtttgcccttttcgacacagggagttcaggggttatcactcgcgacaactggatgcgtctcatctcagccggtaaacggttacccgatctcggattcgtcccggacaccatggcgatattgaatacgagtatgaaatccatcatttcgagagatttcacggggaggacgccaagttag

SEQ ID NO: 8885 - DNA, 1383 bp, A.fumigatus
ggtagccagcaccggcccaagtggcaggacaatatgcattccgacgatccaacaggggatcacacaccagatgaacgtgtcaagaagcctacaacccacaagcgggaacctaaaagtcgaaacaagtgctcaaatcccctccgaaaaggcatacagaattttgtaacaagacatataccctcagacgacctcgccaaacatggtatgtctttggagagccttgaatcagcccttccgaaaaggttcacagtgtatgaacaactgctgctgctgcctgtgaacgcactcagcgatcctccagcctggggctcgctttatgcaagcctagacagccaaaagcgaaggcttctctttgagtcgattgctactgcattcgggcggatgggcgttacacgtattgccatgaatgcgcccatcgcgcctatgaacacgcagggaggagagaacaggatgcgcagccccacgggactgattcctctttatggagactttggcttggtgcccattttgggacggcgagaatgcgcagccgacgcaggaagacttccagcgtgcgttctgggtgcagactatgcagaatcaggggattgtgcagatttgggccccgctgtatacgatgttttctcggggggaatatcacagagaagccccggattttgggtcaaggaatctgctttgaagggcttgatgaaggcccctttggggaaaagatcgacagcattaaccgtggttgatctgtatgcggggattggatatttgttcttctcatatctaaaaagaggggtgaagagggtctggggatgggagatcaacggatggtcagtcgagggtttgagaagagggtgtacagagaatggatgggggtgcaaagtggttggaattgggaatgatggaacattgagtgaatcggtcccagatctggttgacagtcttcaagattcagacagggtggtcttgtttcatggagacaacaaattcgccgctcgcgttatgggcgaaatcaaagggcacatggagcgccgagatgcatggaatagaattcgacatgtcaacctaggccttcttccgtcttccaggggtgcttggagtgacgcttgcgcaatgatcgatctacagttgggaggttggatgcatgtgcatgaaaacgtggatgtgcaacatattgatgcgaagaagcaggaaatcatcactgagatcggcagattgagagcaatagccttcccaagtgctgttcagcagcctattgaatgccgtcatattgagaatgtcaagacatatgcaccaggcgtcatgcattgcgtcttcgacatcaagttgcctccgtccggagagacacctacgggactcgagctgagtcgggcatcgaagcagtctccatcctga

SEQ ID NO: 8886 - DNA, 207 bp, A.fumigatus
ttcctctttatggagactttggcttggtgcccattttgggacggcgagaatgcgcagccgacgcaggaagacttccagcgtgcgttctgggtgcagactatgcagaatcaggggattgtgcagatttgggccccgctgtatacgatgttttctcggggggaatatcacagagaagccccggattttgggtcaaggaatctgctttga

SEQ ID NO: 8887 - DNA, 312 bp, A.fumigatus
ctaagtcatgaagctttcgaggaggcagaacgcagaccagacaaccatcatctcactactacccctgattcgagtccaataagtcccacacctccagtgacccgggatgaatttgaatactacaaccatgaaatttactccatatcgaataacaagccctactgtcgctacgagtcgctgaactcaaagccttcttcttcttctcgtccacctcaaaaatgtctgtccaagaccagcctacttactggtaccgagttgaactccttcacttggccttcagccatcagatcgcaaggggtacagcgattttga

SEQ ID NO: 8888 - DNA, 183 bp, A.fumigatus
ccacatccactcaccgacaagtcccggatctcccaatccaatggccgcgaacgcccctattcctctagaaccgtgtccggaatcattccttctacgtccattctggctcatgagatgtatttaccagaccatcgctcatccgcgagggggttatttatctacgaagttattcgtgccccatga

SEQ ID NO: 8889 - DNA, 1485 bp, A.fumigatus
  unsure (7),(8),(37): Identity of nucleotide sequences at the above locations are unknown.
atgctgnncgtgaggctgcatacaatgaaggcctggnaaccagcggtagaggtggacggttacgatacagacgatgagaatgtagcgaacgcttcgcagaacgttgaattggcaaaacagagagtaggggaagcggaaagaagaaacgaagtagcaattaccccgggctacaatcttcaccaagtacccgagcagacgaggctcgaccattcaagtgatttgatccaggattatcctgacgatgaagccgaagaagaggagcgattgttggatgagatgaccagtggctacgtcatggatgatttcgcatttgatcttcagtcaaaatctgctcttccgcaccagtcaggttcaagcgtgttatcctctaggacctgggagaactcggttgtccctatttcagctacagcaacacccggcgtgactttggctccgctggaggaagatgaggttgtgttagaggatcaatcagaaaaatctcagagcgcacttactccattggagttcaacctagcttcctcacctcatgttccttcctgtccgcccaaacagtcttctgtgctaacagcgagtccaagcgtgcgagcacgacgaatgtcaggtcagaacccgacagaactaaaagtcgaaacaagctcttgtcctaaggttggtgatgatgcgctcacccaaggctccgcggatacggccacgtttcgaccacccccggtccccaaaaacggatctcagacactctcttccgcaaactccattacaaagactcccgctccggcttccgttcatccatcagccgtgcatctcaaccgaaggaatgcttcaattgcgtcactggctgaagatggttccaccattgaagtactagagaaagttattacagaggagggaaaaccgtatgctaagatgtcaaaggtgccatcacccgcccgtctgattggcaaggtcccttcagcgccagacaacctgggcaagttgaattcaggcctgaagtcgttccggccgagaaatgtctctgtaccagcgcctgatgtgtccgccaattccccggaaacgccgtcaagcggtgcattcccggacctccataagggagcggcaattggcccggctccttctctacctacacctattggtgcaacttttgcgccgtccggtctgaccagtggaggcctgtatttgtttgatagccacatccactcaccgacaagtcccggatctcccaatccaatggccgcgaacgcccctattcctctagaaccgtgtccggaatcattccttctacgtccattctggctcatgagatgtatttaccagaccatcgctcatccgcgagggggttatttatctacgaagttattcgtgccccatgacgtgtggggcgtcaaaaacgtgaaacttagggcggtcgaagaaaaggtgtccaactgcgacttgttaacggcggcgttactcaaacttgctaaggtggacacttatgacgccgacgccgtt

SEQ ID NO: 8890 - DNA, 285 bp, A.fumigatus
ccacacaccttgcgcacccatccaaacccaaccttgtcgccgaccttgaaggtagtcactgcgctcccgacgtcacggacggtgcctgcgccctcgtggcctagggcaatacccttgtgcttgaatagccggtccgttccgcagaggcctgcgtgggagatctcaacgaagacttccgagggctggattgtgcgtctaatcgtgtcagggatgacgtctccgctctcggagcctttgaagacattgaattcgatcgttttggacattggcatggctttacaatga

SEQ ID NO: 8891 - DNA, 642 bp, A.fumigatus
ctaccttcaaggtcggcgacaaggttgggtttggatgggtgcgcaaggtgtgtggtcattgcgacttctgcgttagcggtatgtacttttacttgcctctacacccttacgatcgatggtaatgttatgatgcaaggccacgatcagtattgccagcagcgtgagcagtatggcaaggggaacaccgaaatcggggcattcgctacccacgccgtctggcacgagagcatgctggtcaagcttccggatgatctggagcctgagtatgctgctccgctgatgtgcggcggagcgacagtctggtgtgctttgacatgctacgatatcaagcctggggagcgagttgggatccaggggatcgggggactagggcatatggcgattcagtttgcgtcgaagctaggatgtgatgtggttgtgttctcgagctccgccgcaaagaaagacgaggcgaagggccttggagcgaacgagttccatacacttgagaacggtgctgtgggagatgctgtgcggccggtaaagcatcttctctggtgtggaaatgagccgcctgatttttccaagttggtgcctccatccttgagtgcaggagactgtaacttacctctgttccagagtatttccgctcatgtctcctga

SEQ ID NO: 8892 - DNA, 714 bp, A.fumigatus
  unsure (457): Identity of nucleotide sequences at the above locations are unknown.
cgcaggctatgctttgctcgggagcgtggaggatatgaggtatgccctgtcatgactcgcctgaacttggagtggagtgcatcagcattatctgacgattgcagcgaggaggagatccaccaacaaatcaacaccaacgtttacgggcctatgcgggttatcaaagccgctctcccattcatgcgtgcccagaagtccggtacgattgtcaacataagtagtatcgcaggattacaggctcagccttcctgctcactctacgccgccagcaagttcgctctggagggtacgttcagaaggaagtccgaaatgaatcctcgactgacaatcagcaggtttctcagatctctttcgaaagaagtcgccccattcaatatccgagttctaatcgtgaagcctggtgcctttcggacgaacttcctatcggcctatgccaccctacccgctggactgaacncggcgtacgaaggcacgaccatcgaccaggtactacaactctttcagagccgcagcgggaaacaggaaggggatccggtcaaggcagttgagcggatcatcgatgtagtgcagggaacaggtgtaggtgctggcaagaccagttgtctccgcttgccgttgggacgggactgcatcgcacgagccaagaccaagctggaggaagtgagaaagaatctggatgagatggaggagattgcctgcagtactgatatgtga

SEQ ID NO: 8893 - DNA, 354 bp, A.fumigatus
gtgcaggagactgtaacttacctctgttccagagtatttccgctcatgtctcctgacagtacgatctatctactgacagtgagcatgcaacaacccccgctgccagtcatgccgcttatctcgaacggcattcgggttcaaggatccgcggtagcgtcgcgtgtctctgtccgaaagatgctgcggtttgtgtcagtgcacagaatccggcccattatcatgacttggccgatgaccaaggatggaatccaagctgcattccagatcctggagcagggcaagatgcggtatcggggagttattgttggccagagacatttgatggggaagccggctgtagagaaaatgggatga

SEQ ID NO: 8894 - DNA, 330 bp, A.fumigatus
aagtcagaaacacccgatacgatggcagcacctcagacctggctcatcactggcgcctcatccggcttcggggtcgtcctcgcagaagccgtgctaaaagccggtcatcgagttgtcgcgaccgctcgaaaccctatcaaggcagcgcagacttatccccagatcgagtctttaggcgggacgtggttgcagcttgatgtgacacgaccagacacaaaggaaacagtcgaggacgccatccggaagcaaggacgcattgacgttgttgtcaataacgcaggctatgctttgctcgggagcgtggaggatatgaggtatgccctgtcatga

SEQ ID NO: 8895 - DNA, 426 bp, A.fumigatus
aagtcttacgacggcctgtcagggagggaacaatatcacctacccatcaacagcagagtccagaatctaacatatcattgtaaagccatgccaatgtccaaaacgatcgaattcaatgtcttcaaaggctccgagagcggagacgtcatccctgacacgattagacgcacaatccagccctcggaagtcttcgttgagatctcccacgcaggcctctgcggaacggaccggctattcaagcacaagggtattgccctaggccacgagggcgcaggcaccgtccgtgacgtcgggagcgcagtgactaccttcaaggtcggcgacaaggttgggtttggatgggtgcgcaaggtgtgtggtcattgcgacttctgcgttagcggtatgtacttttacttgcctctacacccttacgatcgatggtaa

SEQ ID NO: 8896 - DNA, 342 bp, A.fumigatus
aggtaccgaattgtcaacatccacacaattgatggaatacccaacatgactgatccaacaccgtcctgtctcctaactaactccacagacaccatgcctccgaatcgcgtctcgaacctctcccccaatctcctgaatggcattttcgcctccctcagccaaccgtcccgccgctggtccctcctccgcaccctccaaagcgacaacccccgtgacatcaacggcgaactccgcggcacagcatccttccatcctctgcggcacagctccgcggcgtccgaccaccgtgatgtagtctaccgcgaggagggcgagctaccgaacacattcgggccggcgtcc

SEQ ID NO: 8897 - DNA, 189 bp, A.fumigatus
gtactgaagtattactacaacggaagaatgggtatcagaacaattcaaattctaattgttgtacctatcttctctgcgctcgacctcatggtactattgtatgctgcctgcgatctgtggtatccttcctcttcgataaagtacctagaccatcaaattaaacctgtaccagagaatacaagtacctga

SEQ ID NO: 8898 - DNA, 213 bp, A.fumigatus
catgtcatgatatgttcgacacagaaaagcgaaaaggtaatctactcaagcatgcgagctattactgtcgttatgcaagggcagtttaggaaaatgatatgctttccttgggagcatggcgcatgcatctctggctcctcggatgaccctcttttccctgagaggcccgtcccatctttcacaagcgcaaacccatatctaaaccagacctga

SEQ ID NO: 8899 - DNA, 192 bp, A.fumigatus
gcctctaactggtacgaatcaagccaccttggatcatgggttcgagtagagaaggctagagcgggctacgtagtccctacattagtttggggctatctaatgttcacagtgcccctaactacagagtactaccgagtagtttactgtctcgactcagacgattcaaagaccctagctgtgcttcactggtta

SEQ ID NO: 8900 - DNA, 237 bp, A.fumigatus
cttcctcctgtaaactttttgcagtatttgctgcagcttgagcctgagaccgcttcaaatgtgcctgaggatgcgacaagtgagtcgcccctgtggggttaccgcgtcggatggagcatttctggaaatggcgcttcagaatatcactgcgagagaacgtgtccttgcagagaacacacatgtacgggcgatcaccagtgtctagagggtgagattatttggttagccaatgcctaa

SEQ ID NO: 8901 - DNA, 795 bp, A.fumigatus
tctcaccctctagacactggtgatcgcccgtacatgtgtgttctctgcaaggacacgttctctcgcagtgatattctgaagcgccatttccagaaatgctccatccgacgcggtaaccccacaggggcgactcacttgtcgcatcctcaggcacatttgaagcggtctcaggctcaagctgcagcaaatactgcaaaaagtttacaggaggaagtcagtagtaccgtcccgccttccaatggcatcgcgggtgcgaccttcagcgagggggccgtgaacgggaacggtctgggtgcaggccgaccaggtttcacggaccagcagcctctaggctttacgatgcagtctgtcaatggactgggccgtggtcagccagacgacgcctacgctcatggacaagctcatcagagagcatcgtggatggctactcccaagcagaacccgtaccttgtgcagcctggcactgaagcacctaaccagcagctgaatgttgaccgccctacccttgaacaggcgaaaccctccgtcgttgatcccaagcgtcccatgatgcccggacccgacccgaatcatggcggtggacttgattggacttccatgttccaggctggagcctccgacggctatatcaatcaggtgttcccccagtccatggcatccggccaggagcctatccaagcccaggttgaaactgaacgaaagttctaccctaccactacgacggctggccctcaagaaggtggaatgaacggtttatacttggcttctactactctcggtggcgatggtaagtaa

SEQ ID NO: 8902 - DNA, 594 bp, A.fumigatus
caagaggtcgttgacagcggaaacactaatatcgggctcagagaccaaagactggcgcttcaatgggtccaagagaatatcgcggcgtttggaggtgacccggccaaagtcaccatctggggagagtccgctggaggaatgtctgttgggtatcatctcacagcatacggcggtagagacgatggactcttccgcggagctattatgcaatctggtggctcaatatctgtcagtccagccagctacacagtatttcaaggctcttacgacgatcttgtgtcgaaagtccaatgctcggacgatgaagatacgctgcaatgtctgcgtgatgtgccctttgagacgttgaatgccgcgctcaacggtactggcggctcacccaactaccgatttgccccagtggttgacggggatttcatcccggatcgcggcagtgtgctcttgaagaagcacagatatgtcaaagtccccatcattgctggtacaaacacagacgaggggacagcatttggtccctttgggatcaataccacggagcaattctacgagtacctcacaggtttgttggagtgcgctttcaccttttatcactag

SEQ ID NO: 8903 - DNA, 1032 bp, A.fumigatus
  unsure (812): Identity of nucleotide sequences at the above locations are unknown.
ctctatcagatcaacggacctcaaccatcaaacaccaccaccaccatcaacacggacaacataatcacatctactgacaaagtcagggagagtctcagaatgacatccccctcccaccgacgcctcctaaaagaagctgccgaactcgcctcccacccctccccgcacttcaccgcccaccctgtctccgactccaacctctacgactggcacttcaccctcgccggcccgccccctccctccccatacgccggcggcatttaccacggccgcatcgtgctcccacccagctacccactgcgtccaccctccttccgtttcctcaccccctccggccgcttcgaggtcaaccgcgaaatctgcctcagtatctcgggccaccacgaggagacgtggcagcctgcgtgggggatacggacggcgctgctagcgctgaggagtttcatggatgcggatgcgaaggggcaggtgggagggttggatgttgatgttgctgtgaggcggcggtatgcggttgagagccgggggtgggtgtgcgaggtttgtgagggagggaggagcaatgaggaggtgttgagggcgtggcgggaggtgtgtcgtgccaagggggtggaggttgaggaggatgaggtccagggtgctggtgctggtgctggtggtaccgcggagaggacgccttcgggggaagctgagccaactccagaacgagacccggaggatactacagacgcaaatgcaaatgctaatgcggagacggagacggggacagagtcttctcagaaggaatcagaaccccgaccatcgaagcatgntacgccgcagcagcaggtgcaagtaccggtgccttctgtgccatctgcacctgcgccaacacctgcgccaacacacacgactccagtcccgactaccactgctactacttctcaacccactacaacagatgcaccgtggctggatcgagctatcctaggcgttctcgtcgcgttggcgttcatgatcgtacggcggcttgccaagtcggaggaggtttag

SEQ ID NO: 8904 - DNA, 279 bp, A.fumigatus
tatcctccgggtctcgttctggagttggctcagcttcccccgaaggcgtcctctccgcggtaccaccagcaccagcaccagcaccctggacctcatcctcctcaacctccacccccttggcacgacacacctcccgccacgccctcaacacctcctcattgctcctccctccctcacaaacctcgcacacccacccccggctctcaaccgcataccgccgcctcacagcaacatcaacatccaaccctcccacctgccccttcgcatccgcatccatga

SEQ ID NO: 8905 - DNA, 771 bp, A.fumigatus
cttcaggagatacgttcgacactagaaaaagctgcgtcaatcactgagccatctgttgatgtgcggcagtttttcgcatttcccccggaggacatcgccaactccgaagacaacaaggtgccagcgctcttgatctacgccttgaacatattctccaaatgtctgatttcgtccctcatcacggaggcatccatcaaccagggccaagcggagccgattggcatagtggctgcacagatcttctccatggacgccttcatttacaagggtcaccacatggttgacatcctttgggccaagtaccgtgttgtctgtcccgcactctggggcttttacggcagtgagaaaactgaggccggcagaaaggccatcggctggtggcgtgagggcccggacggaccttttataagtgaacaaggccatgcggatcgcatgacagcacttggggccggatatgccgccttaacattacgcaatttcggcaagacgccgcgcaggaacccgtttcccaacaccatgttctggtatacgatgcataaaatactcatgattccgccgaacgaaatccaagaaacacacattacattgctctctgcaatgctcaagacctccgtcgagaggattgtgggcttcttcggccatatgggcttggcattgattcgacgggcgattgtcgatttacccaacagccttactcgccagagtatgggtgtcaatcaactgaagctcttgagagatatttacaagagagagaaacacatcatcatttaa

SEQ ID NO: 8906 - DNA, 234 bp, A.fumigatus
aatgaaaatcatggaatatgggataattaccctggattgcttatcttgcttggaatgcgaatgccagatagacctacaggaagaaaagtcacaatgatacacgatatcagtggaaataagcataaacatatttgcttctcaactacatatgtagcgtaccttaattataaccagtctcgcgtgacatcatcagcctatgttgtgctacatgctgttgtgattgacttagaatga

SEQ ID NO: 8907 - DNA, 951 bp, A.fumigatus
agacaacgcaccgctggcatgaaacccgcccctcctccaactcgcccccccggtgagactctcaaatacgcgtcagcagcggctgccgcagcggcgagcgacaaaaacggtgtcggtattgcccctctgcccccaccgcctggcacgagccctgcctataccgccgccatcccagtctcgagagcgtcatccacagcatcgccagttgtgtcttcggtccagccagtgtcgaaagcggcagcaaccgccacggaagagcctggcggacacggtcggtccaagactccagctctcaaccccagcgcgacggcgactcctgcagccgccagtgcttcgaatacgatgccttccactccagcgacggacaaggcgaacaccacggctgccaaggaacagtcagcgacagccaacggcgagacagccaaggaagatgaacagcgcgacgagtcgatataccatctgcctcccgggctgcaggacctgatccagtcatttgaaatcaccaagagccgcgcgacgaacagtgcttcaagctcgtcaccgtcggtccagcgattgctcgcagcatcactggcaacttgcccggagcctgccgatgcagagaaaccccgtcattaccgaccttccaatccgtacaacacccctctctactacccgcaagaaccactcgccatattcgatgatcctcgtctgtatgacaccggacggattgataccgatacgcttttttacttgttttactaccgtcagggaagttaccagcagtacctggcggcaaaggcgctcaagaaccagagctggcgcttccataaacactaccagacttggttccaacgccatgaggagccgaagaacatcaccgaggactatgaacagggtacatatcgattctttgattacgagagtacctggtacgtctcattccattcgtcgtttctctgttttctttga

SEQ ID NO: 8908 - DNA, 183 bp, A.fumigatus
caagatcgttgcctgagggtcagcagagggacacatgactcgacaatccgtacttttgctagcgctctctctctctctgtccccctcgcccttccaggtacttcctcttgggctgtcgttctttgcggggatttcaccctttggcacccgttttctagatacttttcgtccaagtggtactga

SEQ ID NO: 8909 - DNA, 600 bp, A.fumigatus
gagtcaggagtcgcaccttctgaagagtctctgccgcctacagaatgccacgaactggtttgtcaccatctattgaaccttatgccgtgcaaccatagccaaccacttctgatattaggtactgctgcaggccccgcatgcaagacatgccgggaaaagtgccgcaagtgtgaccgcggtagacctaagtgtcaacggtgcatctcaaaaggcttagaatgcggcgggtaccccgacctgtaccggttttgcggaatcgctagtcggggaaggtggaaaggcgcaagagtgccgactccaagaaacatcaaatctaaatctaccgttgctgagtcgcagcaagtctctactaccgcaacgccggattcggttacgtctggatggacagagggcgtctcgacgcaaccgtcttctaaaaagtctagcagaagcgcaacagaattgccagacgatatcccaaagatactgaatctcacccagacggagttgttgttatcgcattgtaagctcttattggctggattttggagggcaggaaacactgacgccagagaggtacagacgaaaacttcatatgtccgcatcaaattgctgagatag

SEQ ID NO: 8910 - DNA, 597 bp, A.fumigatus
gatatgaatataggcgagaaagctcgtatcagtgccgctggtggcttcgtcgactttggccgagtcaacggtaatctggccctatcccgggccattggtgatttcgagttcaagaagagccccgagctctcacctgagcagcagattgtcacagcttatccagatgtgacagttcacgaagtgactgatgatgatgaattccttgttatcgcctgcgacggtacgtctttctgtatcgtgggcttatctacaattacaccgtcttgttgccctttactaatggatttgcttgtaggtatttgggactgtcagtcatcccaatccgtagtcgagtttgttcggagaggtatcgctgcaaaacaggaactttaccgtatctgtgaaaatatgatggacaactgccttgcttctaacagtgagactggaggtgttggatgtgacaacatgaccatgatcatcattggtcttcttaatggcaaaaccaaggaagaatggtacaatcagatttctgagcgggtagctaacggcgacggcccatgcgcgccgcctgagtacggcaagtgtctcgaggatcccatggtcggcgagggttactga

SEQ ID NO: 8911 - DNA, 639 bp, A.fumigatus
acttcctccgagggtcaagatgaatgttgtttgtatggtttgtcggccatgcagggctggcgaatcagcatggaggacgcccatgctgcggtcctagaccttcaagccaaatccacaggaggttccgaaaagcctacagatcccgataaacgcctcgctttttttggtgtatatgacggtcatggtggagataaagtagcgttattcgcgggagaaaatgtgcataagatcgttgcaaagcaagaggcctttgcgaagggcgatatcgagcaggcgttgaaggatggcttcctggctaccgatcgggctattttggaaggtaagtggacgccactctggggcttctggaattctgaattctgttctcttgtcattgttcggcttggggttctcaaggaaactgacttgctagacccgaaatatgaggaggaagtctccggttgcacagctgccgtcagtgttatttcaaagaacaagatatgggtcgtatgtaccttcaacctataccctacggccatcacttggagatcaggagaaaggctaattgggatggtaggcaaacgcgggcgattcacgctcagtattgggtgtaaagggccgcgcaaagccgctttctttcgaccacaagccacagaatga

SEQ ID NO: 8912 - DNA, 411 bp, A.fumigatus
gagatggttgttgcagctgaattccgtgggcctggtatccgcaatcaatttgaagaaacccccgataattatgatcttgaaaacgaccgctcccgcggcttcagcgtccgttccggccgtatcattctcctaggtgacggcactgaactaattcccgaacagaatgacgaggaacttttcgaccagagagaggaaaatcgagatgtcacaaatcatttgcaacacgagtcgcctgattcgtcggctcgaggagatcgtgaaggtaccccgggaccccagtcgaagaacgagaccacgagtaaggctgaggagacctcgactgccgccaacctgtccgaatcaccctcaagcgcaaacaagaactcttctggcagcgggactgaagccacggagaagtctgcctcctcgtag

SEQ ID NO: 8913 - DNA, 201 bp, A.fumigatus
gcaaacgcgggcgattcacgctcagtattgggtgtaaagggccgcgcaaagccgctttctttcgaccacaagccacagaatgaaggtccgtgtcttatcatccaaccctccggactttcgcagctaagatatgaatataggcgagaaagctcgtatcagtgccgctggtggcttcgtcgactttggccgagtcaacggtaa

SEQ ID NO: 8914 - DNA, 225 bp, A.fumigatus
ccaactcgctacagtcgtatgcacagcaagggaaagggtattagcgcctctgctattccctacagccgttctgctcctgcctggttgaagaccacccccgagcaggtcgtcgaccagatctgcaagctcgccagaaagggtgctaccccttctcagattggtgttgtcctccgtgacagccacggcattgcccaggtcaaggttgtcactggtacgtttatttag

SEQ ID NO: 8915 - DNA, 513 bp, A.fumigatus
tttggctaccttttctacgacatcctattcacctacgtccctaatgtcttccaaacaccctatcaaacctgccccctagacctccacaccgatgcattctacccctcccgcgcatcagagatcaatcaccgtctggtagaaataacgaacggcgctgctgagaggattattcgtgatattcatgagcgtgaatcagcgaagcagacctgcgccatcggcatcgactgggcctttgagctggacgacttggttgagatcgtgcagtgttttcgaggcgaagctctcgccactatttgcaaagtcatggctcaggagtatcagcagcgcggtggggggatacctgatctctttctgtggagtgtggagaagaaggaagtcatgtttgtggaggtcaagtcggaaaatgatcgcttgagtgatacccagaggttgtggattcatgtacttactggagcgggtgtgagggtcgagctttgcaacgcggttgcgaaggaggttagacgatcgagttaa

SEQ ID NO: 8916 - DNA, 591 bp, A.fumigatus
gggtacgttgaatgtagcgctgttaacagccacaacgtatgtgtcattggcgggtatagaatgcgagttagctgttgcagctggctgacactgactcccagtatcgcaacgactcgtcaagagaatatgatgaatgaactgagagatgcaatactgaggcagaatgaagctttccttcagcaagaaatctccagagcagatggccagtgcgcggagattcaactgtccctacagcaagtcgaggccagcgacaacggccagcaaaatggtgatttagagcagagcagaaatgaacttttgcaggagatccggcagcagcaggcctcccatgatgcgtttcgaatcacctgtgagggagagttgtcgaggacagtctatgagcgcaccgggcagaagattaagggggtcaaggcaactaatcacagttcttcattggcaggattcattaacacctcaggagatgagttaacgattgatcaggatatctcggatgttactgctgacaactggagtgttgcagctgctggagtcattaagaatttgaacttcaaggatttgcgttcgactgccacttctcgtcagacgccttaa

SEQ ID NO: 8917 - DNA, 387 bp, A.fumigatus
  unsure (30),(63),(190): Identity of nucleotide sequences at the above locations are unknown.
ttggtagtctgtgtgccattaacggcgcanacacatcatctcttcggagccgaagaattcgcngtcttatcctcacacatacccgccggacatcccaagccatatctgaccaacattgcacgcggcaaggtcatcgaccaagaggcactgatcgcgtctctccgctcgggtgagttgagcggggcagcgntagatgtcaccgatccagaaccgctccccgcagatcatccgctatgggatctgccaaacgtgcggatcagtcctcatatcagttccctgggcaaggaatatttcccccggtccttggatattgccagggagaatatgtggcgattggagaggggagagccactggtcaatgagtacaaacggacgaggggatactaa

SEQ ID NO: 8918 - DNA, 342 bp, A.fumigatus
ggacagttgaatctccgcgcactggccatctgctctggagatttcttgctgaaggaaagcttcattctgcctcagtattgcatctctcagttcattcatcatattctcttgacgagtcgttgcgatactgggagtcagtgtcagccagctgcaacagctaactcgcattctatacccgccaatgacacatacgttgtggctgttaacagcgctacattcaacgtacccttacagtcgttgagctgtcccttcaaagtcatgattctttctttcccaaacaaacctactctccacctatccatccagaatgtcttctcgtccgtcgacttactcatccagtga

SEQ ID NO: 8919 - DNA, 201 bp, A.fumigatus
tgtcctcgacattctgccgctgtctttatgcacagtcctcagacgttggaggtgcctacaagacggctccccctcccccaaacaaccggcatcactcttgacgacgtggccttcagtaatgttcagcgccacgtgtttgacacaaacggcaaggagtatgtcgagggagcccctcgtctgtggacacataaacttgaataa

SEQ ID NO: 8920 - DNA, 552 bp, A.fumigatus
actgtccaattcctacgccgccgggttcctttgcagatgccgtgggggtgttccctggcgatccctcctgtacttgccaggctggagaggcagaattccatgagcgacatggcgagcgatcagctgttgtatcttgcgtcgcagcgcatcataatccaggataatggaaagaagccggataagttcatggtgatgcagtggatcctgacgctggaagggttggagaacgctcctgggacggggctggaggaccatagtatcagcattgagtcgtttgcgattcggataccgtatgatgcgctgttttacaaggtgcagaatgccttcacgccttggagctatccgagtgtggtgctgttggactatgtgggcgatttgcaacagttgtacgatgatcagcccgtgaggaaggagttgattacgtttggtatggcgatgaatctggctatcgccagtaagaactgttatgctgggggtgggttgataatacggcgactctatttgcatcatgccacaaagagacatttggcattgttgctgttgtactggtag

SEQ ID NO: 8921 - DNA, 975 bp, A.fumigatus
ggatatgacccccacccaaagggcccccctggagacgcaaacccgggaaagcggaagccttccgcaaagccaaagaaaggcttcggccacagaaggaaaaagccatattcaatatcgggaccaagccagaccccatgcaaaggccactcatcaaacacacgtccaccgatcgcatcggacgcaatctcgaaaaagacctcaagtccgagcttttcgggggacctggaagacgtcctcctttctttagccagaggcccacttgagcaggacgtcgctaccctgcgcggtgccatgtcaggcctaggaacgaacgaaaacctcctcacggatgtgctggtcggccggtcgaatgccgacctgcgcgcaatcaagtacgcgtatgtcagcaagtaccagaagtcgctggtggaggatatcaagagcgatttgtccggcaagaccgagcagttctttgtcatgttgctgaacgctacgcggccggagccggggacgtatttcgatgcgcagtcggttgatgctgatgttcgcgagatccaccaggcgacgcaggcgcgcaaggggacagatgagattggtgtctttgccgtacttttgggtgcctcggatgcgaagctcgtcgcaatcgcgcaggcttttgaggcaaagtatcatattagcctcgagaaggtgatcaaggatgagttctcgggccacctggaagatgcgctactgtcgatgctgtctaaggcgaaggatcctgttggtcatgatgtggagaagctcctaaagtgtttgcctcctgttgagaacgggaaagcagatgtgaagcggttgatctactgggttgttcatctgcattggaacccaccccattttgcagcggtcaaggcgcggctgaagcagaagctgggccatgatgttggcaaccacttcagagaagccattgccccaggagacttccttactgctatgcgccaggtgtggaattcggcctag

SEQ ID NO: 8922 - DNA, 231 bp, A.fumigatus
gataaagtgggtccaagactacatggcacaactggcatcgcatccttatgtctcgactctaataacacagacttacggagtactcctatcgtcttcatgaaacacagcataatgatgctaccaacctcaattagcctaatcaaggtattcctttcccctcaaattgcgtgtactcttgttcctgctacacagattatctttacctatctgttaaaatggctttgtgggtga

SEQ ID NO: 8923 - DNA, 249 bp, A.fumigatus
  unsure (167): Identity of nucleotide sequences at the above locations are unknown.
gtcaagattctgacagagggccttgccataggctacactggtatgggggtacgttgtcatgacgctccgtcgcaaacttcaattgctaatgatgagactgccaatagtccttatgtccgttcaaacggcgagtggattggccgcagcattctttcaggcttcttcgntgctccgatcgaagctcttccagaagtgaccgtcaccgatgtggtaagtgcttgtggatcaaacgttcacgccacttattga

SEQ ID NO: 8924 - DNA, 495 bp, A.fumigatus
tactttacccatgaacgagggacgtatatgggtctgtacgcctttttcttggccgggagcaactactttgcaccagtgatatgcggcttcatcgcccaatatcagggatggcaatgggttttttactggcctgccgtattctgcgctgttactatcgctttcctctttttcttcatggaggaaacgaactacgcgcggaaatgtgccgagacaaccacggtcgagggcatcctagaatcgtcaacgaccccctccaagcaaggtgaccaggaaaagcctctacctgcgacgggacaaccggatcaaacagagtgcggagttatgtacagcaagaaaacctacattcagaagctgtcaatcattggacctcggcaacccaggaacaacatgtttaggcggttctaccaaacgttgtactacctgagctggccggttatcttctatgctgggtatgtcaagcggtctctcatattcatcggaaacatcagatactga

SEQ ID NO: 8925 - DNA, 372 bp, A.fumigatus
cgagcaattcacatacagaccctactaactcggtccagatcccttttcaccggaagattcagtgattggcttactatcaaactcgctcgacggaacggcggagtgatggaagccgagcagcgtctctggcccttccttgcgtgtgtgattattgtccctggatcgctgctactctggggtgtgggtgcagcccacgaggtccactggttcggacttctagtcgcgatgtgccttcttgcgctcgccagcacctgtggagtaaccctgagcgtcaactatctcgtcgacagctacagggagctgagtggcgatgcgatggctagtgtgatcttggttcgcaacacaatgtcgtttgccatgggctacgggtaa

SEQ ID NO: 8926 - DNA, 258 bp, A.fumigatus
aaacagcatattgcagctcacagacagcatttgaccttctgcagttgcttttgtctcgtcatggcgcctcgtggagacggtgacagcatcccaggcacgttcaccctggtggacgtggatggtgtattggccactcgtcaccttgatagaggagacagagatattgtccttgtgcctgaaccctccaatgacccagatgatcccctaaattggtcaccacggcgcaagctactgtctacgatctgtgtgagcgtgtga

SEQ ID NO: 8927 - DNA, 297 bp, A.fumigatus
gtcgacggaagaggctgttttgatctagagttctcgaccaaacagctaatctgctccctaatgtccaggtacaccttgtttgcaggcatctcaacttcagtcgtttattctgtgcttgttcagctctctgaagagaccggtgttgcggtggacactctcaaccagggaaccggatatatgttcttgctcgcaggctggggccttctcttctggcaaccatttgcgttgcagtatggtaaacgattgacgtacattctctcattagttggaatattggtgagtcttcaaagctattga

SEQ ID NO: 8928 - DNA, 1230 bp, A.fumigatus
tttatcgtgatagtgcaaagtatcgtggacgtttccgcccgcaactacattggtggtgctttcaatcgccacgttaactggctgggtcgtgccttttggcgggcctggttcgatgcggaccgtgtcagtctggaagcagcacgcagagactatctggaataccgctttggaaccgtcatctctgccagcgagcgcaattatcttctcggcggcattccttactacatcttcgttggacgtcacaagaatcttgcatcaaatctctccggtcaggagacaattgaaatgttggacgcctcctttactgaatctccttatctttctcccgccaatcacaccaaggagatggagaaagcaatggagaggaacgctcaagaaattcgttccaaagcctacgagtcggccgttatcaacctgagcgcgaacctcccgcttccctcatccttctaccagaatcaccactgccgcatcttctacaatgatctgctgcccaagcacacgcagttcaagaatgaatacatttatgccttcaactgggaagatcctcgtgtggatcatcgtcttctcgacatcaagcgggatgatgttatcttggccattaccagcgccggagacaatattttggattaccttcagaagagtccacgcagagttcatgcagtcgacctgaatcctaaccagaatcatttgcttgaactcaaggttgctagtttcatggcccttggtcatcgcgatgtctggaagatctttggcgagggaaaacacccagaattcagggaactcctcatttctcgtctcagcgctcacctctccagccaggcattccagtactggcttgagcacactcacattttcacttcaaaatatggcaaaggactttatgaaaccggtggctcgcgccacgccatcaagatggttcggtacctgttcaaggtgtttggccttgagggtcaggtgaagaagctctgcgaggcgcagactcttgctgagcaacgtgagatctggccaaagattcgcgccgtactcatgagcaagccccttcattgggcggttgtcagcaccgaatggttcgcgtggaaggccgcgggcgtgcctcgaaaccagcggaatatgatcgttgacgactacttcaagagactgggcctgaccaaggacatgaaccaggggcaggatatcagtggccggtcgatctggcaatatgttgtggacacactggaaccccgtcgttaa

SEQ ID NO: 8929 - DNA, 420 bp, A.fumigatus
agtgaaaatgtgagtgtgctcaagccagtactggaatgcctggctggagaggtgagcgctgagacgagaaatgaggagttccctgaattctgggtgttttccctcgccaaagatcttccagacatcgcgatgaccaagggccatgaaactagcaaccttgagttcaagcaaatgattctggttaggattcaggtcgactgcatgaactctgcgtggactcttctgaaggtaatccaaaatattgtctccggcgctggtaatggccaagataacatcatcccgcttgatgtcgagaagacgatgatccacacgaggatcttcccagttgaaggcataaatgtattcattcttgaactgcgtgtgcttgggcagcagatcattgtagaagatgcggcagtggtgattctggtagaaggatga

SEQ ID NO: 8930 - DNA, 285 bp, A.fumigatus
ccgcaggaaacacttggaaaaaaaatcgagtcagtaattattagccacattatcgacgaagcaagccttggcctcccggatcctattccggagggccaggtagaggcgtttatttctaataacttaccaccgaacgctaccgagcaaactaagagaatagccaaccttttcaaatcgctgtacgccaattcaaccaagaaagaaatgctctctgcattatataacgacattctctacacttgcaatctacatgctgttctaaaagcctacctaagccctgcttag

SEQ ID NO: 8931 - DNA, 222 bp, A.fumigatus
ttaactaattctatcctaaaaacaccttataatcttaagcagctgaagaagcaggaaactatacttaaaaagctacttagggagtatatatacagccctcctacccctacaaaggctgtgctaggtcagattattaagaggtgtgagatagtaataaataacactgcccttcttgcaaaggaaaattataatctatatactatacataaaaagcacctttaa

SEQ ID NO: 8932 - DNA, 186 bp, A.fumigatus
aatttggccgcggccgaaattagaggctattttaaacccctaaaacatgattttattactaaatctagttattcttgcgctgcggacattgtaattacctatggcctagaatatggcagtcactgtagcgtaggggtgcctgttaagggcattgttctgtatctactacctactctagagggatag

SEQ ID NO: 8933 - DNA, 963 bp, A.fumigatus
ccggtgtatggaaacaaacaagggaaacttacgatcaagactaccgatatggagacgatctacgatatggggaccaaaatgattgactcaatgacaaaggagcgtgtgatggccggagatgttatttcaatcgacaagtcatcgggaaagatcacgaagcttggacgttcctatgctcgttctcgggattatgatgcgatgggcgctgataccaagttcgtccaatgccctgaaggagagcttcaggtccgcaaggaaattgttcataccgtcagtctccatgagattgatgtcatcaactcacggacacaagggtttttggcccttttctctggtgacactggggaaatcagaagcgaggtcagagatcagatcaatactaaggtggctgaatggaaggaagagggaaaggcggaaatcattcctggtgttttgttcattgacgaagtgcacatgctcgatatcgaatgtttttcctacatcaaccgcgcgctggaggcggagcttgcacccattgttatcatggccagcaaccgtggtcaagcgcggatccgcggaaccacatacacctctccccatggactaccgcttgacttcctcgatcgtgttgtcattgtcagcacgcagccttattctggcgatgaaatccggcagatccttgcgattcgagctcaggaagaagagatcgacctctcgccggacgctttggctctcttgacgaagattggccaggaatcgaatctgcgatatgctagcaatatcatcactacctctcacctccttagtcagaagcgaaaggccaaagaagttagcattgacgatgtacagcgcagctaccgcttgttctacgaccctgccaggagtgtcaagttcgtcaatgcgtatgaacaacggttcataggggatcaaggcgctgtgaacttttcagctcctgcaaatggagatgccatggaaatctcataa

SEQ ID NO: 8934 - DNA, 477 bp, A.fumigatus
tttatttcacagcctatctcaaccgtcgcggagacgaaggagctccgtggtctgaatctcattgctgctcattcgcatatcaggggacttggcgtcgatgcggactcgcttcaacctagaacatcctctcagggccttgtaggccaggaaaaggcaaggaaggcggccgcggttatattgcaaatggtcaaggagggcaaaatcgctggtcgcgcagttctcatcgctggccctcccagcacaggaaagacagccattgccatgggcatggcccagtctcttggatcagacgtccctttcacaatgcttgcagcctctgagatcttctctatggagatgtcaaagaccgaagcactcacacaagccttccggaagtccattggtgtcagaatcaaggaggaaagcgagattatcgagggtgaagtcgtggaaatccaagtcgatcgcagcgttactggagtgagtgcagactcttga

SEQ ID NO: 8935 - DNA, 579 bp, A.fumigatus
acccaccgcggatccttccagccccgtggtgaagacgccgatgcactgaagactttaataactcacctgcaacggggagaaacagctctagaggctttggcaaggataggcaaaggggctccaaagaaaccaaaatggcaggccaagaagaaaaagaaccgctcgaagcaaaacggcgcccaagtagaagatgccgaaatgacggaagacgaccccaacgaggcttctcgaaagcaagcgatagagaccatcaccggcgcggcggatatcctcatgacacggggacaaacggatatttatgacatagagcgtgagatgctcacaagacagtatcgtcaagaaacaggcgaggactgggttgatcctcccttggagtccgctgctcccaccagtgctgaagaagagcctgcaatgtggcaatttcggtggtctgacgctcgagacggcggtgtcgagcatggcccatatgacagccaaacaatggagtcttggaaaagtgctggctatttcggcgacggcgtcgaatttcgaaaagtcggcgatacaggagactggacaagcgaggccactttcctatga

SEQ ID NO: 8936 - DNA, 417 bp, A.fumigatus
gcggccggtcccgttgtcacactcatcacgagctggtcctggaaggtcaccaaaccctcaatcggggcattcatcaacatcctcatcataaccctgagcgtcgcaatggctgtgtcgggcgagatcaggttttcctggttagggttcggtttccagttcgccagtttagtcttcgacgcaaatcgactcgtcatggtccagattcttctgtcggacagtggccagaagatggacccgctggtcagtctgtactactttgcgccggcgtgtgctgtcatgacctcgctggtggcctggcagaccgaatacgcttcgttcgagtggagttcagttgcgcaggctgggtggacagtcctgtcactgagtgccgtgatgggcttcatgcttaatgtctccatctttctcctggtgagttaa

SEQ ID NO: 8937 - DNA, 288 bp, A.fumigatus
tctgatgagaaacagatgttgtccttgctgaccatgaagatcggcaaaacgtccggtttagcgatgacgctgatcagcattcccaagaatattctactcattgctatctcggtggttctctggcatacccccattagtctcctgcagatcctggggtacagtatcgctctgtggagccttcttttctactctattggttggaagactgtcaaggcttatattgacgctctgggggtctggagtcggaagagtgatgaaaatgaagtcttactgtctgacagggtctga

SEQ ID NO: 8938 - DNA, 1890 bp, A.fumigatus
  unsure (257),(414),(434): Identity of nucleotide sequences at the above locations are unknown.
gggttatttccgccaattcgggtttcattcccagcgtggtttgctgaggccgcattcaattcctgggaggcccggcaattctggcttggggtgttaacctgcccggggaacccgttattcttcaaaagacccaggaataatcacgggagaagggtagttgggttgagtttgcccctcaggagtcttccagatgttgggaagagttgtcgacctccatacgacacgtttgtggaagtattcatcatcacatcccagantgaaattcagtactacttttccctcatgaaccagcatttgccgattgagagtcagctcatgagcaaacttgctgataacatgaatgcggagatcgttcttggaaacattcgcaaccgcgacgagggagtggagtggctgggctacacttatcttttngtccgtatgctccgctctcntggcctgtacagcgtgggcgccgattatgagaacgacgacgcgttggagcagaagcgagttgatcttgttcactccgcagccgtcatcttggaacgggccggacttgtcaagtatgagaagaagactggacgcctgcaatccaccgaattgggacgaattgcttcacattactacattggccataattccatgttgacctattctcagcacattcaaccatccatctcgactattgagctcttccgcattttcgccctcagcgacgaatttaagtacatccctgttcgccaagatgagaagttggagttggcgaaactcctcggtcgtgttcctgttcctgtcaaggagagcattgatgaacctcattcgaagatcaacgtcttgctgcaggcctacatttccagactgaagctagaaggacttgctttgatggcagacatggtatatgtcactcagtccgcgggtcgtattctgcgggccctttttgagatttccttgaagaaaggctggtcatctgtcgcgaagactgctctcgacctctgcaagatggcggaacggcggatgtggccaactatgacaccactccgtcaattccctcactgtccccgggacatcctgcaaaaagcggagagaatcgacgtgccttgggccagctatttcgacctcgatcctcctcgcatgggcgaacttcttggtatgcccaaggctggacggaccgtgtgtgatctcgtatccaagttccctcgtttggaagtccaggcgcaagttcaacctgtgacccggtcattgcttcgagtggagcttaccatcactccgaatttcgtgtgggatgatgctttgcatggaacagcgcaagacttttggatcctcgtcgaggactgtgacggcgaggaaatcttgttccacgatcaattcattctccggaaggactatgcgcaggccgagatgaacgagcacctagtcgaatttactgttcccattaccgagcctatgccccctaactacttcatctctctcgtttccgatcggtggatgcactcagagaccaagattgcggtatctttccagaagctgattcttccggagcgattcccaccccatactcctttgctggacatgcaacgggcacccgtcaaggcactgaagcgtgaggattaccagcaactctatcctgagtggcaacttttcaacaagatccagtctcaaaccttcaagtcgttgtatgatacggatgacaatgtcttcctcggtgctcccacgggcagcggcaaaactgtttgtgctgagcttgcattgctacggcattgggcaaccggaaaaggcggcagaaccgtctatattgctcctttccaacaattgattgatcaccgacatgcggactgggagaaacggttaggcaacctcggtggcggcaagaatatcgtccagctgaccggggagaccctgccgatttga

SEQ ID NO: 8939 - DNA, 300 bp, A.fumigatus
  unsure (18): Identity of nucleotide sequences at the above locations are unknown.
agacctcgcagtgggtgngaaaaggttcgcctcctggagtatctgcgtagctacattgcatcccgtctggaaaggggcgagtatgactccgactccgactccgatgaccatgcttcggccgccgcttctccggttatcaagcatgatggacacatggacggtgtggaatcgagtcataaacccatcactgctgaagagacttcggcgcctcccgcagccaaggctgagtctaaccacggtgtgatgtatcccacacttcatggattggatggtgatgaagataccaagatgcaccactaa

SEQ ID NO: 8940 - DNA, 423 bp, A.fumigatus
tccggcgaaaacgacgacccgctcggccgcaggtggaccctgcaacgcttaaatcggagccgcccccgcagacaggcaccgtcttcaacatctggtacaacaagtggtccggcggcgaccgcgaggacaagtatctctcgaaacacgccgcgccctcccggtgcaacatcgccaaggacagcgggtacacacgcgcagacaaggtgcccggatcgtacttctgcctgttcttcgcgcgcggcgtctgccccaaaggccacgagtgcgaatacctccaccgcctgccgacgctgcatgacctcttcaaccccaacgtggactgtttcggtcgggacaagttcagcgattaccgggacgacatgggcggtgtgggctcgttcacgcgccagaaccgcacgttgtatgttggccggatccatgtga

SEQ ID NO: 8941 - DNA, 1065 bp, A.fumigatus
tttcacctgaaggcatcgcagccacttctttgctcaacttcaactcacaaacaacacccacaacatttcaaactcgcaatcatggcggagacagccgtcatcgatcctccacatgccacagagccaacatctctaccaacagaatccgccgacccaagcggccccgctcccagcgacgaaaatgctctcacccaaccgtcagaaagcgccgtcacggccaccacagacgccgatggcacacaaaaaaagaccaagaagataatccggcgaaaacgacgacccgctcggccgcaggtggaccctgcaacgcttaaatcggagccgcccccgcagacaggcaccgtcttcaacatctggtacaacaagtggtccggcggcgaccgcgaggacaagtatctctcgaaacacgccgcgccctcccggtgcaacatcgccaaggacagcgggtacacacgcgcagacaaggtgcccggatcgtacttctgcctgttcttcgcgcgcggcgtctgccccaaaggccacgagtgcgaatacctccaccgcctgccgacgctgcatgacctcttcaaccccaacgtggactgtttcggtcgggacaagttcagcgattaccgggacgacatgggcggtgtgggctcgttcacgcgccagaaccgcacgttgtatgttggccggatccatgtgaccgatgatatcgaggaggtggtgtcgcgccatttcgcggaatggggccagatcgaccgcatccgggtgctgacctcgcgcggggtggcgttcgtcacgtacacgaacgaggcgaatgcgcagtttgctaaggaggccatggcacaccagagtttggatcataatgagattctgaatgtgcgctgggcgacggttgatccgaacccgttggcgcagaagcgggaggcgaggcgtctggaggagcaggcggcggaggcggtgcggagggcactgcccgctgagtttgttgcggagctggagggtcgggacccggaggcaaggaagaagaagaagatcgagggcagctttgggctatcttcaccaggcgtggagatccgactc

SEQ ID NO: 8942 - DNA, 504 bp, A.fumigatus
cccgcatgcagaaaactcgccagattaagagcacagctgctggagcccaccggcggcggcggcggtggcggcacagggttcgacgtgagcaagagcggcgatgcccgggttgctcttgtcggtttcccgtccgtcggtaaatcgacgttcttgtccaagatcaccaagaccaggagcgaggctgccgcgtactcgttcaccacgctcacggccatccccggtgtgctggagtatggcggtgcggagatccagatccttgatctcccgggtatcattgaaggcgctgctgagggtaaggggcgaggacgacaggttatctctgctgcgaaggtgtgtaccaagctactgcctgagacaacgcttcaggaatgctcctctgaccatgtccagacgagtgatctcatcctcatggtcctggacgccacaaaacgcgcggaacagcgagccctgctggaagcagaattagacgccgttgggatccgtctcaacaaggagcctccgtaa

SEQ ID NO: 8943 - DNA, 285 bp, A.fumigatus
acgccgttgggatccgtctcaacaaggagcctccgtaagggcccaagcaaccacctccctcaacattttatgcatactgacctcgacagcaacatctacctcaaagtcaaaaaggccggcggcatgaaaatcaccttccagacaccccccaagaaccttgacgagaagatgatcttcaatgtcctgagagactacaagatcctcaactgcgaggtcctggtgcgagacgagaacggtacgctcacgccaccagccctttgcgtatttgtccagactgcatactaa

SEQ ID NO: 8944 - DNA, 2145 bp, A.fumigatus
tggacgttgtcggccctctgtctgctcgtccgcccactccacctaggacaggttctcgtatactatctgagaaagatcgaacagaaggattcccccatcgtcttacagactcccgtggattctcctttcgctgcggacagttccgtccgtgctccatctactcgacaatccaagcgagtgaacttctcaccatggaccaagtacatcaaacctccgtcctttacaaattctgctcctagattgaagtcagaactcaaggagctgcccccttcgaatgagtgcaaaccgacaaagtcgattttgaagacgacgaatgcgcatcctccgatcgacacaaccgacgccgcaccgtgcactcccgaatcattcgccatgctgctcgattcgatcacacaacaattggccggagagtcgataagttcgagactggatgcgtatatgcagttctttggggctctgagggcttacgaagggcttcccagtgagcaagaacttgggcagaagcttggactcattagccagttcatccaacgggatcttagcacagatctcggagatgatgtgcctctaggcacgaatcttgtcattcaagctctcaaattagctgctgcgctctcatggaacatcgagatagctgcgcaccttccagacgaattcaaggtcttccttgtggagcactccatcaatgcccttgaaagcgcgaaagcgcccaaatcggtattgacacattatatgtccatactatctacacaaaatttccattcaaaaatcatgacaaatgcgcggatcatccgtctactgaccgtactcggagacattaccagccgcgtgaatggaaatgcaatcgtctttcagcgtctaagcatttatcagcgccttcttactcagtccaagtcgattttcgtttcccaatcaggcctctgggtagagcatttgctatccggcctccttcaccacgtcaaagatacaaggattaaagccatctctttgggctttcaaacttcgatgatttgcggtccgaatcccagtctatcgaaaagtatccgtgacctattcgatcgtcctttggacaatggcagaaaactagtatcggaaatatgcgagcgaatgtcaaggatgatggcaaacgtcgaaagtggtgtacatgttccccaggtttggagcatcatcgtcttgcttttgagaagcaaaaggctcagtatcgaccaatgggagcattttaaagaatgggttcttgtgttacagaggtgcttcaactgcagtgaatcatctatcaaagctcaggctattcttggctggaaccgatttgtctacgtcgtcagccccagcgacacgacaagtcggtcaatgctgagaatgctaagcaaacccatcatgtcccagttcgagcgaaagaagcaagaacgacatggatcacagcccggacaattagctctgtgcagctaccacaacctattatactatgcatttcgtccgtctgcaactcttcaacacctcgatattgtctgggaagagtatgttgctggcccctcgaatgtatttgcctcatttcctcacttgaacgatcgattctgtcacgctctttccaacctactttggagcccacaagccaagatatggaccgagaacaaggtcaacgagagcacgaaactcgaacctgaggagctaccttccatcgactgcaaatgggtgaggtcaagaatcacgattatcctgaatgtcttcgaagccatcttcagaacttccctttgggctgatgatttggataaatcgaatatcgctgctgcctggatcagcctgtctcaggctttgtcctatgcctcaagtaaagagatcacaccatccaaagagtccatgcaagccgttgccagcgtgcttggacatctccaacggctttggaatgctggtccttcctcgctaaacgctcttggtgacgagtcaatggatgttttctttgaccgttttcggttcctgtccactaccatgatctcttctctgggaggcatcccatttactgagaaacttctcctgaagacagcgaatgagactttccaggctgctaatacgccgacgcatcatcctgtgcgggcaaacactaacctggacagcccaatcttacatcttctccgattcataagcgacgtg

SEQ ID NO: 8945 - DNA, 234 bp, A.fumigatus
gcgcatttcctgaggtctgttggcgtgagaactccagtctttgcccgcttctcgactgtgactctcggtcgagagtttcctgacgaggcgagaaatccacggggcttcgctgtcaagttctacactggtgagggaaactatgacattgtgggactgaactttgtatgcctgcccaagtctgcgcgcaagccagcgactaacatcggcgatacagcccgtgttcttctgtcgtga

SEQ ID NO: 8946 - DNA, 186 bp, A.fumigatus
actttgtatgcctgcccaagtctgcgcgcaagccagcgactaacatcggcgatacagcccgtgttcttctgtcgtgatcccattcaaggccccgatgttattcgctcccagtatcggattccgcagaacttcctgttggaccacaactccttgttcgatctgctcgcaaatactcccgaggggtga

SEQ ID NO: 8947 - DNA, 279 bp, A.fumigatus
catcggcgatacagcccgtgttcttctgtcgtgatcccattcaaggccccgatgttattcgctcccagtatcggattccgcagaacttcctgttggaccacaactccttgttcgatctgctcgcaaatactcccgaggggtgagcgagccatggctattattgaaacccaaacgctaacagataatagaaaccatgcgggcatgatgtttttcagcgaccacggcacgcctgtggggtggcgcaatttacgtggatacggatgtcacacattcaagtag

SEQ ID NO: 8948 - DNA, 234 bp, A.fumigatus
gtagagagatcatactcagcgctatacatactgacgacgtctccagggttaacaaaaggggagaatttgtgtatatcaaataccaattttatcgcagatcgcggacaaaagcagtccactgccgacgaagccatccagatgtgtggtgaggatccggacttttcaaagcgtgacctctatcaggccattgaaaagggcgaaaagatcagctggacggcgcacgtccagattatg

SEQ ID NO: 8949 - DNA, 324 bp, A.fumigatus
gaccgtactttgacgggtgcttcccacaatgaaactaaaattttgtctgagacaggtcatggtggtcagactccggacttggatggcgacgaggaagacggatatgatgaggtcatctacccggtcgactttcgacaagccggtcacattgtggacgacgagatgcaccggatcatggtccggccactacgcccgggagtacgcttgaccgcaatcttcgactcgtgtcactcgggctccgccttggacctcccctacatctactcgacacagggtatcctcaaggagcccaacctggccaaggagggtcttcacccggggcgg

SEQ ID NO: 8950 - DNA, 837 bp, A.fumigatus
gagtctctcaaagtctttcactggtgttggaaggtttcgttgactgaccgttcgaaagacaaatgcagaaccatcatcaccaacaatcttcctacggcggcggttaccccggccaagcgtaccgtgagcaacatcctcctccgaatccttacgggtatggccagccctcccctcagcctggttacggcgcgcctcctccacacaacggttacggtgtatgtcctcatcagtgaagataactgtgaacaaaaaaaaatgcaagtgtggctgactttgtatgcagcaaccgccgtcaggatacggccagccgccgccgcctactggaaatgcggtgtatggtggaagacagcctggtatgtgatcgcgtttggtgcaggaagaactgcattctgctttggaaagtgtcagtatgcggccgctgacatctgcaacacaggcatgaaccagtatcagaacacctactcgcacggtcatcagggtggtccaccaccaccacccactgatccggtcgcgttcggccacggagctccacagggatacagtttccagtactctcgatgcactggtaagcgcaaggccttgctgattggaatcaactatttcgggcagaagggccagctgcgtggttgtatcaacgatgtcaagaacatgtcgacgtatttgaaccagaacttcggctacgcgcgcgaggacatggtgctgttgacggacgaccagcagaaccccatgagccagcctacgaaggctaacatcctgcgggcgatgcattggttggtcaaggatgcgcagccgaatgattcgctctttttccactactcaggtgagaccgtactttga

SEQ ID NO: 8951 - DNA, 534 bp, A.fumigatus
acacagcttgaggtcctccgcctctacccccctgtagtgacggtacctaaaagcacatccgaaaccccaagccccctcacctatcaaggcaagcagtacgtcctcccgccgcgagtcaacattaatctcaacacaaattgcctccactattcagaacaatactggggcccagatgttgcaatattctatcctcaaagatgggatgcaagaaaccagaacagctttctcgcaaagaatgcgtcgacacaaggacttgctggacctggtctagaatttcctaccgttcacaaaccggtaaggggggcattcattcctttcagcgatgggtttcgggcttgtctgggaaagaaatttgcccaagtcgaattcattgccgcgttgtcagctctttcccggaattataaggtcgaattagcagatgacagcccagagggccgtaatgatgcggaaagagtgttaagagagagcacctcagtgctgacactatcgatgagagaggatgttccaatacggtttcagaggagaaaggactag

SEQ ID NO: 8952 - DNA, 222 bp, A.fumigatus
gcacatctcactgctggaatggaaacaaacagaaccgaagacttcccttcgcactggaaagcaacactcctcggggaagctttctggaaagacgcagagcggttcaaccagcccatcaacgacagcatcgaagccagtaagctccttctccttcttgcctatacctgccccattaccgcaaccttcgtcctaacaatgaatgctcatgtgttgtcaacgtaa

SEQ ID NO: 8953 - DNA, 459 bp, A.fumigatus
aaacgttcttgttgtcctcaggtatcgagttgtgctggatttctgaaactacctcgacaacctgagtcagtgacatcaacatactttcgtccctctattcgccaccacaattatatcagaatgtctactttcttctacggtcatcaccagcagcatcaccaccagggtgctactagccacatgccatcatcaaacaaccaccataacggccgctctcgcagagggcccaagatggcctctcagaatgctcaacgtcaattccgcggtgtgaagagtatgagagaacttgccgaagcccctgctgtgactgccttccgtgcacggtttgaagctggacggtctttcgacctggacgacgacctggagttctgtccgggtctccttacagaggacgatgtatgttttgacagccccgttttcggacctcccgttccctcaagatattggccgagcgcctaa

SEQ ID NO: 8954 - DNA, 189 bp, A.fumigatus
ttggtattggtgtatgaaggtctagcgatgcaggagattgtgccgcctgattttctttatgtgctaggagcaactaggtccaacgattttcaagacgcgacattggaattagtcgcgaggagcgatgccgatgatgaccagctagaagaaggcacaagcgattgcatttgggagcttcggcatgtctag

SEQ ID NO: 8955 - DNA, 582 bp, A.fumigatus
actgggtgccatcgggacgtactcagcagccttgacctcatcggcgtcttcctgagtagtgtctctccacgagaagacttccttctgtctgaactcagcgttgtcatcaaagttcagcttggcgtccatagccagaacctggtggtcggaggtctcagacagagggttaatctcaatctgagtagcgtccttctccatgaagaccttgtacaggttctgaatggttgtcttggcatcctcgatgcactgctcagagaagccaagatcggtagcaatcttgcgggcaatgtcatcagtcacgccaaccttgatgtcaataggagtcgtcatgatagcctcagggtgttccttggcgactgcctcaatatccataccgccttgcgacgaggcaacaatgacgggggtctgagttgcgcggtccatgaggacggcaagatagaattcacgacgagcgaacttgcgctcgcaaatgtagacagcgttgcaaaggcgaccagcagcaccagtctgcttggtgatgagcttgtgtccgatcatctggctagcgaacatcttggcctcggttgggctggagagaaataa

SEQ ID NO: 8956 - DNA, 642 bp, A.fumigatus
gtgattcccctaaaatcatcactgttttctctgcggcatttctccttgttgacattatttctctccagcccaaccgaggccaagatgttcgctagccagatgatcggacacaagctcatcaccaagcagactggtgctgctggtcgcctttgcaacgctgtctacatttgcgagcgcaagttcgctcgtcgtgaattctatcttgccgtcctcatggaccgcgcaactcagacccccgtcattgttgcctcgtcgcaaggcggtatggatattgaggcagtcgccaaggaacaccctgaggctatcatgacgactcctattgacatcaaggttggcgtgactgatgacattgcccgcaagattgctaccgatcttggcttctctgagcagtgcatcgaggatgccaagacaaccattcagaacctgtacaaggtcttcatggagaaggacgctactcagattgagattaaccctctgtctgagacctccgaccaccaggttctggctatggacgccaagctgaactttgatgacaacgctgagttcagacagaaggaagtcttctcgtggagagacactactcaggaagacgccgatgaggtcaaggctgctgagtacgtcccgatggcacccagtttataa

SEQ ID NO: 8957 - DNA, 276 bp, A.fumigatus
caacacttacgttactgccctcatgctgaccgcttcttagtcaacggtgctggtctcgccatggccaccatggatatcatcaagctcaacggcggaaaccccgccaacttcctcgacgttggtggtggtgctacccccgccgctatcaagtctgcttttgagctcatcaccagcgacccaaaagtcactgccatcttcgttaacatttttggcggtatcgtccgctgcgatgctatcgcccggtcttcacctcgggaggcgccgatccgcgtaaaa

SEQ ID NO: 8958 - DNA, 468 bp, A.fumigatus
agagtaggcagcgtcttcgagagacgtctcatcgaggcatatattgccgaaaacggcaaagatccagtaaatggggaagaactctcggtcgacgaactcatcgaagtcaaaagccagcgcgttgtccgaccccgaccccctacccttacatccattccctcactgctcagcgtgtttcaagaagaatgggatgcgctggcgctcgaaacttacacattgcgtcagacccttgctcagacgcggcaggagctgagcgcagctctctaccaacacgatgctgctgtacgagtcattgcgaggttaacaaaggagagagacgaagctcgcgacgctttgtccaaggtaactgttagcgccggtcgcgctggaggtgaagaagctatgcaggttgactcaaccggcttaccagacgctgtacttgcaaggattgaaagcacacaggtgtcgtacgtgacatggctatcttaa

SEQ ID NO: 8959 - DNA, 537 bp, A.fumigatus
ttcgtcatcttgtggttactaacctcacctaggctgtccaagacacgtcgcaagcgacctattcctgaaggctgggctacaagcgatgccctttctacatataagcccactgagacatccaagcctctctgccaaggcggcaaggccctagccgttaacgcggccggggaaatggcactcgtagggggggctgatggcactgtcggtgtctactctctgtccgagaaacgtgtcgttggtaacctacacacaagcggcccagttaccagtgctgtatgggctggtgacaaggcagtcatcgcgtcctctacgggttccatccaggtctttgaggatggcaaagaactggcgaactttgcttctcatgctggttcagcaacggatcttgctctgcatgctactggcgacatagtcggctccgtcggtgttgataagagctatgtgttgtacgacctgacaactaactctgtcatcactcaaattttcacagattcatgtaagcaagggctgaatcgtttcgtttgcaacctttgctaa

SEQ ID NO: 8960 - DNA, 489 bp, A.fumigatus
tttctcccgtctcctttagctcttcataccgtcgcattccacccggatgggcatctcatcgctgctggtggcgcagacggtcaaatcaagattttcgacgttaagtctggcaccgcggccgccaactacgccatgtctggtcccgtcaagtgcctttacttctccgagaacggcacgttccttgctgcagtggcagataactcgactgttctgtccatctgggatctccgcagctcaaaagagatcaaggttctggagacgggtagccagatcgattctatctgctgggattacactgggcagttccttctaactggtggccctagcggagtgactgttcagcaatactcgaaggcgtccaaagaatggtcagagcctttacgcagcgcggtgccagcagtggcagtggcttggggctctgctgcccagagcattgtggtattgaacagcgaaggtggagttacagttttgacagcccaggagtcatga

SEQ ID NO: 8961 - DNA, 423 bp, A.fumigatus
gacaagtatacagatatcacgctaaaccgcttccggacttccttatgccatatttttctgtcatcaatcttgctgctgttattattagactcatgctccgtccccatcaccaaaagctctcgctggctcttcttcatcggcctcccccagctcagtttattatctagaatccagtacaacgttaatcatactcttaaaggaatgtctttttcctctggagccctgcgatcctccagcatctctacccgagttcaattgctgtcgatattgcatcccgtgagatcatcactgggaccccaccacaactaccaccaccaccaccaacagccgcagtatcaccgccgcccctattcttcctcctcttctaaacctgactctcctcccccatcttcctcttcgtcctcctccgcctcgtcaggggtc

SEQ ID NO: 8962 - DNA, 1494 bp, A.fumigatus
gtactctctgtgttaaagcttagtttcctcaaaactctgcatctcctccttcctcttctcctcccatacacgctctctcccttctcataccatacttcaccatctgcatatcagcgactcataatttcgacatgcctaaaccaaagcggcgaaatacaggccagcaaggagaccgggggttcatacctggtcgaggaagaggcagcagatccattaaatcccacgtcaattcacccgatacacaagacaacaactcccgttctccagcaaggagattcgaatttagtgtcagttgagcttccatctcggtctaagcaatttaggttttactcacgattattaagacatctcgtggcagaggtggatacaggaatgttttctccggaggacgaaagtgcgatctcaatgtactcgtctgctgtcctgactcgattgagtgcaatacagctgacaaaaaacaccgaacagaaacctggagactcgcaggaaccaggaattatgtctacagggaatgtcaatgcctctgtatccaaaggcctcgacagcaagacgagcaataccttttccaatgcttaccagaccggcagttcaaactgtgaaggcgaagggaatatcttcaccaaatgtgagaatccacttgttccaagactttcatgtggacagactgcctccaataactatctagcataccatagttcttcgttcaagcccaggctagaagaaggccttgttctatccccccagtctctacaactcgttcccacgaagaagagcttctaccaaggccaagttaggaatgcacatgccatggtgaaagatactcgacctaccaaactttcggcgtttcagcgtcttcccggcgagctacgttggagaatctacgacctcgtgtttgacgttcaccgagtcgaagtcctccgtttgcgggacaagaacccagaaaataacattaagagagtccattaccgcctctaccatcgtcagctgcgacctcgagatccaagaacacatgttgcaccctcaaatgaaggacgctttacttgtgctcccctccccatcgcgcttctgatcacatgtcgcagcatctatcgtgatacgctgtgcctgttctactccaggatgcagttcatattcaacacgactcgtaccgtaatgcgctttctgaagatcaccagcaaggaagctcaaatggcgatccagcacatcgagctgaaccataccatgtacagcgagcctgcactgctaaatttccggtggtacaagtgcatgagcgacatgtcgtggtacaatgcctgcgatgacctgactgtctactgcaaatcgctgcgtgtccttcatatcagtatgaatattcgggactggcccatcagtcttcaagtgggtgagcggtggtccttgccgctgcttgcctttgcgcgctatggaccaagactagactgggtagatattcgacctcagatgtttttccaaaagacggaagaacagtaccttgaa

SEQ ID NO: 8963 - DNA, 1545 bp, A.fumigatus
cgcaccagagaaaagttcgcgaacaacaacccacgcagtgcccacgcacagaatgcattctatcagactctgctccgtgcgaacatgccagctattattgtcgaacgatatcgcagcggtcaatttgcgagtaatgcgctgtctgaagctatttatctgaaagcgttgcaacgtgtcggtggcgccgattccgcaacggcagcacccgtccaaagtcagaaccagcatctcacccccgaccagctgcaggccgttggtcaagccgtcgccgctcggaatcacggtagtcagatcggactggcgacgaagcaatccggtactggtgctaaggataatcctctgcatgtggttgtcgaagagtcgctgggcagctctgtctttcgatgggtcaaatttctgctcgttttcggcttcttcacttacatctctcttgtcgtgatcaccattcttgtcgaaacaaccggtgtcttgaagaatatcaagggtccacagagcaatgaggctcaaccccaacagcaaacggttcggttctccgatgtacatggttgcgacgaggccaaggaagagctccaggaacttgtcgaattcctgctgaatccggagcgattctcttccctcggtggcaaattaccaaagggtgtgcttcttgtgggacctcctggtacaggaaagaccttgcttgcccgtgctgtcgctggagaagctggtgttccattcttctacatgtctggttccgaattcgatgaggtgtatgtgggtgtcggcgccaagcgtgttcgtgaactttttgcacaagcccggagcaagtcgcccgccatcatcttcattgacgaattagacgccattggtgccaagcggaatgagagagatgcagcttatgtgaagcagactctgaaccagctgcttacggagcttgacggattctcgcagaccagtggagtcatcatcatcgccgcaaccaatttccctcagctgcttgacaaggctttgacacgacctggcagattcgatcgcaaggtggtcgtcgaccttccggatgtccggggtcggatggacatattgaagcatcacctgaagaacattaagatcagtacagatgtcgacgttgcagtgcttgcacgcggcactcctggcttttctggtgccgatctggagaatctggtcaaccaggccgccatttacgctagcagaaacaagaagcctaaggttggacccaaggacctcgactgggccaaagacaagatcatgatgggcgcagaggctcgcagcaggattattcaagataaggacaagcttttgactgcctaccatgaggcaggtcatgcgctcgttgcttatttctctccttcgtctacgccattgtacaaaatcaccatcgttccccgcggaatggcgctgggagtgacgcactttttgcctgagatggacatggtttcccggaattacacggagtatctgtccgatatcgacgtctccatgggccgaaaaagcaacgaagagctggtttcgggcctgacaggttacaagtgggattttcggcggtaa

SEQ ID NO: 8964 - DNA, 198 bp, A.fumigatus
ttgctgcggcctagtgccgctctgactcgagacaactatggctttccaagtcccggtctcaagaccggtaagggtcctcatatttcttgcgcctcctatgccatctattctgactttcccttctccacagaatcttgcggccgtcacttccgatctctggccatcgatgtcaaagctattaaatgcgccctgggctag

SEQ ID NO: 8965 - DNA, 738 bp, A.fumigatus
caagactttgaaagtctgagaatagacttaccgccgaaaatcccacttgtaacctgtcaggcccgaaaccagctcttcgttgctttttcggcccatggagacgtcgatatcggacagatactccgtgtaattccgggaaaccatgtccatctcaggcaaaaagtgcgtcactcccagcgccattccgcggggaacgatggtgattttgtacaatggcgtagacgaaggagagaaataagcaacgagcgcatgacctgcctcatggtaggcagtcaaaagcttgtccttatcttgaataatcctgctgcgagcctctgcgcccatcatgatcttgtctttggcccagtcgaggtccttgggtccaaccttaggcttcttgtttctgctagcgtaaatggcggcctggttgaccagattctccagatcggcaccagaaaagccaggagtgccgcgtgcaagcactgcaacgtcgacatctgtactgatcttaatgttcttcaggtgatgcttcaatatgtccatccgaccccggacatccggaaggtcgacgaccaccttgcgatcgaatctgccaggtcgtgtcaaagccttgtcaagcagctgagggaaattggttgcggcgatgatgatgactccactggtctgcgagaatccgtcaagctccgtaagcagctggttcagagtctgcttcacataagctgcatctctctcattccgcttggcaccaatggcgtctaa

SEQ ID NO: 8966 - DNA, 1248 bp, A.fumigatus
ttggctgactctttcaagaacttttacatgtacttcacagagaagcggcacgatacgaacggcatcccaagagacccagttggaagctggcccagtcaggattggcgcatgaaggatcgtttgaagacagtttcggctgccctcgccatctgcttgaacatcggtgtcgaccctcctgacgtggtgaagacgaacccatcagccaagttggaatgctgggtggatcctacatcgaccacgggcggtggccagaacaagataatggagcagattggaaagaagttgcaggagcagtacgaaactctcagcttaagaactagatacaagcagtatcttgacccttcagttgatgagacgaaaaagttctgcatttctctgcgccgtaacgctaaggatgagagggttctctttcactacaacggtcacggtgttccgttgcctacacaatcgggagaaatctgggtgtttaacaagaactatacccagtacattccagttagtttgtatgatttgcaatcctggctcgctggtcccagtctcttcgtttttgatgtttcccacgcagggaacatcgtgcagaatttccacatttttgtggagaagcacgaaaaggagaaccttgaagccaaaaagcgtgatccaaatgccgtggttcagaactacggggattgcatccttctggcagcttgtcagaagaacgagtcactacctaccaatcccgacctccccgcagaccttttcacctgctgcctgaccacaccgatagagatagcactgcgctacttcattctccagaatcccctccagacaaatctctcaattgacgaattcagagtccctggtcgtttgcaggaccgcagaagccctctcggcgagttgaactggatcttcaccgcaatcactgacaccattgcatggaacacattgccacgggcattgttcaagaagcttttccgacaagatttgatggtggctgcacttttcaggaactttcttctcagcgagcgcatcatgcgcacgtacaagtgtcacccgatatcctcacccgaactcccagagactcatcatcatccgctttggaaaagctgggatcttgctgttgagatggtgctatctcagctaccagctctcattgaccatgaagaaggccgcagacaatacgagtaccaacattccacttttttcgcggaacaactcactgcttttgaggtctacctcaaaagttttcaccagccgcagaaaacaaca

SEQ ID NO: 8967 - DNA, 417 bp, A.fumigatus
  unsure (207): Identity of nucleotide sequences at the above locations are unknown.
acatttctcgaactcattgctagtccatcattttcgcgaactgtagcaccgattttgatctccgtcgggatatggaagtctttcaccatccgcttgatcacgactgtttgttggacgtctttctgcccaaagtatgcgcggtcggcgcagacaatattgaagagcttcatgcaaactgtggcaactccgcgaaagaagacgggacgngaagcaccttcgagcttctttgaaatgggcgtgattgtgacaaacgagccgtcaccgtttacctcggatgatggcggcaatgtaggatacatgaccttagatgtaggcgctaggatagccgtgacacgaccatacttctcaccctggcgagacaattcttcgttcaattgttcaattttcgccacgtcactgtcccatgtacgagggtag

SEQ ID NO: 8968 - DNA, 558 bp, A.fumigatus
ctccgattgacgatgccggtggaaaaggcgcccatggaggcccccgacctggagatagttggtgataaggtaacaattcatccaagtggatacactgggggacctcaggatggcccaattacggagcgcaacctcgtttctcatatggcgcgctttcgtgagaatccttttgacttcttgcgggaagttagtctctacatgtcgggaacagggtggcgcgcatacaacgatgtgatcggacagcctatattttaccccgggttctcggaacgaatcaagtccagcatccttgccagtccaattctgcaagcgaaggtcaaggaattagcagaaatgcgccttgcggtggaggaaaaggaagggcttctacagatgggccagggccccgtatcgaagaagaaaaagcagcgccgggctgagattgagagcaatttgaaggaggttgttgacacaatgatggacaacatgatcttgcagatggagagtaagacattcatccggggggcatattatctttgcacccaacttcttacacgggccctatcatcagggttaaag

SEQ ID NO: 8969 - DNA, 396 bp, A.fumigatus
gttcgagaaatgtttacctgggggtccagacgacgtgccgttggtcttgttctctacaacgccttgaaagcagctgaagacgcatacctgtctggcaaaaataaccgcaacgaaattttggatgccgccaatcgcatgacgcagaaggtactcggcgagcagcaggctttgaagcccacagaaagggcactttacgaggttgattatatctcccttgcggatcctgacactttggatgaattggaggttgttgatccctcgagaggtgccatcttgagtggtgcaatcaaaatggctcctctagaggtgtcaaatcccggtgaagattgcggacttggtgatgggaaggtacctgttcggctgattgacaatctgatcttgacgccccgggtttga

SEQ ID NO: 8970 - DNA, 783 bp, A.fumigatus
  unsure (513): Identity of nucleotide sequences at the above locations are unknown.
ccggagaagcgtgatgcactttctgacttttgcttgtctttgatagctacaacatcgttgttcaattccacaatggcttctcgccagcactcgttcgaggtgttccgcgatgtagcccccctccggaagatgcgccgacaactgctgctgtcgaacaggactgtaggcctcgttcccacaatgggagctctgcacgaaggtcatctctcgttgatgcgacaggcagcagcggataacaccgacgtctttgtcagtatctacgttaacccaactcaattcggagtcaatgaagatctagccagctaccctcgtacatgggacagtgacgtggcgaaaattgaacaattgaacgaagaattgtctcgccagggtgagaagtatggtcgtgtcacggctatcctagcgcctacatctaaggtcatgtatcctacattgccgccatcatccgaggtaaacggtgacggctcgtttgtcacaatcacgcccatttcaaagaagctcgaaggtgcttcncgtcccgtcttctttcgcggagttgccacagtttgcatgaagctcttcaatattgtctgcgccgaccgcgcatactttgggcagaaagacgtccaacaaacagtcgtgatcaagcggatggtgaaagacttccatatcccgacggagatcaaaatcggtgctacagttcgcgaaaatgatggactagcaatgagttcgagaaatgtttacctgggggtccagacgacgtgccgttggtcttgttctctacaacgccttgaaagcagctga

SEQ ID NO: 8971 - DNA, 627 bp, A.fumigatus
caagcggctgtgcattccagcccaacaaatttcctcatggcggacgacggcttacttttgaacttctccctcggtgataacaatatcatccaacgggaaacgaagctcaagggcggaacatggcgggaccggctcagcgcaaagaaaatcgccaagcaccatgccaaaggccccaggacagccggcgatgaagacagcgcacctagagccccgcgcaatcccaatagaatcgaagtaccatcgtcgcggccgaccaagagacagaggacggacggaggcgatagcggaaagcaacagtcgcacgggcatccgcattccaatcaaccccgccaattcatttcgtcgctgttcacgaaaaatccggaaccgcagaaagctgaagaagtgaaggaagaagggcacgtcgagaacgctaaaccgacaaacgcgccgctcatcgatggactagacacatttacaaatctagggctgtcgccgaatctggccgcgcatcttcttacgaagctggagctgaaggctccaacagctattcagaaggcgtctatttcacaacttctgaaggaagagggcgatgcttttatccaagcggagactgggtcttcaccgggggctgaaagagcgtcagta

SEQ ID NO: 8972 - DNA, 867 bp, A.fumigatus
  unsure (839): Identity of nucleotide sequences at the above locations are unknown.
gatggagtttcgattttcattctattgtcaatggagcattgcttggacccagagccaaaaatgagtgacaccgagatagagggcggccttgatctccagcaaacacggtcgggctggtccatcgccgaaagcctctccccggtacgggaaacggtcttcatcttcgtgatatgcatggcccaattcatgacccaggccgggctgggtagccaactggccccgctgaccatcatcgggaactccttccacatcaccgacaacggcatcctcagctggttcgtcgcgggctactccctgacagtgggcaccttcatcctcttcttcggccgctgcggcgactgcttcggctaccacaccatgttcgtgatcggctttgtctggttcggcatctggtccatggtcgccggcgtcagcgtctacagcaactccgtgctgttcatcttcgcgcgcaccgcgcagggcctcggacccgcgatgctcctcccgaacgggctggcgattctgggagcgacgtaccggcccggcccgaagaaggacatgatctttgccatcttcggcgcaacggcccccaacggcgccatcatcggggccgtcttcgccgcgctcttcagccagctcgcctggtggccgtggacgttctgggcgactgcgattgtctgcctagtcctggcggcgctgggatgggccgtgatcccgcgcatccaccacgagcgcgagaagcacgggcatgactctgtcgaatggatgcaggagcttgacatcgtgggggcgtgtctggggtgggggggcttgatcttcgtgacgtggccgggaaccaggcgcccattgtcggctggccnacggcgtaagtgtacctgcctgttataa

SEQ ID NO: 8973 - DNA, 516 bp, A.fumigatus
tggctttcaacatccgacgccacctactcatcccgctcctcctcctccaccacctcattatcctggcggtgcgcctccacctccgcaccagccgtacacggttcatcagagcccatatgcgccagtgtccatgccatcacctcatccgtcccatacaccgggccctctaccgtacgcatcctcagcgtcacctccaacggcacaagcgactatcgtccgccactctcctcaacactctctcagcgctttgaacggaggcccgcctccgcgaatgtatcctgtggatcgcatcctcagtgccccgacacaatcgcccccagtgtcgcagtcgcgtatggatccccgggggccgtcgcctcctggcaagacggaagacacgtctctcagtgccgccggaggagcgatgagcactggcaggagttcgggagtcaatggaacgcacgggggatctggggcgagcgccagtccatcgttaaaaaatctactttcgtaacatggggtatcaggctacggtga

SEQ ID NO: 8974 - DNA, 894 bp, A.fumigatus
agacagaatctaccccagcatgctctgcccaagttgaacggcgattacggctcggtcgcggaggggccactctacgaatgccacaaatgctatctgaaaaatgctgcagctcagccatctccggagcctcgaccgtctccctactcagcgcagcggccagtgctgcccgccccgcggatccccgaatatcatgggcatccttatggaccccacgcgcatccgactccccctccgaccaatgctctcccgaggccgcttaatggccctcttgctcatgggactgaatggtatccggcccatgaacagcggccgactgagcttgccgatggtaagctgcgcaacggcttaccagttccggcataccacggaggaccaccccccgtccagactcatccccttaatggctttcaacatccgacgccacctactcatcccgctcctcctcctccaccacctcattatcctggcggtgcgcctccacctccgcaccagccgtacacggttcatcagagcccatatgcgccagtgtccatgccatcacctcatccgtcccatacaccgggccctctaccgtacgcatcctcagcgtcacctccaacggcacaagcgactatcgtccgccactctcctcaacactctctcagcgctttgaacggaggcccgcctccgcgaatgtatcctgtggatcgcatcctcagtgccccgacacaatcgcccccagtgtcgcagtcgcgtatggatccccgggggccgtcgcctcctggcaagacggaagacacgtctctcagtgccgccggaggagcgatgagcactggcaggagttcgggagtcaatggaacgcacgggggatctggggcgagcgccagtccatcgttaaaaaatctactttcgtaa

SEQ ID NO: 8975 - DNA, 582 bp, A.fumigatus
tgggccatgccattacggatcacatctgctccggtatctggtattcaaaagaaaaagagacccgccacctttaaacctcgtgcctccccttttgccggacatgctcgccagaaagccgccgttcaatcctcccatccttccaagtccgatcagctagatgagctgtacacgggtgacttcgatcagggcccacttcctgaccttgggagttctcattatgtgtcacagatcgccgccgtcgaggatgtgattcaggccatccattacattcgtgacaggatgttcgaggatatccctgctcgcgctggcatgaatagtactcgcattgctgaagtacttaatcttcgccggtcgctaccccctctagcctcagtggctcatgttcacactctgatggatgcccctacgaaagtggagaaagagattgtggacctgatcactgccggtcgtgttcgtcgcttgatcgttccaggaagagggactgatgcggcggggcttggcgattgcctagttctaacagaggactgggaaaggctggtgcgggaaagcagtgtcttggaggcctcagttaagggtaagtga

SEQ ID NO: 8976 - DNA, 231 bp, A.fumigatus
taccgtgactgggtgtggaatgcctttgaaaatatcaacaagtactgccgcaccgagtccggattcgctgggttgaccaacgtcaacgcggtaaatggaggaggtcggtatgacaaccaggagagtttcctgtttgccgaggtgatgaagtacgcgtacttgacgcatgcaccaggtatgagctcaatgccagctgcggcggaggataaagctaacaagagcagaggatga

SEQ ID NO: 8977 - DNA, 600 bp, A.fumigatus
attgaaaaaatttttttcgcatgtttcatagacaggatgggctctactaaacctcgcacctccgcacaagcctccgctccaaaagtccagtcgttaccggagaagacattcattatcgacaatggcgcatacaccttgaaagctggatacgcacccgggtttccacctcccgaagatttaggccaggctctttcagcctgcagcacaatcccgaatgccattgccaaaacacgcgggaaccgtatctacattggtgcacaactcaactcacaagttaccgactggaacgagatggttttcaggcgtccagtggagaaaggatacattgtcaactgggaagcacagaaggaaatatgggacaacgcatttttcgacgagaagacggtgaggtcgaaagatcttcggattgaatctccagaagatacaacgctcgtgctcaccgaggcgccgaacgctctgccgaccctacaaaagaatgctgatgaaattgtgatggaagaatggggctttggcggctatgtgagatttgtaggtaagatagccggattccctcactgtcttacctggttattgatgctgacttcgcaggaactgtgctga

SEQ ID NO: 8978 - DNA, 765 bp, A.fumigatus
gatagccggattccctcactgtcttacctggttattgatgctgacttcgcaggaactgtgctgaatgcttggaatgaagttcagtccttgttcggagaccctattgggcaagactcttcgtctccgatctcgccgaagcaatgcttacttgtcgtcgactccggctactctcatacaacagtaacaccagtttacaaagggcaacccatccagcgcgccattcggagacttgacattggtggcaaacatctaacgaattacctgaaagagatggtgtctatgaggcagtacaacatggtcgatgaaacttacatcatgaacgaggttaaggaggctgtctgtttcgtaagcaacaactttgctggtgacttggaacagacatggcagggcaaccgaaaacggggcttgacggacgcagccgaagggatcacagttgattatgtgctacctgatcctaacacaggcaagaagggcttcatgcgaccgcatgatcctctttcgaatgcgaagaagaggaagagtattctctctggcggcaatgctgaggctctgtccgaagacgtgctgattctggggaatgaacgctttactgtgccagaaatactgttcacaccaagtgatataggtatgaagcaagccggtattccagatatcattctgcagagtctttcagttctgcctaccggtctacatccgtcgttcctagcgaatgttctggttgttggagggaataccttgattccgggttttttggaacgattgtaa

SEQ ID NO: 8979 - DNA, 183 bp, A.fumigatus
gtcctgatcgagtataatatcagcgcgggaggatcccagcaagaattcgaatccactaccacttaccacatgcttcagatgagaaaaccgctgcgtcagcataactcccagcgcactgtaacttggatgcaatatcttaccgacaattccacccagagcacaactcagaaagtatttcgatga

SEQ ID NO: 8980 - DNA, 708 bp, A.fumigatus
tattatactcgatcaggacctacgcatacagcagttacacccctcgacctggtcaaatgtcgtcgccaggtagatcccagcatctacacgtccaatctctctgcatggcgccagatcttctccaaggaaggcctacgcggcgtgttcttcggttggtcgcctaccttcatcggatactcgttccagggcgcaggcaaatacgggctctacgagtatttcaagtacctgtatggggaccatttgttccccagcataaaccgcacggtggtgttcctaggcgcgagcgcatcagccgagttcttcgccgacatggccctctgcccgttcgaagcgatcaaggtgcgcatgcagaccaccctgccgccgtatgcgcataacctgcgcgagggatggagtaaagtcgtagctaaagaagggttcgggggtctgtacaaagggctgtacccgctctgggcgcgacagatcccctacaccatgaccaagtttgctacctttgaggagagcgtgaacatgatctaccggacgctgggaaagcccaaggagagcttcaacgcgctgcagcagacgggcgtcagtttcctgggaggctacattgccggtgtattttgcgctgtcgtcagtcatcctgccgatgtcatggtcagcaagttgaatgccgatcggaatggttcgtgtgcgtttctcggaagccgtctgtcgttctgctaa

SEQ ID NO: 8981 - DNA, 195 bp, A.fumigatus
atgccgatcggaatggttcgtgtgcgtttctcggaagccgtctgtcgttctgctaacaggcttgcagctggcgagtcggcaatggcggccgtgtcgcgaatttacggcaagatcggattctctggtctgtggaacggcctgccggttcggatcgtgatgcttggtacattgaccggcttccaatggctcatgtaa

SEQ ID NO: 8982 - DNA, 579 bp, A.fumigatus
gaagtgatgccatctcctcgtgtgaggacttttaccctattcattctcaatgcttcctggcagacatcaatccaccggactcgagcgtgcacggcttcattctcaacgacgacgtcagccctatatgcggccagtcgcgaaccaacattatacgagatactcgatgtgccagtaaccgcgtcagcagcagagattaaaaagtacgataattggcctcgtccaacactccgtccctcaccccctcatctaccatatttttctactctctgcaccgctaacgtaacccgcatcatcagaaaattctactccctctccctccatcaccacccagaccgcattccaggcgacccgaaagcctcctcccgctttgcccgcatctcatcggcctaccacgtcctcagcaacagcgccaagcgctccgcctacgatcgcgaacacggcatctatgcccaacatggctcctcgacgcacagcaacgcaaaccccagccaacacccgatgggtagccacagcaacttccgggcaaatcttcataccaagggcgccttttatgcgggatccagaaacgccaagggccta

SEQ ID NO: 8983 - DNA, 930 bp, A.fumigatus
tcccgcctcatccgatgcgctgtctacaactctgtcaagtcggcttatactaatgaaacgtatttcttcgctacagtgaacggcctgaatggtgacgccaaagcaaatgccactgttatcggtcagacagaagctggtgaggcagaagatgactcggacgacgagaaggaagatggaaatactgctccggaggccggtgcaggcggaggtgcgtacctacacgtctgggtcatatttgacatgcctgtcagtcaggccttgggaatgcttgcttacaattcccggattccagctgcaaagaaaaagaagcgcaagtccaagaagaagaagaagggaggcgccaaggttcagagttctcccccgcgtgtcccagtatcgaatcttttccccaacaatcaatatcccgagggcgaaatcgttgaatataagaatgagaactcctatcgcacaaccaacgaggagaagcgttatctggatcgcatgaacaacaacttcttgcaggagtaccgccaagctgccgaggtgcatcgtcaggtccgccagtatgcgcaaaagacgatcaagcccggccagaccttgacagaaattgccgagggtattgaggatgcagtgcgtgctctgactggtcaccagggacttgaggaaggtgataacctcaagggtggtatgggtttcccttgcggtttgagcattaatcattgtgcggctcattacactcccaatgctggcaataagatggtgttgcagcaaggggatgtgatgaaggtcgactttggtgctcatatcaacggccgcattgttgacagtgcctttactatgacttttgatcctgtctacgaccctctgctggaagccgtcaaggatgctaccaacaccggtattcgggttcgtcaatccccaagcttcaagctatcgaggatttcatactga

SEQ ID NO: 8984 - DNA, 201 bp, A.fumigatus
gccaggagaaatatctccttggagtacgtcaatactctgccggttccggtgcaatctcctctcttctacagtactgacctatctctccagttaaataaccttgtttcgtcgggtatcgtacaggattatcctccactctgtgatgtcaaaggttcatacaccgcccaattcgaacatgtatgggaaagacttacaccctga

SEQ ID NO: 8985 - DNA, 585 bp, A.fumigatus
cttttgatcctgtctacgaccctctgctggaagccgtcaaggatgctaccaacaccggtattcgggttcgtcaatccccaagcttcaagctatcgaggatttcatactgacgattcactgcaggaagccggtatcgatgtgcgtatgagcgacattggtgcagccatccaggaggccatggatagttatgaagtcgagctcaacggcacgatgtaccctgtgaagtgcatccggaacctgaacggtcacaatatcgatcggcacattatccacggcggcaagagtgtgcccattgtgaagggcagtgaccaaaccaagatggaggagggtgaaaccttcgccatcgagaccttcggtagtactgggaagggttacgtgagagaagacgtaagtgctctcaggaagacgccgttgcttgcgttcggaatatgcttaccccatattttttctgcagatggaaacgtcccactatgccctgatccccgatgcgccttcggtccctctcagactctcttctgcgaagaacttgctcaatgtcatcaacaagaatttcggcacactgcccttctgccgtcggtatcttga

SEQ ID NO: 8986 - DNA, 279 bp, A.fumigatus
gtgctctcaggaagacgccgttgcttgcgttcggaatatgcttaccccatattttttctgcagatggaaacgtcccactatgccctgatccccgatgcgccttcggtccctctcagactctcttctgcgaagaacttgctcaatgtcatcaacaagaatttcggcacactgcccttctgccgtcggtatcttgaccgactaggccaggagaaatatctccttggagtacgtcaatactctgccggttccggtgcaatctcctctcttctacagtactga

SEQ ID NO: 8987 - DNA, 228 bp, A.fumigatus
gtagcatttccctccaagctatgctacccaactcattttatataccaggctatctcagccaaagatgctgcttccctcgataaggacttgatggagatgggtggatggtccttggaccaattgatggaactcgcggggctgtccgtttcgcaggcaggcatgtggtcaagtcatggagcattacaagcacaaaataagaataaccagaggctaacacacttgcgatag

SEQ ID NO: 8988 - DNA, 450 bp, A.fumigatus
ttatctggcaaccaacagcgcctcaaaacccagctacacaacctatccgtccctttcgttccagacttcactgaggctctcaaatccgctgacttcctcgtcgacgccatcttcgggttctccttcgggggtcccctccgggaaccgttcccatccatcatctctcagatcgagtcgtcgtccgtcccggtgctgagcgtcgatgcacccagttcttgggacattcagagtggtccacccaaggagggtccgggatccaaatttatgcccaaggcgctgatcagtctcacggccccaaagccatgcgtgaaatattaccgcggcaggcactttgtcggtggccgtttcttgaccaagagtatcgttgagaagtacggattgaattgtcctgattatcccggcatcgaccagattgtggaagttggcgttgatgctgaagggcggctataa

SEQ ID NO: 8989 - DNA, 303 bp, A.fumigatus
aggtcggctcgagactcgaaaccccttgaagtcattggcacctacaatcctatcccgcagcggcctacgaatctatccgaagaggaagctcggcgcgcaaagccattcaaagaggtctctcttgatcgctcacgggcaaagtactggcttggtgttggcgcacagcccagcgaaagtgtatggcgtttattgaatttggtacgtggtgggcaagcttcagaaaatcgaagctctttgctgactgggacatccatgttaggctggtcttgttcaacccaagtcctaatggccccaaaagaatga

SEQ ID NO: 8990 - DNA, 294 bp, A.fumigatus
acttctgttagtagtgcatcaaataaagtgcagtgctttgattcagcgttgcttgctggttacgaaggtcaacgattcagaatagtaaaaatggttgtcagaatacgtctttctcgcttcggcaataggcaccagccattttacaacattgttgttgcacatgctcggtatgcctctttccttttggtgcttcaatttttcttttctcttgaattgttctactgcctgccatcagcatctagattgagattgacggacaatcgccaacccagtgactgtttagaaaagtgctaa

SEQ ID NO: 8991 - DNA, 468 bp, A.fumigatus
acggtccatctacctacgccgagagggattactgcgcatattgcagaccgtgcagacagtgcagacagtgcatcttcagaagagccaacccgggattgcaatgcccaaccgcctaggaatcgggtctatgtccctgggccggccaggaatccacgacctgcccaccaagctccatcaggcttcccggcacggctacgaaggcatcgagctcttcttcgacgatctcgactgcctggcccattccagcttcaacggctgccacctcgccgccgcgcacgaggtccgccggctgtgcgattccctcggcctctccatcatctgcctgcagcccttcctcttcttcgagggtctcctcgaccgcacgcaaaccgagcacctcctcaccgaaaagctccccaaatggttccagatcgcccacatcctcaacaccgacctcatccagatcccctccaatttcctcccgtctga

SEQ ID NO: 8992 - DNA, 792 bp, A.fumigatus
ctgttgacattctctgaacggtccatctacctacgccgagagggattactgcgcatattgcagaccgtgcagacagtgcagacagtgcatcttcagaagagccaacccgggattgcaatgcccaaccgcctaggaatcgggtctatgtccctgggccggccaggaatccacgacctgcccaccaagctccatcaggcttcccggcacggctacgaaggcatcgagctcttcttcgacgatctcgactgcctggcccattccagcttcaacggctgccacctcgccgccgcgcacgaggtccgccggctgtgcgattccctcggcctctccatcatctgcctgcagcccttcctcttcttcgagggtctcctcgaccgcacgcaaaccgagcacctcctcaccgaaaagctccccaaatggttccagatcgcccacatcctcaacaccgacctcatccagatcccctccaatttcctcccgtctgacccaaccaccggcgcaccccgcactaccggcgacttggatgtcatcgtctccgacctccagcgcatcgcagacctcggcgccgcccaaagcccgcctttccgcttcgtctacgaggccctcgcatggggcacccacgtctccacctgggagcaagcctgggccgcggtgtcgcgcgccaaccgccccaacctcggcctctgcctcgacacattcaacctcgcgggccgggtgtacgcggacccagcagcaccctccggcaaaacaccccacgcagaggcggatctcgccgcctcgctgcagcgtctc

SEQ ID NO: 8993 - DNA, 657 bp, A.fumigatus
gaatcgggtctatgtccctgggccggccaggaatccacgacctgcccaccaagctccatcaggcttcccggcacggctacgaaggcatcgagctcttcttcgacgatctcgactgcctggcccattccagcttcaacggctgccacctcgccgccgcgcacgaggtccgccggctgtgcgattccctcggcctctccatcatctgcctgcagcccttcctcttcttcgagggtctcctcgaccgcacgcaaaccgagcacctcctcaccgaaaagctccccaaatggttccagatcgcccacatcctcaacaccgacctcatccagatcccctccaatttcctcccgtctgacccaaccaccggcgcaccccgcactaccggcgacttggatgtcatcgtctccgacctccagcgcatcgcagacctcggcgccgcccaaagcccgcctttccgcttcgtctacgaggccctcgcatggggcacccacgtctccacctgggagcaagcctgggccgcggtgtcgcgcgccaaccgccccaacctcggcctctgcctcgacacattcaacctcgcgggccgggtgtacgcggacccagcagcaccctccggcaaaacaccccacgcagaggcggatctcgccgcctcgctgcagcgtc

SEQ ID NO: 8994 - DNA, 588 bp, A.fumigatus
gaattcttggaatatcatgcccctccgaatcatcatcgttggcgccggcctcatcggccctcgccacgcccaatccgtcctctccaacccatccaccgagctggtggccctcgtcgacccagccagcagcggggcccgcgtcgcctcacagctgcagacagaacacttcccctctgttcccgccatgctggcggcaatccccaaacccgacgccgccatcatctgcaccccaaaccactcccacgtccctatcgcaacagagctgctctcccacggcatccacttcctcaccgagaaacccctcagcgacagcgtctaatcggcccagtcgttgctagccttcgcccgccgccccgaaaacgcccacctgactgtcctggttggccaccaccgccgcttcaacccctatgttcgggcagcccaggagattctgggatactaactccctcggggaccgtaatccgcagtccacggccctctggaccctcctataagccgggaggcctattttcccgccctcgaacggactggggttcttgttccgtccctccggggggggtgaatccccctttaaccttcctcccatga

SEQ ID NO: 8995 - DNA, 339 bp, A.fumigatus
ggaaatagtgaaaaacgtgagaattcttggaatatcatgcccctccgaatcatcatcgttggcgccggcctcatcggccctcgccacgcccaatccgtcctctccaacccatccaccgagctggtggccctcgtcgacccagccagcagcggggcccgcgtcgcctcacagctgcagacagaacacttcccctctgttcccgccatgctggcggcaatccccaaacccgacgccgccatcatctgcaccccaaaccactcccacgtccctatcgcaacagagctgctctcccacggcatccacttcctcaccgagaaacccctcagcgacagcgtctaa

SEQ ID NO: 8996 - DNA, 762 bp, A.fumigatus
gctctggccttgtggatagcacactctacaatggtatgcagacccatcatcacccgtaccctacaaactaacgattgtgcagcctacaacacgttcgtctcgatgcaaacgggtgaagtcaatcgaaacatatcacgaacgaacgacgctcatcgtcaaggaaacaccatttttgtcggcctgggcgcgtcaaaccagaatcttaagccatacggctgggcgcggtctctcacctcgatcggatgcttcgtcatcggctgctttctcttcgcccgactgaaccgtcttctcggaccgagacgcagagtaacactagtcctctctttccttctacaggtcgctatgctggtaatcactgcgtccttggtacaaagcggcgtgatcgctggaatcccctcgaaccctgcttcgagcgagacacattggagccaggaagcgcctatcgtgcttttgagtatccagtctgcaggtcagatcgtcgctagtcgggcgttggggttcaacgagatccctactgtggtcattaccagtcttctctgtgatctcgtgtcggacccaaagctgtttctccttcgcaacgagaagcgggaccgacgaatggtagcgttcgttctgacactgatcggtgcaattgcgggaggatggatcaccaaggcgacacgcgatatctcgcctgtgctgtggatggctgctggactaaagttcataatttctgtttcctggatattctggagagagaacgagggggcaagtgcagtataa

SEQ ID NO: 8997 - DNA, 237 bp, A.fumigatus
cgaacaaaaagcgtttcggacaggctttcgagttggccgggatattttatttgtcgcgaggtgcatgaacccatggtcaagtacgggccggatatacactgctcgcatattgggccgacggggggtgactactgcgtggacgatctatcgtatgaacaggtggtgctggagaagtatttccgggactcgtttattgcgtatgggcatggtcaggagcagaatatctgggttgcataa

SEQ ID NO: 8998 - DNA, 468 bp, A.fumigatus
gtccgagattgtgttccgcaagatccagaacggccaacttgttactacccaaacatagttttacagcctccaggtagtttgtctggcagtacgatactgtattttcccctctttgagagctttactcctgctcggggtacactgggaatgaagcttttgattatgttgcttaagacctggatgatttacacggtccgaaatccaaaagcgccaaaaagcgccacctataacgcaaccaagagcttgaatgacgaccgccgctgggcaatagcacgtccagattgcagaccaacttcttcacgggctttttcttcctatgagtgcgtcgaatgcagacgcatggcattcgcttggcctgcggattgtatgctgtatcacgctagctacgataagggtgtcctgagccaggtcttctacggggaaggatcctcgtcttacaccgccgggatggaaagtcatcgctccgcc

SEQ ID NO: 8999 - DNA, 300 bp, A.fumigatus
cataattatcagattataatcttcgctaaactattcgagctggtcaatgagaagggtgacgatggcgccgagactgcatctctagtgccaagtggcttggctaagcgtcgccggagaatctgtgcatcagaaggcggctttggcttcggggttattcggtgcactcgcagaggccagagaccaccttggattgcaggtttgatagggcgtgcagctcacctaagcggttcttccaacaatgagtccgagattgtgttccgcaagatccagaacggccaacttgttactacccaaacatag

SEQ ID NO: 9000 - DNA, 537 bp, A.fumigatus
ggcgcggctccttccagccccgtggtgaagaccgtcattgaggagcaggccagagagcttcctcgtcttcctactaatcttgatgtctcagagcaggatcgcatcttaaacgcagttaatgaccgcttgtcccagtgtgcatttgactttgttgccaagtaccagttccccatccccttggaagcggacaaaagagaggtgagaattccctcggaccgcgaatggaccgagtgggtatatctcctgaaaaggctggccaccaagcgccgcatacctgcccgggttctttacaatggccaaattaaacaactagtgacagtattggaaaattccttggaaatgagacatgctgccaaacatcagtccagacccatcaaagatgatcgcaatgtgctccagctcatctcggccggcactcaggttgccaagatgcttaaagatgccagtgccatggaatatctggacaaactttatgttgataccgagaaacgcatccatgagcggcgcagccggcgcgtgaaattcgccagtccttga

SEQ ID NO: 9001 - DNA, 219 bp, A.fumigatus
gaatacaccctccacaacgagatcaccaacggcgcacacaaccgtcagaagcgatgccgtgaggctcaggcctctgtggccttcctgtggttcgcttgggctggatatatggcgtcgacgatcatctctatcttgatggctcgtagcgctactgtcgacttgcgcagccggaccggtcgtgcccctcgtgttgctcgccctagcatggctcaggtctaa

SEQ ID NO: 9002 - DNA, 306 bp, A.fumigatus
caagcgagtactatgcagttcgtcttctcactgcttgtcatggccttgatcggtaacatcatcgccatggcgttcgcaggcaaccccgccacgatcaactacagcatgttcactgccacattctctatcatatcgctgttctacctcgtccccgcctcgatcaaccttaactgggccattcaccccatcatcatgatcgtgctcgatgttctgaacaacatcttcttcctgacctgtgcgatcgcactggctgctcggctggaatgccactcctgctccaacgacgtaggtttgcgacgtttgtga

SEQ ID NO: 9003 - DNA, 798 bp, A.fumigatus
aggggtttgattagtagcaccaccgtcggaccttccagccccgtggtgaagaccctgaccgtcgacccggagaagcggtatagtatcaaggaattccttgctcatccgtggatccgtcagaccgatgaagctaccgaagcagctgacgatgcgccccctcttgccaccccgctcgctagtcgtcaaaccaagcaacagcccctggatgctcaagcagccgatcaggcaccctacgcgcctgtaagtgcgcggttactgggtccggcttccgccggtttagatcgccccatggatttccggtcccctggcgcgatcaacctgcgtgaggtgttcgatgtcggctacgcggtacatcggcaagaagaggaaggtaagcggcgcaagaatttccgacaaggatatcggggtgccaatccgaccaccgggttccagtcggctctgaaccccctgaacgaggacaacgacgatgatgaagaggatgacgtcacattacaacacgtgcagaacgacgcctacccgccggcgaagatccccaaagcctctcaggacgcgggagatgttgcagctatggaagccaaattacggtcaacgaacttgggagcccccagtcacgctgctcaagctaggcaggcgcctcagtctcggcagcagggctatggcacccatagtgcgaacgtcgtggcagccgccaagcagagtatcaaccggcactcgcggcaaccgttcgagctaagcctcagcaatgcgactttgttagaaaagcgaggcagacgacaacagggtcaagctgtcgtctaa

SEQ ID NO: 9004 - DNA, 2109 bp, A.fumigatus
ctcgatctggtgcacgtggttcggacgtgttcacacccggtttgttctcatcggccggcgcacggccaagcgttacatccccgtcgccgcaccgcggaccgtgtgacgcgccatatcgaagcttttgcggataggttggatcgcttcaatcaaaaaggtcgcactgacgatttgggaaattaccaagctgcatatcaattggtgaagagctaccaagttctcgctcaagatgcgatccaggatatcacgaagcagaataccttgaagcgcgcgaaaatgggctggagcacaagtcgaaccaacggcaccgcatcgcatgatcccaagatagaggaggaactgcaacggttacagctcgaggcaaatacttggcagcttcttctcaacctcatcagcattgatgatcccccaagcaaagccagctgcaagaaagcgcaagagactgttttccagaagctccatcggtactcgtctgatcgtgaagtctgggagagcttcctcagcgctgaccactacgcgctcgaatgcgtgattatcatgaagtggctggagcgcacggcgacgaccacgcctcaggatattgattcgctgatctccgagcttgaatcgcaggcggaacgaggacaggggcactggacacatggctggctctacacgaaggagacgatcaagggacagaagagacttcgtgcttggccacagcctctcgaacccaaagaccctggcatcacagcgtctctgttgacttccgacgtctcggagccattgattacgcaattagatccggatgctgtgactcggcagaagcagcacctccagaagcaggatcagttctatgagcgcgcgacttggatgacctgctggaagatgttgcgacagggagagaactggaccaagatccgggattgggctgaggaacgactggaaaactggaaggctgtcagtttatgtggctccagtgttgaccccgagtccgggggcgagcggacacctgctgatgatggaatgacgcgcatgatgaactttcgctctcaggagtcctggcgagcggcaggctctgctctggcgcggaatccccacattgaggactttgaacgggcggtctatgcgctactctgtggggagaccgaggccgcactcaaagtctgtcagagctgggatgactacctctacgtccacttcaacagcgtggtcctgtcacgctatcaagggttctgcaagcagttccggcgcaagctgagccactcgcctacggcgccggttaacttcgttcctgagcccgtcggatacagcgatttcaacaagtttgtgcagtacacgaagggcaacgaacgcattggagtggaggcgcgcaacccgtaccgcacgattcaagctgcgatactaggcaaaggatatgacacatttttctactcgctagccaaagcagtctcgcaagttgcgaagacgggttctgaagattcctttgtgccggatctgtccccaacccatgtggacgactcgcttctcatcgccgccgaggacgacgatgcactgcggattgcgacgcatctttacatcatcgccagctccattggctacgtccgttctgacacccaattctttgagacggcatctgtaaatgttatcggttacatcgcaaatctcgaggatgctggcatctacgaggcgataccgctctatgcgtccctcctgcctgctccgcagacccactccgtacttggccgcgtgctgatcgagatccttgacccgagagagcggaaacagcaggttcgattgatcgagaaatacgatataaatatcgaggccgtcttggaagaccagtggaattggatcagtagcactgtctctgcagttgagcacacaaggacagtgaagcgctatcccaaagtcgtccgcagagacgatggaacccgcgagttggtaccagtcaagacagactttatcggaaccgagatctctcgttcagacgagcggttgattcgcagtctcgagtggctccgatatgttgatgggcaatggggcaggatatgccaccttggcgcttttctgtatagaaaattttattgtgagtcgccccttttttgctggctacggcaagaatactaa

SEQ ID NO: 9005 - DNA, 213 bp, A.fumigatus
ataaggtacctcttaatatgtttaagaattctgttccgttatatatgtaccagctatcgaatgagccagcaattgggacataatatgctctatgctgtcgctgaaaatacattaaaagctatggtgagagatcctgcccccagagtcaaaaccatccaaatgtcccatattcctaagcgggtatccaaagacctgcgccgagtcccattgtga

SEQ ID NO: 9006 - DNA, 186 bp, A.fumigatus
cagtatcggtccctcttctcccccaatttcgcctgctccttccaatcaatcttcgcctcgaatttcatctacgacacctcctccctatcctcgcagcaggcctatctccccggtacaacttgcgtcgccgacagaacaaccgtctcctcccttctcgccgattgtgtcaccatcaggttcccatag

SEQ ID NO: 9007 - DNA, 1173 bp, A.fumigatus
  unsure (26): Identity of nucleotide sequences at the above locations are unknown.
gaccatctgaacctggacctggactntccattcgacgacgacggagctactgcgcgtgctatccaacaacaacgccgagaggaagccaatcaacgggagtttcgagcctggcagcgccggttcgaggttgctgagcggcaaggcggcagcaaccggtttcgggacactgctgctctccttgatatcgaggcgccacgaccatcacgacctcgggtcccaagagaacctacccctgaaccggaatctcttgaagagatgagggcttggaatgccttagaacgagctcgcgagatagagaacaaccccagtgcagcaagaaagcgcaaggaaccaacactatccccttcgccagaacctactgagccggagcggaagctcaaacgtcctcggacccgtaggccgcaagagctagcggccctagctctccaaaacggcgagtcctctagagcagctgctcaggcttctgctcgaatcaatgaaggttccagcgagcccagcttccttcagtctcttctgaaagaagtagaagaggcatcaaatcctagcggcagcaattcgcatggcccatctgcacccgtttcggttgctcccaccgaccatagcagtatcggtccctcttctcccccaatttcgcctgctccttccaatcaatcttcgcctcgaatttcatctacgacacctcctccctatcctcgcagcaggcctatctccccggtacaacttgcgtcgccgacagaacaaccgtctcctcccttctcgccgattgtgtcaccatcaggttcccatagcgatgtccgagaaacaacaccatcgcatgttggatcaagccgcccacgttcgcgaattcctagggcagcacttcggttgacagcacggtcaaatgagagctcgcccactcgccctgacctttctctaacggtcaaatcggacattcaaaagttggttggaggagcactcaaaccgtattatcgctcaaaggtggtctcgaaggaccagtacacggatatcaaccgtactatttcacgaatgctatacgagcgagtggggaatgcgcaatccttagacgccgagaccaagaataactttggaaaaatcgccgccgaggaggttaaaaaggcaatcgatggtctccgagcaaaggatgaagactcccttgcggatagtagctcttaa

SEQ ID NO: 9008 - DNA, 708 bp, A.fumigatus
ttccatcatccgcggacgacccatgaaagcgaggtgtcttgggatcagttgcttggagattactgccaagttcatcggtctgtttggacccgctcgttaccttggacgcgatgggggtggcagttgaacttcgatgacccacagcaatacacaatggctaaggtcaaaatcacgacaattcctgaagccgatgtttctaccaattactcggttggcgatatcgtgaaacattgctatgatactggctacgtgtctgagaaaccaggcaagcacaccggaagtaatggcaacaatacttccacaatggccttcgctgctcaaccgacttttgttgtcaaagcagagaacggcattcagatcactggcgacgatgccattgtgactgacgatgccttcgcaactcctgaagtggattttccaactcctgaagagacagatggcactcaaactcctaatcctgtggaggcagaaccagttgtcaacaaccatccttacgctttcatggatgtgcctggcgtgcctggcggtcagcagcttgaacttgaattgttccagggcaatgacttcgatctcaacaacatgcaactcccaattatcgacgccttgccctttgatctagctgtcgcagatgcatttccactgaactatgacccactggaagaacctccttttggagcctttgacattgatcaatacatcaacgtctga

SEQ ID NO: 9009 - DNA, 1860 bp, A.fumigatus
atgagggacccgacaggtccagacatctatgagagctctgatttggaagatcttgagccacagccaggaatacacacgtcatctccacccggggatcctttgccccgaaactccaccggcgaaggatctgatgtgagcgagcctatatgtatggacatttcagagagctctgactcgggagatcctgaaccacaaccaggggtacacacgtcatctgcacccagggagccttcgccccgaacctccatcggcgaagggtgtgatgtgagtgagcgtgcaactatagacatttcagagagctctgactcgggagatcccgaaccacagccaggggcacacacgtcatctccacccagggagccttcgtacccaacctccaccggcgaaagatctgacgtgaacgagcctatacgtatggacatttttgagagctctgactcggaagatcttggaccacaaccaggggtgcagtctgatgttggaataaaagaacgggagcgtacagagtcagatgaagacgagctgggtcgcgaagagcagaagagaagagaacgagaaccccttctgagaggggcggaggagcaagttgaaaatgagcggtttgagtgcaaagttgtggaaactgagcaggggcttttggttcgcgaagagctatcagatggagaacgtcaaagggacgatgccaaagatgacgctcatgtaacgcagcaagaagggaacgaaagagctactgtcgcaaaggcattattggccgatcatcaaggacttaggacagaagaggacctaatggtgcctgcagctactgcaaaagaggttgaggaacttcttaatgagatgctccaaggaaagtcagggttgcgtgctgccaacgaagacgcaagtgtcccagaagaacaagtaagtctggaaagagccgacgctctcgctcggctagaaagcaaggccgaggctcttactgtcgaattagaagatatggttgagggcagcaatgagatcgtctcttcggtcggaggacgtcttagcccagtacatagtgaaggcacgactgagacagcaggcgctgctgagctaggaccttctcgacaagtccaagaaagacacgtggcatccctaccgggtccagaacaggcccacaaggaggcagttgaaaggcgggcagccgaagagtcactgtttgacggcccactgacagaagatcagacgatagaagaagctcaggagaacgagcctatcggaacggccgctgtcccgtcaaaacgtaaaaggtcttcgtcattaaggcatgagcaagacgcacagatccgagtacgggagatcaaagcagtcagggaatcgaagagagtgaaacaaagtcaggtcggagaaagcggtacgcccggcgcatcacaagtcgagttagctttcccactcagagcagtcaatctggaggaacgggtgtcggagggactagagtcgaccgcttcgggccctgggagccacgagcagccagacaacaggcctgaggttcccgctcccctggccccggaaagcagggatggagaacttcctcacgatgtgccccctggccagagagtaacgttaaccttccatgcttacgactcagggaggtggacgaggacagacaccgtatccgtgagcctcgataatccgactgaagcacagatcatcgcggaccgctatgcgcgagatcggagcaagaacgcgcgcttctatgatgaggggttgcggaaggttgccgccgatgagtgcgtccgcgccgcaatcgttgatggtagcttcaaaattctcatgagttttggcaaagacttagtggtgacccgcttccttgttgcatcagtgaagcaactgctccagaaatga

SEQ ID NO: 9010 - DNA, 438 bp, A.fumigatus
tcttctgtcagtgggccgtcaaacagtgactcttcggctgcccgcctttcaactgcctccttgtgggcctgttctggacccggtagggatgccacgtgtctttcttggacttgtcgagaaggtcctagctcagcagcgcctgctgtctcagtcgtgccttcactatgtactgggctaagacgtcctccgaccgaagagacgatctcattgctgccctcaaccatatcttctaattcgacagtaagagcctcggccttgctttctagccgagcgagagcgtcggctctttccagacttacttgttcttctgggacacttgcgtcttcgttggcagcacgcaaccctgactttccttggagcatctcattaagaagttcctcaacctcttttgcagtagctgcaggcaccattaggtcctcttctgtcctaagtccttga

SEQ ID NO: 9011 - DNA, 642 bp, A.fumigatus
cgttctccatctgatagctcttcgcgaaccaaaagcccctgctcagtttccacaactttgcactcaaaccgctcattttcaacttgctcctccgcccctctcagaaggggttctcgttctcttctcttctgctcttcgcgacccagctcgtcttcatctgactctgtacgctcccgttcttttattccaacatcagactgcacccctggttgtggtccaagatcttccgagtcagagctctcaaaaatgtccatacgtataggctcgttcacgtcagatctttcgccggtggaggttgggtacgaaggctccctgggtggagatgacgtgtgtgcccctggctgtggttcgggatctcccgagtcagagctctctgaaatgtctatagttgcacgctcactcacatcacacccttcgccgatggaggttcggggcgaaggctccctgggtgcagatgacgtgtgtacccctggttgtggttcaggatctcccgagtcagagctctctgaaatgtccatacatataggctcgctcacatcagatccttcgccggtggagtttcggggcaaaggatccccgggtggagatgacgtgtgtattcctggctgtggctcaagatcttccaaatcagagctctcatag

SEQ ID NO: 9012 - DNA, 426 bp, A.fumigatus
tatcgttcaagatcagaatataaaaagagagtatatcccctcgggaatgtccattcaacaacctcactcatcctcccaagctctaaaacatcccacacctgtccacgaacgactgtcacgatgaaattccttgcaatcgccactctcctggcctcagccagtgctaccatcgtctatccctacaccagcgcctcctgcagtggcagtaccgtcggcaagatcacctcctgcggctgtaccaacatgagcggcaactacaagatcaagggggctaaactcgacttccaaaaggcaaccgccagcttctacaagggtagaaattgcgaaggcgttcgcatttccaaggcctcggaccagagttgcgtgaagcttccggttggttgggaatcctttggttccgtgcggatccacgggggaacttgctga

SEQ ID NO: 9013 - DNA, 555 bp, A.fumigatus
ccacggccacacagagcggtaattctgctgctcggattgtccgcaatctcatggtataccggctacatcatgggccagtttaaactccgctttccccagatccattccatgggggatgccggcgagctgctgatgggccgcttcggacgcgagctattcggcatcggtcagcttttgtttctgatcttcctcatggccagtcacatcctcaccttctccgtggtcttcaacaccattaccaaccacggaacctgtaccattgtctttggcgtggttgggttggtggtcagtttcatcggagccttgccgcgcacgatggggaaagtgtactggatgtctatggcgtgtacgtatcctttctcggctattgattcgcagccgactgacaattgtacagcctgcatcagtattgtgacggcgaccgtggtgactatgattgcgattggagtgcaagccccagatcacgttcacgtgaatgtgaccaccaaggtttctttccaggatgccttccttgctgtgaccaacatcatcttcgcctacagtacgcgcttttga

SEQ ID NO: 9014 - DNA, 474 bp, A.fumigatus
cttctgttcatttcttttccagtagctaattccgctctagttgctcacgtcgccttcttcgggttcatctcggaaatgcatgaccccagggacttccccaaatccctgacgatgctgcaggtggtggacaccagcttgtacatcgtgactgcgatggtcatctaccgctatgcgggtcccgacgtagcctcgcccgctctgtcatccgctgggcctctgatgaagaaggtggcctacggtctggcgattcccaccgtggtgattgccggtgtcgtgttcggccatgtggcctgcaagtatatctatgtgcgcatcttccgaggatccgcccatatgcatcagaacagtttcctggctattgggtcatgggtggccatcgcgttgggcgtctgggttgtcgcctgggtgattgcagagtcgattccagtgttcaacgagctgctgagtttgattgtatggtccattctcctctaa

SEQ ID NO: 9015 - DNA, 393 bp, A.fumigatus
ctggctagctcgcccctacatataataatgaccgactgggctgccaaggtcaagacgatcggcctcacccaggtcttctgctcgaaggacaagccgctggtcgatatcgtctttgtgcatggactcaacggtcatccatacaatacctggtctacaaaggatcctcccgttttttggccggcagatctactgccgagcctgctcgaaccgtgcaaggtccggattctcacgtacggctataacgccaatgtcactgccttcaccgacggagcatccaaagaccacatccatcagcatgctgaaaccctagcctcaaccctagctgctaatcgcaacgtaagttacgtatattcccccctctaccgtgatctcgctaaaactgctgagctctag

SEQ ID NO: 9016 - DNA, 660 bp, A.fumigatus
cttcgccactgtccggatcggcccatcatctttgtttgccattcactgggcggtctcgtcgtcaaacgggcccgaattaatggaaaaacctttccaattaaaaaaatgaaccccttccggtcaattttgttcccacattacggtatcctttcctggggagaccccccaagggtcaaaatttccaaatggggcgtgctactgcaaaacatctgcagcgccgtgctgccaaagaagtttatggagtcttccccgcagctcattaaagcactgaggaccaacaatgagactctccagaacattaacagtctctttgccgacatcatgggccgtttccatctctatttcttccacgagacacgatccaccgacgtcaagggcacacgcgaacttattgtggacgaaagctctgccgctccttactttgaaggtgtcgagcgaatgggcattgaggcggaccacagccatatgtgcaagtttgcagacgaggacgcccctggcttcgaggctgtagctgaagctctacttcgatattcgcgcgacgcgcccttgaccatctttgacagatgggttgaggaagaaaagacccgcttggtgatccggcagaccaaagcaaaagaaatcttcaacaacggtaggtccgtcatgtgcaacaagccgtag

SEQ ID NO: 9017 - DNA, 1695 bp, A.fumigatus
cacgacatctttcttttcagccgtgtgcaaagctttcacattgcaatggctggacacgcgaccgcgcctgcggagcccagccaggccaacggctcaacaggtctcgacccatccaccacaaatccttacgagacaaatccggagttgattccgcccaccgatccatttctctctcgaagccggcaatacggccgctatgccccgcatgtcgatgatttcaaaccccgctacgatggttggtaccaggcggaaccggatgccatttcgtattgggaggagatagtgcgaacattctgcaccccgcaaaattccctgaatgtgcctgggacaagggaggtatacgctgctggcagtgttctaatcaaaatcgaccaggaacctgcggccggtgcggctgcggagcgatattcaaatgtgaatacgaacgagttgagtgctgctagaagagcgcaggatgctcttcaagaactcggcgttgcgataccgatcatatacttttgtggcacagttgacggaaagaatgtcaccgtggagtcgagaattcccggggtgtctctggaggttgcctggaagtatctcaccattgaacagattggcgcttttaaacaacaatgccgtcgggttattcagcgccttgcactcgtcgagcctgcaccggattctgcgtcgtatgtctgcggcgaactcaactctcaatcacctccgggcgtcgaggactccgaaagggatatattgtttcaaggcagaaaggggacggagcagctccacctggttcacaacgatatgattcggtcgaatatcgtggtcaaggatggccggatcgttggcattctcggctggcggcaatgtgggttctttggctttgagcgagcaaagcagatacatcgtcagtttcggataccggagcgtcctgtcattgacaatggcggggtcaacgtaacacaggtctgggccgacctctatgatgatattccagacgttggtgggacgaacggcttcccagatcatcagactccagttgcaccagaggtgaaaattgagcctctgcagccgtcgttggacaagtatcccccaagcaatgaagcggaaaccctgcccgctctggcacaacttgatggcacccttttgcccgaagaacatccgacgccgaggaaagtcgctgacctgaagagcgaattggcctcaagagcatcatcggcagatcgatcttcgccgtctggctccaccaaggcagccgggaaaagaaaaccgggccctagtgcgtcgaagaaagggacagccaagaaacaagccacaaagaaacgcaaaatagacgaacttgcgagcgaagatgcggagaatcgtcgctccaacaccccttcttcgacgcgcgccagcaggacgcccggaactaagaagcagggatccgtatctgtcgcgggctctccggctcctgaaggcacgaaaaggaagaagaatgccaagaaggcgaaagtagagaaagcggaagaggaagaagagccagaagaagattcgtcagaggatgacggggttttctgcatctgtcgcaagggtgatgatcatacgtggatgattgcatgcgacggtggatgcgatgattggtttcatggaaaatgcatcaacatcgatcccaaagatgcagatttgatagacaaatacatctgtgagtcgcggcttaggcagcttgtactctga

SEQ ID NO: 9018 - DNA, 978 bp, A.fumigatus
tgcacatcaggcccgaattgcaaggcggagggcaaaggttggacgacgtggaaacccatgtgtcgactaaagggttgtcggaaacccgctcgtgtgacaggcaagaaccccagtaagtattgctctgacgagcacggccgggagttcatgcgtcaacgggtccagcaactcaacagaagccccggggatcctgccaagaaagaatgggatgagcttggcagcagaggcggtgttcttacaacgggtgatctccacgcggtcgtcatggccgtctcctctgcggaggagttccgtaaacttggagagcgcattatttcgccgccgccagaagaggaggaccctgtgacaggagcaaggttgagcaagaaactgggcttggacgtggatcccgaaggcctgacctattctcatgacgaggcatctaaacttgagcaattacgcaaacaaagagaggaccttttccaccggcgcgacgtactcaacgcgcgttccacgttcatggcactcgttcgtcagcgatcaaaaagcattgtcgagaagctgaagcaaacagatccaaagggaggatggaaggatatctgtgggttcgacacacgcctcgcatggtccgacgaggaattcaatgagtggagactgtccaagctcggagccaaagcgcttgaggagggcactcctgaggcactcgcttccagctatccagacgctgtggatgcggatggcgacacggccatgaatggcaccaaggcggaggaggaagatgaggacgagttggccaaattgacccgtggagtctgtacgaagaagcgttgcgagagacacaagcaatgggtcaaggttcaccagtccgaagttctcttcgaggaaaacaagctgaagcaggaccttgccacgtgcgagaaagaagcccacaatgttgtccaaagggccgttctccgaatgtgggctgaaaaggacaatgccgacaatggcaccgagtga

SEQ ID NO: 9019 - DNA, 720 bp, A.fumigatus
ttgccacaagagcacaagagcaatctaccccgtcacctggagtactctctctctctctcatgcatcatctacatatacatcgtacttgtatcgactgcccggatgatccgctcgcagcccccgctgtcccttcccgtacaccctctcccgcgcggtcagggcctctgcgtcctgcgccggctgctccgggtacagccctcgtctcctcagttccggaaccaacagctcgaccacatcctcaaaagtccccggcgtcgacacatggccgatgttgaacccgtccagatccgcctccacgatccaccgctccatctcgtccgccaccgtcgccgcgctgccaatcgccacggggcccagcccaccgatagacgccttctccgccaccacccgcggcgtccagcgcgggatgtccttgctcgtggtcgtgaacgcgtccaggatactcacgatccggcccgcctctgccgagtcggccgccgtgatctcttggtccagcgggatccgcgagatgtcgatgcctgtccatccgctgaagaggacgagccccccaaccacggacgcgtattttttcagctcctcgtacttggcccgggcctcctcgtccgtgcggcccaggatgggtgtgaatgtcgcaaagaccttgatcgaccgtggatcccgccccttctccgcagccagctggcggatccggtcgactttgggccgcagcaccgatggtga

SEQ ID NO: 9020 - DNA, 747 bp, A.fumigatus
tccgctcgcagcccccgctgtcccttcccgtacaccctctcccgcgcggtcagggcctctgcgtcctgcgccggctgctccgggtacagccctcgtctcctcagttccggaaccaacagctcgaccacatcctcaaaagtccccggcgtcgacacatggccgatgttgaacccgtccagatccgcctccacgatccaccgctccatctcgtccgccaccgtcgccgcgctgccaatcgccacggggcccagcccaccgatagacgccttctccgccaccacccgcggcgtccagcgcgggatgtccttgctcgtggtcgtgaacgcgtccaggatactcacgatccggcccgcctctgccgagtcggccgccgtgatctcttggtccagcgggatccgcgagatgtcgatgcctgtccatccgctgaagaggacgagccccccaaccacggacgcgtattttttcagctcctcgtacttggcccgggcctcctcgtccgtgcggcccaggatgggtgtgaatgtcgcaaagaccttgatcgaccgtggatcccgccccttctccgcagccagctggcggatccggtcgactttgggccgcagcaccgatggtgagtggctcgagacgaagatcgcctcggcgtgcgtggccgcaaactccgagcctgctgcagacgtgcccgcctggaagagaaaggggtccgctccggagatttttcaccaagagcgccaggaccgcgatgagtta

SEQ ID NO: 9021 - DNA, 612 bp, A.fumigatus
ctcatcgcggtcctggcgctcttggtgaaaaatctccggagcggacccctttctcttccaggcgggcacgtctgcagcaggctcggagtttgcggccacgcacgccgaggcgatcttcgtctcgagccactcaccatcggtgctgcggcccaaagtcgaccggatccgccagctggctgcggagaaggggcgggatccacggtcgatcaaggtctttgcgacattcacacccatcctgggccgcacggacgaggaggcccgggccaagtacgaggagctgaaaaaatacgcgtccgtggttggggggctcgtcctcttcagcggatggacaggcatcgacatctcgcggatcccgctggaccaagagatcacggcggccgactcggcagaggcgggccggatcgtgagtatcctggacgcgttcacgaccacgagcaaggacatcccgcgctggacgccgcgggtggtggcggagaaggcgtctatcggtgggctgggccccgtggcgattggcagcgcggcgacggtggcggacgagatggagcggtggatcgtggaggcggatctggacgggttcaacatcggccatgtgtcgacgccggggacttttga

SEQ ID NO: 9022 - DNA, 765 bp, A.fumigatus
aaaatctccggagcggacccctttctcttccaggcgggcacgtctgcagcaggctcggagtttgcggccacgcacgccgaggcgatcttcgtctcgagccactcaccatcggtgctgcggcccaaagtcgaccggatccgccagctggctgcggagaaggggcgggatccacggtcgatcaaggtctttgcgacattcacacccatcctgggccgcacggacgaggaggcccgggccaagtacgaggagctgaaaaaatacgcgtccgtggttggggggctcgtcctcttcagcggatggacaggcatcgacatctcgcggatcccgctggaccaagagatcacggcggccgactcggcagaggcgggccggatcgtgagtatcctggacgcgttcacgaccacgagcaaggacatcccgcgctggacgccgcgggtggtggcggagaaggcgtctatcggtgggctgggccccgtggcgattggcagcgcggcgacggtggcggacgagatggagcggtggatcgtggaggcggatctggacgggttcaacatcggccatgtgtcgacgccggggacttttgaggatgtggtcgagctgttggttccggaactgaggagacgagggctgtacccggagcagccggcgcaggacgcagaggccctgaccgcgcgggagagggtgtacgggaagggacagcgggggctgcgagcggatcatccgggcagtcgatacaagtacgatgtatatgtagatgatgcatga

SEQ ID NO: 9023 - DNA, 870 bp, A.fumigatus
ctgacaaatttgctaatgagtggactaataggaccggtggaaattcaacttcctgccgagggagagggaaacaaaatcagcgtcagtaatgtgtcggaagagtacttgcagatggctcgccacccggcatataagaactcgacccttgtccagaaatctgccatggcatcccgcttgatcgtgacaggatcatcgtacattggcaacgttttaaccagtggagctgaaagcttcacgaagaaaacaaaacccaatcccaagccaatgacattttctgaaaccacccacgcacgatttcgaaagattggcaccctctctcaaggcgcggcagaactctccgccaaaaccgtgggccaagttggtaaagtggcacagaatttcggtgcctctctgacccggcgagagggtaaacagaaaggtattgataagtacggaaacagcagcgattacaagccggggatcttgaacaagtccttgatcgccttctcaactctggcggatggtatcgagcagggtgcgcgcaatgtgctgacttctggctctgtcgcggccagcacaatgattgcacatcgttatggagcggaagccggtgccgtggcgagcaacgtcactggcggtatcaagaacgtcggcctggtgtacattgacgcgtccggtgtgagccgcaaagctgtcctcaaatccgtcgcgaagggaatggtcgttggacgcatgcgcgatggtaaacaagtcgtcgtcggtacgggtgatggaggcgaagtgcctccaagtgtaggtggccccagccaatctctgcttggcggacgagaccccgtcgcacgacgcccgtctcccagtcctacaccacctcccgcttatggggcttcgggc

SEQ ID NO: 9024 - DNA, 201 bp, A.fumigatus
accaaccataatccatgtggcggtgctcactgtgtcagcgttgtgtcagttaacataattcccaggtcagccgccaccttctgtaatccatataaaatggcactttttaaggctttaatttctcaacaaccaaacatctacttggatataatgttatgtatgacgtatactattcatatatctaatcctagttacaactaa

SEQ ID NO: 9025 - DNA, 357 bp, A.fumigatus
ttgcctttcttagaactggcaacccatgtgtgggttaattccccggcaatggggaccttcccggggtcgcagtatgatctaaacacatactgggggtggggtgcgccatgcggcagatatctcggatcccaaggtgagtgttccaacattctgtctcgattttgctgtatctcaactgacgcatatcctaggatgttgttcgtatccccgtctggtctagaacaagcgaagcgtcttatctcgtcttataagcaaaatcatatccctgttatgactcccgagttgtggcgggcgaagaaggtggtggactctacattgcatccaggtgtgttggtagtatttggttgcttaatataa

SEQ ID NO: 9026 - DNA, 681 bp, A.fumigatus
actactggaacgcttctgtggcagatcgccaaccagtcgctcaatgtcgccattaacaatgcgaatgcgaacaagtcgactcctctgtcggtctctcagatggccaagtcatacttgatggcggtgtcggcgtcatgctcggtggccctgggtctcaatgcgctggtccctcggctgaagaacatatctcccaacaccaaacttatcctcggccgtctggtgccctttgctgcggtttccagcgcaagtgcgctcaatgtattcctgatgcgtggcgaggagatccgtcagggcattgatgtctaccccgtcctctcggaggaggagaagaagaagcgcgaggagaccggtgagccggtccacagtctaggcaagagcaagaaggccgccacaattgcggtcggtgagacggccatcagtcgggtactgaacgcgacgcctatcatggtggtaccgcccctgattctcgtgaggctggagaagacggcctggctcaaggctcgtccgcgcatggttacaccgatcaatctgggcttgatcctggccacatcgctgtttgctcttccgctggccctgggagcgttccctcagcggcaggcaatcagtgcccagtctctggaagaggagttctggggccgaggaggcaaggacgggcaggttgaattcaaccggggtatgtag

SEQ ID NO: 9027 - DNA, 483 bp, A.fumigatus
tgtaggcgtatgttgttatctgatattagccaagtttctgtgggttatcaactgactttccacaaatacagtcgcgcccctaatccacctcgaacctatctgagtgaaacagcggacagcacagcctccctagtcgacgtcgactctccgcatgtggtctcagtggactccgatttcctcaaccaggaagtgaagaccactactcaggctgatcgcttagaaagagaggcacaggagaaagaggaacggaaagaacagagaaaggccgagaaggcgaaagcgaaggctgcgcgcgccggccatgtcgccaagcgcaaccctgtcatccttgggaatgctgtgctgtatgcccttgtcggtgccgcgcttggatatggcgcatacagaaagcatgccgaaggcaagctgtcgttgaagcttgttggaacatggactggtattgtcggagccttcagtacggtcgattactttgttagcaagtaa

SEQ ID NO: 9028 - DNA, 201 bp, A.fumigatus
cacccaaggacgcctgcaatacaaagcaggatggcaactaccaccagtcgtgcagcctttgaggctgttttccccacattggccgaagatctcctggcccatgctaagaaatataatctgcccgagaatgcagtaaagtggttcgaacaggtgagcccaggtcgacgcgcccacttacgactgatctcagaacagccatga

SEQ ID NO: 9029 - DNA, 942 bp, A.fumigatus
ccaatactctttcaaaaggtcctcgatgtcaacgttcccggtggaaagctcaaccgcggcctctcggttccagataccggcatcgctctactgcagaagcccctgaccgacgagcagttcaagcatctcagcatcctgtgttggttgaccgagctgctccaggctttcttcttggtcagcgatgacatgatggacagctcgattactcgtcgtggccagccgtgctggtaccgccaccctggagttgggctgatcgctatcaacgacgcattcatgcttgaatccggcatctacgtgatcctcaagaagcacttccgctctcatcctgcctacgtcgatttccttgagctgttccatgagaccacctggcagacggaactcggtcaactgtgcgatttgattacggcccctgaggacaaggttgatctggacaacttctccatggagaagtacatgttcatcgtgacctacaaaaccgcttactacagtttctaccttcccgttgctcttgctttgctctacctcgaactcgccacccccgagaaccttcaacagacccacgacatcctgatcccgctgggtcagtacttccaggtgcaggacgactacttggacgcctatggtgatccagccgtcattggcaagatcggcaccgatatccaggacaacaagtgctcatggctgatcaaccaagctcttcagcgctgcaacactgagcagcgcaagctcctcgacaccgcctacggccgcaaggacagcgagcttgaggccaaggtcaaggcgttgtacaaggaactcgacttggagaaggtctacaaggagtacgaggagaagaccgttggtgaaattcgcagcaagattgcagccattgacgaaagtcagggcctgaagaaagaggtcttcgaggcattccttggcaagatctacaagcgcaccaaatag

SEQ ID NO: 9030 - DNA, 1368 bp, A.fumigatus
  unsure (537): Identity of nucleotide sequences at the above locations are unknown.
tattggcaggatattcgtcccgactggtatcacaacatgtcgtcggtgatggaggcaggtcctgtcgtgcgcaccaaccagctcgactttgacgaagaagtcatctacaaatcgacacagtatctttatgatcatgtccgccaccgtaccgaccagcccttctgcttgacagtgtctatgacccatccgcatgacccgtacgcgatgacaaaggaattctgggacttgtacgaagacgtggacattccgttgccaaagacgcctgccattccccaggaccagcaggatccccactcgcagcgggtcctcaagtgcattgacttgtggggcaaggagataccggaggagcgcatcaaagctgcgcgccgcgcgtactacgccgcctgcacctacgtcgacaccaatgtcgggaagctgctgaaggtgttggagaactgtggtctgcgcgacgacaccatcgtcgttttcacgggcgatcacggcgacatgctgggtgagcgaggcttgtggtacaagatggtctggtacgaaaactcngcacgtttgcccatgatcgtgcatgcccctaaccgctttgctccgaagcgcgtttcggagaacgtctcgaccatggacctgttgccgacctttgccgcaatggctggagccccgttggtcaaggagcttccgctggatggtgtgtcgctgatgccgtacctcactggcgaggagggtgtcaagaccgacacggtgctgggcgagtacatggccgagggcacgcagtcgccaactgtcatgatccgtcgcggccggtggaagtttgtctattcgctgatcgacccacccatgctttacgacctcgagaacgacccggaggaacgggtgaacttggttgcgggtcttgctgtaccatcgcagtcattggccgtcaagggtgccgcggttgatcaggtcaagtctacagctctccctaccccggccgatacgccgtcggaaactcctcgtgcgtccccagtgccccagcgcgccaattcatccttcccgttcccgactcccccacgcacccccagtcccgccaagcttcccgttgcggtgcctgcgaccaccgatccggccacgctgttggcgcactttaccgaagaagtgcacgcccgctgggatctgaaggcgatccaagaggacgtgctgcggtcgcagcgccggcgtcgcctggtgtactcggctctcatccggggtactccgaccatctgggactatgagcctcgcattgaccctagcacgcagtatgtgcgcaaccaaggcaagggggctttggacgatgtcgagtttatctcgcgctggccccgtgtgttgcagcaggctgccaacgccatgggtgcgaaggtttag

SEQ ID NO: 9031 - DNA, 198 bp, A.fumigatus
tctgtctcgactcctttcctttctagtgactgtgacgacaacgacaccaccatggcggctaagaagcccaacatcctctacattatggcggaccagatggccgctccccttctggccttccatgacaaaaactctcctatcaaaactcccaatttggaccgtctggctcgggaaggtgtggtgtttgattccgcataa

SEQ ID NO: 9032 - DNA, 465 bp, A.fumigatus
cggaccaaccatagtccccggggtaaatgtcgctggtcagtcgctgctcatagccatgaagctggtcaggtccacaaaagtgcattttaccagccagagcagtgtgatagccttcgcggcgcaaataatgggcatatgtggggatgtcggcgggcaattccgaaggcttggtcctacgcgccaatttgggacgggaaccgaacgggtccccttgaacaaaccgcgagggaacccacagtgggggaaatggccttatgcggaatcaaacaccacaccttcccgagccagacggtccaaattgggagttttgataggagagtttttgtcatggaaggccagaaggggagcggccatctggtccgccataatgtagaggatgttgggcttcttagccgccatggtggtgtcgttgtcgtcacagtcactagaaaggaaaggagtcgagacagactagacgagacttga

SEQ ID NO: 9033 - DNA, 1329 bp, A.fumigatus
  unsure (361): Identity of nucleotide sequences at the above locations are unknown.
ctgcgatggtacagcaagacccgcaaccaagttcacccgttcctccgggtcgttctcgaggtcgtaaagcatgggtgggtcgatcagcgaatagacaaacttccaccggccgcgacggatcatgacagttggcgactgcgtgccctcggccatgtactcgcccagcaccgtgtcggtcttgacaccctcctcgccagtgaggtacggcatcagcgacacaccatccagcggaagctccttgaccaacggggctccagccattgcggcaaaggtcggcaacaggtccatggtcgagacgttctccgaaacgcgcttcggagcaaagcggttaggggcatgcacgatcatgggcaaacgtgcngagttttcgtaccagaccatcttgtaccacaagcctcgctcacccagcatgtcgccgtgatcgcccgtgaaaacgacgatggtgtcgtcgcgcagaccacagttctccaacaccttcagcagcttcccgacattggtgtcgacgtaggtgcaggcggcgtagtacgcgcggcgcgcagctttgatgcgctcctccggtatctccttgccccacaagtcaatgcacttgaggacccgctgcgagtggggatcctgctggtcctggggaatggcaggcgtctttggcaacggaatgtccacgtcttcgtacaagtcccagaattcctttgtcatcgcgtacgggtcatgcggatgggtcatagacactgtcaagcagaagggctggtcggtacggtggcggacatgatcataaagatactgtgtcgatttgtagatgacttcttcgtcaaagtcgagctggttggtgcgcacgacaggacctgcctccatcaccgacgacatgttgtgataccagtcgggacgaatatcctgccaatattagtgttgtgcgtactacaggcggagcgcaacgcaactcaccggctcgtcccaattgacggaccaaccatagtccccggggtaaatgtcgctggtcagtcgctgctcatagccatgaagctggtcaggtccacaaaagtgcattttaccagccagagcagtgtgatagccttcgcggcgcaaataatgggcatatgtggggatgtcggcgggcaattccgaaggcttggtcctacgcgccaatttgggacgggaaccgaacgggtccccttgaacaaaccgcgagggaacccacagtgggggaaatggccttatgcggaatcaaacaccacaccttcccgagccagacggtccaaattgggagttttgataggagagtttttgtcatggaaggccagaaggggagcggccatctggtccgccataatgtag

SEQ ID NO: 9034 - DNA, 339 bp, A.fumigatus
  unsure (69),(123),(231): Identity of nucleotide sequences at the above locations are unknown.
aatcctcacatctgcgatctacgaacctacgcgatcttgtctacccgtggccgcgtcctgcgcacctcngaagttgacgccgaaggcaatgcaaccgatgctgtaccgaacggagaagaacanaacgatgacggagtcgacggcgaggaatcgcaggatcccagtggatcgaatgacccaaaaaccgcatgggtcatggccctgtaccaggatgatgcgggcgaggagcancaatgccgacggtcgatcacaagctttggcgttagcgaataccggatcaacaattgctttgggacggggcaacagtacaacgaggctttcgaggcggaaaatatctga

SEQ ID NO: 9035 - DNA, 822 bp, A.fumigatus
ctgacccccgcgatccttccagccccgtgtgaagacggcccgcagtcattaccgacatggagatatttctcttcatgtgctcctcggaccaaggctgttgtcaagcccacggcaccccgtaatcctccaaaaccatcgcaagaaacgctcaaatttgcggggaggcgaccagagggactcggcaaactagaaaggaaggttgcgaaagaaggcgacttgttactttttaaggcaccatcacatcgcttctatgtgttgggtgcttacggtatcgcagcattctgcttggcttactcggtctacaactcgagcatcgtgttcggagacccagttgtagctctgccaatgtggcagaagagtctatttggtggcatttgtgtcatgatgagtgtcatggggacagtcttcattgtgaagactgcgcggttgatcaaggccatcaatgccattcacttgaatggcaagacataccttcgcttcactgttcgaagcatgatccctttccgaaagccataccgctttgatgccctacctcgccaaatagccttctctcggcgtctggtcgtctcccctgagtcgctcaagccacagacgactccaaacgctcaaccggctagggtgagcatctacagagcgcctttgacgaagattagccaggtcttctggaagggtttccggtctgtccgacaactctttacacaggaggatatcatcctcttggaagtcgagggtcaaaagggtgttttccgaatggattcggctgggtacatctccgaggatttcctggtgattgggaacccggtgagcatcaggagctattag

SEQ ID NO: 9036 - DNA, 279 bp, A.fumigatus
gtgaatcggcgcgggcgtctttgttcccattttgagacttcaactttgcttttgcagtcgtgggacagcggctgccttatcgcaagatggggaaacttattcgccttgagcttttcagtacgggataatacgattactcgtcggcggatagtgctaacctattccttagatttcaagtcctacaagggacatcatgttttgctgtttggagatgcctacttcacatccattatcggacctaatgggtctgggaaatccaactcgtgcgtgtcactttaa

SEQ ID NO: 9037 - DNA, 621 bp, A.fumigatus
aataagagcaagtcacaagatatatataagtggcatacaacaaatgctatgtacaatccgaatccaacaacgctcaagccacaggtatcagataaaactccaaattttgcttcaccgcagcgtccaataggaataaatcacagcatgggcttgacatcgtccgcaaccttgaatggagcatccgtcttgctccggacctcctcgacagtgactccatcagcaagctcgaccaatgtcaacccgtcagtaaagtcgacatcaaagacacaaagctcggtgatgatccggctgacgcaggtcttgccggttagagggaactcgcactgcttaacaatcttggggttgcctttcttatctgtgtgctccatagtcaccaccactttagtggcggaggggttggatactaggtccattgcacctccaaagcctttgatcttaccggggagcatccctacaatacagtcagtcacagcacataacgagggaagaaaggagactcacagttggccaggtcaccacgggcgctcacctgcatcgcacccagaatggtcagatcgatgcgtccagagcggatcataccaaacgactcatcactgccgaacacagccgcaccggggatga

SEQ ID NO: 9038 - DNA, 1266 bp, A.fumigatus
tcttaccggggagcatccctacaatacagtcagtcacagcacataacgagggaagaaaggagactcacagttggccaggtcaccacgggcgctcacctgcatcgcacccagaatggtcagatcgatgcgtccagagcggatcataccaaacgactcatcactgccgaacacagccgcaccggggatgagggtgacggtctccttgccggcattgatcaagtccgcgtcctcctggcccttcttagggtaagggcccagaccgaggataccattctccgactggagcatcacttccaccgaggggtcgacgaagttgggcgccagcatgggcatgccaatacccaggttagcatacatgccgttcttgaattccttggcggcacgacgaacgatacgctcccgcttcgcggccgtgtcgcccttgcccagggcggccgtgtcgtccccatcctctttggcaaaggtgtatttctcgatgttcttaggcgccgtgctctggaccacacgcttgacataaatacccggcaagtggatagcagccggctcgatctcacccggttcaacgatgtgctcggcctcgacgatagtcatcttggcatttcggcccatcgcaccgttgaagttggctgcggcgtaccggaactggcagttacccagcttatccgctttccatgccttgacaaaggcatagtcacccttgatcgcctcctccatcacatagctcttgccgtcgaagaccttgacgtcgcgcggctgactgtactgagccaccgtgccgtcggggttatgcttgagcggcagctcgccggtctgaacgaccgttccacaggccgctggggtaaagaaggcagggatgccggcgccaccggcacgacaccgctcggccagcgtgccctgtggcgtcagctccagctcgatttcgccggtcaagtacatccgctcgaaggtcttgttctctccaacatagctggcaatcattttcttgatctgcttcgactggaggagcagacccaagccagcaccatcgacgcctgcgttattgctgacaacggtcaagcctgtgatcgagggattggcgcgcacggcgccgatcagtgtgtcgggaacaccggacagaccgaatcctccggcaagaagcgtggagttggacttcatatccttgatggcttcctcggcagaagctaccaccttgttgatctcattccggcgcacgctgctcgagaatgctcgtgcaaggaatcgttgatgctagagagcagttgttag

SEQ ID NO: 9039 - DNA, 360 bp, A.fumigatus
gtctcctttcttccctcgttatgtgctgtgactgactgtattgtagggatgctccccggtaagatcaaaggctttggaggtgcaatggacctagtatccaacccctccgccactaaagtggtggtgactatggagcacacagataagaaaggcaaccccaagattgttaagcagtgcgagttccctctaaccggcaagacctgcgtcagccggatcatcaccgagctttgtgtctttgatgtcgactttactgacgggttgacattggtcgagcttgctgatggagtcactgtcgaggaggtccggagcaagacggatgctccattcaaggttgcggacgatgtcaagcccatgctgtga

SEQ ID NO: 9040 - DNA, 1215 bp, A.fumigatus
catcaacgattccttgcacgagcattctcgagcagcgtgcgccggaatgagatcaacaaggtggtagcttctgccgaggaagccatcaaggatatgaagtccaactccacgcttcttgccggaggattcggtctgtccggtgttcccgacacactgatcggcgccgtgcgcgccaatccctcgatcacaggcttgaccgttgtcagcaataacgcaggcgtcgatggtgctggcttgggtctgctcctccagtcgaagcagatcaagaaaatgattgccagctatgttggagagaacaagaccttcgagcggatgtacttgaccggcgaaatcgagctggagctgacgccacagggcacgctggccgagcggtgtcgtgccggtggcgccggcatccctgccttctttaccccagcggcctgtggaacggtcgttcagaccggcgagctgccgctcaagcataaccccgacggcacggtggctcagtacagtcagccgcgcgacgtcaaggtcttcgacggcaagagctatgtgatggaggaggcgatcaagggtgactatgcctttgtcaaggcatggaaagcggataagctgggtaactgccagttccggtacgccgcagccaacttcaacggtgcgatgggccgaaatgccaagatgactatcgtcgaggccgagcacatcgttgaaccgggtgagatcgagccggctgctatccacttgccgggtatttatgtcaagcgtgtggtccagagcacggcgcctaagaacatcgagaaatacacctttgccaaagaggatggggacgacacggccgccctgggcaagggcgacacggccgcgaagcgggagcgtatcgttcgtcgtgccgccaaggaattcaagaacggcatgtatgctaacctgggtattggcatgcccatgctggcgcccaacttcgtcgacccctcggtggaagtgatgctccagtcggagaatggtatcctcggtctgggcccttaccctaagaagggccaggaggacgcggacttgatcaatgccggcaaggagaccgtcaccctcatccccggtgcggctgtgttcggcagtgatgagtcgtttggtatgatccgctctggacgcatcgatctgaccattctgggtgcgatgcaggtgagcgcccgtggtgacctggccaactgtgagtctcctttcttccctcgttatgtgctgtga

SEQ ID NO: 9041 - DNA, 258 bp, A.fumigatus
atagcattcgctcaagagtccgagcctgacaagactgcgatgatccagacgcctgggttcggcggaagcccgtggaagacgtggttcatcgataatatgacgtccagtcaacaagccgagcaggtagcagtcgccattcttagccgagccccgtcttccaacacctattcgatgcatggcaaggatgatattatggttgagcttgtctgcatccaggccctttcttcggggggtgcatcatctagccaagatggctga

SEQ ID NO: 9042 - DNA, 522 bp, A.fumigatus
  unsure (286): Identity of nucleotide sequences at the above locations are unknown.
cttgcatcactcccatacagctcctactattacctcccagcagagcccactcagcaacctcagccagtgattcaggaccctgtgcttcatactactttcccatacaatctgactaaccccaacactataccaaccgagaacaacgacccagttgttttccaaacaccttcaaagaagctctctgacagtcaacaacatgagctcattcaagccgtagtggctaatgtaactagcatcgtcaatggcaacgctacgcacggcagctgcaacaaatgcaaggcagcgntggccgccaccaaacctgcagcattgtatgcgccgactttagtgcctgacaccattatatcgctctgcaaagagttcaatttcaggtcaaatgccacctgcgaagaggactatgccgcgtcagtcttcggcgccgtctggacgcaggtcctggcctacgctgatgtcgagggccttgacggggactatatctgccatgcattgaacaagtcattgtgcggtccgccagcgacaagc

SEQ ID NO: 9043 - DNA, 1068 bp, A.fumigatus
ttactcgcacgctttggcaccgtggacgaggaggtgctccagaaaactaatattgctaaacttctatcccgtttcgtgaagaaggggggccccactgtcaaggagctctctcagaagatcctagataatgctgctgcttccacgaaaaggaaacaggagtctaccaaacccgcagctaaagagaggcaggcaaccaagagctctccctctgaagctgcacctgcaaataattcccgccccgaaatcactggctcgaagaggcctcgggagggagaacccagtggccagggtgcttcaaagcggatggttgtaacatccaatatcaagcctagcgcaaaggcaggcaatgctaccattactggctctgtcaagcgcccacaagagacagctcaggagaacagatctgctgctgctgtctcgcgtccgaaggcaaacattatcgctcccaagcctacaagcctctttggcagcttggtttctgcttccaaacggccaggcacctcaaatgcagagcgcgctgccgccgcagctgccgcagcgaaaacaaggtatgcagaatgcgaagctcctgtatgtggaccttcagaaataatgctaacaatgatcagccctccggccgaaaggaaagaaactcaagcaccccctcctagacctactttctcctttggcgatattatggcagatcttaataagcaaaagggccctgaatcagttgagccaactgaggatcgacctccggaatccgaagaagaacgcaagaggcgacttcgcaaggaggctcgaagaaaattgcgcgtcagatggaaacctgacgagtctcttacggaagtccgtctcttcacccacgatcctgacgaggagctgggaccgggtgatcgatctcagggagaaattggtgacatcaagggagagggtagtgtccttaaactgcacagagatcttgaagacttggaagatgacgatgatggtgttattcgcgaagagaatttgatggactatacagagccttcgggtaagccagtatcgacgcaaggtatgggctgtctgctaacggaatctagaaattga

SEQ ID NO: 9044 - DNA, 198 bp, A.fumigatus
  unsure (33): Identity of nucleotide sequences at the above locations are unknown.
catgcgttaccttccaggcccggtcgtgttagnaccagcatgtgtcatcggctgatgttctatctttttgtcttatctttcatgatttcccttttctaccttcctttgactacatgggtgatgacatggttggaaataccaaatggactaccgggacctcagattcgcagccctcgtgatactcctattaatggttga

SEQ ID NO: 9045 - DNA, 246 bp, A.fumigatus
tccgtcatgccgtccattctgagcgacgccgacaaagaaaccgtgaagaggaatgtctcgaaaccctcgaacaagatccttgctgtagccgttgcgcggctctatgtcgcatacccagatccccaaagatggacatacacaggtctgcagggtgctgcggtgcttgccaacgacctggtcgggaggactttctggctgaagctagtggatgtatctgtgagtagctacttcttggaacaaggctga

SEQ ID NO: 9046 - DNA, 900 bp, A.fumigatus
cctgctgggagaggtgttatctgggaccaggaaatctacgataatttcgcatacaatcaagaccgcacgttcttccacacattcgagctcgaagattgcgcggccggtttctcctttgctgatgagaaagaggcaaagaccttcattaagaagatgcatgagcgggagaaacatgcaagcaaggaaacccgtcaaacaccgttcgcatcaactcgcggccagggtcccgcccctatggccaatggcaaacctggcgtgggacgctcgctgttcggcagtctattgggccatcggtcaccctctggttctagtgtaccacctcctgcacccgcacccgcagcaccttccgcgcctccaactcaatcagctcttccgagcgggccctcgcgcaaggagttgccctttgatactagtgatccatcatggaaggggctcctagatgaacttctacagatgggaatcacggaagaccaaattgcggagaattctgactttattaaggcctatatagaacaaaggcagggcagtgaagctgaacccacagcctctccttcggaagatcagaggcgaggtaaggctccgcctcctccacctccatcagcgcctcccgccttgaagaccacccctatcagtccacaaaataccggcaacagcgggggcagtcgccgaggtgcgccgccacctcctccgccgtcgcgcaaagctcgtcctgaagcggaagaggaaccggcacctgcgccagctcgtgaaccatcccctccgcgacccaggttccgtgcgccacctccaatcgcagatgccgggaagctcgctcacaccgtcggccctcccgtccctggccgacagagagccatgtccggtaccaacccgtcttcacccaggcggatggaaagacaaacg

SEQ ID NO: 9047 - DNA, 207 bp, A.fumigatus
tggttccttgtaggcgctggggagtccggtaaatcaacaattatcaaacagatgcgcattatccattcaggagggtttcctgaagatgagcgacgacagacacgtgcggtcatatactctaatctagtcatcgcattcaaggttctgctggacattatgcgcgcagagcagattgattttgaactcgagactacaaaggtaaactga

SEQ ID NO: 9048 - DNA, 723 bp, A.fumigatus
caatctgcaatagtaagtctcgttgacggtatcttcctcattagcggctacttactctcttgtagctttttcgggtcgcttgaccgtttattcaagcccggttggctaccagacaaccaggacatgctgcaggcccgtttaaggacaactggtatcacggagactctcttcgagctgggacaaatgaatttcagaatgatggacgttggtgggcaacggtctgagcgcaaaaaatggatacactgttttgaaggtgtccagtgccttcttttcatggtcgcgctatctggctacgaccagtgcttagtagaggatcaaaatgccgtaagtcaatccagtctcagtgcctctgaagaagcatgttatctaacgcaaacgcagaaccaaatgcacgaagcaatgatgctcttcgaatctttggtgaacggagaatggttcaaacgcaagcccatcattctgttcctgaacaaaatcgacctttttaagggaaaactcgaattctcaccggtatcaaagcactttccagattataatggttcgaactcggatttcgacgccgcagcgcggtacttcgctgacagattccgcggtatcaaccgaataccggaccgtgagatctatatccactataccaatgctacagacacaacgcttttaaaagccactatggaatctgtacaggacatgatcatccagaagaatcttcacacgctcatcttatga

SEQ ID NO: 9049 - DNA, 243 bp, A.fumigatus
actgaaggggaaccctctatatttcccatccaaactttggtcccacttctgatactaaccgttggtttcgctttccagcaattggcggaattcatagacaatttagagcccgatgtaggatcggacgaagcattttcagattacaaggtccgcgatgcgatgagggaaatgtgggttgatgcatgggtgcaaaaagccgtgtctcgaggtcatgagtttgctctacatgacaatctgcaatag

SEQ ID NO: 9050 - DNA, 249 bp, A.fumigatus
ggcggtgttgccactcccgctgatgccgcactcatgatgcagctgggctgcgacggagtgttcgtcggctctggtattttcaagtctggtgatgcgaagaagcgcgccaaggctattgtccaggccgtgactcactacaaggaccccaaggtcctcgctgaagtcagcgagggtctgggtgaggccatggttggtatcaatgtctctcagatgcccgaggccgaccgattggccaagagaggatggtaa

SEQ ID NO: 9051 - DNA, 522 bp, A.fumigatus
tattacccaagtgtttatgattgtattaaaatcacccacagaatgaattcattatcttcctttcgaaaatgtgttctcagccgatccgctcggtcaacatcaccattgatgctcgactttctcgctccgtcagttttgcgccagagtcgcacccggcacagctctacagcagcgtctagttctccggatggagcccaacagtcctctcagaattcgggggctggatcctcgaagcccacatacattttgagcaagaaacaacgagagtacctggacagcgcactccgagtctaccaagccggcgaacttgccgcaacgctcatctatgctgcgccaacaccccaagtcttgcgctcgcatccccacctccgaacgctcatgaagcacatgtgcgaaccaagaagtcggaaccttctcgacattcaacaaaactcattggcaaagccaccgggatccgccccgacggtccttgtattccgatttgggaaaattcccaccggactttctttggggatggtccga

SEQ ID NO: 9052 - DNA, 855 bp, A.fumigatus
gtttgccgttttctttgtacaccttttgatctcaattgtgtcctttgtgttcggtggctggaaactgacaacactggccccaccaggtctgatgctggatctcaccattcactcgagtcggccagcatgtccgagtctgacgccgcctccgattctgagggagcaagtgaggacgctgaagaagatcgccctatctttccttacgaaaagctctactactccgccaaagacaaagaagaaatcatggcgttgccagaaatccagcgagaacagatcctttctgagcgagctcaagaggtcgaccgacgcaaccaggacttggctcttcgccgtctcttagcatctcgcgaacgtgatgaggctcgccgggtgaaaaagtctaagcgaaaggcgagcgtagcggatttggaagaaggccagcgcaagagctcccggcagaagaccacacttggcgggcgcaaagttggcgaggcttctgaggccattgaggcatacaagcgtcagcgtgagaagaagggcaggcgcgatgagcttcgtcgtcgggatatggctgctggtgaagcagctccagtgaaggacgaagcaccatcagataaggatgctgaaggggaaagcgaggtcgagtgggataatcgcgagcgctctccctctcctccaaaggatgacccgcctgcggaccttcgtgatattcaacgtgctcgcgtgggacgtaccaatttcgcacaagtttgcttctatcctggattcgacgaagccatttccgggtgctatgctcgagtaaatatcggaccgaacagagatactggtatcaacgaatatcgtctctgcttgatcaagagtatgtcgccgggttga

SEQ ID NO: 9053 - DNA, 270 bp, A.fumigatus
aatgtaagtagctctactagctctttatctctccgatttctcaccatgccccaagatatcaattcggaactcgatgaattggacagagaggagttctaccgattgaagaaggtttcaaacaagaagcagcgggatagtgctgctgctgatgccgaaattgtagctactagggaaagggaggctgcggacaagcgggccgctgaagtcgaggcggtgccagaggtcccagacgttctgggggagaatgaagacgccgatgtcattttctag

SEQ ID NO: 9054 - DNA, 477 bp, A.fumigatus
ccaaagctacgctccgcagtgtctatgtgtgtctcctcgtctgcatgttacaacgaacgaacagcgcatctaacatccttgaccaaacaggtccgtaatttagaagaacgcatcaaggtcgaccagctgaaggtggccttggaagagatcttctctgagtatggcaatatcgtggagatcgtcgcgaagaccaatctgaaggccaaaggccaggcgttcattgtctttgacaacgtcgaatccgccacccgcgcaatcgaggaggtcaacgggtttgagcttttcgacaaaccgatggttctcgactatgcgaaaacgaagagcgatgcaaccgttctgcgagagggcgggacagaagagcttgaggtccataagcggaggcgattagcagagaagggtgcgttcttcttggccttctcctttttccctttcaagtcttgtctgttgcttttggtattggggtgtgtctttcactaa

SEQ ID NO: 9055 - DNA, 414 bp, A.fumigatus
ctgtgtttgtttctggtagagcgcaaacaagcccacgaagctctggaagctcagaagaagctcaagcgtccccctggcccagccgacacagcgcgtccagccaagacagtcaagggcgcgggcctcaaaccgaccagcggtgcagcggcagcagttatccccgacgagtaccttcctcccaacaagattcttttcctgcgggacttgcccgacaccgccgaccaagagagccttaccgctatatttggtcggttcgaaggattccaggaagtcagattggttcctggccgaaaaggaattgccttcgtcgagtacgagaacgagtctggtgctatcagcgcgaaggaggctacggcgaacatgcctatgggggacaatggcaagcctatccgcgtcacctatcagagacagtga

SEQ ID NO: 9056 - DNA, 192 bp, A.fumigatus
gaaatgtacattgcccaaagaaacagcgcagacactctagaaaatgacatcggcgtcttcattctcccccagaacgtctgggacctctggcaccgcctcgacttcagcggcccgcttgtccgcagcctccctttccctagtagctacaatttcggcatcagcagcagcactatcccgctgcttcttgtttga

SEQ ID NO: 9057 - DNA, 507 bp, A.fumigatus
acccagcatgccatgaacggcactcctcgacttcggtctgcctttcctcagacccctcaaacacttcaaaggacaagagagtataacattacaccgacgaggcctaagccgcgggatgtcgggctgcggagatccccagtgaaagtaccgcagaccaaagcggacgcgcctctcgtgccgaccggcgtgatagacgccccgtcgcagaggctctacgtggtagctttctacattgcgctcaatgcatggcgcgtctatgagtcttggacagcttcagatgagttggactcaacctggctgtttctaaaatggacttccatcgacggggtatttctctttggcctgcaggcgttgcgcataccctggctcgagtgggcgtttccaacaacgctggcgattttcttgatccatgttgtcggtaacatgtttctcatgtttcaaattccggtgcgtaccctaccctgccgtgcgatggtcgacttgcttacaccaagaagattccagtga

SEQ ID NO: 9058 - DNA, 1722 bp, A.fumigatus
aagtggcatacgatcgggaattatccatttccgagcgtagtgtcaaacctggagatattatccataatgcctctctcattcttgggaagcagatcgttcacattcttccggaggggtaggctctccttatcatgggtgcccaagactcgcctactgacgttttttagttccgccgttctgaacccggatcagatccccttctgtctagattctcaaagaagtaccgtcaatctaccgatacgtgtcaaccaaaccgacccggttctcatagaactactacgcctagatctcagcaccggtgaaaatgaaacgattacaatctcatcgaaacagctgaagcagatgaaacgtcaggcggggaaaaaactatcgagctcagacgcaccagaacaccgtgatatactctaccccatccggcgcactggtatctatcgtttacaaagagtcgtggacgagtcaaaccttgaggtccgcatgcggtcatctgacgcgcttgtcgtttcttgtccgcgcgcactaatcaagaactctcatactcacaaatgcaagggagaattgtctaacctggtgttggaggttgagggcacaccgccgttgaagatcaaatatagtagacaagtgaacaagcttgatcgtggattttccttccagaacattcagcctgatcacctacggtcaccattgcttgggcagagaagctcaggcattttgttcgatgcagaacagccggagatcacatgggctcagagtcaaactatcgaagtaccactgaacgaatctctgaacgtgggaggggaatggttctacaacattgaagaagtccatgacggttgtgggaacatcgccaattattcgacgcttctggacgaagctgatcgatcctcgccaaaatcattaccgcattggcaccagttctccgtgcatgaaagacctcgtttatcattgtctgggtgcgacgaccagcacttcataaaggtcgcgaaaggagaacatgtgaatcttcccttaaggtttcacccggttggacagggatatgactacgacgggcccttctccttgggttactcatttaggggcaacgagctagatgagagggattcgtccgacaaggttcgccagctttcgctcaaagaccttgaccagaagcctcagataaaggaatcaggctggtatatgttgaactctatttcaagccaattttgttctggagaaatattggagccttcatcttgctatcttcacaaccctccggagcctgaattggccctgaaatacgagaagatattcgacaagtgtgccaacaactccgtaggtctactccttgatctcgatctcactggctcgccgcctttccgcatgcggtacagcattgagcactcaaaaggtgttgaaaccaagtcactgactgttgacggtctgcgcactcaactcgatttcactccatctgaagccggattctatcgataccgcttcttagatattgcggatacagtgtatgcgcctcgctctttgaaagataaagtgcccgtcttggaacaggacgtgaaaccaccagcctctgctcatttccttggctccagggaggtgcgcagagcctgttttggtgaacccgtttccatagacgtttccttccttggggaatcgccctggactctgcattatgaactgcctcacaatggcaaattttttcacgagagcgtaagccggaacagtgattgggga

SEQ ID NO: 9059 - DNA, 234 bp, A.fumigatus
tgttatactctcttgtcctttgaagtgtttgaggggtctgaggaaaggcagaccgaagtcgaggagtgccgttcatggcatgctgggttcaccgagaagaacccgctcttgattgaggtgagttgtacctatacgaacggccagtctatagaagacgtcaacaatcgaaagaataacctaatgattcgggaaaatcgagaaagctatacgcgactgttgcaactcgccaattga

SEQ ID NO: 9060 - DNA, 213 bp, A.fumigatus
gccggtcgacgggtgttggagtcgcttccagcttctctgaacctcaagtttagtttcgtcgacctcgatgctggtttcgacaccttcaagcgcacaggtaccgctctgcccgacaagaccgttgagacgctgaagaaggagtgtgacggtgctttgttcggagctgtcaggtcggttgtccctatgacaggaaactttaggtcttcagcctga

SEQ ID NO: 9061 - DNA, 216 bp, A.fumigatus
caagaatgtcagcccaccgggctgatgaatcgggtccagagtaaacacaccgtgccagacaatcggacagtcgtcttcctttatgccattaacacgctgtatgccttcgatggatacatcatctcttcccatcagcacaaaatgcacctcatttatcttctgagtggccattcggcaagcgagaggcagaagatcggaaacgctccgcaggtttga

SEQ ID NO: 9062 - DNA, 210 bp, A.fumigatus
agacatggctctatgtccctcaaccagacaggattcacagacattattgatggtggctcatcgggttgctatgttggcaccagcaacgagcaactggttcccaatgcaagctggaatgcaacgccaggatgggatcctgttaccgggcttgggacgcccatttataataccctggtgaaattggccacgagtgtttcaagtaccccatga

SEQ ID NO: 9063 - DNA, 651 bp, A.fumigatus
gaagacgtcgctatcatggcacacagcgtcgacctccggtccctcgtttcagagctccataatgctctcaaccgcaagcagctcgatgctgcaaacaacctcctcagccaagcaaagcgaacccttcttcttcagaatgcgctgataccaacaccttctacaccatctgacctcattgcgctcgctcgtgaagttctggaactaggagcccttgcatccatccggcagaccgacgcacaaggcttcacgagatattaccagcagctgcagcccttttacgaccttgagagggatggcgcgggctcagtaaaggtggatactaagtctagccagcgcagcaagattacaggcttgtatctgatgcttttgctgagcatgggtgatagcactagtttccacaccgtgttggaaggcctggttgaggaggcgagtctacagggcaagcgcgtggaggatgatctgtacatcaaataccctgttgatctggagcggagcttgatggagggaagttatgacaaggtgtggagggagactaactcggagagagtgccctcggaggactttgctctgttttccaacgtgagttcagcccttttccgttgtattctttgcttttgctctgctgttgagctccccctgatgactctgtga

SEQ ID NO: 9064 - DNA, 279 bp, A.fumigatus
gtccttgttggaaccatccggagtgaaatcgcggactgctccgagaaagcatacccttcgcttcccatttccaacgccaagaatcttctgtttcttgactccgagggagctgttattgagttcgctcagcaacgagggtgggttctccgtgacggccggatatacttcccagtcgagcccgaggccgcagcccggtctgagaaggatattctggtggcaagcagcacggtcatcgagaacacgataggctacgctcgcgagctggagacgattgtctag

SEQ ID NO: 9065 - DNA, 636 bp, A.fumigatus
tgtcaccatcatgtagcctggcattgtcattgttgtcccttgcttcgcttgttgcctccagactctgtccatatacatccatgtggatttcatcttgattcttatttccatccgcaggtatcaaactatatccatacacactctcgatttttttactggcgaataacttcatactcactattgcgcttcttatattataagcggaataccgcccggtggtacattataggtgtaggaaacgaaagagtcagagccatcatgccaggcaaaacaacgactactccgcgtatcaccaaattcactaactgtcgcatcgtcaagggttccgagcttgttgagcaggatgtctggatcgattctctgtcgggcaagatcctcaaagatcaggaagctttctatgggttacatctctcgccagatgaggtcgtcgacctcggcgggcgtattctcgctccgggattgatcgatgtccagctaaatggcgctcaaggttttgacttctctgtgcctcaagcgtccaaggaggaatataatgagggtttgcgcttggtgaacaaaggccttgccaggaccggggtgacttcatacttgcctactgttgtcagctcaaccccagaggtttactggaaggtatga

SEQ ID NO: 9066 - DNA, 432 bp, A.fumigatus
cggcccctgcgcctccgagaatcagcagatctgacgcaaatgtcattccaggtattgccctctttgggcccttcgggcagcaaccatcgtcctgaggatggcgcggaatcattaggagcccatgtcgaagggcctttcatcaacccaaatcgcaatggcattcacaagaccgaggtgcttcgtgctgcgcaaaatttcgaggatctagaggagtgttatggcaaagagaatctcaccggaagctccaagtcagtcaaaatgatcacagtcgcccccgaggtgggaaacatggtatcgaccatcccctcattgacctcggccggcatcgtctgctccatcggtcactcggatgcgacattcgaacaagcgctctcagcgaccactgcgggcgctacaatggtcacgcatatgttcaatgcgatgcggcccttc

SEQ ID NO: 9067 - DNA, 309 bp, A.fumigatus
tgctgtgagggtcaaagtccccagctcgcagctctactctggtaccaggtttctttcctgaggaacattgagatatatgctattcccagacatggcatgcatgtgatcatcgacgtgcactcaccgggtggagtgaatggaatgccttttagcgaggcatacggacactacagatggttcaacagtcaaactgctctcgattgttcccttgcagcaatcgatgccgttctcgcttatgtgcagagcttaagtcacccagaatgctccccattgcacccatcaatgagccggttgataatcgagccatga

SEQ ID NO: 9068 - DNA, 1299 bp, A.fumigatus
tccacccttagcttgccaccgattctttcgttggccgttgtctttgtcacccaagcagatacgaccgtcccaggcaccacgatcaagggaacatgcgttccgtgtgattcagaacctcatacaacatcgtcgcctttaagcttagtgctatcagctcgcccggcctcaggcatggctgtctcgttccgctggagaccctcgccgcgagccaccaaagctctcctcatctcggcttttgcaatcctttcgctatgcacactctggacactttggtatcatgtctcttcgacgttctcagcagtaagcacaccaattggtctacatgacagtgagggaaagctttcggatgagcaacgcgagcgtccgagtccttccggtcccgagacagtccccgagaaggggccgccacggcaacacagatacgcctttgcgacgattttgacaggggaagacgcaactgaaacggacatcaaagacccttactttaccgcggtacgcctactcgcatatcaactgctccgcagcccgcacacgaaaagcagttcggatataccctttctggtgctggtcaccgaagaggttcctcaacggcaacgtgatatacttagtcgtgatggtgctattgtcgtgccagtggaagggttctcccgcgactggatccacccaaagtgggagcgatggaagagcgtgctcgccaaactgaacctctggaagcttacggaatatgagaagattacattcctggacgcggactcggtcatcttcgaaccaatcgatgggatatttaccgagcgagccacaatgacacagatcaccaggccctcatcggcggctctcactacgccgggtccagtacccgacagctatatgatggctggaatgcacgatcgctgggtggaggtcgccttaccccccgttcctgggagtgagttctatgccaaggacaattatatgaacgccggtttcttcgtccttgcaccctccgaggcaatgttcaagtactattcgttcctgctcgaccagcccggtttatttgacccagcctaccccgaacagaatcttttgaattatgcacatcgagttgatggacggatgccgtggcaggacattggtcccctttggagtcaaaagggcagtagctttgagcattacgatccaagattgaaatccctccatcagaaatggtggaagactagctatgaccaaacatttgacgagcgaattgccaatgccatggccgagctgaaggattatctggggaaacaagaggaagacacagtgcagcctcgctcgccctga

SEQ ID NO: 9069 - DNA, 405 bp, A.fumigatus
aggggccaaacccgaacctggaacttcattctccctgaattacaacttcaagaacaagaagatcaaggtcaatctaaatattcagatcaaatcggagcagaaggtagagtcggacgatactcacaagacaatagaggaggatcgaaagttacttcttcaggtatgtatttcccaggatctcccgctgccccgcccgcaactaatcgagttatccagtccgccatcgttcgcataatgaagtcccgcaagaagatgaagcacgtacagctcgttcaagaggtcattcagcaggtcaagtcccgttttcctcccaaggtgcaggatatcaaaaagaatatcgaagctctcatggagaaggactatatagagcgcgttttcaacacgactggagatccgcaatggtta

SEQ ID NO: 9070 - DNA, 2124 bp, A.fumigatus
  unsure (1811): Identity of nucleotide sequences at the above locations are unknown.
ttaagcgccgtacacaacttttgcacatcacaaaaggcagtcagcaacgggcaaggattacaggcgcatcgtggtggttcgtctttccgtcccctatgcgaatggtatgtcggcttgtgctggccttgttctgacgatttttcttctgtagcacacttgttgggcgaggaattatacaagctccttggggagtacctgtcccgccatcttgaggccgtgtacagagagtccctaagccataccgaagaagctttgttagggttttacatacgtgaatgggttcgttacacaactgctgccaaatacgtcaaccacctcttccgctacctgaaccgccactgggtgaagaaggagatcgacgaaggcaagaagaatgtctacgatgtgtacactttgcacctcgtcaaatggaaagacgacttcttcatgaaggtccatgagaaggtcatggaggctgtgttgaatctgatcgaaaagcaacgaaacggcgagaccatcgagcagtcgcaaatcaagaacatcgtcgattcttttgtgtctctcggcctggacgagaatgataacaccaagtctacactggaggtttacagagtatacttcgagaaaccattcattgctgcgaccagagtttactacgagaatgaatcccgccagttcgtggccgagaacagcgtggtagagtacatgaagaaggcggaggctcgccttgacgaggagaaggcccgcgtgggcctgtatctgcatccagatatcatgaagcgtctcacggacacttgccttgatgtcttagtcacagcacattccgaattattgcgggatgaattccaagttttgctagacaatgagcgccaagatgacctagcacgcatgtatcgacttttgtcgcgaatcaaggatgggctggaccctctgcgggcgaagtttgagactcatgtcagaaaggcgggcttggctgcagtcgagaaagtcgcagcggaaggcgaagcgttcgaaccaaagatgtacgtggatgcgcttctgcaagtgcacaccaggtatcaaaaccttgtcaatgaggctttcaacggtgaatccgagtttgtgagatccttggataacgcctgccgcgagtttgtcaaccgcaacaaggtttgcaaatctagttcgacgaaatcaccggagctactggcccgatacaccgattctctcttgaagaagggctcaaaagctgcggaggagtctgagttggaggagatgctcgtacagatcatgaccgtgttcaaatacattgaagacaaggacgtcttccagaaattttactccaagatgctggctaagcggctggtacacgtcagctcggtatccgacgatgcggagactagcatgatcagcaaacttaaagaagcctgcggtttcgaatacactaacaagttgcagcggatgttccaggatatccagatttcgaaagatctcaattccaactacaaggactggcaggagaaggttcttgacgaagatgatcggaagaagcaggtcgacgcacactttcagattcttggaactgggttctggcccctcaatccacctacaaccggcttttctgcaccacccgaaatcgtcaagacttacgagcgcttccagagtttctactatgacaaacacaatggtcgaaagcttacttggctctggcagctgtgtaagggcgaagtcaaagcaaactacatcaaaaacacgaaagttccgtacactttccaagtatcgacatttcaaatgggtatcctcctcttgttcaacgagaatgacaccttaacctactccgacatccagaaggntaccagcctcgcccccgaaattctcgaccccaatctcgctatcctgctgaaagcgaaggtgctcctgccaagccctgaaggggccaaacccgaacctggaacttcattctccctgaattacaacttcaagaacaagaagatcaaggtcaatctaaatattcagatcaaatcggagcagaaggtagagtcggacgatactcacaagacaatagaggaggatcgaaagttacttcttcaggtatgtatttcccaggatctcccgctgccccgcccgcaactaatcgagttatccagtccgccatcgttcgcataa

SEQ ID NO: 9071 - DNA, 402 bp, A.fumigatus
  unsure (92): Identity of nucleotide sequences at the above locations are unknown.
tgccactcctcttatgtatttttaccgaaccagaaccctcatcagctagcctcttatcgagccatcccattttcatcaaaatcacttacaantaacaaccacaaccacaacagacatgacacgacacgacacgacacgacacgacaggggaaaaaaacctacaaaatgaaactccaactaaacccaaccaccctcctcctcgccaccctggccctaacctcgcagctcgcccgcgcagacctaagctactactgcgaaatggccaaagacggcaccaacatgatccagaaggcctattgctgcgatgatctggtgcctgcgcgctacgccgagaggttcttgcagggggagaagtgtacgcccctcatccttggttcttgtccttgttgcatactgcgatga

SEQ ID NO: 9072 - DNA, 243 bp, A.fumigatus
atatacccattcgaagtacaaataaacatccgctcctatcatcatcccccattagccagccttcttttcccccactcccctcaggagactgccagaggaacttacaatcgtataacaacaaaccggcaccgtcccatcattgggacacttatcccccaccgtcttcggatccgcaagcgtacctacacacatcccatcacatcagtcatcgcagtatgcaacaaggacaagaaccaaggatga

SEQ ID NO: 9073 - DNA, 1659 bp, A.fumigatus
cagctcgtgtccttccagcccggtggtgaagatcggttggagaatctgagctggagactctggacacgggaaactttctgtgtggagccggacaagtccagcgatacttccgtattgccactccttcgctcagaagctggtgaccttccggaactttctgccagcgttgaatctgctgcttcagaacaagccgagagaatcgagagtcatatcaagcgttctaggtgcgatcttaagcctgccgttgtccgcgaagactcgttctcctatctaggccgcggaaaagaaaagcacatcacgtcactcgggttagagcgcatggtgcttaacattaaagagaagaaaaatctcgagcctctcgacccgcccatgactacagtcgcccctccggtggttgacctgacaccacgaccgtcgacactttcccctacgccgccctcagaatccactgccaaacgcaccccgtccttcccgcctttcaacaatcaagctcttcattctacggcatcatgctcgacaaccgcgccggagggtaacgatagcgatgctgcgaacgttaatgcatctgacaccagcgtctcgtcctctggtatgcttccttctcgatcctgcttaataaagtctcctagtgtcgtgcgtggcttttctccttcgctcgtttcctcgtcataccggtcgcaaccaagactggcggcggatcctgggccagcacagcagccagcgcaattgaaacccacacccttcaagaagaagggtggcatgttcacactcggtggttcttctggggatgatgatgaaagctcgttcgaggaccggatagcgatacaaaagccacagcacagctcgctttccaacgagcatagcaagtcggcaaacaccaatccgagcccatcgaagaaagtgacttcgtttcaagaacaagttggaattatcaaacccgtcagcgagaggtcctatgacaacgatgaggatgcaattgagactgaggatgaagtttcagagagtgctattgaggatgatgaggattcggattgggaagactcggtgacggagagtggaaggtcgagcgtcgaggaaagggagcttttcaagcgagttgactccaggccgaacctggtctcgcgtcgctcccttctcacaatgatgatgcaccagcctacgaagatgcaggggccagcgtcacgctctagccccgccctccagcgctcacggttaacatcacctaatggaccatctatccccgcctcaccacctgaagatgaggaggaaagcttgactatgcgtggtcccgatgttccccggtcgaagccgatcattgtgaagccctcgccacagtcggtcgcacactctcctcgaactacacggcggaacatgcttgccacagaactgaccgagtcgttgagacgtcatctactctgggagcgccagcagaaaagtgcaaccgcaaacgctttcctgaagcgacgacacacaacccatgatatggcgaacctacaggaatatcccgaacctaatggggcactaaagggacaaacatcccaacagaatgctggcgtcccgaatggaacctccgcaaaagcacacgctgaaaaggatgtcgcctcatttaatcattacaccgactttgggccgtgggaataccacgttgaaggatggtag

SEQ ID NO: 9074 - DNA, 414 bp, A.fumigatus
  unsure (386),(396),(411),(412): Identity of nucleotide sequences at the above locations are unknown.
agcagctccttgcagtcgaagggcttgagacgacggagcacccgttcaccgatacgcccaacagcaacggttccgacgaccttgttctcgaggtcaaactcgttcttggcgacggcagcaacatcccattcaccgttgcggatctgctcgtgggcagggacgaagttgcgaaccagtgccagaatggtcatgacaacgtgctcggcgacagagacgacattgcagccagtgacttcggcgacagtgataccgccgttggtcttgttggcggcattaaggtcgacatggtcggaaccaacaccggcagtgacggcgagcttcaacttcttggccttggccaagcgctctggtcttcaccacggggctggaaagtgccgctccatttnaaaaccacancggcggtcccaaggnncc

SEQ ID NO: 9075 - DNA, 933 bp, A.fumigatus
agaccagagcgcttggccaaggccaagaagttgaagctcgccgtcactgccggtgttggttccgaccatgtcgaccttaatgccgccaacaagaccaacggcggtatcactgtcgccgaagtcactggctgcaatgtcgtctctgtcgccgagcacgttgtcatgaccattctggcactggttcgcaacttcgtccctgcccacgagcagatccgcaacggtgaatgggatgttgctgccgtcgccaagaacgagtttgacctcgagaacaaggtcgtcggaaccgttgctgttgggcgtatcggtgaacgggtgctccgtcgtctcaagcccttcgactgcaaggagctgctctactacgactaccagccccttcggcccgaggttgagaaggagattggctgccgtcgtgttgagaacctcgaggagatgctcgcccagtgcgatgttgtcacgatcaactgccctctgcacgagagcactcgcgggctcttcaacaaggaactcatctccaagatgaagaagggtgggttttggctatccagttttccacttgcgaacgccatatccgctaactgtctctctctaggctcttggctcgtcaacactgcccgtggtgctattgttgtcaaggaggacgttgccgaggccgtcaagtccggccacctccgcggttacggtggtgatgtctggttccctcagcctgcccccaaggaccaccctcttcggtacgtccagggcccttggggcggtggtaacgccatggttcctcacatgtccggtacctcaatcgacgcccagatccgttacgcccagggtaccaaggccatcctcgaaagctacttctccggtcgccacgactacaaacccgaggatctcatcgtcaaggacggtgactacgtcaccaaggcttacggccagagacagaagtaa

SEQ ID NO: 9076 - DNA, 261 bp, A.fumigatus
atggccctgatcatcctcgtcatcatcgctatcgtccatgaacccctgctcgaggtctcggctgagtcggctacttgcgtctgccgtatcgcgccgtcgttcaagcgcttccctccgagaaggatccatatccatcccgaccatgatttccccctcctcgtcaaatatgctaatgttatcgtgctgtgcgtcggtctgccgccgccacgccgatggcaggaagaagcgcatgacagcatcggctatacgatctcgcaatga

SEQ ID NO: 9077 - DNA, 426 bp, A.fumigatus
gctcttggctcgtcaacactgcccgtggtgctattgttgtcaaggaggacgttgccgaggccgtcaagtccggccacctccgcggttacggtggtgatgtctggttccctcagcctgcccccaaggaccaccctcttcggtacgtccagggcccttggggcggtggtaacgccatggttcctcacatgtccggtacctcaatcgacgcccagatccgttacgcccagggtaccaaggccatcctcgaaagctacttctccggtcgccacgactacaaacccgaggatctcatcgtcaaggacggtgactacgtcaccaaggcttacggccagagacagaagtaaacgtcacaatcattttatgaagcgaatgactgaatgtatttattcttacacatttctttttgggttccggtcatccttttga

SEQ ID NO: 9078 - DNA, 225 bp, A.fumigatus
ctgcagtctgctctctaccgcttcaccttttcgttctcgcaatatctgcaaacattcattgtcctagcttctcagactctatccgatcacatcagtcatcatgctgccgccgcggctttcctcgcttctgtacctcgccggcctagctaccctcccggtaacaagcgcatacaacggcgacgagaatatcaagagcattccggtacgcaagatcatcttccatga

SEQ ID NO: 9079 - DNA, 447 bp, A.fumigatus
  unsure (263),(266): Identity of nucleotide sequences at the above locations are unknown.
caggcacgtggtctgcgcggcgcttcaattcctaccaaggctcgcttgacatacttccaagacaagtctctgaccctagacttgcagtataagtccgaggacacctggaccaactgcttcactctgaacgctcccgagaccaatatcgccatccctgccgtttcctacctgggcttctctgccgaaactggcgagctgagcgacaaccacgacatcatttcggtcaatgctaagaacctgtacagcatcgggggcaacgccgnctncaccttcggccgaggcccagcaaacaacggcagacaggaccaggcccacgtgaagctgcccaagcagaaaggcggctggggttggtttttatttaagttcatactgttccttggtgccatcgtcggcgcgtatgtcggtttcaccatgtatcggaccaagcagcgctactcgcggttttag

SEQ ID NO: 9080 - DNA, 186 bp, A.fumigatus
cttctcagactctatccgatcacatcagtcatcatgctgccgccgcggctttcctcgcttctgtacctcgccggcctagctaccctcccggtaacaagcgcatacaacggcgacgagaatatcaagagcattccggtacgcaagatcatcttccatgaatgcgcaaatgcccctcggatccgctaa

SEQ ID NO: 9081 - DNA, 288 bp, A.fumigatus
cgtgtgacccagatcgaggttgagttcaacatccacggccaagggaacttgcacggcgacgggtttgccatgtggctcaccaagcagcgcgcaacccagggtcctgtcttcgggtcgacagacaacttcgaaggtctgggtatattcttcgacacatacaagaacaatcgtcccggaacatcatttccctacgtcatggccatgatgggtgacggaaagacgtcttacgaccaggcccatgacggcaaggccaacgaagtggctggctgttctgtgagcttgtcctaa

SEQ ID NO: 9082 - DNA, 186 bp, A.fumigatus
attcaatccacggatacccctcaatccacctcacttcctacgcctaatccttttagacgtccacaaaatcaaaatacaagcagcaaaatggccatctggggatcctcaagctctaacaccgcgtcctccggcgaagcggacatcaaaacccacctcatgaaccacgtccggcaagaagcctattaa

SEQ ID NO: 9083 - DNA, 1245 bp, A.fumigatus
tcgctgactcccaaaagagagcgagataatgcgctttcaattttgggcaggttgcacattatgaccagcactacgacgtcggataacataaaagcatacaccgtcaccgatccttttgcatcctctcttcggcaggctctcaccggtgccgagcagactcaatcgttcggtgtcctgtcacagatatctgacaaagaagccgtctccattgcggatttggacgagtattccagacggcagtgggaaggagttctgggatacatggtggggaccagtggactgggcatgcaacgcgacgtcagtttgagcaaaggcgtgaaggagctcttgcaggcgggccacctcgtcgagatcagggatcgtcgagtggaaattacacaggacgggttcgctttcgctctacaagacgttggcactcaagtgtggcatatcctagttctatatgttgagagcgccgcggccatcggtatggacagcgtcgaggtgctttcctttgtgttcttcctgagcagtttggaactggggaaatcatatgagaagaagcagttgacgtcgaaccaattgcgcactctgaccgacttggccgactttggtatcgtctaccaagaaaccccggatgccactcatttctacccgacgcgcctcgcaaccaccttgacttccgactccagcactctgagcaatcctctcgctggctccctttctggacctacgggcacatcctcgagcaaggccggttccggattcatcatcatcgaaacgaattaccgactctacgcatatacctcctcaccgctccagatctccctcattgcactgttcaccacattgaaatatcgcttcccgaatttgatcacgggtaaaatcacccgccagtcagtccgtcgtgcagtggagatgggcatcaccgccgatcaaatcatctcttacctatcaacacatgcacacccacaaatgcgcaagcacaatgtgtccaggtcgacttctaatcaagccggaatgccggtgtctgtcctaccgcctaccgttgtggatcagattcgtctttggcagctcgagagagatcgcgtcaaagcgacacatggctttttattcagggacttcaacactctggccgaatatgaggccccgtgtcgatatgccgaggagatcggcgttctggtctggaaatctgatcgcaagcggatgttctttgtcactcgacatcaccaggttgctgctttcttgaagaccaggaggaagtaa

SEQ ID NO: 9084 - DNA, 1014 bp, A.fumigatus
aaaggccgctcgcgaagaggttcaggcgtggttggacggaactctgcagaccgtggatatggcgcaggaaggcgatttcgtcgctctgaagtatgtttcccttttaagtcttttctaaaaaatttaaatttgagctggccaactgactgtcatagattcactggtatgggtgtccaggcattggacctcttgcagaagaaggccgctccctctccatttatggacgaggcaattcagcgggtttgtgacttggctatttcccgtaacgttcgtttgctcgtcgatgccgaggagcaggcagtgcagcccggaatcgagaactggaccatgaagtaccagaagtactgcaattcgcagacacctggccgtgccatcttctacaacacctaccaggcctatttgtgttcgacccccgccactctcgccaggcacctggagatcgcccgtcaggaaggctacacgctgggtgtgaagctggtccgtggcgcctatctcaagaccgagcctcgccatttgatctggtcgaccaaggaggaaaccgacgcttgctacgatggcattgttgaagcccttctcaccagacagtacaactccatgctcaagcccgcgtccgtggaacacacgaccgaactcccccccgttaacgttatcatcgccacacacaaccgtgattccgtccgcaaggcacacgcgctgcgtctccagcaagcaagcaagggtgaggacaaaggcgtggatctctcgtacgctcagctccagggtatggcggacgaggtcagctgcgagctattggaaggcttccagagccccgagcccactggcaagaactcgttcgtggagtcgcctaacgtgtacaagcttctcacatggggatccgtcaaggaatgcatgggattcctgctcagacgggccgtcgagaacaccgaggccgtcgggcgcaccaagcagtcgcaggaggccatgtttgctgaactcaagcgcagagcccgccaggccttccgtctaagcaactga

SEQ ID NO: 9085 - DNA, 225 bp, A.fumigatus
ctgtcattccatcatagtggtaactcaatattgagccctgagcctactacaggactagtggtcgatcctgttcgatgggtggatccagatattatcaagtatcactgcggctggcaggcggcgccactctgcatgtcgtcttatctaaggaatgatattgctgaccgtcccggctttcaggcggtttccaccggctgcactatcactttcttcagcaccaagtag

SEQ ID NO: 9086 - DNA, 693 bp, A.fumigatus
ttctcatccatcaatacctcagcatccttatcgctcatcgtagggtttattgctcaagtcccgccacctgtatcaaccacaacaatgaaggcatcccgccgtcctttgcgggctctgtcttgcatgcccacgacttatcctactccccgatatgtcagcggcacgagcaacgcgaaatcatccatcgcagcgacaccggctactagcctgttgcatcaagttcctccatcccccaagaaagaggcaacctcgccgctcgcaaaactgcctctctcctctgtcctgcggtccttgatgatcctctctgtttcttcatcctcgcttttactgaagccatgcatctataccctttccgtgttggcgcatcccaaaacgcctcttctcgatgttgccaaaaaccccctgctgaacatgcttgtcaagcacaccatctacaagcagtttaacgcgggagaaaacaagctggaagttcaacagtccattcgcgatatcaagaatctcggctaccgaggcgtccttctgggttacgccaaggaggtcttggttggagagagcaacgtcagccctcgcgatgaaaaggccgctcgcgaagaggttcaggcgtggttggacggaactctgcagaccgtggatatggcgcaggaaggcgatttcgtcgctctgaagtatgtttcccttttaagtcttttctaa

SEQ ID NO: 9087 - DNA, 822 bp, A.fumigatus
  unsure (53),(131): Identity of nucleotide sequences at the above locations are unknown.
ttgtcacaatgtaatagattccgctatcgtgtcaccttcttcgctcccaccgntatcacggatcatgcgcatgaaccaccagtcacctatctcaacaagtcccagtcatactcggtatccattgtcgactntacacccccggcgcacgccacacaatccgtcaaatatcgcacgagtgtgagaatcacctttgaggaaacggcacaccgatcgaacccggcccggtgctggcgactctggaaggaagcgcgaggggcggtcgaggcgcaacaacgaggggggaagatgcgagcattggagtttgtggacctgcgtctgggatcgaagaagaacgcgccgcggatcaaaaaggtggacagcgcgtcgtttgacgggttctgtgtaacctggacgagcactccggaagccggttcttccgagtgcgtgatcaacgtccgcttgaactttttgtcgaccgatttcagtctatccaagggtgtcaagggcgttccgacgaggttatgcgtcaaaacagagatgattggcctcgaggatggcactcctgcgtcgggatctgacaccgaagccgagatttgctactgcaaggtcaaggtgtttcgcgaccacggagcggaaaggaagctgtccaacgatgtggcgcatgtgcagaaagcgattcacaaggttgaacggcaaatcgcgcagggagatatcgacggccataatggtctgggaaagcggaaacggcgaaaaggcgtgggacacgggctgaccaagaatcatgccgtctcgatgagcctctcccccagccgttccaacagcctcacgggcatagacgattta

SEQ ID NO: 9088 - DNA, 1107 bp, A.fumigatus
aacgatgcccgaagacccgtggatctctggagaccaatatcgtccattagaagagaagaatgcactcttgaagccgatcttaaccgcgcccagtcgcaagtgacggctcaaggaaacgcgctcaaggctatggcggccgaaatgccacttgaagccggaggaaggaatacgtacaccgagattctcgaacttattaaagaccttgacccgcacagcacgacacactcgtccggaaagccttccttgtcaagagatgcagactcgagagatgaaataatggaagaatatcgtcaggacttggccaaggcccgggccgaactggaggaggcatcttcggttcggaaggcccttgagctcgatttgaagcggtcccaagaacaggccgctgaggcgcagaccctcttcaagtcggttgaggacgagaatacccgcctcactaaacaaatagacgacctgcgaaccagcctagacaaagttcagggagaactcggtcagatgaaggcggagcattcggaagccctcgaaaccatcaaccgtctccagaccgagaggaagacgcagcaacccagtcctcccccttcaccacccacgccacacaacatcggccaggcagagaagcttgaagaatcgtaccgcgcccaactcaagagccttcataccgcacacgccaccgccatctccactctacgttcgtcccacgccgactccacccgcaaactacgtgatctccttgccgcggccgagaagcgagaatcaaaactcaaagccgaagtgcagtccctgctcgccgcgcgggcggcgcaagatactcaattacagtcccttgacaccgaagtcaagagactgcaatctgcgattgccgtgaaggaagaggcggccgctgccctggacgagcgaatcgcccggtccgtcgagaagcgcgagaaagagtgggagcgccgcgtggatctgctcctaaaggagcgagagcggatggccaaagccctcatgtgggcctggggggagaaggaagtcggcgaggtcaaggagaacctcggcgaggacgggcgacgcgtcagacaggcctatcgatacaagtatgctcaaaggaaaggaagggagggatag

SEQ ID NO: 9089 - DNA, 498 bp, A.fumigatus
ttatctggtgccctttgtctatcagctatggcccctataaagcgcaagggcaatgctggggaggaggcagtgactcgtcagccccagaagcgtgttcgagttggaggagctgaacagggcaaagatcagaaaaagcagagaacatcagaatctaccagcgaccttaaacctaccgagcttacagtgctgcgcgatgacgaaccttcgtttcctcgtggtggtgggagcgttctgacacctctcgaaaagaagcagatccatatccaagcgactaaggatgtgctgttcgagcagaaagggtccaagaagtcgtctgacaatttcgctgttggggatgacgatgaagacattgaaatggacgatgctgaagacaatgcgacctctaccaaactgtctcggaaaaggaaggccaaaagcaagaagcgcgcaaaagaagaagcaaatgagaagcaaggtgtgcgaattgaaggcctcaacttcaaggtaggcccgcattaa

SEQ ID NO: 9090 - DNA, 195 bp, A.fumigatus
ctaatcggaaccggttcacaaaaaaatagcggatacaaaaaatttctggatctatgtcggcagaccgccttccgtatcaagtacaaccccatcactttaattgaagagtccaccgcctactggaagaagcagctcgcgtcacgaaaaaagcacgtcgacacgagattgatttgttctgctgcccgcgacgcatag

SEQ ID NO: 9091 - DNA, 204 bp, A.fumigatus
cgcaccgatctcgttcctcgttcagaccagctggatacctacacagttgagccgtctctcaataagaagactctttctccctcttcatcgccgtcggaaattgtgaactttacgcccgctcggctcgttctctctccagtcaagttagttgttcctcttttcccctccccgagtccgctgttcaacggttcaaccaccggctaa

SEQ ID NO: 9092 - DNA, 1329 bp, A.fumigatus
  unsure (1259),(1294): Identity of nucleotide sequences at the above locations are unknown.
catagagtcggcgtcctctctgatcgagggacctggtcctgtctttacgagggctgtggattcggctcagcgagctcccaaatagtcgtcgcaatggctccctcgatttgggaaaaggccaaggttggcggcaagaagggattcgacaaggcatggaatacggtcgataagctaggcgcgccggtgaatcggttgtcgaatcgcgttggagcggaggcgttctggcccatgactctcgacaaagaaagcgacaaggcagctcgcatcttgcgcagcttctgcaaagatggtttctataccaaagaagatttggagcaaaacggtacggacagcgatgggaagatcaatcgtcccaagggtaagcagcgagtgatcaagaagatccccgcgccggtaatccaacgcgcagtgggcctcgccatcttcaccacaatgcgaacgggattatggctgagtggttcgggtggaagcggcgtgcttttggctcgcattcctgaaacaggcgaatggagtccaccctccggtatcatgctgcacacggctggaatcggtttcctggccggtgtggacatctatgattgcgtggttgttatcaacaccttcgaggcactggaagcattcaagaaggtgcggtgtactttgggaggagaggtcagcgcggcggctggtccctatggagtgggaggtgtcctggagtcggaggttcacaagcgacaggcacccatctggacatatatgaagagccggggtctatacgctggcgtccaggtggacggaacaatcatcattgaacgtacagacgaaaacgagcgattctatggcgaaaggatatccgtcaccgacattctggctggcaaggcgaagcggccaccaaggtccatccagactctcatccagacgatcaaggccgcgcaaggtgacagcgatgtggaggagagctggattcctcctccgggacagacgccgggcgatgtcgaagttcagccagcgactctgttcggagtcccggatcccgatgaccctgatccattcggggtaaaggctctggaagccgaaggcttgttcatccgcgaggccgggactcgatcgcgaccatcatatgatgtctttgaattcaaacccagtcctcatagtcccatctattccaccttccgacgaagtttggatagctccccacgcagcagttggagagcgagcgttcaaagccacgccagtgtggatcgagggacgcagaccgatgtggcctcctttacagctcntacatcgatctgtcgggcctccgcccggtcttctncctcaatgagtcagcagtcacgcactatagcatga

SEQ ID NO: 9093 - DNA, 597 bp, A.fumigatus
aagtgttcagaggtgaattcattcagtcctgctgcgcttgaaacagaggacattgaggttagtgacgcaccgcaaccagggatatcggagccagcggcacccgtgggcgcagcagcagcgcaagtgaaggaaacaaaacctgaagaggaatcacgcgaagacgaagcacctggcgcggcttcacccgaagaggaaataccagaagaggaatcgccccaagaggaatcaccccaagaggaatcaccccaagaggaatcacccgaagaggaagcacctggcgtggcttcacctgaactgcaaccgagatccggcgtccgtacttacggaaagggaaggagatttcctgccggggaaactgctgaagcgtttgaaacggagaatattccctggacaaaaggggacccacacgattggccgtggtggacttatccgctgcccaacggcggcgcgattatggctgagaagaagaccaaagaacggacaggcggcggtcggctcccattagctattaccttgttgaaattccagtgcagcaagacaaaggacggtggggtgttacgttgtatcagcattaccttggtacggtattatgactaa

SEQ ID NO: 9094 - DNA, 324 bp, A.fumigatus
gtacggacgccggatctcggttgcagttcaggtgaagccacgccaggtgcttcctcttcgggtgattcctcttggggtgattcctcttggggtgattcctcttggggcgattcctcttctggtatttcctcttcgggtgaagccgcgccaggtgcttcgtcttcgcgtgattcctcttcaggttttgtttccttcacttgcgctgctgctgcgcccacgggtgccgctggctccgatatccctggttgcggtgcgtcactaacctcaatgtcctctgtttcaagcgcagcaggactgaatgaattcacctctgaacacttttag

SEQ ID NO: 9095 - DNA, 1977 bp, A.fumigatus
gaagtattaaccgccggtactgcagaggagggccacgcggaacggtacaccgtagcctctcagtacctcaacctgtgcaagacgatccacgggcagtcgagcccagcgactcgggatgctactctccggctggcggagatctgtgagcaaagcgatagccatctcgaagaggcactggccctttaccgacatgtcctccagacgaaggagtgggtgcctccaacgcaggcctcccgggccttgcctgatatgacggatccgacggcgaagatggtcaagcataaactcgcgcagatctatctccgcaagaagagcacctccgacgaggctcatggtttgtacatggaagagcttaccctgtccaagcagcagcgaggtctgtcatcctccccgacaatgttgtggctgcgtgaggtggctctagtctacgcgttgaaggacacgatcgaggcgcgcaaccagggagcaactctcttacgggatcatgtcaacgaggtcatccacgtcactgccagccgcgaagcggtggttgagcgtgctcaccggctggcagagatctatctcgaatgcggatacaaagatgcgggctacgacttgatcgacgagcttcataagaaggtcattctcgacacctccgctgcacaacgattggctctgaacgagtaccgacctgcggtctttgttgccgcgttcgaggagaagttcggcaagaagatgacctatagccagatccttgacgcgctgtctcaagaaagcggcgtgtaccatgagtaccagacgagtctctccaggcacgacctcgtcaccactctagttgccggccagaagctccatgtcctgcagaccgagcagcgacgcacgacggcagccaccaagacacagggcagcttgtacgaatacttttgcaactcgctgtctgtttcgtccagtttgcgctccagggacgtggtacatcagttctacaacctctgtcgtcgagaggtactcaatgctgactacaatatcaacattattaccgagactacccacatggtccgcgacttgtgcgacagctcccgcttccaggatgccgccgagttgaccggcgtgttccattcatttgtgcacctgaccgacggtctgaacagccacgaggccatttttaccgccatcaagctctgcctgtatctcaacggttaccagacgagcaagtgctcggacagcggcaaagccaagcacatggcgttcgaatcccagatgctccttcaggagatcatggacagagctcgccatctaaagattgagttctccgaacttccattcgctgaactgaacgatctggccaccgtcttgggtgaacatgagatgtttgacgatctcgaggtatatgatccttaccccttctgcctcccagattacatgcatatgctaattgcaccaggccatcctcaccgacctctggacctcgcgtctcgtccaaaaaacatggtcttccaacatgatcgtctggatcggccggcgtctggtggaaacccgtttctgccgcgggcacaccgacgcggcaacgcagctcggcagggatatttgctacaacctccgacaggtctggggcaactgcgaccccgtcacgctggagatgaccaagctgctgtccggcctgtacacggcgtcggggaaccacctggcggccgtggcgctgcacgagacggcgctgcacgagctcctcaacgacaccgacatcgaccaggcgcatgcggccgacgccgccagccagcatctgcggctgctcatgcacgcgcagtcgcggctccgcaaggagagcagtcaggccgtggacaccagcgcgtacgacgagctggtgcagcaggttggcaccaagtttggcgtgaggccggagggtctgcaaggcgcaggcgacgatgtgggaatgtggcatcggccgaggcggttcagcctggatatgggcgaggagcagatgcattcgaaccacctgcgtag

SEQ ID NO: 9096 - DNA, 624 bp, A.fumigatus
ttgcaccaggccatcctcaccgacctctggacctcgcgtctcgtccaaaaaacatggtcttccaacatgatcgtctggatcggccggcgtctggtggaaacccgtttctgccgcgggcacaccgacgcggcaacgcagctcggcagggatatttgctacaacctccgacaggtctggggcaactgcgaccccgtcacgctggagatgaccaagctgctgtccggcctgtacacggcgtcggggaaccacctggcggccgtggcgctgcacgagacggcgctgcacgagctcctcaacgacaccgacatcgaccaggcgcatgcggccgacgccgccagccagcatctgcggctgctcatgcacgcgcagtcgcggctccgcaaggagagcagtcaggccgtggacaccagcgcgtacgacgagctggtgcagcaggttggcaccaagtttggcgtgaggccggagggtctgcaaggcgcaggcgacgatgtgggaatgtggcatcggccgaggcggttcagcctggatatgggcgaggagcagatgcattcgaaccacctgcgtagcagcagtggctcggcggtgctgcatgggtatttttcagcaagcggcgaaaatcattga

SEQ ID NO: 9097 - DNA, 1221 bp, A.fumigatus
accatacagcaggccgacagtgatcatggcggggatgcgcttcaggaggatcttcatgttcttcagttcgtaaatctcgccggggcccatcgggttgtcgcggagggtgcgcatcgcccagccaaggggtccgcgcttcttgaggagacgagcgttcaggcgtttgttagattcctccatgagttccttgtaggtgagctgcttggtctcgttggtgacaagggtcttctcgttgggggagatggcaggcgaggtgatgggttcgatctcggtcttggggttcttgctgtcaaactcggagagggtctgctcggagggagcgggggaggcctgggtagcgtcctcctcgtggtcctcgtcctggacgacggcgtagttggggactttggcacggtcggcgccctgaggagcgggacgcttgaacagcagaggaccgaggataaacatccaccacttgacgccgtgatcccgcttgatcacacgggcgtggacaaagggaacgaagaagatggcggagaggatggcaacaccaccaccgcaacccatggtcacagaggcaatataccagctgggcttcttgctcagaccgagactaggcgaacccttgtagacaatggacagggtacagaccgtggcggcgaggaggaaccagaagggagagctgtagacagcccacggcacggggttcttgcgcatgtggacgatgagcttgatcagcatgaagatactggcaccgaaaccggccgagatggcgggagccatacccaggccggcgaagatagctcccagtccctttccgtggttccatccccattgtaccttggaagcaccgacggttgcaacaccgacaccagcaacggcagagatgagggagtaggtcgacgagacatgggccgagtgcttggtgcaccacataacccaggaggaagcagcggcgagggcacaggtaaaagcaagcatctgcacaccggcatcaccgcggaaggccgagttggggatgataccgttcttgatggtgtcagccgtccgagcaccgactgtgatggcaccgagcatctcgaagacggtgccgaagatcatggcttgtcggtaggtaaccgatctggaagaaacactggtagcccaggagttggccacatcatctttagacaggcaatgtcagcaaatcatctctcaaagcgcggtcaaagagatattgacatacttgcaccattgttgtag

SEQ ID NO: 9098 - DNA, 204 bp, A.fumigatus
cagcataaaagccccgtggctcgctcgctgtctgagtcaattgcaaatcaagccctcatacacttatctcacacacacacacacacacacacattcacagtcgagatggtgctcagccagtatgactacatctttgccattggcactctgtttgccatgctggatgcctacaacaatggtgcaagtatgtcaatatctctttga

SEQ ID NO: 9099 - DNA, 297 bp, A.fumigatus
  unsure (27): Identity of nucleotide sequences at the above locations are unknown.
gccatagtcatgggcaacaagatcacntaccactcccccagccgcggttgctcgatggaattgggcgccgccatcaccgtcttggttttctcgcagtactctctccccgtctcgacctcgatgtgcatcaccggcgccaccgtcggcgtcggtctctgcaacggtaccctcaaggccgtcaacttccagcgtgtgggtctgctgctgctagcatggatcatgaccattcccattgctggtacacttggtggtgtgctcatgggcctgttcatcaacgcccctcatttctcttcgtag

SEQ ID NO: 9100 - DNA, 1497 bp, A.fumigatus
cattgcctgtctaaagatgatgtggccaactcctgggctaccagtgtttcttccagatcggttacctaccgacaagccatgatcttcggcaccgtcttcgagatgctcggtgccatcacagtcggtgctcggacggctgacaccatcaagaacggtatcatccccaactcggccttccgcggtgatgccggtgtgcagatgcttgcttttacctgtgccctcgccgctgcttcctcctgggttatgtggtgcaccaagcactcggcccatgtctcgtcgacctactccctcatctctgccgttgctggtgtcggtgttgcaaccgtcggtgcttccaaggtacaatggggatggaaccacggaaagggactgggagctatcttcgccggcctgggtatggctcccgccatctcggccggtttcggtgccagtatcttcatgctgatcaagctcatcgtccacatgcgcaagaaccccgtgccgtgggctgtctacagctctcccttctggttcctcctcgccgccacggtctgtaccctgtccattgtctacaagggttcgcctagtctcggtctgagcaagaagcccagctggtatattgcctctgtgaccatgggttgcggtggtggtgttgccatcctctccgccatcttcttcgttccctttgtccacgcccgtgtgatcaagcgggatcacggcgtcaagtggtggatgtttatcctcggtcctctgctgttcaagcgtcccgctcctcagggcgccgaccgtgccaaagtccccaactacgccgtcgtccaggacgaggaccacgaggaggacgctacccaggcctcccccgctccctccgagcagaccctctccgagtttgacagcaagaaccccaagaccgagatcgaacccatcacctcgcctgccatctcccccaacgagaagacccttgtcaccaacgagaccaagcagctcacctacaaggaactcatggaggaatctaacaaacgcctgaacgctcgtctcctcaagaagcgcggaccccttggctgggcgatgcgcaccctccgcgacaacccgatgggccccggcgagatttacgaactgaagaacatgaagatcctcctgaagcgcatccccgccatgatcactgtcggcctgctgtatggtctacactacgacatccacgctgcccagtccggtatccacggtactcccgagggagaacggatgcagcgtgtatacgcccatgccgagaagtaccccaacgaggtcgagcacacgtattcgttcgtgcaggtcctgaccgcttgcactgcttcctttgctcacggcgccaacgatatcggtaactcggtcggcccctgggccgtgatctactcggcctggaagacgggtaatgcggctgcgtccaaggccccggtccctgtctggcagcttgctgttctctccggatgtatctccatcggtctcatcacttacggctacaacatcatgaagggtaagtga

SEQ ID NO: 9101 - DNA, 210 bp, A.fumigatus
agctttgagagctcattattacctaaatatcctctcaacagtactagtaaggttatgcctaaggtcggttccgaaggaccaaagctacctaataacattaccggtaccacggccccaccatccgaccttgagtggccttggacgttcagagctggaacagagtcattcccctttctattttcatttatttttagctcgcgccattgttga

SEQ ID NO: 9102 - DNA, 414 bp, A.fumigatus
gtttcccgacaacgtcgtcttccagtccgtccgttcccctctctcattgacctcgctaactcggacaggtacatcccctacgccgaagaaagcagcgatatcaacgcctgcggcatcccaatcaactacaacgcctccaaggaatgggccgataagaaagtcgtcctcttctccgttcctggtttgttcacttcaccagcacttccgaactatgaatctaacagcacaggcgcattcacacccacctgctcggcgaaccatctcccgggctacatcaagagcctcccccagctcaaggaaaaaggcgtgcagattgttgctgtcctcgcgtcgaatgatccgtatgtgatgagtgcatggggcaaggcgaatcaggtcactggggacgatatcgtacgtggtgcaactacttga

SEQ ID NO: 9103 - DNA, 189 bp, A.fumigatus
gaacctggtccaaaagggctggcccaaatgggtgcaatttcccctggtggaatgtccagttccccccccgaaacccccaagggcccaaaaattcaaaccttgcacacggcctaccagacggacctggcccgggcagattcgccaggcccatccgagcggctgaagcgtcgactcttgtgggtgctgtag

SEQ ID NO: 9104 - DNA, 1596 bp, A.fumigatus
  unsure (1007): Identity of nucleotide sequences at the above locations are unknown.
cttcgcggtagcgcgtttccttccagcccctggcgtgaagacgctcgtcccaagtcacggtctcgtgactctggtcacagaagatcccgagacaagggctccagaagctcgtccctatccaggcatgcctactcacaagaggcaaacttcctagcatcgaggggaaggcgcgagcatagcccaaagcgacacgaaagtgagcctgggtttccgcgagacctgcacggacatgaagccgcgaatcggggcgggagcaaggcgcgagattccgaacacaatggacctcacaagggtagtgataagaatgattgggtgggacagcacctggatgaaatagacagtgcgcattggatccatcgcgataagctggcccgtattgaaagcgaggagctgcaacaggcggcgtatctttttcaccgtcgtgctggcctggagaatggcaaggcgagccgggcgagaaaccacgacttcgacaacagcgggttcagtgggttggtaggcgcaccgacggcatcagagtctatggagccatggcccaacctccgcgacgagcagcacaagcatgccagctctccgattccctttgacggtgatgacactggagacgtgacggaagaggagcgccgaggttgggatcttcgtagaccagaggagattgctgccgacgaggtgacagatagcacatcgagtatgtatcgtaacccggggcttcgaaaaagttcgtctcggatacccatatcgacggccagcccggcacctatttctcccgagcatctgggacgcgagttttccatgcagcgtgcgccggacgctcacaaacggggaggaggaaatcttgtttttggaaagccacgcagagccagcgagccaatcgcgggggaagggtctgactcccttgccactccatgtgcaggcagccgaccaaacagtcgcggcatccagcccaaccaaagttgttcggccaaaaggggaccagcgagcaaaggttctgccacccgaaaaccttntgctcctcccagcaatacccggaaaacgtcacggaatcggaccgtttcaaccaactcccagcgccctaccacccgatcaggcgagccccgtccaccgcagccgatcaatcgacccgagggggatcctccttggttggcgaccatgtataaacccgaccctcgactccctcccgaccagcagatccttcctacgcatgcacgaagaatgcagcaggaacaatgggagaaggagggccgcacacctacaacgtacgatcgggaatttgcacccttggctatcgggcctgacgatcgacctcagctgcccagcaaggcggaaggcacagagaaagtggagaatacgccagaaaagactgaagagcaatcactctcacagggacaagcagagaagaccgaccatctcctcgcgtcaccaaagagtcccacatcaagaccgagttccagtacaggatacagccccatgcctaagctgcaggagatgccggccgctgcccaggtgggattgacgccaaaatggaaccctccagtggtgactgcgcaacctccacccccgaaggagaagggatgcggatgttgcatcgttatgtga

SEQ ID NO: 9105 - DNA, 213 bp, A.fumigatus
aatggaaatgaaaagaggtgtgctgacgtgtgtggtgatgatgatgatgatgtagacgacggaagagagattcagaatgcgctgtatgaaatgacgcagcagcggactgtgccgaatatctttatcgggcagaagcacattggtgggaactcggagttgcaggccaagtctgcgcagttgccggctttgttgaaggaggcaggtgcgttgtag

SEQ ID NO: 9106 - DNA, 186 bp, A.fumigatus
gcaggcgaatattcaattgataaccgctcaacgaacagtgtagtaaccttcgccgtatgtacgtacgtcctggcatattctggtctgcaagctgaaccttgggcgattaacccgttggttcccacatctcccggcgtttttaactattcaaataaaactacccagttactcaacctccaagtttga

SEQ ID NO: 9107 - DNA, 225 bp, A.fumigatus
aatcacacgcccttccgagtctcaagctttcaagcgttgagaaacaggctgcatgtccttcggcacgcccagaagttcactgctgtggtgcaaacatccacagtttacgcagacttgtctctaatgaaaccttcatcttacattgacgcgggattaaacgtggatgtgctactgcaccgcaccgcaagacacgggctcctgccaccctcaatccttgagtattga

SEQ ID NO: 9108 - DNA, 234 bp, A.fumigatus
caattgtcaaatatcctgttatcacgagatcaaaaagccaaagccagcttccctgatcaatggcggctgggagcggcaactttccgcccctttaccgttatcaataggacaactgcgcagctggctatcatcctcgaagcaggtatttatttggcgccttcttttagcgcgaggaaccaaactagtatctctctgtcggagaaacacgccatcattctaagtcttagatcctag

SEQ ID NO: 9109 - DNA, 423 bp, A.fumigatus
aacgatgcatacttatcatttctgagaaaaagctggtctaatacacgattgacacagtggaatgccgtcgctttgtgggcctgggatatcgtcgtcgacaactgtgcaatctgccgcaaccacatcatggatttgtgtatgtccctcacccctttattctgcttgattgatgctcatctgcttcaaacaggtattgagtgccaggcgaatcaaggttcatcaacaactgaggagtgcacagtagcctggggaatttgcaacgtaggtttcgcttcagcgactgctttttctccatctagggctaacaaatgttttacctctcagcatgcattccattttcactgcatatctcgctggctcaaaacccgacaagtttgtccgttggataacagagactgggaatttcagaagtacggcaggtag

SEQ ID NO: 9110 - DNA, 909 bp, A.fumigatus
  unsure (250): Identity of nucleotide sequences at the above locations are unknown.
tatcgactgctgggcagtatcacggtgattcggctttatccgtcattgctgttattcttatccgtgacctcgctctttattgatcagttccacttcaagttcttccacgaatcttcaaaggctgcctacttattaagccatttaatcgcaatgtcgagtatatctcctactcctccgactcccaagggatctcggagcaaccggcgcaacccgaagaaaacaaccaccccttctaatcagaagatggctntgctcactacccctccgtcatcgccaccagggaactcgagccctggagagatagttaccgatacgtctatcaatcttcataatccttctaagagaaagaatccccgctcaaacaaaaagccacgcgacgcccctaaatcctcgccagcgaacaacaacggacaccgacacacatcctcgcatccagccggcagtactccccaagtcaaagacagccctcattatgcgggcccaacgttccatgcgtcgcctgctccttcggcgctcccaattccaagctttttttcgaagtctgtgccagaatcagaccccgcagaggaaatcgacggggaccatctcgaagctggtctcgacctagacactacaccgtcaaagccgcggccacgttttcaaactcagtcggaaaagtcacactcgacgcctcttgactttttattcaaagctgcagttgaagccagaaactctcagcttcagcggagtcccgaagccaatattggtactcggtctccgcaaacagatcttaaagttcaacgtcaccagatgcccaactgtaaaaacggagccttcgcaggtattttccccgttagagatggaaaattccggcctacagaactctgtcttcacccacaggggccggaaggacccgcgctatgcgtctat

SEQ ID NO: 9111 - DNA, 201 bp, A.fumigatus
ccacacttaatgtttgcttgggcactgttagtcatcgcagatccccacttaaagttccctaactctctccagccgacctctgcccgcccttcccaaggctcatttcgtcctcttgccagtttactccaacttcaaatgtctaaagctacaaacatgcgtctctgccctgtgtccattctctccttgcgttcgcctatctag

SEQ ID NO: 9112 - DNA, 216 bp, A.fumigatus
cactacttccttaagactccttcacagtataacagggccctaataaatacaaagctttctacagagcaagaggtggctcttataaagtatattaatatacttattaagctagatattcccctacagctaaaggcaatcagcaatatagtaaatttaatactctttcatagacatactaatttaataacccccccccctttaattagcatgcattag

SEQ ID NO: 9113 - DNA, 1257 bp, A.fumigatus
gaagacgtgcagagagacctcgttcttctcaaagctagacggcctgtgtatgatcaaaatccacccagccttgaatacaatctgacattgtgcgatagtggttacatcgattgggcaagagtcctcagccctcctgaagacttcctttctaccgcgcgcgattgtctgctcaatgggagggcctcgaatgtcccaacaactgttcgtaccacgggttctgaacaaactcaagtcacgggggccgttaatcacgaaactccacaatctttcaaccagcctgaggagaccaatgcgggccgagcatacaaggactccaccgtttctttccgttcagacggagactcagtggcaattgctacacctgtgtcctctaataatggtcagtcgtcacgggtgagcatagtccaggcagctcatacagcaactgaaacagaccagcggtttgagcccagcagactacgatcttcacagcaagggaaaccgcagcacgtcaaatccaactctgaactggcagatgacaaagctcaagctgggaagcaaaaccaagacgacgcactggttgatgtctcaacaccaccgtccggctcaactacgatcgtccggaccaaagacctctactatgataatgtccaaaccgaggggaaaactggaattctccttgacttcaactccactcctccaaggaagagtcttccaggcgcggaaaatagtttgtcgatgagcccagccctgcaagatttggaaggcatcaattttcaggtaaatgttgcacaaagtattcttttgaggccagaacagcgaccagaaacgcagatatactctttcattgaggctgatccagtcgatttgaaggacttctccagcccaaggatcgtggaaagcaatggtgatacgatgacccctacgcctgatagcacaccatctgatctagctgccctccgagaaaagctcgcgcgcctttgcaaatttgtggaggaaacattgcgccaccatgtgcctgagccgcttcgagatatggacttgcaagctctcaggaagtacgaacaagagctcacagagatactttccttgcaccaaggaacaatgcatgagactgcctcacagactgccagaaagcgacaggaatttctctcatctcgcaaatctcaggaaaagaaagctgaaacagctgtggaaagaaaaagtcccaagatatcctcccccacaccgtcggtctgttcccctccggtgagagctcctcttgaggaaggaaattag

SEQ ID NO: 9114 - DNA, 630 bp, A.fumigatus
ggttacgacgttggcaaaacgcttgtcagccggttctcgaacgtccgcatggagaacaacaccccccagtacaccatcgcccagatctccgctgctggtttcttctccgccattcctatgacactgatcacggctccttttgagcgcgtgaaggtgcttctgcagatccagggccagaaccctccgcctccaggacagaagcccaagtactctggtggtctggacgttgtcaggcaactatacaaggagggtggtatccggagtgtcttccgcggaagcgccatgactctggctcgtgacggcccgggctccgccgcctacttcgctgcctacgagtacatcaagcgcagcctgacccccaaggatgagcacggcaatgtcacgggtgccctgtccatgcccgccgtcctagctgccggtggtgctgccggtattgccatgtggatccccgtcttccctgtcgacaccatcaagtcacgtcttcaaagtgcccccggcaagcccacaatcggcggcaccatccggtctgtctacgccagcggtggcttcaaggcgttcttccctggcttcggtcccgccttggccagagctgtgcctgtcttcaccacggggctggaaagagccgctcca

SEQ ID NO: 9115 - DNA, 342 bp, A.fumigatus
gcgtacccttccaacactggtgccactacaaccgatacgacattgactactactaccaccagctttgagaacggctcctccactggcaacagttcttccgagactggagctggtagcggttcctccaccgctaccggttcaggctccggctccggcgccgggtccgcttccaccactgcccccaacagttcgtccactggcaatgttgccccttggcggcgctgtcgttggttccggtgccgttggagccctggccctcgctgccttgattatcctttagacttctcaaagattacgttgatgggaataggttcgttgatgtcagtgtatgtcttatgttga

SEQ ID NO: 9116 - DNA, 486 bp, A.fumigatus
aatatcttcttgatcaaatttcttctcacttcagctttgtttctccgttttttgcatttcgcgaccgtttcgcgtcctccgtcctctcacccttcgctctgctcgcgggatcacctcacaccttggcctctttgtgccattacttatcttcctcctctcccccactacgaactgagtcgtttcttccccgcgtccccctgcacacattccacgatgtcgaccccaggctcgtctactcctgaaaacctcagcgatgagctgaaggcaatcgagacaaaggctgtcaaccagaccattgctcagatccgctccctcgcggcaggtgcggcgggtggtatctgtgcggtggttgtcggccatccctttgacctggtgaaggtgcggttgcagacggcggagaagggtgtctactcgggtgccattgatgttgtcaagaagactattgcccgtgagggtttggctcgggtaagttgcgcggtcagttga

SEQ ID NO: 9117 - DNA, 1203 bp, A.fumigatus
acagaacggactggtcgaccttgggaagacctccggaagcgcgaggaagctgcatcgcagaaggtcaaagaaatggagcaagcctttgcgaagcttgagaaggagaaacagcaaatgaaaacagaaattgagaacaccgtgcgccgagagtgggaagtgaaggcaagactcgagatcgaccgtcaggtacagaatgaacttgacagattacgcaagaggtttgagttcgaggtacaggaaagagtgaacatcgaagttgagaagcaaaagcgaaacaacacttcgagggacgatacggtcctcccaacgggcagttctcagtcgtctgttaatagcggggacgacactggcttcccctcaaacaccgacctcagccagttgtccatcgagtctcctacagccaacgcaaacaagcaaccaaagaaggagtctaggacgccttttagtcgctcgaagacaatggttgaatcgcctgtcgacgtgcagatggctgagccgtcaccaatatccatagcatcactctctttgtccccccgccgtacctcagtggcaagcaggaatatctttgctgaggcggacaaaccgcgggcgaagtgggagccaactctaacttactctgatgacgaacatgatatacccgatcttccctcacctacccggcaaaaggtcaaacatgatcctcccaagggtccggcacgtcctctgcttcgacagaacactactgcgttcatgcagaaactaagctcccagccgcccctcttcccttccaattcctccagattgccccagatgccaggtggcccgtccgaaactcgccatggagagaagtctagatcaccccatcggcgtctgtctaaaatcccatcatcggcgaaccttgctgctgatgccgggtccccaactcgcaagagcgctactaaacagcttccatcaaaagcgaatggcggtggtgaagagatgttcaaagctgtcatgcaacgtaacatgggtggccgaacattggttgaacttgcccaggcaagggctggtgggcggccaatggatgaagtcaagcggtgcgcaagtgattctcgagcctcgggctgctcctcgaacctgaaatcttccgaccgtgagcctcctgccgtttgggatccagagaaggacgagatgcccagcccattcctggctcgtgggagaaaggtcattcgaaacttcaggtag

SEQ ID NO: 9118 - DNA, 582 bp, A.fumigatus
ataggaccaccgctgtccttccagccccgtgtgaagacggtggcgataggacctctactgcactttgacgcaaactggtggctgatcattggcacttacgccggtctcgttggcatgaatgatggctgtgtcctccgaaacttgcaagctcggctgcgaggctttgccgacctcgagtttgaaaaggttgcagtggaagacgacaaactcttcgagagtgtctgtcaggccatgccgatcaaagaggccgctgaaaagccaggtctgacgcagcgtgtatccgatgcgatgaaccgggtttgcgcacatgagatcactgtcgtggctggctttctcaccattgtgggcctcattgcaggagccagcgcaatgaaatggacaatgacaggccaattgctgtgcaatgtcccaccgagtttgattgagtcattcttcatgatcatcttgatcacaggtcataactcggctgacgatcgcaagagaatggatctgcggaatctctacgagaggcgtctgcatcttctggctctcgtgaacagtgtacagacactccgagaggagaaccggtcacagagggactaa

SEQ ID NO: 9119 - DNA, 927 bp, A.fumigatus
gctgcttatggcctggccgttgtcggatcaactgcaagtcacacaggagttgccggaacgacactcggaggcggcttcgggtggttaactgggcggtacggtctgatcagcgacaatctcctcagtgtcagaatggtcttagcagacggtaccattgtggaggcatctgacgaggatcaccaggatctattctgggcagttcgtggcgcaggacaggcctttgggattgtgacagaactggttttccgggctcacgagcttgctgggccggtgtatggtgggacgctcgttttcaccgtagatcgactaccgggaattcttgaattcgccagtcgcttcgacaaactgcaagacgaaaacagtggctttttctttgggcttgcagcgccatcagcggctgatcgtaccggtatcttggtgttgccattctataacggcagtcaagagaaagctgaggaattcttcgcgccgttgatgtctctgggcccttcaataaacaagacctctatgatgtcctacaaagaactcaatggaattgcaaatgtcgatccagtcccggagggtcgaaaatgtttcagtgggactaaagtatccatgccactcgaccagcatctgctctgtgatttatgggagcatttcgacgcgatcatggataaatacccgcgatcgaataacagcgtgctaatgtttgagctcataccttacgagaagaccataagtgtccccatcgacgccacagcctgtgcagatcgaggacgatactacaacgtcgcattgctgctctgctggtatgaccctgagcacgacgcggcgatgcatacgtatatgcgagccctgctcacgcagatcaagcgatcagattgttatgctggcaagaaggagcctctcgtgcaggccaatgctaattttgcaggtgggagcacttga

SEQ ID NO: 9120 - DNA, 336 bp, A.fumigatus
ttgccaattgattgttttcttgcagaccatatcggcgggcatattcattcctccacctgggttccaagctcatcactcgattatcgcatgccggaactagtccggacgctcaaagacaaagaaaaagttgtattccattgtgctctgagccaacagcgtggcccagcagccgccctccgctacgcgcgggagcgagaggctgcgttgggtcctgaagagagtaagaagcagcaggtctatgtcctcgaaggcgggtttgtccattggcaggagaagtatggtaaagatactcggctgacagaggcgtacgtcgaggatatatggagggagtattga

SEQ ID NO: 9121 - DNA, 708 bp, A.fumigatus
cgactctactctatccctcatcagacgtgtcaccaattcctccatatcgcaaagatggaggcacgatccttggctcgatgcctccgcctgaggccgacaacatcgctatataccagacaacccatcatcttccgcggacaggacgccctccgatacttctcaacatccaattccctcttacaaactcctcccgctagtcaggaccaaccgagctctacgacgcctgcgtcgcctcaggatcaatcgaaggtccaaaccagcagcagcaacagcacagcatccaactccgactccgccgacttcgaccggatcctcgaccaactcaacttcaacaacgccaaccgcaatgccacagaagacagccagtcctccgactccctttcgctctcgcgctcggtcagcatggccgccgggacagagagctacaaacagccgctccgccgggtggaactaaaattgggacctacgctgggtcgccaggtgcacgtcgagccggagaaggggttggatctgacgacggcgctgcgcgtgctgcaggggaatgtcacgacgaacaaggtgcgggcgcagtggtatgcgcagaagttccatgtccggaggggccaaatgcggaagaacttgaggatggagcggtggcggaagctgttcaagttctcgtttaagcagactgtgaacaagatccagcgtatgagggcgcagggatggtaa

SEQ ID NO: 9122 - DNA, 417 bp, A.fumigatus
cgaagttgccattcttctctttctatctctctccttgtcgaatatatacgacacattgaaagtaactcgatcagtccactatctctacgccaatccgcatcgtcagctaccgcacagctccccgcacccatcctggaatttccacgccacacagtcgatgacggaccgtcatccaaacggcggagactggtctcctcttcaactgcagggagtccaagcttgaggacctattcctccacatttccaaggctcatgccatcgtcgtcgtcgagtgccgcttcctccgcttcctctacacccgcagctccacacgcttcattctccatccctggtcccaccgacgctggccctaggtctcatgctagctcagaaacattgagaacatctagtgctggcgctgcttttgataaacggtcg

SEQ ID NO: 9123 - DNA, 192 bp, A.fumigatus
cggaccgtcatccaaacggcggagactggtctcctcttcaactgcagggagtccaagcttgaggacctattcctccacatttccaaggctcatgccatcgtcgtcgtcgagtgccgcttcctccgcttcctctacacccgcagctccacacgcttcattctccatccctggtcccaccgacgctggccctag

SEQ ID NO: 9124 - DNA, 570 bp, A.fumigatus
ggaactctgcccgaatttcttcctattaatatacaatcaatgtccccggtggctctgcgcatgagcagcaaagcactactgcccctgtctccattgctccgactgtccaccgcctcaccggccctcgcccgcccttgttcgcccagtcctcgcacatcagcaacgctggctccccccactcgacaagcccctcctccctcctccctctcgtcctcctccttctctccttccttctcccctcaacaagcaaatttgtcttcgccatcatcgtcaagagttcgttcgtctgtcagctccgcgtcaactcgtgctgctcttctttctagacatttttcctcgtataccccgccgcaatcgcccaacatgtcttacaccgttcgcaagatcggccaggccaacaccctggagcaccgtgtctacattgagaaggatggcgtcccaatttctcccttccacgacattcccctttacgccaacccggaacagacaatcctcaacatggttgttgagattccccgctggaccaacgccaagcaggaggtacgcaattcggatccgcgagacacttag

SEQ ID NO: 9125 - DNA, 192 bp, A.fumigatus
atctccaaggaggagttcctgaaccccattaagcaggatgtcaagaagggcaagctccgtttcgtccgtaactgcttcccccacaagggttacctctggaactacggtgccttcccccaggtaagccaacttcatgaacacggtgcacgtccaggccaatcaatgctaaccagagatttctcgatggtttag

SEQ ID NO: 9126 - DNA, 492 bp, A.fumigatus
acctgggaagaccccaacgttgtccaccccgagaccaaggccaagggtgacaacgacccgctcgatgtctgtgaaatcggtgagcttgttggctatcccggtcaggtcaagcaggtcaaggttcttggtgtgatggctctgctcgatgaggaggagaccgactggaaggtcatcgtcattgatatcaacgaccctcttgcccctaagctcaacgacattgaggatgttgagcgtcaccttcctggccttctccgtgctaccaacgaatggttccgtatctacaagatccccgacggaaagcctgagaaccagtttgccttctctggcgagtgcaagaacaagaagtgggttccttcttactgcgtctggtatcatctttctatgctaacatttctcatttccaggtacgctctcgatgttatccgcgagtgcgctgatgcttgggagaagcttatcaccggcaagagccctcgtggcgatattagcctgtaa

SEQ ID NO: 9127 - DNA, 297 bp, A.fumigatus
tatacaatcaatgtccccggtggctctgcgcatgagcagcaaagcactactgcccctgtctccattgctccgactgtccaccgcctcaccggccctcgcccgcccttgttcgcccagtcctcgcacatcagcaacgctggctccccccactcgacaagcccctcctccctcctccctctcgtcctcctccttctctccttccttctcccctcaacaagcaaatttgtcttcgccatcatcgtcaagagttcgttcgtctgtcagctccgcgtcaactcgtgctgctcttctttctag

SEQ ID NO: 9128 - DNA, 234 bp, A.fumigatus
tctgagttgacgacatttgtatatattagcattgaacaagatattttcttcttttcagcccgccaggccagtttctatgggtcttcacagcaatatctaagctccaaggaaagaggattccgtgccacgtgcattatttcatttagacagtttctactagatcagaccaatcgcatttctacagaatatgagcaaatgcgggaatatgcaaagcccttagaacagtttttttaa

SEQ ID NO: 9129 - DNA, 411 bp, A.fumigatus
catagaaagatgataccagacgcagtaagaaggaacccacttcttgttcttgcactcgccagagaaggcaaactggttctcaggctttccgtcggggatcttgtagatacggaaccattcgttggtagcacggagaaggccaggaaggtgacgctcaacatcctcaatgtcgttgagcttaggggcaagagggtcgttgatatcaatgacgatgaccttccagtcggtctcctcctcatcgagcagagccatcacaccaagaaccttgacctgcttgacctgaccgggatagccaacaagctcaccgatttcacagacatcgagcgggtcgttgtcacccttggccttggtctcggggtggacaacgttggggtcttcccaggtctaaaccatcgagaaatctctggttag

SEQ ID NO: 9130 - DNA, 243 bp, A.fumigatus
ttattccgtccccttccaccgattcattatcccgccatggcgcagattcgcggcactgcgggttacaacctcggtcaccagaaccccttcgtaggacctggacgagcagacgcgacgagcgacccgagtcctttggacgctattcgggaacagacaagcaagattgaagactggttggatacaatctcggatcctgtaaagccgtacgttgtccaattccaccttgtccgcgagaagggatga

SEQ ID NO: 9131 - DNA, 726 bp, A.fumigatus
ttgctagctatcttcctgctattggccgtttccttattgtggtcaccttcatcgaggacagcttacgtattatcacacaatggagcgatcagctcgtatacctccgtgaataccggaaaagtaagcgtccctgattcgccatttcaatacagctctgcgacagatctctcacacgatattctttgtccagttccctggggtatcacgcacacgttcctcatccttaacgtcattgcaatgtccgtctgctcgttcctggtcatcacccgccggcacactgagatcgccgtcgccggcctgctcggagttgtcgtcacacaaggtctcggttatggtctcatctttgatctcaacttcttcttgcgcaatctcagcgtcgtcggcggtctgctcatggttctctccgactcgtgggtccgcaagaagtttgtcccagccggattgccccaattggatgaaaaggaccgcaagatgtacgtccaatttgctggtcgtgtgctgctgattttcctcttcgttggatttgtcttctccggccaatggagcttgtggcgcgtgctggtcagcctgttcggtttcgttgcgtgtgttatggtcattgttggtttcaaagccaagtggagcgcgatcattctcgtggttttgttgagtgtcttcaacgtcctcgtcaataacttctggactgtacgttcatttccctacgcgacggataaagctcgtaactga

SEQ ID NO: 9132 - DNA, 207 bp, A.fumigatus
ctctcactctcagctgcacccccaccacccccacaaggactttgccaagtacgactttttccagattctatccattgtgtaggtttctgttttccttatccccacaagtactcgtgtcctaaccactataacagtggcggtctccttctcctggtcaacatgggtcccggtcaactgagcatggacgagaagaagaaggtctactag

SEQ ID NO: 9133 - DNA, 1887 bp, A.fumigatus
  unsure (113),(166): Identity of nucleotide sequences at the above locations are unknown.
gcttcgacaatgtgggtttgttccaggatgccctgggtcgggtacgatgagctcccctgtggggtgaataaggccattcacgagcagcttcagggtacgggcgatcagcatgngggtgcttttttgactgccagcaaggactggcgggagaaagctatggccgctntgcaggaggcaggctcagtgccctctaatgaagatgacgctgtgaagtcggtcgctgttggggaaattgaccccgaggactttccgctagattcaaatcgaaagccttaccgggagatgattctcgccagcgatatctcaatattcgatttccgcacttatgtgttctcccggcagctgaccttgctcctgagagccgcaagagcgccgtccttggttgcgacagagaccggcgcaagccagaatgggaagggggataagaaacccgaagacttgatgcttctctccgagctttgtgagagagccgccgatttcattaccctcgccgcacgtacgctgagagccgacctcgactccggcttggctgatgtggatcatccgtccaagacgcacctcataaacaacctggtatcgtcgtgggcctatgctgcagcaagccaggtcttggttcagacatacacaccgaagctcacattgcctgaatcatcccttcatgctatgagcaaggcggtggcggccaccaccccggaacccaagcccgaggtccccagacgctctagctcattgatgtctccagtcacaactcgccctggccgttctaacagccacggtattccgctcccagatactcttgccaatgccgctcgcccagaccacgaatcacagaagcctgtacctgcctttatcccaaagaccggttccgagcaattagccagtgggagaggggagctcttttcgctcgcacgacgccttttggaagaaatcgcttgcagatgtggttggaacgagaagtggaaggatctggggctacttttcgacgaccaagatcaaggcgagggcgagatgactgaagtttccttagacggtgggacggacgagaagccggacgagaagccggacgagaagccggacgagaagccgaagggagagtctctggtttcgaatcctcttcttggaattgatcttcttgagctgaggactgctctgcgatcgagaaagactttccgctctcattacgagcagcttacggacttggtgtatcggcactatgttatggcgaaccgcacatattcagcccagacggctctcgccgacatggctcttttacgttatcgacagaatgattacaacgcggcggcctcctatttccaccaaatcatcccattctacgggaccaagaattggattttactggaaggcatcatgctcgaaatgtatgccagatgtctcgaacagctgaaacgaatcgaggagtacgtacgaacgatgttgcggcttcttgccaaattcgccgtgcacacgcactcgggtttgactgcgcgggagaagacgctcgacgcttcttcaatctttaccgaacagagcctggtttcccggtacgtggagaaactctttgaagcctcaggcacgcttcaaaaagaagtctcggctcctttcgccgacttctttgcagacttggaggtgaaaccaatcatcattcattacggtgacaaggatggatttcagatgcaacttagcctgcggtttttactggggaaacgaatcgagattgattcgatgaaggtgcggcttgtcagtgcgagcgggccgcatagcaacgagaactggatagaaactgccactaaggcgattattaagtcgtcgcccacgaaggttctcgttgactctacggtaagcttttctgacccatcgaagcttctcacgttgactgaaatcatataa

SEQ ID NO: 9134 - DNA, 282 bp, A.fumigatus
ctgaaatcatataaggctactttgcaaggaaagtactttgtcgaccgcctggaaatgcgagctggcaacatcctcttcaccctggctggcgggactcacccagcccttcctgtgggctttagggaggtgctcgacgccgaagaggccgatagtcggccctatgtctactgcttcccacgacccgagggattgcaggccaagatcacatctcctcatttagtcaatttggagcaaatgcggacggtcttcaccgcggggatcgaggggtcgatcataataaat

SEQ ID NO: 9135 - DNA, 708 bp, A.fumigatus
gttcgatctgtccggtccctccgcatcggcttcgttccagcccagcttgagacagacgagcgcaagccgtcgagcgatacctccaggagtgctccggtggctcaccgacgccatcagatccctggtctgcgtcaaacaccgtatttgaagatctacttcctccgatgcgatgacaatgaaagctataaggcaaccgctcgcaaggccttgcgggactggatcaaggcccacgcgtcgacgccgcaggccggcgcctcggcagcaagcaatcaggagaagcatgatgcgttcgagtggttgatcgtgcacgtggtacaagacggtgacggcaaggagaaggccgcgccggcgtcgaaatggggccggagcaccacgaccgtcctcgagaagatcaaggcggatttcaatggatcgtccaagtcggctgttgatcgggtggcgcagttacgtctgccccggccggggagcacgcagcggccgactgagctggcggatcaggtggaggacttagtggagaagatgaagaatgccattctggcgtcattcgatctccgcgtggcgcaatatgaggaggatatcaaggataatgactcgcagcggactctgcccggttggaatttttgcacgttctttatactcaacgaagggcttgcgataggcttcgacaatgtgggtttgttccaggatgccctgggtcgggtacgatga

SEQ ID NO: 9136 - DNA, 1431 bp, A.fumigatus
ttggaaaggtacaagggcaaacagctcgatctctctttagtcttccggctctctgggctagcttccggtgcgaaacttgaattagtgcagctctcccgatcgccttctatcgtcacggtcgctttacagctgcctgaggcagaagctcgaggtgttcccaacggacggcttttagacaagttccccagcacgacaacgttatggctagtgctgcgcaagttcgaggcaggtgttgcaggtggcggaccgactcgaaatttcaccggacgaggcgtcccagtcgccagtgccggcaacgagggatcaggacgcttattttatgagactccggtagttcagatcatgggacgagaactgtccacatttgaagatctccagaagtcgctagcgcagcttggtttcaatagtgggaatgtcctggtcagattaagtttccggaggacagaggaacctcttgaggtggctatggttaagatccaagattacttcaaagcatttgaggatgctgccccggaaccgcaagagacggccggtgtgccagcgcaacctaagaccgttgccgaaagccaacctggacaacaagtgccgagtgctgaacatgctgagcccctggatgctgtagcagcagcggcggcagcacctgcgctatcaacacaagaaccgggacctgattctcatccctccatcgcctccaccgaaccatctgctgtgacccagccgtcttcgcgaccagtcacagtcttctcagcaccgtccaacaccactccgcaggccgcgcgaatgacatataacgaagacgactacattccatctgtggaccaagcacaagcccaccagcgccgtctcaatgccgcctctcgccccgtccgtcttcccacggatgcagaaatcgcagccaaagcggcagaggaggaagagaagcgtgcagcggtcagagaagttgacgtcaaggtccgccttccggaccagagccagattgtctcgaagttcgggcaacaagataccggcgcaacgctctacggcttcgtaagaagttgtttgtcggagcaatttgccagcgagagtttcatactcacgtccttccctgctgggaccccgggtttaggtgcgaagaagattcagagtatcattcctgatacagaccagacgttcttgatcaaggatcttggcatgatcggtcgagtcctcgtcaccttctcttgggacgcaagtgcgtctcctgctgctcgatcaaccagagcaagtcttctgaagcctgagctcaggaaccgagcgcaggagctcaaggtcgagcagccgccagagttgatggatacttcgcaggatactctgcctgcgaaggtaggcggacttggcgaccgtgatcgagaaaagtctggacgcaaacctggcgggatacccaagtggttgaaattgccgggaaagaaatga

SEQ ID NO: 9137 - DNA, 534 bp, A.fumigatus
ctaaactaccatcctcacagccacatcaacccacccaaataccgctgtccccgctgctcaaccagaacctgctctctcccctgctcccgccgccataagctctggtcccagtgttccggcgtccgcgatccggccgcctacctgaagcgcagcgagctcgccacggaatccgccttcgaccgggacttcaacttcatcacgaagatcgagcgcagccttgagcgcgcggagcgagaagcggaggttagagggattccgttggatgggactacggctgctgatccggcggtgttgggtctggagcatgaacttgggcaggatggaccggatgccgaggcggggagcaagaggaaaaggcctgagcaggggggctatgtgaagggtgaagctgggtttgtgcgcggggcgcaggctgccggggtgagggttatcagggcgccgagggggatgagtaggaataaggcgaatgcgtcaaagtggaatcccaagaatgacttttctttctgggtggtgagagcggtgtcggtatgctaa

SEQ ID NO: 9138 - DNA, 546 bp, A.fumigatus
cagacccgacaagcgtcaagtctgcgttcgagaaaatcgcccagcagtacgctggtgtccctctcgcggcagccgtgttcaaccctgccggtggattcacgcgcaaacccttcctggagcttacagaggaaaaattctcccaggggttcgagaaccaagggtgagttttttttgtttccaacgacaattgtatgcatccaacggctgaatcgaaacagaaaaggagctttcaacttcgccaaaagcgctttgcctctcctgcttcaggcgcagggcttgcagcatccaccaacactaatcttcacgggagctacagccagcgtcaaagggtctgctaatttcgcagcctttgcaacgggcaaatttgctctacgagcgttggctcaatcactggcgcgagaattcgggccgaagggtgtccacgtttctcacgtcatcatcgatggggtcatagatattcccagaacgaaggcttggacattcgagcatgaagacgctaaacttgacccagacgctgtaagatgctttttcctcgtttggaattga

SEQ ID NO: 9139 - DNA, 309 bp, A.fumigatus
catgaacagggcgcttccattgccagacgcttcgccaaagcatactcggtggtggtacttagccggaacccggccaacttcgaacctcttgtgcaagagatcaactctagcggtggacaggccctaggaatcagtgcggacgtgacagacccgacaagcgtcaagtctgcgttcgagaaaatcgcccagcagtacgctggtgtccctctcgcggcagccgtgttcaaccctgccggtggattcacgcgcaaacccttcctggagcttacagaggaaaaattctcccaggggttcgagaaccaagggtga

SEQ ID NO: 9140 - DNA, 2241 bp, A.fumigatus
agaagaacgcccccgaaaccgcaaccggaacctgcaccagagcaaacggcacccgatgatgcctggggaggctgggatgttcccaagaaagagaagaacaataaaaaggggaaggcggctgaacctgagcccgagcccgaacccattcctgaatctgaacttgtacctgaacctgaacccgaacccgagcctgtgcccgagcctgcggccgaacctgaacctgagccggagccggagcctgaacctgaaaagaaagcctctggattgcccgatgaccctctttacgacaattgggtaaatttgtcgtcaaaggagcggaaaaaacgcgagaaggcattaaaaaagaaaggccttccgatacctggaaaggacatcgagattccaccaccagaagcagagcctgcgctagaagcggctcctgaacctcctttggaacccgaacctgagccagccgctgagcccgagccagaacctgagccggtcgttgaatcacaaccagagcctgagccagtttccgaaccagtacaggaagaacctgtagttgaggatagctggggtatctggacctccccaaaggacaagaagaagcccaagaagaacaagattgccgttgacccgccgccccctgccccaacacctccctcactaggcctggaccccgaccctcctgttccggaagaggtggcggaggatctcctattcgagaatgacaccaagccttctaaaggaaccaaaaagggatcctttggcgtggacgagactcccactaaagcagtgaggggattttgggcgacgttcggtgcagccacaatgggctccagaccaaaggctacaaggaaaagatcagaggagaagccaaagctcattgaacctgcaaaggaacctgggcccgaacaggaaccacctgtaccagccccggagcccctggctgatctgcttggggacattgggcatgcaccaatgcctgaagcgcccgagccgcctcttattgacgagccagccgcgccagccgcgccgccagcaaagagcacctctaaggccaagtcatccaccaagctttcagttgccgagcgcatcaaagccctcgaacaagccaaaaaagagaggctgaaagagaaggcgaaagctaaggaaaccgtatcaccaccggaaccccctaaccaagaacctgccgtagagatcccgcctgagcccgtcgaagcgcccaagatctctcgggaatcggtgccgggaagcttcccggatgcttttgaggacgacttccaggaacctccacctcctgctcctgaacccgagccggagccatctattgatccaccgcctgagcctgagcctgagcctgagcttgctccagccccggctcctttgtccaaaaaagcggagaagaagaaaaagaagaagggtaagctagtggagcccgagcctgagctgacaccagcgcctgagccagaaccagagccggaatctgcgcagcctgagccggaaccagaaccagaaccagcacctgcgcctgagcctgaacctgagcttgcacctgtaccagtacagctctcgaagactgagaaaaagaagaaaacgatggccaaggctgtcgaacctgaacccgcgccaccagaacctgagccagagccagagcgggcgcttgggcctgagcccgaaccggagccggagccggagcctgagcctgagcctgcgcctgagcctgctgccgagcctgtagacccacctacccaggagccaaaggccaccaagaaaaccaagaagagctccaagtccaaaatgagcgaaccggccatggaggtaccaccagctagagatgtacctgccgaagagcctggtgcagacgctggtggttcgcctactcctccacctgagcccgctgcaccaggaaaatcagcgaagaaagagcgcgctcgagttgagcgaactcctggtgttgcttcgtggggcttctggggcgctactcctgctcctaggaaatcagcccatagagaggtcaggtctagccgagcggaaccttcatccggcgaagtcgtacggtcaaagtccaccaaatattcaaggcgagaagaagtgccttatgaggcggaaaagacgtctggttctgacagagacaaacgacaagggagcaaagaggaccgggcgacgaccttctccaacttcatccttggcggtcctgcgccgaccagaatgaaggtcttcaccacggggctggaaggatcagcgtctcagttgaaatca

SEQ ID NO: 9141 - DNA, 1797 bp, A.fumigatus
ggcacttcttctcgccttgaatatttggtggactttgaccgtacgacttcgccggatgaaggttccgctcggctagacctgacctctctatgggctgatttcctaggagcaggagtagcgccccagaagccccacgaagcaacaccaggagttcgctcaactcgagcgcgctctttcttcgctgattttcctggtgcagcgggctcaggtggaggagtaggcgaaccaccagcgtctgcaccaggctcttcggcaggtacatctctagctggtggtacctccatggccggttcgctcattttggacttggagctcttcttggttttcttggtggcctttggctcctgggtaggtgggtctacaggctcggcagcaggctcaggcgcaggctcaggctcaggctccggctccggctccggttcgggctcaggcccaagcgcccgctctggctctggctcaggttctggtggcgcgggttcaggttcgacagccttggccatcgttttcttctttttctcagtcttcgagagctgtactggtacaggtgcaagctcaggttcaggctcaggcgcaggtgctggttctggttctggttccggctcaggctgcgcagattccggctctggttctggctcaggcgctggtgtcagctcaggctcgggctccactagcttacccttcttctttttcttcttctccgcttttttggacaaaggagccggggctggagcaagctcaggctcaggctcaggctcaggcggtggatcaatagatggctccggctcgggttcaggagcaggaggtggaggttcctggaagtcgtcctcaaaagcatccgggaagcttcccggcaccgattcccgagagatcttgggcgcttcgacgggctcaggcgggatctctacggcaggttcttggttagggggttccggtggtgatacggtttccttagctttcgccttctctttcagcctctcttttttggcttgttcgagggctttgatgcgctcggcaactgaaagcttggtggatgacttggccttagaggtgctctttgctggcggcgcggctggcgcggctggctcgtcaataagaggcggctcgggcgcttcaggcattggtgcatgcccaatgtccccaagcagatcagccaggggctccggggctggtacaggtggttcctgttcgggcccaggttcctttgcaggttcaatgagctttggcttctcctctgatcttttccttgtagcctttggtctggagcccattgtggctgcaccgaacgtcgcccaaaatcccctcactgctttagtgggagtctcgtccacgccaaaggatccctttttggttcctttagaaggcttggtgtcattctcgaataggagatcctccgccacctcttccggaacaggagggtcggggtccaggcctagtgagggaggtgttggggcagggggcggcgggtcaacggcaatcttgttcttcttgggcttcttcttgtcctttggggaggtccagataccccagctatcctcaactacaggttcttcctgtactggttcggaaactggctcaggctctggttgtgattcaacgaccggctcaggttctggctcgggctcagcggctggctcaggttcgggttccaaaggaggttcaggagccgcttctagcgcaggctctgcttctggtggtggaatctcgatgtcctttccaggtatcggaaggcctttcttttttaatgccttctcgcgttttttccgctcctttgacgacaaatttacccaattgtcgtaa

SEQ ID NO: 9142 - DNA, 420 bp, A.fumigatus
gtgggtctacaggctcggcagcaggctcaggcgcaggctcaggctcaggctccggctccggctccggttcgggctcaggcccaagcgcccgctctggctctggctcaggttctggtggcgcgggttcaggttcgacagccttggccatcgttttcttctttttctcagtcttcgagagctgtactggtacaggtgcaagctcaggttcaggctcaggcgcaggtgctggttctggttctggttccggctcaggctgcgcagattccggctctggttctggctcaggcgctggtgtcagctcaggctcgggctccactagcttacccttcttctttttcttcttctccgcttttttggacaaaggagccggggctggagcaagctcaggctcaggctcaggctcaggcggtggatcaatag

SEQ ID NO: 9143 - DNA, 720 bp, A.fumigatus
aaggcttggtgtcattctcgaataggagatcctccgccacctcttccggaacaggagggtcggggtccaggcctagtgagggaggtgttggggcagggggcggcgggtcaacggcaatcttgttcttcttgggcttcttcttgtcctttggggaggtccagataccccagctatcctcaactacaggttcttcctgtactggttcggaaactggctcaggctctggttgtgattcaacgaccggctcaggttctggctcgggctcagcggctggctcaggttcgggttccaaaggaggttcaggagccgcttctagcgcaggctctgcttctggtggtggaatctcgatgtcctttccaggtatcggaaggcctttcttttttaatgccttctcgcgttttttccgctcctttgacgacaaatttacccaattgtcgtaaagagggtcatcgggcaatccagaggctttcttttcaggttcaggctccggctccggctcaggttcaggttcggccgcaggctcgggcacaggctcgggttcgggttcaggttcaggtacaagttcagattcaggaatgggttcgggctcgggctcaggttcagccgccttcccctttttattgttcttctctttcttgggaacatcccagcctccccaggcatcatcgggtgccgtttgctctggtgcaggttccggttgcggtttcgggggcgttcttc

SEQ ID NO: 9144 - DNA, 777 bp, A.fumigatus
  unsure (214): Identity of nucleotide sequences at the above locations are unknown.
cctgttgaaggctcagagacgcctgcagatggcacccccgctgaagaaaacactgaaaagaaggaggaagcggagaaaaaggacgacaaacctgccaagcctagtgggccgacaccagcatatgtctctccggccgaatattcatcgcggagtcttccgcccaccctcccacagtccttggacagctccgtccccatccctttcccacatttgntgggtttcttgaatacaccaatcagactctaccgttacctgagccgacgccatatagccgatgagatcggaagggaagtcgctggtcttgtcctcgcctcgtccagcagaccatatcatgatggttccttcagctccgactccgaactgagcggcgcaatggttgacgccggtgcttcaactttgtcttcacccgatgacatgatgccttcatcttctgcaaagtacgagcagcaaaccgtcctcgaaaaggaagagtccgaatggcacaaatcagtgcacaagagggacgaggaaaaccctgacaaggagcgcgagtggatagatgatatcgtcctggacccacgcattgcatctcggatgcagcgctcccttctctccgctgacgaagaggcgcgctcacaacgcattactgagggcaaggaatacattctcggtgaagaaaggcccgcccctgtctccttctggcagcggatgtggatcaagtatggctacggggaggatgaagaaaccatcaggatgaagcccatcattggcaatcttgatggagcggatggcgaatga

SEQ ID NO: 9145 - DNA, 1719 bp, A.fumigatus
ggttacgtccaaagcaggagtgcgatgctgcaagctcgtccgggcttccgccagaactggacggcgttggcgattgcgcaccatcttgcgggtgatctcgaggaggcggagaaggttttgaccacgtacgaggagacgctgaaacaacagccgccgatatccgacatggagcactcagaggctgttttgtacaagaacatgatcatggcggaagcaggcaaggtccaacaggccttggaccaccttgagactattggatacagaattacggatgtgctcgcggtcatggaaatgaaagcagactaccttttgcgattggaccgaaaggcagaagccgaggccgcctacactgcccttcttgagcggaacccggagaactcgatctactatgacggtctaataagggcgaaggggatctcagaaagcgatcatgcagcgctaaaggcattctatgacgcttgggcggacaagcaccccagaggagatgctcctcgcagaattccactggacttcttggaaggcgaggagtttaaacaagcggcggatgcatacctgcagcgtatgctcaagaagggtgtgccatcactctttgcaaacatcaaatctctgtacaccaatcctagcaaacgcgacacggtacaggagcttgtggaaagctatgtgtcaggcaatgggacggcagaatcaaacgggtccgcggaaggagcggcaacaaaggatagcactgagttcctcgcttcgacttactacttccttgctcagcactataactaccacctgagtcgcaatctatcgaaggctatggagtgcgtcgacaaggccatcgaactagccccaaaggctgtcgagtaccagatgaccaaagccaggatatggaagcactacggcaaccttcaaaaggctgccgaagagatggagaaggctcgacttctggatgagaaggaccgctatatcaactctaaggcggcgaagtaccaactgcggaataacgacaacgaaaaggcacttgacaacatgagcaaatttaccaggaatgagaccgtcggaggggcattgggcgatcttcacgaaatgcagtgtgtttggtatcttaccgaggatggagagtcatatctacgacagaagaaacttggtctcgctttgaagcgcttccatggagtgaacaacatttttgatgtttggcaggaagatcaatttgacttccatagcttttcccttcgcaagggcatgatcagggcgtacgttgatatggtacggtgggaggatcgtttgcgcgaacatcccttctacaccagaatggctctctctgccatcaaagcatatattctactccatgacgaaccggatctggctcacggtccactgcctagcggactcaatggctcaggcgaccaagacgacgccgagaggaagaaggccctcaaaaaggccaagaaggaacagcaacgtctggagaagatcgaagccgaaaagcgtgaggcaagaaaagcggccgccgccactgcgaagggcgccgatggagagacgaagaaagaggatcctgaccctctgggcaacaagcttgtccagacgcaggacccgctcaaggatgcgaccaagttcttgacgcccttgttagagcatagcccaaagaatatcgaggcgcagtgtcttggatttgaggtatatctcagacagagtaagtacaattcacttgggatgcctttggaaattggctaa

SEQ ID NO: 9146 - DNA, 306 bp, A.fumigatus
gtacaattcacttgggatgcctttggaaattggctaaagcctttaatagaaaaatacgcacttgcgctcaaatgtcttgccgccgctcaccaaattgacgcaagcaacccgactctccatgttcagctcctgcgcttccgcaaagcccttgacagtctttctgagcctcttgcccctgaggtcgctgaggtcgtcaatactgaattcgaaaagctgctgcccaaatcgcagaatctcgaagagtggaacaactctttcttgtccgcccacaaggagagtcctctgtgcaacaccagcccagtctga

SEQ ID NO: 9147 - DNA, 219 bp, A.fumigatus
ggcgaccagtgccgaacaatagcaatcaaagctgtcgccaaagcgaatggactcgacctggatattcgcgaaacccccagaactcctgaccatctgagtatcagcaagctcggcaaggtccctgcctttcaaggtgccgatggcttcaagctgtttgaatgcatggccattgctctctacagtgagttacgatatcctgtgggcgtgatcgagaactga

SEQ ID NO: 9148 - DNA, 315 bp, A.fumigatus
  unsure (60),(68),(130): Identity of nucleotide sequences at the above locations are unknown.
cagccctcatcagtcacttctcagaatgaacaaaccactctttctcgaaaggacaagagngaatacgncgagatcatcaagtggatgtcttttttcaacaccgagatagtcatccttatgaccccaacanttactgcccagctgggtgtgaatccgtacgacagagaacaagtggaggtctttcgcacaatgacccacgattcgtccattgtgtccaggagtattgcaggaccgacattcctcggtggcgacagctctcctttgtggaactgtctgggccggaaacacttgcttggctttcaatcttctacggca

SEQ ID NO: 9149 - DNA, 666 bp, A.fumigatus
agcgactggtcatggcgattgcccagcttactgcaagccatctgcaccgtagtcattattgccggcatctggtggatgcccgagagtccgcgttggctgatgaacaaagggcggcatgaagaggctctggagatcctggtgaagtatcatgccgaaggtgatcacaatgacgagtttgttcagctcgagtactctgaaatcaaagcagctatcgctctcgacaaagaaatcggccacactggctgggtggactttttaagatccaaaggaaatcgcaagcggatcgctttgattacagctctcggcctcttcagtcagtggagtgggaatggtcttatctcttattacctcaaatatgtcatggacagcgtcggtatcaaggacgcgcagactcagctcggtatcaatgcaggcatgaagaccgagggcttggtcgtcaactttatctttgcctttttcattgacattctcggacgacgacctgtctatctgacctcgactattggcacattcgtcgttttcaacgcgtggaccattgtctcagcgcggtatgagattgcaccaaataaagcgctcggctatgcatttgtgttcctcacgttcctgtacggagtcttctatgatatcaagtcagtatcctcctgccatgctctgcacttttgctga

SEQ ID NO: 9150 - DNA, 381 bp, A.fumigatus
cgaatggataggtccggcctcatggcgaactatacaacggagatcctcccctacgggcttcgagccaagggcttcacctggctcaatttctgtgtcactgctgctctcttcttcaaccagtacattaatgccatcgcccttgatgccttggcttggaagtactacattgtgtactgtgtgttcctaggattcgaagtgttcgtgatttactccttcctcatcgaaacgcgatatacgcctatggaggaaattgccaaatatttcgatggcgaggatgctgttgatgtcggtcagattgctgctgcagacttgaaggagcagggtataatagcatcggacgacaagggtacggccaccattcacattgaaaagaatgagtag

SEQ ID NO: 9151 - DNA, 633 bp, A.fumigatus
  unsure (101),(124),(211),(234): Identity of nucleotide sequences at the above locations are unknown.
aagcaccatggaagggggcgcaagcacatggcgccgtcattcagttctgcagtggtacatgtattctcgtcaatgggagatgaccatgattcttttgtcantaccttgttgcaattgcagcaantgacccccgcccagctcttccatgcagtgaaatcgtatcgaccggaggtgggagaaaaggttctcacaaagcaagcaatgaaatttntacttgattttcaacgcgatccngatctccttgcccgcgagcagctgagactgcaaggcgccgcggagcaagggaccgcagacgaaccaggaccgaaagacggtcgtccagaaacccccaaacaagaccgaccttcgaacgccccagctcccgtcacccctgaggcatccacgcacagcatggcgtcgcctggttctgccagtgcgtcgccccgcccggggcagccatcacggcccgatgagcgaaacgggacgaactcggtgtttctggatccgtcacttactctacctttctccttacctaccagcactgacatgctgatcagctacggggcaggatggggaggaaccaaccgagaacgagcgcgaaagtacattcccacggtaccccccgaggttctgacccggttcgaccgcgattga

SEQ ID NO: 9152 - DNA, 237 bp, A.fumigatus
cccaagggaaaaaaagcgaccaaaaagtgcccaaccggaaaaagcctcgactgtcaaactggaaactcttcctttcttcctctcttcttcttttccttcatctccttttcttccatttctcgtccatcctccatcatctctaatatcctccctctccctttcaccctcttcgtccctttctcactttccttttttgttttccctttgatgactcaggtctttgcttgttgtgtttga

SEQ ID NO: 9153 - DNA, 234 bp, A.fumigatus
agaagaagtattactgcaaaacacctgcagtacctgctgagtttgcgcgagaaagagactccagacctgaacgacaacggaaaagaggccgtatcacaaatacaacagaaggtaagggccgagaatctctctaaggatggagacaggattttgcaatggcgaaaaaacccaaccgagatagctctaggcgacaacgatcggggcacagaccaagccagtggctgcactacttga

SEQ ID NO: 9154 - DNA, 387 bp, A.fumigatus
acccaggtggatagttcaaaattggactctttcaagatggaataccatggtgacggaaatgggtctggtcacccctctcagtctcaggagtccgcctatcctgacattgatgagacgttgcagtacccttggcaaggttctcagccagccgtcgcaggcgaatcctcacttcactccgtaattgatcctcgcctttacaaggatctgttttcgcggagcgcctctggccagcaagccatggagtatggggacgaggaggatgcacaggagtattcgcaactggatggctcggcggaggactccacttacgaattctcagcagaagaatcttcaacgtcagtttgttcatccgaaataaccttacccctgatcactgatgttttctag

SEQ ID NO: 9155 - DNA, 930 bp, A.fumigatus
tcactgatgttttctagggaagaggagccttcagatgtagaagagaatgctgcagacgaaggtgatgatgattcggtcggtcggagacgacgccgcagaagaggcacggggcccttttctggacgatggggcgcccgtggcgggaaaggaatcaagagaggacctcgtaagccgctggagcccagtgcggaattcaagatgctgcactcggacgctacctcggcctttatcgatggcgactatgaaaccgccattgatcttgtgaagcgtgcaatccatatcaaccctgagatgtttgctgctcactcgctgctgtcggagatctttctagctcagggccagaaagacaaagctctaacggcgctgttcagcggggctcatacgcgaccgagggatgcatcggtgtggttcaaagtagcgcaaatgatacttgatcgagccggcgatgaccgtccagcagccctgaacgatgtcatctattgcctgagccgcgtcattgatattgaacccaagaactataatgcgaggtttcagagagctgctgtctatcgagagttgggccataatggccgggctgtcacggagtacgaaagaatcctcaaggaagttccgcatcatccacgggctttgcgaaatctggcagaagcctacattgatctcaacgaagttacgaaggctgtagatcagtggacggaaagtgttgagtactacaagtcctttgagccggaagatgctcccgacttttcctggtccgacgccaacatatacgccgaattgttcagctatctgggccgatatgaagaaggattaaaggctcttaagtctgtctcacgatggcttcttggtcgccgagatgatactatgtgggaaaatttcaacgaagacgaccgcgcctgggagttttcaccagacggagccagatcagcgcgt

SEQ ID NO: 9156 - DNA, 912 bp, A.fumigatus
ggatggactggcgcggctccttccagccccgtggtgaagactgggccactccataaccctcacttcatccagaagattcttgacatgctgcccgacgtcgatagagatatctatcataccgtcgagcgcatcgagggcatgttaaccacagctcttgaagaggatctgaacctggacacaatttcgagctctaccccgacgggcacccttgcagccgaaaaggagctcacggaagtgtccacgtcccgcgaatattcggccattattcctcgtttggatccggccctccgggatccgtttccattctatttcactctgagttctctggcaaaagttctacacacgtcaactatatcagccgatgcgttccgtggagctctccgttccttaggctaccgatcaacgcgcagccatgcaaagccaaatactattcgtacagatgcaccctgggacgtcatttgggaaatcatgcgagagtgggtgagacaaaaagcccctgtcaaagaaggagcaatccgccctggcactcctggagcggcgatcatggcgaagagtcgagaaaattctcgaaaagataaaggagaagactcactcaatatattgagggaagagctcatgtctgcggctgaaagtggaaaggatatcagtgacctagtgacgaaagtcgaagctgcgatctaccgctttagccatagataccctccccgcatccaaggcgctgagctgcgtcagcagaccgaagggccccagtccccacagacagcacctgcagttaagcaaaatctgaacacgttagaggtcgttttcgatgaggccctgggcagagaggcgtctcattccaagaaacggcttgtccggtatcaaatcaatcctcgggctaattggggccctctcaaccgggcgtccggctga

SEQ ID NO: 9157 - DNA, 1293 bp, A.fumigatus
accactgcacgcgaaaacccaggcaaattcccttcgcctttgcttgatattaagtaccgtcgccgccaattggacctgcgtaggaagcagattaaggaatggcaagagtccgaactgctctaccttcaagaagaaattgaggccatgaaagcgcaagggcttgcgtcatctgacctatcagattacatgcaggaacgtgcccgccacattgaacgggaggctgtacggcaagagaaggatgctcaattcagcctgggcaacaacttctggaaacaagattctcgtattgcgcctctgcgtggtgcacttgctacttggggtcttacgatcgatgatataggtgttgcttcgttccacggtacttctacggttgcaaatgacaagaacgagtccgatgtcatctgccagcaaatgaaacacctgggccgtaagaagggaaatgccgttcttggtatattccagaagtaccttactggtcaccccaagggagccgccggtgcatggatgttcaatggttgcctgcaagttctcgacagcggtctggtacctggcaatcgcaatgcagacaacgttgataaggtcatggagaagttcgattacattgtttatcctagccgtagcatccaaacagacggaatcaaagcgttctctgtcacgtctttcggtttcggtcagaagggtgctcaagttatcggcattcaccccaagtacctctacgcgaccctggatcgctctcagttcgaggcgtacaaggcgaaggttgagtctcgtcaaaagaaggcgtatcgcttcttccataatggtctgattaacaacagcatcttcgttgctaagaacaaggcgccctacgaagataacatccagagcaacgttttcctcaatccagactaccgagtggccgttgataagaagacatctgaattgaaatttccacccctgcctccaaaggccagcgacaaggatgctgagagcaccagacaggtggttgagtcgcttgcgaaggcgcatgccgaagacaactccaggataggggtggacgtggagaacattgacgccgtcaacattgaaaatgaaaccttcatcgaaaggaacttcactgccagtgagcaggaatactgtcgcaaggcatcatcgccacagtcatcattcgctggccgatggagcgccaaagaggcagttttcaaatcgttgggcgtatgcagcaagggtgccggtgcgcctctgaaagatatcgagattttgagtgatacaagcggagcccccgtggtcaacgtaagtttactcccattctga

SEQ ID NO: 9158 - DNA, 318 bp, A.fumigatus
actgaaactcttcacatcgtcctcaccatgcagattttcgtcaagactctcacgggcaagaccatcaccttggaggtcgagtccagcgacactattgacaatgtcaagtcgaagattcaggataaggagggtatccctcctgaccagcagcgcttgattttcgctggcaagcagctcgaggatggccgcactctttccgattataacatccagaaggaatctactctgcacctggttctccgtcttcgtggtggcatgcaaatctgtaagttactttgccttctgcccaattttgccaccctggtggccacattttag

SEQ ID NO: 9159 - DNA, 756 bp, A.fumigatus
gttactttgccttctgcccaattttgccaccctggtggccacattttagggtcgcccgctgactcattgataacagtcgtcaagaccctcactggcaagaccattactctcgaggtggaatccagcgataccattgataacgttaagtcgaagatccaggacaaggagggtatccctcctgaccagcagcgtctgattttcgctggcaagcagttggaggatggccgcaccttgtccgactataacattcagaaggaatcgactctccacctcgtccttcgtcttcgtggtggtatgcaaatcttcgttaagactctcacgggaaagactatcacattagaagtagagtcttcagacaccatcgacaatgtcaagagcaagatccaggataaggagggtatccctcctgatcaacagcgtctcatctttgctggaaagcaacttgaagatggccgtaccttgtctgattacaatatccaaaaggaatccacactgcatctggtcctccgtctgcgtggtggcatgcagatcttcgtcaagactctcaccggaaagaccattaccctggaggtggagtcctccgacacgattgacaacgtgaagagcaagatccaagacaaggagggcatccctcctgaccagcagcgtctcatcttcgctggtaagcagttggaagatgggaggaccccctccgattacaatattcaaaaggagagcacgctccacctggtgctgcgtctgcgtggtggatgctaa

SEQ ID NO: 9160 - DNA, 324 bp, A.fumigatus
cttacagatttgcatgccaccacgaagacggagaaccaggtgcagagtagattccttctggatgttataatcggaaagagtgcggccatcctcgagctgcttgccagcgaaaatcaagcgctgctggtcaggagggataccctccttatcctgaatcttcgacttgacattgtcaatagtgtcgctggactcgacctccaaggtgatggtcttgcccgtgagagtcttgacgaaaatctgcatggtgaggacgatgtgaagagtttcagtctattcgttgaaaggatgatgacagagtattcagcagtaggaggaagctattga

SEQ ID NO: 9161 - DNA, 423 bp, A.fumigatus
aagcaaactttctcccatttagcatccaccacgcagacgcagcaccaggtggagcgtgctctccttttgaatattgtaatcggagggggtcctcccatcttccaactgcttaccagcgaagatgagacgctgctggtcaggagggatgccctccttgtcttggatcttgctcttcacgttgtcaatcgtgtcggaggactccacctccagggtaatggtctttccggtgagagtcttgacgaagatctgcatgccaccacgcagacggaggaccagatgcagtgtggattccttttggatattgtaatcagacaaggtacggccatcttcaagttgctttccagcaaagatgagacgctgttgatcaggagggataccctccttatcctggatcttgctcttgacattgtcgatggtgtctga

SEQ ID NO: 9162 - DNA, 693 bp, A.fumigatus
gcaccgtttccccaaagggttgtgatcaccaggagcggattccccaaattctacagcaacgggttgtacttcgaactcgcaactaccacagagggtttcatcgataagtggctctggaagctattccggcgctttctcacgtatgtatttttgaagttctcagagcgcagcatctgtctaacatggcacaggttccccatgccaacaatctgcctgctgaacgggcacgccttcgcaggagggctcatgctggccatgtaccacgactaccggatccagaatcctaccaaggggtttctgtgcatcaacgagctcgagttcggggtgcccctgcagagccccatgatgagcatcttccgggagaaattgtccccgtctgccttccgggatctaattcttgaggcgagacggttcgcgggtccacagtctgttgctgtgggattggtggacggcgtaggcgggcttgaggagacgctgcaattgattcgggagcgcggattgcagaccaaggcggcgacggggatctatggcacgatgaaggaggagatgtaccggcatacgctggacatcttggataaccatgcgggtaaccttgcgtggagggagcaggtggaggagaagaaagggacgcgagaagaggctgcgttgagagctgtggaggcgtttgagaagcagagaaatgcgaagctttaa

SEQ ID NO: 9163 - DNA, 351 bp, A.fumigatus
tctcccacacacttctctgcctctatcgttcgtctccttttgacttcgttcatacaggcgcctcacccaccacgcatgatgattctcagtgcgttcattctccttctcactctggtcactgctctggcccccgcatatgacttcatcatcgtcggaggaggagtcagcggccttgtcgtcgccaaccgtctctccgaggaccccaacgtctccgttctcatcatcgaagccggtccatcagtccttgacaacgagaatgtgaccgatgtcgacgcgtactcccgtgcgtttggtaccgaaatagactggcagttcatcagtgaatcacagctcttcggcggagaaccatag

SEQ ID NO: 9164 - DNA, 714 bp, A.fumigatus
  unsure (635): Identity of nucleotide sequences at the above locations are unknown.
atcctccgggccggacgagcgctgggtggcgggagcgcaatcaatggtgaatcatccccatccggatatggatatgaatatgcagaagagctaagactgcgtttaggaatggcctacgtgcgtgctgaggacgtccaactggacgcttggcagtccatcggcaatgagcgctggaactggacgagtctgtttccttactatctcaagagcgagaacctgaccttgccgacagccgtgcagacggatgcaggcgcaacatacgatgcctttgcgcatggctcccgcggtcccctcaaggttgctttcccacgtatgcagagtggtgataatgatctgacacctgcggtcaaccagacgcttcaggctgcggggattccgtggaacgtagatgtgaatgctgggcgcatgcgtggatttagtatttacccctggaccatcgatgaggaggcgtatattcggtatgatgccgctcgggcttatttttggccgtttcagtcgcgatcgaacctgcatgcctggttgaacacgagggtgaatcggattgtttggagagacgtgcctggtggagagaacacccgtgcatctggcgtggatgttacttcacagcatggcactgtaagtgttgtgatgtcganaagagaggtgattctctcggctggagcgctcaagtcgcccgccattcttgagctttccgggatcgggaatccacggtga

SEQ ID NO: 9165 - DNA, 846 bp, A.fumigatus
  unsure (606),(663): Identity of nucleotide sequences at the above locations are unknown.
gttgcttctcggtcttatatccgcgataaacgggctggagctgaggcactgaaactcccttatagcatcctcaatcaacacaacatccccgttcacgtctcactcccaggcgtcggagaaaacttacaggatcagatgaacactctcatgacagcgtcgacccattcacccatcaccggcggcagaaccgtcactttcgcatcggccacggacatcttcagtcaggatatctcctccctcgccaacctcacacataccaagctcccctcgtacgctgccctcgtcgcaaacatgagcaacggagccatgcaacccgaacacctgcgggctgtattccaagtgcaacacgaccttatcttcaagaacaacattcccattgcagaaataatcttcaagcccggcggcgagaaaaccgtcaacgccgggttctggggcctcctcccctttgcacgcgggaacgtgcacatccgctcttctgatccggcagcccagcccgcgatcagtcccaattacggcctgttggactgggatatccagctgcaggttgcaattgccaagttcatccggcggatgtttcgctctgcgccgcttgaggggatgattgangaggaatcgaggcctggtctgtcggcggtgcctggggatgccgcggatgaagtgtgngggaactggttggaagataactgtccgtggggtaaatttctctttttcccaagagatgtctctaactccattgctgccaatgcgtccaatttccctgccatcgggccacacgggccagatgccccgtcctctagggtggagtcttcaacaatcggttgcaggtgttccggccggccaaatttc

SEQ ID NO: 9166 - DNA, 390 bp, A.fumigatus
cttaaagcttcgcatttctctgcttctcaaacgcctccacagctctcaacgcagcctcttctcgcgtccctttcttctcctccacctgctccctccacgcaaggttacccgcatggttatccaagatgtccagcgtatgccggtacatctcctccttcatcgtgccatagatccccgtcgccgccttggtctgcaatccgcgctcccgaatcaattgcagcgtctcctcaagcccgcctacgccgtccaccaatcccacagcaacagactgtggacccgcgaaccgtctcgcctcaagaattagatcccggaaggcagacggggacaatttctcccggaagatgctcatcatggggctctgcaggggcaccccgaactcgagctcgttga

SEQ ID NO: 9167 - DNA, 1149 bp, A.fumigatus
cacctatcctgctgccaacctttgctggtttcagccttcggtgttgaatactggtcgttgattcgaagctccgtcgttacgcctcttcttttggagactaacagcccacttcgtaccgtcactcgttttgtctcggagagctccctgtggtgcccttcccgacatcctatcgttttcaggatatattgcctgtcattcgcttctttaggctgttgtgttccgttgcagttgctgcaacattttcaaactggcttactcgaagacacacggtattctggtaagccaaagtctcgaatttctgtttctctcgttgctgcccaactgccactgctctcttccctttccccctttttgatcccgtcaatttgtcaatgttggttcaatccgtgtctctccgcgaaactccttcggacagtgtgctcttatcccttctttcttgtgctgacctctttgccttcacagttcgaccccgacttccaaacacctctgattctagacgagtcgctggatttctcggatcctgaagagtcacgatttgccggcgcgttttcagacggcctcctggccaagtctgagcccttcctgtctatgtcgacttttcagaaacccccgtcagcggccttgctaggtaagtttgtgccctctttcttccttgagcactgctgctcctttggcaaatgcaggcagacggatcggctgactctctcagattacgactctgcgcgatctctgcataacggtgcttcctattccacctatggccagactccttatgtgaccgctacctcgctcgttccatcccccatggctgatcaagccagccaaatttccgattgtggcccatatctgccaaatcaggagtacgctagctcttacgaggagagccggtcgcccatgcttggtgcagagtcccgtcagctgccggaggtcgtctcatataatccccagagaggttcagaaggaacacgggtatttgtgcaaattcagtgcccacatgatctccactcatctccgtatgcgactctctatcttgcctttgggtcgaagaagtgtgaatgtcttccacatttcctcggcttgcaggggtcgtcctttcagaatgccctctccgttgacacccccgcctttttggccacgggaatccccgtc

SEQ ID NO: 9168 - DNA, 612 bp, A.fumigatus
cccccagaccaatggccagaagatccccaagctcttcacgcccttgaccatccgtggcgtcaccttccagaaccgccttggtgtaagtccgtttgcccttgctcatatcgacgaaagctaatcccccgtcagctcgcgcccctctgccaatactccgcccaggacggccacatgaccgactaccacatcgcccatctgggtgggatcgcccaacgcggacccggcctgatgctgattgaggcgaccgccgtccagcccgaaggccgcatcacccctcaggatgtcggtctgtggaaggactcccagatcgccccgatgcgccgggtcatcgacttcgtgcacagccagggccagaagatcggcgtgcagcttgcccatgccggccggaaagccaccaccgttgcgccctggatctcattctcggccatcgcgacggagaaggtcggcggatggccggaccgcgtcaaagggcccggcgatatcccctttgcggagcccttcgccaagcccaaggccatgacgctggatgagatcgagcagttcaagaaggactgggtggcggccacgaagcgcgccatcgccgccggtgcggactttgtcgagattcacaat

SEQ ID NO: 9169 - DNA, 276 bp, A.fumigatus
agatcaccgcaccgaggagtttcttaccaacccatcaataaccatccacaatctcctacaacaaaaatgactgtcgccgatatcgacgttcctcctgccgagggcatcccctacttcactccggcccagaaccctcctgccggtacggcagctaacccccagaccaatggccagaagatccccaagctcttcacgcccttgaccatccgtggcgtcaccttccagaaccgccttggtgtaagtccgtttgcccttgctcatatcgacgaaagctaa

SEQ ID NO: 9170 - DNA, 258 bp, A.fumigatus
ttattcgggtatattaggtacgccataggattctcagatcttgaagttgtgatgaagcgtcttgttgatgagggaaagtatgcagacatgacaatagcttgtttaggacgcgaaattcaaaggccacgggtggtcaaggaactgactaatcccaagtcatggcgggttatgcattttagtagatggactaaggtacggattctgctaccttatgttaactacaaggtcaaaagtttgtgtacccttcaaaaatcgtaa

SEQ ID NO: 9171 - DNA, 288 bp, A.fumigatus
gagtggtttgaaactcattgcatctgggtcatagaatggccggatcatttgcctaatttaaacctaattaagcacctctggaatctctcaaagaaaaagccattacagctctatccagaactcttcctaggaggcagatctaagatagattggacgtgtttttgcaatgctattatagaggcatgggaggctaagcctatccctcaggtgattaatgggctcatctactcaatgccacatagattacgtgcagatagccaggcaagggcctggtctactaactattga

SEQ ID NO: 9172 - DNA, 258 bp, A.fumigatus
tatacccgaataattatcatcaactactgcatgactttgcagatggaagcacccaccagagtgaatctaaataatgggcgcagaagcactacggcggttagattacattatattgaagatgacaagaagcgaaatcaggctgggacaactgcaatccaaagtcaaaacattgagcaaatagtggctttttccattaagattctaatatacagacgtctctccgagcctgaacctaatatagtcatcgagtcgggttga

SEQ ID NO: 9173 - DNA, 255 bp, A.fumigatus
gttgaaacgcattcattgcacggacccttccagccccgcggtgaagacgcgcagctactgatgacgcaggacccgtttattatatcgggaagcaaagttctcgaaggaatgggcacatatctggtgaccagcgtgggtccgcactcgacgtatggccggatcatggtgtctctaggaacagagagtgctccaacgcccctccaggtcaaattgggaaagctagcgaactggatcggctggtttggactggggtag

SEQ ID NO: 9174 - DNA, 483 bp, A.fumigatus
gtgtccattaccacacacacggaggtcggaacttaccgcacaggtgacaacatccacacggcgttatccatcgccatctcctgcgggatcaagacggaggacggcatcgcaatggaaggacccgaccttcggcagctgaccgaggcgcagttgaagacgatcattccacggctccaagtcctggctcgctcctcacccagtgacaaacagctcctcgttgagcatctcaaacagcttggtgagacggtggccgtgacaggcgatgggaccaacgacgggccggctctcaaggccgccgatgtagggttctcgatgggcctgagtgggactgaggtcgcgcgtgaagcaagctcgattattctccttgacgacaactttcgatcgattgtcacggccatcgcctggggccggtgtgtcaacgatgctgtcgccaagtttctgcaggtgtgctgcgtctgcttctctcgccgtccatgtggctga

SEQ ID NO: 9175 - DNA, 1038 bp, A.fumigatus
tgcctcacagaaggactacccctagctgtgaccctggccctagcgtttgcgaccgcccgtatgctcaaggaaaacaatctcgtgcggcagctacgtgcctgtgaaacgatgggaaacgccaccgtgatatgctcggataagacaggcactctgacgcagaacaggatgacggtggtggcgggcttcctgagtcccagtgagtcgttcggccaactcccgctggagactgcatctcagccacagcatgacgacatttcgggtgtgacgcagaggtacccggcagccttgaaggctctgctcgtcaagagcctcgtagtcaactcgacggcattcgaggagctgcgcgagaacgaaacggtcttggtggggaataacaccgaaattgcgctgcttcgatttgcacagacagctcttgatgtgcgggatgtgtctacggagcgagaaagaaccgatatcgaacaggtctatccatttgactcggctcggaaggcgatggcggtcgtgtatcgtttgggaacagggcaccgactgctcgtcaagggcgccgcagaagtcgtcctcggggcctgcactgaatcgacacttccaggactatcggataaaacgtcattagccagagcacagatgtcgtgcgaggacaggcggacaatccatgaccaaatcgatatcttttctcgagcctcgttgcggacgatcgcaattgcataccgcgagcttccagcctggaattctgagcaggctggagacaacgcgaaagtctcacctgatttcgatgccttgttcaataatctgacctggatcggggcattcggcatccacgacccgctaaggcccgaagtccccgaagccattcggacgtgccacacggcaggcgtccaggtcaaaatggttaccggtgagtgtccattaccacacacacggaggtcggaacttaccgcacaggtgacaacatccacacggcgttatccatcgccatctcctgcgggatcaagacggaggacggcatcgcaatggaaggacccgaccttcggcagctga

SEQ ID NO: 9176 - DNA, 471 bp, A.fumigatus
cgacaactttcgatcgattgtcacggccatcgcctggggccggtgtgtcaacgatgctgtcgccaagtttctgcaggtgtgctgcgtctgcttctctcgccgtccatgtggctgacacagccagtttcaaatcacggtcaacatcactgccgtctgtttgactgtcgtgacggccatttacagcagctccaacgaaagtgtcttcaaggcggtccagttgctatggctgaatctaataatggacacctttgccgctctggccttgtaaggcctcctgactgtaagcctccatggcacgagagtactaacatcccgcgtggtcccagagcaaccgaccctcccaccgcggatatcctacagcgaccgccccggccacgaagcgcgcctttgttcacggtgaccatgtggaagctgatgctggggcagtcaatctgtcttcacacggggctggaaggatccgcggtggcgcaa

SEQ ID NO: 9177 - DNA, 498 bp, A.fumigatus
cgccgtgtggatgttgtcacctgtgcggtaagttccgacctccgtgtgtgtggtaatggacactcaccggtaaccattttgacctggacgcctgccgtgtggcacgtccgaatggcttcggggacttcgggccttagcgggtcgtggatgccgaatgccccgatccaggtcagattattgaacaaggcatcgaaatcaggtgagactttcgcgttgtctccagcctgctcagaattccaggctggaagctcgcggtatgcaattgcgatcgtccgcaacgaggctcgagaaaagatatcgatttggtcatggattgtccgcctgtcctcgcacgacatctgtgctctggctaatgacgttttatccgatagtcctggaagtgtcgattcagtgcaggccccgaggacgacttctgcggcgcccttgacgagcagtcggtgccctgttcccaaacgatacacgaccgccatcgccttccgagccgagtcaaatggatag

SEQ ID NO: 9178 - DNA, 507 bp, A.fumigatus
gatgcagtctccagcgggagttggccgaacgactcactgggactcaggaagcccgccaccaccgtcatcctgttctgcgtcagagtgcctgtcttatccgagcatatcacggtggcgtttcccatcgtttcacaggcacgtagctgccgcacgagattgttttccttgagcatacgggcggtcgcaaacgctagggccagggtcacagctaggggtagtccttctgtgaggcatcaacaaagcggatcgaggagggatgggaagcgggtgcagaccaggaattgcaaccacgatcactgtcaccgttactatgagaatatccataaactcttgtccttttacagtggacggcgcatcgttatctggaagttgagccaagaagcggaagaggagcacgaagaagaggagaagagccgccctgcactggctgtcagctactatcccgcacgcagttctttgttcaagggatacctaccccagtccaaaccagccgatccagttcgctag

SEQ ID NO: 9179 - DNA, 462 bp, A.fumigatus
aactggctgtgtcagccacatggacggcgagagaagcagacgcagcacacctgcagaaacttggcgacagcatcgttgacacaccggccccaggcgatggccgtgacaatcgatcgaaagttgtcgtcaaggagaataatcgagcttgcttcacgcgcgacctcagtcccactcaggcccatcgagaaccctacatcggcggccttgagagccggcccgtcgttggtcccatcgcctgtcacggccaccgtctcaccaagctgtttgagatgctcaacgaggagctgtttgtcactgggtgaggagcgagccaggacttggagccgtggaatgatcgtcttcaactgcgcctcggtcagctgccgaaggtcgggtccttccattgcgatgccgtcctccgtcttgatcccgcaggagatggcgatggataacgccgtgtggatgttgtcacctgtgcggtaa

SEQ ID NO: 9180 - DNA, 228 bp, A.fumigatus
  unsure (21),(35),(70),(120),(121),(146),(151),(174),(177),(225): Identity of nucleotide sequences at the above locations are unknown.
cctgattacccgaagagaagngaagttgttcagantgcccctaaagcgtcttccttccccaaggagcccnacgaccgcgtctttccgtatccggcagagctttccagttgcgtctccgtnntagatcctccagaaacattcaacgntaatntgccttcgtcaacacagtgctcngtntcccaccaccctccttccccgctcatgagcacaccaagcccgaggagntga

SEQ ID NO: 9181 - DNA, 816 bp, A.fumigatus
  unsure (7): Identity of nucleotide sequences at the above locations are unknown.
cctgaanatcagtgtcgaacagcttcctctcgacgtaacgctcccaagattccggagccataccggtctcaaacaaacaatgtggagacagtttacactcttgaccttatatctaccgaccctccaagcagactacatgcaacccctcctccccttgaccgacctgtcgaaccgcataggacaaatgcaacactcttaacaccccatggctcctctctcgtcgcctacccgcccggctcggagagtctctccccctccaagaccggtcgaccccgtccgaccgctacgaccggtaccctcctcgagaaagccgtagcacatctaattgctacagacgcgcgcctggagccgcttataaggcgacatccgtgtcctctattttctcctgagggactggccgaggaaatcgaccccttccgcagtctcgtcagcagtatcatcggacaacaggtgtcaggcgctgcagcccgatctatcaaggacaaattcgtggctttgttcaacaaggacaatgagggacaggatcctgcgaagccgcctcggttccccacaccagaggaggtcgtccaatgcgacctcgctacgttacgtactgctggactctcccagcgaaaagccgaatatatccacgggctatcccagaaattcgctaccggagaactcagtgcgaggatgttgctcaatgccagtgacgaagagctcgtggagaagttgactgctgtccgagggctaggccgatggtccgttgagatgttcgcgtgctttgcgttaaagcgcattgatgtcttttccactggagatctcggcgtgcagtaa

SEQ ID NO: 9182 - DNA, 237 bp, A.fumigatus
  unsure (81),(129),(132),(155),(160),(185),(186),(236): Identity of nucleotide sequences at the above locations are unknown.
caaatccgcgccaccggattggccaatactttatgcggggaattgacgaggccggattatggaattgcgagatcgactcanctcctcgggcttggtgtgctcatgagcggggaaggagggtggtggganacngagcactgtgttgacgaaggcanattancgttgaatgtttctggaggatctannacggagacgcaactggaaagctctgccggatacggaaagacgcggtcgtng

SEQ ID NO: 9183 - DNA, 945 bp, A.fumigatus
tacaacatggtgatgctaactttcggccgctttcttagtcgctcctaccctcacagccgggaaggccctacaatcctctcatttcgacaacaactcatcatggagggcaccggactcgatgatgaccaagatagaaggacaaaccagatgacgggcgtgcatgactcacctgtgttgcaacccgcatcaatggaagatatggatgccttctatgacacagatgaatatgcggactcctccaatcgctcatattcgccgccagcctctcctcctaggctgtcgcgaaatccttccttttcgtatcaggatgattgggagacgtttccgccgctagacaaactcaccgtgtttgacttgcttgacaacttttcactctcccagaaactcgagaaatggcaacaggcgatcaatgtgcagagagagaaggtcagaaagcagcgcgagaagctgaaatctacctcaatgaacgcaaaggatcgagtggtcggagaatggaagcggcgggttcccacagccgatgagcaattggccaaatatcgccgtcggatgagtgatggtgtcaagcggctggagaagcagtggaatgccacggccacggtgacactacgcgagaaggtttcgttcatcgcaggcgttctcaatatcttcgtcagcggctacctcattggagcctaccccgaatacttctacatctggttcagcgtgcagttggcctacttcatgccgatccgatactatggatatcacaaaaagggatatcattatttccttgccgatctttgctactttgtcaatatgctctgcatgctcagtatctgggtctttccgaggtccaagagactatttatcagcaccttctgcctcacttttggaaacaatgccgttgctattgcaatgtggcgaaactctatggtcttccacagcatggataaggtcgtgaggtag

SEQ ID NO: 9184 - DNA, 807 bp, A.fumigatus
gtgccgttgaggaatttcccggcaaaggatcattcgctgacgtgtctcatgcgcagtctcttcattcacatcatgccgccagttaccttacactgtctcgtccatctcactcccgcggaagtgctacgagagagatttccggccgtctacgacatcaagttcagcaaacctggctcttccaaccactattctcttctttccatgatgctgtgggcaactgtgccttacatgttctggcagctgacctatcattttttcattactgtgcgccgtgccgagaagatcgccgctgggcgtcctaccagcttcacgtggcttcgcaaatcctacgcgaagacctggattgggaagtttgtgatcagtcttcccgaatcattgcaatcgcctgcctttatgatgattcagtacatttatgcgcttctgaccatgattccttgtcctctctggttccggttccgatgggccagcggtgttttcttgacagccctattcgttttgagtatccacaatggtgccacttactacattgacatctttggcaaacgtttccagaaggagctggaggagttgaagaaagatgttgcgcgctggcagggctctccggctggtacgaccagctcgacgctaccgatcctgaacaacgcttcttccgcaggggctggcatcttggaggactcagcatctgtgcacaaggacagcgacaagtcaagtctcgacaagatccccccgcttgactctagtgcggcgtcgactgccatagatggctccaatctcgcggccgctgccaatacgcgagagagaaagtag

SEQ ID NO: 9185 - DNA, 249 bp, A.fumigatus
gccatgcacgacatcacgctcgatcccttgctcctcggaaacctcaccggcaaaactgctgtcctgaccggtggcgccggggggattggcaccgccatcgcaaaactactactggaacatggcgcgaatgtcgtagtggccgatttggaacacacacggcccatagtggagacaatgatcgtggatcttcctggttcgtgcaagggacgagtgcagttcgtcgcaacgaacattgtgaagtgggattag

SEQ ID NO: 9186 - DNA, 591 bp, A.fumigatus
gtcacggcactcttccagtccgctaaggagcggttcggttcaatagaactggtaatcgccaacgcgggagtcatggagagaacgccggtgttggacatggatcagatcgacgaacatggaaacctggaagagtcgcacgagttttgcaaagtcattgatataaatgtgaagggaaccatgaactgcctccgccatgctatctttagtatgaaggggaaccaaccatgctacccagatggatcgcgcggcgcagtggtccttgtgagttcgatttcgggctactttggtggcaccggtgtatcagggtatatcacttcgaagcacgcggtgacggggatgctgcgggggtcgcagctggttgcgagccaggacgacattcgagtcaacgcggttgctccgtttgttactcccacggccatggcaggcggattttccgaggcgtggcaagcgaaaggccttccaatcaatacgactgaaggtgtagccacagtcgtgctgacgctggccgtgaaccctgcagaaaagggatcttgctacatagtatggcgttccatttggcaccgtgacaacggtgctctccttgatccctaa

SEQ ID NO: 9187 - DNA, 309 bp, A.fumigatus
aaggcttgtccttctatcccggcggttaggacttcctactgggaagacagtctgcgcggtcgctgggtatgctactgcaggactgacatcaatattacatttcttctatacaacggagaccaactggacggctgggcagctgcagaggctctgggcgatttgaatcagtcggccctggctaggacgtatcgattgcatggtagaaacgacgtcatatgtgagctattgctcgaaaataggactacaagtactgtgcaattgaaagtgttacgtgttaagcgtatcattacaatgggcatcagtagatga

SEQ ID NO: 9188 - DNA, 324 bp, A.fumigatus
gctggtgcacccgctggtcatgatggtagtgttgatgcaaccaagtatggaccaatctctccgcaaccacctgataactcgcgcgagtcccggcagcacctcttcgtgggtgcaccggccgcgaatccgaagcagtccgagtttgattgcctgcgcttgaatatctacacgcctcgggtggtgatttcatctgaagagaaagtccctgttcttgtatggattcatggaggtggatgggcaatcgaaaacggtaacactgacttttgtgagtccatagcctgttcgctatgttaccgccagttctcgactaatggagggcgttag

SEQ ID NO: 9189 - DNA, 432 bp, A.fumigatus
ggaactcggcactttagggttcccccccccctggcaaaagacgggaaagtatattgcggggtacagatgatacgattcggacaccaggtcaatggaacttgggttctgagcgctcgggatcagcagattctcaatggtgcattgtctgttggggtgttctgtgctgcaatcatcacaggcttcctgtccgatgcctatggtcggaaaaaggccatgatgattggcagtattatctgttgcgctggtgttatggtccaatactatgctacaagcatcttgatgctttttggtgggaaacttgtcgcaaccctggggtttgggattggccattctgtagcaccagtctttgtatcagagctggcaccgagctcattgaggggaatctgccttgcgctcattgtgagtacgctcttgttgacagcatttcggtga

SEQ ID NO: 9190 - DNA, 1173 bp, A.fumigatus
ctttcctcagtcaacaatgcgtcttcaatgacgaaaccctcgatccgtataccgttgaccggtccgctgcctccaccaattattgtaccgccatcagcaagcacactttcaggagcgattaatgccgtcttatcatttttcacagctcctccatccccgtatcttagcggagtggatgttggccgacattcgcaggctgttctcttgactggtgctggtatctcggtagcgtctgggctatccgactatcgaggggagaagggcacctacgtcacgaataaattctacaggcctatatattttcacgaatttctttcacgacatgagtctcgcaaaaggtactgggctcgaagctttgttgggtggcctgggttgttgaaagctgagcccaactcgacgcactgggccatccgagatctcgccgccaaaggctttgtcagttccgttgtgacgcagaatgttgactctttccactcaattgcgcatcccgagctaccgaccattgagcttcatggccacttgaagtctgtcgtctgtactagctgtcgaaaccaattctctcgcgctgagtttcagaagtcactcgagaggctcaaccccgcctgggcggagtttcttgcccgcatggtcgaagcaggagctctcgacacaaacaatcctgaagaacagagacggaaggggtttaagctgaacccagatggtgacgtggacttggctgaggctccatactccacgtttaggtacccatcttgtcctacctgtttggaaaaccctccaagactgaaggatggcacactggccagggtagaagtggaaaaagatggggcatggcttccttcgtctacagctggcattctgaaacccgcggtcgtcatgtttggtgaaaatattgaccctggagtgaaaacagccgctgaagaggctatcgatgatgcggggaggctactgattctaggaagcagtcttgctacgtattctgcatggagactagttgagagagcccacaggagagggatgcctatagccataatcaatctgggaggtgtcaggaatgagtcggtcttatttgagacgagtagtgatgtctcatcctcacatgttcgttgcagctttccgtctgaggcgattcttcctcctgtggtgtcgctgcttcccaaatctatttacgggtga

SEQ ID NO: 9191 - DNA, 369 bp, A.fumigatus
gcaaccgcctgcgatttgccatcccaagataggccgcgcgggggctggttcaaacaagttgcgatcagatcacctccgagcatggactatcggaattcatacagaaccgcagaggattctcgttcagagtacaacaaccctgcttctttttctgaaatcgtatctacccttgtgtcccctaaatcctttcttttcaataaccaacgcccaaaaccctcgactcagcagacttccatcacaaccagaggtaacatctcttctcagacgatggataagtcgcagcaacccagttctttccagcagctggagaaggtgtgtgagactgcttctataaccgcttggaaggttgtcaagggaggccgttactaa

SEQ ID NO: 9192 - DNA, 378 bp, A.fumigatus
  unsure (339),(355),(356),(364): Identity of nucleotide sequences at the above locations are unknown.
tcccaatatccgcaggtttttaaaggacgcaaccgccaaaccggcgagctcgtagcgttgaaggagattcaccttgattcggaagaaggaacaccatcgacagccattcgagagatctcgttgatgaaggaactaaaacatgagagtattgtctcgctttatgatgtgattcatacggagaacaagctcatgcttgtgttcgagtatatggataaggatctgaagaagtacatggacacacggggcgaccgaggtcagctggaccacgccacgatcaagtcattcatgcaccagctcctcaagggcatcgccttctgtcatgtctacacgcccggaacntgccagtattcgcgtnnaaatcccnccgcgccccccccc

SEQ ID NO: 9193 - DNA, 204 bp, A.fumigatus
ggcagaaggcaagttgcttcggccaatctggccaccgtcgaaacaccttccgttcatgttctagccctgaatgcaaagggcggccctcttatgggaggggaagtaagcccgactgaagccgatatcgatggtgtctttctaatttacaatccctgtcatccccctgtcgtgcgggtcattcacgagggttaccacccaggatag

SEQ ID NO: 9194 - DNA, 1320 bp, A.fumigatus
tcgagctgtcgaactatactgataggcgatgaagaggacccggccgagttcttcagtatgatctttggtggcagcgcgtttgtcgatctgattggtgaaatctcgttgatgaaggacctgaccgcgaccatggatatcaccatgcaagaaatggaggaggaagaactggcggaggccgcggaagagaaactccatattcacgatgaggggtccaaggctgccgccgcgacaggggaagccagccatgccgcaggcaccgcagccccgggcccaggaccagtaccagctgcagccgcggcggcggaaccttcagagaagccggcctcaacctccggatcgagtacaccccgccgttacttgggacaacaggctatcatggacaagtcggaagaggaggctcggatggaggcagccggtctgtctcaggaggagaaggaactgcgcaagaaggagaaaaagaagggcctatctcgggagcagcaagagcgcctggctgcttacgaactggagcgaaagaaggctcgtgaggagcgggtcaacactttggcgacgaagttggtcgacaagctaagcgtgtggacggaaaccgacaagggtcccgacgtaacccgtgcctttgaggagaagattcgccttgaggtggaaaacctgaaaatggaatcgttcggtctggagattctgcatgccattggtgctacctacacatcaaaagctacctcgtttatcaagtctcagaagttccttggtatctccggtttcttctctcggctgaaggacaagggtactctggccaaggagacctggactacaatctcaacagctatcgatgcgcagatgaccatggaggagatggccaagctggaagagaagggcggagaggactggaccgacgagaagaaggcggagtacgagaagaaggtcaccggcaagatcctggcggccgcatggcgaggcagcaaatttgagattcagagcgtgctgcgcgacgtctgtgatcaagtcctgggtgacaagcgcgtcaaactagagaaacgactcgagcgcgcgcacgccttggttattgccggcaatatctattcaaaggtaagctcttctcgttcgaccgtaaccatgtcacaggtcgctaagcgaaactataggcagagcgtgatcccgaggaagaaggagactacatggcctttgagcagctcatggctgaggccatgtcgaagaagggcaaggacgagaagaaaaagaagaaggaaaagccgaagaatgagcatcaccaccacgaagcaaccaccgcgtagatacctagtcctgttcatatccttgccatga

SEQ ID NO: 9195 - DNA, 195 bp, A.fumigatus
ctccaagtcagcatggtcgcagacactacctactacgatgctttgggtgtgccacccacggccacagaactcgagattaagaaggcctatcggaaactggctattgtgacccatcctggtgcgattactcctatgcctgctcggattcttgctatcgattctgacttcttccctagacaagaaccctggcgatga

SEQ ID NO: 9196 - DNA, 225 bp, A.fumigatus
gactgcgcatgcgagatttcaagcggtgtgtatacttcaatatatgcagttcaatatatacaaagttttaactcctctcggcacgatcagattggagaagcctaccaagttctcagcaatgaggagctacgaaagcgttatgataaatatggaaaggaagaatcagttccgggcggtggtttcggtaagttgctcagctgtgatcgagctgtcgaactatactga

SEQ ID NO: 9197 - DNA, 654 bp, A.fumigatus
ccttgtatagtctggacggtgtccgacctgcaggaattcatgattagcacctttcctccagagttggcatcgtgtgtccgtgaagctgctccgatcttacatcgttgtctcgtgcgacttggatcgtttccttaccacaacgatccacaacgtactctgttgcaggacgtcctgcgtacaggaatgattatcctgctaagattgaatggagggaagcttcttgaacaagacgacggcaaagcgtcgctcatctaccctgatcgtctcaatgctgcacaacgcaccttattgtttcagagcatggcagacatgcaagcagctaacaccaatacacctcgcaatgcggaagatgactttcatcttcagcgagcgcttgatctgattacttacggtaatttcagccgcaatccattgtttccgaccgctgtgaccaaagggcctgagtatcctcccgctgaacattttccgtcgtccaactcaacgttgacaaacggatatatccccgtgaaggactttagacccttgctacggctgatgcttctaacgcagctgcatgtggccggtattgacccggatgagttcacctcctgcctagcgcaggttgaaacggtgaactcatgtcttctaccacgggccgcgacggtccgcgaatga

SEQ ID NO: 9198 - DNA, 1269 bp, A.fumigatus
ccaaatcttaaccaaacaggccccagcttccatgacctcacatccttcaatgacacttttcttcgcttctcgctggacgctcgatccatgaacctccacccattacacattactcagtcctccgtgggcgagaggtgtgcttcatatatcacagcgatcagtgatacacttgcccaacgaatcatttcgcctcttctgtcctccaaagcatcatcttccctgcgcactctaaaccttcaacccgactgggccctcgctcctgcagatcctcctactgccgctctcaccgtcttcgcctgtgcgattgcactcgtcgccatgagctggcgattcagcgatctctggcgccgctccccctatccggctgccaagaccacgccgacgcatatcagcgacggcgactacacctacctcacgccggaggatatcgtggaccggccgtcgggttacgcgggtgcggaggaagacgagccagatacccttcttctcaagcatcgcaagaatacctacgccttgcatttccccgcgtacgccatcaatgacggggcgctcagcgtgggcgagttgaggcgccgggcggcggaggtcacgcgcacacctaacccggcgcgcatcaaattactctacaaggggaagttgttggatgatgactcggtgccgtgccgggctgagggcctcaagcagcagtcggaagtactgtgtgttgtttcggaggtgcagcctggtgagagcacccccagtgaaggctcggaggcggaggcgggggcggaaaaagccgatgaggctccccgtctagacgaggtgcagagcggcggggagcgaaggaagagaaaccggaatagaaacaagaagaagaagggcaagggccggattaagactgctgatgcggctgctgatgatgcggacgggcttgctccgccggcggaacccccgcgaccgtcctctgcagggggctcgtcatcgttaccggcgccgtctcctaacctgaaagtcttacgcaccccgctcgagcaagccaatgcgttgatcacatacctgcggacggagctactgcccctctgcgaggcgtatgtcgctcatccacctactgatcccaaggcacgcgatttcgagcacaagaagctgagtgaaacgatcctggcacaggtcattctcaaagcggacggaatcgagccggacggtgatgagattgctcggaatgcgcgtaaagctctggtcaaggaggcgcaggcggctctcaacagactagaccaagctgcaagggagtga

SEQ ID NO: 9199 - DNA, 564 bp, A.fumigatus
gagttaaactacgtgccaagcatggggcaggccgagtttaacgccagaacggacgccagcgccgagatatccgcattcgcagttcgagcagaaccagactcggagcccgtatcggaaaaacaaggaacggcagagacagccgcagagacaggggcaggcgggacggaagttcctgcagagaggaatggcgaggatgatgtggagcggacaccaaagaaatcgttgtcgtttaaactcgcgtttataggcctcgctgccagcatgtttgtgttccaggtggatgcaacggccttcggtatcgcctttccagtgagcaataccacgttatctcatcgggagctcaattgccccaggactgacctcgccggtagaccatcgctgcggatctcaagggcgagagtttggagtccttctgggcgaacttgtcctacaccctctgtggcctcgtcatgcaaccggtgtgggccagtatctccaccgcgttcggtcggaaaccgcctctatacgtatccatggcgttgttcttcatcggatccatcgtctttgccgtggcccagaatatga

SEQ ID NO: 9200 - DNA, 1491 bp, A.fumigatus
  unsure (1476): Identity of nucleotide sequences at the above locations are unknown.
accatcgctgcggatctcaagggcgagagtttggagtccttctgggcgaacttgtcctacaccctctgtggcctcgtcatgcaaccggtgtgggccagtatctccaccgcgttcggtcggaaaccgcctctatacgtatccatggcgttgttcttcatcggatccatcgtctttgccgtggcccagaatatgaacacgattatcgtcggccgcgtccttcaaggcttcggaggtggaggaattgacgtgctggcggaggtcattctggcagacatgacgacgctggaagagcgctcgaaatatctgggcttgatggccatccccatggcgattggcaatatcatggggccctccgtgggtgcattgttcgcgacgtatgcgagctggagatggattggatgggtgaacttgccgttgctcgggatcggtacgcccttggtgttcttcttcctcaagctccgaccagtccccctcgatgcatcgctggccaagaatctgaaccgcctcgattggattggcatggtgttggtcgtggtcgggatcacgatctttgtgttgcctctcagttgggcgggctcgttgtctccatggggtgcctggcagactctcgtccccctgttcctcggggttgcggtcctggtcatttttgctttttacgaagcgaggcccgacgcgcctattgttcctcatcgactcttccactcgaagacgggaaacatgacgttagtcggaggcttcctccatggcgcggtcctggtctcgctcttgcagtacctccccttaatctaccaagccgtacaactcgaaactgccattttatcggccgtctccctgctgcccaccgtgatcattagcgtggtggtcgcagcgatctccatgatgttggttccgtggtttggtggatatgtgtggattctaaggctggcatgggtcatcctcacgctgggaaccggtttgctggccctgttcgacgtcggatcgtcgtcatccatgcggctcggacttcccatcctctggggcgcgggggttgccttgctgcgtctcaaccttcttcccatgcaagccagcgtcaagaatgtcgacgacaccggcctggcgatcggacaatttctcacaatccgcatgtttggcggtctcgtcggcctcacaatctctgcaaccattttcaactctgtcttctcgacttccatctccgccactgcagtccacctgaccggtcctctggcccctctcaaggacgtcgccaatgcagttgcctttattgacaagctacggtcaatcgacgttccggtcgaaacacgcgatcaggttctgatggtctatctcaagtgcttccacaccatcttttacactatgacagggcttattgggctggggctggtgacttcgctgtgtgtggatgatattgatctgaagtcgcagggcttgggggatccacccttccaaggattactccgaacagaaaggatggagaanacagttgcacactag

SEQ ID NO: 9201 - DNA, 399 bp, A.fumigatus
caatacccagactttctatcgacagggcgcttccgtattctgtgtctcacgtcttccgaccttctggaccccaagggcgtttccgcccaggtattgacatctctcggatcatctgtccttccacgctttccgcccaacgtgattgagcaagtggttatccaccctcgcttgggcaagacgttcatgtggcaggatgtgccaaacgaactcaagaaacactcggagatgcgattctacagcggttacgcgttagacgatgtctacaagatctacggcgtagacgagacaaggggtgctctggctgtcgttcgacctgatggctatgttggcatggtggcggggttggcggatctagagcgtgtacaggagtatctagagaggtgcataaggactatctga

SEQ ID NO: 9202 - DNA, 186 bp, A.fumigatus
ccccgagaaccccaagaactggccaaacaagaagaaatgggctgctattatcacggtttccttttcacttttatctccccagtatcatcatccatggttgctcctgcgttgccgtcgattgcaagcgattttcatatcgaggagcaggtctcttctcagcttactctgtccattttcgttttggcc

SEQ ID NO: 9203 - DNA, 384 bp, A.fumigatus
gcggggccattattgataagcaatggcattattctccacaattctcacgcgttccgctggcatctatcgtcattccccctcactgttgctaactcccgcaagcttataaatcaacaatctgtgctgcctatatcaacggagcgggaaactgcgtactctctctgtgattgtcaacatctcaccatccgcgaacataacagcaccatgtctgcccccaaaatcaccctctacaccaaccaccgatgcccctgggcccacagagcgcatatcgccctcaaggagctcggccttgactacgaagaggtcatcatcgatctcaacaccccgcgtgagccatggtatctcgagatcaacccggtaggccgccttcagccctgggaatga

SEQ ID NO: 9204 - DNA, 270 bp, A.fumigatus
cagccacagcgcggcctcgtccccgccatctcctacaacggcaccatcatcaccgagtcggccatcgtcgcccagttcctcgcagacgcgcatccatcccacctccttcctccctccaatagcgtcgaaggcgccctgcagcgcgcccgcatcgccttcttcgtcgataccttcttcagcaagggtcgccccgcactttctggcttctcagcgcgccacaagcgaccaggaccgcgttgcagcgggggaggctatcgttgcggccattga

SEQ ID NO: 9205 - DNA, 288 bp, A.fumigatus
aaaagagatgcaagtggaaacgagttgaattcactcaaaacattgagaattgcatgcttcaaaatgcgagccattgctttccttctgctctttacttggctgttcactgcatctgggacgattcttgagaacggccaggcgcggttgaacccgtatccgggacaagcggagatcatcactctggacaaaaagacatggaggaactataagccgagcgcaaaggagatctcctacaaggggaggtgggacgacaagcatatttcttgtgagtccaacaggacaacataa

SEQ ID NO: 9206 - DNA, 636 bp, A.fumigatus
gccatggtatctcgagatcaacccggtaggccgccttcagccctgggaatgattccgtactctaacagccacagcgcggcctcgtccccgccatctcctacaacggcaccatcatcaccgagtcggccatcgtcgcccagttcctcgcagacgcgcatccatcccacctccttcctccctccaatagcgtcgaaggcgccctgcagcgcgcccgcatcgccttcttcgtcgataccttcttcagcaagggtcgccccgcactttctggcttctcagcgcgccacaagcgaccaggaccgcgttgcagcgggggaggctatcgttgcggccattgagaaggaactcgagcccatcctggcctcgcagaagggccccggtccattcttcggcgggagggagaagttgaccctggcggaggtgttgattggttcgttcctgttacggttgctgtcgttccataagcctgagcatgggctgctgagggaggatttgccgcagctgttggagaagaggactccggcatttacgaaatgggccaatgcgacggtggagcaggagagtgtgaactttatctgggatgagaagagcgttgtggagctgacgaagaagaagattgcatcgctggcgaagaaatga

SEQ ID NO: 9207 - DNA, 183 bp, A.fumigatus
ctctggtcatttcatttaacagtagtggtactctcagtggctgatattcccgctaagtccaaatctccgagacagtccacagttaagacggctatgtccgctctaatagatcgagagttcgtcaacgttcttttccgtcttgcattgtcaatgttgacacaaatcaattttacatggttctag

SEQ ID NO: 9208 - DNA, 573 bp, A.fumigatus
acctccaaaatggcgacactcaagtcacgcaacatcatcctccttctcacgagtctactctccctcctccacctcgcgacatcccaaagaacccccaacgaaaacctcgtcctcgccgactgcggcatcggcctcggcgtcaacggcggctccacctcccgcgaaatgatctactaccccggcgacgtctggacgggcaacggcgccgacaccaacaaaccaacaatgatggtcaacgtcccctggtccggttcatatccctggggccaaaacggcggcgtgtccgcacgcatgcccaacggcgacgtgtttaccgtacacattaatccgaagatcaaggaccccattgctgcgggcgacgcgtggcatatgtacgagatgaatttgccgctcaagtgctatagttatcataaagataaggtttatcagcttgatgatggcaagtggtgctcgagtgcgtatgtgtgcaaccatcggggcacgcccacgccgcatgttaagccgtctccggcgccgaaaccggggcctgtgccggtgaacacgaattccgccttccgggggtgcgatttgtga

SEQ ID NO: 9209 - DNA, 903 bp, A.fumigatus
gcgctcgcaatggtgtcccttaaccttcccaaactagccctgttcatctcgttcctaggaacctgcctagcagagctcctcaccccgttcccagacaccgccagcgaacttgccatcaagttccaacccgtcctcgacttcgacacggacagctgctaccagaccgcggccatcggcaaagactacaagctcaactctggtatcgacccaaccctcgctccaccccgtcctccaggtccagggccaatcgttcgagccgccaccgacgacgagcaagtcatctttgcagccaacgccagtgacagcgacagcgacagccagattgggatccgctcgggcggtccctttgcgccctctggatgccgcgacaaggcccgactagaccacagccagacgtacgtccgtgagcgctgcaaccgcggctggtgcgcgtatctgtacgggtactactttgaagtcgacagtggcttttcaaacgcacacaagcacgactgggagcacgtcatcgtgtggacactccatgaccaagtgttttttgtctcgtggtccgcgcacggcgactacacgacgcactactattccacggtccggttcgaaggctcgcacccgaagatcgtgtaccacctcggttcgtcgggtacgcactcgctgcgcaaggccgaggccaaggacgataagattgaaaacgataccgggcggtggtttcgggcgccgctggtttcgctggagaagatgccctgcaagtttaatcggctgctgctgaatcataattggggcagtgcgcatagtgatttgagtcggcttggggagaagctggataagtggatgccgtgggatgcgaggaataatgagaaattcaacccatgggagcccaaggtgcctttgtgggctgtgagggagtaa

SEQ ID NO: 9210 - DNA, 234 bp, A.fumigatus
cactttcctgttccccaccaattaacaacattgcttcaaaccacccctacccccagcaacaccaacacattatttttttcaaaacatcacaaatcgcacccccggaaggcggaattcgtgttcaccggcacaggccccggtttcggcgccggagacggcttaacatgcggcgtgggcgtgccccgatggttgcacacatacgcactcgagcaccacttgccatcatcaagctga

SEQ ID NO: 9211 - DNA, 228 bp, A.fumigatus
gctgccacttctataccacaagccctaccaatgccctacgatactaatcaacccggcgtccccagggagttctcgtcgaaggaccttcgaaccgttggtaactacacccttggaaggctgattgggaaaggctcctttggcaaggtttatcttgcttcccacaagctcaccaatggttccaaggtattattcaccccgcggccgacccaagaggcagaaccattctaa

SEQ ID NO: 9212 - DNA, 189 bp, A.fumigatus
  unsure (152): Identity of nucleotide sequences at the above locations are unknown.
gttgtgctcaagtcctccccaagggaggatacgaatctccctcgcgagattcatcaccatcgccagttcctccacccgcatatcgcccgtctctatgaggttatagtgacagaaaagctggtctggcttgtactcgaatactgtccaggtangggaacgttgcaacgtgatgcaatcggctaccgctga

SEQ ID NO: 9213 - DNA, 1635 bp, A.fumigatus
cctccgttcagctctgctcaccaatcatcaccctccctctttgaaccattccttgccgccttgcccttgccaacacccagcatagccttcaccgcacttgccgcactcagaccgttcgtgtccgcggttacagcattcaacccttcgtattctctatactctgcccttgcagcttcttacaccttcacgctacacggaaacctcgtcggattgagctttgcactgtcgacttcgggcatcaacgtgcgaaaaggactcttggatatttccgcggaaccgggataccgtgcatttgacgtgttctactatcttgtgacgtcctcatcgacgcctgcggaacgggaatttttagccctgaaggatccttctgcgtatacattactcaacaggtcaggtacctattcacctccatcatatctcccaaccgccgacgatgctgcggcggcagaggattttagggcagcgttgaaggccattggtatcaaaggtgcctcactgcgcggtttactctccattcttgcaggcctactcaagctcggtaatgcggctggctttctggtcgatcaggaggagctcgaggacgtatgcgaagaggttgggggactgctgggattagatccggaggtgcttcttcacaagtgttccactgaagatcgcgaggtattgatcgcgggcatctacgaagcactggtcgactgggtcatcgtgaaagccaacgaaactattgcgaatgagctccgggcaaaccaggaaggtgactcaggaagcggatcagccggccagtggtcagacgaagacaccgtgggtatcacggtcgtggatatccctaggcctgcctttggtaaagctgtggcattgagaggagtctttgatgatacccttggtatcaatgcagagatgaaggaggatggcgtccaggttcctcccgtcggacactctgtactcaatgacttgaacaattccgtagcgcaggtcgagccagatttgggaattaccactggtcctgcctggcgtgaacgggaatatgagctcgacaagaggcaggaagttctcgaaaaagtcggattagaggttgatatggactcgttcctccggcagttactgtttcccgtggaagctgaagggattactgtcggcaaaagagggcggtttgacctcatgactaccttgggtagcagtcgagtctggcaccacatctcgatccatccaaccgaccatacccctgactccttaaacgcagcctcgcccaccgccgcctggtctgcaggtacggtttctcgccaaatacgtgagtggagacttgccgaatgggccaatcgacgtctgaagcagatggattttacggccgactttgacgtagaggagtttgttagccgttattcgcgattgggctgtagagaaggaagggacggtgtggagagctggttgatggaaagaggctggaccaacggcgacgcctttgtaggccatcaacggatctggatgcgtgagaatgcatggtgggaagcggagacgatgcttgatctcaagccagatgaaacacccggagcaaactcgtatatgtacgccagtggcatgcttgacaatggcgtggcacacgtcttaacgacgatatgggtctacgcgtcgaaaaaa

SEQ ID NO: 9214 - DNA, 279 bp, A.fumigatus
tccgactttttcgagaacttcctgcctcttgtcgagctcatattcccgttcacgccaggcaggaccagtggtaattcccaaatctggctcgacctgcgctacggaattgttcaagtcattgagtacagagtgtccgacgggaggaacctggacgccatcctccttcatctctgcattgataccaagggtatcatcaaagactcctctcaatgccacagctttaccaaaggcaggcctagggatatccacgaccgtgatacccacggtgtcttcgtctga

SEQ ID NO: 9215 - DNA, 189 bp, A.fumigatus
gcagaacgtttcatctctgtgcaacttatcttgggatccacgcctggatacatgtactccccttttcataggactcatctgcgtagacgatgctacgggaccatctcggctttcagctaccccagtatgaccgcagaaggacgtgtcgataataccatgaccacttttggtttgataagcgtcctgtga

SEQ ID NO: 9216 - DNA, 732 bp, A.fumigatus
actttcttcgagatgcttggaaattggagttttggcgactatttcaaggaagatgcaatccgatactcatgggaacttttgacgaaggtttacggtttggacccacaacgcctctatgttacctactttgagggtcacgaagagggtggactcgaacctgacctagaggcaaaagctctatggagagctgcgggtgttccagaggatcatatccttccaggaaacatgaaggacaatttttgggaaatgggcgaccagggcccttgtgggccctgtagtgagattcattatgatcggattggcggccgcaatgctgctcatcttgtcaatcaagatgatcctaacgttcttgaaatatggaacaacgtgttcattcagtataatcgcgagtctgatcggtctctgaggcctctgccgaataagcacgtcgacaccggaatgggatttgaaagattagtctcagtgcttcaggacaaatcatccaattatgatacggacgtgttctctccgctgttcaatgctatcaaaaacatcaccggagcccgggaatatcgaggaaggtttggtgccgatgattccgatggcatcgacacggcttatcgtgttgtcgcggaccatgtccgaacattgacttttgccatctcagatggcgtgacgccaaacagtgatggtcgtggatatgttgttcgacggtcttcaccacggggccggaaggatccgcgcaatgcgaat

SEQ ID NO: 9217 - DNA, 432 bp, A.fumigatus
gtatgttcgtcagtagcattcgagtcttcatcaatcaatatcagcgctcaaatttcgatttatagtcttggactaaaactctcatctcatctagaaccgcgtttgtttggcacacctcagatatgtggtgggggtacatcttcaattcagtcaaattcgtttgatacgactgagcggatgatgttggatgacactaagcatacaatatacattcatgatcttgattctgagctagcagattctgatgctcaggagtactcaatcacctttttgcccgacatcggggccaagttggggaccttgccgaagttattgactgttgatacacaacctcagaacaaggaattggtcctctacagggatcccaaatctctaacccttccagaggaggatgattatgtgcggagagccatccttgagtcccggagatct

SEQ ID NO: 9218 - DNA, 840 bp, A.fumigatus
  unsure (24): Identity of nucleotide sequences at the above locations are unknown.
tcgtgtcggcggccctcggtaaanatttcgaaccgttcaatcgccattgattttgcggacgatggtcactacgaagcagatgatgataagcgaaggaacgagcctcgctcgatagattttggtccacggtcaattggcgatcaggaaacacgcaaaaaggaccgcaaagcgaagaagcgaacgagcaaaaagcacaaagcccgcaaggaagataatgccaacaccttggacactgatgcatcaacacagcgaccgtgcctgccgtctcctcagcctgtgcctggtcctgatggcatcaactcgtcccagcaggctgaggttgctgccgccctcccgaagagaaggtctccatttcgccccgcaatcccatcgttactatccaatactgtgttttcaaacactgccgcttcgaacaaccttgctccaggagaacctggtcttcgacgcacgcggtctcttccatctcacatgaatcgtcctcccccagttggaaacgcagtacagtttgctagaggtgccgctcgtatgccaactacgcttgatgtcacggctaacaatgctcctcctgaacacaaagaacctgagatatcacgcacggctgccgtggtcatgttactggtgtcaactgcgcttgtcgccgtttgtgccgagttcctagtggacgccatcccagaaatgatcgagagctcatcggtcagcgaggcctttattggtctgatcattctgcccattgtcggtaatgctgcagaacacgttactgccgtcagcgtggccaccaagaataagatggatttgtccattggcgtgtcagtgggaagcagtattcaaatcggtgagtag

SEQ ID NO: 9219 - DNA, 312 bp, A.fumigatus
atatcactcagtgaacttgccttaactaccacatactactacacatacattgcgagcagcatgtcctactacggagaaagagatacctactacggaggcccgccgcaacccacctacggccggcctccctacgaccgacccccctacgagcaacagcaacagcaacaaccaccctacaaccgccctccctatgacatcccaccccaggattcaccctcgtacaaccgccccccgtacgagcggaccccctacgaacgtcctccccccgaacgctccccctcctccttcgatccatcccgcccccgctactaa

SEQ ID NO: 9220 - DNA, 303 bp, A.fumigatus
  unsure (94): Identity of nucleotide sequences at the above locations are unknown.
cgagtcccttgctgtcagaatgctgatacagtacaggcggctgtcacgtccggtaaaccaccgctccccatcgcccaagaatactgtcttcggngcgatggtgtgctgccgatgacctacaatgcaaagtggaaacgtctgcatgcctttttgaagcagctgcttaatgccaaggcatcggcggcgttcatcctcagccaggaatttgagatcaagcaacttttatgggatctcagccatgatgctgggaaaaacagcacagatttctatatgcacatccgccgcatgaccttctccatgtaa

SEQ ID NO: 9221 - DNA, 564 bp, A.fumigatus
  unsure (543): Identity of nucleotide sequences at the above locations are unknown.
tatgtggctgctcattattctcccatcaaaagtgctccttatttctcttactggaaccgctgtcgtgtgaagtactctgagccagacatggattccttcaaagccattgacctgccccttcctcctcacttcgtcgctgctcttggcagacctaccgtccttgtgggctttgcctgtgtttttctattctcccaacttctggtctggactgccaagtactcccgcaagaagtccaagggcctggcagatatccctggcccatctggatggccgattatcgggattggcctggatctaccggctcgcccgcgcaaattgttaaactcctgggcaaaccagtttggagataccttcaaggtgcgcgtgggctggtacaactgggtgtttttcaaccatccagatgccgtcaaggaagtgtttgatcggcaggtaatccaacccccaactagcgagtcccttgctgtcagaatgctgatacagtacaggcggctgtcacgtccggtaaaccaccgctccccatcgcccaagaatactgtcttcggngcgatggtgtgctgccgatga

SEQ ID NO: 9222 - DNA, 1098 bp, A.fumigatus
cgtccgcgtaccggcttcgcatccctcagtgggactgccaggaaggtccgtgatgtatacggaaacatgcggatgctttcaatcattctaagccccggggtgttctggattgacgtgttcccgccgctgaactggctgccccggtttctattcccttcatggcccaaagccaagttcatggcgcagaggatgcacgcaaacaagatgaggcactggaacaacctcaaggagcggattgccctcggtaatgcgcccgattgctttgctaaagacctcatggagtcaaactaccgcgattacggactcgaggaggagacagtctcctggctagcgagtgcggtgccggaagccggagcggagacaacggccagcgccctcaacggcatgatcaggtacctggccatgttcccggaggcacaggcccgggcccacgaggaggtcacacggatccttggcgatggacggatggccactctagctgatgaaccacaaatgccttatatcaaggcagtgattaaggaaacgctgcggctgtgccccgtagccacgacgggcctgcgtcgcatggctgacggtgatgtcaagtaccgtgactacgtcattcccaagggaacaatcctgctcgcaaacctgaacgccctgcattgggacccagagcgtttcccggatccgttcagcttcaagccggagcggtacctcaaccatccccatcgatcagcggtgtatgcagccgggggggacatcatggcccgtgaccacttcacctttggggccggacgtcgcatctgtccaggaatccacctggcggagaacgggctgtttttggccgtgtccaacctcatctgggcctacgagttcaagctgcctttagacgagaagggcaacgagatccccctcgatatcagcgacgagggcttcatggaaggtgccattcgcgtgccaaagcagtacaccgtccgaatcctggaaaggaatccggcgcggtcccgtcttatccgggagtcgtgggaacaggcccagaaagatggatacatcctgcgaggcgtacatgtcgacgcggatggaggagtgagaggcagcgcaaaggtaaaggtataa

SEQ ID NO: 9223 - DNA, 237 bp, A.fumigatus
cgaaacacgaactcttgtttccttgggataccgcgtcaaggcgtcatgccatatgcgagcatgtccaacctgctctggaagtggaagcgccagagctcattcagtccctattggattcgaagtttcctttctctctccacaattactgcctgctgcttggataaccatgcactagcagtcgacggagaggcttacatgactaagtggctgaactggcacgatcaggagggcagatga

SEQ ID NO: 9224 - DNA, 1005 bp, A.fumigatus
aaagacgagtttccaggacagcaacgcaccgttcatttacccactagtcccaagtcgacgacgtccaatgaagcacttcttagcgattcgtctccacttcaattggagaaatccaacatcctcctactgggaccatcgggggtgggcaagacactgatggccaaaacgcttgcaagagttctctcggttccattcagcatatctgactgtacgccgttcacgcaggcaggatatatcggagaggacgccgaggtaagtgttcaccggctcctcggggttgcgaaatacgacgtggagcaggccgagcgggggattatcgtgctggatgaagtggacaaaatagcggccgcaaaagtcagtcatgggaaagatgtcagtggggaaggagtgcagcaggcactgcttaaaataatcgagggcacaacagtccaagttcaagcgaagcaggagagaaatgctcacagaacaagtggcaccccgagctcatatccatcaaacaaccctttcggaaattcgccgttctcgcaatctcctacaggcaacgccccccagaaaggggaaatatacaatgtgcgcactgataacattctgtttatattctcaggtgcatttgtggggcttcataaggtcatcatggaccgcatatcacacgggtcaatgggattcggccaacctgtccgctcacagtcgagtccaacccatcgacccggagatccgctcgccactacacccaaccagcctgttcccatcttaccgggatccgaagaggaagctctgtacaagaaacacctgccattcttcacagcagcttcacccacatcaccagacggtgaaccaccctatttcaacgccctggacctcctcaaccccacagatctgcaaaactacggcttcattccagaattaataggccgtatcccggtcactgctgcactatcaaccctctctcaacccttacttgtccggattctaacagaaccccgaaactcactgcttgcgcaataa

SEQ ID NO: 9225 - DNA, 678 bp, A.fumigatus
atattctggtgcctggtgatgctgcgactaccgatccgcgctcatggccttaaatgtgcttcaagagcacatcacagttcactgctccgttatcggcatgtagctatctgccagacttgttgggcaaatcgcgggtttacatctactgctaaatcctttcccacttactctgagtttaatagatcggattttacaaaccagccctggtctagcatctatgaagctgggttaccaaccgctggccctctggggtccactccagcgtttggagctcctcgcataacacccaagaccttgaaacaatatttagatcagtttgtggttggacaagatcgagcaaagaaaattctcagtgtcgctgtattcaaccattaccagcgagtgcaagagcttcagcgaagggaggaagagaaggcggaattgctagcaaggcaagcccggagagaagcattggagcatcatcctgcagagggtaagccttatgtcccttggaattcttctcaaagtacgctaaacattgaaaagacgagtttccaggacagcaacgcaccgttcatttacccactagtcccaagtcgacgacgtccaatgaagcacttcttagcgattcgtctccacttcaattggagaaatccaacatcctcctactgggaccatcgggggtgggcaagacactga

SEQ ID NO: 9226 - DNA, 192 bp, A.fumigatus
ttaaatatatctattttaactactattatcctattagggttaaactatataagaattagggctataataaatatcttctttagtagtttaaaggcctttatttactcttctccttatataaagggggctctcttttatattaatactattaagggtcatgctatatttaagaaattctatataaactattaa

SEQ ID NO: 9227 - DNA, 453 bp, A.fumigatus
aaatcctggcccatagtcaagtcattcgtcggtgctgtccgccagaacgaaggagctcagctccccatcggagcagccggtttctgctggggaggcaagcacactgtcaatctggctcacggatttgaagtagacggcaaaccgttgatcaatgctggattcacgagacatcctagcctcttgaacatccccggggagattgagaagataacgatcccagttagttttgccctgggggatttggatgtgattgtgaaaaagccgcagattgagcagatcaagaaaattatggagggtggggagaaggttggtgaggtgaaggtttactatggggctagtcatgggttctgcgtgcgagcagaccgtcttctgaaagatgcagagcagcaagctacggaggcggaggatcaggctctggattggtttaatcgccacttcgctaatgtgcaataa

SEQ ID NO: 9228 - DNA, 927 bp, A.fumigatus
aaaatctcgcctgtacgattcttaataatcgcttttcaagttccgcaaatcagtgcctctcaagacatggctactcagctgctacgactgaccaacctacctgttggccaatcccatgaacataagggtgacaaacgccctttgaaggcagcaccggtgaagatacgaagtctgacctttcgatatccatcgcggctcgacgctcctgctcttcgaaacgttactctcgccatagctgagaattcttgcacagcgattgtaggcggctctggatcaggaaagtcgaccatcgcatccttgattctgtctctctatgaaacaccgctgtctatgtgcaagacgccgaccatctcaattgggggtttggatatccggcggctccacactccgtccctccgttccctgatatcgattgtttcacagcagcctacggtattcccaggcaccatacatcacaatatctgttacggtttgagagacgagtcgcccctccgtgagttgcacaatgttcgtactgcagctcaagctgcgggcatcgatgacttcatcgtgtcactccccgacggttattcgactatcattggggacggtggcgtgggcctgtccggtggccaggcgcaaagattggcgattgcacgagctcttgtacgtcggccgcaggtgctgatcctagatgaggcaacctcgaaccttgatccagagagtgcaaaggtgatccggcagacagtgcagaggctggtgtcggctcgattaggccttaccgtgataatcattacgcatgccagagaaatgatggagattgcggataatatcgtcgtccttcaacaggggtctattgtggaacagggcccttacgaggttcttgcacggcggcgcggtggaaagttgaaagctttgatagaggacagtgagggcgtagactcatag

SEQ ID NO: 9229 - DNA, 618 bp, A.fumigatus
ttccccgagattgcggctccttccggcccctgtggtgaagaaattgacgggactgcctcttacttcatgcattatcttttggaagcttcaggccaggcctgggtcgatcagcttcgcaaggaggcattcagacgagtgtcggaccagcctcggcagtggttcgatgaagaaagcaattcaccatccaggatcactgcatgtctagatcaaaacggggaggatatgcggaacctagtaggccgtttcggcggctacgtcctggtagctgtggcaattaccatgaccgcagtcatttggtgtctagtcgtctgctggaagctcaccctggtggcactgtcttgcggtcccgtcatttatgccattaccaggggatttgaaggaaccagcggactgtggcagggacggtgcaatgaagttgccaggaatgcatcagacgtatttgtcgagacattctcagaaatacgaactgtgaggaccctaacgctcgagccattctttcacaagaaatacttgatggcggcgtcaaaatgcatgaaaatatgcctcaagagggcggcttgcactgggattttgttcggccttgtagagtcgacaataatattcgtgagtggtgagtag

SEQ ID NO: 9230 - DNA, 186 bp, A.fumigatus
agagagagtacgtacacacattcgcggacaatatccaatggaccgtacatgagctatagcaacaagaaatacacaacgcaggcgaaatatgacccatgccgtggtctaactggatactccgtcgctcacagcactattgcccctgtttcattcttagggagcaggtttcctggtccagaatggtga

SEQ ID NO: 9231 - DNA, 258 bp, A.fumigatus
actgggcatgtagctaaggaggatgagatcgagcagaatctggatcttctgtccggtgctgccagtcgcctgaatggacttgctcgtgccacaggccgcgaacttgacgagcagaacagacacctagaacggatcatgggcaaggtaagtgttccagcgtgcttctctagtgcctgtggacttactgacttgctgcagagcgatttcgtcgacgaccaaattgctatgaatcgggccaagctggaccgtattcattaa

SEQ ID NO: 9232 - DNA, 201 bp, A.fumigatus
gctcatctttactcgactcacattagtatatgtctaatttcaaccagggccgcgtattcgggcaccgcgctcgctttcagagatcgcttgatcattgagtggaataaaacgcagcagcgtcaatctttcgccgaccagaagagggtctattgtaggtgctactgcttggacgtcccgatctacctcgtgaaattttgctaa

SEQ ID NO: 9233 - DNA, 1779 bp, A.fumigatus
tttcggaaaaaagagggtttgaaggaccttggttttcgaattgaggacgtcatcaaccaagagcatgatgccgctctgggaaacggaggcttggggcgtctggccgcgtgcttccttgatagtatggcgacactgaactatccagcctggggctacggattgcggtacagatacggtatcttcaaacaggagattgtggatggctatcaggttgagattcctgactactggcttgatttcaacccctgggaattccctcgacacgatatcactgttgatatccaattctacggttgggtaagaacgtaccaagatgagaacggcaagaccatccactcctggcaggacggtgaagctgttcaagctgtggcctacgatgtcccgatcccaggatatgggactcgcacgacgaacaacctccgactgtggtcgagcaaggcagccagtggggagttcgatttccagaagttcaatgccggtgactacgagagtgcagtcgcggaccaacagcgtgcagagactatctcagcggtgctttatcccaacgacaacctagagagaggaaaagagttgagactgaagcagcagtacttctggtgcgctgcctcgctctatgacattgtccggaggtttaagaagacaaagagagcatggagcaagttcccagagcaggttgcaatccagctcaatgacacccaccctacgcttgctatcgttgagttgcagcgcatactgatagatcaggagggcctcgagtgggacgaagcgtggacaatagtaacaaagacctttggctacacaaaccatactgtcctgccggaagcgttggaaaaatggtctgtgcctctgatgcagaacctactgcccaggcacctccagattatctacgacattaacctgttctttttgcagtccgtggaaaaaaggtttcccagcgatagggaaatgctgtcccgcgtatccattatcgaggaatcacaccccaagatggtcagaatggcacacatcgccatcattggatcgcacaaggtcaacggtgttgctgaactgcactcggatttgatcaagacgacaatctttaaagactttgtgaaaatctatggaccagacaaatttaccaacgtcaccaacggaatcactcctcggcgctggctccaccaggccaacccgcgcctatctgacttgattgcttcgaagcttgggggctatgacttcttgaaagacctgacacttctcgatcagctcgaagcttatgttgatgacaaggccttccgagcagaatggtcggagatcaagactgccaacaagctgcgactcgctaagcatatcaaagacaccacgggctacagcgtgaatccgaacgccctgttcgacgtccaagtaaagcgaatccacgagtacaagcgccagcagctcaatatattcggtgtcatccatcgctatttgatcatcaaagccatgtcgcgggaagagaaggagaaactcgtgccccgagtgtctatctttggcgggaaggctgcaccaggttactggatggctaagactataattcacctgattaacagagttgcggcagttgtcaacaacgatgccgatgtcggtgatcttctgaaagtcatcttcattgaagattacaatgtcagcaaggccgaaatcatctgtcctgcatcagacattagtgaacatatctccactgcaggcacagaagccagcgggaacagtaacatgaagtttgttcttaacgggggtttgatcatcggaacctgtgatggcgctaat

SEQ ID NO: 9234 - DNA, 618 bp, A.fumigatus
gatagtctctgcacgctgttggtccgcgactgcactctcgtagtcaccggcattgaacttctggaaatcgaactccccactggctgccttgctcgaccacagtcggaggttgttcgtcgtgcgagtcccatatcctgggatcgggacatcgtaggccacagcttgaacagcttcaccgtcctgccaggagtggatggtcttgccgttctcatcttggtacgttcttacccaaccgtagaattggatatcaacagtgatatcgtgtcgagggaattcccaggggttgaaatcaagccagtagtcaggaatctcaacctgatagccatccacaatctcctgtttgaagataccgtatctgtaccgcaatccgtagccccaggctggatagttcagtgtcgccatactatcaaggaagcacgcggccagacgccccaagcctccgtttcccagagcggcatcatgctcttggttgatgacgtcctcaattcgaaaaccaaggtccttcaaaccctcttttttccgaaatcagctactactttcgagtttgacggtccggcaaggcgaaggcctacctcgggcagcatccttcatcccaacattaagcatcgcattgtctaa

SEQ ID NO: 9235 - DNA, 207 bp, A.fumigatus
cgaaatgccccggttaatttaaaccaccatttccgtgtttactcccagaatgtctatggcggatttggcaaaggtctctacgagggcagctgggctacgggccccgaaaagaacgtattcggcaatgttagcttgggcagccttgtggcggggacttctaggaagctgaagcatgtatgttatatcctgcctattggctctgcttaa

SEQ ID NO: 9236 - DNA, 474 bp, A.fumigatus
  unsure (58): Identity of nucleotide sequences at the above locations are unknown.
agcatgtatgttatatcctgcctattggctctgcttaagactgacgatatgaagatcngtgtctacaccctcactgaaggaaacaccctccaagagtttgcctacgactccggaaccggatggtacaacggcgggctgggcggtgcaaagttccaagtcgcaccctactctcgcattgctgccgtgttcctagccggaacagatgcattgcagttgcgaatctatgcacagaagccagataacacaatccaggagtatatgtggaacggtgcgtcgaatcataagtctcttgatgtgctttctaacctgcatcttaggcgatggctggaaggagggcaccaacctgggaggtgctctccccggcactggaatcggagccacctccttccgctataccgactacaatggcccaagcatccggtacggcactgccatatacacatcctgaatacgggaacgcttactaatatttga

SEQ ID NO: 9237 - DNA, 255 bp, A.fumigatus
ccggaacagatgcattgcagttgcgaatctatgcacagaagccagataacacaatccaggagtatatgtggaacggtgcgtcgaatcataagtctcttgatgtgctttctaacctgcatcttaggcgatggctggaaggagggcaccaacctgggaggtgctctccccggcactggaatcggagccacctccttccgctataccgactacaatggcccaagcatccggtacggcactgccatatacacatcctga

SEQ ID NO: 9238 - DNA, 453 bp, A.fumigatus
atacgggaacgcttactaatatttgacatacacaggatctggttccaaactgatgacctcaaactcgtccaaagagcctacgacccgcacaaaggctggtacccggacctcgtcaccatctttgacagggcaccgccacgtacggccattgcagccaccagctttggagccggcaacagttccatctacatgcgtatctactttgtcaattcggacaacactatctggcaggtctgctgggaccacggcaagggctatcacgacaagggaaccatcaccccagtcattcagggctcggaggtcgccattatcagctggggcagtttcgccaataacgggccggatctgcgtctgtactttcagaatggaacatacattagtgctgtgagcgagtgggtttggaatcgggcacatgggtcgcagttgggcaatagtgctcttcctcctgcttga

SEQ ID NO: 9239 - DNA, 624 bp, A.fumigatus
aacatgacttccaaagccgccgccttccacgatgaaggcgacatggccaaacccactggcctcgacgccatccacatggttcggatccccttgaccgaagaagacagcaagcgtatctgtcgcaagactgaccgtgtgattcttgcgattctggtgtgggtgtacttcctgcagattctggataaatcggtgctcggatatggagccacttttggcctccaagccgacacgcacctcacgggcaaccagtactcgcttgttggttcaatcgcccctatcgctcagctggcctggcaaccattctcttcgttcttgattgtcaaagtcccgcatcggattctgatgccgtccttggtcctcggatggggcattgcgcagacttgcatggcggcatgccatagctttggcggcttgatggccacgcggttcttccttggtcttttcgaggctggctgcctgccactgttctccatcatcaccagtcaatggtatcgccgtgcggaacaaccgatccgtgtcgcagcctggtacagtaccaacgggttggcgacgatcgtggccgccgccctgtcctacggcctggcacacatcaagtcggatctgctcaaggagtggcagatgtaa

SEQ ID NO: 9240 - DNA, 231 bp, A.fumigatus
tgttggaattccacagctaatcagaccagtatcttcctcttcgtcggtctcatcacggtcatctccgccccaatcgtctactggaaactggacaacgatatcgcctccgctcgcttcctgaccgaacaagagaaactgcaagcgatggaacggctccgcgcgaaccagaccggcgccggaagccgcgaattcaagctctcacacgtcgtcgaagccggcctcgagccatag

SEQ ID NO: 9241 - DNA, 234 bp, A.fumigatus
ctcgcgtggttgatcgcatgtatcgcatcaatcatctcagatatcaagacagattatcctaattactcgtggtgggcggtcgcctacatgttttgttgtattatgggtgtcaccatcgtttttggttcggacaccggtctcgtctatggggtagcagtatgtttcactcccttcgttgtgggattctcggcgctgatgggtaacaggttgtgggctatctttcaacaggcttag

SEQ ID NO: 9242 - DNA, 534 bp, A.fumigatus
gctaaccttaaacaggtcgtgtggatattctactttggatcgtcgcctcaggctacgcatcgcggctttatcgattcgttcgccctcaacaaggaaagcagcggcgcatacggtaaccgacccatgtctacggcttatggtcctcgcccagacacgatgtcgacaagcgcaccccagatgtacacttctgcccaactcaacggcttcgaaacgtcgtctccagtgtcaggttatcctggtggtggtcccggctcagaaaaccgcagctcgtcccaggctcggtttggcaacccgtctgccagcaacgttgctgggaacaacagcggtcaggacgaagtcccgccgccaacagaatacccgtacaaggcaaaagcgatatattcctacgatgccaatcctgaagatgccaacgaaattagtttcagcaaacatgaaatcttggaagtgtcggatgtcagcggcagatggtggcaggccagaaaatccaacggagagaccggtattgctccatcgaattaccttattctgctgtga

SEQ ID NO: 9243 - DNA, 216 bp, A.fumigatus
tacctggcacttctactaatcattaagcagctttcccgtcctcaaacggtaaagagactctggcaatatattcgtgaacacaatttacaagatccaaacgaccgacgtcatattcgttgcgacgacgccatgcgcgctgttttcaaacaagatcgcatacacatgttcacgatgaccaagatcctcaatcagaatctgtacagcccggacgaatag

SEQ ID NO: 9244 - DNA, 513 bp, A.fumigatus
cgcgcgttgttatcacaggctgcgattaagcagcttatcatgaaaaggttcgatatatttgcggaacaaagcggcattggagggtcttctgatgcggctgcatcatcgaccgcccctacttccaacggtcaactacagaaccatgattcagtaacacctgcagagccctcacctcctgctccgtcctcgtcccctcagaagcgtcaagcggagagcgacgaccagtccgatccaccaagaaagacccccccggcaaagaagaagaagccggaccacgatatcgacgcagatgccctctatgctgccaaattgcaagcagaggagaacatgcgggctcgaccgactagaggtgccagtgctcgtaggtcagcaccagtgaagaagaaggcgaaggccaaaacctccaagaaagtcaaagcggaggacgattcggatcttgactctggttctgaaacaaagaaggaagtgaaccgatctggcggttttcacgtgagtttccagcactttctctag

SEQ ID NO: 9245 - DNA, 231 bp, A.fumigatus
ctcgcctgcgatgattttcctatactgacgtgtctcaagcgtcgcacccatgcaaatgttccagagacccccgctggggtgctcgagaatgttcgcaataaactccgaggccttttgcccggagagtcagttcctttatcagtggatggccatgttgatgaactaatcacacaagcaacggacaagagaaatctaacggccatgtatatcggctggtgtgcttttttctga

SEQ ID NO: 9246 - DNA, 414 bp, A.fumigatus
cgtcgcgatccacgcttgtctgttccaagtgcgtcgtgtctcttccacgtcatgtcttccaggtcacctcaaggccgatcgccacgtcgctcaatgcatgagatggatctcgaaggacgatcacggcgttcaatgtcccctcgaggaggtccaaggtcggtcagccggagtccatccgctcagtatgacaatggccgccgcaacaaacatcgttctagaagctggtctcggtctccgtcgcgttctcggacgtcatccctgagccgtagtcgcagcccaagccgtgattctcgatggtacagaaataggagctacagtcgtacaccgagcccaagcagtggacctccaagaagttcaaaggtctgttcttattctacgtacctattccatctgcatctctctaaatcttactga

SEQ ID NO: 9247 - DNA, 216 bp, A.fumigatus
ctctccgggcaaaaggcctcggagtttattgcgaacattctcgagcaccccagcgggggtctctggaacatttgcatgggtgcgacgcttgagacacgtcagtataggaaaatcatcgcaggcgagctacttaccttctttcccaatgaaatctgtggttggatcatgcaagaaagtctccagcacgtcttcaccacagggtggaagatccgcgtc

SEQ ID NO: 9248 - DNA, 249 bp, A.fumigatus
gtcaagctgacgatcatgttatgcaggcgtcactttttgcaagctggtttacctgtaagtttttattcttttcgcctcatctgtggtgatgtctggctgacggctgcagacggcttcagcgctcttttttggctatatctcaataagggccggttcttctcgactccgatgaagaccgcgcttactattctcaatgttgtcatcatgggcgtcgcatgctgcattgtaagtccttgctggacattctag

SEQ ID NO: 9249 - DNA, 498 bp, A.fumigatus
ctgatcaagagcagtcatggttgccgagacagtatcgctgggtattctctccctcccagcggttgtagccgccttaggccttgtcccgtgagtcaatccatcccctccgccgacaattctaacgaacctagagccatcattcttcttgtagcccttggtctgatgtccacctacactggatacacgatagggcagttcaaatgggcttatccacatatccattcaatgggtgatgccggcgaggtcatcatgggtagatttggccgggaactcttcggaacaggccaattactcctcgtggtcttcattatggccagccatatcctcacatttactgtcgccatgaactcaatcaccgatcatgggacatgttcgatcgtctttggagtggtcggtttggtcatttcgtttgtgctgtgtctgccacggacgctggccaaggtctcgtttctatcagttgcctgtgcgtgtttctctgacgatgtagaatgccactga

SEQ ID NO: 9250 - DNA, 456 bp, A.fumigatus
caccttgcagccttcatcagcgtcttttcagcggttctgatcgtcatgattgccgttggtgtccaacgtccatggcacggcggtctcaatgctactgtggatacaaatttatacaaggcttttcttgcagtctgcaatatcgtcttttcattctgtaggctgttcctccacttcagctcattcatggatcgcactaacaaaacagccggccacgtcgccttcttcggcttcatggccgaactgagaaatccccgtgactaccccaagtcgctcttcctgctgcaaggcatcgacacatgcttgtacatcatcgctgcggtagtgatctactgctatgctggtgacgacgtgacctcaccggcgctaggctctgcctcaactatcgtgaagaaggtggcgtacggaatcgccttgccgactgtaagtctttggtcctcatcccaagaagccatctga

SEQ ID NO: 9251 - DNA, 432 bp, A.fumigatus
ccagaacacccaggtggccagaaaatcatcctcaaatatgctggaaaagatgcgactgaagagttcgacccaatccacccccgcgacacattggacaaataccttgaccgatcgaaacatctcggcgaagtggatatggcaaccgttgagcaagaagagaaggctcatgaccccgacgaaaccgaacgccaggagcggatcaagcagatgcctccactgcaggcttgttataacttgatggattttgagaccgttgctcgcagtgtaatgaagaagactgcgtgggcttactactcgagtggtgcggatgatgagattgtacgtggactgacgtgctggaaaccagacaagagtgtctcgctaacttcatctagactatgcgcgagaaccactatgccttccacaagatttggttccgtccacgagtactag

SEQ ID NO: 9252 - DNA, 282 bp, A.fumigatus
gctttaaatgtgggacttgttcggatttcaaagcgatcatccatagttgctttcaatccacataaaaaccggtctatcgtccctggatctttttctcgattattttctttcgtccctgattccttcccattcaatcgtcagaaaatagtcgtcacgatgaaacaagggaagctcactggcgccgaggtcgccaagcacagttccaaggattcctgctgggttatcgtgcatgggaaggcatacgacgttacagaatttctgccaggtactgtttctgtatag

SEQ ID NO: 9253 - DNA, 1080 bp, A.fumigatus
actatgcgcgagaaccactatgccttccacaagatttggttccgtccacgagtactagtcaacgtagagaacgttgacttcagcacaacgatgctgggtaccaaggtctctgtgcccttttatgtaacagcgactgcacttggaaaactgggcaacccggaaggagaggttgtcttaactcgtgcagcttacaagcacaatgttatccaaatgatccccaccctcgcctcttgttcctttgacgagattgtggatgcgaagcaaggagaccaggtacaatggctgcaactctacgtgaataaggaccgcaacatcaccaaacgtattgttcagcacgccgaggcacgtggctgcaagggtcttttcatcacggtcgatgcgccgcagctcggccgtcgtgagaaggacatgcggtcaaagttctctgatgttggtgccagtgtccaagccagtggcggggacgaagtggaccgctctcagggagccgctcgagctatctcatcgttcatcgatccttctctttcctggaaggatatcccatggttccagtccattaccaagatgcccatcatcctcaagggagtacaatgcgtggaggatgtcctgcgtgccgtggagatgggcgtggatggtgtcgtcctctccaaccacggtggtcgccagctcgagttcgcccgctctgccatcgaagtcctggccgaggttatgcctgcgctccgcgagcgcggctgggagaacaagattgaggtctacatcgacggtggtgtccgtcgcgccaccgatatcctcaaagctctgtgcctcggtgccaagggtgtcggtatcggacggcccttcctctttgccatgtccgcgtatggccagcccggcgtggaacgcgccatgcagctcctcaaggatgaaatggagatgaatatgcgcttgattggtgtcagcaagatcgaggagttgaaccctagcctgattgacgtccgcggtcttaccggcggccaccatgctccggtgccgtccgacacattgactcttggtgcatacgatccgctgcacgctccgcggttcagcgagaaatccaagctgtag

SEQ ID NO: 9254 - DNA, 582 bp, A.fumigatus
ctacagcttggatttctcgctgaaccgcggagcgtgcagcggatcgtatgcaccaagagtcaatgtgtcggacggcaccggagcatggtggccgccggtaagaccgcggacgtcaatcaggctagggttcaactcctcgatcttgctgacaccaatcaagcgcatattcatctccatttcatccttgaggagctgcatggcgcgttccacgccgggctggccatacgcggacatggcaaagaggaagggccgtccgataccgacacccttggcaccgaggcacagagctttgaggatatcggtggcgcgacggacaccaccgtcgatgtagacctcaatcttgttctcccagccgcgctcgcggagcgcaggcataacctcggccaggacttcgatggcagagcgggcgaactcgagctggcgaccaccgtggttggagaggacgacaccatccacgcccatctccacggcacgcaggacatcctccacgcattgtactcccttgaggatgatgggcatcttggtaatggactggaaccatgggatatccttccaggaaagagaaggatcgatgaacgatga

SEQ ID NO: 9255 - DNA, 840 bp, A.fumigatus
ccagcagtggaagggctccagaggatgcatcaccctcacaaagtagttatctggggcaaccacgacagatgcttcgacatacgctccagacgagacgaagaccgcgacgcttcctcctcatccttcgtggcaatatcctcctcgaccgcctccatccgctccctcgatgacgacccagacggcctcaaccgcatcaactggggcgacatccactacctccaacactcctccatcactctctccttccccccgccgtccccagcccacgccgcagcccgcccgcgctccctaaccatctacggcgccccccaagtccccgccatcgtccccttcacctccgagcacgccttcacataccacccacaacacgatgcctggtccggcaccatccccccggacactgacatcctgatcacgcacaccccgccacaggcccacctggacttatcccctgtctactccacaggctgcccgttcctgctcgccgagacgtggcgcgtccggcccgcactgcacgtcttcggccacgttcatgaagcatacggctgcgagccggtctattgggatgaggcgcagagggcgtgggagcggctgtgtgcgtcgaggcggccgcgtgcccggtacggtcgtctgatgtccgtcttcgggctcctgcgggacctgtttgatgttcatggctggctggatgcgatgcgggtcgtcacgtacggcgtgctaggggttgtttgggccaaggtctggggtggtgagaatcggggctgtgggtggatggtgaatgccgcttgtatgtataggaatacgggacggttggggaataaaccgcaggtcgtggtgttgtaa

SEQ ID NO: 9256 - DNA, 273 bp, A.fumigatus
acctcaatcttgttctcccagccgcgctcgcggagcgcaggcataacctcggccaggacttcgatggcagagcgggcgaactcgagctggcgaccaccgtggttggagaggacgacaccatccacgcccatctccacggcacgcaggacatcctccacgcattgtactcccttgaggatgatgggcatcttggtaatggactggaaccatgggatatccttccaggaaagagaaggatcgatgaacgatgagatagctcgagcggctccctga

SEQ ID NO: 9257 - DNA, 939 bp, A.fumigatus
  unsure (917): Identity of nucleotide sequences at the above locations are unknown.
gaccctgctgagctagaccaaatcaccacattgcctaatggaatccgcgtcgccacggaatccttacccggaccctttgccggcgttggtgtctacgtcgatgcgggatcccggtacgaagacgagagcctacgaggcgtgagccacatcatggaccgactagccttcaaatcgaccaagtcccgaacaagcgatgagatgctggagactcttgagagtctaggagggaacatccagtgcgcttcgtctcgggagtcgttgatgtaccagtcagccagtttcaactcggcagttcccgcgaccctgggccttctggcggagacaatccgtgaccctctgatcactgatgaggaagttctccagcagttggctacggcagagtacgagatcaatgagatttgggccaaacctgaacttatcctaccagagctggtgcatatggcggcctacaaggacaacacattagggaacccgctactctgtcctcgtgagagattggaagagattaacaaggctgttgttgagagatacagggaggtctttttcaagccggagaggatggttgttgcctttgccggtgtgccgcacgaggaggctgttaagctaacagaacaatactttggtgatatgaaggccgcaaatcaggccaaagggcccgtattatccgggactggaattgagacgaccttgtcagattcagagacagcagctcaggaaggacaggtgccgaccgtccctcaattcacgccatcgtcgacaatcaccacaaccccaacctcaaaaacccagtcagtcctttccaggcttcctttcctgaagaacctctctacaaccgcgtcgaagcctgcatctgtggcgccccttgatccttcgttggtgcagccatcatcgctggacttgacaagaccttctcagtntacacgacgggatggaagctaa

SEQ ID NO: 9258 - DNA, 381 bp, A.fumigatus
cgtgcaagcctagagctcattataggggtaattagtaattataactatgctatctctgttgcgctaactacagggaatattctagctgagtatatatatattctatgctatgtctttgacagttgtgctaaagataattacttaaagaagccttgccttatagttgctgataagcatcagaggagactattatacaggacctcttaccctaggcatcttccctataatatataccttagaatagagggagcctatagaaccgcagccattacacaaagattaaagttaggcctattattaggcacatacctttctctattacaccctacctttcttaatctaaactatataggcaaaacatatattactaataatatatag

SEQ ID NO: 9259 - DNA, 207 bp, A.fumigatus
gacatatatactacagagataaataaagaactacttattacatctactctcaaaagagcaaaagttctaatattaactggactggcgagtcttggtaaatactactttcccaccctagagatttatgacttagttaacaccatgtccaccctattacacattaactttaccaaactcctagagacctggggcccgggcagtgagtag

SEQ ID NO: 9260 - DNA, 192 bp, A.fumigatus
acaaaagcctccaggtatgcttcttttgctcattttgatgggctgatgctcactgtggtctatcaggaggtcaacatccagaacatgaatgtggagcttgtggctcagatgttcaagaactaccagtccaacgttctcttccacttggaaggtagagttgtcctccctctcagaaggctacagccttgctga

SEQ ID NO: 9261 - DNA, 1011 bp, A.fumigatus
actaccctagacgaagtgagtaaatgcttgttccagaaggagtgtgctctgacgcccgtagtgatgaacgagatcctcttcgagtgctattccgcgccgtccgtcgcttacggaatcgattcgctattttcgtaccgattcaacaaaggcaccgatggcctgattatctcctcatcccacacatcgacgcatgtcatccctgtcctaaactcgaaagccttgctctcgaattgttcgcggttgaactggggtggcatgcacgcttcggagtacatgctcaagcttatgaagctaaaataccctaccttcccggctcgaatgaccgaaagccagatggaagatttggttcacaagcattgctacgtatctacggactatgaccgggaactgagcagctatctcgagtggacagggcttgaggacagggatcatatcattcaatacccttttacggagcatgtggttccagagaaaaccgaggaggaactggcacggattgcggagcggaagaaggagagtggacgtcgcttgcaggagcaggccgcaaagatgcgactcgagaagttgatgaagaaggagcaggaactcgagtactggaaggacctacagcgcggccttgcatccgaaaccaagaaggaagcgagacgtatcttggattctgaggatttgaaagatgaggctcatctggaccggctgatccgtgaccttgagcgatccatcaaacgctctagaaaccgagacctaggagttgaagagactgaagagcctcctgaagatatgtctttcccgctacttgatgttccggatgaagagctggacgaggcaggcttgaaggagaagcgccaccagcgactcatgaaatcaaacatcgaggctcgccaacgtgccaaggccgagaaggaacgcgagagagcacggaaggaggaagaggagcgactggatcgggaaaagcgcgagaacgactttgagaactgggttgccgaacgaagagcagctcgacaggtgtgttga

SEQ ID NO: 9262 - DNA, 564 bp, A.fumigatus
  unsure (556),(557),(558): Identity of nucleotide sequences at the above locations are unknown.
aatattttgcaaaggattaaggagcgcgataggatgaaggcggatctgggtaatcggaagtcgctcgccagccagatgcgtatgaaaacccttgcaaacctcgctgcggatgggccgaagaagcgaaggagaggcggtgacgacgacgatttcggcgccaacgatgaggactggggtgtgtatcgcacagtggcaactggagaacagagcgacgaggaggaagaagaggacctcggcgaaatgctcaccaacattgagaatgagcttcttcagtacgatcccgagtttacagagaaccacactctggctgcgcagtctgactggaccaagagtctggtacatgttttcctacgtggaccctggccatttgaccctgaaagtcagcgtgaggcccatcaaatccatctcaatgttgagcggattcgagtacccgaggtcgttttcaagccatcgatcgccggcatcgaccaggctggcctcttggagattgcggccggtattgtcaaccagcggttcgtcttcaccacggggctgcaaggagcagtcgatttcaatnnnaccccc

SEQ ID NO: 9263 - DNA, 639 bp, A.fumigatus
agaagctcattctcaatgttggtgagcatttcgccgaggtcctcttcttcctcctcgtcgctctgttctccagttgccactgtgcgatacacaccccagtcctcatcgttggcgccgaaatcgtcgtcgtcaccgcctctccttcgcttcttcggcccatccgcagcgaggtttgcaagggttttcatacgcatctggctggcgagcgacttccgattacccagatccgccttcatcctatcgcgctccttaatcctttgcaaaatattctacgaacagttagttatcttgccgaattcaagcaagaatcaacacacctgtcgagctgctcttcgttcggcaacccagttctcaaagtcgttctcgcgcttttcccgatccagtcgctcctcttcctccttccgtgctctctcgcgttccttctcggccttggcacgttggcgagcctcgatgtttgatttcatgagtcgctggtggcgcttctccttcaagcctgcctcgtccagctcttcatccggaacatcaagtagcgggaaagacatatcttcaggaggctcttcagtctcttcaactcctaggtctcggtttctagagcgtttgatggatcgctcaaggtcacggatcagccggtccagatga

SEQ ID NO: 9264 - DNA, 228 bp, A.fumigatus
cttggtggcgctctggctccgcgtagtcaacctgtgcttgccgacgaagttcagacgttcaaggccttgattacgatacataaagttctgcaggaaggtcacccgattgtggtgagagaagcgcaacagcatgtcaattggattgacagcttgatgaggggcgttggaggggatgggatcagaggtatgcggcagaaatggcttggctgcaggggagcactcggctga

SEQ ID NO: 9265 - DNA, 1134 bp, A.fumigatus
atgctgaccttattgtcacatatagctacgggagataacgaggcactcgagccacttcgtggtcgatatgacgctcagcactatcggctagtccgattctactatgaatgctccaacctgcgctatctcacgagtttgatcaccgttcccaagttgcctcaagatcccccgagcttgttggctgaggacgaggaccgtccggccctaccgaaacgaccgacgaaggaggttgagaaacagccttcgccgccaccgaagccagtggctgctgagccggagcccatcaacgacttctggaccaacgaggcgaagcgtcaacaggaggagtttgaagcagagcagcgacgccttcagcaacagtgggaagaacagcagcgtcagcaacttcttgcgcagcagcaggcgcaacgtgagtttgaggaacagcagcgtctgcaggcagagcagcagcgactggctcaggaacaactcctgcgtgagcagtatcagacccagactcagggtcgattggctgagcttgaacgggaaaacctgaatgcccgggcgcagtacgagcgtgaccagctgatgctgcagcaatatgatcgccgcgtgaaggatttggaggagcagatggcgcagctgaccacgaacttgaacatgcaaaacgcttcgaaagacgaacagattcgcgctttgcaggagcaagtcaacacatggcgctccaagtacgaggccctggctaagctctactctcagcttcggcaggagcatctggaccttctgcagacgaccaagagcctcaaactcaaggcagcgtccgcccaggaggcgattgagaagcgcgagaagcttgagcgggagctgaagacaaagaaccttgaactggccgatatgatcagggagagagatcgtgctctgcatgacagggaccgcttgacggggaccaataaggaggagctggagaagctcaagcgcgagcttcggcttgctatcgaacgcgctgagaatgctgagcgctcaaagggtaccgaaatctcgaccctgctgtcgaagtacaaccgtgagatggcggacctcgaggaggcactcagagtgagtctcctgacctggaaattttccttgacaagcctgctgactctattgccagaataa

SEQ ID NO: 9266 - DNA, 279 bp, A.fumigatus
ctatgcccttcgcgtccaacggtgatgacctccgctgaccactgttccagatacgagaccattaccgatctcatgaccctacaggaccatattgacactttccaaaagctcatcttctcacacttccaatcaggaaccaataacgagtgtagaatttccgcattggttccccttgttcaggaaagctatggcatctacaagttcatcactagcatgctaagggctatgcatactagtaagcatccgcttgtccgaagcaggatgctctttgaatgctga

SEQ ID NO: 9267 - DNA, 405 bp, A.fumigatus
cttgctcctgcaaagcgcgaatctgttcgtctttcgaagcgttttgcatgttcaagttcgtggtcagctgcgccatctgctcctccaaatccttcacgcggcgatcatattgctgcagcatcagctggtcacgctcgtactgcgcccgggcattcaggttttcccgttcaagctcagccaatcgaccctgagtctgggtctgatactgctcacgcaggagttgttcctgagccagtcgctgctgctctgcctgcagacgctgctgttcctcaaactcacgttgcgcctgctgctgcgcaagaagttgctgacgctgctgttcttcccactgttgctgaaggcgtcgctgctctgcttcaaactcctcctgttgacgcttcgcctcgttggtccagaagtcgttga

SEQ ID NO: 9268 - DNA, 267 bp, A.fumigatus
cgacatatgcacaaatcagccgagtgctcccctgcagccaagccatttctgccgcatacctctgatcccatcccctccaacgcccctcatcaagctgtcaatccaattgacatgctgttgcgcttctctcaccacaatcgggtgaccttcctgcagaactttatgtatcgtaatcaaggccttgaacgtctgaacttcgtcggcaagcacaggttgactacgcggagccagagcgccaccaagtcagtcatcatatccacaacatag

SEQ ID NO: 9269 - DNA, 222 bp, A.fumigatus
atcacgctcgacagcctcaagaaatgggacggaggacatctcgaagagaaagatatcgactgggcaacaccagctcatctggcagatagacgtatggtattcgtagccagagagctcctcaaagctgcgctagctattgctcaggatccattcgcagagagcccatatatggaaaaagctattgaggagggcttggccatcgaagggggtaggttcctttag

SEQ ID NO: 9270 - DNA, 459 bp, A.fumigatus
ctccttcctttgcaaagggcatctattattctgcgcttctgcaggaaggagaaagccatgagtatcggaaaagatgatgactatgttgtgtcgtatagaggtgaagtggttgaaaaccgacacaaggtccacgcttcagttgttgacgcaacagggaaacaacactttcatgttggtgacccatcacgaatcacattagctcgctccgcagcaaagccagcccaggcgcttgctatactcgaaacgggtgcctttgagcagttcgatctcgacgatgcagacctggcattaatgtgcgcgtcacacagcagcgaggaaaggcatatcaccagggcgcgcaatatgctggccaaagcccaagtcaaggaagacgatcttcgctgtggtggtcatccggctttgtcagctactgtgaatatagaactaagtcttcaccccggggctggaaggaaccgcgta

SEQ ID NO: 9271 - DNA, 318 bp, A.fumigatus
ttgacgtactttacctacctggttctaggtactgtagctcacacttttagactagctgacggttactggatctggcgtccagcattgttacagagaaagacgaactgttggtcttactgctcccttcccatcattattattagttcctttttctgtttcccttgccctcccctctccctatttgtttatcgatcacttcgtcagtctacttctactcgtcctcccactgctgcttcttcaacctccgaatgtaacttgtctctgctactgacaactattaccattacccactcttcagctcgcgttaaatacttctga

SEQ ID NO: 9272 - DNA, 456 bp, A.fumigatus
agtcgccaggtaactgggaaagccaaccggcctgacactacacctcccactgttcccgtccgtaaaccagaatttctgcccagccgggagacgtcgaagctgagggcgacatggttaggccatgcctgctactatgtcgagtttcctgacggtctgcgagtgttgtttgatcctgtctttgaggatcgttgctcgcctttctcctggcttggaccgaagcggtacacggaggtgccgtgccagatcaaagacatcccttttatcgacgcagttgttatctcccacaaccattacgaacatctatcacacccgacagtgaaagagatcgccaaactgcatccgaattgccatttctttgcgcctcttggtaacaaagagtggttttcgagttcgggaattaagtatatgactgagatggactgttgggaagagtgtgatgtcgtcctttcgccttag

SEQ ID NO: 9273 - DNA, 189 bp, A.fumigatus
gtcctgttgttcagacgcgtcttacacaccccccgtttaaggggaaagattaatactgctcagcctccaccttattcacacgcaactaatcctttgagaatgatgggctccgtgagcttcgccaaggagcgcgtcggctcggagatagcgggattagtgactgacatgcaagtctttgcttcggattga

SEQ ID NO: 9274 - DNA, 396 bp, A.fumigatus
ctgggtattgtgctcagagatattggataccgtgcggtacctgaacttccggacggcgtggacgatcacgccccggagtatgattacctttcgtgccccgcgttcaagcaggtcggcgaattcagaggaccatttgacctcggtctgatccccatcggagcgtacgcgccacgattcatcatgagtccaatgcatgcagaccctcatgatgctgtggaaatattcagagatacaaaatgtaaacgagcaaccgccatgcattggggcacgtgggtgcttactgaggaggacgtcctcgaacctgcgaagaaattgaaggaggcgttgaagaagcattcaattcctgaagagggagtgttcgatgtttgtgacattggggaaagcagggagtattga

SEQ ID NO: 9275 - DNA, 270 bp, A.fumigatus
ctcggcgagataggtcaggctggcaatatccttgcggaaacaggagccgccgaacccgagtccggctttgaggaattgagctccaatgcgcgcatccagaccgatagcttgagctacttggtcgacctcagctcctgttttctcgcaaatagcactgatagagttgatgctgctgattctctgggcgagcatggcgttggctacaagctttgcgagttcggacgaccatgtgttgacctcgaggatgcgcgacgagggcacccaagatga

SEQ ID NO: 9276 - DNA, 600 bp, A.fumigatus
agaacatctgcgttgtgggcgctggatacgtcggtatgcttgtgctattctgtttcagtggtgcaaagtctcattgttacaggtgggccaactgcagccgttatggcgctgcacaacccgtcgatatcagtcgaagtcttggaccgagacccggttcgcattcggcagtggaactcaccacaccttcctgtacatgaacctggcttgatcgacgtcgtccgagtgacgagagacggagcagagatagtcaatcaggagactacgtccttggtcagcgcaacacgcttgaagcggcgcgcaaacctcttcttcacaagtgactcggtgacaagtatctcacgagccgatgtgatcatgcttgcggtcaacacacccaccaagacgtttggtctgggcgctggtcgagcgacgaatatgtcagctattgatgaagccgtgcggcagatagctatctatgcaaaaccaggcgcaatcatcgtcgagaagagcacggttccttgtggcacggcgcagcgcattcgacacctggtacgtaccattgacctaatgtgcctgctcttcattgatcgcaaagtgacgatctatagctggccactctga

SEQ ID NO: 9277 - DNA, 1206 bp, A.fumigatus
ctggccactctgagacccggcgtgccgttcgaggtgctgtcgaaccccgaattcctgtctgagggctcagctatcgagaacctcatctcacccgatcgtgttctcatcggatcatctggaacaccatctggacgccacgcagcgcgcactcttgcacagatttactcatcttgggtgccctcgtcgcgcatcctcgaggtcaacacatggtcgtccgaactcgcaaagcttgtagccaacgccatgctcgcccagagaatcagcagcatcaactctatcagtgctatttgcgagaaaacaggagctgaggtcgaccaagtagctcaagctatcggtctggatgcgcgcattggagctcaattcctcaaagccggactcgggttcggcggctcctgtttccgcaaggatattgccagcctgacctatctcgccgagtcattgggcttggaagatgtggctcactattggagccaagtgaacgtgatgaatgagatgcagcgtgaccggtttgcgaggaaagtcatcgagaggttcgatggtaacttgaccggacggaagattgccatgcttggcttcgccttcaagaagaacaccggcgacacacgggaatctttagcggctgatgtgatccggttgctgctggaggaaaagcccatggagattgcgatttttgatccctattgccttgaaaaagacatcatgcgggaggtcgaacgtgcctgcggcaccttggacggaaggatagtcaaagtctttccggacccgtaccaggcttgttctcaagccgacgcggttctcatcatctcggattgtgatcaatttcggaacatgccgaccagatcgaagccgaacccttttgcttcacagacagaggctaaggctgctaacactctttccaaagccataatatcgaaagatccagaggaggacatttggtcatgcaacagcctgtcataccgcttgtcccctcagaaaccgtgcgatgattgtgaagtatgccgtttaacagtcaattatcccactgccaccgagcctgtagaatgggcacgcatagcatacaacatgaaggcaccgaaactggtcattgatggacgcggaatcctggatgttcatgaaatggagaaactcggtgtccatgtggacgctgttggaagacgaccgcctgttatttccacaggcattgaccctttgaactgtgacatctag

SEQ ID NO: 9278 - DNA, 411 bp, A.fumigatus
cattccactatagagcaaatcaagcgtctacagcagaacggcaatgttgagcatgaatttttcatattttggctacccagacgaacatttgtaagcaataagatccttgaagatgcaggaatcattggcgatgtgaatatcttcgagtttcccctgtattttgtacctctcgaacaagatgtcctttccctggaattggacgactccttcggtgatctctacttggtaagaaccagaaatattgtctcactgcaacccatttgcttatcatcacgcagcataaagatccaggttgtatcttcctcgccgcaaaggctctcatggatattcagcaaagacatggttattttcctcgaatcattgggaagggagatcacgcgcgccgactcgcagaccttctgttgcggatga

SEQ ID NO: 9279 - DNA, 936 bp, A.fumigatus
tctctacttggtaagaaccagaaatattgtctcactgcaacccatttgcttatcatcacgcagcataaagatccaggttgtatcttcctcgccgcaaaggctctcatggatattcagcaaagacatggttattttcctcgaatcattgggaagggagatcacgcgcgccgactcgcagaccttctgttgcggatgagaaaggagctcgatgctgaagagagctccggtttgaggggcccttctgcaagaggacttctgcccagcgcgagtaccgaaagtctgatcatcattgaccggatggtggacttcggcactccactactcacgcagctcacgtatgagggcttaattgatgagtttgtcgggatcaagaataaccaggcagatgttgatacggctatcgttggagccaactctgttccccaggcgcaggagtcttccaaggctccccaacaaaccctaaagcaggggcagaagcggaagattcaactggactcttctgatcagctgtttagccaagtgcgtgatgcaaactttgccatagtcggcgatattctgaataaggtggcgcggcgtctagaaagcgagtatgagactcgtcatgcggccaagacggcttcagagctacgcgaattcgtgaataaactgccagcttatcaattggaacaccaaagtcttcgcgttcatacgaacctcgcccaagagataatgagaaacacgcgttcagatatttttcgcaaagttcttgaagtccagcaaaataatgctgcgggcactgacccaacgtatcaacatgataccatcgaagagttgattgcccgggatgtgcctcttaagactgttctccgtctgctgtgcctggagtcgtgcatgtcaggcggactccgttctcgagatctcgagaatttcaagaagcagatagtacacgcgtactga

SEQ ID NO: 9280 - DNA, 480 bp, A.fumigatus
catcagcacatactgactttctctgccctggagaaaatggagctcctgcagccccgttcatcggatgccaccatgcttattcagactgctggtgctcagccaggaagtaagacaaattataactacttacggaagaacctacgcgtgctggtggaagaagtcagtgagaaagacccgaacgacattgcctacgtatacagcggcttcgctccactcagcattagtcttgtcctatgcgttctgcagaaaccctatatattctcactcgtcaagggcggtgctgcctctgctacctccacccctgcaagcactgcatcccccggctggctcggattcgaagacgtggtaaagagcgcccgtggcgcgactttcagcattgttcagaagggagatgataaggcagttcgtgcgcgacagacgctgagcggcaacaatgccaccaagattgtatatgtattcttcctaggtggagcgtgttga

SEQ ID NO: 9281 - DNA, 819 bp, A.fumigatus
  unsure (601): Identity of nucleotide sequences at the above locations are unknown.
atgatctactggtatataaatcttcagactcccaccgcgacatcattaacaatcagataccttgttcttagtactaataacgacgaaatgccctccatcaagaactccacaattgtcatctttggcggtagctccggcatcggctacggtgtcgccgacaaatgtctctctgaaggcgccgtcgtgcacatctcctcctccaaccccacccgcatcactcaggccgtctcttctctgaaggagaagtatcctgaggggcaagtaaccggccacacttgcgacctctcccttccggacgtggagcaaggcctcgtcaagctattcgaggaaatcgcctcctgtgaccacatcgtctacaccgctggggacgcgctagccgtcagaccgcttaaggacctcgatctgcagttcatccagaaggcaggacacatccgcttcgatgtcccgctgctcgttgcgaaacttgccctgcgggtcctgaagccagggtatacctcatcgctgatcctgaccggtggcgcggtaggggatcggccgcagccggattgggctgttgttgcggggtatgcggctgggttgtacgggatggtgcgcggtctanctttggatatgaagcctctgcgggtgaatttcgttagtcctggtccggtgaaaacgggactgtttacggatgaattggcggagatgttcgcgaaaaagaccacgctggggaaagtggggagtgtaaaagaagcggcggaagcgtatgtttatctgatgaaagataccaatgctacgggtatctgtgtgagcacgaatgcgggatctttgttagtctga

SEQ ID NO: 9282 - DNA, 432 bp, A.fumigatus
cgcgactttggcccagacaagtaccacctcatcccgccacatggccgctggcaacactttgaagtcggcggcgtcagtcgccctgagagtctactgaaacagtggaagagtgacggcgcgaatccacttgagcagacacgtggattgttagacttattcttcgtctcggtgctacttgacgcgggagcaggtgacagatggcggttcactgaaccagacacggatatcgttgttggccgtagcgaggggaccgcattagcctcgtacaatatgtttgtaaatggcgacttttcgactgttgatagtgagagaagggatgttgtgatgggttcgtcccatacccttcctagtgacaagagcaggactaaatatcaacagggcaagccctcaaggactttgacgctgcaactctgcaacgcggtttccagatag

SEQ ID NO: 9283 - DNA, 210 bp, A.fumigatus
  unsure (134),(140),(157),(166),(174): Identity of nucleotide sequences at the above locations are unknown.
actcgtatagagaaaagagctttaccaattactggaaagggctttccggaagcttcttaccgaaaaattgctgtctatacgcttatgcagggcttgtttcatcattcatcgcgcattcctcgttccggttctangccacnggttagggggttagctntaactgcantgaagcantatccatccaatgggaagaccccgaaattattataa

SEQ ID NO: 9284 - DNA, 189 bp, A.fumigatus
ccggccaatcaccccaggtccgaaactctccagtttgccccacagcctgcgacggactttcatgtccggttccccaaggactatctcgacggcaatggcccgaactcgattggattcgagtacgccctctgtcatgagaggacatatggatttagatcctccagtagacatacctcgggtccctactaa

SEQ ID NO: 9285 - DNA, 291 bp, A.fumigatus
tccttattagcaagggagaggacgtcagtgcccaggggggtatatatggcaacactctccggctgcttcagctgcaggacattcagagatcgtcaactgcttttacataagggggcggacatcaattcttcggggagcgaatatgataacgctgtctatgctgcttcagctagaggacatcaagagaccgtccaactgctcgtagagaacggggcagaggtcaatggtcaaggggagaaatatgacaacgctttccaggctgcttcagacaggccttcgagggaatgttaa

SEQ ID NO: 9286 - DNA, 1341 bp, A.fumigatus
acgcttagcgcggatccttcgagccccgtgggtgaagaacatcaccatctaccattcttgcatcaggagtcgttcaagcccactatggcttcgcctccgctcttactggccgtgctttccattggtgctctgtacacgttcgagcgcgaacacgcattcatgctccacgtcggatccaagatgctcgtgaaccaattcttgcaacacaaggagaatttcgattcgagaaaatgtccattgtggtccatgcaaagcactctgttgaacatgatttttgagagctggagtggtgatcccaaaggtctcgagtggacctgctcgatcaagagcttgctcgccaacatggttgctggaaaccgttatcaattgaaggtcagaacggaagctcgcgagggtcgtcaaccaactagagacgaatggatcgaggacgagtcctgccgtcgaacttactacgccgtctacatcttcttcggcatgctcactctgacattcaaccacaccccagcaatgagcttcgacgaattcgacaatctcgagctgccgtcctctgagtcgatgtggaacctggacgtcaatgacgacgaggcctggcgtcgaagcctgtcctctgccagcacgcttaccgtccgggaagctcacgactgtcttttccagggtgaacggacgcgttacagtgcctttgccactcgtgtcttgattaatgcccttttcttgcaggtgtggaatcacaagaggacctttgaggctcttcaggatgtggtcactgagtacaaactccgccttgcgctggagacatgggagagttctctggaagtttgcgaaccagagacgatcgtcgtgcctctgagcacgcctcagaacggacaccctttgatcttcaactcgatggctgtctatcgtaacacgcgtgctcgcctagaggttgacctcaagtcaatccaggaagccttgcgctaccattcttcctacgaggttgctgctgcgatgacagtggcccgtgagaaggtgaagcggtctggggagatgaacaaggtgatccagtcatgtttcgagtgcatcgagattgcagcagtccaaggcattaattgggttgccaaaacgtcggcaacaaattggagtgtcgagcatccgctctgcggcttggatctgatggtcatcctcagtctctggctttatcgcctggaacatgacgaagagccggcgactgaggctgagctggcgatctacaacaaggtccggaatctgtttgatgacgacgccgttgacgcttttggtaaactcagctccaccgtggcccgtgtatggggtaacatcctggacggcgtggtagtctgggggtaa

SEQ ID NO: 9287 - DNA, 225 bp, A.fumigatus
gtgtctctgtatccgagtaggattgctcgactcaaaaagcagatggagcgcaagggaagagcttccctacactatgccgcagaggacggacattgggaggcagtgaagttgctatcgaaacacgattgtgtcagtgtgcaagcgagggacaattctagcagaagagacatggatttggcattggataacgacttttatgacgtcttcaaagcgcttcaggactga

SEQ ID NO: 9288 - DNA, 249 bp, A.fumigatus
aatttgccttcctccggcttggtttctggggtaaacatgttcttcttccacggctctcgcagtaagccctcgacgactacctccccctgtggtagcccgatggctctgtctttcttattcatcatcttcttcgaaatccagcctctgttcacaagaatcgtgctttccccttcgcctctttctagtggagtgaccacaatgaagccctcctggccttcgcgcatgcggggcccgatcaacatctcctga

SEQ ID NO: 9289 - DNA, 321 bp, A.fumigatus
gcaaccatacccggttcacaaaaaagagaggatatcaaaaccgtcatgttctactccggaggtcttcaggaaggaatctcccttgctgtcacagagaggaaagctgtggtctgcttcgttcgaggtctgtctgtcattccccgcacgattacatatgatgctactatcactcagagtcgcatgctgattgacggggagagtgtagatgacgaagagaatagtaatatatgggaggaggaatatttcaaggatgacgaggtaaatccctcgatgatggcgatcgctgttgtatggcttcttaccccaatgccatctacctag

SEQ ID NO: 9290 - DNA, 708 bp, A.fumigatus
ccaccctgcgcagattgtacgcacgggacgcaagcatgggcctggcctaataattctaggtacagtgcacctcacacggcacgagatgtttctgggagcatcttcgtaaataaaagtttattgactaattacaattggcctgatgcagcgttgatccccgtcacggcgtttatcctaggcacctggcaggttcagcggctcgattggaagacaaagttgattgcgaaattcgaggatcgtctcctcaagcctcccctcccgttgccgccgcgtattgatccaactgcgatctctgagtttgattatcgacgagtctacgctacgggtcatttcaggcatgatcaggagatgttgatcgggccccgcatgcgcgaaggccaggagggcttcattgtggtcactccactagaaagaggcgaaggggaaagcacgattcttgtgaacagaggctggatttcgaagaagatgatgaataagaaagacagagccatcgggctaccacagggggaggtagtcgtcgagggcttactgcgagagccgtggaagaagaacatgtttaccccagaaaccaagccggaggaaggcaaattctactttcccgatgtccatcaaatggctgagctgacgggaagtcagccgatttggattgaacaaactatgggtaagcaaattcctagccgtgcgagcaggagatcccgacatgactga

SEQ ID NO: 9291 - DNA, 1473 bp, A.fumigatus
atctaccttgcacttgaaatgttgttgaatgtacccctgagaaccctcgggacctgcttgtcgagagctccttcgatcccactgcgttctattcgcaatgcctccttgacttcggccattggtcgcggcatccgcaagactagatcggtggaaggaaggaacgaaccgcagaagagctccacaggtgactcagaccaaagccgtggcgggaggcattttggtcgatcggatagtcgcagagatgtcggcataaaagctttcgacgaggaagagttcattaagacaggtcgattacgtgagctcagatcggaacaaggtgcagacttaccggagccaaagcgacctaggatacaaacccacgaaagggccaagaccatcaaagaacacaggaaggagagggatcttcaagatcgatccaggttgaagaggggcgagatacgtttcacagaaggggaacccgagcagcagaagaaacatgtgttggttcctgactctgttccgtacacaactcctgcgtctgaattcatctacggaaccagcgctgtggatgcggcgctacgcagcggcagacgccagctgtacaagttgtacatatatcagggagacaacgaggaacttggccccacacgatctatgctacgcaagctcgccctctccaaaaacatcaaggtgaaaatggcatatgcaggatgggaccgactgtttgatcagatgagttctggccgtccccacaatggctgtatacttgatgcatcccctctgccacaactgcctgtgaagagtttttgcgccactcagaccttgggcgcggatgagttccgcgtggtactagcgcctcagtcaaaggaggaagcgatggtgaacagcacgaacaatcgcgtccccgtccgccaccttccaggccaaagcagatatccagtggtccttctcctcgacgggatcaccgatactggcaatcttggcggcatcatccgctctgcctattatctgggaattgacgccatcgtcttcgctggccgaaactgtgcgcccctctccccgataacgatcaaagcatccgccggagccgcggaaaatatgcctcttattaaagtcagcaacgaagtggatttcatccagcaatccaaagccaacggatggcgctttttcgcagccgatgcaccgttaccaggtactaggtaccctgacacaaccggcgatatcgacctcactaggaacgcggtcacgcaggcacctagtgtcatcatgctgggcagtgaagggtcagggttgagtggccatatcaagtcccacgcagattcgattgtcagcattcccggggcgagaaacgcgactgagtggggatatgagaaggaccccgccagagttgacagcctcaacgtaagtgttgctgcggcgattctgatggaacaatttctgcgaatcccgatcttgatcacagaggcgccgccaaggaaggctgtgaataaatga

SEQ ID NO: 9292 - DNA, 225 bp, A.fumigatus
ctaaattcaatggctcgcatacggcgcacactcaacgggaaagacctcaatctacgcttcaacgaacaccccagccagggcctcagcaagcatctcaacaagagcaacccctctcgccggatgcgatgcctcgtgaaatgcgacttgctgcagttgaagtacctccgatcgccaacccagaagagtatgaatttcttcctggccatttcggggtccgctatgtga

SEQ ID NO: 9293 - DNA, 423 bp, A.fumigatus
gtcaccttctctcaccttcagacacttgagaacggtccggaggccctactccacttccagagcactgattaccgatcgtcatctcccacaacttctcacataacgcttcactcgtcagacaaggaagatgttgaatctgaaacccgaggtcgacgatctcgacgcacaaagaatgctaccttcacggatttctttgggcccctcagcagcgacgacgagcctatgggggatgcttcgagtgatgatattatttcctcctctgctatcaccgcaaggactcgccccctcaagagagatgtccgcaaccaggtgccgcgccgatccagacagcagtcaagttcagagaacgagttccctgatcctagatgcaaccgcttctcaaattcggcagcgggaagaccttgcgggggaattctgccttga

SEQ ID NO: 9294 - DNA, 567 bp, A.fumigatus
actctccttcaggcattgaaattcattcccaatcaccgcgtcctcccagaggggttcccaacgtctttccttgagtatctttctcctcgatcgacccttgcgccccctcatccttccccgctagcagcgaacctgttcaacgttgatggcgtaacttcagtgttctatggtccggacttcattaccgtgaataaatccagcgatgccaactgggcacacatcaagcccgaggtcttcagccttatcacgcaggctgtgacatccggagaggcgattgtcaatacggtagagaagacaggagaacatgcgcaggagagcggtgagcaggaatctctcagttttagcgaggatgatgaccaggttgttaacatgattcaggaacttcctggaaccgataaatcctgccttcctattcctgaaagaccgtggttgatatttgaaactccgggggccttccaagaaaccggcctttggttaaattttaaaagctcaccttgggttcggtttccggctactttgcctaactcgaaactccctggtgaacttttgaaaaaatgggccttctga

SEQ ID NO: 9295 - DNA, 507 bp, A.fumigatus
  unsure (461): Identity of nucleotide sequences at the above locations are unknown.
cccgctgttcacagttgctcgctcgcctgcactcagtcccataagatctattgcgcacccaaaccccaggggccggagcccaaaagcgcgacagataccacccaaaccacgcctaacgtccacggcgagcaggaagtcaccgagagctcgaacgcactagcaaatcgaaatgcatacagcgtggaagcactagcgtcctccccacaagtcaaagacctacttgctcagagtcctcagcttcgtgattgcctgcgcgatatctacaagattactttggaagaggagtggatagaacagggacctcctggtcgatcacgaccgtaccatagaggacgtggaggttaccgcaatcgaggctcgtggacccgagagaaaggtttcaaccgaggattgggtaagcttaggaaattgagagagaggtgtgaaggaggatcggagaccggaaagcacgcagaggcgtntatgaattttatggctttggtcaacggtgagaaccagcaccagcaa

SEQ ID NO: 9296 - DNA, 1014 bp, A.fumigatus
tgggaatgcatatgtgcagttcaaacattattggatgcgccagggcagtatgatcccagaggcacagccccattatatcatcactcctttcatggaggagaacttcaaaaatctcgttcgagcgagctccactcgtcgattccccagtgctgttgcaggggtcccacatcagcgggtaaaacaagcatgatagagtatcttgccaaagtatcgggcaacaagtttgttagaatcaacaatcatgaacacaccgacttgcaggagtatcttggttcctatgtctctggtgatgatggaactttgcgttaccaggaaggtgtgctggttgaagcactgaggaacggttattggatcgttcttgacgaacttaatcttgcaccgtcggacgtcttggaagcattgaacagacttctagacgacaaccgcgaactattcatacccgagactcaggaagtcgtccacccgcatccgaattttatgttgttcgcgacacagaatccggccggcctgtatggcggccggaaagtactgtctcgcgcgtttcgaaatcgtttcctcgagttgcatttcgacgatatcccagaaagtgagttggagttcatcttgaaagagcggtcgcagattgcgccatctttctgcaccaggattgtgtctgtttatcgaaagctttccctactgcgccaagcaaacaggctattcgaacagaaaaacagttttgccactctacgtgatttgtttcgatgggctctgcgccgggcagacgaccgtgaacaactagccgtcaatggctttatgctgcttgcagaacgcgtccgcaatccacaagaaagggcagctgtcaaggcagtgattgaagaggtcatgaaagttcccattgatgaagacacaatctatagtgctgctgaattggaaaagcgcgctcctaacctgaaggaattggcgcctggcattgtttggacaaaagccatgcgccgtctcttcgtcctggtctcagtagcgcttgagaacaactaa

SEQ ID NO: 9297 - DNA, 579 bp, A.fumigatus
cccgttcttctcgtgggagaaactgggtgcggaaagacgcaactctgccaggcagttgcagaaatttgtaggaagcaattgttcattgtcaatgcccatgtgaatttggaaactggggatctaataggagctcaaagaccagttaggaacagagcggcgatcgagactcagctactcaacgaccttcgaactgtggtcaacacaggtgatgctgagccgatatctcttgacgagctgacgagcacttttagtgctatgacagttgaacaattggaagcatgcgatactgaaatagtccaacggatccagaagaacattgctcgcttgaatgccctctttaaatggtctgacggtagtcttataacagccatgaagactgggcaatttttccttcttgatgagatcactctcgctgatgattcggtattagagagacttaacaatgttcttgaaccccacagttcgatactcctggcggaaaaaggcccaaatgattccatggtcgtagcgcaccaaggattccattcccttttgaccttgaaccctggaaggagattaccgaaagcgccgagcttttag

SEQ ID NO: 9298 - DNA, 924 bp, A.fumigatus
tacgtatatgcggatccgtcgggcctccgtggtgaagaagtgacgccaagttcgctttcgccttcgtccaggggaaaaatcgttcgtgcacttcgcaatggcgaatgggtcctgcttgatgaggtcaatctagcctccccagatactctcgagaatattgccagtcttctgcatcatggtagcgaaggttctccttctgttctgctatctgaagctggtgacgtcgaacgggtttttggccatcctgacttccgcatattcggcgccatgaatcccgcaactgatgcgggaaagaaagaccttcctcctggactcagatctcgtttcacggagatatacgtacagtctccggataccgacctggacgatctgctcgctttgattcagaaataccttggtgacctggcaataggcgactcaagggtcgtgtcggacctggcgcagctttacatggaaaccaagaaactcaacaacgagaacaaacttaccgacggagcgggacaacggccgcatttcagtatccgaaccctcgttcgtgctctcatatatgttctcgaaaatgcccacatatatggtttgcgccgggcggtctttgagggctactgtatgagtttcttgaccgttctaagccaagaatctgagcggctactgttgcctctgcttgagcggtatgtctttggcaatgcgaagaacgcaagggcactactaggacaaacccccaggccaccgaatgatgggaatgcatatgtgcagttcaaacattattggatgcgccagggcagtatgatcccagaggcacagccccattatatcatcactcctttcatggaggagaacttcaaaaatctcgttcgagcgagctccactcgtcgattccccagtgctgttgcaggggtcccacatcagcgggtaaaacaagcatga

SEQ ID NO: 9299 - DNA, 183 bp, A.fumigatus
aagctgggccacctaatcgaagaggttcgcgagggcttacacgtcagggatgttggaatcaaggccgagacggtggagaacggaaacgttaagacaaaggccgcggaggcagatatctatgactttgcagtggtccatatactcgcctttcgcctgtcgaaggtcttcatgtccgatctgtag

SEQ ID NO: 9300 - DNA, 1044 bp, A.fumigatus
  unsure (14),(49),(54): Identity of nucleotide sequences at the above locations are unknown.
gagcgcccgcctcnaatctatatgcggacggctcgtctgctagagaaanacgantggccccggcccttctggatgaaaatatccgagttgctcctcaaatccaccggtcggaagtactcctggcagtcctgtcggcgacggatgcagcagtacgttgagaaacgaaagacctattgggcagcattcgacgccgataaaacccttcctgatctgggcgacatggacgaagacctggcctccgacatcgacgactggatgggacggtgcgagctacggctccagaacgaggagaaagagcgcagggacaaggcgcagaagaccgagctggagcaggcggaactcgcgcgcgccctcaagctgcaacggacgttcgaatgggcgaagaatctgcctccaccggaggaaatggagcgccagccgacccactggggaatgcctccgcaccgattcgtcacaatgaacggccgattgcttcagggtctggatctcgcgttccatctgtccaaggtccggccagatgagagccgacagttggcgctcgacgctgtcctgctccacggccagttcggctacccagcacacgaccagaaaccgaaaccggatccctcgggcccttgccttgggatatttaaccccggcaacaggaagcgaccgtttgatgccatcgacggcgctgcctcggagcgacccgcgcgccagccccgtatggatcttgacccgcatacccagtcccagtcccagccccagcccccgacccaggctcagcctgcttccggcgataaaccctccgagaagagagaaactcccgcggcgatgctggcgaggaagaacgtggaccgcattgtcaaccacctctggctgcagtttgccaagggcatcgcgccgtactacgaggagcatagggaccagccacagacaaacaagcagttcggactggttctgtacgatctctaccgggatctgggccgggctttcacgaaggctgtcaaccgactcgtggatttggaatgggattccgagtgtgaatccgcatcgcagtattga

SEQ ID NO: 9301 - DNA, 597 bp, A.fumigatus
  unsure (3),(112),(117),(330): Identity of nucleotide sequences at the above locations are unknown.
ctntgtttgaatcacttcgtcgaaacgtacgatccgactattgaagactcgtaccggaagcaagtcgtgatcgatcaacagtcttgcatgttggaagtgctggacaccgcangccangaggaatacacaagcctgcgagatcagtggattcgcgacggcgaaggttcgtgcttgtctacagcatcacatcacgcgcttcggtcactcgcatacaaaagttctacacccggaacaagattggcaaagagtcagcccaactccggtcggcattccgaaccagctatatgggaatcgcccatgaaccgcgctttcggttccgcccttcccgtncccgtgatgcttgtcggcaacaagagccgccaaacaaggggaaccagcgtccttaacgcaagaaaggcaaagccctggcaaaaggaactgggcttgcaaattcttcaagggcttccgccagaaatggattcaagtttggaaaagcccttttacaaagtcgttcgcaatgttcgaaagaaagggaaaaaaggtagggggggggacaagcccaaaaatttttacccgatgggtttgggcccttttgcccaacgggaacccgggccctaa

SEQ ID NO: 9302 - DNA, 1362 bp, A.fumigatus
  unsure (300): Identity of nucleotide sequences at the above locations are unknown.
cttccccccgtgcagcgcggtaccttccagccccggggcgtgaagacaaatattcccactgcgcaggcctccgcctcctcggccacggccgcttcgatagccgtgtcccacagtgccgctgcatgcgcgagcaaggcaatcaccaagacccgtgttcagaccgtcatgtctcaagcgaccaagccaagctcgttattgaatggcccgaaggtgtttgagcgatccaagccgcagtacgcggaatacgccgcttcgtcctttgtgagcgtcaagtcggccggtgccaagggtgatggccanaccgatgacaccgccgccatccaaaaagtgctgaatagcgtgacggaagaccagatcgtctactttgatcacggtgcctacatcatcaccgacactatcaaagtgcccaagaacatcaaaatcaccggtgaggtctggccccttctcatggctcacggcgagaaatttgccgacgaaaagaacccaattcccctacttcagattggtcagcccggcgaaaagggctctgtggagatcaccgacctcgccatccagaccaagggcccggcacctggggcaatcctgatggaatggaatgttgccgaagccagccagggatctgtgggtatgtgggatgtgcacttccgcattggcggctccgcgggcacggaattgcagagcgacaagtgctccaagacgcccaagatgaccacaacccccaacccgcagtgcatcggcgcgttcatgttgctgcatcttacagagcaggcaagcgcctacatcgagaacgcttggttctggacggcggaccacgagctcgatctggcggaccacaaccagatcaacatctacaacggtcgtggtgtcctgatagagagcaatggacccgtctggttgtatggcacggcctcggaacaccaccagctgtacaactaccaggttgcgaacgcccaaaacgtgttcatggccttgatccagaccgagacgccatactaccagtccaacccagacgcactgacacccttcacgccccagaccacatggaacgatcctaccttctcccactgcacaaccgcctcgtgccgcaaggcctggggtctgcgcgtcatgaacacctcagatctgttcgtgtacggggcgggtctgtacagcttcttcgagaactatggccagacatgcttggataccgagtcgtgccaggaaaacatggtggaggtggactgctcgaatgtccatttgtacggactaagcaccaaggccagcgtcaacatgatcacgtcgtccaacggcgcggggattgtgccacaggacgagaacgagagtaacttttgctctactattgctctctttgaacaatcgtga

SEQ ID NO: 9303 - DNA, 462 bp, A.fumigatus
ttcctcaagaccgccgtatctttaatcttcatcgccttttccatccgcgactggttggagggttccgacgccgggacgggtcttttttcctcccatctgtcatcgcggtcgtcgtcgccttttgcacgaaattcaccttcttcttgtattggtgggccctccgcaaccaggtctcccagatccgaatcctctgggaagaccaccgcaacgacctcttcatcaacggcttcggtatcctcacctccgtcggcggcagtaaactgcgctggtggatcgaccccatgggcgctattatcctttcggtgcttatcagcgtcctctggctgcataccgcctaccatgagttccagctgctcatcggtgtcaccgccgataccaagatgcagcagctcatcacttatatctgtatgtttcttccattgtctggatagggaagtgaaaaatgagagagaggctaattga

SEQ ID NO: 9304 - DNA, 273 bp, A.fumigatus
aaaatgagagagaggctaattgatctcccagctatgactcattccccctacatcaccgccatcgataccgttcgcgcgtacacctccggcccccggctgcttgtcgaggttgacatcgtcatggaccccgaggagtccctgcgtgcgacccatgacgtcgccgaggagctgcagatgaagctcgagtcgttgcctgatgtggagcgggcttatgtccatgtcgactatgagacgactcacaagccggagcatttcttgaagaaggaactctga

SEQ ID NO: 9305 - DNA, 456 bp, A.fumigatus
  unsure (25): Identity of nucleotide sequences at the above locations are unknown.
accagcaggcaacattgggttatgnttcctcaagaccgccgtatctttaatcttcatcgccttttccatccgcgactggttggagggttccgacgccgggacgggtcttttttcctcccatctgtcatcgcggtcgtcgtcgccttttgcacgaaattcaccttcttcttgtattggtgggccctccgcaaccaggtctcccagatccgaatcctctgggaagaccaccgcaacgacctcttcatcaacggcttcggtatcctcacctccgtcggcggcagtaaactgcgctggtggatcgaccccatgggcgctattatcctttcggtgcttatcagcgtcctctggctgcataccgcctaccatgagttccagctgctcatcggtgtcaccgccgataccaagatgcagcagctcatcacttatatctgtatgtttcttccattgtctggatag

SEQ ID NO: 9306 - DNA, 438 bp, A.fumigatus
gactgtccccacgatacttccagtgaaagccatgtcagccccgccttcgttaaggtttttggagagaccttgaccctggttcggaaactcttccagtccaccaagccctccgcacagcccttcgtcatctccggcagtggcacactcggctgggatgttgtggcttcgtacttgatcgagaagggcgaaaatgcgctcgtcctgcacaccggatactttgccgattcctttgctgcctgcttggagacatacggcgctcacgcgacacagctcaaggcacctattggcgaccgtccgtcctttgagcagatcgagcaagcattgaaggaaaagccgtacaagataatcactattacccacgttgtacctccaccgcgtgctgagcgacttaagcgcgtcccgaaaattgtcgccgggttaccccaaacccctgtgggt

SEQ ID NO: 9307 - DNA, 828 bp, A.fumigatus
gcccgaagttcccggaacggtttatgttgggtaagttcagtaatcctctttgcctcgttgttctgccgtgataaggtcttaccatctcctttctacagacgtatcccccacggtttctacgaacatcagatgcgcgcttacttttcccaattcggcgacattactcgcctgcgtctctcccgtaaccgcatcaccggtcgctcaaagcactacgctttcgtagagttcgcctcgagcactgttgccaagattgtcgcggagactatggacaactacctgatgtatggccatatcctgaaatgcaaatacgttccctccgatcaactgcacccagaggtctggaagggtgccaacagacgattcaagcgcaccccgtggaaccgcatcgagaagaagaggctggaaaagggcaagacgagggaacaatggtcggagcgcattgagcgggaacagaagagacgtcttgcaaaggccgagaagctgaaggctctgggttatgagtatgagcttccccagctgaagagcgtcgacgaagttcctgtccaagaagagaccaaggcgattgaagctgccgatacgactgccgatgagcccaagaaggctatcgaggcaccctcggcgcaggagtccaaggaggagactaccgtggacgagattcctaagaagttgaagaaggagaagaaggcaagccaatcgactcctaagcaggggacgcccaagcaggatggcgaaaaggcgtcaacgaaaaagggagtgaatggagctgccgcttcaccggctacaaaggctgggaccaaggacaagaaggctaagaaggtgaaggcgtag

SEQ ID NO: 9308 - DNA, 630 bp, A.fumigatus
ctgacatccgtcgagcgcgcatccttccagccccgtggtgaagactctatactgaagaagaacaagaaggatggccctgctacagagcaaaattccacttccaaagtgaaggtcaatggcgagccggcaagacaggtcaagcctcgcaagcgtgcggcggatttcctcagcgacgacgagagtgagccggaagttgttgcatccgaacccaaggccgataccgaggagaagaagcagcccagtaagaagaagtcgaagaaggaggacggcactcctgcgcccgctacaaaagccaagacaagcgctactgctgcgaagcccaaggcgaccaaggcgaagaagcctgagccggtcgtcgaagagtcggacgatgaggataaccagcaggtccctgttgtctccgatgatagctctgaagacgaagaagatgatacactagacgatcagaccgccgctttgatcaagggtttcgagagcagcggcgacgaggacgaatccggggacgaaggatttgatcctgaccagccagttcccaagatccccgattccaagaaggccaagcgcaagatcttgaagaagcaaaagaagcacgatgagcccgaagttcccggaacggtttatgttgggtaa

SEQ ID NO: 9309 - DNA, 1398 bp, A.fumigatus
cggagaaccccccgcggagtcatggaatcagaaagggacccaggaaacccaggaaacccggccgtcaatccgtcggagacaaaggtcctactttcaggcgttgtacctcctccccttctgacggggacacagcatcgtgatcggtatggattccgcaagaaaacgaactatattacccttgaacagtacgaggcttggaatggtccatattcagagtttgtggcgagccggcgagtcaaatgggcagaattactcaaggagaacggactgccgacgtccgaacccacagtgttcccagccaagtcgtccaagatgaagcgatttgtccgcaaggggattccatctgagtttcgtggggcggcctggttctggtatgctgggggttttgatctcctcaagcggaatccgggactgtatgaccggcttgtcaaggaagccatggattctcccaacaacgatgataaggagcacatcgagcgcgatctgcatcggaccttccccgataacgttcacttcaaacccgaattcgtcgacgaagctatgacctcgggcactagctctggcagcagcaacccgaagtacagctcggtcactgtagagactcagatgatccagtcactccgtcgcgttctctatgcattttctctttataatcccagggtgggctacacgcaatcgctcaactttatcaccggtatgctcctgctttttcttccggaagaaaaagcattctggatgctgcacatcgtgacgtctgtgtatctgccgggcacccatgagattagcctcgaaggtgccaacatcgatctctggatcctcatggtcttactgaaggagacattacctcatatctacaacaagatcgctggcaacccgggcaggtcgaagactcccgccctgacggtggactctcggcttccggatatcacgctgggcctgacaaactggctgatgtcgttgttcattggcagcctgcctttggagacgacgctgcgcgtttgggatgtgttcttctttgaggggtccaaaactttttttcgcgtgtcgctggctatattcaaggcctgcgagaaggacattcttgccgtatccgatcccatggaagtcttccaagtcgtgcagacggtgccgaagaaactgctcgacgccaacgcgttgctggaggattgttttgtccggcgacaccgtgtcggacaaggtcgcatagaggagttgagagcctcccgacgggcggctgtccgacaggagaaactgaggcgttcgctggcgatcagcaagggtcaactccaggctgccacggacgagtggccgaccacaaggtcgcggacgcctattcctgggttggagcgcaaagtcgcggattcctggcgtcaaatgaggcaacatgcctttagatga

SEQ ID NO: 9310 - DNA, 285 bp, A.fumigatus
caaagtacagcgcggattgccggccctcgtggtagaagaacagctatgctccctatgcagaatatatggcagagaaatgagacatggaccaagtatctctacttcctccttaacgagagacaaaatatcgccatccggattctcccaataatatcgcagaagcaaaatggccagatttctatcttcagacttcagcctacccgcatctctgcatttaaagagctccgccctttggacctgattatgaggccaccacgtggacggtgcacgcgtcggaaggcgtga

SEQ ID NO: 9311 - DNA, 183 bp, A.fumigatus
agaccgagactggagcagtgtcactgcatgctggccgactttgatctgcgtttcgggtgtgagtttccgaaggacggcgatgaaggagtcgagaagcggtcgcgccgctacgatgctaatttcttcgctgagtaccgagtcaagatagtagatgaggtcttggccaagctcatgttcggatga

SEQ ID NO: 9312 - DNA, 1284 bp, A.fumigatus
  unsure (1188),(1206): Identity of nucleotide sequences at the above locations are unknown.
gcttgcactctgctcaagagaacctcccttatggcatctcagaggatcgcctccgcactcgcggagattgagtcgtccaccaacccacagaccaagctccagcagtacaacaaccttctctccgagatcacgtccacatcatccgaacatgagcttggccaagacctcatctactatcttgactcggtactcagcgaagaaattagcatcgtagcggcgcgaccgcttctcgactccttcatcgccgtccttcggaaactcacacccgaaacgcagatcaaagtcggccagcatgcagtgacactgctccagtctcggtcttcatccgtcgaggagcaagactcccagattcgcgagattctcgcggacgcatacgagtcccaggaggagtacgcggccgccgcacgtgcactacagggcattcacatcgacagctcgcagagactcgtctcggacgccgccaaggtgcggctatggatacgaattgtacgactatacctggaggaggacgatacgaccagtgcagaggggttcctgaacaaaatcaagaacctacccagcaagatcgaggaccacgaactgaagctccatttcaagctatcgcaggcccggatcctcgatgcgcgacggcggttcctggatgcgagccaggaatacttcaatgtcagtttggccggtggcgtggacgagagcgatcggctacaagcgcttgctgctgcgatccggtgtgcggtccttgccccggcgggaccgcagcgctctcgcatcctcgctacgctgtacaaggacgaccgtgcgacttccgttgaggagttcggaattcttgaaaagatgttcttggatagactcctagatccagctgagattgctgccttttctgaacgactagctccgcaccagttggctcgaacagcagacggcaccacagtgcttgacaaggctgtggtcgagcataacctcgttgccgccagtaagctttacgagaacattacgacggacgcactgggtgcgatcctgggtctcaaagagagcggagatatgacggcgggcgaaaaggcggaggcctacgcggcgcggatggtcgagcagggtcgactgaacggtagcattgaccaaattgctggtatgatttactttgactcgagcgagggcgggtcggccactgcaacgggacgacatatccggcantgggatgcgggggtgcanggtctctccgaaaatgtggaacgggttgcagctagtattaaagatgcatttccggtatgtgctcattcagtctggtag

SEQ ID NO: 9313 - DNA, 369 bp, A.fumigatus
ccgccagcaaggccactggctttgctgtcgtgcgctggtagattctggctgaaaacgacgtctcgaccacgaaacatacttggtgttattgggtactggttcttgaccaagaattctcacctacctctcattgtccatgtcctggactacgagtatggaaagacagcgctcctcgctgcaaagaatgtcgccggagagaacgcgatgactacaactagtgaggaagcgagtgacttcatccaaaccgccaacgctgtaaacaagatggttaccgtttaccagagtaagcccttagcttcatggttgcgaggccatcgagggcgtacattcaggtggtctttgctatgcgatttggacaagcacttctga

SEQ ID NO: 9314 - DNA, 189 bp, A.fumigatus
tccgataacttcagtacccatcacaccgggttcatactactgccttcagctttattccactacggcatagctggtggaggacaaggcaagccagacaaccgatttattaccgggaaacgcgtactcgcccgaattgcttgcggtaagttcgctgtgattgcgtccgtcaagcaaacctgtctgacgtga

SEQ ID NO: 9315 - DNA, 738 bp, A.fumigatus
gaaaatcgacgggcaacccccaacatacgccacgacgaccgtacgaccatatcccggagccaactgatcaccaccagcattgtccggcccgtcaagatgcttttcctctcgcatgtggtcttcggactatctctgctgaccgcggttgcgtatggaacgctctacatcttcttcaccacggtaaccgacgtctttgcatcgcgctacggcatcatcaccaacgtgggccttatatatctgggctgtggctgcggtcaatttgccggcctccctatcttagggcttgtgtccgatgcaatcgtcaggcgagcagcccgaggcggcgagatgaagcccgaataccgtctgccacccacgatcctgggcggatccatgatcccgatcggcttgctcatatatggctggaccgccgagtatcgggtcttctggttcgtgcctgttctgggcacatttctcatagggttcggcatgataacggttttcaccccggttgggacgtacctagtcgatgcgtttccaatgtacgctgccagcgccaccgctgctaatacggtcttccgcagtgtggggggcgcgtttcttccccttgcgggtcctcgaatgtatagtagccttggtcagggctggggaaatacgcttctggccggtatatccttgcttatgatgggcatgattttcatgtccttgaagtatggagaacggttgaggacccatccaaagtaccaaatcaagctatga

SEQ ID NO: 9316 - DNA, 1137 bp, A.fumigatus
cctgcctttcagatggcacgaaaccctacaatggatcccaacggcactttatctcggcctcttgatgagtctctgtatcgcgaacttccccagctccaaagcctccgcattgctcctctccgacagcctgtctcttcccgtctgctgagcgctccatcacctcttgaaccgaatgccactggaatcagtgagccgaatgcgagcagcaaacccaatacacctggagcgaatcagcccgccaatctccccactcttacagagttcttgaacgctgcccagtcgaagaagaacggtcgtgcggtggacacgcttctgagcttggagcctcctccaaaaaccatactgccagcttttgtcaacttacgagctttggagcgattcccgtattcctcgttcgacgatgactctctggctcgcaagcgtcgccgtttagatgttcagacagattccttcggagaacatttgcagcttccgattcctcaggcacagaaggaacatcgacctccgccatttggaccttttgcaattctcaatggactgaatgaaccgccccccaacgctgctctcctgcctcctatcgaacctggctctatcacgcaactgctcaccaaaccttcccgggatgtcgctgttgttgagtccgttacattgactgctaccacgacggcggctgctcagaccgctgaacgaagggaagggagaatcaaggatatccttgactcccccattgatgacaagaccgccagtgcagaccaagatcctgtcgaagcaaaccattcagtgaacggggcgaccgttgatcgacccgggggcgacagtgacaaatccgaatccgataagactcctccgcgtgcggatgatgtggagccactttctccaaagacaaggggccgctcccgtaagaacgtacgcaaatggactgaggaggagacgactgcgttacttcgcggggtggtcaagtgcggtatcggtaactggacagctatcttggcgcagccagaactgaaattcaacaaacgaagtgcttcaaacctgaaagataggtatgatttgcgcgcagtccccgagaagccaagaactaacatcggctttcacgtcgttaggtttcgggtttgttgtccctgggcatatcggtga

SEQ ID NO: 9317 - DNA, 828 bp, A.fumigatus
  unsure (783): Identity of nucleotide sequences at the above locations are unknown.
gttttgattttgacattgttcggttgcagctctctaacattctatagcgctgccgatccgaacgaggccacaaagcagttgcacgatacgttggccaatgcactcctcagagctgagacggaaggttctgatggcacggctggaaagattttgcttccacaaccgaggccaactaattcagagtctcatacttccaatggaggctcaatggccaatgtgaacgagtcagcctccgccagctcgtcctcagaagccgataccaaaatttcaaagtccccctcgaaatacgggccttctttcaaggccacacctactctttcaaatagatctaaatccactcttgcttctctcggcattcctgaaccacactttgccatgaaatcccggcgtcgctcccgccgcccatttaccgtcgctgaagacgaagctctactcaaagggtatgccgttcacggattccagtggacactcatccagcaagataaacgcttgaaccttagccaccggaaagcaactgaccttcgggatcgattccgaaccaagtttccccacgcgtatcgtgacgggggctccgtcaatggtagatcactgcatatccagagtcaaggcgtagacctggcagatacagaaaaagcaccacccataaaacccaatacacaacctacccggcaatccacgtcttctgcacgaagtggtagaactgaatgggcagaatcagtctccctgggaactattgaatcgggcctttctccgcctgctcctccacagggtttgcttgaagcngcaacaaacgcgccacaggaaattacatctacatttcccggctga

SEQ ID NO: 9318 - DNA, 354 bp, A.fumigatus
ttaaccgatacgtgcgtgaagaatggcggctcccattttctggcggaaattgcgtcgcgcgagtttatggataatcttgtgtctctcctcacgacggagggggctcccttgaatactgatgtgaaagagaagatgctggaactcattcaggactgggctatggcggcccaaggccgcatggatctcaattatcttggcgagacctaccgcaagctgcagaatgagggcttccgcttccccccgaagaatgagattagtgggagtatgttggaaagcagtgcggtatgtttgcgtccgtcccatggtgcggatcttctcttgaagctaacgttcaaaattcctgcggaaacatag

SEQ ID NO: 9319 - DNA, 711 bp, A.fumigatus
  unsure (616): Identity of nucleotide sequences at the above locations are unknown.
cctcctgagtggatcgattccgacgtttgcatgcgctgccgtacaccgttcagtttcatgaatcgcaaacatcattgccgcaattgtggtaatgtcttcgatgctcagtgctccagcaaaacccttcccctgccacacttggggatactgcagcccgttcgtgtcgatgatgggtgctatgtcaaattgacatcaaagtcatccttgccatctaatttatcagaccgatctgcgttcaagaaccactcaataaccaaggcaaatgcgatggagcctcgcggcgcaagggcagaagggggctttgatgatgacctgcggcgggcgcttcaactgagtttggaaaaggctcaaagcaagggctcctctggctacgtaccatcaactaggatcaatgacgaaccggcaaagacgactactcaaaccaaccacgaggaggaggaagacgcggacttgaaagccgccattgaggcttctctgcgagacatggaggagcacaagaagaagcatgcagctgccctgaagagtaatgcagccgcgacagattcttccactcgtgatagtgccgccgcaactcccttgcccaaaaatccctatgagctgagcccggtcgaggtanaaaacattcatctgttcgccgccctcgttgaccggttacaacatcaacctccggggactatcttgcgggaacctcagattcaagagctgtacgag

SEQ ID NO: 9320 - DNA, 711 bp, A.fumigatus
cctgctctactctgctctacaccagacagcgtccagcatcgcccagaactaacagacgggaaccagctaccgaatctcatcatcggcgatctggactccatccgcccctccgtgcgctcgcattacgaggggctaggcgtctccgtcattaaggacccggatcaatactcaacggatttcaccaagtgtctcaagtacctccgcgcgcacgcagctgagatcatcaccaagcgcgtgatttcaacgcagtcgcggtctgcgcggctggagattctcatcatgggtggcctgggcgggagagtcgaccaagcgttatcgcagatccatcatctgtatatgatgacgcgggaagtagctggtgagtcggcggcgggggatctgtacctaatctccgaggagagtatcacatttcttctacagtcgggacggcacactattcgcacgccaagaacgaacaggcctggtgtgtgtcctgagcagggcgaggatgaatattaccttctggaggaaaatgttgggataattcctctatctggaccggcgaggatcacgacacgcggattccagtgggatgtggaggactggttgactgagattggaggccaacttagtaccagtaatcatattcgagccgatgaggtgatggtggagacgggggtccctgttctatttacgttggagctggcggaaaggtttaagaggatgcggtga

SEQ ID NO: 9321 - DNA, 456 bp, A.fumigatus
aaaggcctcctcccccatccgttttctgccccattatcctgttgggcacaaccatcaataaccctgaggttcgcgtttaagggtacccaccctcttcatgttggtggatggggccttttgggcccccgttctccctgtggctgcttacgggctaccctactaccttggttctttgcttactttttcaacatcagctgcaaggcaagcggcagttctgtgcttaagacgcgcaaggcccccaagacgcgtcctgaattcgatccgctcagtttcaatatcgccaaagccgtcatcgcgtatgtggtttatgcgcagcatttcaacttcatgggtctatacagcaacttctccatcgagagggtcaatgtatcagtcccgttccactggccaggcatgcttaccactgctgcaattgggaccgttggcactctctacgaggctattctgcgaaagtag

SEQ ID NO: 9322 - DNA, 210 bp, A.fumigatus
tgtcttccttgtttgcacgcagcagccactcgaaagccattgggtatctctcctattgttggcactgccattgcagcttttggcaatcagctggcaacaacgacgtttatcacttatgctgttgacaactatcctcaggactccggcagtgttggggtatttatcacattcgtccggcagatgtggggcttcattgttccattctggtaa

SEQ ID NO: 9323 - DNA, 210 bp, A.fumigatus
ttctctgcgtgtctgctgtctgctgttgtcatcatgtctaacgggacagcccaatcggccgaggaggccttgtataagccgtacgaccagttcatcctgtttggagactcgattacgcaaatgtcttcagatcaaagtatggggttcggtttccagcctgctcttcaggatggtaagattcccctgtctatagggcatgcgacgacttga

SEQ ID NO: 9324 - DNA, 432 bp, A.fumigatus
acaatatttttcggagcaaatgatgcggctgtccctggacactaccagcacgtcccagtggagacctacaaagaaaatctgaagaaaatcatccagcacccggcgacagttgctcagaaccccaggatactgatcctgaccccgccaccggtgaacgaataccaactggaagaattcgatatcgcaaagaacacacctcatcccagcaggacagtcaagcagaccaagctgtatgcggaggccgcccgcgaggtcgccgcctcgctaggggttgcagtggtagatctctggactacgttcatgactgcggctggttggaaagagggagaacctctgatcgggtccagagacgctcctaacaatgagaagctgcagagtttcttcacggatggttcgatcccactgttcgtccatatgggcgcttcgtgctga

SEQ ID NO: 9325 - DNA, 192 bp, A.fumigatus
  unsure (95),(126),(162),(167): Identity of nucleotide sequences at the above locations are unknown.
gagagatacccaatggctttcgagtggctgctgcgtgcaaacaaggaagacatcaccccaacgattgtgagaattgacccggggtatgtgaccanaaaacaatctcgggttcgggttctctctgantacaacaaacccgtggttcatccaaaatttcgaaanaaaanctccaacttgttctccaaaaatcaa

SEQ ID NO: 9326 - DNA, 885 bp, A.fumigatus
tgcgggggatcggacgatcctcgcctctacacgctgattgccatccgcagacgcggtatacctcctggcgctattctctccttcgtcaacaacctcggtgtcaccaaggctactgccatcgtccagacggccaagcttgaccagattgtccgtcagtacctggagactaccgtgccacgtctgatggttgttctcgagcccctcaaggttgtcatctcaaacctgcccgacggctatgaggagatggtggaggtccccttctccaaggaccctgctttcggctcccatctcgtgcctttcaccaagactgtctacattgagcgcagtgacttccgcgaagaggactcgcccgactacttccgccttgctcccggaaagaccgttggtcttctgaaggtgcctttcccgatcaccgccaccgcgtttgacaaggaccctcagaccggcgcggttacctgcgtctacgcacattacgagaagcccgaagaaggctctgacggccctgccaagaaggcgaaaacgtatatccactgggttggcgagtcggccgcccacaagagccccgtcaaggccgaagttcgcgcgttcaactctctcttcaagtccaacgaccccagcgcccatcctgacggatttctggccgatatcaaccccgattccgaggagatttatgagggcgcctatatcgacattggattccacgatgtctccaagtcggctccctggcccaagacgagtggtgagaccgggggcgaagtgaacccctattccattcgattccagggtatgcggaccgcatacttctgtgtggatacggattcgacggcggacaatgtggtcttgaatcgcatcgtcactttgaaggatactcagggtaaaacctga

SEQ ID NO: 9327 - DNA, 453 bp, A.fumigatus
cttatctcaccattaccaaatcaatcaacaacactttccccaaaccaagtccaagccaaagccaaaaagaagaaaaatgagccatcgcaaaccccgaactctcctccttaccctagacgccttcggcacagtcttccacccccgccgccccgtcccagaccaatacgccgaggccgcgcgcgccttcggcctcccccgctcaaccagcatcacccccgaccgcctcaaaacagccttccaatcaaccttcaagaaacagtcgcggacacacccaaactacggccgggaggaggtcctgcgcggccggtatggcggcccacggcagtggtgggaggaggttatccgggggagttttgcgcaggtgttgacatctggggaacagggcggcggcggcgcggacgtcgccgtgccagatgcgctggtgtcgcatctgctggatcgctttgcgggtag

SEQ ID NO: 9328 - DNA, 873 bp, A.fumigatus
attcgcatttcgccgtcggcgaaagaggtgagccagcatacttggtgtctcacggaatctgtgtggcccagtgttatttatatctttgtgaatggcgtagaactctatgttcgccgcaaatttcacaacggcaaagatattcctcttgacatcagtggtcacctaaaagaaggcttgaatactatctccctgcatttcctccgcagtgccgcagagagcagagacgtggtatatgcattagcggtggaggtcatggatatcctcagttttgctcaagtgaagaagctcgctcagaccctacccgcaccccagtctcgcgagcggatatgtcgacgtctttcctcgagcgctgcggacgatgaattaagtattatcagtgactacctcgctgtcaatctagtggacccgtttatggctcgaatattcaacattcctgctcgcggaattacttgcgagcacgtagaatgctttgacctcgagacatacatcttgaccagggcctccaaggcgggtaaagctgtcttgaaggagaattggagatgcccaatctgcggcgcagacgcccgtcctcaacatttgatcatcgatggctttcttagtgaagtccgtgccgaacttgtacgcacgggttgtcttgagggagcaagagcaataaggatcaaagcggacggatcttgggagctcaagagtgatggggacgttacttcatctgaaagggagcttgcacgggtacaggaaagcagctcattgaaacgaaaacgtgagggcgtcgtttcacctctcgcaactcagaggccgaagacagaaggtgctggtcgagaatcgctagcttctcgcgaatcctcagcatctttggtcatcgaactcgattag

SEQ ID NO: 9329 - DNA, 3219 bp, A.fumigatus
agacgcgaccttgcgtgccgtctcctgtgtgtgctcatgctcgatcgctttggtgactacatctcagataacgtcgtagctcccatccgagagaccgtcggtcaaacgctaggtgcactcctctcccaactaccatcccggtcggtcatttctgtctacaagtgtctctatagaatcattatgcagaccgatctcggcctggaacggcctatctgggaagtttgtcacggtggcatgatcggtctcaggtatctagtagcggttcgaaaggatctgctcattaaggattccaagcttatggatggcgtgctcgaggcggtcatgaagggcttaggggattatgatgacgatgtccgtgcggtaagcgcggcaacgcttgttcccattgccgaagaatttgttaaaactcgtcaaagtaccttgggcaccctgatgaccatcgtttgggattgcctttcgaatctgcaggatgatctcagtgccagtacaggttcagtcatggaccttttggcgaaactgtgtacattccaagaggttctcgacgcgatgaaggccaatgcagcggtcaatccggaatcgtcttttggtaaacttgttcctcgcctctacccgtttctacgacacaccattaccagtgtccgctcggcggttctgcgagcccttatgacattcttgcaactcgagggcgaaggcaccgacgagtgggtcgacggaaagacagtgcgtttgatctttcagaatctgctagtggagcgaaacgagggcgttttgaagcagtctcttcaggtctggtcagagctactaaattcactggagacccgcggttccttcaagtcggaaagcgacctcctaagtcatatcaaaccccttatcactctaagtatgggtcctttcggtgttccgcgatacccggttcctatggacgcttctttgtttatcaaaccctcgggtctgcctttcccgtcaagcgctgcggctcctgccaggtcatctccggctagtaacacgcctgaaggaactaaaggtcgtcggcgcaagtccgagaagaaagaggcgccgccaccttctgcccacaatgttgacgggcacatgctccaaggcgacattgacctagtgggagcggatactatgctgaggtcgaagatatatgccgcaagagctctcggccagttgctatttgtctgggaccagaaccagctcccgagtctatggcagtctatcctggaaggactcaaccattcggcctcgacttcgcaactcgcttcggccatgatagtggaggaatatgccaagctctctggacctagtgggaggtatgcctctactttgtgtgagaacctacgtccaatcatcgaaggcgagcgtcctccgtggtatagcgacattgcttgctatctccatgtcgctcgagcacagtgtcactcccttttgaacaccttccgcgaccacgcacatgttcccggctcaagattgcctgtcctcgccgtcattgttcaaggggatcctgaggctggacctaatgcgttctcgctgtctgacgccgagaaggtcattggcccagactttgagcggctcaagaagggtcttactccggctcagcgcattaccgctctccaggtcctcaatgatactcgcgcaacggctgagagcgctgtcaacgaggccaggaatgtcagagagcaaagagacttgcgtgttcgggctgctgccgcaggcgctctggttgctttaagcgacattccgaagaaacccagccatattatcaagggaatgatggatagcataaagaaagaggagaacgcggaactgcaacagcgctctgccactgctattaccagccttgtcgagtactacaccacttcggcgaagcggggacccgtcgacaaagttatcggtaatcttgtcaagtactgctgcgtggatacttctgagacccccgagtttcaccacaatgcgatgctcgagaagtctatcctctcgctccgtaaggaagaagaccggcgtgatcatccagatgctgccaagtttgagagagaggccaaggaggctcgaatcatgcgtcgtggcgccaaagaagctctcgagcagttggccgtcaagtttggttctgagcttatggccaaggtgcctaacctcgcttctttgatagaacgaccactgaaagaagctcttgccgccgacgaacttccggcgaacattcgtgatcccgaaaacgaacttggccaggaagttgtggatggattgtccacgttgcgtgccatcctgcccaaatttcattcgggactttacccctgggtggtcgatctcttgccgcttgtagtaaaggcgcttcaatgcaagctttctgtcattcgatacgcagccgccaagtgtttcgccactatctgcagcgtcattaccgtcgaaggcatgaccatgctggttgagaaggtcctacctatgatcaacgatgctctggatgtccaccaccgtcaaggcgccgtcgagtgcatatatcacctgattcacgtgatggaggacggcattctgccttatgtcatctttctcgtcgttcctgtgcttggccggatgagtgattcggacaacgaggtcaggctgttggccacaacgtctttcgcaaccttggtgaaactggtcccgttggaggctggaattcctgacccacctggtctgtcagaagaacttctcaagggacgtgaccgggaaaggcaattcatggcgcagatgttggatgtccgaaaagtcgaagaatttaagattcccgtggctatcaaagcggagcttcgaccttatcagcaagaaggcgttaactggcttgcctttctcaaccgctacaaccttcatggcattctctgcgacgacatgggtctgggtaaaactctgcagaccatttgcattgtcgccagtgatcaccacatgcgggcggaagagttcgctcggactcagaagcccgaggtgcgaaagcttccttcgctgatcgtctgtccgccgtccctctccggacattggcagcaagaattgaaacaatatgctccatttctcaactgcgttgcttacgtcggaccacctgcagagcggtcaagactgcagagcgctcttcccaacgctgacatcgttgtgacatcctatgatatctgccgcaacgacaacgaggtcctcaatccgatcaactggaactactgtgtcctagatgagggtcaccttatcaagaaccccaag

SEQ ID NO: 9330 - DNA, 756 bp, A.fumigatus
cgagatctctactcacgccctacagttcggcaaactcatcatcaaaggcctggtctccagtcctctccttgcaacagccctcggcatcccacaaggagccttccaggtcttcttcattctttccggcacctacctctcctcgcgattcaagaatatccgcacaatcatcatgatcatctacctcttccccaccctgataggcgtctgtctactttggcagctgccccgaacgaatcgctacggagtcctcttcggctactacatcgtatgtcaacaacccctttttttgggtgcatactaaccaagcagatcgcatcatacgtcacatccctcgtcctctgtctccaaatgccgtcgagcaacaccggcggctacaccaagcgagtcaccgcaacggctctcgtgttcatcgcatactgcttggggaacatcgtcggccctcatgccttcttggctagagaggcacccgtctacgagaccggatgcaagctcattttggcgtgtgcgttgggtcagatggcgtgcacggtggccttgcgggtgttgttgagcagacggaataagcgccgagatgctgagggcgtggctccggcggagggagacgcagatgagcagattctggcggatctgacggatttcgaagtatgtgtgttgtgttgtgctgtgttgcatgcgagtggcggcgcagttgctgacggtggtagaatcctcgctttcgatatgttttgtaggcttggacaggatggactatggtag

SEQ ID NO: 9331 - DNA, 420 bp, A.fumigatus
agtggtaccaaatccgagaggctttccttgatccccaagtctggctcgtcttcctttttgtcttgctcaacgagacggctaacggaggtgtggctaatgtacgtctccctgctgcatagcgagatctctactcacgccctacagttcggcaaactcatcatcaaaggcctggtctccagtcctctccttgcaacagccctcggcatcccacaaggagccttccaggtcttcttcattctttccggcacctacctctcctcgcgattcaagaatatccgcacaatcatcatgatcatctacctcttccccaccctgataggcgtctgtctactttggcagctgccccgaacgaatcgctacggagtcctcttcggctactacatcgtatgtcaacaacccctttttttgggtgcatactaa

SEQ ID NO: 9332 - DNA, 279 bp, A.fumigatus
cgacggcaagaccgacgccatcctcgcaaccgtcccggcaaggaagatgacattgagaatggtcacatttcttcgctggacgaggctgaacttttcctgcgagagcatggcatttcacactcccagcttcaggaaatgctcgatgaccccgccaaatctcggaagattagaaggcgagttgatttgatccttctgcctcttctctgtggtacatacgttttgcaatatatcgataagcaggtgaaagtttcatgcacatccgaacagactacttactga

SEQ ID NO: 9333 - DNA, 345 bp, A.fumigatus
tattcctggatctttcatgacatatctgacaatctcaagcttggtggcctgataagctttgctattggccagctaaatggatttcctgtctggcgagcagtatttctcatctgcggcggggtgacggtgctctggggaggcattctgctgctttaccttccaaacagcattctctccgcgaagcgatttacgatcgaagagaagatcttacttattggaagagggaaacagaaccagacggtgtgccacttccctcagtgccaatgtacagaatgctcactaatccttccagggtattctcaaccgctcaataaagtggtaccaaatccgagaggctttccttga

SEQ ID NO: 9334 - DNA, 186 bp, A.fumigatus
  unsure (63): Identity of nucleotide sequences at the above locations are unknown.
ggcgattgttactccgttcctgactacaatacaaaacactccgcccgcatctctccccaaccngaagcgtttcttcctctcaacgcgacatttgcatcaacttctacggctctaatgagaaccagtgagctgtacagctctcccgactttacaaggggactttcctatttgatcgcataccgatga

SEQ ID NO: 9335 - DNA, 642 bp, A.fumigatus
  unsure (5),(32): Identity of nucleotide sequences at the above locations are unknown.
caatntcaacaatcgaccccgggattgcttcntgcttctggccttcttcatggtcctcacaaccttcatcctcaacagcatcatggttctggcccaggccattttgaggatcatcaccgtatgcagatgtcggcatcaacatctcagatcttcccttcaccgagattgcagcacgggtacccatctcctatggctccgcatgcccagcttgcgtttggacaacctgtcccacagttctatgtgaaccaaggaggtccgcaaccagctcatctcaggccttttccgggagcacctcagtttgtcaaccctcagacaggcatgggcgccccaatgatggtccagcagccctcaagcgggccatatatgggcggtcctcagggcatgacgccctatgctcctcaaatgcagatgtattctccaaacccaggtcatgcataccctcagcacgcccctcctccgcaacctcacagtggctatccaagccctagccgcggtgcccccatgatgatgcatcagaattctcagccggggcagctccctcagccggtcatgttcatgtcaccagggcaacatggtcagcccgtgtatgctgctcaacaaccaggtcatagtatgttttttacagttgtcggccccagctag

SEQ ID NO: 9336 - DNA, 1335 bp, A.fumigatus
actgactttggcgttgcatattctaggctttggggtaatccatcccatttggactacctgaccgcgtctctcagagagcgatacggagaagaccgtctctacatactcgccgcgaagggaaattctgggaatttcacctatgatgggatcgagctcggaggggagcgactggcgcatgagattgaagacactctgggtgccttggatgcggaggggacccatattaaaaaactgagcgttatcggatattctctaggaggtctagtcgccagatatgcgctgggtttgctacacgcgcgaggatggttcgacaagctggagcctgtcaatttcaccacgttcgtgtcgccacatgttggtgtgagaatgccacttaagggaattcgagaccatattttcaatggcttgggcgctcggacattgtccatgtccggcaggcaaatgttcatggttgatgagttccgagatacgggacggccactgcttagcatcctcgctgatccggatagcatcttcatgaaagccctggcaaagttcagaaaccgttcagtatacgcgaatatcgtcaacgaccgttcgacggctttctttacgaccgctctttcgacgacgaacccgttccaggacctagaaaacgtgaacgtcaactatgtgaagggctatgagccagtcgttattgatcctgatgactattttctgccgccgaaaaaacaagagccgccttcattcttctctagactatggcaaaatatcaaaggcacgttaactcaggtggcaatttcgctgctcgtcgtggtgtttgtccccatcggcgttgtactatacctcgtaaatgctgctgtacagacgtaccgcagtcaccggcgcattcgcctccatgaggacggaaaggcgggagtacttatctccaactaccgtgtgcctgttattgtgaaggacatgcaaagtgcagttgaggatgcttttgagagcgcaaccgcgatgcaagatccggcctacctatcaaacgctcgtacccgtgccggaaagaaagaatcactcccgcaaacacctgccgtcagcaagactggcgccctcgaaaatcaaacatgcacgctagacgaaacttcttccgcattgcctgaccaaaaacgcgatgccacactggctctaacgccagctcaattctccatcatcgaatcactcaattccgtgggattccgaaagtacccggtatggatccataatcactcgcacagccatgcagccatcattgtgcgaatggcaaaaaagggattcgaagagggcaaagtcgtggtgaagcattggctcgacaacgaatttgacattgagtga

SEQ ID NO: 9337 - DNA, 183 bp, A.fumigatus
aagtcacttgccgccaggtcgaggttttcttatcttgggctctgggtccagttcgtggaagactttagcctgaagtccaagtttaccgacgtctactgggcggccagccatactaagcttcatatgcctcactcccttggactcatgaacgagctgctggaatgcagctactgcagctcttag

SEQ ID NO: 9338 - DNA, 873 bp, A.fumigatus
agacatcaagacacccaagtcaactgggcgtttttaacgccttccacggctagaagcctcaaccccgcagacgttcccttgctaactacactagttctgggaggtgaagctgtgacccacgagagcgttgaggtgtgggcaaaaggccgctccctcatcaacggctatggccctgccgaggcaacgatctgcggagtgggcaatatccccgaagcgggatggaaatccggcgttgtcggtcgaatcattggtggtttgggctgggttactgtgccatcagacccgaacagactggcagcggttggcgccgtgggtgaacttctcctcgaaggcccctttctggcccgaggatacctgaacctgccagaggtcacgaaggccgctttcattgatcctcctagctggagaacacggattcctgctccgtcgccctattctttcctctaccgaacaggcgacctggtccgatatcagccggacggatccattcagtatgtcggtcgtaaagacagccgtgtcaaacttcgaggtcagcttgtcgatctgggtgcagtcgaggccagtgtcatgagagtgtatccggctgcgggtcaggtagtcgcagacgtgttggtctcagagaatactgccagactgactgcgatggtgaagctcggcccctcagtgactgagaaccacgatggccctatgtttgcggccccagacttggttttcaacgaggctgctgcctctatccaggctcgtcttcgggccattgtacctgcttatatggtgccgtccatgttcatttctttacgggacatccctggcaccctcacaggcaagaacggatcggcgtcggcttcccagacaaaatactttattatcacatag

SEQ ID NO: 9339 - DNA, 1626 bp, A.fumigatus
  unsure (57): Identity of nucleotide sequences at the above locations are unknown.
gcttctcgaaccaagaaacccatgtttgatgacaatgaacgggggtttcaagagatnggggcagagttgtttaagctcccatgcgaagcaattgggagagaggattctttctattctcttggtggtgaatctctggcgacgatgaaaatggtagcattggcaaggagggttgggttcatgtttgctgtgacagacgttatgaataacacgagcctgtcaacccttgcgcggtcacggcacttgatcacagagcaggccattctgacctcctcaccctctctctcactgccaaccattgaaggcgagtccctccaggagattcttcggccattactgaacgccggccacatccaaggaggcaatgacattgctgctattcatcctgtcaccgctgcacaagcattcctcgtacagaggtatccgtggtcccatttccagtttgacttgtctggcgctgtctcgcccagcaagctccaaaccgcctgcaccgcgctgatggcccgatttactatccttcgcacggtatttgtcgaacatgcgggctgtctcttgcagcttgtcttgcgggaggtgcccaatcgtgtccatgagattacgaccaatgagcctcttgatgacttctgcaattcagtttgtcagcagcagcaggatgtctgtgttgttaactctacaaccctgccaactctgtttactctcgtgtccaaccgccaactaaacagacatcgacttctgctccgcctcgctcatgcacagtacgatctcaccacaatccctctaattgtccaatccttggccgacgaatacaacagaaccctccgttcgggtttctccgccgacttcggctactatctcagtcatcataagcggcagaataacgacgacaggtctcataacttctggaagcgatacctgtcaggctcctctatgatgtctacgaatcagactgcagatccgacgacggttcaagagcgcgtatttcacgtcacaggatcatgtataattatacccacatcacatcccccggacataacaattgccaccgccgtgaaagccgccgtctgcctggttctagccgcaaggactggctgcaaagatatcgtcatcggtcaaacagtggacgcccggtgtagttcggctgacagcactcttgaccaaattgttggcccctgcacgaactatatcccgtaccggctcagcgtgtgctgttctaaaactgcgctggaatacctccgcagcgcgcaagcccagcacacaacatgcctccgatactcttccctggacttcgaccagatcgtggccaagtgcaccagctggccaagcagtactcaatttggatatatcgtccagcaccaggacactggcgcagagttggctctcacgctgggaggtgacactacttccttgccgatgacttcttacggccgtgtatttcctcagggtgaggtctggatcggttcgacaccctgttctactggtctgagaattgatgtcattgctctgagcgcagtgctaagccagaaggacgctcagactatggctgaggaggtcggcgcggcgttggagaaattgcttgggtgcggttatcgccgtctttcgcatctgataggaaataccttcgctacctaa

SEQ ID NO: 9340 - DNA, 1572 bp, A.fumigatus
  unsure (1562): Identity of nucleotide sequences at the above locations are unknown.
aaagatctgggccgacgagacatggacctgcaatccgttcaagatctcaaaggggtcttgaggcgcgactttttccatggttacgccaccgcggcggcccaggtggaaggagcttggaataaagacggtaaaggccaatcaatctgggatacttttgcgcacacacctgggaaggtgaaggacggaagcactggggacgacgcggtacgctcgtatgacctgtacaaggaagatgtggcgctcatgaagtcgtatggggtcaatgcataccgcttctccctctcttggtctcgaatcattcctcttggagggtgcgacgacctcgtcaacgaaaaggggattgaatactattcaaatcttgttgacgagcttctccgtaatggcatcacaccgtttgtcactctcttccactgggacacaccgcaatcgctggaggatcgctacggcggcatgctgaaccaggaaaagtttgtgccggactttgtcaattacgctcgtgtttgcttcgagagactcggcgatcgcgtcaagcattggatcacgttcaacgaacctggtgtctatacgctggctggatatgcagcgggcgtccacgcaccgggccggtcttcattccgggaccgcaacgaggagggcgactcgtccaccgagccattcatcgttgcgcacacggagctggtcgcccacgggcacgtgtcccgtctctacaagcaagagttccagccccatcagcaagggaccatcggcatcacgcttcacgggaactggtccgagccatgggatgaagccgacccgctggatcaagcggccgctgagcgcgcgcgcgagttcgagattgcctggttcgcggacccgctctacaagacgggtgactatccggcctcgatgagagcccagctgggtgaccgtctgcccaagttcacgcccgaggagtcaaagctggtgcttgggagctccgagttctatggcatgaactcgtacacgaccttcttcgtcaagcacaagaccacgccggcggacattaacgaccacaaggggaatgtagagattcatgatttcaacaaacatggcattcctcgaggcgaagagagcgacaccgagtggctgcgagctgccccctggggcttccgaaagcttctgaattggatctggtctcggtatcagatgcccatctatgtgacggagaatggcacgacagccaagggcgagacagccccttcacccagtgttctcaacgaccagtttcgcatcaggttctttgagggatatgttgggtgggcactggctcgtgcggtcaaggaggacgggattgatatccgctcctattttgcctggacattcaccgataactggggtaagtttttttttcgtctctcctccaagtgcaatgctgaagatggaacagaatgggccgcgggctataccgatcggttcgggtgtacctttatcgactttgattcaccggagaagacccggtaccctaagcaatctgcttattaccttgacaacctgttcaagcatttgatcaaggggtcttcaccaggggtggaaggtcgcgcatnattgatttca

SEQ ID NO: 9341 - DNA, 432 bp, A.fumigatus
accaggaaaagtttgtgccggactttgtcaattacgctcgtgtttgcttcgagagactcggcgatcgcgtcaagcattggatcacgttcaacgaacctggtgtctatacgctggctggatatgcagcgggcgtccacgcaccgggccggtcttcattccgggaccgcaacgaggagggcgactcgtccaccgagccattcatcgttgcgcacacggagctggtcgcccacgggcacgtgtcccgtctctacaagcaagagttccagccccatcagcaagggaccatcggcatcacgcttcacgggaactggtccgagccatgggatgaagccgacccgctggatcaagcggccgctgagcgcgcgcgcgagttcgagattgcctggttcgcggacccgctctacaagacgggtgactatccggcctcgatga

SEQ ID NO: 9342 - DNA, 1026 bp, A.fumigatus
  unsure (136),(148),(259),(441): Identity of nucleotide sequences at the above locations are unknown.
tttgggatccgtggccggaattgggaacagaggcaaaggagacccagaaaggggcaacttgccggggaagcaatgggcaagacggacaataagggtgaatggcagccggaggaaggagggagttttagggccatcntagtcacgttcntcaagcaatacatcttcatagactgggtcaaggtcctcatgatgcacgacccatacttctggggtctggtcgagtcggccccggcccgcccatttcctttcacctacttcntactcccgactattcccgacatcgtcgtgcgtctctaccgagaaatcctgagcgggctcggcgtttacgccgctctaagcttcgtctgcccccttaaccccatcattttcctaggcctctcgctcgccttccccagtgcctctcgcacgctcacgcgcgtcccactggatgctccctggctntactccgaccccttcggcccgtttcttggcccctatcttgaccatggccttgtaggctgctggagcaaatggtggcatcagcttttccgttttggcttcacctccaccggcaactttctcctttccctactccccaaacacatggcagcacgccccggcatccgacgcaccgtaatgaccgtcactgccttcttcctcagcggcctcatccacgccagcggaagctacacccagttcgccgagacgaagccccacacccatttcgtcttcttctgcctgcaacctgtcggggtcatgatccagaaccagctagcgcggtctattaacgccaggtaccgcttctcgcggcccatcagacgcgccgctaacgcgatctttgctctctggtggctcatgctctccggcgcctcgatcgccgatgattttgcccgcggcgggctctggttgacggagccgttgcctattagtccgctgcgtgggttggggctcggggccaagggcgaggggtggtggtgttggggggagccgtggtttcgatcctgggatggggggaagtactgggagagggggttaagagtcctataa

SEQ ID NO: 9343 - DNA, 675 bp, A.fumigatus
agcatccactatcaaccatccatcgtcacatcctcctcgtcatcctcgtcgtcctcgtctgtatccggctcaatgttcagcgtaggaatttcatcgtcgctatcgtcgtcacctgcctccgcggctactactgccgtccctgacatcggagcatccgcaccagatgtagccgcctgcgcgatgctcatcggcattggctcagaggttgccgtgacagaggccgccgggatagagatagccgcggtggccgtgaacgaggtaggagaagccgtgccgagggcgggctgggataaaacagcctcggtatcaagccggactttcttcgtttgcacatcatcgagtttcttgtctgtcagactggctgctggcgcaattggcatcccaggattgatttcctcgggcaggctccgcttgtgcatggatggagcgggttcctccatcgcttcagtgatgccccgcctgctctggataatcggagtggcggttggtctgaggaatcctgtaagttcaggggcagcgtgctgcacagcggcagtggtccgctcttcttgttcttcatcttcctcgtcgtcgttgtcgtcgaccatgctgccatacccgctgataccgggtgcgtgcatcagaaccggcattctgggtctgatcagtccctcgacctccatctcggtagaatag

SEQ ID NO: 9344 - DNA, 711 bp, A.fumigatus
aagggccgcggcacgggctccagcatcatgcccttcctggcgcgacgctattctaccgagatggaggtcgagggactgatcagacccagaatgccggttctgatgcacgcacccggtatcagcgggtatggcagcatggtcgacgacaacgacgacgaggaagatgaagaacaagaagagcggaccactgccgctgtgcagcacgctgcccctgaacttacaggattcctcagaccaaccgccactccgattatccagagcaggcggggcatcactgaagcgatggaggaacccgctccatccatgcacaagcggagcctgcccgaggaaatcaatcctgggatgccaattgcgccagcagccagtctgacagacaagaaactcgatgatgtgcaaacgaagaaagtccggcttgataccgaggctgttttatcccagcccgccctcggcacggcttctcctacctcgttcacggccaccgcggctatctctatcccggcggcctctgtcacggcaacctctgagccaatgccgatgagcatcgcgcaggcggctacatctggtgcggatgctccgatgtcagggacggcagtagtagccgcggaggcaggtgacgacgatagcgacgatgaaattcctacgctgaacattgagccggatacagacgaggacgacgaggatgacgaggaggatgtgacgatggatggttga

SEQ ID NO: 9345 - DNA, 213 bp, A.fumigatus
ttgaacaaaatggtgcacatcagtcgagtgcaaaagcgccccaaaggtcaccgtgccagaaaagccgaagtgaccgactatgtttatggcacccacttcgcagcgcaagacctgccgcaccatgaaatggcagagtgcgaaatgccagctgccgttgcgtaccggttgatcaaggatgaattaagtcttgacgggaatccattactgaagtag

SEQ ID NO: 9346 - DNA, 612 bp, A.fumigatus
acacagccatcccacacctttcagcccaccaactcaatcgtcacaccagtcatgtcttctcctcgtcaaaatggcgtacagacgtcttgcgagccttgccgcaggtcaaaattacgctgtgactactctactccgacatgccagcggtgtcttcgccgtggaaagtcagacgtctgtgtttatcatccctcgcctatgactcggagctggtattctgatccagtctcctcgccacatacgcctgcaagttcagacaacaattgggacaagaaaattcaatcggtcccaccacctgggtcctcgagactgacgagctactctggcgtgtccagcgagatcgacgagcatctgaacgagatcttcgcgccgctggcaaccttggagcacggtgggaccggctcgagtccaaagcaggttcagctgggtgcacggctactgctgaccctgtttgggaatctgtcgttatacgagactatcacggaaaatcgttcagacaattcaccagaaggttgtgttgtcggccaacagctcgttcgtatgattttcagggccttgaaagataaccacaaactgcctggcaaatggccaggatgcagaagatcggtactatga

SEQ ID NO: 9347 - DNA, 237 bp, A.fumigatus
tatacgagggcgcggctggaattaatgactgcagagtcatggcagggtacaccgcaccgtagcaagacaactatgttttttggaatgactaggaaaattgagcaacgcagtgtgaactatgtaaaatcaatatattatagagtgtcttactacgggtatataaacccagcaaaagaccatcgtcggcacaacagacaaggacaacaacgtcatctcagccatttccgatatttgtag

SEQ ID NO: 9348 - DNA, 303 bp, A.fumigatus
  unsure (136),(181): Identity of nucleotide sequences at the above locations are unknown.
gggaagaacaggggacgcggggtcaaaggatatgggtactgggctccccagcccccgttcactgtcgtgattaccggggaacccatcagagccccaagtaatcggagcgaggactggaactctaccccctgggtanctgtccccaaaggccatgtaataccagtcccctgcggggggtccnacaatgcccccctatattccattagttccgtggtttttgactataagcaggctgcctaccctgaatggggttcaccacccgccgggcaatcgggaattgccaatgttccttccaggaagtaa

SEQ ID NO: 9349 - DNA, 573 bp, A.fumigatus
  unsure (54): Identity of nucleotide sequences at the above locations are unknown.
tacagcgtaaacaacggcctgaccctaaagaccgccaccgtgaccaccgacctntacgcagcccgaaacaccctcacgcaccggatcctaggcccagactcaactgcaacaatcgaactgacaatcagcaacatgaaacccggagaccggagcggcatcgccatgctccgcgactcttccgcgtacgtcgccgtcatcaacaacaacggcgccttccgcgtaagcatggtcgccggactgacaatggacgccaactggaacaccctctcaacgggctccgaggtcgctggtgtcaatctctccggaagcccttccaagatctggctgcgcgcgtacgcgaacatccagcccggcagcggcaggacagcgtcgttctactacagcacggatggctccagcttccattccattggggctccgtatacactgaacaatacctggcagttcttcatgggttatcggtacggcattttcaactatgctactgtctcgctgggtggaagtgtgctggttagctcttttgagatggaacgcggtgcgccgtcttctggcgcgaccactacagcctcgtag

SEQ ID NO: 9350 - DNA, 297 bp, A.fumigatus
caggagacatcagcggactttgaaatcgagttgtgcaacggggacggtgaggactgtgacttgagtcggggtccagaagtgtatggctttgtttcaataagactcggcttcctacgtctcattgtcgacatcattgtgcttctgctgaagtcctcacaagacatgttcagcgcggctgatgaatggctgtatgccaagagtggctcttccttccttgaacgaatgaaaccagagtcgttcaagctgtcctgcatttcgcaaccagtgaaaagctcagtgtataaagcatgttcttga

SEQ ID NO: 9351 - DNA, 198 bp, A.fumigatus
attaacgaaaaggtaagtagtcgagtggctcacgaaattgtgcagcccaaagccggccgatacaggaaggtaacccaggtaacgtttacgacatatgtcatggatgacaataccatgagaatgatgatatcttataacaagtaccaaattttggatgtcccctggtatatcttctcgtgctatgaatatgtgtcataa

SEQ ID NO: 9352 - DNA, 2010 bp, A.fumigatus
  unsure (86): Identity of nucleotide sequences at the above locations are unknown.
ttgattgcttttccgccgggcggtgcgagtcggacgaaacttgcgtcgaagtcccgagggaagcttaccgacagtcgaccagtcgntggtgaccatgggtggaagccacttccgttatttcaggcctatccacaggcaatcaagcacgactgcttttgggccccggctctgtctgccgattccattttgcgcatccaagcaaccgcaaagagtcacagcagctccaatgatgtagaccctcagggcaatcagccgccaaatgaggaagcttccgcggaacggaagaagaaggaagagagggtaaagaaacatatgcgaacggtctcggacactatcggcaagactgaatggtcccaaaagatttatgtgctggtcacatctggttatatcttgcaatactcagcaagcgggaagcacgatcgactgccggagaagatgttgcaggtgggccccagatcagtggcttttgccagcgacgcgattcctggtaagcgttacgtgcttcaaatttctcaaagttcggaagaagacagcacggcgacagttgatacccatcggcccttgttttcccgcctgggattccatcgatcctattcccggcgatggactcgtacgttccttcttgtgttctgcaatgccgaagaaatgagctcctggctcctggctgtcagagctcagatcgaagcccgcggaggtaaaaaatacatctctgaaaatctgtacgacgaggacttggagcatcaactgcggccgaaaccgagtatccgacagatggtgcaaagagacccgaaccgcttctccaaaatctatctacagcctcatcagtcggcaggttccgacgaaaaagatcaagctcccagcgaccaatcccgccgcagctcctacatatctgttcaacgccgatcgatcgtttatcagtctggcgctgagtcccgttccaactcgatgtcgaccacacagacggatgtcacaccgcctgtcaatggcttcgggcgcttgtatccgtcggcttctccgccgagtggtccttatacccttcctaatggcctcacagttcctgggacatccgaaccgggtgtaccgccgagctcaaccacggcaagtatgaccaaacgcctatccacctatgtggcgggatccttgagcacggaggggcatgaacctgggtcgtcgccgccaacggtgccagagccaatcttgcgaagcacttcgcccccagcacccaacttcagtgttccgtcattcagcaagaggtttgctgctaaaaccgttcaagctaagcttgttcaagatcctcgtctggactgtgaccaaagtaatgggatccgtcatcaggaatctgacgagcaactcgatgcgttgtctgcgtttccctccccacctcagtcgccagcccggaacatgagtaaaatgagccttaacgacatacatgaggatccttctaccgtccgcaacgcctcccctaggcgacaattgcgggtatccaattctgaggattcgctggcagatcttcagcaaagaaataatgaccataggagtctacccaaccaacgtctaccgataacgtataccatgccatcgcactcccgtcctcagagcatagccattgacccgttaagcaagcttccatctgaaccgcaacccacacgaccaactacaaatcacggaaatcagccgcaccttgagctccaacgggatagaatgtatcccacagaccgcagcggtcgtcctcccagcatggctcggcgcaagagcatgccgggactgtcagttggacccccagcagcacctccccccaattgtcccctaccgaaaatcccatatccaatcgatccacataggcctattctactaccaagcgcttccctcacaagtcgttcctcccaattgccaccttcgaagtcgttacgagaccgccaaagaagctttgccagcatcaatcctcccacgtcccatatcgatcttcctactgctccaagtatagataccccggtatcttccggattataa

SEQ ID NO: 9353 - DNA, 189 bp, A.fumigatus
agcaagaagaagaagaaaaagtccaagaaggccgtcgctggcgctgtgaccgcagagccacaaactgcatctggcaagggggaagactctaccccttccgcgaccacaacagcaacacctgccgcagatgcttccggcgtcgtgaagcgtgatctagcgcccaaggtggaagaagccactgaggagtaa

SEQ ID NO: 9354 - DNA, 240 bp, A.fumigatus
tcggtgcccgttcatgaattgacgacacacagaaaatcacacaatgttcaatgcagcatcacggcgcgcctgcgccttcatttcgaggccaagaaccctacaatgcaacaaagctctctctacacacacagtgtcacccagatgtcaacctggaaaaagtaccagatcatcacttcagagacaatcgcaaccaccatcctccttattacaaaatatccgtcctcaattccgacatcttag

SEQ ID NO: 9355 - DNA, 729 bp, A.fumigatus
tgttcaggtacaggctcggacgagaagctttacacatataccatcatcacgacttcttcaaactcgtacttgaaattcctccacgatcgaatgccagtgatactcgagcccaacagcgaagcaatgaagatgtggttggatcctgagcggacaacttggtccagtgaattgcagtccattttgaaaccgtatgaaggagaattggaatgctatccagtcaccaaggaggtcggcaaggtgggaaacaactcgcctgacttcatcattccgatcaacagcaaggataataagagtaatatcgccaatttcttcgccaatgcgaagaagcagaaaggtggagcagactccttcgctagggacgaagacgccaaggaagccttgccctctgccgaacaaaaggtggtgaaagattcggatgagccgcgcaagactcaagacagtcaatggagtgaaagtaatgctccgttgccagaaccaggcgtcaaaagagagtaccctctggacggcaatgacattagcaatgaaaccccgaagagacagaaaaccgagccagcaccatcactatcaccaagaggaaaagcacatgagccgaaggctaagtctgaccggaagacaacgacatcgactaggaaaacacgaagtgcgacgcacaacgacaagtccttaaagaagccaaataggaagacgactgatggttctcagcgaatcacaaatttttttcagaagtaa

SEQ ID NO: 9356 - DNA, 2526 bp, A.fumigatus
  unsure (2),(4): Identity of nucleotide sequences at the above locations are unknown.
antngtcccagaggggtagaatggtggaagaccaatgagttcggaagctaccacccaaagaggaaagatgatattccggcgcttgtggttcccgacttggcttacatcgagttcacacgtgctcctactggggacatgcgcggtgtagtcatgagccaccggacaatcatgcatcaaatggcttgtctcagcgccataatcgcgactgttcctggctcaggtaaaagtgtccggccgcatggagagaccttaatcagctatctcgatccaaggcaaggtatagggatgattcttggcgtccttcttactgtgtatggtggccatacgaccgtctggcttgaggatcgagccgtcgagactccaggcttgtatgctcatttggtcactaagtatagggccacactcatggctgcggattaccctgggcttaagatcacagcgtacaactaccagcaagacccaatggccacgcgtcacttcaagaaaaactcagaacctaactttgaaaatgtgaagctctgtcttattgatacgttgactgtcgacgctgagtttcatgaaattctggctgacagatggctgcggcccatgagaaaccccagagctcgggaaattgtcgccccaatgctatgtttaccggaacatggcggaatggtgatcagtgttcgggactggttgggcggagaagagcgcttgggctgccctctgactcatgagatggatccagccgagcgttcagaagccgcagacgccaaaaaggaggaaaggaagtctgaaaacaacagtggtttcggtagcagccttctgggcggcggtgtgcgtgcttctcctgctccgaaagagcagaacaagaatgagctgggcgaagtacttctcgataaagaggctttgaagagcaatgaagttgtggttttggccatgggcgaggacgctcggaagtacgcagcgaccatgccaaatgctgtgcgagtcggctctttcggctacccaattcctgatgcgactcttgccgttgttgacccggagaccaatttgttatgcacgcccaatgtgattggtgagatatgggtagactcgccatctctttctggcggtttctgggcattgcccaagcacacggaagcaatcttccatgcacggccatataaattcgaagagggcaaccccacccctgtactggtggaaccagagtttttacggactggtctccttggctgtgtgattgagggaaaaatctttgtactaggtctctacgaagaccgcctccgacagaaggtagagtgggtcgagcatgggcaggagattgttgaacatcgctacttcttcgtccaacacatgatcgtcagtattctcaagaacttgcccaagatacacgactgcactgcctttgatgtgtttgttaatgatgaacatcttccgattgttgtcttagagtcatatgcggcatcgacagcaccgacgacatcgggtggtccaccccggcaactggattccgtgctcctcgaatctctggcggaaagatgtatggaagtcttatatcaagagcaccacttgcgagtctactgtgtgcttctcacggcgcctaacacacttccccgtgtgactaagaacggacgccgggagatcggtaatatgctctgtcgcagggaattcgacgccggaactctgccctgtgtgcacgtgaagttcggtatcgaacgatcggtcatgaatttgccggttggcgtcgaccctgttgggggaatatggtctcccttggcttcggcgacgcggcaagagatgcttgccatgcaagaaaagcagtactcgggagtggactaccgcgatgttgtgatggacgatcgcacctccacgcctttgaacaacttcgcaacaattgttgaccttctccaatggcgtgtctcccgccaggcagaggagctggcttactgcacaatcgacggtcgtggaaaagaaggcaaaggcatcacctggaaaaaatttgacttgaaggtcgccgctgtagcgatgtacttgaagaacaaggtcaaagttcgacctggagatcatcttatcctgatgtacacgcactcggaggattatgtctacgccgtgcatgcctgcttctgtctcggtgttgttgtcattcccatagctccaatcgaccagaaccggctagcagaagacgcccctgcattcctccatgtgatcaatgatttcaaagttaaagccatcctcgtcaatagcgacgttgaccacgtcatgagacaaaaagtggtttcccagcatatcaagcagtccgcgcaggtcctcaagattggtgtgcctgctatctacaataccagcaaaccatcgaagcagtctcatggttgccgagatcttggctttactgtcaaagaaacttggttacaatcagaccaaccagctctagtttggacatactggacaccggatcagagaagaatctctgtacaaattggccacgacaccatcttgggtatgtgtagtcttcaccacggggcgaaaaggacgacggtggtctattga

SEQ ID NO: 9357 - DNA, 240 bp, A.fumigatus
tatgctctatcttctctcctcccatctctcgctctctctgtctgtcactttcggtttcttgaacccttcccgcgtgtcatgtgcatccccgctatccccaaaatgggtcagactaactacactttccccttctggcctagtgccttcaacacctaccggaaacaagctagcgagaactcactccaaatgcccaactacccaggcagccaggcaacaattccctcctctcaaccccattga

SEQ ID NO: 9358 - DNA, 372 bp, A.fumigatus
caaatggcatcaacttcaacgccagcgtcaaggtcaaggtcaacatcgacttctacctccaaattcagcactacggtcacagcctctacaccgtcaaccctccagctcagcgccaactttgcaggcgcgcatactaagtcccatgcgggaaactccaatgccgtgggatacgaccatgagacctaccttcagttaacggccggcgagaaagcgaaagagaagacgccgaaccaggtataccgagaggtgagtgatccctaccagaaaagacgcaatgcgattgacgttattgcaggagcgagctcggaggcgcacgacgagggcattggatccagctatcctagaacctcagggcgatccgagcccgattga

SEQ ID NO: 9359 - DNA, 405 bp, A.fumigatus
cctcacggttcccttgttctctatgctgccacaccccctccgcgaccatgttccgacatctctggatcgttatcgaggtccccttccatttcagcaacgaatctctcccaggtatttatcacaccctggaaaaagtcgatgtgcttctcggcaagagcccctagcgtatctcggaactcgaccgcctttatccgttcaaagtcggctacttcgcggacaacctcttcgtcgaacatctctgatgtggtcttggccgattccacctcccgggtgagctcgtcgatgcgcagctccagcttccggacacgctcccgacgcgattgttcgtggtctactccgcgcatgtcttccatcttggagcggatgaatgaggcaggcgatgaagttaaagggttagaggcgtag

SEQ ID NO: 9360 - DNA, 408 bp, A.fumigatus
gccaagacaccgccggacggcagcccctcgatggatcagcacgacgactttgatagcgtctcatggagacaggacccggagagcgacatctctcggcccaccacgtcaggaacagacgcggatgagtcgctagaatacaaccgtgataccaatggcaagcggaggatgagttcagttcacgaagacccgcctcaggccgggccgctggcggacgccgtggacctggcgggtatcggggatggggtgctggaatgtcgagttgattcacccttgaaagagaatgatggaactaaggatgcgtacatttcgtatctcgtcactacacatgtgagttactttttcctgatcagtggccttgtgtccgtttgctggctgcctggctggagatgcatgcaaatgaagtattga

SEQ ID NO: 9361 - DNA, 1203 bp, A.fumigatus
atgcagacagatttcaagtcttttcagaagccagactttgctgtacgaaggcgatttaccgatttctattttctgtacaagacgctttaccgggaatatcctgcctgcgcggtcccgccgttgccagagaagcataagatggagtacgtgacgggggatcggttcgggccggagttcacttctcgtcgcgcttggtcgttacatcggttcttgaagcgcttgacattgcaccctgtccttcgtcgagctccgttgctcgccattttcctcgaatcgccagactggaatgcgcacatgcgactacactctacccgtacctcgacgggtaactcggatggaagcggcacggagatattcgacaactttacggacacatttgtcaatgcattcacaaaggttcacaagccagaccgtcgtttcatcgaagtcaaggagaaggccgacaagctggatgaggatctcaaccatgttgagaagatcgttgcccgagtagcgcgtcgggagagcgatcttgatgcagactacaacgatcttgcgacgcaattccggaaacttgtgcctctcgagccggatgtcgaggtcccgctacaaatcttcgctgcatcggtggaggagactgcgaggggtttcaaaatgctcaaagaccacacggatcagaactatctgggctctctacgagatatggaagcatacattgtctccgtcaaagcccttctcaagacccgcgagcaaaaacaactcgactttgaagcgctggtcgattatcggaataaagcagtggctgagcgggactcgcttgccgccaacccatcttcctactacgcctctaaccctttaacttcatcgcctgcctcattcatccgctccaagatggaagacatgcgcggagtagaccacgaacaatcgcgtcgggagcgtgtccggaagctggagctgcgcatcgacgagctcacccgggaggtggaatcggccaagaccacatcagagatgttcgacgaagaggttgtccgcgaagtagccgactttgaacggataaaggcggtcgagttccgagatacgctaggggctcttgccgagaagcacatcgactttttccagggtgtgataaatacctgggagagattcgttgctgaaatggaaggggacctcgataacgatccagagatgtcggaacatggtcgcggagggggtgtggcagcatag

SEQ ID NO: 9362 - DNA, 1098 bp, A.fumigatus
ctccgatttgacgcttatgcccatcccgtcgtgaagatgcgcatttgcgttgagaatgggatgttcacgtattcctttctgaaagaggcgtcacaaaagttcaggggctggattgatgatcttttgtcatcggcatgggctagctgccaggacagcgaccttctcattgaatcacccagtgcaatggcgggtatacacatcgccgaggcgctgagaatcccttactttcgtgccttcacaatgccgtggtcacggacaagagcttacccgcacgcctttgcagtgcccgagcacagaatgggtggtgcgtacaactatataacctacgtgatgtttgacaatgtcttctggaaggcgatcgccgggcaggtgaacagatggcggaaaaacgagctcggcctaaaggcgactactctggacaagatgcaaccgaacaaagtcccattcctctataactactctccctcggtagtaccgccaccattggactaccccgactggattcggatcaccggatattggttccttaacgagggaagcgactggactcctccaactgctctgtccgaattcattcaccgtgcccgcgaagatgggaaaaagatagtttatattgggttcggatcaatagttgtgtctgatccctcggcactcaccaagactgtcattgagtcagttctgaaggctgatgttcgctgtattctctccaaaggatggtccgataggctcggagatcctgctagtgctaagccggaagtaccattgccgtcagagatccaccagattcaggctgcaccgcatgactggctcttctcgcacatcgacgctgccgttcatcatggaggagcgggtaccactggggcgagcttacgtgctggcgttcctacgatcatcaagcctttcttcggtgaccagttcttttttgggtcgagagtagaagatttgggcgtggggatttgcatgaagaagcttaacgtgagcgttttctcgcgggcactctgggaagccacccatagcgagcgaatgatcatcagagcccaagatctaggcgcaaggatccgtagtgtgagtgacattctgacgatcaagttcttgtga

SEQ ID NO: 9363 - DNA, 843 bp, A.fumigatus
  unsure (99): Identity of nucleotide sequences at the above locations are unknown.
aagagcaaacgtgccccggtcctggtaacatttggtcaatgtgaggttgaagatcccaaagccgatctccagcacggtgtggacgattcttacccctgngatgtgaagaaaggctccgataccatccaaatcactgcaaagaccgtttggggtgctctgcatgcgttcaccacccctcagcagatcatcatctcggatgggaaaggtggactaatcatcgagcaacctgtcagtatccaggatgcgcctctctatccttatcgtggcatcatgatcgatactggtcgcaacttcatctccgtgaaaaagatcctggagcagttggatgccatgtcattgtccaagctgaatgtcctgcactggcacttggatgacacgcaatcgtggcctgtacagatcaacgcacatccggagatggttaaagatgcatactcggtccgggagacttactcgcacgctgacatccgccaaattattgcctatgcccgtgcccgaggtatccgtgtcatccccgaagtcgatatgcccagtcactcgtcgtctggctggaagcaggcagacccgaaaatggtgacttgcgccgattcctggtggtccaacgacgtctggcaatatcatactgccgttcaacccaacccgggccagctggacatcatctacgacaagacgtacgacatcgttcgggatgtctacaatgagctgtcgggggtctttaccgacaattggttccatgtgggagctgatgagattcaacccaattgcttcaatttcagtacctatgtccagtcatggttcgcagaagatccgtcgtcttcacgacggggctggaatgacctccagtaa

SEQ ID NO: 9364 - DNA, 186 bp, A.fumigatus
gagacgcaagaatcggtcctcacattatctttctggtcatctaaacaaggctggaagcgcgcagctgtcaacaccctccgctgtctggcgggatgcacactaggtgatttcttggcgctgtgggtgcttcaaagtttctatggacattgggatatgagtgctattatgggcgtttctagtatgtga

SEQ ID NO: 9365 - DNA, 978 bp, A.fumigatus
tactcttgccagttgttattcctctatactaatcagcttccgttgacatctgtacagcaacatgagcgcgacgcagtcagctatgatcccttctccgtcggcctccagcttcaggcgcaaggcatcgaggccaaacatccaatcgttatgatccccggtgtcatttcaaccggcttggagagttggggcacagggccggcctcccgtcagtactttcgtcggcgactctggggcagttggagcatgatgcgtgcgctcgttatggataaagcagaatggaagaatcacatcatgctggacagagagactggattagatcctccggggatcaagcttcgcgcagcccaggggttcgatgcgaccgatttctttatcacaggctactggatctggaacaagatccttgagaatctggccacgattggatacgacccaaccaatgcttttacggccgcatatgattggcggctatcctatttaaacctggaagtccgcgatcagtacttcagtcgtcttaagtcgtatatcgagacggctgtgctggttaaaggagagaaggtgactctagcgtcgcacagtatgggttcgcaggtggttctctacttcttcaaatgggtcgaacatccagatcacggcaaaggaggtcgcgactgggttaacaagcacatcgccaactggatcaacatcagcgggtgcatgctaggcgccgtcaaaggcctgacggcggtgttgtcgggcgagatgcgcgacaccgcccaacttaacgcctttgccgtctacggcctggagaagttcctgtccaaggaagagcgtgccgagatcttccgcgccatgccgggtatatcgagcatgctccccaatgtcgggcgaagcagtctggtgcaactttacctgggcactcgacgatcaaccttggccagtcatgacctttggcgaccttcctcactttcgcggaaccaatttcttcctgtaccgtaa

SEQ ID NO: 9366 - DNA, 336 bp, A.fumigatus
  unsure (90),(107),(136): Identity of nucleotide sequences at the above locations are unknown.
aaactcaccacaacggaaaagcttgactatctgctcgaccaaagtgaagattggtacccgcaccaggtgcttagcaactattcacacggnggtgcgcatacaaccanggaagtccaagcgaacgaaaccaaccccngcacatggttcaacccacttgagacaccggttgcccttgcccccggaattgaagaactacttgctttaccgggtgggcaaacccgacggaccccattacttttattaagaaaaaccgaaccccttgttaaacttaaacgttggatttggaacccccggaacccccccaaaggggtaaatccgggcgtctctcttggttaa

SEQ ID NO: 9367 - DNA, 489 bp, A.fumigatus
cttctcactttcaattctttttatctactttcctgtcgtccgattctctgggccttaggagttattgtcttcgagctacactcccagtctgagtttggcgttacatcaattgcagcattttgctttcctttacgacccttcctggcggtcgcccacatgctccgccgtcgtctggcaaaggacgacgacgtccagcagactaaggacaagtctcgcgatgacaaaggaaagtcatcgccagatactaagacggttgttatccaagaaaagccgcaatctggatcgttcttttcccgaccgaagagtaaacggcgcaatggactcatcttcgcactaggaggcattttcggcatctttgttgccttgtttttcgccaaccagcaggatgtgattagtcttgaatcattgatggatctgaacctggacacattgatcgatgttattcctcaaggcattataagggatgcgcgagagttcacggtatgttga

SEQ ID NO: 9368 - DNA, 528 bp, A.fumigatus
aaaaaggtacccaagaacagcgacggtcgtcgaaatcacatgggaaacaggaacccgaacgtcatgcgagatcctcaaaattcctgtcttctcggaccaccaaccaccatcatcagacacagcgcaatcacaagctgctcacattcgtccttttaccggcttctccaacagtctactgaaatcaagctccaccgtccaagtccttatcccacaacaactcccgcacctattcccctcgatgactccgtaatgagccaggatgactcttcgcccgcagagcccacagctgctggtgctgctgctccttcagacctccgctacgtgcgctacgatggatcccgcgaaagtgaatttgtatccgcaatgagacagcttatttccaaagatctttcggaaccgtacagcatctacgtttaccgctacttcctctatcaatggggggatctgtgcttcatggccatggacgatacaaaggagaaagatttcatggtaggcgtggtagccttccccacgggagaaaatccgcgt

SEQ ID NO: 9369 - DNA, 222 bp, A.fumigatus
  unsure (164): Identity of nucleotide sequences at the above locations are unknown.
ccggtgttgatgaacaatgaagctctcgcggaagatccaccgacccctctctgggaacttgtgctagaacaatttaaggaccaactggtcctcatcctcttaggctccgctgctgtgtcttttgtactggctctttttgaggaaggtgacgactggacagcgtntgttgaccctgttgtggtacgttctgcgaaaccccgttgtacgaaggtgatttcttga

SEQ ID NO: 9370 - DNA, 504 bp, A.fumigatus
attttgaccattctgatcctcaatgctgtcgtcggtgtcacgcaggagagcagcgcggagaaggcaattgctgctcttcaagaatactctgcaaatgaagcaacagtggttcgtgatggcaaaacccagcgtattaaggcggaagatctcgtccctggagatatcattcacatcggagttggtgaccgcgttccggccgactgcagactgctagctattcaaagcaacagtttccgcgtcgaccaagcggtcctgacgggcgaaagtgagagtgtctccaaggatacccgctcgatcaaggatgaacaggccgtcaagcaagaccagacaaatatcctattctcgggcacttcggttgtcaatggccatgctactgctattgttgtgttgactggtgcttcgactgctattggtggcatccacgaaagtatcacgtctcagatttcagagccgacgccacttaagcagaaactcaacgattttggcaaatgcttactaaagtga

SEQ ID NO: 9371 - DNA, 285 bp, A.fumigatus
aaatactgctatccgagaactacttacctaacctggtctactactaccggtaaccttttgttcatccggccacttggcattcatgactcggtagccacgttctccctttatatttcttctcattctttcttcctctctctcctcttcgtctccctctctcttggcttgttcgattgttcgaggtgtgattggcaatggagcgatcttttctccattctccagcagaagtgctggagcactttggagtctcagagcgtgctggtctgtcccaggatcaggtcgtga

SEQ ID NO: 9372 - DNA, 603 bp, A.fumigatus
tccatcgttcgtccaacaggactccgtatgcatttacccctcccccgcgggtcacgcatctgctgtaatttatctaggctccaagttcctccttctctatcctcttctactcattcatcctcatcctcatccttttcttccaatcgcgccggccgctgtgcctgtggttgtcgcaattccgcctcgtgctcctgctcctgctgtgttcatccatcctctctgtcccctttaaccaaagctaccagatcattgactaccactacttcgcgcgcactattccgcacatcaccatccagaatggcgcaggaatacaaactcaaggacatctcgtccctagcggacatcaagaacatggacaaggtcgagtccgaggttgagggcgtggagggtgggaaggtcctggtgctgcgtttcaatggccaggtgcatgcgatgagccccaaatgtactcattacggggctcccctgaagctgggcgtcgttgcgcctgatggtcgaatcacctgtccgtggcatggcggtaagtcggtcctagtaagggagtgggctgtgtacatgctgatcatcgtttctggtagcctgtttcaatattgggagcggtga

SEQ ID NO: 9373 - DNA, 210 bp, A.fumigatus
tcatcgtttctggtagcctgtttcaatattgggagcggtgatgtggaagatgcgcctgctcccaacgcattgaacaagttcgagcttgtggagaagaacggtgcggtctatatcaagggcgaggaggctgcgatcaaatctggacagagggatccggtctttaaatgcagcccttccactggggagaaggtggtcgtggttggcgggtaa

SEQ ID NO: 9374 - DNA, 300 bp, A.fumigatus
gctccaagttcctccttctctatcctcttctactcattcatcctcatcctcatccttttcttccaatcgcgccggccgctgtgcctgtggttgtcgcaattccgcctcgtgctcctgctcctgctgtgttcatccatcctctctgtcccctttaaccaaagctaccagatcattgactaccactacttcgcgcgcactattccgcacatcaccatccagaatggcgcaggaatacaaactcaaggacatctcgtccctagcggacatcaagaacatggacaaggtcgagtccgaggttga

SEQ ID NO: 9375 - DNA, 1212 bp, A.fumigatus
cattataagcccgggaaaccgctagtagcagaaagccaagcaaaagcggcgatcggacccctttggatgacccaaatcaagatggcaaggacccggatgatgacgatacagttctccctaagaattccccaagccggtcggagaaaacgggctctcgacccaacgtatattcccggcaagaatgacgtcggtgaagaagaagatgatgatgatgagtatattccaacgggcctaggacgaaagaagagaagaattttggaccctgccttcgttcctgacaaaggcgacgaagatcaggacatatttctagattcgtcaaagaagggcaagggcaggactacagaaaatcgaaccacgacaaggaaagcgaattctgaaattggagcagggaatctacctactcctagcaaagagacacctcgacccgcgaaaacgatgaagactgaaccgacatcacctccaagagtcccagttttaccggctctcacggatcctcaacatgatacctctgacggaaaagcggccattaaaaattcgtgggagcttgtaaacgccagaacacagccaaaccaccccttaaaggtgaaagcgatgaagatactcaacaagattgcagaagatagaaatagagccttcttcgcgctcgtcaaagctcatcaacgctctcggaaaagttatgcggcccatttggcaggtaatacaaatgacgaggctcatacccagggcatggcagactcctcgaggagaaggaacaaaacctcagacgccgttgcgaggcattcagactctactgcgcaagtgaatgatacttcattgactcaggaagatgaggcagacacttctgtaccagatctttcccaggaaagagcgaagcgctgggcaaatgctgtcaatgtgcccaagggtctatggagcgaagtggagaaacaacttttctatcggatcgccatgagaggtttcgaacctttgcttcctaagcagtggcattatgacttctccacactcccgaatcctctgttcgctgtttcgggtgagaacccggcgtcgttgatcaatgcaatcagaggctcggaattctacggtaagttggacctcagccatgcaatttgccttgatagtccgctgaatatttgcagcaatcaggtcgctttccgatttattctctctcggcggctatgtcagagactgcaatctggtgcatcgtcgacctga

SEQ ID NO: 9376 - DNA, 363 bp, A.fumigatus
gcccttatggaccacttgtctttgagaagagactcatcgcaaatggcagagaacaaccccgacgtaatgaacgaattggcaacaaagttgggtctatcatcagagctccaattttacgatgtctattccctggatgaacccgaacaactcgcacatatccctcgacctgccatggctctgctcgccatcattccacgtacaccggcttgggaacgagatcgcgaggccgaagatgccaacaaagaaccctacactggctccggcccaaacgagccggtcacctggttcaagcagaccatcggccacgcctgcggctcgattggtctgctccataacttggtcaacggcccggccgccgactat

SEQ ID NO: 9377 - DNA, 945 bp, A.fumigatus
caggcagtagatactcttcttgacctgcatgccaagctgtccacggtggtgcggtattacgatcgcatgctagaggaacgattatctagtgcatactcgcagcattcgctcggatacgcaactgcgccaggcggttccccttaccccaatatatatcctacgatgccttcccacatcccggaaggtaaaactggagccgaaaacttttattacggaaaccccgttgccgatagggcgcctccagtccgtaacacttatggataccctcattccagcagggatattcgcgagccaactgcagctcccagcggtccgatcagctccggcgtgtattaccaacccggtcaggcagtgcctctaaatccaccatggaatggaaaagctccttctgtcgcatcacctcaaccatccgatccatccactcctttccctaacatttcttcagataatcttgaaccttctgcttggaggcaatactacgcgtccgcgccacatcaaaaacaagattcaaatgcgtattcaggcccccggcctggggagacagacgtatctcaccagtcgtcgccaaacatgcgacgagattcttactatcaatcagctggagcgcctgtcactgcgcgggctagcgccccggaacaatctccgcctacagaccagggccagtctccagcttatatgcaatacggagattctcattcagcgcaatcgactggccaacctacccatcaacatcagcctacggcccctcctccccagtcgtactacttccagcatcaacctccacaaagcgcaccacttccaacgcactcgcagactccaggtgcgccatatggaacgtatcctggcggagatgtttccccaattggtgcgcctgcacctgcggtgcattatcaaccagctgcccaaaccaaaccggcggttgaggaaagtctgattgagctgtag

SEQ ID NO: 9378 - DNA, 186 bp, A.fumigatus
tactatcatccccccggcgatgccttttgccttgcacctttattcctttctacctctgtcttctattcccattcatctttattcgacacccattttagcactaacggcgtccggtgcatcgttatggcttttagcttacgagcatttcttatcaaattcgggatatcctactgcgtcaatctttga

SEQ ID NO: 9379 - DNA, 228 bp, A.fumigatus
aaacttcagccttcgttcgctcttgacactggagaacttaaatattctggagaagtgcgcactgccactgtgcctgacgctttttttggtcccttgaagctaattgcctatagatacctgtggccgacatattcggaagatgcgtccaatcaccatgtgctactaattgcgctgattgtcagcattaagcagcgagatcatttgccaatatggggtgcgttcctgtag

SEQ ID NO: 9380 - DNA, 1809 bp, A.fumigatus
  unsure (1598): Identity of nucleotide sequences at the above locations are unknown.
attatagagaccttctctgaccggcccggcgacttctccaaccttttccatcgtatcctctctatgagcgtcgacaattctttgtctaccttctctcgccaatcgatattgtccttcattatcagtgctttccaatccctggagaacgtactcatccgaaaggagtgcgcacctctcgtttcgatttccatctggcacaatctctcgagcgaagaactaagggatcggatctttgctaaagtaccatcattaaagaaagcctggagagcagctgggaagcggtacgaagctggagatgagacagcaaaggcgaggatgcgattcgagcgatcgtggctctttactatgcttctggatttcttgcggcgattgaatgggtccgagcaggaattgtctgataatctacgctattgtgagaggtttctggaatacctggtagacttggagagtcagctcccgacacggcgctacgtcaacacgttattgaaggatctcaatttactcccggttatacggctttcgcaaatgtaccgttctcctggaaatgctctcttccgcgacctcgttgagcttcttaaccatttctcaggattcgcaatcgatgattacaccggcgaacctcttgacccgcaggcaatctatgagagccattcccgagagttggcacatttgcagcggaccgcaatgaagcacttcaaggataagctgatgatccttgctctgtcaaattacggctcaatcgagcaacgctcagaactggaagggcaactgagtaccctgaacgactccgagcttcaaagtctctgtatgcacctgggtttccggacagattatcccaaacaatccggtgtcataccgactcgacatctctatctcgagatacttctgtcattctacgagcgcaaggtgccgtttcaagagaccgcatcccgactaagcattgtgcccacagaaaaagatctctatgacccttcattcttgcgaaacgaaacctatgacggatctcgaccgcttgcgattccgaaactgaatcttcaatatctgagccttggcgactttctttggcggtcgttcctgctgtatcgttccgaagctttcttccaggtccgaaaggatatggaagcgattatcaagcggatgcagcctcgatcaagccgcgatggtaaaacgctgaccttcgatggtttctctcgcatggccattcccatctccaaaccagccataatcgaggttgcacctcctaaagtaggctcgtctgacccagcttttgtgagagctgagattgcaatcgaagttggcaggttagcagatcacattcggaaggagtgggactcacttcgtccagatgacgtcgtcttccttctagctgtccaaccgggtaatgcaaacaattccgttttcagggacagctctgtagagactccgagtctgatgcaccttaggactgcaacggtggttcaggttctcgatgaacagggtcgcccacttcgtgaaccagttgtgggccacacgaatgggtatcaatctcgacctcgcctccggagattgctgctcaatctggatccatccgctttcaaggctgataaggatcgcacctnccaaggaaagcaggacatttatccattgataaacgtgattgcaagacggaaagggcgggagaacaatttcaggtcgatactggagaacatgcagagactcattgtctctgatgttacccttccttcttggattcaggatatctttctaggatacggagatcctgcaggtgccaggtatacgggaattgcccaaccgactgaagtcagttga

SEQ ID NO: 9381 - DNA, 324 bp, A.fumigatus
gaattgttcaatttgaggaacgtacaagagacttcgtttagcttcagcggtcatgagatgaccacgatgagcgacaagctggagccccttgcaattgttggcatgaagtggcggttctctggcgaggcgaactcagccagcggcttttgggatgttcttaccaatgcgagatcagctaaatctcgcatccaagcggatcgcttcaacgtcgacgcacactatcatccatcagccgatcggaatggatcagtaagtgcatttaatatcccgtggcaatcagacgccgagagtctccgcagatcattaaggaaggacacttcctga

SEQ ID NO: 9382 - DNA, 243 bp, A.fumigatus
ttcgggaaggggtctatcacaatctgtgttcgcgtgacgagctctctaaaaacaggggagtctgctacggacaggagctgcggtatgcaccatgaaatttgtctcttgaccgagctgacacgacacagcctgaatctcatgttcacaatcgccgctgtggcgaccaatgtctgcgccttaccagttggcactatcctagatcaatacggtcctcgcgtctgtggtatcattagcagcatatga

SEQ ID NO: 9383 - DNA, 195 bp, A.fumigatus
catcgcatgctcatcgaatctggtggggcttcgtcaccgtacatgcaaatgtacatgtacgaggacagttgggaacttcgggatccggctcgtcttctactcactcaagactctattacagccacttttgagaaaacgcaattttgctctaacaagctagatcctcggcgtaacacctcatctccaaagccatga

SEQ ID NO: 9384 - DNA, 720 bp, A.fumigatus
aatctaatcaaggcaacggtatgtcgtctccaacctaagctctgcttctgttcagcttctcatctgcaatgtatagctatgtctctaaatcgagtctcttaccttgagtcgtggggccaaactcggccaggatcactgcagcaacagcaacaaggccaagaggatggcgattctgactctgtggacgggcgcaatgtcgaccttccggagagttcactttcatcctccttccagtcaacgtacacttatcgtttaaatttcaatccatatgctgggcccggttggactcagacccctgatgaagttgcccctgaagtcctcccatctggtcctgaaactcctacaataaaaacccagccaaaaccactggaggagggtgaccatggaagatatgatccacaacatgcctccttaaggttgccgaatgaggattatccattgcagaccactggggcgttcgaagtcagtagtacacgacgaatttgtaagaatccggttaaaccttgtttgttcacgacgcgagagatactaatgagatacttaggccaggtaattgttgcggtcatctattgcttcctcgcagcaggagttgtgttcggatttgcggcattgaaacccgtcctgattcgggaaggggtctatcacaatctgtgttcgcgtgacgagctctctaaaaacaggggagtctgctacggacaggagctgcggtatgcaccatga

SEQ ID NO: 9385 - DNA, 1272 bp, A.fumigatus
  unsure (488),(495): Identity of nucleotide sequences at the above locations are unknown.
cgcgtaaaggtcttggatgacctgtgccggcttgtagatggcgagcaattgcattttttgcgtatcaagtcactttctcaaacgttcacactggagctcatcgagagcattctcactaacagcggacgcttatttgttggtcatgcggagctaacgcatgttctgcggactcggctcatgccgatgacagtcaggtatctctctgagaggcacggctttgcccttaccagccgcgtcgctcggattcttctgatacttctcaagcgttacatgtctcttctgacagccgaatgcgagatggctcttgggttgctgactcaccttctcgaaccggatggaacatcgccttggaaaagagtactctgtatggaaatttttagaggcctttatgccgagccggggctagtccggctcatttattctctatatgacggagaaaacaacaggaagaatattctcagagatcacatggccgcttttggttgttntgggttnggagaacccttcatgaatggagtcagcagtcgttccaccgtacccatgcgagctgtacatgcacgatccataacggaagagcagataacactggaagccgtcggatttgccggggttattggggccattggccattctactgagactaatttccagggaattagcagtcagtggagcacagtccgcacgccgtatatcgagttgcttgacaagaccgatccgccacctccccgtgaaacgtacatctacagcctagtactcaattgtatcacctcatttgcagaagggctggcgaaattcatacttccattaactgtcccagactcaaagcagaagcggagaagtcggatgacgagccctgacaaaagcaattctcctaagcctgcacatatttatcagagaatggatgccagcacaactatacaccgatcgaattccaagaaactcgcgatacctcttaatcccttggacctagattctcaccctcaattgacagctatcaaggcctgcgccggcatcatggagaattgctggcctgctatactagcagcctgttcgacatttctctacgcttcgttggacgaagattactatcacaaccttgttcgatcttttcagaagctggctcatgttgccggtcttctcagactctccgttccgcgggacgcttttctgactactctagcgaaggctacaatgccagctgagatggctggtgcttcgactgcagctgcctcagattcccacagcattcccgctatggatgaaaaacgctag

SEQ ID NO: 9386 - DNA, 294 bp, A.fumigatus
aggcattgccttcaacttccgaggctcagatatctgctggtgggtgtcaagccatgccatatgtcgcccttgttgctgcttgggaagattactgagtacccaagagatctcgtgcgcaaacccaagtttgtcgatccatttattttagcctgccatagtcgacatgcaaagcttgctggaatcggagttgtctgcttgcagagacttgtggcttcacggtcactaccttctgagaggctgaatgatgtccttgggggattgaaagagaccactagcctgagtatgcagtcttag

SEQ ID NO: 9387 - DNA, 297 bp, A.fumigatus
ttcttggtagtggtgtattattattattattattatctggcgtgcccgcacactcgctcttcaacctttttctcttctgtctcaatcactcacttttttccccttctctccataagttttccggagtatcggtctccggtttatctaacgatggttttgattgacaagcaagagtacctcacccaggaggaacagcgtctcaaggaagatcgtgaacggaccagatactggaagaaatggggtccttatgtcgcagagagacaatgggccacaggtgagtcctctctctattcatga

SEQ ID NO: 9388 - DNA, 198 bp, A.fumigatus
tcgacgtatctgttacggttagatttctcctacgatcactcccggtcaagaacatatcggtggggcgaggatggaattgctggtgtctcggatactcatggcttagaaaatatcgcttttgccttttggaatgagaaagagtatgcctacgcttttctggatatgcaatctgagcggagctctgacattgactgttga

SEQ ID NO: 9389 - DNA, 336 bp, A.fumigatus
  unsure (281): Identity of nucleotide sequences at the above locations are unknown.
atgtcctacgactccgcattcacccctcaaggagccgccctctccgacctcccctggcgcgaacaactccgccgcggcttcaaagacatgggcgcccgctcctggtcctcggccaaaaatttcggtatcgtcggtgcgctctacgctggcacggagtgctgcattgagggcctgcgcgcgaagaacgacctcaccaacagtgtcgcggccggttgcatcacgggcgggatccttggtgcgaaggcgggcccgcaggctgcggctgctggttgtgttggttntgcggcgttcagtgcggcgattgatgcgtatatgaggatgccgtcggaggagtag

SEQ ID NO: 9390 - DNA, 495 bp, A.fumigatus
acgttcctcgagaacattcgacaggctacggtgggagaggagggaatcaatgccactcagtcgaggggagtgcctcctgcgcggaaacgggattccagctccgcgtcccgaagcagagatcggttgtcggtgcatggaggcaaatcatcgcggtcaccgtcgtccgctcggggcaaggcggcagggacacaattatctggtaaagacactaaatcggtggacatagacgtgtcgttctggagtgaattcggcattgatacagctgggcagaagtccacgaaagctcgcggagcctcaaataccccacgcggggcgaccgaacaagaaacctccaacaatatcgacgttgaagagaactgggatgactgggatactccccagcccaagaagacgcacaccccttcgtcgagccgctccacgctggagtccaagcatgaccagtctccaataacccagaacagtagcccccgtacaagcggcaggtatgctatttga

SEQ ID NO: 9391 - DNA, 1209 bp, A.fumigatus
accatgatgaatccttacattagctgggctctgctactcgtggtggcaggtggcctgggatggtattataatgccccgaatcccaaagccaagcccaccgtcaagcccgcggcagagaagatagaaagtgcgactggagtgaagaagcccaagaagaaggcgaaaaaatcccacgagcctacttcatccgcaacgaccaaaaaggtcgaagagaagcccgcattcgaggacggagctacggagggtgatgatggggatgaagagatcgaccggaaggagatggccaagcgttttaccgctggggagagtggaatccccgcccaggggagcggcagcgagggtaaatctcaaaagaaaaagaagaagaccaccagccaactcgaggctgaggagagtaagcgctccggatctcgcgtctcggctcgcacctcctccaccgctggcgccgacgcggatgatgatctctcccccgcgggttccccgatggtgaagcctaccgcctcctccgctggatatgtatcggacatgctcgaagctcctgctcccggcgcgtctgtcctccgtgtcaccgggtctatggaagcgccccagaagaagcagaaggctcagtctttcaagcaggtcgaaacgaagaagcaacgccaacaacgggcgaagaacgaggctcgtaagcaacaagtccaggaagctgaggcagaaagacgcaagcttctcgagaaacagctgcacacggcccgggaggctgagcgccgcgaagcggccaagaccaagctcgttgcgcctcagagcaacgcctggcaggcaaaggaggtgaaccccacatccaacggcaccccgaatgtgtctcagggccccaacgtggaactgctggacactttcgaaacgccatcctctaagcagtctcctgccactacctcgagctcgaagaagtgggaccagggccttccgtcggaagaggagcaaatgcgtatcctgggtgctgatcctagtgatgactggaccactgtgtcgagcaagaagcctaagaagaagggcggaaaggccgatgagagcttcagcgaggccagtgcgtctgagacccagttgactcctgccgctccagcggccgttcccgctgcccccaaggtcactgtgacccccacttatatacccgatattctgcgctcgaagcagaaaggacacccgctcgactccgactgggccgcttag

SEQ ID NO: 9392 - DNA, 243 bp, A.fumigatus
attggatcactgcaaaacttccagtcaattaattatctgcgatcagtcactaccaggggctactccctgcccaatctcctacgccgttctgccaacttctacttcaaggaacgatcgattgagacgacgaccataaatatcacgactttcctctacttttttttgtcccttttgcttctctttgaaaaaccaatttgcccaaggttgctccgttcctacactgatgccccacttcgatcctga

SEQ ID NO: 9393 - DNA, 558 bp, A.fumigatus
tcgcccattcggccgctgtgcttcctgccccgtggtgaagacgcccctcttcctccaacaactatcctgtcctcaaaatccatctcccaatccgccgcccacgacttcctcgccgcctatctcgaccgcgcggccacagatccagccctacaacccaacgctagcatcagcgagcacggccccatttcccgtaccacagcggcagcgccgaacctcatcctacataatctgaagcgcgtccaggccgggttggctggcgaggttctgggccgtgatttgactctggcgaagatcaatgccggtgaggcgctgcagggtgagagtggggacaatgtcgtgtgggaggagaccaagcatgaacaggtggcagctgatgatgcgatggatgacgacgaggaggagatgcgaggggaagatgacgaggagaacgagcagcagcctagtagggtagggggtgaggctgacaagcataccgtggacaaggaggagcggaagaggaagaagaaggagcgccggttggctgagaagagagctaaagctaagggcgcggacgcttag

SEQ ID NO: 9394 - DNA, 762 bp, A.fumigatus
gcgtatggtcgcgcaaaagccaagtttggtttcatctcgggtctttacggtcaaatccagaatcttgcatttatctacggcgatgtcctccccaagctctggggattgagcggtctcttgctagcccggtactttccctctcggtttcaaggcgagatttcccagactcttctgttcatcttcggtttcaacctgatcagcaccgttctgtccctgccagtttcatactacaacaccttcgttctagaggagaagtttggcttcaacaagcagacgctcaagctttgggtcacagacatgctcaagggtcagatgctaggaattgtgttgggaaccccgatcatcagcgcggtgcttaagatcgtgcagaagactggcaactcgttcttctactacctctggctctttggtgtcttcgttcagatcttcgctatcaccatctaccccattgtcatcctgccactgttcaacaagctctcgcctctggaacccggagaattgaagacaggcgttgagcgccttgcccgggagctcaagttccttctccatgagctgtatgtcattgatggcagcaagcggagtgctcacagcaacgcgtatttttacgccctgccgtggaaaaagcacattgtcatctatgataccctgattgagaagagcgagactgaggaagtcgttgccgtcttgagtcatgaacttggtcactggagcctcggccacactactaagctctttgctattgctcaggtacgtgtttactga

SEQ ID NO: 9395 - DNA, 237 bp, A.fumigatus
tctcacatgttctacatcttcgccctgttctcggtatttgtgaacaacaagtccctgtatcaatcatttggcttccaccaggaaatgcccatcatgattggattcctcctgttctcggatgctctggctcccatggatgctgtcgtcaagctcttgatgaacgttcttagccgcaaattcgaatttgaagctggtatgatttctgtcccctcggaaatctctacagacagaagctga

SEQ ID NO: 9396 - DNA, 438 bp, A.fumigatus
gcgtccgcgcccttagctttagctctcttctcagccaaccggcgctccttcttcttcctcttccgctcctccttgtccacggtatgcttgtcagcctcaccccctaccctactaggctgctgctcgttctcctcgtcatcttcccctcgcatctcctcctcgtcgtcatccatcgcatcatcagctgccacctgttcatgcttggtctcctcccacacgacattgtccccactctcaccctgcagcgcctcaccggcattgatcttcgccagagtcaaatcacggcccagaacctcgccagccaacccggcctggacgcgcttcagattatgtaggatgaggttcggcgctgccgctgtggtacgggaaatggggccgtgctcgctgatgctagcgttgggttgtagggctggatctgtggccgcgcggtcgagatag

SEQ ID NO: 9397 - DNA, 282 bp, A.fumigatus
tttctgtcccctcggaaatctctacagacagaagctgactgtgccacagatgccttcgccgtgaagctcgggtattccgaacagcttgccgcgtcccttctcaagcttcagatccagaacttgagcaccatggacgctgactggatgtatgccagttaccactactctcatccgatcctgaccgaacgactcaaggcgcttggttggcagggaggcaaggtcaccgacgcgaagacggaatatagcgaaaggccggtcaaggctgctgaccgggagctctga

SEQ ID NO: 9398 - DNA, 810 bp, A.fumigatus
atcaccatccatccagcgggagtacttgtatctgtcaacaccacgaggcagcgaacaacaggtcaacaacacagtgccttgttcaaaccgcctgttgtttgtgctgaatttccagccatgtatatcctcgaggtaagctctcagaaatattgttcatgttgtacctcgctcaagctgaccgaacggttctgccctcgacagcaactcgcgcgtcttctggaccgcccgttcttcccgtggaagaatgttctcgtgggattctctttaggtcagttcattctcgaaggattcttgtccttccgacaatacaaggtgctgcagcgtacgaaaccacccaaggtgttggagaatgaagtgtcacagaaagttttcgatcagagtcaggtaagcagagatgattatattgctattgtcaagattgcaggtctgatatttctgcccttctctataggcgtatggtcgcgcaaaagccaagtttggtttcatctcgggtctttacggtcaaatccagaatcttgcatttatctacggcgatgtcctccccaagctctggggattgagcggtctcttgctagcccggtactttccctctcggtttcaaggcgagatttcccagactcttctgttcatcttcggtttcaacctgatcagcaccgttctgtccctgccagtttcatactacaacaccttcgttctagaggagaagtttggcttcaacaagcagacgctcaagctttgggtcacagacatgctcaagggtcagatgctaggaattgtgttgggaaccccgatcatcagcgcggtgcttaa

SEQ ID NO: 9399 - DNA, 420 bp, A.fumigatus
ggtcaacccagcatcaaaccaaatccggaaccatggcaaccccgactctgcactaccgcctcgcgaacccctccgacgccccccaaatccagcacctcgtccaatccgctttccgcgccccagacaccagaccaaactggacaggcgacaaagctctcgcctcagctttccgcatcgacaccgccgacatcctatccgggatcaccacgccggacagcgcattcctcctcgcgaccgaccccaccggcgcgccgatcgcctgcatcggagtctcgaggtccatcgctaacgacagcctcgctcgcttcttcctgctcgctgtcgatgaagcgtaccagcgctttgagatcgggcggaagatcctcgcttccgcggaggtgtacgcccagagggaatggggagctcaacgcggggggctga

SEQ ID NO: 9400 - DNA, 231 bp, A.fumigatus
gtcgacgcagtcatgtactgtgaggataaggtgcactacttacaggtccacatagctgagttgcagtttctccaggcttgcatctatagctctggggatgtccgcaatattcgtaattaccttggttgtcacaaaaagctgctcccgtgggacgccactctctttgatggccaggcctatctctggttctgtaccatagacttccgcgccatccaagtggtgatatcctag

SEQ ID NO: 9401 - DNA, 591 bp, A.fumigatus
ctgcgtcgacctacgagactgatacgctctattgcaccttgcagatatctgatccattccccattcttcgccaaatcagacaatgagttgcaagaagcctgggctgccatggagaaggtcaaggcagctgggaaggccaggtctattggtgtctccaatttcctgcaaagtcacctagaggcaattctcaaatccgccaaggtcactccctcgatcaaccagattgagtaccacccatatatacagcatggtggccttgttcagttccagggagacaagggaatcaagacagcgagctacgggcctcttacgcccattactcgagcaaaggatgggcccctcggggaggtactgcaaactctcgcctacaaatatggggtcagtgaaggtgagatcctgctcaggtggtccatagaccggggtgatgtttcaatcacaacaagcagcaaggagtctcgtctcagcagctatctgcgcgcgttgcgcttccgactgacgccgaaagaattagacgaaatttccgctatcggacgccaaaaacattatcgcgcattttggagggataaattcgcagatgacgatcgtcaatga

SEQ ID NO: 9402 - DNA, 300 bp, A.fumigatus
ttctccttatgccagcttggatatggcactggcacagcttggttcaaaaaaggcggggcgacaggcattgatcgagagttagttgagtcgatcaaaactgcaatcaagctaggatatcaccacttggatggcgcggaagtctatggtacagaaccagagataggcctggccatcaaagagagtggcgtcccacgggagcagctttttgtgacaaccaaggtaattacgaatattgcggacatccccagagctatagatgcaagcctggagaaactgcaactcagctatgtggacctgtaa

SEQ ID NO: 9403 - DNA, 738 bp, A.fumigatus
  unsure (617): Identity of nucleotide sequences at the above locations are unknown.
gcagtcggaatgctttcgacctcctgtttacaacaagcttctctcaccgaggagtcatcacccaagatgggattacttgtacactctctgggacatcttatggccaatgagtacgttctcattgccctggccatgttattcttcctcgtcactctctctagccgctcccattcaagggaacgatcttcgacgtcagcgtcgccctccctcaattccactcgtaaagaatgtaaagcaccaaatacacccagctggggacgaagaactccgagacccatccaatggtaccaggatatgtacttccagattcacaatttggaacagtatccgaccgtgctggaaccagctcgcgatgagctcttagcaatgatagcagatggggtctcgctcgccctcgaagcccccgagaaaggaattctccgcgttgaaagctatgatgccgaacgacttcgatccttcatcaacggtgaacacgaaaaaacaatgaacgaatgggcaagataccatgatcgcaggaaactgggactgggaccgacactttttggaaacatagcagaagcaaagaaatggctcacccagcgagctccagcaaaactggtcgacggcgcttggctaanccatatacacaaaatcaacaccccctttgctcttcgccgagtgacgaaagatgcgtggcagatattgtccgaagagcttgggagacggagatgtcaaccgaaaacatgtattcatctataa

SEQ ID NO: 9404 - DNA, 936 bp, A.fumigatus
catgaatcgtattcggtagagtcggttcatatcattcgtcatttcgccgaccaatgctcgaatcgaaaactcccaatattatattcacttatcgcatgcttcttcgggacgggcatggttgctggcgagacttcgcttccggtgttgtttaccggccgtgtgatgcaaggcattgctggatcctcggtatggattatcggccttgcgaccgtggctgataccgtgggaggagacaatatgggtaaagttgagggcatcatgatgtcgtttttgtatggtggattgataggtgggccatgcattgctggttggcttttggcatatgttggttattggcagacgtggttgctgccgcttgtgcttcttattatagaattcatcgcccgtcttgtcatggttgaaaattgtgcagttccaacctccagcagcggaccggaaacatcatcgaaagcggacggttccacgaagccattactctctccatgtgaagatacccccacaaactacccgtcggagaacttctggcgcattatacttacggacgttcgggcggtggttgcaatctgcgttgccatttcggcaaacacagttggcaccagtttccatgccaccctccctcttcatgtacaggaaacatttggctggggctccggaagaagtggctccttgttcgcttgtcttattatgccgactgttgtacttagtccagtggccggatggctgcgggattgtttcggagtccggtaccctgccagtgcagccgctgtttttcaagcggtgatgtttgggatattaggccttgcgggtactgatcttctgccttggacgagtgctcagtctggagggggagccttgtacacggggtgcatacttgccattggtgcggcgcgaccattcacggcaaatgtaggccctgtcgaactctcgtgtgagtga

SEQ ID NO: 9405 - DNA, 348 bp, A.fumigatus
ccatcatcaaatatggtcaagactcggaaaagattggccctcgcctgtgatacatgcaggtcacgacgggtcaagtgcgatggcgagcgaccattctgcgcgccctgtcgcactcgggggctgaactgtttctatcagcagcttcctgaacgccccgccaccaagtacgcttcttcttcgcccactgccttgggggaattggtggtcggaactgattctgtgcagagtagaaaccgaactagccaatgtcaaccggcgcttagactacctcaccatgctgttgtccaaggagtctcaaccgatagcggagccgcaacagccgtcgaccagtgcactggggtcgcatga

SEQ ID NO: 9406 - DNA, 669 bp, A.fumigatus
gtgttcctcgatgctcgtttcatccgtctcaagcacacctttggaaacagactgctacgtaccgccaacatgagttctgccctgggaagccacctcctcgccgacgtcaccaaacgaaaggccgctcgcagcgctcgcgttgccagctgggaccaaagcggactcaacgaagatgcatttgtcgtcctgcccggcgaaaccgctgtgctcgccgatctccagggccctggtgcaattacgcacctgtggtttgtgcaaacctgccgcaagatccttggaccgggcctgatcccgtacaccaagtccggagtggccatgatggagatccataacgcactcggactgaactttgaagtcaatgaccccgactactaccgtaaagtcctcatcaagatgtactgggatgagtccgagagtccgaacgtgctggcgccgattggagacttcttctgcctcggccactcgatggcggcgaacttccagtccctcccgttcaccgtctctgtgaaaccgtcggaggagaagcagtatgggggtgccgcagccttcaactgctacctgaccatgcccttcaacaagcgcgcccggatcgagatcgagaaccaaaacgacgaggcctacatccagtacttctacattgattacgagctctacgcggagccactgtct

SEQ ID NO: 9407 - DNA, 324 bp, A.fumigatus
tactactctgccagctacggagtcatgttaattgacagttcacagccgcaaagacctccaaggcaatccaggccgcggaatgttcccacaacacgcgcacatccagtacgtaccttctccgccctctgttcctacaataacaagcatgcaccctctaataccaaagcagaaccacaaacctttgccgtcttcgtcacggaccaccagtacgactcctcccatggagctccctacggaacctgcaaggcgtacacctgcaccgcgcccactgactcgcaaatgaccgatgtcaacgaggattgctggacgttcttctggaagtga

SEQ ID NO: 9408 - DNA, 864 bp, A.fumigatus
  unsure (145): Identity of nucleotide sequences at the above locations are unknown.
tcaaacaacggggaatacggacggcaacagtacaagggtgaagccagcggcgaaaaatggaccgagaaggattaccccattgccaatgcgtccaggttccacgaagctgccatgatgcagacccatccgtccatggtagcctttntaatgggatccgatttttggcccaacgaccgtgcaaccaagatttacctcgatgcgctgcatcgcatggactggccggtgccgattatcgcgtccgccagcaaacggggataccctaaagttctcggaccgtctggtatgaagatggacggcccgtatgactgggtccccccgaattatttctatggcgatcagctgggtgccgcatttggattcgggtcagaagagggtgctggggtgggaacgcccgagttgaccagtctgcgaaagtttctgtcgccaaaggacttggattccttgtggaagaaccccgatcagaaccagtaccatatgtcgcggtatgactcgtccttctataaccgcgctctgtataacaaagctctctttgcgcggtacggcgccccaggcagcctggaggattatctcctcaaggtgcagatgatggactatgaggccacgcgtgcagaattcgaagcgttctctgtgcgccagaatgcctcccgtccggccaccggagtcatatactggatgttgaatagcgcatggccgaatctgcactggcagctgtttgaatattatttcagttcctgcagggggcatatttcggaaccaagatcggtggaagaatggaacacgtggcgtatgactaacgaggagcgtgcagtttacctgatcaatcgctcccttgagaagaaaggggcctcgcatcgtctctgttga

SEQ ID NO: 9409 - DNA, 276 bp, A.fumigatus
  unsure (247): Identity of nucleotide sequences at the above locations are unknown.
attctcgtggaccatatcattgtattaccatttctgagcagtcgctggctatatgtgcttgttatgcactacggatgcgctccttcaccacacatttatgagattgtgcctttgaaattaattgataaccccggacaaggatatcagactcaagacacagaattgactatcgtttgtaccaacagcgactcttccatggcctctactttaacagtatactttcaatcaccttggcgtgctgcatcanagcctcgtccttcagctttctgccgatga

SEQ ID NO: 9410 - DNA, 597 bp, A.fumigatus
gaagaaaggggcctcgcatcgtctctgttgaccttgttgatcggcatggcaaatgcgctcttcaaccaggaggtcacgattgataccacacctaccgcctccaagagggtcatcccagtcaaggccgttactcagatcaaggacgtcgcattcctccggctggtgctcaagaaccccagtacaggggccatcctcagccgcaatgtatactggttgtccgcgaagaacgatgtcctggactgggagaattcagactggtattacactcccgttacaaagtacgtcgactacaaggcactgatatcgatgccgactgctgctgtgactgcatcgctgaagcggctgcccgccaaagacggcctgtcccaggtgcaggtagtcttgaagaatccttcagccacccctgccgtgttcatgcacctgtcagccatcaacatggacacgcaggaggagatcaccccggtattctggtctgataattatgtgactgtcttcaagggcgagagtgtgaccctgacagcggcattcccgggaggtcgaagtaattgggaggtcattctgtcgggtgcaaatgtgaagagaactctcttgtcgtaa

SEQ ID NO: 9411 - DNA, 192 bp, A.fumigatus
aacatctctacagcatccaaggggtttgttgtgccggagttatttttcagtttcgcctcatttcccaccctttcaattctcatttttccttccctcgcctccccccttggacatcttcccaaccaatttgatattattctccttactttggcctggctttggaagtcaacctacagccttcagcccctctga

SEQ ID NO: 9412 - DNA, 561 bp, A.fumigatus
agaggttccttaacgaggtcgatgcagagccttctccgacggataactacggtcagctcaagcgaagacggcgaaattgcggtgctagaggccacaaaggataccgggttagggattgttctccgtgtgccactgctgtatggtactgctcagaataactccgagagcgctgtgaacattctgatcgatgcgatctggaaggcccaggatgagaacgcgggagtgaagatggacgactgggcgcagcgctacccgacaaacaccgaggatgtagctcgtgtgtgccgtgacattgtcatcaaatatgtcaaagaacggccacggattcatgaactgcccaaggtcctgcatttctcgtctgaagatcggatgaccaagtacgaaatgtgcgagaagcttgcggaggtgctgggtctttccctggcagggatgatcaggaacaagcaagggaatgatccaaacgcatctgtacagaggccttatgatactcacctctcaaccaaggtactgaaggatttgggcattgatgttcagacaactgactttgtcgcatggtggtaa

SEQ ID NO: 9413 - DNA, 438 bp, A.fumigatus
cgggagcagggcgactttccgcatcctattatcgtggatgaatcgtcctggacgctggagacgacgtcccagcctcccggaaaggaggtctcggttcatctggacaaggtcaataagatggaatggtgggctcacgttgtgacgacggcgccgaagattgatgtgagcaaaatcacgccggagaactcgagtttgagtgatttggatggcgagacgagggccatggtcgagaaaatgatgtacgatcagcggcagaaggagatgggcgggttgactagcgacgagcagcggaagatggacattctgaagaagttccaggctgaacatccaggtatgttgtcgtcgagactcggtgtggtctacgggctaatgtcttgcagagatggacttctcgaatgcaaagattggttaaggtggtgcgggtctactgcttgttga

SEQ ID NO: 9414 - DNA, 441 bp, A.fumigatus
  unsure (316): Identity of nucleotide sequences at the above locations are unknown.
caaactcaaacaccccttctcatgcacaccatcatagcggtggcaacctcccatcttcgttatgttgtgcctgacaacaccgcttacaaaatggccgaagcgtaccactggcagcaggctatcagccagtattccaaggagctcggttgcgctgtcggtccccacaacatggacgcactcttctccacatgtctcctcatgacggtccacgcgttccaactggaagaatacaacccccgcaagtcctttgtcttctccaacgatccacaaaccctgagctggctcactttacagggcggtttgccgcacctcctgngggcttaccaaaacctggctgtgcatcagcatgtggtgggacgtcttcatggcgactcgacaggagagtcgaactttcgaggatcccccacccggacgggagggtctccacccggagctggctga

SEQ ID NO: 9415 - DNA, 246 bp, A.fumigatus
  unsure (80),(81): Identity of nucleotide sequences at the above locations are unknown.
acctcaattgctgcgactgttagcaccggcttttttgctgaatatcttttttctgacgatagtgcttacgcgacggctgnnctggcttcctctaacatgaatcgggcgatcatctgtggcattcccatcaagggtatggcttgtaacgagagccatgccccggtcgatatgtgtaagagtgaatacctgagttcaggacaagaatcagccaccaaaattgtgaacagtataataacgcaatcctaa

SEQ ID NO: 9416 - DNA, 375 bp, A.fumigatus
agtcttgtcagagtctgcgccatgctttctatcaaacgcactttgctgctccttggagctgtcctgccagccgtctttggcgcgcctgtccacgaaactcgtcgtgctgctcagaagattcctggcaagtacatcgtgaccttcaagccgggcaccgatacagctaccattgagtctcacactctttgggccactgatcttcacaaacgcaatctggagcgtcgtgataccactagcggcgaacctcccgtcggtatcgagaagagctaccagatcaaggatttcgccgcctacgctggctccttcgatgacgcccccatcgatgaaatccgcaagagcgcagacgtcagtactcttcagaaccccagcacataa

SEQ ID NO: 9417 - DNA, 465 bp, A.fumigatus
gcactatcgtcagaaaaaagatattcagcaaaaaagccggtgctaacagtcgcagcaattgaggtctactttgctcgttgccttggcttcagtctgctcacgatcgccaccttgaccatcatgctgacgggttccatccctctcagctcagcggtttcagaaacggtctcaaccgaggattccgaccctaaggctccgtatgccgttccgacattggtagtgacgtccatctaccatgccatttcggccttttatgcgtacacctggtataccaccaccgaccaaggggtcttcgcggtggccatggtgggatactttgccgtcgggtcccttgggttgtggtgtacactttttgcaagcagccaagggaagatcagtcgcaagacgggagctgacaagagaactacgggttacccatttggcaacagagtggcggagaggaagcatgtcgagaagagtgactaa

SEQ ID NO: 9418 - DNA, 324 bp, A.fumigatus
cgagcgggcgacatttccagagaaagaaacagtatttacgcgttgtacagggcatcaataccaaggttatctgccacaagccagcatggctgcctgtccgattggcgtctaccgggcctccagtctaatgcaaacgttattacgatctgcaggcccgttaaacatggcatcatgtattttttcccctcttgccaatctcatgcgactaagtcccgtctagggggaccctggctggccgccatcaggctagtcaatatccttgtctcgaatgcgtgcagaaatgccaagaagaaatcgcatgaggttgccaagtaccctgtttag

SEQ ID NO: 9419 - DNA, 507 bp, A.fumigatus
  unsure (14),(21): Identity of nucleotide sequences at the above locations are unknown.
ctccggcccttttncgggccnacgctttccgcggatccttcgtccgcccgtggtgaagacttagccaaggatccaacagcctcccgtgttcttcagcaagccctaactgctccaacttcgacatctcagttccggcgacagtttactacgcgcttctcgggccacctggtagaactcgcgcttgatagcagtggatcccacgttgtggacgcgctatggccggcaacgaaagacctgttcttcgtgaaagaaagaatggcacaggaattgctcaacgaagaactgagtctccgggactctttcgttggcagagcagtatggaggaattggtccatggacctctacaagagacggcgaggggagtgggcttcaaaggcgaaaggcctggacagtattgaaaacggccaacgcgagcggcctaagtctcgcattgacttagcccgggctaaatttgcagcaaaggcggcggaagagagttctaaggcgccggtagctgcaaagacttga

SEQ ID NO: 9420 - DNA, 831 bp, A.fumigatus
cttctgggtgcagtcgaagatctcctcatcccattcatccagtccgccgacgaaaatcctcttggccttgcgctccagcaaaatggggtcaatggaacgaatgatacgaatggtacgaatggacacctgaaaagtccacggacagctttagtcgattacaaaaatcctgaagagcttcgggatattctgcaattatctctaccggagaagggtaccagacaagagggcttgattgaggttcttcgcaaagtgttgaagtattccgtgaatacatggcatcagggatttctcgacaaactatatgcctcaacgaatgctcccggtgtggcatccgagctgattttggcggctctcaacacgaacgtgcatgtctaccaggtctcgccggctttgactattatcgaaaagtttacaggagaaaagttggcttctctatttgggctcaacggaccacgagcagggggaatttctgtacaagggggctcagcatccaacaccacctcgattgtcattgcgcgcaacaacctataccccgatacaaagaaaaatggcaatggggactacaagtttgtggtcttcaccagcgaccacggccactacagcatcgagaaggcggcacagatgctgggtttgggaagcagctccgtctgggtagtgcccgtggacaagcaaggtcgcatgatcccggaagaactcgagaagctggttcgaaaagctctccaggagaacaggacaccgttctatgttaatgcaactgccggaacgacggtaatgggctcctttgaccccttcaatgagatcgctgccatctgccagaaatacaacctctgg

SEQ ID NO: 9421 - DNA, 420 bp, A.fumigatus
ggtcgtgaaacctccgttcttgcgcgtttgtcgagtcgcatagtcccgagagccagtggcttatctttagcgatacgtttttaccaacctctgctctactaccaagccatggcagatctcttcggcgagaacttcctaagcataacctcttcttcctcccagttacggcctacaacgacagaccatgacgcaccaccagcatccactggccatggcgacgcggataatctccatcttcctcgtaccaagcgcatcgcatgtgttgtatgtcggcgacggaagctgagatgcgatggaaagaggccgagctgcgggacttgctcccgattaggtcatgaatgtgcttacgatgaggttcgcaaaaagagtggtccaaagcggggttatgtgaagcagctggaagctcggcttggtacgtga

SEQ ID NO: 9422 - DNA, 279 bp, A.fumigatus
tactatcatggtggccgcgatggtatgcatgtctccatgctctgcaagaacttccgactcattccctcgcaggccttgaacatcttgttcgccttatgcggtataacaggctccctgtatggaatgggccgcaaattggagcatgtggaacagttctcgacagccctatttgtatgtcttctcaaaccaccttcactcagtcctgtgcgccactcggtttatattgcttacgctcgtgtgtttcatagtggtggtggctcggtcagacaagctacgtag

SEQ ID NO: 9423 - DNA, 375 bp, A.fumigatus
ccaatgcttagggcgaaactcgtggacgatccccaaatcaaatatgcgtcattgcataaccctctccctactcaacttcatgcctatgtgtggcctttcctgatcatctggcctgccttcttcgccgtctacctctcccctgagcgctacgatacatacattcaagggcaagaatggacattcgtctggtctggatcgatcatcacggcgcagtccctcctttggttgatgacaaaatggaacatcaacatccaaaccctgttcaccgcgaacaaaggccgatccctcaactctgcccaactcaataaaattataccgggttgcaacgcttgctccgctgaaaatttgcccttgcattgcgaaaaaattggttga

SEQ ID NO: 9424 - DNA, 204 bp, A.fumigatus
acggtatttgaaatcaagtacaaaggcatgggctctgcttatatgcaaatttatctgatgcacctagcgcaacatgagccttgtgcaacactctaccttgcccctgatagcctgctgcgcactgacgggtggcgtagtgacaattttccgtatcagacaatgctaacaattacaaaggcatctgcctccctccctacaagctag

SEQ ID NO: 9425 - DNA, 984 bp, A.fumigatus
aattgcgctaactcttgcagcaatggcaatctgagagcgcttccgtcgggcttgctccgtcctcttcaataccttaccaagttgccctcagtcagagagcctccaatatcggaagagggctacagctccttgaaaccgtttctgcggttgttcctggctggcaatgcgcttactgcggtttcgggagaaatattcgaactcgactcgctcagagttctcagcttgcggaacaacaagctgacggagattcctcctgctataagaaagctgacaatgctacaagagatcaatcttgcagtcaatcgcctgcggtgtcttccttgggagttactatggttaatcaggaagggtgacctgaaacatctgatggtccgacccaacccccttcttcagaccaatgatgtagaagttacaaggtggtacacgcccgatggcagcgatgcagcatcaccggaggaggcgttgaaagcgtgccattatgaaggacccccacctgaggaagcatgggccccaattcaagtggcgatcagccccatccgacgattcaacatggaaggtattcccataacggatggccaaagcggcgccttaccgttgagatcatcggacgataccccgtcccatgtaccctcgttgcgtgaggtatccctcctggctttcagcaaatctgcctattgcgaccagatatccgagtccgaaatgatcggctatccagaattaatggttcgcctccttcgacaggctaagggtgttagaaatgccggtggtagaagctgctcgatatgtcaccggagcttcgtaattcctcgcaccgaatggattgagtggtgggactgcagcacctacgaaaacgggctcaagagacctcggtgtcctggggagcaactacgcccattgccatttcgaaggtttggttgcagttgggcatgcgttcccgaagccgaagagtcaatgctccaagcggaaactggccaacaaggctaa

SEQ ID NO: 9426 - DNA, 201 bp, A.fumigatus
agaggacggagcaagcccgacggaagcgctctcagattgccattgctgcaagagttagcgcaatttcacattactcaaacagaaattttctcacctcaagtcgacgctatcctgccctttttcaagacagtcattgacaatcgtcctagcgagctgatgttccctcggctcctccaccttcctgggaccccgcggctgtga

SEQ ID NO: 9427 - DNA, 525 bp, A.fumigatus
cccttcctcacacttgttttcattacatctatttgttttacttccgcaaaagtaggagctgactttgatcactggaagatcggacttgaacatggccgaatcctatcacagcagatccaggaccaaatcaaagtctatgaggccatgttcctggaggcctccaagatgtcctgggatgctgtcagaaacctcgccgaggaatttcgtgaatcactagagaagaaactgcctgacgtctacgcggagatgcagggtatagcagagggagcggggttggatcttctcgacattgtggcgctgaactgtcgcagtgagattgccatgggcaatttttccgatggctgcacaagtctatcctggaagaaacatgacaatggacgagtcctggctcagaactgggactgggctcccgctgcggggaagaatatcgccatcatgtcagtcgaacagcccggcaaacccaaagtctttatggttaccgaggttagtctactctcgcagtttgtattggacaatacggactaa

SEQ ID NO: 9428 - DNA, 714 bp, A.fumigatus
tctactctcgcagtttgtattggacaatacggactaacactaatcataacaacacaggctggaattgttggaaagatcggattcaacagcgcaggtgtaggcgtttgtctcaacgccattcgggcgaaaccctgcatcagttccaagatccccatccatgtggctctccgcctctgtcttgagagcccatctgcccagatggcggtcgaaagggtctctgagctaggaggtatagcttgcagtgtgcatatcctacttgcagacagcacaaccgcattgggacttgaactctcgccattgggagatgtgtatctcaaggaagatgtgctgggaactgtcactcacactaaccacttcatcgagaatcggaacgtcattgagcccccatggctctccggctctccgattcggttgaatcgagtccgtcagctccttcgtgagctgatcagtggcggaatcgctgggtctcagatcaccccgggtctcttgcgagacaagatcttttcggatacttccaatgcgccgcaggctatctgttgctcagaggatcctgcccggggtcctgctgtgcgatctacaaccatcttcaacatcattatgaatctggagcaagacaatgtcagcgcggaacttgtcgtgggccgaccaggttctggggaggagactgccgtgatacgaatgccttgggcatatcgacctcggattgtggtttaa

SEQ ID NO: 9429 - DNA, 222 bp, A.fumigatus
tttttaagcccttccggccggattgacccctccacttccgtctcctatacactaaatcaaaacatcacattcccgtcgaccatggccagtaaggaaggggccgcaggaccggcctttggccccgtcctcgcagcagtcgctacaatgcaaggaaacgtttcacgaagtgagaagacacaggctcacgagttccttgagaaattccagaagtccgtgagttga

SEQ ID NO: 9430 - DNA, 423 bp, A.fumigatus
caacgacactgtcgaatagcgcccactcagtttcagtgccagctacgttcatttaacaatttcccacgccacgtgtcaatcatgtccggtcgagcaggtggtggaggcgctcgcaagacattgcttgcgccaattcacttcattttcaagcttctgcagcaacgaacgactgtttctatttggctctacgagcagttggcgtttaggatagagggcaaaattagggtaccattcattcctttccttgcaacacgttatcaagctaacaacatgcgccagggattcgatgagttcatgaacctggtcattgatgatgcagtggaagtgaaaatggctacaaagactgatgaggagaagcggagaccccttggtatgatctattatcactgtatatttgatatcgcaagtgagtgctattactaa

SEQ ID NO: 9431 - DNA, 405 bp, A.fumigatus
ttgaatccaaccgccacaattgctgattcggtaggtcccttcgaactggccaagaacgttgtgcagacatccgtcttggtcgctcaccgttcccaggcgtctcccgatgcggtgcgggacccatctctgcgcaccagaccacgcctcggcaccatcgaggcgatcaggcagattgttcgccggtatgggtttcgcggcctgtacacgggtttccatctccatgcgatgcgcgacacaattggatccggcttgtattttagcgtctatgaaactgtcaagcagctggcggcaaaggaattggggccggacaagtctccttttggaggtccgatgattgccggtgccatctgtagcaccgtgccttggttttgcgtaaggcactttttctctaatgaaacggtctaa

SEQ ID NO: 9432 - DNA, 273 bp, A.fumigatus
gttgctaatctttgccagacctatccacttgatactcgcaagacccgagcccagagcgtgctacttggcaagtccaaggaggtgggcgaagcatcagcggccgtctccaagtcgagtatgtataaaggcctatcggtcattcttattcgtacaggagtcaacaatatgattctcctgagtatgttcgagtacattaagatgcggatcaaccagttggaaggcttagcgggaattgcatggttgatttttcttgcaaacaacggagctggtctt

SEQ ID NO: 9433 - DNA, 291 bp, A.fumigatus
gttgacattgcacttgaattctacgcaatcgacgggtctaatattcaaaatacaggagctctccctcctctggcaagtgtgaccgcggtccgtgtcgtgaatttctccacgtacaacgtcgccaaacaccgcatctccgagtttgtcgagagaattactggcgagtctcctctggcaacctacaacacgccaggcagcagtcccactgtgtccactcttttcaccttcactaccgcgggcttcattgcaggcctgatcacctctccgctcgcatgtaagtttcgtaattga

SEQ ID NO: 9434 - DNA, 1131 bp, A.fumigatus
ggaacttcgctgctctactacctcttcaaaggacaagcctcgttgcaggccaacctgcgtcagctgaaaatgacgtcctcaaatatgtcaatccgctcattggctccaccaacggcggtaacgtcttcgcaggtgcaagtcttccctacggcctggccaaagccgtcgccgacgtcgacggccagaacaccgacggctttgcgacagatggcagccgtgtcattggtttctcgagcatgcacgactccggcacggggggtaatccctcgctgggcaatttccccctcttcccgcagtactgtccggacgatgtgctggataactgccgttttccgaaagctgcgcggggcgtgcactatgtcaacgagtcggttgttgcgcggcccggggtactttgccctcgcgctggagaatgggatccaggctaagatgacggtgtcggagcatgcggcgctgtaccggtttacctttccgccgtccacggcgcaggacggatcggagctcagtcctctgattctggttgatttgacgaacgcctgggatagtcggcaaaatgcgtccatcatggttgatgccgagaatggtcggatcacggccaatgggacgttcttgcctagctttggagccgggtcgtacgtctcgtatttttgtgccgatttcggtagtggagcggtgaaggatagtgggatctgggtgaacgatcgcgcggggaccgagcctcaggagctgtttgtgacgcgcgggtttaatctgttctatctgcaggctggtggctttatgagattcaaacggcccgaggatgggacggttactgtgcgggtcggggtgagctttatcagctccgagaaggcgtgcaagaatgcagagattgagattccgcatcctgaagatgacttcgttactctgaggcagcgggctgagagtgcgtggcgggagaaactcagccctgtctctgtacagacgggaggcgtcaccgacgactttctcgagagcttctggagcggcgtgtaccggactatgctgtctcctcaggacttgacgggcgagaatccgctctggcgcagtgatgagccctactatgattccttctactggtatgtatcgcgggatgatatggtatttcatcgctag

SEQ ID NO: 9435 - DNA, 402 bp, A.fumigatus
ctgatgattggcagtatctgggattcctttcgagcccagcacccgtttctcaccatcatcgatcctgtctcacagtcgcggatggtacgcagcctcctcgatacctacaggcatgaaggctggttaccagactgtcgtatgagtctttgcaagggctggacgcaaggggggtccaacgctgatgtcgtcctggcagacgcttttgtcaagaaccttaccgggatcgattgggacctcgcgtatgaagccatggtcaacgatgcggagaacgagcccttagaatggtcgtacgaaggtcggggtggcctgcagagctggaagcgcctgaactacattccttacctggactttgattacctggggttcgggaccaattcccgcagcatctcacgcaccctgtag

SEQ ID NO: 9436 - DNA, 735 bp, A.fumigatus
tattcctacaacgacttcagcctggccaccgttggacgaggtttgcgcaagcgtgactataccaagtatctctctcgggcgaacaactggcagaatctctacaagccagaccagcagtccctgatcaacggcaccgacacgggtttcgttggcttcttccaaccaaagtatctcaacggaacctggggctaccaagaccccatcgcctgcagtgccctggcctcatggtgctcactaacatccaatccctccgagacctttgagtccagcgtctgggaataccaattgtacgttaccccctcccagaccgaagccaccgttaacaaggaaccgcagttacgttcctcacgacatggccaccctaatccacctcctcggcgggccggacaccttcatctcccgcctcgacttcttccacacctccggcctagcagacatcggcaacgagcctgtcttcctaaccgtcttccaataccactacgccggccggccggccctctccgccgcgcgtgctcacacctacatcccctccgccttcaacgcctccacagccggcctccccggcaacgacgactcgggcgccatgggcgccttcaccgtcttcacgatgatgggcctcttccccaacccagggcagaacgtgtaccttatcatccccccgttcttcgaagccgtgagtatcactcaccccgtgacaaacaagaccgcaacgatccggaatgtcaatttcgatag

SEQ ID NO: 9437 - DNA, 690 bp, A.fumigatus
catccaatccctccgagacctttgagtccagcgtctgggaataccaattgtacgttaccccctcccagaccgaagccaccgttaacaaggaaccgcagttacgttcctcacgacatggccaccctaatccacctcctcggcgggccggacaccttcatctcccgcctcgacttcttccacacctccggcctagcagacatcggcaacgagcctgtcttcctaaccgtcttccaataccactacgccggccggccggccctctccgccgcgcgtgctcacacctacatcccctccgccttcaacgcctccacagccggcctccccggcaacgacgactcgggcgccatgggcgccttcaccgtcttcacgatgatgggcctcttccccaacccagggcagaacgtgtaccttatcatccccccgttcttcgaagccgtgagtatcactcaccccgtgacaaacaagaccgcaacgatccggaatgtcaatttcgatagctcctaccggaggatatatatccagagcgcgaggctgaatggcgagccgtataccaagaattggatcggtcatgaatttttcacggaggggtggacgcttgagttgacgctgggcgaggaggagagtgattgggggactggggtgggtgacctgccgccgagtttgggggagagtatgcatctatggacctag

SEQ ID NO: 9438 - DNA, 1239 bp, A.fumigatus
ctttcagcacgtagggcatacgatgtcgtcgttattggaggaggccacgctggttccgaggcctctgcagctgccgctcgatctggcgcacgcaccgcattggttacgccctcgctttcgaacattggcgtttgttcatgcaatccgagttttggaggaatcgggaaaggaacaatgatccgcgaaatcgatgccatggatggtgtggcagggcgaatcattgacaaggccggtatcatgtttcgcattctcaatcgatccaagggacctgctgtatggggtccgcgcgctcagattgatcgggatctctataagaggtacatgcaggaggagcttctcgctaccgaagggctgagtatagtggaaggcaaggtcgcagatatcgtggtgtcaaaagagggtgtggagaacatcccgggatcgcagggcaagattgtcggagtacggctcgaatccggagaggtgatacctactgggcgtgtcgtcatcacaactggaacgttcctgggtggagaaatacacattggacttgaagcgtacccttcggggcgtatgggtgaagcggctacgtttgggctcagcaaatcccttcgcgaagcaggttttcagcttggtcgtctgaagaccgggactcctcctcgtttggatatgaaaacgatcgactttgcgccattggaggttcagagaggtgactcgcctccgcagcccttttcgtatcttaacacgacggtcgatgttggtgatgaaggtcagcttacatgctggatgacccacaccaacgaggcttcacacgagatagttcgcgcaaatcttgacaaatcgattcatattcgcgagactgtccgagggccacgctactgcccctcgttggaatcgaagatcatacgttttacggataagaaacagcatcagatctggctcgaaccggaaggatgcgcaccgaatgaggtcatctacccgaacggtatctccatgaccattccggcagacgcacaatatgccctactacgcacggtccgcggccttgagaacgtgcgcatgctacagtctggctacggcgtggagtacgactacatcgatccccgcaatctccggccgacgctggagaccaagctgatcagtggcctgttacttgcggggcatatctatggaacacccggatatgaagaatctgcaggaaccgagatcattgccggcacgaaacccccgtctgttctgcctcccaaaaaggggggggcc

SEQ ID NO: 9439 - DNA, 207 bp, A.fumigatus
tttgcgcgatcactaggtgcggggctgttttttcatgccccgcaggcctttacatcggttttctatctcttatatcttcgcgctgataggataaaggaatactctgttaagtttattgacctgttgcctcctatccgaacgcaaaacatactctgttggcggtcctgcagagaagaagcatcccaccatgaaggcttattggtatga

SEQ ID NO: 9440 - DNA, 294 bp, A.fumigatus
gcgcgcggaccccatacagcaggtcccttggatcgattgagaatgcgaaacatgataccggccttgtcaatgattcgccctgccacaccatccatggcatcgatttcgcggatcattgttcctttcccgattcctccaaaactcggattgcatgaacaaacgccaatgttcgaaagcgagggcgtaaccaatgcggtgcgtgcgccagatcgagcggcagctgcagaggcctcggaaccagcgtggcctcctccaataacgacgacatcgtatgccctacgtgctgaaagttag

SEQ ID NO: 9441 - DNA, 408 bp, A.fumigatus
ggtgaccagcgggaaccccatgactccggccgcccggtgacggtggactatctcgcctccattggagtccagtactaccatttcccctccctcgagtctgttaatgaattggccaaggaacgtgggtacaagaatcgtgatgagattgtagtttcgccacaggcgatgggtgatgtgtacgaggagaaagtgaagatgttcttcaatgagcatctgcacgaagacgaggagatccgctacatccgtgatggcgagggttactttgacgtgcgtggtcaggaggacgaatgggttcggatcaagttggcgaaggatgacttgatcatccttcccgctggtatctaccatcgtttcaccaccgatgacaagaatgtcggtttccatgagcttatccagtcaaccctttga

SEQ ID NO: 9442 - DNA, 234 bp, A.fumigatus
gaaggtcggtgcgagatcacagaccacctattctccttggtacggaaaccaaatatttgcggcgatgcagtacgtatgggccaggatggaactaccctgagtgagcaaaagtaccaccatcacgaggacctagtcccactaccaaccagctccactctattcatgcagcctacttactgtacatgggatgacaacctgtatgggatccactctgtagattttgtttcattgtga

SEQ ID NO: 9443 - DNA, 216 bp, A.fumigatus
ccaaggactccattacagtgtcactgtcaggaaatgaagcgtttgctgcctgtctacctgcctaatcgcctccccatcgcaccctatcaacgcacctcgaagacatgcctcatcagtcgtcaccgactttttctcgttggctctaagcgacccaacaatatccattattccggtagcgtgggagagaacagcagggacagcaaggcaaaggactag

SEQ ID NO: 9444 - DNA, 567 bp, A.fumigatus
cttctgtatgtccaaagcaaacccccttcgcagtccgaatctgtggaaagccccgagaaaggaagaaatagatggattcaggctgactgttgcgctcaggaaatgattgctgatctcaaagcggactccgctcgctgggaagcagatgtcatgcgtcgggctgaccaaggctatccaagaggtagttacattcacgactacaacgttcgtcaagcccctaacgtggtcccagcgccttacgcagcttcttctattcatgaagtgcgccaccaaggaagcccgtcaccaccacaaccacctagtcaaccctatgtggatccgtacactcaggccccgtacggtgcaacccagagccccccatacacagctccatcatcatatccttcaagtcattcgccttttgcggcaggacagaatccttaccctccgcaagtcccttactctgctccaggccaacccccagtgtctgccgacatgcacccatcatacacctacacgaacaacactgggtacccctatgagaacgggagaagtaatgctccacgctacacaggacctggctacgac

SEQ ID NO: 9445 - DNA, 408 bp, A.fumigatus
tactcaagcttaggcttgcgacttacgatcagcctacacacgcagcttgtcgccatgatgatgcctttcttgcaggtcatgacattcattctccccggtgccattgcgaccacagctgcaacatctatacctgccaccctcaacatcacggtcgtcggcgcccgaaacaaccagtcaatcctggagtgctggtcactagaaccgggtttcgagtcatcaactcaaccaggcattgcaggcagcgcttcgctctccctaggacctgtaggaggcaacgcgacttacactattgttcctgctcaattcgatggcgggatacacaatgctcccgtgagacagtatgtatcacttccagtctatcctactcatgtcgtccacaaaaacaatgtaggagcggaacgttgctga

SEQ ID NO: 9446 - DNA, 483 bp, A.fumigatus
atggtttcacggacaatggtaagatcacctgtatggaagcatgattcgagcatcccgttgtcgttcgtcttgagcgactgcgtaaggaccgtagataacgtgacgccagaggtgatctgctgcaccgctgcgctgggtttcccagggacgagggatccgatacgaacgtcgtcttcaagctcggcttccacatcgatttcttccgaagcattagcccgcaaaagctcgccaaaagacggctctcccgtttcgtcttcttccacatcctcttcgactccggcttctgatcgcatttcaatgtcactatccgcatccttcttctgcttccgctgccgagtttccttcttctcaaccggcttctttgcatcatcgtcgccgtcctccgaatcctcctcactgtcagctactgttgtgtctgccctcgtgtcctgcatctcgacatcagtctaccggcagcggctggaaagtacacgtcgggggcac

SEQ ID NO: 9447 - DNA, 204 bp, A.fumigatus
tcgtctgcatatgagactcgtagagttgtcaactatcttatcatgacttcctcagccaatacgactgatctacacgattggaacgataaatatctgacagatccattcccaggcatcgaaacgaaccagccctcagaaattaacctccgtcgctttgcaagcaccctgatacaacactcgatgcgctggttcctcatcccctaa

SEQ ID NO: 9448 - DNA, 1209 bp, A.fumigatus
actgatgtcgagatgcaggacacgagggcagacacaacagtagctgacagtgaggaggattcggaggacggcgacgatgatgcaaagaagccggttgagaagaaggaaactcggcagcggaagcagaagaaggatgcggatagtgacattgaaatgcgatcagaagccggagtcgaagaggatgtggaagaagacgaaacgggagagccgtcttttggcgagcttttgcgggctaatgcttcggaagaaatcgatgtggaagccgagcttgaagacgacgttcgtatcggatccctcgtccctgggaaacccagcgcagcggtgcagcagatcacctctggcgtcacgttatctacggtccttacgcagtcgctcaagacgaacgacaacgggatgctcgaatcatgcttccatacaggtgatcttaccattgtccgtgaaaccattcaacgtctcgactcgtcgctagccgccactctgctccagaagctggccgagcgtctctcatctcgcccgggccggtacggacaccttctcgtgtgggtacagtggacatgtgttgctcatggcggcgctctcgccggcaagccagaactgttaaagcggatgtctaccttgttcaaggttatggaccagcgctcgtcgagtctgtcttccttgctgttgctcaagggcaaactcgacatgttgcatgcacagctgggacttagacagtccctccgcagcggagccgaaggcatggacagcgaggacgaggacaacgtcatttacgtagaaggccaggaggagttggaggatgaggatagcgatgccgacaccgcgaagaacgcagtaacgccgcggaccaagtcaatacgtgatcagacatacgatgaggacgagtccatgattgacggtgaccagtccggccgagacgagtctgacgatgaagaagatgacggcagcgacgaggaggaagagaacgaggaagacgtgttcgatgttgaggcggaagagtctgttggttcttctgatgccgaggaatctttggacgacgaggacgacgaggaagacgatgatgcagaaagtgcaggctcgatggcagacttcatcgccgacaccgaagatgacgagtcggatgaagatgcactctctgcgcaacctccgccgtccaaaaaagccaagtttggcggtagtggaggaaaagagaagaagtcgggaaggagatag

SEQ ID NO: 9449 - DNA, 960 bp, A.fumigatus
aggaagggtgggaatacgatccttggtgaagctggagccgctggggaggtggccacagccggtgagccatccgatgaggataatttcaatgttggaatcgatttcgatgccggcggcaccaccaagaatagcagccagctgggcacgagcgtcaagagacagggaggccatgctctcgccggagatcaggatcgaaataacgccacggaaaacagagccgagagttgcctcgagagtgccagtaatgaaggaggtaagatcgccaaggagacctgtggacacgctgacggagacatcggcctcgagagcgaacgaaagccagaagagaacaatagccttgagctcagcgccgagcgagcagctggagctggtgagccaggcgacgagagcggtacgaacttcaacatcaagggaaacggcggcaccgcccttggcgcaggcctcgagggcggcctgaacgtgggcgtcgagaccggcggaaatgccggcttcgaggaaggcggcgagagaagcctgagcgctggcggagaggatgccagtctcctcaaccagggcgacgacggaagcaccggcagagatcgttgccagaccattgctgggcagagacccaatggcgatgacgtcggcaccaaccttaccctccaaccaagccaacacggcaaccttcagagaagcggacagggtgcattcggaactggcgagccaggctttcagggcggcctgcacatcggcggcgaggtcgacgaagacaccgccgccagcacaaaggctgagaccagccctaaccttggcatcgagagcagtctcaacagacgccgagaggaatgcggacagagaagcctgggcggaagcgctcaggacaacatttgcggcgacctcggcggaggagaagataccctcaatggtaacaaaaaggtcgcccttggcggcgatgtcagcgcaagtggggatcagcactga

SEQ ID NO: 9450 - DNA, 915 bp, A.fumigatus
tactcgcaggcggaaacaatgacggtcttggtgacggtgatcaccttgggacccttagaaggcaccgcggtaggggcagcggtgatggtcgcagcaccgttagtaacggccccggtcttggtagcaatggggacaacagtctcagaaaccaaagtctcgcaaggcgtctcggcggcgtcagggccagcaggagaatcaccggagggagcagggactgcctcggaaacaatggggggaacattgccgtttgatgctccgctaggggaggcaccagaaggaacggagccgctggggacgctgggggcaggaacgttggcggcatcagagggggaagcaccgctggggacggggacgggcacgttagggacggagccggagggaacggagccgctggggatgccggaaggagtgggcacagagacagaaggaacaccggtggcagagccggtgggagttgaaggaagggtgggaatacgatccttggtgaagctggagccgctggggaggtggccacagccggtgagccatccgatgaggataatttcaatgttggaatcgatttcgatgccggcggcaccaccaagaatagcagccagctgggcacgagcgtcaagagacagggaggccatgctctcgccggagatcaggatcgaaataacgccacggaaaacagagccgagagttgcctcgagagtgccagtaatgaaggaggtaagatcgccaaggagacctgtggacacgctgacggagacatcggcctcgagagcgaacgaaagccagaagagaacaatagccttgagctcagcgccgagcgagcagctggagctggtgagccaggcgacgagagcggtacgaacttcaacatcaagggaaacggcggcaccgcccttggcgcaggcctcgagggcggcctga

SEQ ID NO: 9451 - DNA, 588 bp, A.fumigatus
gcgctggcggagaggatgccagtctcctcaaccagggcgacgacggaagcaccggcagagatcgttgccagaccattgctgggcagagacccaatggcgatgacgtcggcaccaaccttaccctccaaccaagccaacacggcaaccttcagagaagcggacagggtgcattcggaactggcgagccaggctttcagggcggcctgcacatcggcggcgaggtcgacgaagacaccgccgccagcacaaaggctgagaccagccctaaccttggcatcgagagcagtctcaacagacgccgagaggaatgcggacagagaagcctgggcggaagcgctcaggacaacatttgcggcgacctcggcggaggagaagataccctcaatggtaacaaaaaggtcgcccttggcggcgatgtcagcgcaagtggggatcagcactgacagtccggcgcagacatcggcggaaagggtgacggaggcgtcaccttcacaccactcgagaagggaagccttgatggatgcatcgaggaaggcggcggcctcagcacgaagccaggcggccagttcagctctggcggcggcatga

SEQ ID NO: 9452 - DNA, 1893 bp, A.fumigatus
tacctaccgagacactcgtttaacatctcttattgcgctcctacaatgcgttccaacaagcttttcctgctcgccagtctggtgagctacgtcctcgctcttcccaccgacgtggagacccgccacctgaagctgggtgcagacctcgatatcggtgatctctccattggcgcggggatttcgatcgatggcggtctcgatttgagcgcgctcatcaacgccatccttggtggccatgcaagcaccacgaccctccttgctggtctgagtgctcaggcagccgctgccctgcagggaggcgtacttggttgcaaggccggtgcgattcatgccgccgccagagctgaactggccgcctggcttcgtgctgaggccgccgccttcctcgatgcatccatcaaggcttcccttctcgagtggtgtgaaggtgacgcctccgtcaccctttccgccgatgtctgcgccggactgtcagtgctgatccccacttgcgctgacatcgccgccaagggcgacctttttgttaccattgagggtatcttctcctccgccgaggtcgccgcaaatgttgtcctgagcgcttccgcccaggcttctctgtccgcattcctctcggcgtctgttgagactgctctcgatgccaaggttagggctggtctcagcctttgtgctggcggcggtgtcttcgtcgacctcgccgccgatgtgcaggccgccctgaaagcctggctcgccagttccgaatgcaccctgtccgcttctctgaaggttgccgtgttggcttggttggagggtaaggttggtgccgacgtcatcgccattgggtctctgcccagcaatggtctggcaacgatctctgccggtgcttccgtcgtcgccctggttgaggagactggcatcctctccgccagcgctcaggcttctctcgccgccttcctcgaagccggcatttccgccggtctcgacgcccacgttcaggccgccctcgaggcctgcgccaagggcggtgccgccgtttcccttgatgttgaagttcgtaccgctctcgtcgcctggctcaccagctccagctgctcgctcggcgctgagctcaaggctattgttctcttctggctttcgttcgctctcgaggccgatgtctccgtcagcgtgtccacaggtctccttggcgatcttacctccttcattactggcactctcgaggcaactctcggctctgttttccgtggcgttatttcgatcctgatctccggcgagagcatggcctccctgtctcttgacgctcgtgcccagctggctgctattcttggtggtgccgccggcatcgaaatcgattccaacattgaaattatcctcatcggatggctcaccggctgtggccacctccccagcggctccagcttcaccaaggatcgtattcccacccttccttcaactcccaccggctctgccaccggtgttccttctgtctctgtgcccactccttccggcatccccagcggctccgttccctccggctccgtccctaacgtgcccgtccccgtccccagcggtgcttccccctctgatgccgccaacgttcctgcccccagcgtccccagcggctccgttccttctggtgcctcccctagcggagcatcaaacggcaatgttccccccattgtttccgaggcagtccctgctccctccggtgattctcctgctggccctgacgccgccgagacgccttgcgagactttggtttctgagactgttgtccccattgctaccaagaccggggccgttactaacggtgctgcgaccatcaccgctgcccctaccgcggtgccttctaagggtcccaaggtgatcaccgtcaccaagaccgtcattgtttccgcctgcgagtactag

SEQ ID NO: 9453 - DNA, 213 bp, A.fumigatus
gtgctcaggcagccgctgccctgcagggaggcgtacttggttgcaaggccggtgcgattcatgccgccgccagagctgaactggccgcctggcttcgtgctgaggccgccgccttcctcgatgcatccatcaaggcttcccttctcgagtggtgtgaaggtgacgcctccgtcaccctttccgccgatgtctgcgccggactgtcagtgctga

SEQ ID NO: 9454 - DNA, 480 bp, A.fumigatus
aggttgccgtgttggcttggttggagggtaaggttggtgccgacgtcatcgccattgggtctctgcccagcaatggtctggcaacgatctctgccggtgcttccgtcgtcgccctggttgaggagactggcatcctctccgccagcgctcaggcttctctcgccgccttcctcgaagccggcatttccgccggtctcgacgcccacgttcaggccgccctcgaggcctgcgccaagggcggtgccgccgtttcccttgatgttgaagttcgtaccgctctcgtcgcctggctcaccagctccagctgctcgctcggcgctgagctcaaggctattgttctcttctggctttcgttcgctctcgaggccgatgtctccgtcagcgtgtccacaggtctccttggcgatcttacctccttcattactggcactctcgaggcaactctcggctctgttttccgtggcgttatttcgatcctga

SEQ ID NO: 9455 - DNA, 603 bp, A.fumigatus
tctccggcgagagcatggcctccctgtctcttgacgctcgtgcccagctggctgctattcttggtggtgccgccggcatcgaaatcgattccaacattgaaattatcctcatcggatggctcaccggctgtggccacctccccagcggctccagcttcaccaaggatcgtattcccacccttccttcaactcccaccggctctgccaccggtgttccttctgtctctgtgcccactccttccggcatccccagcggctccgttccctccggctccgtccctaacgtgcccgtccccgtccccagcggtgcttccccctctgatgccgccaacgttcctgcccccagcgtccccagcggctccgttccttctggtgcctcccctagcggagcatcaaacggcaatgttccccccattgtttccgaggcagtccctgctccctccggtgattctcctgctggccctgacgccgccgagacgccttgcgagactttggtttctgagactgttgtccccattgctaccaagaccggggccgttactaacggtgctgcgaccatcaccgctgcccctaccgcggtgccttctaagggtcccaaggtga

SEQ ID NO: 9456 - DNA, 813 bp, A.fumigatus
  unsure (423),(440),(607),(650),(776): Identity of nucleotide sequences at the above locations are unknown.
gagaatgtggacgtatggagtctaggcatcatactctatgcacttctcgctggggagctgccgttcgacgaatacgactatcaagtcaccaataagaaaattcttaccgaagagccagttttcaatgataaattccccgacgatgccaaggccctcatcaacctactcctctccaaacggcctctcatccgaccgagcttagccgatatactggctcatccatttctcgcagagcatgctccggagcagcaagcaattcttaagattgctcgtccagcgcctttctcaacgcccttggaaaggactaccctccagcggatgaaaagtgctggagtcaatgtcgacgaagtcatggagagcgtcctggctcaacgatgcgatccgctcgccggctggtgggctctcctaattgagaaagagcancggaaggaggttcgganggaacgcaagcgacgggaacgagaggccgaggcgaagaacttgcgacgactcagcgccgccagtagccgtttggagaagatctccgccgcactccttgaagtggatgaagaaggacatgcgtctccgagcacattgcttcaggaacgaagaaaaagggacaggcgcnagtcttcctctcagctcgctgttccggagtttgcaatgctacncgagccggttcctgtgcagcccctggacttgaacaccccggttgcaccaccgcctcctccacctactgacaaggactcggtccgatctggcagctcaaccaagacgtcggccaagtactcccccanaagacaatacgcgaccgcgaagcaccctgcatgctag

SEQ ID NO: 9457 - DNA, 354 bp, A.fumigatus
ccttgcgccaagcagcgcctcctactccaaccatcgtcattcatatccgcgacagccccggccgctgagtactggctatccgagccatcgcaattctctatctccgtctccaatcacgccaaggggctcgtacagacgatcctccacggggctacgaggtcgcaaatccacctcgtcctctgtatcctccatacgaagcattcatcatacgcacactcactccaaggcgtcttctgtttcctcaaacagcattggatccgcatcgaccccgacggctcggccttcgagatccccacatgcgtcgataaaagttctccctacgacacccagtgcctccgcacgctttccgagtaa

SEQ ID NO: 9458 - DNA, 834 bp, A.fumigatus
  unsure (57): Identity of nucleotide sequences at the above locations are unknown.
caaggactcggtccgatctggcagctcaaccaagacgtcggccaagtactcccccanaagacaatacgcgaccgcgaagcaccctgcatgctagtgcgttcccacccggatttggcacaacataatggtatcctcaggcgtcgaactggacgccgtcagtaccccatcatcagtcagctcgcatcgctgaaacattggctaatggaatctgctaagagggcaaagtctcctcatcctaaatcggcggggggagggcatcgcaagttcttctccgacagactgagcccagggaaaggacaagaagttgggaagaaaccagcgccaacctcacctaatatcccccctgcaggcgatctggcgactccaacgcaaatcaagcgcgcatccaacgccagtagccttgcgccaagcagcgcctcctactccaaccatcgtcattcatatccgcgacagccccggccgctgagtactggctatccgagccatcgcaattctctatctccgtctccaatcacgccaaggggctcgtacagacgatcctccacggggctacgaggtcgcaaatccacctcgtcctctgtatcctccatacgaagcattcatcatacgcacactcactccaaggcgtcttctgtttcctcaaacagcattggatccgcatcgaccccgacggctcggccttcgagatccccacatgcgtcgataaaagttctccctacgacacccagtgcctccgcacgctttccgagtaacattcgcctcgtacggaatgcaggcaatggattccgtgatacccacgatgcgaacggaaggatgcaatctgttttcaactaa

SEQ ID NO: 9459 - DNA, 423 bp, A.fumigatus
tccccgcatcgcgttaccttccagccccgtcggtgtaaaaacgtcaccatgttctttgagtctgtctgcttccccaccatcgtcgccctgggtatccgcggcctgggccgccactacaaacgcgggtctggcttcatcgtcggcggtgtttgcggtggtgccgtcgtgccgcccctcctgggccatgtggccgacatgcacaacagcacgggcttcgctatgattgtccccacgatgttcatggttgctgcgtggacgtatgctgtcgccgtcaattttgtgcctgcgtaccgcgatacggtcgacaaggtcggcgacagccagatcgggctgaccgagggtggcggagctggcgtgatgaaggacattgaggctcgggggatggagaagtcggcggaggggtctgttcaaatcgagcattga

SEQ ID NO: 9460 - DNA, 1326 bp, A.fumigatus
gagttctcctatttccgtacagaagtccttcagcttgaccaaattgcacaacggctgggattcccgtcagttgtgcccgtcatcgacggtagcattgacgatgggcccgcgtcgcccgttcttacacagttgagtgttactgtgctggagattgccttggcacgcttctggtcgcacctagggattcgcatcagcgctgttattgggcacagtcttggtgaatacgctgcttttgcggttgccggcgtcatctctgctacggaagctctgtacctcgttggacggcgcgcacagctgaccgaggaacgatgtactcagggcagccactcgatgctgtccgttcgcgcgtccgaggatgatattgaagagcttattgcaggcagccccgacactgctgaactagcctacgaagtgtgttgtcggaacactccccaagataccgtcatcggtggcactcaagagtccatcgatagcattcgtcaggcccttgagaaaaacactatcaaatgcacgcagctggatgtgccatttgctttccacaccgcccaaatggaccccattttggactcgctggagacgttggcgacgccgatcacgttcaaggctcccagcatccccgtgctgtcccccttgctcggaagcgttgtgttcgaccgcaagtccatccatgcacagtacctgcgccgcgcgacccgcgagacggtggattttgtcgcggccattgaagccgctcaggacttcggcctggtagacgccaagacgatctggatcgatgtcgggccgcaccccatttgcgctggtcttgtgcgtggcatagacagctccgcatccgtgatctcctcatgccggcgcaacgaggacaatttggcgaccatgtctaagagcctggttaccctccacctggcggggctcacgccctgctgggcggaatacttccggccccgcgagcaggagtactcgttgctgaaattgcccacctacagctggaatgagaccgactactggattccgtacattggaacatggacgttggacaaggcactgctcaagtacggggaaaagaaagcccctctgtctctgtccatgtcgcgcccttccgcacttcgcacctcgttggttcaccagatcaccactgagacggttgaggcgacaacggccaccctccatgtcctctctgacatgcagcatcctgatttcctggaggctctacatggtcatagaatgaataactgcggcgttgcaacttcggtatgtcatttattctacacacttcgtacttctggcgtatatgcctgcaagcaatcgtgtcactgtctcggacacagt

SEQ ID NO: 9461 - DNA, 198 bp, A.fumigatus
accttgcgcttggccgcctggtgttaccgctgcagattgctcattgcaactggtgacattatcaacatgatcctttggctgctcccgggctcgcttgactgggggcggcatttccgacaaaggatcgtcctcatcgtcagagtcttgaattactctatcaaaggacattttgtgaaaggtatgtatttagccttgtag

SEQ ID NO: 9462 - DNA, 1332 bp, A.fumigatus
tggctgtggtggattaatgtaggctcagtaatgacggaaattggacttgcgcagcaacggcttttcgacgatgctccacattcagctatccgcgaggcccagacagccgcttgtggcaatcagccggacaattgctcagcacttgccgagtcttcagttcccctgaacatggcagtgtcgaattacgacgattacaatcaccacgaggggagtcctgttgctctacaacttggctcattcgatactcccacatcgcaagacatggctctcctcaatggcaaaaaccacgggcacggttactccaacaatgacattaccggattctacggagatcatatacggcaagtcgggccgctaaattgttcgtcgactcatgacctggcgcaatcctcaacgtcatacaacttctttgaatcatccctgaatcaagctgcacagttgaatgacgatctccagagccatctgagatcaagcggtacagtgcagacggaggccattcataaaaccccaggaaggtcacattccatgcaagctacatcttactctccccacgataccgagccaatctcgtcattagtgacgccgaaagtcaatagagtccaaagcgatagcacttaccgatttgctccatcgcagtcgcaaagaagcgaatgcgatgagctcgccgcccctgttacagtcgagataccggctgttaaattgaagcgcgggcgcaaaagaaagcaagacataccggaaggcgacgaagatgatgagcttgctccctcaaatgatcgagccatcccagagggtggtgaaacagtgaagagaaagccaagccggccaccgaaggtcgtacggacgttgaacgaatctgatgacgccgggctggccaacaatcagccaaaagaccagcctgttcctaatacggaagagattcaagatctaggtgatacgccactgactcctgatgcaattgaatcgaacccaaatgccaacgggatatcacatgtgccagaaaaggactattttcgagttgaagttgccaatggttcaaaagacaatgggacagaagtcttgaacgaccagcctgccgaaataagtaccccgccggcgaagccctcgaaaaaggcgaaagaaatcaagaagaaaaaactgaagcgtggaaagactacctcagtgacgttgaagaaatcttatgaatcagatatcgaagacgacgtgatctgggtcgatgaaagaccctcaaatcatatcctacaagacgaacagcctgctcagaaacccagcaatgaccaaacatctgtcgatacaaaagacacggaattgtttcatatccagataccaatacct

SEQ ID NO: 9463 - DNA, 510 bp, A.fumigatus
agcttgcccacgctcgtactaaaccccatcagcaagatcgcagaggatatcgcccgagcagcaccctcaggacgcagtattctagtagatgcttttgccggcgcaggtgggaataccatcgcgttcgcccggacaggcaaatggaagcgagtctacgctatcgagaagaaccccgccgtcttgcagtgcgccaaacataatgcccaggtctacggcgtagcggacaagatcacatggttcgagggtgattgtttctctattctcaagaatcaactcaaggaactcgctccttatagcgtcatctttgcaagtccgccatggggtggtatgttctttgctttttccttcgttctggccgtgcagctgtctaacccgtcctgtaggccctgggtatcgttcggacgaagtcttcaatctacggaccatggaaccttactccctcaaaacgctgcacaccgagtactccctattcacaaaatacatcgtcctctaccttcctcgaacgtctga

SEQ ID NO: 9464 - DNA, 270 bp, A.fumigatus
tggacgagcattggaacatgggacttgacgcactgtcgctcatttggtctacctaacatggcgagcaattctacggatgaagctccgcccgaggttcatcactacaattacatcggcgaagtgccgtgggatattcagaagtatgtactaccgactgatcctcggctagggtcctctgctgactttctagttactgggcgcaacgatacaagatattttcgagatacgatgaaggcatctggctcaccgacgacgcctggtttggtgtga

SEQ ID NO: 9465 - DNA, 405 bp, A.fumigatus
cggacaagatcacatggttcgagggtgattgtttctctattctcaagaatcaactcaaggaactcgctccttatagcgtcatctttgcaagtccgccatggggtggtatgttctttgctttttccttcgttctggccgtgcagctgtctaacccgtcctgtaggccctgggtatcgttcggacgaagtcttcaatctacggaccatggaaccttactccctcaaaacgctgcacaccgagtactccctattcacaaaatacatcgtcctctaccttcctcgaacgtctgacgtgaggcagctggcgaaacttgtcagggacggcgaaaaagcccctgtggtgcattattgcatggaaagagccagtaaagcgttgtgtatatactatggtggctttgatctttaa

SEQ ID NO: 9466 - DNA, 471 bp, A.fumigatus
gacggtgccggtgggttatctgggccatatgccgacatagcaaacagggcttgctggagtttccacgctcgaagagccgcaggatccatgtcatccgcagtaggagttaccgtcccgtcgtcctcaaagggttcgtcttcatcctcgtctatcgtcatcggctctggttccggcgcgagcgtttcagcaggcttgactgggaccggtggcttggtctcctcttcctcgaagaacaaatctcgagtggtatccatctgcgctggtccaggcgaggacggtccctcgccaaagaggtcgtcaagctcatcgccccccggcgcctgttggtcctcgcgatccccgaagaggtcatcctctgcttcgaacaaccccttctgctcatcgtccgcaactgccgccacgtcctctgtggcaagtccgcctgttcgttcttcttcttcgggaaggtcatcgtcgtcgatgtcttcgtaa

SEQ ID NO: 9467 - DNA, 207 bp, A.fumigatus
aattcaacggcgtctctattggtatctttcccggctttgagcggtggtgatggagtctttgaacagttcgcatcttcctcggactttttttcttggtctaatgaattttccaacatttttggatgcgtctcccagctcgacgtgtttgattgttttccagagagggggtctataagattaataggaccttccagtgcatcaaactga

SEQ ID NO: 9468 - DNA, 2157 bp, A.fumigatus
  unsure (63): Identity of nucleotide sequences at the above locations are unknown.
tctggctgttctgccttccacctttccatctcgttactctcttccctagaaagcaagctgccntgcctgttcaacctgctcgagaattcctcgggacatgcatggctgatccgatgccaccatgtatgccgtgtcatgcctcttctcaataggtcccagagctcacccgacgcgggaatccgtcctttgcaggcaccggatacttacttttcccgcaattcccgctcgatgcccgtctcagatacgtcctcatccagctacaatgcctctgtcaaaaggcttggatatcgtcgtattcgtccctccgttgcatctatagccgacattttcgtcaactccttggtcatggcgagtttctgtcgcgatcactctccccgcaacagagggctttctacagtggctgtcaagacttcattacaaaatatggctcgtatgaagggaaagtgttcaacaaccatcaggcggctcacttctgggaagcgcccggtcccctcatcaaactcgccggtagagtgctttggctttgacagatggcggactcgacgaacattcaactcgggtgtcgtgcagaaagttaaggatgatgaccacggagaaggctatgggacccagaagaatgtgacaggcttagaccaacgggctgaagacctcgaagcaggtcgaagtcaaggatatactagccagtcagcattacttcgctcgaagaggaagccattcttccgtgataatggtccttcgaacgagccccatccgagtggttctgaagaattgatttctaaccaaacgagaggtcagtttgatgcactggaaggtcctattaatcttatagaccccctctctggaaaacaatcaaacacgtcgagctgggagacgcatccaaaaatgttggaaaattcattagaccaagaaaaaaagtccgaggaagatgcgaactgttcaaagactccatcaccaccgctcaaagccgggaaagataccaatagagacgccgttgaatttcaagccgttcagagatttcttgaagcagtcggggatcctaaaaaaacaaatcagtatatcttccgtctctatagagaccttccgtcgcccggtgtggcgcacctttcgaagcgcacccgtggccttcttttgcgtcgaatgtcccagcctcccaatcgtcgttgggctgatgcacgccgctatctcgctatagtggaagatatgattgctgctaagcttccactgtcgcccgcgttatggacatccgctatacacctggcaggaagggcgatgggccaagtgaagaagcaagatctcgtgcgatcgatcggcatctggcagcagatggaacacttggcaggaatcgagtccgacccggtggttttcactattctgtttgatatcgccatcaaagcgagtcagttcacagtagcagacagattacttgaagaaatgtcaaagcgtggcattgaattccgacgtgccggcaaggtctcgaaaatttactattatggaatgctgcgcgacgtcaacggtattcatcgggcattcgatgagttcctagcagcgggagaaatcgtggacacggcggtcctcaattgtctaatgacgtcgttcatcagagctggtaaaatccggatcgccgaatcgctgtaccaacggatgatgcaggcgcaggcggctgcacgaccagctggagatactaatcacaagggggtgtcgactcaccaacccgcgcttgcttctgaattggtgttgtaccggaaagcagccaaggagcttaatcgtgcttttgagatggcagctcgtattaaaaacactctgccagcacaccatcgcgccctgcaagagtccatcccgatgagcccggacacgcgaacatttcacatctttctttcttaccacgcaattcactcgggtaatctgcaggctttctcgaagattgtggaggatatggagaagacgttcacaattccacctcgtggtatgatatatctgatgcttttcgaaggctttgctcgccatggcagaaagaagaagggttggaccgcggataagttacagatcgcttggcgatcatatgttcgtgcgctttacgagtcaaggaccaagaatgaatggcgacttcttgcatttattgaccctgcccttacttgggagaaccccattaaagggtga

SEQ ID NO: 9469 - DNA, 204 bp, A.fumigatus
aaaatgcaagttctccaagaacaatcgtccaagaggggcataataaattactcgctcgcaggggagagcttcaactcatcgctcaattacagcaaggacattaattgcatttgtctgtttagcccgcgcctcttagaactcgatgctgtccctaatctggctgttctgccttccacctttccatctcgttactctcttccctag

SEQ ID NO: 9470 - DNA, 1320 bp, A.fumigatus
tgcgagcgagcggcgaaggaacaagcgaagcaagaggcgtttgagcgagcatacgcacttgctggcttgactgaagagctggaagtcctgaaaggacgcttgcgcaatgttgaagccaatcgtcgctccgacagacttgaggcccgggcaaaagaaatgagcaacgaaaatatcggaagattatcgctggaagaaggggatctcgcgttcatgctcaccccggcacctcgcaggccaaaacggcctgctgacgattcaacgcaatcaccacttgcggaatctacagatcagcctacggcgcaagacactcctccaaagagactaagactttcagatgtaacccctcgtcaaggtgatcaaaatacactatccacaaacacccagcaagaaataatcgatagcctcgaagaaatgctcaagcatgagagaaaaatgagacttgatgccgaggacatgattgagtttctgagaatggagtgcgaattcaaacgatgctcctgcagacttgcagaagaagaggaacaggcccatctagtccatgcgccagcccgcgaagatgtcgtagccaaagacgaggttcaaaacatcatcgaagaacgtcgtgacatccgtggccctgaagcccagcatcattcacgttttgacaaccccttgcagggatcagggcccacggagcaggaaagaccccaagaacaaccagaggaactcttgataactttctcgcccgtgacgggaactttcaaatccgtcccttctccagttcgatctcctcctaaacaaccccaaggcacagctttcagtgggctcgaatcatcgatctctcacgaaaacctgtcagcggagcagctgctcatcagtccttttgaagaaaggcatattaatcggcacgagccgtcctttgaccccacggtgcaagttaaagaagacccgttccaacctttcgctccaggtcttcaaccatccccagctcgtatcagtgtcccttgggattctccctcaccacgatacagtattgaagataatcacaatgcacctacaggatcagatggtgcgctcgcgcatcattctgttcccctgcctggaacgtccatcgatagagaacaagctctagcgcaaattcgagcacgaagagggaaaactagtacattgaaaagatctgtcagcgctaatgaggctacccttcgctcaggaggaggcggtgtcacacccggccggggtgcgcaaaggatccctggcgttcagaactcggcagtgagaaccgacggggataaggctgtacgaagagatctaagtgctccggtcaggatgttacgccggtaa

SEQ ID NO: 9471 - DNA, 939 bp, A.fumigatus
  unsure (210),(340): Identity of nucleotide sequences at the above locations are unknown.
cccggatccgtttggatagcttgcagcacagacagtgtggttagcatgaaaagcgagctcttgaagttcctggttactttacgtgcgccacatagtagaaacgcagcccaaaaagtattccgtaaaatctccgtcttgcttaaccgaagcgcgcagcataacgcgtctcaagcaatttacctgaaagccacacagcgcgatgcgcgacgntacaccatcctgcgcaagggcttacaccacatctcccacgataacactgcatctggtgaagatgaggactccgatgctgcatctacatactcatccagtccggtcgtcgagcccctgtcgtggacacgcntagcatacacatccttcatctggtgggcatccgcaggcgagaagcgtgacggactcacggaagaagaggaagaagagcgccaaattgagcaagacacgcggctcctagccagcttggaagccatccccaccccgccctcaggatctcttggccgccattccatgcaagcggaggacgcttcgcagcctcccgaaatcgcactggtctcctacttccgtcgcctgacgacccagctcttcgttacgttgtcggacgtgattgcccgtcaggatggtagagacggcgaacaggatgcagacattggcgccccgtacgaggacgaatcagaggaagcggatgccgaaccctccatctccgttggcagggaagtttcgcaaggagacgactcgagacggcccttactgccatctggagccaagtcttcacctgaggatgacgagctggtgactatcacctccgaggatatgactgagatgggcctcgatgtgtggagtgcttctgaccgcatctttgtcgaggagctggtgcggtcatggtggggtcgcaaagcctacgttgataccgcacgcattaagtgctgtgggatttcaatcatttga

SEQ ID NO: 9472 - DNA, 324 bp, A.fumigatus
cgtggtaccttccaccgcgtggtgaagatcttggcaactgtcgcgttctactttgctaaaacgcggttcatgcctcgcgtccagaatgataagatgttccgctgggactacgattatgttgagtacggcgattccgcactcgactatgggtacggtccagccagcttcgaaggcgaattcaaccttgatagcgatgagtggaccgttggttcttcgtcatccatttcgtccggctccctcagtccagttgacgaccactactcttgggagggcgagactcttgcctctcctgccaccgacatcgagtctggaaggcatttctga

SEQ ID NO: 9473 - DNA, 210 bp, A.fumigatus
  unsure (16),(17): Identity of nucleotide sequences at the above locations are unknown.
agtgagaaaagcttcnncatgagaacaacctacccggtcctgggacccaagattcatcacgaggtccacgttcagaattgccaagcttcgatggcgaagtccgacttggcctacttaaacacctttagaagattgcaggtcctcccaaggattaaccaaacaacggtgcggttggaaccgagcttcaaattacgcccatttcggaaatga

SEQ ID NO: 9474 - DNA, 390 bp, A.fumigatus
ccgtcaatgtctgggagtattctggcgctgactctttacctttttaaaggctattggatgccatatgaggcagcaaaagcggtggcagcgacgttctgctggaagatccgacatgcattgacaccattatttggcctggatttcccatcgatgtgtatccaccctcaggaccgaggacggtttggccgtatggtcattgacccggctattgtaagaaaggccaccgagacggcaaactactaccgcattcttgaactccagtctccgtcctatagttcccttcaccttacccgcacaggaggcaaattccgcccgaactcaacagggagctctgggttcgtgaagcgactcataccccgatctcatgagcaccgatactcaggagagtag

SEQ ID NO: 9475 - DNA, 564 bp, A.fumigatus
aacgctgtttacatggcgtcgatagcatctttgttgaatccccttcccggcccgagccaactatcatcaccaacccgaacactggcaagctctgcagccagtatggcttctaatacgccccgtcctaaacggcccaaggttgccaaagatgctgcgatcttcacaaaggccaagcctaggggagaggttcggtatcccccttgtgaagagcgagacgaagagctggctcgaatgcaccgcgaatttcgcatccatcccatgggtgatatttcagagtatgcaagacacataccatataacagtgacaagaaatcgttccaggagcgcactggtcgggagagttttgagggtgagtcacacagcgaacaacataccacatacccgaggggtgtatatgcttacaagatctctatagtctttcagtatacttttaagcttcctggtgacgagaaagaatggatcgtgatgtgggattacaacattggtcttgtgcggacgacacatctctttaagtgcaatgactattcaaaggtatacagcacgacttcggctgctagttcctga

SEQ ID NO: 9476 - DNA, 612 bp, A.fumigatus
agcgactcataccccgatctcatgagcaccgatactcaggagagtaggaccggctacgggtcgtcctcgcccgagtgtcatggcgacgtatactgcgtctccccagtgagcccgttccggaacagcttcacccccgtcaacacaccacgaagctccgaagtgatcggctcgaagttactctcaccgcgagcgatagccgccaccaccgcccccatgcccgaccgagaacacacagcaggaagtgaggaggattccgggtcggacgagacaggctcctcgaccatgtacacggagagtaccagtaccacgacagaggtcctctccgtggacctcgatgccgacgacgatgacgatgacgaggattatcgcgagaaaagcgaccgaagcgataggggctccgtcaactcgtcgattcctgaccataaccggaagatcgagacccggtccagggggaaacatagctctgcgctgttcgcgcgagaagtcaaggccgcgcatgccttgctgagcttacacatgcaagaagccatgggcagtgacggcgatgaagagcctctgctgatggcctcgaggggcttgaacagtaggaagagacggagggcatctgcttga

SEQ ID NO: 9477 - DNA, 381 bp, A.fumigatus
gtaactgcttctcagcttatcaacttttccgtcgtcacctttacctatacccgttttcggaaagctatgatagcccaaggtattccacgagaatcgctcccatacaagagttggtggcaaccctatactgcctatgttgcgctggtttccacgacagtcatgacttttgtaggcggctatactgtctttctgcctgggaattgggatatcccgacctttctcttctcttatacgatgattggagtgtttccagtcctgtactttggttggaagattgtacaccgcacacaggtgaaaaaaccggaagaagtggatctcttgacaggactcgacgagatcgacgagtatgagagacattacgttcccgaaaagccaaggtaa

SEQ ID NO: 9478 - DNA, 318 bp, A.fumigatus
tccgtgctaaatacaggttgcctcctaggtctggctgagatggtcatctacctgccaatctcatcgccctttattcgatttgccggccgctatgtcgatgaagcctttggtgttgccgccggctacaacttcttcgtctttgaggctgccctagtgccctttgagatcaccgcgtgtaatatgatcataaactactggagcgacgttatcccagtgagcggggtcatcgtcatcgtgctggtcctttacatgtacgtaacatcttctgaacggcaaaaggccctgcccatctggagtcgcctgaatattgacttctag

SEQ ID NO: 9479 - DNA, 822 bp, A.fumigatus
attgatagactcctcaacgtcttcgcagtgcaatggtacggcgaatccgagttttggcttgcgctttcgaaagtattactcagcattgggttgattctcttcacattcattgtgatgctgggcggcaacccaaagggagatcgattcgggttccgatactggaacgagccgggagcctttgcggagtattacaaaacgggtgatcttggacgatggctcggtttccttgcatgcctgatccaggccagtttcaccattgcaggacccgattatgtgtcgatggcagctggagaggcagccaacccccgcggagtcttgcctaggacatataacgttatattgtatcgactcacagctttcttccttttgggtgtgctgtgtatcggcattcttgtcccttacaatgaccgtactttggccgaagcctttgccaagggcttgccgggcgccgctgcatctccttatgttgttgctatggacagactcgggatccttatcctgccccacattgtcgacgccatgttgttgctggcagcttttagtgccgggaatagttatgtttattgcgccagcagaagcttttacgggcttgttgtggtcggcaaggcaccccgattgttcactaagtgcactaagcggggtgtaccgatctactgtgtcacagttgtcatgttgattgcacttctagccttcctccaagtatcaaacagcgcatctgtcgtcctggattggttcgttaatctggtacgtgccgattccgagactagcatcaccttgacttctatctcgaaaaaaacaaagtctctaacagttggtaggtaa

SEQ ID NO: 9480 - DNA, 363 bp, A.fumigatus
atcatgtcaaggcctgacccagacacgagtgtccatcaaacatcattgccgacggctatcagcagtgataggtcgtcccacctggccgacgacttcaatttggccacagccaatttgaccaaaagaaatggctgtcctataacttactcagagaaggccactgttgtcgaggatggtgaagaatcaataggaggcacattgtcgaagccgacttttgatcatacgcaccggaagctgaagcccagacatattcagcttatcggtatcgggggtacgattggtacagcactctatgtccaggtcggtaaaagtttgatgaagggtggccctggcagtctgttcctggcattttcaatttggtaa

SEQ ID NO: 9481 - DNA, 429 bp, A.fumigatus
gtgtctctctactctgcgccagtatcatggcattcagcattatatacgcccccgatgcactctactcgccaaatctacctgcctactgagattgttgtgcaaattgtccgctttgtggctacagatgaagcccatcgtcaagaagcgctttacgcatgctgcttagtatcgcgtcagtggtattccgcagccgtctccctcctgtatgaaaagccccggctacatatcggaaactctttccagcagtttgtatcaacttgctcaggagtcggtggacggagaaataaattgaatctgggaagttttgtccgtcgcctggacctcagtcggctggtgcaccatagctccaacagcgtgactgcccgactgcttggccgagtcaaagagaacctggaagttttcgtggctccaagagtgtcatttgcgtaa

SEQ ID NO: 9482 - DNA, 801 bp, A.fumigatus
  unsure (598),(764),(765),(768),(789),(790): Identity of nucleotide sequences at the above locations are unknown.
cctagcatcgatggtgtactcctccggtcgtccaagcctatccccggtgcagcggagtctctagcattgctcaaggaccaaggaattccctttattcttttgacaaatggcggtggaaaacatgagacagagagagtggcggagattagtgagaagctcaaggtaccattggacgcctcagtcatcatccagagccattctccttttgcggagcttgtgaaggggccagatgaacacagctctttggaggataaacgcgtgctagttgtcggaggtgatggtgatggctgtcgtcgggttgcggagcagtacggcttcaagaatgtgctcactcctggcgatatttttatggccaatccatccatttggcctttctccaaagggtttaaagattactacgagaaatttgcaaggccgataccgaacccgctggaccctcgggatccaaccagaaggttgaagattgatgccatcttcgtgtttaatgactcccgcgactggggcttggacgctcatctgattatcgaccttctactatcatcgcagggtgtgttgggtacaatatcggacaagaatgggcgagccgatctcccaaatnagggattcttgcaagacggccagccacatctgtacttttcaaacccccacttgtggtgggcagctgcttaccatttaccgcgtttgggccaaggaggttttcgcgaagccttggaaagcaactgtggcgcgaattaccggagggcaatcaaatgcgtcaagctgannaanaagatcttcgggaaccatacnnaggaactatga

SEQ ID NO: 9483 - DNA, 288 bp, A.fumigatus
ataagcaatatctttagatcggatcaccaggcaatccaagctagccaagccatgtctgaaagaggctctttccggggtggtcgtagccgcggcggaggtcacgacaggtctggcggtcgtggcggtggtcactcctcccaacacaggggtggcggtgcaggtggcggtgcgcaacagcaacaggagaaacccaagaaggagaacatccttgacttgtccaagtacatggacaaggaggtgaaggtgaagtttaatggaggacgagagggtgagtttgtcaccaactga

SEQ ID NO: 9484 - DNA, 261 bp, A.fumigatus
agtttaatggaggacgagagggtgagtttgtcaccaactgattgtgcttcttgcctactaaaatcgatattagttagtggtatgctcaagggttatgatcagctcatgaacctggtgttggatgatgtcaaggaaagcatgcgtggtaagtcactcaacgacatcaccaagctggatgaagtatctaacagtgctattcagatgatgaaggaaatgaaactacccgctcccttggtctcatcgtcgcccgcggcactctga

SEQ ID NO: 9485 - DNA, 420 bp, A.fumigatus
cagatttgcttttgttcagatgcctatagaaacgaagactatgaccgtaaaatcctggaggaaatgggggagctaggcctcctcggcgcgagcattgaaggatatggatgcgccggtgcgagtacagtggcctcagggttgatcacaaaagaagtcgaacgggtagactcaggataccgatcgggaatgtctgtgcagagctcgctggcgatgacgggtatcaacgagttcggcactcaggagcagaaggaccgattcctaccgcaactggccaagggaaaactggcgggctgctttggtcttacagagcccaaccacggctccgaccccggttcgatggagacgacggcgcgcgaacacccgaccaagaagggatactacttgtcttcatcacggcgctggcaggatccacgattaggt

SEQ ID NO: 9486 - DNA, 423 bp, A.fumigatus
aatagatattcagttcttatttgctttggactacttcattcaccttcccttctctcgcgctgctttctttcgttcttatcagtcatgaaccggtcaatcttccgcgcggcatcgcgccaccttcgatcagcgaatcgcttgtataaggctcccgtggtcagccataacacttcggtacgagcttattcaacagtgtttaattgggaggatcccctcgccgcgtcggaactgtatacagacgaggaattggcgattcgggacacagcccgacaatactgccaagagcgattacttccccgtgtgctcggtaagccatacttcgggacgatctgtgagaattctgctgacagatttgcttttgttcagatgcctatagaaacgaagactatgaccgtaaaatcctggaggaaatgggggagctag

SEQ ID NO: 9487 - DNA, 219 bp, A.fumigatus
tttcggaggcgggacgattatcccggatcctctcgacgttttacgacttattatgacatgctctcggaaaatcgtgttgccagatattcaacacggcactcgggttctgggtggctcgatcgaatggtgtttcaaatgcattgggatctagatttcacaggggtcagtttcacggagtttctggatatggggtttaccatggttgttactcgcttttaa

SEQ ID NO: 9488 - DNA, 576 bp, A.fumigatus
caagctattcaggctgctggtgccacttccctcctcttcgtctactctctcgactacgctcgtacccgtcttgccaacgacgccaagtccgccaagggtggtggtgagcgccagttcaacggtctcattgatgtctaccgtaagaccctcgcttccgacggtattgccggtctctaccgtggtttcggtccctccgttcttggtattgttgtctaccgtggtctgtacttcggcatgtacgactccatcaagcctgttgtcctggttggttctcttgagggtagcttccttgcttccttcctgctcggctggactgttaccactggtgctggtattgcttcttaccctcttgacaccatccgtcgtcgtatgatgatgacctccggtgaggccgtcaagtacaagtcctccctggatgctgctcgccagatcatcgccaaggagggtgtcaagtctctcttcaagggtgctggtgctaacatcctccgtggtgttgctggtgctggtgtcctgtccatctatgaccaggttcaacttatcctcttcggcaagaagttcaagggtggctctggctaa

SEQ ID NO: 9489 - DNA, 876 bp, A.fumigatus
cgtcggtcggcgctgctgtccattaacacaaggaactcgtctcccgttgagattgctgggattcttgattataatacccatctcaacatgactacaaccgcgcctcctgacgcgacagccccgtccacatcatcggaacaggacgaaccagctccatccgaaactgcatctgtgtcagccaccgcgactgcactcccatactctccggttcacgccactgcccaagctcaaccaggaggcaccacggtcatgcctgcgcggtctggcagtgacggacctcctctacccacaccgaccaaatcgatagccacccctgctacgaaaacgagcacctcgcctcctccccctcagcctggagctcgtcctgatcctggaattcctgcaccgacgactcttccagttttggctgcatcttcagctccagctccagtccctagtcctggtcccgctccccaggctcaacctgaacctccaccaacaccttccgctacagccacaggcgcaactacaactacaacgccagcgaaccctatgcctggccacggctacggctacagccccgcagccggcaggtatagctccgaattcacacacccagcccagggccaacaattccatccacgagcacaccctcacgcacaaccacacccaaactcaacgtccacaccctacgcctcgctctaccagccacccgacacctcgtcacagctacccctctaccagacccagggccctggcgccgacgagtttgattccgcccacggagacggtgggttcctggcgagcgccaagtcgtggatggcgagtgcggggacgaagttggcagaggtggaggctgaggtgtggaagaggatcaatgaggctcatgataagtag

SEQ ID NO: 9490 - DNA, 1218 bp, A.fumigatus
cgacccgcgtttttgggatcgaacgtggtgtatgattgtcccaattccaagctgatggagcagaaaaagttcatcaagtacggcttgactcagtctgcgttagagtctcatgtgccacttattgagaaggaggttttggactatctgcgcgattcaccgaactttcaaggctcgtccggccggatggacatctctgcggcaatggctgagattaccatttttaccgctgctcgagccctccaaggccaggaagttcgttccaaactcacggctgagttcgctgacctctatcatgacctggacaagggctttactcccatcaattttatgctaccgtgggccccattgccgcataacaagaagcgagatgctgctcatgcgcgcatgaggtcaatctacgttgacatcatcaatcagcgccgtcttgacggtgacaaggactctcagaaatcagacatgatatggaacctgatgaactgcacatacaaaaacggccagcaagtgcctgataaagagattgcgcacatgatgataaccctgttgatggctggtcagcattcgtcttcgtccatcagcgcctggattatgctgagactggcctcacagccaaaagtcctcgaagagctgtatcaggaacagctggccaatcttggccccgccgggccagacggcagtcttcctccgctccagtacaaggatcttgacaaacttcccttccatcaacatgttattcgtgaaaccttacggattcactcctctattcactctatcatgcgcaaggtgaaaagccccttgcccgttcccgggaccccttacatgattcctcccggtcgcgtgctccttgcttcacctggagtgacagccctcagcgacgaacacttccccaatgctgggtgctgggatccccatcgctgggagaaccaggctactaaggagcaggagaacgacgaggttgtcgactacggttacggcgccgtctccaagggcacgtcaagtccctatcttccgtttggtgctggccgacaccgctgtatcggcgagaaattcgcttatgtcaaccttggtgtgattctggcgaccattgtgcgccacctgcgacttttcaacgtggatggaaagaaaggagtccctgaaactgactattcatccctcttttcgggccccatgaagccaagcatcatcggctgggagaagcggtcgaaaaacacatccaagtga

SEQ ID NO: 9491 - DNA, 1053 bp, A.fumigatus
tctactcctactgggccccctatgaatcccaacccaggcaccatgtcgcctgtctccgtagatggaagtgattggtcagggatcaatcagtaccagaaatctgatccaccattctcacctacttcctcgactcgcaataacctcgcaactcctccaacctcaggcacacccagcgggctgggtccgaataatgcgggtgcgccgaacgggtccacaaatggtgtgagcgacccaggcaacccgtcgcccccgagctcagtcgcggcccggtctagcagtggaactttggccgaggatcgcagcaagcggacgaaacagatggaggaagttcttggtcaacactactttgccctgagacgatttcttaatgcatcttatcgggatgaaagagcgaacagtaaatcaaacaaagcccgagacaagctgctcaggctttcggcaactcagtttcaagagctcagtactgatgtttacgatgaactcctccgccggcagcaggccatgccttcccccgggcggcctggtcctccgcggcctgatgtgccgcccttcctgcctcctcgggaagactttcatgagaagcgcaatcaagcacgccagaaacttgcgtcccttcaacaccagcggtttagagacttagctacggacgtcttctgcgaactggaacgacgcttcccccagtttccggcacgggaatctcgccgagccagccccgcccccagcttgcgtggacgcccatcaaatggctaccctccaaatggtttcggtcctaacggttatcctccgcctcccggcagtcggcgctctcagtctcgaggccctccaaaccgcatgggaaggggctatccctccggcggtcctccaggcagtccaatgggtgggtatcctccccgccaagggtccttgggcgggccgccgtcggtgaacggtgacgttggaccgcaagccaagtcattccaaagcaacacgattgtcccaaataagagtatcatggtggaggacgacgacgatcttcaccacgaggcggcaggcatccgcgctaagaatgggggg

SEQ ID NO: 9492 - DNA, 285 bp, A.fumigatus
ctacggacgtcttctgcgaactggaacgacgcttcccccagtttccggcacgggaatctcgccgagccagccccgcccccagcttgcgtggacgcccatcaaatggctaccctccaaatggtttcggtcctaacggttatcctccgcctcccggcagtcggcgctctcagtctcgaggccctccaaaccgcatgggaaggggctatccctccggcggtcctccaggcagtccaatgggtgggtatcctccccgccaagggtccttgggcgggccgccgtcggtga

SEQ ID NO: 9493 - DNA, 738 bp, A.fumigatus
gtcgtagttgatgacaagcgagacttgctgaacgtcgataccacgagcccaaacgtcggtcgagatgaggacacgagagttgccctggcggaagtcttgcatgatactgtcacgctccttctggggcatttcgccgtgcatgctggatactgtgaagttggcttcgcgcatcttatcagtaagccagtcgaccttccggcgggtgttgcagaagatcacggcctgcgtgatggtcaaggtatcgtagaggtcgcaaagggtatcgaacttccactcttctttctcaacagcgatgaagtattgtttgatgccttccagggtcaactcgtcacgcttgaccagaacgcggacggggtcagtcatgaatttcgtcgtcatgtccaggacgtcataggggagagtggcggaaacgacaacgacctgtgtagcgggagggaggtagcggtagacgtcgtagatttgttcacgaaaaccgcggttcagaagttcgtcagcctcatcaagaaccaacatcttgatatgccgggtgcgcaggtggcgtctacggatcatgtccgcaactctacccggtgtacccgaaacaacgtgctggccatagtccagctttcgaatgtcctcgccaatatttgtgcctccaatgcaagcgtggcattgtacattcatgtaatctcccaaggccataatgaccgactgaatctgagtcgcaagttcgcgagtcggcgaaaggaccagagctga

SEQ ID NO: 9494 - DNA, 525 bp, A.fumigatus
gctttgcggcgagtactatcacgtgattccagcagtggcactcgcgccgcaaactcaagttgcgctcacaaactatcacatctccagaccaaaatcagtcaagctgatcgcattctctacaagcttcctggaacagacaaaatggctgacggtattgatcgacgaacggatggtatgcgaataatggaactttttgaagagatttgggctaacggcgcaaattcagacaggctggagttcagcacctcgaaggaggtcacggttgccccgaccttcgaggatatgcacctgaaggaaagcttacttcgtggtatttatgcttacggctatgaatccccctccgccgtccagtcccgagcaattgtccagatttgcaagggtcgtgacacgatcgctcaggcgcaatctggtactggtaagaccgccacattctcgatcagtatcctgcaagtcatcgacactgtcgtgcgcgagacacaaggtatgtcacttaatactcctcctgtgctggtgaagcgatcctaa

SEQ ID NO: 9495 - DNA, 858 bp, A.fumigatus
  unsure (853),(855): Identity of nucleotide sequences at the above locations are unknown.
ttagtatcagctctggtcctttcgccgactcgcgaacttgcgactcagattcagtcggtcattatggccttgggagattacatgaatgtacaatgccacgcttgcattggaggcacaaatattggcgaggacattcgaaagctggactatggccagcacgttgtttcgggtacaccgggtagagttgcggacatgatccgtagacgccacctgcgcacccggcatatcaagatgttggttcttgatgaggctgacgaacttctgaaccgcggttttcgtgaacaaatctacgacgtctaccgctacctccctcccgctacacaggtcgttgtcgtttccgccactctcccctatgacgtcctggacatgacgacgaaattcatgactgaccccgtccgcgttctggtcaagcgtgacgagttgaccctggaaggcatcaaacaatacttcatcgctgttgagaaagaagagtggaagttcgataccctttgcgacctctacgataccttgaccatcacgcaggccgtgatcttctgcaacacccgccggaaggtcgactggcttactgataagatgcgcgaagccaacttcacagtatccagcatgcacggcgaaatgccccagaaggagcgtgacagtatcatgcaagacttccgccagggcaactctcgtgtcctcatctcgaccgacgtttgggctcgtggtatcgacgttcagcaagtctcgcttgtcatcaactacgacctacccaccaaccgtgagaactatatccaccgtattggtcgaagtggtcgtttcggaagaaagggtgtcgccatcaacttcgtcacaagcgtttttgtgcgcatgctcngngac

SEQ ID NO: 9496 - DNA, 402 bp, A.fumigatus
  unsure (57),(111): Identity of nucleotide sequences at the above locations are unknown.
tgctcaaagtgtaacacctcagccgcaacccccaccacatcaaggaagcagcacccntcagtcgaaccatcctcaacctccctccagtcaacctcagcagcagccaggtgntgcccctcaaccccatctgacaccaaacccgcccccgcaacagttgccgcaggctcagcaacccggccagcagccccaccagcagccacagcagccaccgcagcagcagccccagcaacagcaatcacaacaggggcaaccgcaaggccagcagcaacaaatgacccctcaggaagctcaaatgaaggcccagcagactcagaatcaagccgccataatgatgcagcagaggatgggcatgaaaggcacttcgattctggccttgctcacttttgcggagcacttgagtaa

SEQ ID NO: 9497 - DNA, 807 bp, A.fumigatus
  unsure (344),(398): Identity of nucleotide sequences at the above locations are unknown.
aggctgctcaataagccgcaatgcaagcgaattcggggaatgcgaccggtaaatgtacaaatgcaccttcaacaaatgcttcatggccatcagaacatccagcaacagcagcagcagttctttgttatgcagcaggcccaacaagcgctacaggcacatcaggcgcagcaagcccaacaagcccagcaagatcaacaagccgcagcggccgccgctgcagccgcggcgcaaccgggtcagcatacaccgcagcagcgtcatgcagcacatccccagaatatgcatgatgctcaaagtgtaacacctcagccgcaacccccaccacatcaaggaagcagcacccntcagtcgaaccatcctcaacctccctccagtcaacctcagcagcagccaggtgntgcccctcaaccccatctgacaccaaacccgcccccgcaacagttgccgcaggctcagcaacccggccagcagccccaccagcagccacagcagccaccgcagcagcagccccagcaacagcaatcacaacaggggcaaccgcaaggccagcagcaacaaatgacccctcaggaagctcaaatgaaggcccagcagactcagaatcaagccgccataatgatgcagcagaggatgggcatgaaaggcacttcgattctggccttgctcacttttgcggagcacttgagtaactttaccgtacgtcgaaccttgtcgcaacatgcgaatgcttatagagattgtgctaacttgataacagagccgcggcgaggctcaggatttgctgtattggcaagcatttgtcgataa

SEQ ID NO: 9498 - DNA, 390 bp, A.fumigatus
cagagccgcggcgaggctcaggatttgctgtattggcaagcatttgtcgataaattctattctccggttggtgttcttcgacaaggggtgtacaatccccaagcgggttcgaaacaattcgagatctcgacgccagccctagcacggtactacctgactcaatttaccagtggaatccgtcagattcagatgctggttgaaggtgcgcgcgagagagattcgcccaatggtggtcgcattgtggaaagtcgcagaacgtcgtttatctactggttcaccaatgagtctcaggttcgtctactgtttgttcgtctggatgtgagacattttgctaacttcccgaaagctattcaccaacgggacacttatcgctcacttcgatcacaataa

SEQ ID NO: 9499 - DNA, 540 bp, A.fumigatus
  unsure (267),(321): Identity of nucleotide sequences at the above locations are unknown.
gcaaggccagaatcgaagtgcctttcatgcccatcctctgctgcatcattatggcggcttgattctgagtctgctgggccttcatttgagcttcctgaggggtcatttgttgctgctggccttgcggttgcccctgttgtgattgctgttgctggggctgctgctgcggtggctgctgtggctgctggtggggctgctggccgggttgctgagcctgcggcaactgttgcgggggcgggtttggtgtcagatggggttgaggggcancacctggctgctgctgaggttgactggagggaggttgaggatggttcgactgangggtgctgcttccttgatgtggtgggggttgcggctgaggtgttacactttgagcatcatgcatattctggggatgtgctgcatgacgctgctgcggtgtatgctgacccggttgcgccgcggctgcagcggcggccgctgcggcttgttgatcttgctgggcttgttgggcttgctgcgcctgatgtgcctgtagcgcttgttgggcctgctgcataa

SEQ ID NO: 9500 - DNA, 297 bp, A.fumigatus
ctcttactgggtgataaacaacctgcggataggataagcactaattcgggtttcaccgcatcttacgccattatcatcattcaaattaccggtcagaattcggctgatctgctagtgtacataatacactcgatcacccagaaaagcccgttttcagactacatcatcccagctagtatgctcggcatgcctgaacaaggcaatatttgccgatgtctactgcttggccttagtataactctcacaccggttggacagtgctggcgagctgatgcgccagtcttcacgacggaatag

SEQ ID NO: 9501 - DNA, 252 bp, A.fumigatus
gatgatccctctcagatggcggcaatgctgtcgtatctgggtgtgacatcccatgatagtcggatgttgggaattgagaataggaacatggaggggcaaattccgctgattcctacattcctgggttttagctatgctcttgatgaacacactatcgagattgacgacgagacgctattggacagtaatttagtttatcagccccctgtctttcccactcacggatgcagcacctccggtcaaactggatag

SEQ ID NO: 9502 - DNA, 333 bp, A.fumigatus
gctgttctcttcgctctgtgtgttacgcggtcggtttccgcgaccctatttgttaattttaccaattacgcagccgaagactgtgctatccgctacggttcatctatgcttgtcccgacctattgtgtcaatatcgaggactttcccatcaagagttacggggcgtcggtgagttctggagagtgtgacgattcttccacgtctccggtcctgaacgtgttcacggaggctgggtgcaatactggactattcaacactgtcgccttgagtacggagccgatatgcatcaatgatgagacgactgtgttaagtgtcagcgtggcttgcgtctaa

SEQ ID NO: 9503 - DNA, 186 bp, A.fumigatus
gacgactgtgttaagtgtcagcgtggcttgcgtctaagtctgaagctttggggtgctggactacagagctcctttttgactgctcagtcccatgtctacattgaagctttcaaacaatatccgaaggacttacagtcgcgtactactgacctgaatatggatactgaatttctaccaaggttataa

SEQ ID NO: 9504 - DNA, 417 bp, A.fumigatus
  unsure (8): Identity of nucleotide sequences at the above locations are unknown.
attgcctngatcaactttttcaaggactggggaatctccccatcagccgttgtagtcaactcgagcggcgaggtgattgcggcgtatgcggcgaacgccctttcacttcgtacggctatcatcttcgcatacctgcgtggacgatgcgtgtccaaggtctatcttcaggcggcatggtggccattgggttggatgaagcgtctctcaagcctattctttccgaaggggtggttgtcgcgtgcgtcaatagcccccagagcgttaacctctctggggacaagacaaggctggccgcggtggttgacaggatcaaggcggacaagccagaaacctttatacgatatattccagtacctgtggcgtaccattcgcgtgagcttaaccctgtttttgtcaccttttgttacctcgcaatag

SEQ ID NO: 9505 - DNA, 507 bp, A.fumigatus
ctaatgaaattaacagccgatctgcaaccagcggcagccattctcaagtcagaagttgccccctttctccagcacaacgaatcaatgctgcccatgtactccactgtcaccggcaaggcgataccaaacccggctgccctcgacgcagagcattggcagaaaaaccttgaactccctgttctgttttcgactgcggtggatggtgttctggccgagcgtcctgagcgccgaaagatcttcctcgagattggaactcattccatcctttcgggaccactccgccagattttcacctataagtcgagtgactgtgtctatcttccgaccctcatcaagtcagagagcgagacgttctgcctactcaagacagcgggccagctgtatctccatggacatcccgtggactttcaggctgtaaatgggaacggacacattgttaccaacctgcctgcatatccctgggacagaaagagggtaaactggcagggaaagccgtttaagccataa

SEQ ID NO: 9506 - DNA, 1854 bp, A.fumigatus
actggcagggaaagccgtttaagccataactggcggtttcgcgtgtatccgaatcatgagctcttgggctcgcgaatgctggaggcaagtgatctcgagccaggatggaggaacgtgcttgaatccagacatgtgccatggctgtcggatcaccgtgtctcaggggaggttgtgtttccgtgcgccgggtacattgccatgattcacgaagctatgcgccagctgtcgaacaataacgagtgcaccattcaaaacctttccatgcaggttccgttgattgtgccccgggtagagcctatcgaaattcttacaaccgccaaacgcatccgagtcaatgatcgcgtagaatctgattggtttgagttcgccataatgtcgtataacgggaccgaatggattcggcatgcctttggtcgagccaaatccggcgtcgacaaggtcgattccgaaccacgtgtgccccgagacttccctcggcgcgtttcatcagagctatggtatcggacgctggagaaggtgggattgagctatgggcctactttccgaggactacaagaaatcactgccgacccttcaagacatgtggctgcggcttcgatgcgcggccgccaagatagcaaggctgtccatccgacagtaatcgatgagtgtctgcagttattcaccgtagctgcatgcaaggggagagcagtaaatatgaccagactctatgtgcccgtgtttgtgggagaggttcaactcggattgggtcaagaaatcatgagagcggaagcgacgatcagcaattggacagcagaactaggcagcgggaatgtgcggttgatagctatggaccaacaagacgcctctatcaagcgagtactttcgatggcgggcgttacggttgccccgctcgacagcaatataagagcagtcagcgaggcagactttcccttagcatcacacgcagaatggcgtcctgatattgatctcctaaacgagcaaaggctaacgcgacactactcccagtctactgaagctggctttgctctgattgccaaactgtccgctctgtctgttattcaggtgcatcgacggattgccgatgtgacaccattttccccatcgctggcaaagtaccagaagtttatcagtactcagattgcagaaatccagggagggtctttttgcggggttcctgaagctgcatcgtggctcaagttctcggacgaatctttacagcgccagcgggccgctttggacgaggggctccgaacaagcaagttggcatgcgtttcctcgctgagtaactggatcgtggagaccgttcggaatgtcatcgatggatcgcttctgccgtctgattttccggctgccatacaggaacagatatggcagtgtgagagcttggttgcttcgatgacggatctctcccactggtttggccttctccggcactctaatcccttgttgcggatccttcatattgccgagggaaagggagtggtatcccatcaggttcttgagcatcttgattccgaagatctcccattctactcgaagtatacatacacgagcacgaacgatatcagcccagccgtacaagaacacctcaaagagtacaaggaagtgaacttcaagagccttgatataactaaggatcctcgtcagcaaggctttgaagaaggagcgcatgacttgattatagtgtcaaatttctgtgatgttgatttcagtgccatatggcattccaggctgctgacagctttcccagacgaacgttccaccttctcagttgcaaactgctcttcaaaacatcaaaatgctccttgtgccgggaggccgagttctgcttcatataccaaatgcaggtga

SEQ ID NO: 9507 - DNA, 585 bp, A.fumigatus
  unsure (6): Identity of nucleotide sequences at the above locations are unknown.
tgcctngatcaactttttcaaggactggggaatctccccatcagccgttgtagtcaactcgagcggcgaggtgattgcggcgtatgcggcgaacgccctttcacttcgtacggctatcatcttcgcatacctgcgtggacgatgcgtgtccaaggtctatcttcaggcggcatggtggccattgggttggatgaagcgtctctcaagcctattctttccgaaggggtggttgtcgcgtgcgtcaatagcccccagagcgttaacctctctggggacaagacaaggctggccgcggtggttgacaggatcaaggcggacaagccagaaacctttatacgatatattccagtacctgtggcgtaccattcgcgtgagcttaaccctgtttttgtcaccttttgttacctcgcaatagctaatgaaattaacagccgatctgcaaccagcggcagccattctcaagtcagaagttgccccctttctccagcacaacgaatcaatgctgcccatgtactccactgtcaccggcaaggcgataccaaacccggctgccctcgacgcagagcattggcagaaaaaccttga

SEQ ID NO: 9508 - DNA, 231 bp, A.fumigatus
agtttacgtctgcaacgcgtttctccatctttcaaaatggcgactgaagatcttatcactcttacatacaaagagcgtattgcgatcattacattcaaccgccccgagaagcttaacgctcttaatgcagacctctactacctgctcggtgagcggttacgggaaattgagaagcgagacgacattttcatcaccatcctgacaggaactggtcgttacttctccgcgtaa

SEQ ID NO: 9509 - DNA, 648 bp, A.fumigatus
cgtcccattagcggagcagacgtgaactccacccggccaggcggcggcctgaacagcgacacccggcgagagatcactcggaccttcgtcgtcaacaacctcgatctcacccgcactgtctacaaccaccccaagatccttgtcgccgcactcaacggtccagcagtcggtctctccgcagccctcgtcgccttcgcagacttcgtctacgccgccccgcacaccttcctccttaccccattctcctccctcggcctcgtcgccgagggcggcgcctcccgcgcctttgtagagcgcctgggaatctccaaggccaacgaagcgctcatcatgagcaagcggatcacctgcgaggagctggtggccaccggcttcgtgaacaaggtcatctccgctccgtccggtaaacccgatgactcggagggcttccttaagaaggttcttgaggaggttgaggatcgtctgggtacgcatctgaaccagtcgagtctgctcaagatcaaagagctcattcgtcgtccggagcgggagctgcttgaccgccagaatacttatgaggtgtttgccgggatggagcggttcgtgaagggttatccccaggaggaatttcgcaagttggcctcgggtgagaaaaggcataagctgtag

SEQ ID NO: 9510 - DNA, 474 bp, A.fumigatus
atccccgaagccgcaccagcgtgtgtgggctatcggacatcaacccttgggcggaacagaaccgacccacttttgttcagctgcttggaaattctgcagatgaagaaccctatcggaattaaggaagaggacacagatgctcccgaggaaagctttgttcgactgtctctcaacggagcaacccccacagtggtggaggtaaacagagatgaggactccgaatcagaaaaagatgttggaagcgcagacgatggggacgactcgccgttcctcccggaattccgtctcgtgaaacgtgatgacccagaggcatattcttttagtacgcctcagtactccgcgcacaagttgcccaaagaggttgttgatgcgtctcttgctgggtcaggtggcatgagtgagtttttgggtaaatggcaggacattctagccaagcagacacaggaggatacggacagtgacgatggacgatag

SEQ ID NO: 9511 - DNA, 834 bp, A.fumigatus
cccgtgacaacaatgaccttattcactacgaaccaccaaaccgccttcgccatgtcttcgcaccagtataccttaccaggcatgcatgatgtccccgagacctatccataccacatgagagtagatagcgaggaagacatggacagcctctacctgtccagtgcgccagagccctcatacacacgcctcgacttcgagccgaccataccagccatgccaacgagccaagcctacaacaccaccatgcgcgcacccatgagcggatcctacctcccctacagcgaccaatggacctcccaagtccccccaacggcagcagcggcacctacaacaacactataccaccccaccgacatctacccatcctcaacaatgacatacaccccgcaaagaacagcccccactgccctcaaccccaacccgcaaacctacttctacccggacccttcaacaaacaccaacctcgacctcgacctgaaactaccctcctcagacctcgacaccaaagacctaaccaactacggcatccccaaccccgacggctcctggagctgcgcctacccaggatgcacctcgactgcgacgttccatcgtggctgcgacctccggaaacacttcaatcggcaccggaagcatctgttctgtcggcacgagggctgtccgcaggctgttacgggcgggttctcgagcaagaaggaccgctcccggcacgaggcgaagcataaccccggggttgtgtgtgagtggccggactgcgggagggtatttagccgggtagacaacatgaaggatcatgtgcggcggattcataagaggggggaggtttactcttga

SEQ ID NO: 9512 - DNA, 252 bp, A.fumigatus
tcactagtttggttttgtcttttcacacctactatagggatgcttatattatttattagggttaataagtctaacccagacttaactaatactatagtaattagtttagcagaggtatccaaacatccatctatacagagctattacctgctaagtattactgtagttaggcaggaccttaagagtaatcttttacttacctacatcatcaaccaaggcactgtagtgcttggctggatagttagaaggtaa

SEQ ID NO: 9513 - DNA, 1047 bp, A.fumigatus
  unsure (371),(870): Identity of nucleotide sequences at the above locations are unknown.
atcgaccgcggatccttccagccccgtggtgaagaccctcccctttccctctggcatggcttcatgcctaccttcactaccacctcgtcaaacccagggcttgaccaccgcctctcttccccaatcctcgagcactatgtctacccaaccttcatcgccgtcgcctggtgtaacgccatcgacttgatcgtcctctgcttcaacaccttcaagcgctactccggcccctacttctggtccctcctcgtgtcctccttctgcatcatccccttcggcctcggctacgtcctcaagatctacagcatcaccttcacaaactacttcctcgagatcgccattctcgatgccggctggtcgggaatggtcacggngcagtcgctcgtcctctggtcgcggctgaatctggtgctcgacaaccgccgcgtcttgaaagcgctgctatacctgatcatcgtggacggggctgtgctgcacaccgcctgcaccgcgctggagtttgcgacgaacgccctgccgtccaatggcgtagctatcgcgttcgacgtcatggagcgcgtgcagcttgttggcttctgtctgcaggaattgctgctctcggggctgtatatctacaaggcggtgccgctgctgaagatggatgcggatcgtcgctcgcggggagtgttggtgcagctgatcgtcatcaatgcggttattatggcgctggatgtgtcggtcgtgattgtgcagtacctggggttgtttaccttgcaggttacctctaaggcgttggtgtatagcattaagctgaagctggagtatgttattctagggcggctggtggatgtctcgcgggtgcgctcgccggccgcggcgcggatgaggttatantttgttatatttcttgtctatatctatagatttctccttgtccatattatcttgtctatatataacattgtctatataaggttgtctactccgacctcgcgctcttggtcttcttgctcctcaacttcatcatcagaaacaccatcgcatagcttgaaacgcaaaagagcgccgtaa

SEQ ID NO: 9514 - DNA, 540 bp, A.fumigatus
aacgcaaaagagcgccgtaatcccggtctacgccgtcagtatcggtcttgttactcgcaacgggggaagacttacatctctccaagagtaataccgctccttcaggttaaacgtccgcgcatagtccgccccagtcgaatactgacagaactcacaagccgtcgcattcccatcaaccagatatcccggcttctcagccaggaacgcagccatgtactccccacacgtctgtcccagcggcgcacgaaatcgcaccagctcagacgggtcacagcgcacctccacatcccagaggacctcacccagcagcccgccaaccaggtacgtgaacggatcgaggtagtacagccagtcgcgccagaacggctgcatctgcgaaaagggcaccaccacgccgcagaagctgaccagccccgcgccgatcagcacggggttcatcaccgccgcgaagtactcgttgggcgcgtacgctgcgatcccctgtccgatcgacgtgtacaggaactcgtagaagatcatctgcagatacatgtgtcctga

SEQ ID NO: 9515 - DNA, 702 bp, A.fumigatus
agatccgcgtacaacatcattcgcttcctgaggaagctcgtcgacggcggccaggcggtgctgtgcacgatccaccagccctcggccgttctcttcgaggccttcgactcgctgctgctgctcgcgcgcggcggaaagatggcgtactttggcgaaacgggcaaagactcgcagaccgtgctggactacttcgctcgccatggagccccgtgtcctccggacgagaatcccgcagagcatatcgtcgaggtgattcaaggcaacactgacaagcccatcgactgggtgcaagtgtggaacgagtccgaggagaaacagcgcgcgctggcccagttgcagaccctcaacgcccgcggcaaagccgacgcggactacgtcgaagacacagccgactacgcgacgtcaaaatggttccagttcaccatggtgacgaagcggctcatggtccagctgtggcggtcgccagactacgtgtggaataaggtcattctgcatgtgtttgcggcgctgttcagcgggttcaccttctggaagatcggcgacggcacgttcgacctgcagctgcggctgtttgccattttcaatttcattttcgtggcgccagggtgcatcaaccagatgcagccgttcttcctgcataaccgagatatctttgaagcgagagaaaagaaggtactgtcgtatcccctatatactccttga

SEQ ID NO: 9516 - DNA, 192 bp, A.fumigatus
cctgaaggagcggtattactcttggagagatgtaagtcttcccccgttgcgagtaacaagaccgatactgacggcgtagaccgggattacggcgctcttttgcgtttcaagctatgcgatggtgtttctgatgatgaagttgaggagcaagaagaccaagagcgcgaggtcggagtagacaaccttatatag

SEQ ID NO: 9517 - DNA, 645 bp, A.fumigatus
tccaaaatctaccactggctcgccttcatcggcgcgcagactgtctccgaaatcccctacctcattctctgcgccaccctctacttcgcctgttggtacttcaccgcgggattccctaccacggccagcatctcaggacacatgtatctgcagatgatcttctacgagttcctgtacacgtcgatcggacaggggatcgcagcgtacgcgcccaacgagtacttcgcggcggtgatgaaccccgtgctgatcggcgcggggctggtcagcttctgcggcgtggtggtgcccttttcgcagatgcagccgttctggcgcgactggctgtactacctcgatccgttcacgtacctggttggcgggctgctgggtgaggtcctctgggatgtggaggtgcgctgtgacccgtctgagctggtgcgatttcgtgcgccgctgggacagacgtgtggggagtacatggctgcgttcctggctgagaagccgggatatctggttgatgggaatgcgacggcttgtgagttctgtcagtattcgactggggcggactatgcgcggacgtttaacctgaaggagcggtattactcttggagagatgtaagtcttcccccgttgcgagtaacaagaccgatactgacggcgtag

SEQ ID NO: 9518 - DNA, 237 bp, A.fumigatus
gctgcttgtgcgttcgtcggactcatggtccattcaccctctccgattcgacatgcgttctatgaaaccttccttcatctgcatattgccatggccattgtttcgatggttggcctttggatccacttggatggccttcccgctcaaacttacttgctcgtcgccatcatcttctggggtgtggaggtaggtcatcgcaatccctttcccgtaaaacttgaacaagctcggagctga

SEQ ID NO: 9519 - DNA, 885 bp, A.fumigatus
ctgtgcccacagcgcgccacacgagttgcgatcattgtatatcgcaactgcggaaggagggcgacaacggcggtcgttgaggccatgcccggcgaggcgatgaggatcaccctgaagatggcaaggccctggacgttcaagcctggccagcacatctacctctacattccctcgatcggtttgtggacctcgcatccattctctgtcggctggagtgagtcggaggaagttgtcacagacgagaagggcatgccgatgacccgccaggacgtgttcggcatgcagaagacgactgtctcgctgcttgttcgacgccgaacgggtttcacaaacaaattgtaccagcgtgctttgagcgcccccgactcgcgcgtcactctgaaggcgttcgctgagggaccgtacggaggcatccactccatggattcttacggcaccgtcgtcctcttcgccggtggtgtcggcatcacccatcaggttccattcgtgcgccacctagtcaagggatatgcggagggcacggttgctgcgcgacgagtcactctggtctggattatccagtcacccgaacaccttgaatggatccgcccctggatgaccagcatcctggccatggatcgccgccgggaagtccttcggatcatgctgttcatcactagaccccgtaacacaaaggagatccagagcccgagtgccacagtccagatgttcccgggccgaccgaacattgatacgctgatcggcatggaggttgagaatcagatcggagccatgggcgtgctggtctgcggaaacggcagcttgagtgacgatgttcgtcgcgtgtgccgtaaaagacaggaccagacgaatgttgatttcgtggaagagagctttacgtggtag

SEQ ID NO: 9520 - DNA, 414 bp, A.fumigatus
ctatcgtatgcattgaagtattcctcatctcgtgcaggtcgcgacttgcctggctcgacgcaggtcttcttcgcccatcagccgtttgcagacccgagtgaaaccctcgatcttcggccttggatggatcaaacgcctattacacttaacagtgggacgactttcttgatagtacgacgcatgttccagagattgggtctccgctatgtcctctttgcaaacaagggtgtcctccaaggcctgctcactaagaaggacgtttggtctattattgatggtgcagaatcccgcagggttgaagacctagtcactgattcattcaggcaaagaaatacggccgaggaggttggtttacttgaaagtgatgatggaacgagtcttgccagttccctggatagacgtccttcactttga

SEQ ID NO: 9521 - DNA, 255 bp, A.fumigatus
ttactttttgaggcaatcggactagttgagcattctgaaaactccagaaccgcaaccatgatggcagatcccttcgaggttcgcatgcgcttcactgcacagctgcagcatcttaatgcctccgtgacctcgtcacagaaggcagcgcattatgcgttgaaataccgcgacatggatgaggatctccactcctgtatcctggaacaactcgaaagggtatgtatgtctctactgccgtacaggagactactctaa

SEQ ID NO: 9522 - DNA, 645 bp, A.fumigatus
ttctctatgttttctcacattgtcacggcagcaaaaggtctatttgcacggcaagaagtcgacgaaaccaaactcgacaacagcaatacaacctcgacatcgtcaacaggtccaattggccgcaacacaaaaatggtgacggcaacgagaaggaggactctcgagacatcgtcgacagcttctggggatagcaagggtatgccaacctccgcaaatgggaagcgcaagcccgaatctacaagtgctgtaaaacccgaatcgcagcacaacaaacggagaaagagaagcagtgtagaggctgcggaagagcagaaaagagaattgtcgactgacggcgtcgtggctgagccagactcaaaacgatcagaggcacaggcggcttcttctaagacgaaacacttcagattcgacagcgaagagcctgaactgccggtggagatggaaaccgaggcgccagaacctcagcagaaggagcaggacaatgaagacagcagcgatgatgacgaagctcctgaagcgattgacaattcaactcagatgtccaagatcagactggaagctaaaaggcaagaacgagcaagacaaatgttagtatcccccctacctctaaagaacttctttgtctctaactcgaatctacagtga

SEQ ID NO: 9523 - DNA, 564 bp, A.fumigatus
aacaacatgaataatcgagccaacatcatgtacttcatcgagcaattttgcgaaatggccactaaggaaaatcatacaccctatgtccggatgatgcaaagagatattctacgcgttgttgatgctgttgtaccaccagatggatcaggagctgcaaacatcaagcacgtccggcgtgttctcaacggccttcagagtaaagatattctctcagccgaaacggtagctgagattgatgcggggctcaaggaacgggaggcccaggtggcacatctcgacttggatgccgaggaggagggcaataatggttcgaaagcgaaaggtggaacgccccgaggctccaggccgagtgggatgcgcgtggacaagaggcagatcgagcaacgtattgaagaagaccgtgaacggaataaaaggctgcgcgagagcatgtggacggtcagtggggatgatggtgacgaacatggcaagttctgggatgaagtcagtgatataggtgaggacgacttcctgggagcgcaggaggaactcatggagcgcaatcaaatggttgctgctcaatga

SEQ ID NO: 9524 - DNA, 654 bp, A.fumigatus
gtacctttcttcgcaacggcctcggattcagagcatttaatcctcttctgttttatttcgaaggatccatctgccttgcctaagatgcatttctctcccgcagcgattctcttcatctccgtcctcggtacacaagcagtgcccttggccttccccggactggaaagcaacacactcgtgcgcagacaagaagagacctattcagttgttaatgttggcggcaccagtcccaacggtgtcgataccagctcggtggttgagacccagacccagactgtgaccgctcctagcatccctcaggctcccgtaactgtcacggtgaccgatatgccaacatcgacatctacaccagtcatcacaccctcttcctgggccacaccttcgtccagctcatacattccatcatcaaaatgtctgacagcttggccgacaccttctcctgaggatgaccatcgcaaacctcctctgccccctaggagtttccggagagcgctctcgagcacaaacagtaccggccgtcatgttttcaatgttcgcagcgacaatgcaactgtgacggtgcctatctcagctcggactttgttgaacagcacaatcgcagctcgcggcggtgtctttgcgcgggctctcaaccagactggccatgtctactaa

SEQ ID NO: 9525 - DNA, 222 bp, A.fumigatus
ctacctaaaatcacattctatctattgacgcccatctatgtaacaaatttgttctctttcaataccaatatgtgcaggaacccaatcgatacaatggacaatctatcaactgagaacatcccagaaagtaaaagcaagagcgtgccgtatgtccgttccaaatataccatagcaagagcaagacgtcgaagctcgaattcgccatatggacacatcaagtga

SEQ ID NO: 9526 - DNA, 1599 bp, A.fumigatus
atcagcagagaacgagtcaccatgcctggccgtctcctttccagctttgttcgacccgctgctctccattcctctctcctttcacactcgaattcctcctcaacctcatccgtcaacgagattactactactaccgtggctcccaagaagccccatgcgcactctgatcgagcgaggtctccagagcgtcgcctgtcctttaacatggaccacctgattcaccctcaccgagaccacagcaaggagaagaagcgcagtcatggcagatcagcgcgctcaaaggagcgttccggcaaggaggatatcaccgccgcgccggccaagctggacgtcatcgtcgaatctccacccctcgtctgctacggaacccctgcaaactcgaccggcgcgttattttctgggcgtttaaggatcacagtctcagagcaagccaacgcagtcaccctagacaagttcgatatgaagctgctcaccaagatcaccaccaagaagcctgtgtcgcgggaatgccccaactgcgcatcacggaccgaggaattgaccagctggaacttcctcacagaatcgctcactctcaagcacggagagcatgatttccccttcagctatctgttccccggtcacttgcctgcatgctgcaatgggtcgctgggtcaggtggagtactacctttctgcgcgtgcgcacgacaccaacggcgaggagtacacctacagaatgccgttgcacatcaagcgcgccatactcccgggcaacgacaagtcatccatccgcatcttcccgccaacaaacctcaccggccgcatcgtgcttccgtccgtcgttcatcccattggcacgttcccagttcagatgacattgagtggtgtcgtggataagggcgaagagacccaaacccgttggcgtttgcgcaaaatgatgtggcgcattgaagagcatcagaagattatctcggcagcctgctccaagcacgctcacaagatcggtggcgaaggaaagggtgtcctgcaccaagagactcgcattatcggtcacaaggaagaaaaggacgggtggaagacggatttcgacaccgctggcggcgagatcagcatgcaatttgaggccagcatcaaccctacctgcaacccagtgtgtgacctggaggtgcccaatggccttgaggtcaagcacaacctggtgatcgagttgatcgtcgctgaggagttctgccccaaccgcaacacacgctcgatcacacctacaggcgccgcacgggtgctccgtatgcagttccacttgcacgtcactgaaagaagcgggcttggcatcagctgggatgaggagatgccccctgtctatgaggacgtgccagcaagccctcctggatacactatgctcgatggtaacagcatcatggaggactatagtggatctcccctctcccttccagattatgaagagctggaacggatggagtctctgcatctggactccgactcagctggctctgtccgcgggcggagtcgactcaccaccgaagacctgactgcagagccaatggaaccagggagccgaagccgcggtttatctgccgactctggtgcatccgagcattga

SEQ ID NO: 9527 - DNA, 189 bp, A.fumigatus
agcgccctgacggcagggaaattatcggcctgcactgcgtactatagtgagggcggtctaagcttggcccatacttctgtcatccaaaagctgggtgactcctgcgttgtccttgcgtcggatttatttgacaagcgcgcgttctttgccagttcgccgcgcgggtgccacattataggtggtctgtag

SEQ ID NO: 9528 - DNA, 354 bp, A.fumigatus
  unsure (16): Identity of nucleotide sequences at the above locations are unknown.
gcccagccgggaccgnttcgctttcaattcggtctcatttgtgagcatttcacgctggagcgccacgggaaggtcaagcctagcctgtttctgctgtggacgcatggtcttgatgggcggaaagacgaacttattccttttacctatgttcggggcagtgggcctgagttctggtacattgatctcgaggatcccaggacactgggtgctcctggtcagaagctccaagtggcggcgcttactgagtttggagatcggaaagactgcagggggatctctgtggatgaatacaaggctaatgttggacgggttcgtatggcgttttcatttgttgccgaatgggcccttgtttga

SEQ ID NO: 9529 - DNA, 222 bp, A.fumigatus
attgacaggcacagatattctgatgaccagtttgagtaccgacatgttcagcttcccaaaaacatgctgaagaagattcccgccgactatttcgatagctcaaaaggaacgctgaaattgctatgggaggaagaatggagggcactcggtatcactcaggtactacgaagtggactgcgaaaactcgcgtctatcagcctgtggctaatcttgatgctctag

SEQ ID NO: 9530 - DNA, 1419 bp, A.fumigatus
agaatacctgaactcgtagaccataggaatacaatgaacgaaacaccaacagcaacaggtctccccatcgccttccatggcacgatcatccactccctctcccccacccacctccaaatcctccccaacacgttcctcctcgtcgacatcgctggcaacatccaggctctggtccccaacaccgacccctcaaccatcaacacgctaatcgtagacaatggctacgcaccggacgtcttccccgtcaaacacctccccagcagctccttcctgatcccaggcttcatcgacacccacaaccacgccccgcaatgggcacagcgcggcgtatggcgcggcatctccctcctcgactggctcgagaaagtcaccttcgcacacgaagcgaaattcgaggacgcagagtatgcaaagcgcacgtacagcgccgccgtggacgggctcctccggcagggaatcacaacagcaagctactacgcctccaagcatctcgccgcgacgaagatcctagcggaggtatgccgctccaagggccagcgggcactcgtcggtcggtgcaacatgaaccggcacgcgccggggtggtaccgcgatctcaacgcagaggtatccgtcaaggagacccgggaattcatcgtgtggatgcgcgagttcaacggtaccgacgaccgaccgctcgtcaacgcggtgatcacgccccgcttcgcgatctcctgcgatgaggaggtcctctccggtcttggggcgctggcggccgccaacccggacctgcgcatccagacgcatttcaacgaggcgcagcaggagatggagtttacgaggcagctgtttccggacttcgcgcacgaggcggagctgtatacgcggtttgggctgctgagtgagcggtcgatcctggcgcattgtatcttcctgcgggaggaggagatggagacgctagcgcggctgcgatgtggcgtggcgcattgtcctgttcccaatacgacgatgcaggcatttatggttgcgccggtgcgggagtatctgcggagggggatcaaggtcgggttgggaactgatagtggcgggggtcattcgatctccatgctggaagtcatgaagcaggcgtttgtggtgtctacggcgcgggcgacggagacccgtggcgcggatccggcgttgtcggtggcggagtgtttcttcctggcgactttggggggtgcgcaggtatgtgggttggaggagagggttggtaattttgctgtcggcaaggagtttgatgcattggagatacggactggggagggggtggagatgagtgttatggcgccggtggaagaagaggattcaattgaggtcatctttgagaagttcctgatgacgggagatgaccgcaacattgccaaggtgtatgtcaggggacgtgctgtcaaggattaa

SEQ ID NO: 9531 - DNA, 243 bp, A.fumigatus
gtcaggttcgtctctgtggtgctgtttgtactgactcgctcagatttcgttctgtctgccgctctcgattctggcgtcgccgtggctaccgtcatcattttcttctgcatcatgcttcctgccggcccattacactggtgggggaatatagtgtatcgcaagactgcagacgggatgggaacgcctctcaaacccttgccatctttgggatactttgggccaccgaaagggaaatgggaatag

SEQ ID NO: 9532 - DNA, 348 bp, A.fumigatus
gtgcatccatgccactccaaaactcgtgctgacagacaaggcgccctgggtcctggacgaaacttttctccaggtcaaatctatggtaaccttctctggttctttctcgctggacctgtagtaattgtcatcacctttctccttggacggcgatggaagaggtttaacaagatatcatggcctgtcgccttcggagccatgagtcttgttccgcctgcaacagggatcaatttctcttcgtggtgggtagtcaatgtactcttcaatgggatcatcaagcggaggaagcctgcatggtggtccaagtacagtgagtcaggttcgtctctgtggtgctgtttgtactga

SEQ ID NO: 9533 - DNA, 348 bp, A.fumigatus
ctgtctagattcgtggccgatatgaagctcgcgcattatctccacatcgccccacgcacgctgttcatggctcagggattagctaccctcgtaggagccatcgttcaatgcggtgtcaccgtctttatggtcacaagatttgacaacatctgcaccccagatgctgatggtggattcacctgtcctcatggtcgagtaacatattcggcttctttgatatggggtaagtgcatccatgccactccaaaactcgtgctgacagacaaggcgccctgggtcctggacgaaacttttctccaggtcaaatctatggtaaccttctctggttctttctcgctggacctgtag

SEQ ID NO: 9534 - DNA, 606 bp, A.fumigatus
gcgcgcgccctcgaggcgagcagagagtcgcgcgcgcgagggcgacgaagggagggcgaggagggcgaggagggcgaggaggaggaggagggggaggcgcgcaggcgagcgcgcggcggccagttggctggccgagttggcgcggcggggggcgccgcgcgggcgggcggcagggtgaccagttggcgggagccccttgggcaggccggccgccggcaggcaagggcgcgcgccatggacagacgctggccgagcgacacactcgcaggcaccgggggtgaccagttggccggcgcgcgccagggaccgacaccgggtcgagagacacccagacggacacgggaggcgccagaggtgaccagttggccggcgcgcgcgcgcccttgtcggcaccggagagccgcgcgccgtctacggggacacttgcagcgacacgcacatggccgtcggcctcgacggatgccggcatggcccgccggcggcatccatccgtggggatacgcagacacccacccatccatccatatatatatgtgcatatgcacccgcatccccccccgacatctgcacggaggtaggtcggcatggcccaccggtgccatctag

SEQ ID NO: 9535 - DNA, 711 bp, A.fumigatus
acggcgcgcggctctccggtgccgacaagggcgcgcgcgcgccggccaactggtcacctctggcgcctcccgtgtccgtctgggtgtctctcgacccggtgtcggtccctggcgcgcgccggccaactggtcacccccggtgcctgcgagtgtgtcgctcggccagcgtctgtccatggcgcgcgcccttgcctgccggcggccggcctgcccaaggggctcccgccaactggtcaccctgccgcccgcccgcgcggcgccccccgccgcgccaactcggccagccaactggccgccgcgcgctcgcctgcgcgcctccccctcctcctcctcctcgccctcctcgccctcctcgccctcccttcgtcgccctcgcgcgcgcgactctctgctcgcctcgagggcgcgcgcctaccgggcccccagcccccctcaaccgactcccctcaaccgggaccctcgcgcgcgccgccggcggcccttctcctacacatacccaccgacctcgcccggcccatcatcgtgcgcgcaaacgttcccgggtccgaacgtcgttccggggggaggcccacctgcgccggcagaccgcgcgccgcccgtgcggccatgtgccccagccaactggtcactgcccttcgtcaccaggcggcggcggcgcgcgggtcccccgcgcgccgcgtcctcaaccgcccggctggaaggtactacctg

SEQ ID NO: 9536 - DNA, 900 bp, A.fumigatus
atggcaccggtgggccatgccgacctacctccgtgcagatgtcggggggggatgcgggtgcatatgcacatatatatatggatggatgggtgggtgtctgcgtatccccacggatggatgccgccggcgggccatgccggcatccgtcgaggccgacggccatgtgcgtgtcgctgcaagtgtccccgtagacggcgcgcggctctccggtgccgacaagggcgcgcgcgcgccggccaactggtcacctctggcgcctcccgtgtccgtctgggtgtctctcgacccggtgtcggtccctggcgcgcgccggccaactggtcacccccggtgcctgcgagtgtgtcgctcggccagcgtctgtccatggcgcgcgcccttgcctgccggcggccggcctgcccaaggggctcccgccaactggtcaccctgccgcccgcccgcgcggcgccccccgccgcgccaactcggccagccaactggccgccgcgcgctcgcctgcgcgcctccccctcctcctcctcctcgccctcctcgccctcctcgccctcccttcgtcgccctcgcgcgcgcgactctctgctcgcctcgagggcgcgcgcctaccgggcccccagcccccctcaaccgactcccctcaaccgggaccctcgcgcgcgccgccggcggcccttctcctacacatacccaccgacctcgcccggcccatcatcgtgcgcgcaaacgttcccgggtccgaacgtcgttccggggggaggcccacctgcgccggcagaccgcgcgccgcccgtgcggccatgtgccccagccaactggtcactgcccttcgtcaccaggcggcggcggcgcgcgggtcccccgcgcgccgcgtcctcaaccgcccggctggaaggtactacc

SEQ ID NO: 9537 - DNA, 909 bp, A.fumigatus
ctggctagatggcaccggtgggccatgccgacctacctccgtgcagatgtcggggggggatgcgggtgcatatgcacatatatatatggatggatgggtgggtgtctgcgtatccccacggatggatgccgccggcgggccatgccggcatccgtcgaggccgacggccatgtgcgtgtcgctgcaagtgtccccgtagacggcgcgcggctctccggtgccgacaagggcgcgcgcgcgccggccaactggtcacctctggcgcctcccgtgtccgtctgggtgtctctcgacccggtgtcggtccctggcgcgcgccggccaactggtcacccccggtgcctgcgagtgtgtcgctcggccagcgtctgtccatggcgcgcgcccttgcctgccggcggccggcctgcccaaggggctcccgccaactggtcaccctgccgcccgcccgcgcggcgccccccgccgcgccaactcggccagccaactggccgccgcgcgctcgcctgcgcgcctccccctcctcctcctcctcgccctcctcgccctcctcgccctcccttcgtcgccctcgcgcgcgcgactctctgctcgcctcgagggcgcgcgcctaccgggcccccagcccccctcaaccgactcccctcaaccgggaccctcgcgcgcgccgccggcggcccttctcctacacatacccaccgacctcgcccggcccatcatcgtgcgcgcaaacgttcccgggtccgaacgtcgttccggggggaggcccacctgcgccggcagaccgcgcgccgcccgtgcggccatgtgccccagccaactggtcactgcccttcgtcaccaggcggcggcggcgcgcgggtcccccgcgcgccgcgtcctcaaccgcccggctggaaggtactacct

SEQ ID NO: 9538 - DNA, 444 bp, A.fumigatus
tggaaggacggcgccggaggctggatttggtggaacactgatgatgacgttcatgacggggttcccataaggggggtttctggtatgggctggggtgggcgaggggaggaggtcgcggagtgcggcggatgtggcgaggcgggctgcggcggagagagcggagggggtggtgtcggtgccgaagatgtgtgtggatgggtcgaggtggagcgtaacgcgggtgctgtgcatggggaaggtgaattggggcccgcgcgcgagggcagccagacacccgttttgcagggctgtgcgcaatgtgtgtacgtccaggcctggcgggaggaaggggctctcctcggtgcctttcttggtgtgttcgatctggaggtcgggggcgagaatgatgatttggttcccgtcgcgggtctcgacagcgagagcgtccggttctggggctggtga

SEQ ID NO: 9539 - DNA, 417 bp, A.fumigatus
tcgagccgttcaaccgagacacatcaccagccccagaaccggacgctctcgctgtcgagacccgcgacgggaaccaaatcatcattctcgcccccgacctccagatcgaacacaccaagaaaggcaccgaggagagccccttcctcccgccaggcctggacgtacacacattgcgcacagccctgcaaaacgggtgtctggctgccctcgcgcgcgggccccaattcaccttccccatgcacagcacccgcgttacgctccacctcgacccatccacacacatcttcggcaccgacaccaccccctccgctctctccgccgcagcccgcctcgccacatccgccgcactccgcgacctcctcccctcgcccaccccagcccataccagaaaccccccttatgggaaccccgtcatga

SEQ ID NO: 9540 - DNA, 555 bp, A.fumigatus
gggcaaagccggctgcacggccctagtcgagccgttcaaccgagacacatcaccagccccagaaccggacgctctcgctgtcgagacccgcgacgggaaccaaatcatcattctcgcccccgacctccagatcgaacacaccaagaaaggcaccgaggagagccccttcctcccgccaggcctggacgtacacacattgcgcacagccctgcaaaacgggtgtctggctgccctcgcgcgcgggccccaattcaccttccccatgcacagcacccgcgttacgctccacctcgacccatccacacacatcttcggcaccgacaccaccccctccgctctctccgccgcagcccgcctcgccacatccgccgcactccgcgacctcctcccctcgcccaccccagcccataccagaaaccccccttatgggaaccccgtcatgaacgtcatcatcagtgttccaccaaatccagcctccggcgccgtccttccactacatctccgcctcccgcgggcgggcaaaatcattctccctccgaagaggaacctccccct

SEQ ID NO: 9541 - DNA, 2475 bp, A.fumigatus
tactcggtattggttgcagctcctatcgtgcgcagctttccccaggtggtacgatccaatcgtccaagagcagctgttgatgatgccagacgccttggggtgaggacaggacggaccacgatctctgacaaaatctgtgtgcttcggagtcaatacgaagcgaagggtttctcgacatctacatcaagatggcaagagaaaattctggaccgaacaaggaacattggtatcatagcccacattgatgcaggcaagacaaccaccacagagcgtatgctctactatagtggctttaccagaaggataggggacgtggacgagggatctacagtcactgattttcttccggctgagcgtgcgcgaggaatcactattcagtctgcggccattaccttccactggccgccaactgccggggagagtgataagcaagaagtgcagacccccagatctgcgtcatcacatacgatcaatctgattgatactcctggacacgcggactttacatttgaggttctgcgatcgttgcgcatcttggatggcgcagtctgcatactggacggtgtagctggtgtcgaggcgcagacggagcgagtctggcaccaagcaagcacttatcgcattccccggattgtctatgttaacaaactagacagagacggagctgcatttgggcggacggtaagagaggtaggctccaggctgggggcctttccggctgtgtgccaaattccctggtttgaaaatggcaatggtcgctttgtcggggtagctgacgcgatcaacctacaaggccttcgatgggaagagggggatggcaaggttgtcaagatgctgagcctcgagcagctatatgctgaggaggcccaactcggtaaggagctccgacgtgcccggatagcgcttgtcgaactgctgagcgagcacgacgaggcgatggtggagaaattcctagaatgcgatgagaaccatcttgccgttcctccgcaggacatcttggagagcctgcgtcggtgtctcctcgaggagtcaggaagcaacatcgtcccgatttttgcgggcgccagcttccgcaacatcggagtccaaccccttctggatgccgtggtgaacctccttccgagtccgctcgaggcccccgatccggaggtcagcattggaggggttcaaggagggttgcagcgccttctctcgggagaactccttgtggagtcgggcgaaaagtcccaatctcccaaaggcaagcagagaaagtctgtcgcgcatgccgagtcccagaatgtgatgaagaacttgcaaggatgcgccctggccttcaaggtagtcaacgatgcaaaacgaggggttttggtatatgtgcgcgtgtactctggatccctggaccgcaactgcgttctgttcaacaccaacctgaatgtctcagagcgcgctccgcgcttactcaagatgtacgccaacgatgcggtggaagtggattcgattccagaaggacacattggtgtcgtggtcggcctcaaacatgcccggaccggtgacaccctcgtctcctacgcggggaacaaaccgacacctccaaagccactgaatacattgcagttgcgacccatcaacgtaccgcctcccgtcttcttcgccagcgtagagccacacagtctgagcgaagagaagaaggtgcaggaatgtctcgcgctcctattgcgagaagaccctagtctgcatgtagccgtggacgaggactccgggcagaccctgctgagcggaatgggcgagctccatctggagattgctcgcgatcgcctgatcaacgatctcaaggccaaggcaaccatgggtcgcatcgagatcggctaccgcgaaacgcctctgggcccgtcccctgccgtgaccaagatcttcgacaaggagatcgccggccgtaagggcaaagccggctgcacggccctagtcgagccgttcaaccgagacacatcaccagccccagaaccggacgctctcgctgtcgagacccgcgacgggaaccaaatcatcattctcgcccccgacctccagatcgaacacaccaagaaaggcaccgaggagagccccttcctcccgccaggcctggacgtacacacattgcgcacagccctgcaaaacgggtgtctggctgccctcgcgcgcgggccccaattcaccttccccatgcacagcacccgcgttacgctccacctcgacccatccacacacatcttcggcaccgacaccaccccctccgctctctccgccgcagcccgcctcgccacatccgccgcactccgcgacctcctcccctcgcccaccccagcccataccagaaaccccccttatgggaaccccgtcatgaacgtcatcatcagtgttccaccaaatccagcctccggcgccgtccttccactacatctccgcctcccgcgggcgggcaaaatcattctccctccgaagaggaacctccccctt

SEQ ID NO: 9542 - DNA, 573 bp, A.fumigatus
aattcaggttcgttgtcttgggcttccctggggatgttaaaaattaccatggccaatcccatgccaaaggatcaaggatatggccatggtttatgtaataagaataagtgcctcgttcaaaaaagggcttctgttaagggaaaaagggaaattaaccccctggaaggtcccccaagaaacgaggcgaatccaccagcaactcaccaaaaaaagcagccgaccaagcaagccaagaaagcagcaggaaccgctccccagctaatcatcttcaaaatgaagttcattgccgtcgccaacgctctcatcgtggccctctgcagccacgtcgccctggcctctaccatcggccacccctccctgatgccgcgcgaggatgccctcagcgacaacaacaacaacagcaccgtcgcgactccctacggcaacgttgtgagcaccgtcctcgacgatggcaagaagaaggtggagttcttcgatgtcgatggcaccctggaagttaccgccatcgaggccgctgacggaagtacgcctttggctccctccatcactcctttcaagatacacgtaaactga

SEQ ID NO: 9543 - DNA, 513 bp, A.fumigatus
cggaagtacgcctttggctccctccatcactcctttcaagatacacgtaaactgacagacccagctgctatcttctacgacgccgagggcagggaagtcaaccttgcagacatggacgaggacgacgacgacgaagacctcgagaagcgggtgcccaagtggaggctcgccatcaagttcgccaagctgattgccaaatatggcaagcgggcctggtcctacatctactgtgtcggtactgctccattctggaagtgcggcgacgaggtgagtactcctgctcagggggaaagattgtggctgatgagataccgtagttccttgactgtgctactgctggccgcgctccctggaactgctacgagggagccatctgtgttggatggaaagttcacaagcactgcaagtagatgcgtgcaagtcagacgcatattgtccaggggacttgaaacttggccgcagacagtatatacggagtgttgcctgtttctgaattctgacatggctctgtga

SEQ ID NO: 9544 - DNA, 252 bp, A.fumigatus
aagcgtttttccacgtttgcagtccttggtgcatctgatttttatcacagcggtctcgggccgcaaccctccaagctcgaaaaccgcaattcgaggggggaaacgctgaatctccggcaagccttgaaggggttcgttcatacaaggacggtttacagaatggcggcggatctcgataccggcaagatcaagaactggcgttccatcgtcacacttattgttttcattatcactagtatgtctgctagatga

SEQ ID NO: 9545 - DNA, 690 bp, A.fumigatus
atgtggaccgcatcggatcctaagcgactgactcttgcagatatcatcgtacttttccccttccatatccccatctacgtcccacgcgctttctcaaatgcagtgctggattttttgagcaaattgcgaattatccctccgagggaaaatcgctttcaacccgacgatcaggaagacgccaatggcaaacttaagccatatgtgcgaatgaactttcctcttaactttgtcacagcaccgctcattgcagacctgtttctgctagcgattatggcgatcggacgggaggaagtgcgtggtggcacgcttggggccgacaatatcatcccaatcgatatcatggccttcttcctaactctggcttatatcgctatctccatcgatgcatccggtctgattaggtacctggctttcaaagtccttcaaaaaggtggtagggtcgggcaccggctcttcttttacctctacgcctttttcttcggcctaggaagcttcattggaaatgatccgattattctctccggtaccgcattcctcgcctatatgactcgagtatcaagcaacatcgtccatccaagagcctggattcacagtcagtttgctgttgccaatatcgcctccgcgatccttgtctcctcgaacccaaccaatctcgttgctaacgggggccttccaggtcaaattcattga

SEQ ID NO: 9546 - DNA, 1008 bp, A.fumigatus
ctcgagtatcaagcaacatcgtccatccaagagcctggattcacagtcagtttgctgttgccaatatcgcctccgcgatccttgtctcctcgaacccaaccaatctcgttgctaacgggggccttccaggtcaaattcattgagtacactgctaacatgattgttcccgtcgtggtccccgctattgtcttgtttcccttcctactgtacatcatcttcgcggatgaatccctcattcctccttccatcaagatgcacgagctcacagaagaagaaaaagagaagaagcccgtaaaccccaacatacctcatgcgaggggaagggccgatgagcaagaagacctcgcggatgatgaacaaaagctctctcttgaagagattatgaatccttttcttgataaagggggtgctgcatttggagctctcatcatggcggccacgctcattactctgctagccctcaatgcctctagccaaaagggccacccgaaacccgtttactgggtgaccctgccagctgcgggggtgatgctgtgctgggaccttgcgtttggatggtaccaccgccgtgaaacacgcgagattgcccgtaaaggccgcgcagaaattgaacaggcccgagcagagcgtgcccttagggatgaggaaaccatgcgcgcacaacagattgccgaggcatatgaattcgccgaatcgacagacgctcgattacagaaagagccccaccctgaagcaggcaccgataaggggaatacggcctatgtcacaaacatacggccatcagatcgagcttccaccggcttttcgtcccaaatgtcggatggccaaagccagacgctggcctctccactagaatcatccatttcgacgctggcacccaaggatgatccgttgcagaacggacaattcacaaccgacgccatgagcacgctgaacgaaaagcaggaactccccacatccgcgtcttcaccacggggctggaaggatccgcggctggcgctattgaac

SEQ ID NO: 9547 - DNA, 690 bp, A.fumigatus
gtgattgcaacatacctagccactaaatatctgcttttgttggccaccactggtgcagatatggccagaacaaacaagcgcaagcgcagagaagccgactgctcagatgatgaggatccagtcggacatccttccggtaatactaatggctttggagtagcccgaactctatcacttctccacgacgcaaaaccacaagcggcagacgacagcgcgatagctactgcaggttctgatgcgacacctacagaaggagcccatgatcaggcgaaagacggtgtatcggtgcaaagacccacgaaaaagaagagagttgacggcgaaaagacaaaatatcctgttcttacctatgtggaagggcgactgcaatcctccatccgcatctcggatctccaaaacctattgctgtactgtttcgcggatggcattgcaccgcagtggatttccatcaaacattcgggtcatattagaaagattgtcgtgttgatggttcccggtttagaaatggggatgtttgacgggactgttccgttgaaaccgcaacctgaagatgaggattcacgatcgtctcaagcttccaacgcagagcagaaagaccccgatgctaacaagtcggccgaagaagacgaagacaaggccaacttccttcgctggaaacaaggccttccgctggaagatcgatcgcaccga

SEQ ID NO: 9548 - DNA, 984 bp, A.fumigatus
  unsure (5),(16),(69),(169),(312),(788): Identity of nucleotide sequences at the above locations are unknown.
aatgntttaaagaggngaaaagcaaaccctcctgaatcggatacgggcacgatgaggcgtcgattcttntgggacaacaagactatggaagagagacagtactggttctcgtacgaggattacatgaataacgaaacagcattcataaagtccatgcgccatctagctntgatgggcatcatattcgttaagaatatccctgactcgcgggagatggttgagaaaattgcaaccaagatggggcccctccggaacaccttttatggaccgacatgggatgtccgcagcgttcccaaagcgcccaacgtcgcntacaccaacgtcttcctcggattccacatggatcttatgtacatgaacgagcccccgggcttccagctgctgcattgcctcgagaactcatgcgaggggggcgagtccctgttcgtggacggcttccgagttgcggaactaatacgttggaaatacccagagcaattcgaagatctgaccaagctgcgcctgaactacgaatacaaccacaaggaacacatctacaacaacagctggcctgtagtggagacggaagacggcgacccgaagaagcgaatccttcacgtcaattactcgccccctttccaagcgcccctcctctcggacgataaccaccaaatgccctggattgagtacagtcgggctctacgggcttttgcgagggaaatcgaacgcccttacaatgtcttccagctgaagttgaacccgggcgaatgtgtcatcttcgagattcggcggattctccacgcccgtanccagttcaacaccgacaagggtaagcggtggctgtcgggcacctacgtcgacgaggacgacgtcctctccaccttcagaaagtgtcgtaacacccagtaccatacctggcactggacaagggttacagggcccaaacatgcgaccgaggcggccgcgaagggtgaagctatcgccgcgaatcacagaaccgagtaa

SEQ ID NO: 9549 - DNA, 642 bp, A.fumigatus
ctccccgttaatcaaaaggtctgttccgtcaggcaatctaaccccacgacttgtgccccgcgacattctctctcaagcaccatgtcgacgctcaacgaaatcacctcggacgccgacttctcggcacacacctcctctctccctccctccaccttactagtcctctacttccatgcgccgtgggcagctccctgcgcccagatgcgcgccgttctctccgccctcgcctcccagcacccggttactaccccgcccaccatctcctttgtgagcgtcaacgctgaagaactccccgacatctccgaagagtacaacgtcacagcagtcccctacgtggtccttatccgcaacggccagatcctcgaatccatcagcggcagcgacgccgtcaaggtgcgcgatgcggtcgagcgccacgcgggcgctggatcgggcgcgggtgcagacggcgcgaacaagacggctatccctcctcctttgacggctacgcctcgcgagaatgcccctgcggctgctgcgcaaccggccgctccctcgacccaggcattgacgcccgagcagtccaaggaggcgctgtttgcacggttggcggagctggtgaaaggccgcgccggttatgctcttcatgaagggtacacctag

SEQ ID NO: 9550 - DNA, 327 bp, A.fumigatus
aaggccgcgccggttatgctcttcatgaagggtacacctagtgcaccacagtgcggattcagtcgccagttggttgccatcctgcgggagaagagcgtcaagtacgggttcttcaatattctggccgatgaggacgtaaggcaggggttgaaggagtttgcggactggcctacatttcctcagttgtgggttgagggcgagctggttggtggactagatatcgtacgttcttctatcgtcgctcctgcggctcgaaagtcattgctaactgatatgtttttgccacacaggtcaaggaagagatcaacaacgaccctgatttcctga

SEQ ID NO: 9551 - DNA, 840 bp, A.fumigatus
cggtgcgttgccaaggcggtcagcaccccaaagaatccgcccaaattctttccatctagcacactttccgatcattttactagcggacggtgctctatcgggctacgatttccctcatcagcagtcttttgtcggctgtctacacttgatttcctactgtcatgccattgctcatgcagtttctataacttgattatcaaaatggcaggtctccagagtcgctccgccatgactctcccctcctccctctccgcagcttttcgcaacctctcattatcagtcccgacgcgctcgttctctacgacattggctgcgcaaaaaacgaagcaattaccggattatattcctccttatccctatggacccaactacattttcaagcaatctaactccggtctctatggtggggctatgatccagttcggaaacaagatctcgaagggccgcaatgagggtaaaacccgacgattctggaagcccaacgtcaggcggaagaagctctggagtgaagccctcggagagtacctctttatcaaagtgacgcgaaaggctctgcgaacaatctggaaatctggcggtctcgacaactaccttctggacgaccggcctggccgtatcaaggaattgggtatcttcggctgggagttacgatggaaagtgatgcagacacctaagatccaagagcaattccgccaagaaagaaaacgccttggcctccccgagccaccgtcgttcgaggagtgggtaaagcagaaggaggcagaagtcaaagccaaggtggaggaagagatcaacatcaaggaagctacgaaaccaacatacaacgagaaacagtactag

SEQ ID NO: 9552 - DNA, 267 bp, A.fumigatus
caggcgtgcggtgtcttcgtggatttgatcaaggcgaagaaaatggctggacgtgcaattatgcttgcaggaggaccaggaactggaaaaactgcccttgctctggctgtatcacaggaactgggaaccaaggtcccgttctgccccattgttggcagcgaaatctactcagctgaggtcaagaagaccgaggccctaatggaaaattttcgaagggcgattggtatgctgtttcagacgcgtctttcgggctggggttgcgattaa

SEQ ID NO: 9553 - DNA, 237 bp, A.fumigatus
gaagatcctttcagcttccaggccaggccgcaatacttcgccatggttcagatcagtgaagtgaagggcagttcgcgcgagaacagaacagcagcacacactcatatcaaaggccttgggttacgtccagatgggactgcggagccctctgctgatggattcgtcggtcaggcagcagcccgcgaggtgggcagcattcaatttttttcctcgtttggtaagatgagcttgggctaa

SEQ ID NO: 9554 - DNA, 489 bp, A.fumigatus
tggaaaattttcgaagggcgattggtatgctgtttcagacgcgtctttcgggctggggttgcgattaacaagattttaggcttaagagtgcgcgagacgaaagaagtgtacgaaggagaagtcacagaactcacgcctgaggaagccgaaaacccccttggcggctacggacgtaccatcagccatttgattatcggattgaagtctgccaaaggaaccaagaagctgcgtcttgaccctagcatttatgaggcaattcaaaaagagcgtgtgaccgtcggagatgtcatctatatcgaagcgaacactggagcttgcaagagagttggacggtccgatgcatatgcgaccgagttcgatcttgaggcggaagagtatgttcctgtaccgaagggagaggtacacaagaagaaggaaattgtgcaagatgtgacgcttcatgacttggacatggccaatgcacggccacaggtggacaggacgtcatga

SEQ ID NO: 9555 - DNA, 681 bp, A.fumigatus
cgtagagagacatgtactaatctactctatcagcccaagctcacagaggaagagcttacccgacgcatcgctgccgccaaggagaacgccgctaagaaagctgccgcatatgctcgcgctgaggctgatcaggcgtcatttctcgaacgcgagaagattgcagaagagaagcgcctccaggaacgccagaatcgccgtgcaatggactccgaacgcgagcgcaaccgcttgaggaaactcgaagctttgggcggaagggagtgggacgcgaccaagcgtgaagaagactacaacccccgtggtggtagaggtcaattccggcgtggcatgcacggaggagtctctggttacgtccgacgagatttcgatgacgcccgcacggaggaggaccaagagggacgccatcacctcaaccaccgcggtcgaggacgtggtggaagaggtgggcgtggacgaggagcttctcgggctgcgccttttgatggcgcgtcagatgaagctgctgctgcagcctctccagcccctccggttttgaataatgaacaagagttcccagcccttcctggaggtcataaaccaacggacaagacggtctctgatctcgcagataagcttgagacctcactgtccccagtgtcaggcgccacgtgggcagagcaagttgagtcgcaacgggattaa

SEQ ID NO: 9556 - DNA, 192 bp, A.fumigatus
gctaccaaccccaagtcatcgatgggagagttcctgggcctgagttcgcagaagggtgccgcgagctcgaactttgagcagcgggctcagggagcgtctgaaatgagtgccaaagatacgtcgtgcgataccgaggatcatagtttcatggaacatgggcctggttttcaactcgcactgccgacatcccaa

SEQ ID NO: 9557 - DNA, 189 bp, A.fumigatus
ccaccaaccacaatgggagacagaacagccgacaacgccgtcaaccacgaaagaacctcaactcagggcggtgccagctccaaacccacacccgccaacaatgcaggcggtggatcgggatggggcgacaagggcttcttcaagggaggcacaggcacagaggggccgggccatcaggccgtaagttga

SEQ ID NO: 9558 - DNA, 699 bp, A.fumigatus
cttgcaaacagacgttgcacggtctgctttaacagcgaatctattaaaaatgtggagattctcccttgccagcacatatactgcgattattgtttcagccgattggcactcacagccatggcaaacgagcagttgtttccgccgaggtgctgctcgcagatgattccgacggaccaagtcctctcgaaactgacagagaaggagaaagccctttttaagctgaaagcgcgggagtatgcgacatcggccagagaacgccggtattgccccgcgatgaaatgcgggaaatggataccacttgagaagttggaaggtcaatcaacggcacagctctgcccgtattgtggcactgccatctgcccgggctgtaaggacaaggcacatgcgcctggtaaatgttccttcgaccctgggctgactgaatttctcgaactcgcgaggactcaaggctggcagagatgttttcactgtggggcgatggtcgagcttaatgagggctgcccacgtataacttgtagatgcggtgcagatctttggttcgtcctaacccttacttcatccttggccgttcgagatactgacgcagcaaagctacaactgtggtggaccatggcttatctgccatcacaacgccttagggaacgtaatcgccgaatgccaaaccggcgcgcctctcgaagacggagtgggaacacatga

SEQ ID NO: 9559 - DNA, 399 bp, A.fumigatus
agaatttcattttttcgtactctagagcggcaattaccatcgtctctcgccatgttctcatcttctgtccggggtgtggcccgcgtatgctcatcaattacctctcgtacctttaatacttccaccgccgcctatgctgccgaggttaagtccctgggcgtgatcggggctggtcaaatggtgagcatgcttccatactgtaactttttgtcaagtctaatgctaagtgatctgcacggtctgggtatcgctcttgttgatgcttcaaaggctcacgttcctgttaccctgatcgataatacacaggcggctttggacaagggtctctcattcgccggtatgcttgatacagcccaattgtcctctacacttctgtggcttcttggatattccaattaa

SEQ ID NO: 9560 - DNA, 750 bp, A.fumigatus
ccgacatttcccacctcagacaagctccttcagaaagatgtttccaaggagcgccttactcaggaagctgccgacgccgttcgtgcgcgcattactcctagtctgaacatggacgacctttcgtccgtggactttgtgatcgaggccgttcccgagattcccgacctcaagacctccatcttctcgaagctcgctcaaattgcacccaagcatgctatcctcgcaaccaacacctcgtctatcccgataactaagatcgctgccgccacctcaacagatccgacagatctacaggccccttcccgtgtgatctctacccatttcatgaacccggtgccggttcagaagggcgttgagatcattgctggtctgcagacgtccaaggagaccatggataccgcaattgcctttgtgcagcgcatgggcaagattgcagccgtttcagcggattcgcctggtttcctcgctaaccgtatcctcatgccatacatcaatgaggctatcatctgcctggagactggagttggtgcccgcgaggacattgacagcatcatgaagaatggaacaaatgttcccatgggacctttgaccctggctgactttattggtcttgatacctgcctggctattatgaatgtactgcatcaggaaaccggagacagcaagtataggccgtctgggctgctcaagaggatggttgatgcgggttggttgggtaagaagagcggaaagggcttttacgactactaa

SEQ ID NO: 9561 - DNA, 555 bp, A.fumigatus
gtggctaacgcatgcgcggtccttcaggccgttgtgaagaccaacaaaactaacgtacctagtccgtccactgaagaagcagacatcatctccgaatcgctcccgtacccggtaaagtttgctctagaagtgcatttcacgaaacgcgcctacgaagccgagaaagacatcttaaacgggctcaaggctgctggcttcgagctcgactttggcgttgacggggcgggtatctcccgcgcgtacatgacccgtggcggagggtattacattgacgtcggctgcagccaacttatcgccgacggcaagatcaagatcaagaggagccctgaggggatagcggggttcaacgaccgtgggctgctcctgagagacgggagcgcattagacgcggatatcgtcgtgctggccacgggatacgacaatatgcgaacaacagtgcgcaagatattgggcaatcgagtcgcggataggtgcaaggatgtctgggacctggacgaggagggtgaggtcaatgcggtaggtcaaccctttctggactattgccaacaatgctga

SEQ ID NO: 9562 - DNA, 210 bp, A.fumigatus
ggtcaatgcggtaggtcaaccctttctggactattgccaacaatgctgataaaagacggacagatgtggcggccaagtggccatccgggattctggttcatgggtggaaacttggccctgtgccggatttattccaagttccttgcgctgcagatcaaagcgattgaggtgggtctggcatcgcaggatacagtgcatgccaagctgtga

SEQ ID NO: 9563 - DNA, 213 bp, A.fumigatus
cgaaagtctacagggggcaaatcatcccatacacgttctgcgccttcacggtggccctccatgcctgcaccgacaccacctttcctaacactgtatccgaaaccgtatggaccaaggcgcccaaaccgttcgaagcaaacatcgtccttgatacctagcattgtatttgaccccatcactgcatccggaaacccacggggtactccagggtaa

SEQ ID NO: 9564 - DNA, 2217 bp, A.fumigatus
  unsure (107),(114): Identity of nucleotide sequences at the above locations are unknown.
gcgcggcgctctcgagcacaggtgggttactatcgtgtgcagaatcggataatgcgatacctgtgcctggctttattttctgcactagttttgttcatcctcgcctntttccgnttcaccatcacttcggatgagaagcaagtcgcccttgggctgccaaaggtggcgcccaaaccgcttcaatgggagagcttcccttttttgaaacggtatcatggtggtattcgaacactgatcccgcggaacgaatcggtacccgaatatccaagtgacggaatggaggagatggccatgggctcggacaacaataagggtcaggctaacattgaaaccagaggtcaggaagccttgatgtcgagtttggtgttcaacccatacccagattacgattcagatgagtacaagaagaagtatggtgagaagcgcgaatgcttcctcgatgagcaggagacgattcgcattcccccggtgcagcattaccctggagtaccccgtgggtttccggatgcagtgatggggtcaaatacaatgctaggtatcaaggacgatgtttgcttcgaacggtttgggcgccttggtccatacggtttcggatacagtgttaggaaaggtggtgtcggtgcaggcatggagggccaccgtgaaggcgcagaacgtgtatgggatgatttgccccctgtagactttcgtcacgtcgactgggctgctgctcagaacagatgcgtggccctcaatagccaccgcttcaaggacctccctcagccgcggctgaatcgctttctctccttgcccgtgggggttccaaagtcttctcaatctcaggaaaaggatgaagcatcccagtcgaaagcggatcgtctacctcgaacggcagtggtaattcggacatggcacgattttcacttcacgcctgatgacattctgtacttgcgctccctgatctcggagctctcattgctgtctggaggagagtataccattcatttcttagtccatgtcaaagatggaaacttgcaaatctggtcggacgacgagacctacgagcgcgtgctcaacgatgctcttccggcagaattccgcggcatgggtactctttggtcggaacagcagatggctctcatttatcctgggttggaagaaacatggacgcgtggattgcctgtccacggtgtataccgaagcacgttcatgccaatgcagtacttcgcataccaacatccagagtacgacttctactggaactgggagatggacgtgcgatacacaggccactggtaccatttattcgataaagtgggtagctgggcgcgggaacagccgcgcaaattgctgtgggagaggaatgctcgcataaatgttccctctgtccatggatcctgggaggatttccgacatacagtccgtgtgcaaactgagagtggtaccaacagcccgaacaacttatggagtgcggccaccaaatatggctcggatccgtcctctggagacagacaggctctccatcgtcaaggtgacaagccaatctggggacccgaacgccccgatgagcgggatattctggaggtggacggagaaggcatcccccagacgacgatggagaaggatcagaacgaatggggagtaggtgaggaggcagaccttattgtcttcaaccctctatatgatccggagggcacgacctggcttcttcgcgatgatgtgaccgggtacaataaggagaacggtatgcctcctcgacggacagctatcattaccgcgtctcgactgtcgcgcaagctgctcctcactatgcacaaggagacaagtctgaaacggcataccatgttctctgagatgtggcctgccaccactgcgttgcatcacggcttcaaagcggtctttgtgccgcattccgtatacatcgaccgtcgctggccgacgaagtacctcgaatccgttttcaacgccggccgcaacggtgcatctggtggagctcgaacttccgtgttcggtgaccgggagcataacttccgcggaactacctggttctactctgctggcttctcaccgaatctctggcggcgttggctcggctacaaagtcgataatgacggcggcgagcaggaagaattggctggagagggaagaatgtgtcttccacctatgctcttacatccgatcaaagatgtgcaaatggtcattgatgacggcgcgagcgatatgcttggagcctcttaa

SEQ ID NO: 9565 - DNA, 549 bp, A.fumigatus
  unsure (54),(113),(114): Identity of nucleotide sequences at the above locations are unknown.
tggccaaaggctaattcccaaggggccgttttcttgcaatttggctttggaggnggggaatttttggccctgccaatcaaatttaaatttcaattttcccggggggagggtcnnggagcaacaaagtcaaaacttccctggaatggtttaaaaggcagctgtacacttatcacggtgcgaaccatctaccgaacggtcgagtacttcaccgctgcgagcctcaacatttacaacgtctcagatttgagtcccattctgaaagacgaatggttcttctgggtttttgagacagctgtcatgttcacaaataccactttactcaatgtcttgcatcccatgcaatggctcccacgctcgaacaagatctatctcacaaaggacggtgtcacagagattgaaggcccgggattcgaagacggtcgaccattcctgcagaccctcattgatccttttgacgtgatcggcctcatcgcaaataaaggaaggaaggagaagtactgggacgctctcgatgcgaacgagaaaagatcaccccctgctcaagtgtga

SEQ ID NO: 9566 - DNA, 672 bp, A.fumigatus
cacgcgtcagtctatggcgcaagtcctcaattttgcgctggtcctgtccacagcgttcatgctgtggaagggcctctccgtgttcacgtcagtaccagcctcggaaggacaggtttcaatcgactaaccgtgagttcgaatttctacagagcgagctcgtcacccatcgtcgttgtgctctccggttccatggagccagccttccagagaggcgacctgttattcttgtggaaccgcagcccgcgggcagagctaggtgaaatcgtggtctacaacgtccgaggcaaggatatcccgatcgtgcatcgcgtcgttagaacgttccctcaaatcgaaggcaaagcgaagaaggtcaaggaggttaatgagtgcgttttgcattctgcttcgatctgctgcgaacaattactgaccaggcgaatctgtcatagggcctcctccgttcctcccaacatgctcctcaccaagggagacaacaacattgccgatgataccgagttgtatgcgaaaaaccaggactttctacatcgtgaggaggatattgttggcagcgtgcgggggtatatgcctatggtgggatatgtgactattatgctcagtgagcatccgtggctcaagacggtcctccttgggattatgggtctgatggtcatactgcaacgggaacaatag

SEQ ID NO: 9567 - DNA, 216 bp, A.fumigatus
agagccgcgaacatgggtagccagaagcgcatagctaaggtccgtcactgggatcaagtcgcctcgaattttctagtgttctacctgcttgctaacgggataaatgttctgcaggagcttgccgagttgacagagagtcctcccgccggcatcaccgtcgagctggtggatgagtcgaatttgtacgaatggaaagtctacttgggaggaccataa

SEQ ID NO: 9568 - DNA, 882 bp, A.fumigatus
cagcgcgtttccttccagccccggtcggtgaacacaggggcggtctttattgaagactccggtctgatctgggatgcaactcttaatcagacgaattccgcgcataacaacaataagttctaccggattcagctgctggttgatacctccgggacaacctacaagacctggacacgctggggccgtgtcggggagtttggatcgtctgcattgctgggtgatggcactctgcagagagccaagttcgagtttgagaagaagttcaaagacaagacgggtctgaaatgggaggaccggctgagtacgcccaagtcgaacaagtacacctttatcgagcgtaactatgaagagtcggacgacgaagacgacagtgaggacaaaatggatgtcgataagagggaaaagatcgagagtaccttgcctcaggcggtgcaggaacttttgacctttatctttaaccagcaacacttcctgtctacgatggcgtccatgtcgtacgacgcgcaaaagctgccgttgggcaagctgagcaagaggaccctgacgactgggtttcagattctgaaagatctgtccgaactcgtggccgatccctcccttgcgagctccagatacaacacttcgttccagcaggctgctctggacctcagcaatcgttactttaccactattccgcacgtatttggtcgcaatacgcctccaattctgactaaagatcatcagatcaagaccgaggttgatctgctggaagcactgaccgacatgggcgttgccaacggaatcatgaagaattctcgggatgccgagatgatgaaccagctggatcgccagtaccagggtctgggaatgcaagagatgactccacgtcagtctgccatatga

SEQ ID NO: 9569 - DNA, 666 bp, A.fumigatus
agcatacctgaacaattctcgcggctcgacgcaccatcttcgatccagcgtgagtatttcccccgaaacctgaagtttcaggatactcaacacaaacaggtcatcaatatcttccgcattgagcgcaagggggaagaggatcggttcaagtcttcttgttttgcaaatttgacgaacagcaaccgccgtctattgtggcacggatcccgcagtaccaatttcggtggtatcctcagccagggtcttcgcattgcaccgcccgaggcgcccgtgtcaggatacatgttcggcaagggcgtctacttcgccgacatgtcaagcaaatccgcaaactactgtgtgccctacaacagcgccaacatgggcctgctactcctctgcgatgtcgagcttggaaatcccatgctcgagcagttccgggccaacttcaacgcaggaacggatgcgaaggcccaaggcaagatcgcgacgctcggaaaagggcgaactatcccggccggttggaaggatgcaggctgtcttcatccggcactgtcaggtgtgcagatgccggatgtgtccaagtctacgatgagtgacaatggcagtctactgtataatgagtacattgtgtacgatgttgcgcaaattcggcagagataccttttccatgttcacatgagttga

SEQ ID NO: 9570 - DNA, 315 bp, A.fumigatus
  unsure (185),(186),(194),(229): Identity of nucleotide sequences at the above locations are unknown.
aaacgtcttaaggcccgagttccctctggacccacatgcacaagagcctccgcctcccctccaattccctacttacaaatggggcgcatcgggctgaaccgcttcaaagcggccatggcgcgcttcttgaacgaacgcctccacccagcgacccccctcgagccacaccatctcatcctcacaannggcgtctntgcggcagtcgagcatctttcctgggcgcttgcgnataaaggcgagggcatcctcctgggagaccgtactacggcacctttgtcgcggatatctccatgcggttcggcacggaggttgtga

SEQ ID NO: 9571 - DNA, 897 bp, A.fumigatus
aggcgagggcatcctcctgggagaccgtactacggcacctttgtcgcggatatctccatgcggttcggcacggaggttgtgaccgttccctttggaggggccgatccgctcggcgaagcctgcgtcgaggcgtaccgacaggcgctgactagcttcgagcagcggactgggaagaagtgtcgtgcactgctgctatgccatccgcataatcctctcggacggtgttactcgcgcaatgtcctggttgcgctgatgcggttgtgccaggagcaggggatgcattttatcagcgacgagatatatgcgctctccgtatggggtggggaagagtttgtctccgcgctgagtatcgacaccagcggcatcattgatgcggaccgggtgcatgtgctctggggcatgagcaaggatttcggtgcgaatgggctacggttgggtgccctgatcagccagggaaataaggatgtgcgtgccgcggttgacagtgtcgcgctgtattcgtatgtgtctggaccggcggaccatctggcggcaaatgtcctggaggatgatgcgtatacggatgagtatatccggttgaactgcgagaagctaaaacaggcgtatgaatacacagtaggattgctgacgcagaatgagatcccatacatggccggagccaatgcgggattctttgtctgggtggacctgggcacgccgtatcttaagcaccacccggaggcgaaacacgaggatgtcggcgagatcgtgatgcagcgtctgctgaagaacaaggtgtttctggcctcgggggcgctgtttggctcggagacgcccggatggttccgcattgtctttgcgcatccgcaggcgtacctggacgaagcgttgcggcggattgtggctgctcttcaataa

SEQ ID NO: 9572 - DNA, 429 bp, A.fumigatus
cctggcaggccgggcacacggggaccttcatgccaaccaaccaaaccaaaaccgagggcaacgatgaccaggcgttctgggctttcgcagccatgtccgctgcggagcggaacttccccgacccagacccggaccacgggcccgggtggctggcgatggcgcaggcggtgttcaacacgcaggcggcgcggtgggacgaagacacctgcggcgggggactgcggtggcagatcttcagcttcaacaatggatggaattacaagaataccatttccaacgggtgttttttccacctggccgcccggctggcgcggtacacggggaaccgcacgtacgctgagtgggcagagcgggtctgggactggacggtggacgtgggcttcatcacggacgactggttgttctacgacggggcggacgtcctgctga

SEQ ID NO: 9573 - DNA, 594 bp, A.fumigatus
tgcgtggctaaccagtacaagacggaaggtgactcccgatgggaggcgaggacgaagcatatcctccaggcgacggatgcgtttttcgccgaggacccggccatggtgatgtacgagcgggcgtgcgagctcgtggacacgtgccaggtcgaccagcgcgcgttcaagggttcctcgcgcgatggatggcggcggccacgcaggttgcccccttcacgtatgactgggtcatggccgcggctgcgggcgtcagcagcggccgctgcaaggacatgcactggcggtcccgatggcgcagcgtgcgggctgaaatggacgacgggggtctgggatggcagcgaggatgtgggattgcaaatgagtgcgttggaagtgatccagaatctcttagtcgaccgggtggatccgccagtcaccgatgccaccgggggaacctcagtgggcgacccgagcggaggaatggagcagcccgatccacggccaccggtgctgacgatgactatcaccggggcagatcgcgcgggggcggggctcctgacagcgatgttgggggtgttgatgatagggacaacagggtggctcctctatgaatag

SEQ ID NO: 9574 - DNA, 846 bp, A.fumigatus
tccccaaagtcagctacaatgcattgcatgcaattactatggctcttgacactctcccccgcgtatagcatccctctagaccccaatgatcccacctccatcaagcaggccgcccaccatgtcgccgccaacatgctctcccactacacggggatgaaacccggcgacaacccgggcaacctaccacccccatactactggtgggaggccggggcgatgttcaacgccctcatcgactactggtacctgacgggcgacagtacctggaacgcaatcaccacgcaagcgctgacctggcaggccgggcacacggggaccttcatgccaaccaaccaaaccaaaaccgagggcaacgatgaccaggcgttctgggctttcgcagccatgtccgctgcggagcggaacttccccgacccagacccggaccacgggcccgggtggctggcgatggcgcaggcggtgttcaacacgcaggcggcgcggtgggacgaagacacctgcggcgggggactgcggtggcagatcttcagcttcaacaatggatggaattacaagaataccatttccaacgggtgttttttccacctggccgcccggctggcgcggtacacggggaaccgcacgtacgctgagtgggcagagcgggtctgggactggacggtggacgtgggcttcatcacggacgactggttgttctacgacggggcggacgtcctgctgaactgctccgacttgaaccgtatcgagtggacgtacaactctggggtgtatttgctgggcgcggccaacatgtacaattgtgtatgtctatgtctatggctacttgctcttctgatgcgtggctaa

SEQ ID NO: 9575 - DNA, 192 bp, A.fumigatus
ttaggtcgggatctctccagaaagggaaaacaggagcgcacaacgctgaagaaagcaacgtatgttctatcatactgcctttcattgtatctgaatatggaatctaaagagctatccaagatgtctatgctccgatctaaaatatgcaacgtgcaagcaagcagacaggcaggcgtactcaaatgtgactaa

SEQ ID NO: 9576 - DNA, 675 bp, A.fumigatus
ttgaaattttcaatatgtctgtcgtatgtgtttgtgcacaatctagatgcctgccaccaatcccaactcgacacgggattgttgacccgagcatgtatctgtatgcgaacatacgctatcaggccagtttctaaccgcttgcccggtcccattgaaccgaagaagcacaggcgagatagagacaattctacgacaggttccctctacaatgctttgattcatcctgttcagcgggagaagactattacttccacgatgattagagtcgctgagtttcagccctttctgaacacaatcagtgtactccaagtgctcgcggcaatcttcattggagccctcacctatcgactgattgacgccttttttctctctcccctccgttccattcctgggccccttctggcccgactgacaaccaaacgcgccaatgtcgacaccttctccgggaaggtgacccagactgtcgacaaagacgtagccaggtacggcgatgtatatgtctacaaaccccgtgcggtctgcatcaatcatccagacgacatccgcgctgtgctaggctcccaggagtttcgcaaggctgccttctttgacatctttaatgacggcaacacacccaatatcgtctcgctcagggagccagagctggccaaccgtcggtcttcaccacggggctag

SEQ ID NO: 9577 - DNA, 762 bp, A.fumigatus
  unsure (699): Identity of nucleotide sequences at the above locations are unknown.
gacaccatggccctccccattattctctgcctcgctgtcatcttgtggacttcctggcgcctgctggacgccttgttcctatctccccttcaccgggttccgggaccggttcttgcacgcctcacccctctccgagcaatctatgcccgcctcccgagccgggtcattcccgcagctctggccgacttccatagctatggggacatttacctctccaagccgcggaccataacaatcagccatcctcgggatgtgcgagccatcctcgcatcttccgagtttcaaaaaattgacgtctatcatggccttaatgacccagtcatggcgaatatcgtcaccttcagtgaccccaagctggctagtcgacggcgccggcagattggtccgtacttcaatcccagctatctggcaaaaatggaggagctgattctgtggtgcggctgccgggctgtggcggacaagtgggatcgactgattgctcaacagggccatggcccacagaaatcagtcaaggtgaactaccgccacgacctgcagatggccacctttgatattatgagtgcgctggcatttggtcggcggctggactcactgaaggaagaaggggagagtgtggcgatcgtggagtggatcatggcgacagccgtctatatcggcgtgcggatcaatttccggttgctcatggtgtttcccttctcnccgctggtgccgcgctggacaacgcctatgccgaatttgttcattttaccagcaaccactggg

SEQ ID NO: 9578 - DNA, 741 bp, A.fumigatus
  unsure (85): Identity of nucleotide sequences at the above locations are unknown.
gcggaattattcaaggacttgttagttcttccccgccggttatcacttcggtcccagggcattaggagttttggttcacccgcgntggagtatgggttcccttcgacgcattcgacaaacgccgtctctgtcgctgtctacgtgctcactctgctcaattcgccggattcgaccgtgagcagccatatcaatttgatcttccaatgcatgacgtatctctacgtcagctccattgtattgggtcgcctttactgcggaatgcatgggtttctcgatgtcattgtcggttgcttgctcggagcttcgataacgttcgtgcaaaatttattcgggcctcttctcgatgactacgtgttttcagcatcagggaaacaaatcgcgctggtggtcctggtaataatcatccttgtgcgcattcacccggagccagcagacgattgcccgtgtttcgatgacagtgtcgcctttgcaggggtaataattggagtgcaactgggctgctggcatttcgcgaagtctagcatcgcttggtccgacccttcccccgctacgatacctttccggtacaaagatttgggtctggtaaagaccgtgctgcgctttgttctgggtgtctttttgattttcacttggagagaggtcatgaagcctcttctcctccgtaccctgcctccaatctttcgagcgttggagaagttgggtctcctgcttcctcggcgattctttaccagggcttcgtaa

SEQ ID NO: 9579 - DNA, 717 bp, A.fumigatus
tccttccaggcgcccgtggtgaagacagaatcgcgtactcagtcgcctgttgctctcaatcgtagacagagcaaccttgacacaaccggggcgtctctgtccgactacaggcccacgagtcgccgttcttcaacgctcctgacgacatcatcagatgtgggcactcccccgcgtcagaattcccttcctgttcccgtcctatcccctccgatgtcaacaggcctgtcaaaccctccgataatggagtctccagtcatcacctttgagccagatgacttcttcagcggctctgcgacaccggctaccccatccgcttatggatttcccccaagtcatcattcgcgaggtatcaacgacatcatttcggagtcgactgtcggcgctgggccatctgttcagttagttgagcgtatgagcgctacggttcgccgcttagagagcgaacgagccgcagccaaggacgaacttgcgcggatcactagacaacgtgacgaggctcgaaagcaggttgttgacctcatgcgagaatcagaggaaaagaaggcctctgatgctcgtgtgcaggagctggagacaagacttgaagacctggaccaacgctaccaaacgactctggagctgcttggcgagaaaagcgagcaagtcgaagagctccaggctgatatcgccgatctcaaaaaaatatatcgggagttggtcgatagcaccatgaaataa

SEQ ID NO: 9580 - DNA, 540 bp, A.fumigatus
aaaatgcagaaggcgatcccatcatcgacctgttactacggaaaggtgcagatgtcagcgtcaagagtgtctcaggccaggtatgtatcaatgactacagacccagctactagtttctcattcccacacgctcgcttcaaccagaatgccctccatttcgcaacgtccaaaggcaacctctccaccgtgcgcacgctgttagccaacaaatgcagtgccagagtcaaggacagaagagggcaattaccacttcaccgcgctgcggcgatcggatccattcctatcatcaaacttctcctggaggaagggaagagtccggtcaatgctaccgatatcgatggcttgacagctctgcatcatgccatctccgagggtcatggggatgcggcgatcactttgctcaaggctggtgcggaggccgacaagaaggattctgaaggtcgtctggctattgagacggcgccggatgcgaaagtgagttgtccgcgattttcgtggctgatgtataaacgagctgactgtcgatctcttttaggttaa

SEQ ID NO: 9581 - DNA, 1581 bp, A.fumigatus
gcggatcctgccagccgcgtggtgaagatcttgaaagatcttcttggtcacgatcgcgagcatgctaatctgccacttgccgtgttatttgccaagagctttagttgggatattctaggagcgaatatggtcgacgaaaaccggaagacggttgatgtagatgggaccacgacctctgttgctcccccagagacagtgagtggcggagacgatgcgacggccccggagaatgaaccaccgcttgtgtcggagaaaacgcagcttcgcttcaaaagtattctgagccggtatttggaagatgtcaaggcgcacgttgttcgcgaccagagagcattggcagcacagagccgtcgaaatgcggaagcctacgtcaagagtggtgagatatttgaggatcgtcaggcgaattttgacaagcagagcaagtcattggagaaactggttgcgaacactcaggtattgtgcgaggttctaggagtggaaatgcccgtcttggctgagcaggaagcagctgattctgcttcgagtggcggaatcgggcttgtgaagacttcggaatacctacgtggccagggcgaaggccccggtatttgggaggatgaagaggaacggcgtttctatgaaaacttggttgatctcaaaggcaaggtaccgccggttctgcttgaagatggtaagaagaaaaagtccgactccgacgatgctgcaaagaagaggacagacggcgaagctacccccgattcgagtgtagagaagcctgagaacgcaagccaaactccaacatccgaagagaagtctgctgcggaggcggaagatcagtctaccgctatcgccagcaagaccgtgggagctcaggtagatgctctcttggctaggctccccgaacttcaaacgaaagaccaagttgatcagctggcactcgagttctgctttcttaactccaaggcgtcgaggaataggctcatcaaggctgtgtcagatgtcccaaagggtcgagtcgatcttttgccattgtattcgcgactggttgcaaccctcggacagtatctccaggatatacctcaaggtttaataacttaccttgacgaagagttccgcagtcttcaacgtcggaaatccaaagaattcctcggccaggttcggatgaccaatatccgttatttcgcagagttgaccaaattcggtgtcgttccggagcatatcatctttcactgcttcaaggtttccctcgatgacttttcgcgcatgaacattgagattattggccatctgctcgaaaactgcggacgctacctacttcggaatccagaaacatccccgcggatggcttccttcttggagaagctcggcaggaagaaggcagtccaacatctgggtcagcaagaaagaatgatcatcgagaacgcaatgtactatgtcgacccgccgccgcgacctgctattcaacaaaaggagcgcacgcctatggagtcctacatccgcaagctgatttacctagacatgaacaagcgtaattacaccaaggttttgaagtcaattcgaaaactccactgggaagagcaagatgtaagcccactctaa

SEQ ID NO: 9582 - DNA, 381 bp, A.fumigatus
tcttcttccaggtatctcttcttcccgctcagtcttcgagaggagtgtggtctgacattttcacagtactattatcttacaaaggatcctttgcctatggacgtcgaattcttgatccaggacaccttcgctatggctcgtcctcaatggaagttgatgactgatttgcaggaggccacgcggctgttcagtgaggcagtcgctcagaactacaagacttcggattctgagcgtcctgtggagccggatgaggatgatgcagaaagcagctcgtctgatgacggtctcgaggatgacgcgattcccgaggctgaagaagaacaggagtcgagcgatgaagctgaagtgagtttcacatccatcagggcgaagtcgccttga

SEQ ID NO: 9583 - DNA, 252 bp, A.fumigatus
gtggtcgatattatggagcgtgtctttagtaagccggtcaaggtcaaatacggcaatatccaccttctcgctattcttgtcagtgcactttacaggtatcaccaggacttcgtgattagtgttgtagacaacatcctcgagcagatcacactgggactcgaacagaacgatttcaagttcaaccagaagcgtgtggctgaagtcaaatacctcggggagttgtacaactataaaatgatcgactcaccgtag

SEQ ID NO: 9584 - DNA, 402 bp, A.fumigatus
tctttgatacgttgtaccggattgtcacttttggctacggtaagcatctttggattcattattgttttctattactcacaatattatgtagagggtggcactccgattcctggaaagctcaacccactagatctaccagacgatttcttccggattcgcctagtctgcactctgctggacacctgtggtcattgttttgatcgtgggtctgctaaaaagaagttggatttcttcttgatcttcttccaggtatctcttcttcccgctcagtcttcgagaggagtgtggtctgacattttcacagtactattatcttacaaaggatcctttgcctatggacgtcgaattcttgatccaggacaccttcgctatggctcgtcctcaatggaagttgatgactga

SEQ ID NO: 9585 - DNA, 252 bp, A.fumigatus
gctaactttcattctttctctgtcactgttatcatcatcatcatcatcatcatcatcatcatcatcatcatcatcatcatctatgcccttgaatgcaatcaaaatcctcgtaccccacatcctctgcactccttttgtgatcgtcccccccagctgtccggcggatcaccaccactactaaatcactccgcaatccgtatcgtctccccccgtctccgcagcatttctccttgcctttcatcacccgtctag

SEQ ID NO: 9586 - DNA, 606 bp, A.fumigatus
atgtggtcgctgccggtgactacatctggaccgccaccccgaagtccagcatcaaccgctggtacgatgtcgataccactgccgagattgagtctccctcgtcgaggggaccccgcagactctgacgcagctaaacctgaggagtcgtcggtgcggaaaggtcggcgaacaaagatcccgtacgagtcaatcctactgttgacaagcacatcgaccttccccaagtcacaagtaccagaaggcacatctgagggtctgccgaccaacggacaacagcgctcacccgatccgaccttggacgacgatctggacctcaatctaccagtgtactctttacccgacgagacgatagaggggcaacatggtttgattaagcatttcatgctgaacgacagaaagcgcacgcttacgcaagattccgccggtgaggtcgatctttgggatcttctgaaggtgatatttctctctcgccatccctccataaggtttcttctgacccttgcagtgcaaaccaatacaatctttcggcaagcgccatatggacgacgtcgcatcggagatcaatactacagagagcatcgctcactggtgcacgatcgacattag

SEQ ID NO: 9587 - DNA, 255 bp, A.fumigatus
tctcagttcattactcctcttctctgcatcttccctctctttccgtcttttgaattgtgctacttgaccattgagctaactttcattctttctctgtcactgttatcatcatcatcatcatcatcatcatcatcatcatcatcatcatcatcatctatgcccttgaatgcaatcaaaatcctcgtaccccacatcctctgcactccttttgtgatcgtcccccccagctgtccggcggatcaccaccactactaa

SEQ ID NO: 9588 - DNA, 228 bp, A.fumigatus
cccttgcagtgcaaaccaatacaatctttcggcaagcgccatatggacgacgtcgcatcggagatcaatactacagagagcatcgctcactggtgcacgatcgacattaggacaggccggttatcggtcatcctagagctcaatcgctgctttgacgccgaggtctacgcggacgaggctgacctccatgattactcccagatcctgggagatcaaagaagtgggtga

SEQ ID NO: 9589 - DNA, 963 bp, A.fumigatus
ctgactgctgccttcccaaggtattccgctggccgcgatggagtgatctgcgcatgggatctcaacctccctctctccgcatccaaatcctctccagctctaggcgctcagaagtcaggaccgactaccttcagacatcaagtgcaagcgcacagccattggataaatgacatcgtcttaacgcagaataatacggccctcgtttcggcttcatccgataccaccgtgagactctggcgaccacactcggaatccaccgagctgccatcacccatcggcaaacatgcagattacgtcaaggcccttgcgacgcccggagggcactcaagttgggtggcctcgggaggactcgatcataagcttcacctgtgggatctgaatggtggcggcgagcttcttagcatcgatgcctgcggaggcgagagcacggccaagggttctgtttatgcgctgggggcagtctcatcggtcctcgccagcggtggcccggagagcgtggtcagagtctgggatccgaaatctggaaagccgatcacgaaatttgtgggccacacagacaacatccgagacatcttgattactcgagacggagataggatcatgacggcctcgtccgaccaaacgatcaagatctggtctctcactgcaggaagatgcatgcacaccttgacgatgcacaacgacagcgtctggtcgctctactccagccatccccagctatccgtcttctattcgagcgaccgttctggcttggttgccaagactgacacaaggcactgctcggacgtggatcagggcatttgtgtcgcagcgttgcaggaaaacgacggcgtcgtgaatgtggtcgctgccggtgactacatctggaccgccaccccgaagtccagcatcaaccgctggtacgatgtcgataccactgccgagattgagtctccctcgtcgaggggaccccgcagactctga

SEQ ID NO: 9590 - DNA, 285 bp, A.fumigatus
  unsure (182),(253),(267): Identity of nucleotide sequences at the above locations are unknown.
tacgccgaaacagaccgtcacccgctcgccatccccaatccacacaacacagaccaaaacgacacccgctccctctcctcatcaatctactaccatctcaaccccgactcccaacctgcgtcttcacctgaaaccgcagcgcacaatcacgccctccatcgtggtctggcgcggtatgtcantatccaccccgattcggcgaacgacaatggcacggcgcccgttacgtccttcgtggtcggtccggatctanaacagggggagaanaatcattgtgttgtttaa

SEQ ID NO: 9591 - DNA, 498 bp, A.fumigatus
  unsure (427),(498): Identity of nucleotide sequences at the above locations are unknown.
tacaattttatcttgtatctactcggtagaaacgaacaaacacctagatacacatctctctctaccacaatccatctacgacgtatacaagttcccgaaataccatggacatccccatcccctccattcaaccattctatcacccatctcccaccagccccaaacccatccccgaatccaaatccccatccatccaaacaatcctccaaaccctccatctccagcctcacccagaaggaggttagtacgccgaaacagaccgtcacccgctcgccatccccaatccacacaacacagaccaaaacgacacccgctccctctcctcatcaatctactaccatctcaaccccgactcccaacctgcgtcttcacctgaaaccgcagcgcacaatcacgccctccatcgtggtctggcgcggtatgtcantatccaccccgattcggcgaacgacaatggcacggcgcccgttacgtccttcgtggtcggtccggatctan

SEQ ID NO: 9592 - DNA, 678 bp, A.fumigatus
cagtgtgtgaaagtctaccatcctagggtcaaagcccaagcaatctacgtgcctaccatggccagcacttcccaaagtcgtttccatgaggatctacgcgatgatggatcgatccttgatgacgacttaattgaggccgatgacggtgagtacatctcgttttccaggttctccctcgattgtatcagaccggctcttgtttgtttacccgagctactacgatgtactgacacttgttacctttctatcatgccagccatcgaagccgatgaccctcttcacacttccgataccgctccgctaagaggcaacatccaatccgaaccctcgagttcgagcagaggaggttttggaagcaatctatctagcaattacctgacatcgaccatcccgggagaggatcgccgcgcaacgcagaacaccatcgatgaaaccgtttgggagacgctctcacgagacttacgagcagtatgggagaagatgcgccaagtgttgtggcccaagtacctgatgggaggtatgctgcagcgcggtggaggaggcattggggccgccgagaggggcgaagcgacggggttcggtggtgggctcagaggccttgtaggacgctggccggatgccgacgtggtcttgcagggtggaatgagtgagggtctgcgtgactgggatctttggtaa

SEQ ID NO: 9593 - DNA, 1290 bp, A.fumigatus
  unsure (164): Identity of nucleotide sequences at the above locations are unknown.
tgttgttcaccggtgaacagaggtcaactcgacatagacacccaattgggggggccaatggcccgcctcttgcttgaaggcggcagcgaccgcgattgttacgatgtcttcgcactcttgaatcaaactactgggcttcctatcctggcaaagaagccttcacntgagcgccaacgggagtctgaggtcgccagacgccgaaagagccgatccgctgaaaataaggagatggaagacgtcccctttgttgacgaaggcaaccgaccatacaaaccagcagagaccgaaatggaagaacgcgaagaaaagacagagcaaacagaagaagaggaagacgatgaggaatttgaaaatctttttgacccagtggtgtctactggttcttcttccaaaacgaagaaaggcaacattggtccatcctacgttgttctaggtgatcaggagctcaccatacttattgaaacttgttataccatgactcagggtgttggtactggaaaagcttactggaagtatctaacgctcgaggatcacgagtataccatcaaaccaggcatgccttcgttacatgcatatttgcgactactaagagtgtatcgcgctagtcgtgctacggtcgatgttgtgcgcgaccaggttcccgaaccaggttggaaaacgttccacattgcgatgagctgttgtcttcgcgatcgcaggaatatcaacattctcaaaaatgccaacgaactattgggaatcatggacaagtccatggtccttccccacccccgggcgcttgacaagtatcttaacctcgtgcaaacactacaggacaatccacagcgcctcatatcattgaatggactgaagattgcgcggaaaccctctgacagcctcgacgtcgtgggccggaaattacggttgagcttgcagacagttgctttggagaaccttcgtcctcatattgacaagctccatgaggctctgaagaatggaaagacttcatttatttcacacgttgagcggagacaagcgggcgcggccgatacagtttgtggtgcgaccgctcgcacggtgatggatcgcacccgaggtctgattgacgagctcctcaagcccgagaatgcgcccttcctttccaagtcggaccgtgagcaactcgagcaagagtcgcagaaactccgcgtatactcggatgtcgagatggtccgaaagttcgaaagcacccgattgcatccaactttcgaacaggtcatggcattccaggagaagcatgaccctaaacagaacactgacgaggccgactaa

SEQ ID NO: 9594 - DNA, 258 bp, A.fumigatus
gtaagagcattaaggaagatgcagatactgtccaagctcgcttcctacaatcttccctctgtaaaggaaatgacaaggtatactggcgagagcttagctacaagaaaaagcattaaggcctatctgcccaatcatgcaatcatccatgtatctagcctgtacaaaaacgtttctggctggaaattttttatgcaaatcaattcaaaacccaagaatgtacctggcagatgtcatttgccgaccgcaacttccagctaa

SEQ ID NO: 9595 - DNA, 237 bp, A.fumigatus
gccatccggggaaaaggtcatctgtcttgttccttcttgttgcggagaattggcttttatgtagacgctttgactcagtttgacatgaagttctctatctattataacaccatcaatgaaaattacggatctcaacaaataaactttgcgacagatactggaataagtctctcgatggcatatagagcctcgcaggttcggctttatgtggcttacacagtctttgactctttataa

SEQ ID NO: 9596 - DNA, 1203 bp, A.fumigatus
agcactagcgttttccggcagttgcgagtgaaaacttcggacggtgcggctaacaccgcaccgtattctagattggactcacggcaacggaaaaagctccacactgagaaactcgaggaggaaaagaaacacttcactcaggttatcagtgagcttgaagaagcgttgcaaaacatgaagttgcgtgaggctgagctcctccgtgaaaagagcgagtggatggcagcccagcagcagattaaccagtacatcgaaggcctgcacatggataaggacgagatgcttcgcgtgcacaccctggaaacggctgagcttcgaaagaagaacaatattctcaaagagacagtggagaagctcgagagacagatgggatcatcggctaccaataatctcaacacggacttctctgactttgagaattttaccatggacaatgcgccttgggaagacttcaccatatccaacagtcttcctcttgaggcggagtcgactcctgctacctccacgatgcagtcatcagcaatggtgatgtcagcgagcgatagggtcaccgagaagagtacaaacacagcctgtgactaccctttcagctggaatgccttctacatgtgtctgctctttggcgcgttcctggcttcgaacggcccatcgctctcctcacgttctattccgcaattgtcggaggagtaccgtgccgagtctgccaacgttttgaaggcagttctcgccgcctctccaccagagctcgcacaggcgaacactcagcaagcggtggcatcctcctcctccgctgctccaatgccaacgaccatcagcggagcggagatggctcaaatgactacgggtactgcacaatcttccaaccttgacgagcttcacaacaacctcgcgatgcctaccaaggagcaggagcgagagcaggtcttctccctcaatgctgaccaatacaatgccctgaccacctttgacgagtctcatgtcgactacaagtctcagccttctaatctgcagcaggctttggccgcgatgcggaacaatgctgctttcaataaactgccgaacaaggctacatccgacgtgtacaccagatctttgatgtgggatcgcgttcctgagaaggtgattcgcgattttcaacgcatggttcaggaatttggcgcttcacctatcaaagaggagcagtccggcttcagtcaggcctga

SEQ ID NO: 9597 - DNA, 249 bp, A.fumigatus
tatagcggacatttgttcctcacagcgtactttagtcatctcgtctcgttttccagcggcattcccagtcagagtcaccttaaacttgcctgcccttcacgaaagcactttgcacaaacgttacgttctgccgcttcttttctcgccttcatcaacgattttcttttcagccaaacatctctagcgcttctagcgctttacgctatcgagctacgcgactctcttttggccacatttagccagacttag

SEQ ID NO: 9598 - DNA, 369 bp, A.fumigatus
attgaatcacttcactatgcaactctacaaagcatatcgcggttgagaagttccggacccacccagctgatcattgacgatcccggcattgatttattcatgcaatgcggaaataagcataattggcgaatggagattctgacatacggcactttccacacgctctctcacatcaaaggcaaggtgtccgagtggtctaaggagcacggttcaggaactgaacctacaaactgtttcgtcagtttccgtgtctcgcaaggggcgtgggttcgaatcccacccttgtcatttcatgtttctttttgtttgttcatcatcgtttgtctgatcatctcttcgctctcaaatgacactgttatacacgaataa

SEQ ID NO: 9599 - DNA, 279 bp, A.fumigatus
gccacctcggccttttcccagcagcactacacgagcaatgctgaactatttatacaggctgcggttgaagcactgcacgctctttatagcaggtcgaatttcgaaatagaagacttccagcctctcgtgcacttgatgtacgaaacagagtacttgactcttctacggaaattgtacgagtggtccattgtagggcccgacgacatcgacgatactaggtacacgatctcgaaaaagctatccgaggtaggaacttctagacccagatgcctgccatga

SEQ ID NO: 9600 - DNA, 900 bp, A.fumigatus
gtctctacaccggtcgacggaatggccgcccaagatgagctctcagaaggcggcatggctgacctcgttcgggcactggagctcatccacaacccttcgtcaacaaatgacctccgcaggcaagccctgacctttgtggagtctcaaaaagaaagcaagctagctgctcgtaatgggttccttctggcttcacgggtagaaaacgctcccttggtccgctattttggcttaacgctcttggatcatgtactgcgtcacacttctttcaccgccgcagatcaggtggctatcctcagagactttgttctcaagcttgctgagtctatccggccagaggatccggcctattaccgcaacaagatcccgcagttatgggtagagattgccaagagaagctggggcctagactggttggctatggacgagattcttgtgcagttttggggagccagtcttgtacacaaggaacttgtcctttcgattctggaaacattgtcagaggacatattctaccgcgaagacaccgtctcatccttgcgaggcacagatctcaacagagcattagtggagatctgcacaccactgtcagtctttgaggagatctatccaaagcgcgagcaccatgttgagcttcggtgtgggaccgagggatggctcgcaaggacatgcgagttccttatctactgtgttgagaacctgcaagcttccatacaggccagagacgcagcgctcaaagctcttgcaacactgaagtccatcttagtttgggcaatccccaaggccatcatgtccacaaattgtgtctcgagtatcgtaaggccgcttacctgtagtgatgagcaggtgttgttggtaagccacctcggccttttcccagcagcactacacgagcaatgctga

SEQ ID NO: 9601 - DNA, 1317 bp, A.fumigatus
tggggattgccaaggccggtgcttctagcccacgtggttgaagacgagggcgacaaggaggcgcgtggccagaaggtggtcgtggatgaggaaaaggaagcaaagaagaagaagaaggctaaggacgcaaaggcagtcaaacttgatgatgccctcgtcaaggaatacgaggagattttggcgcaaattgataacttcgatggcactcagttggaagagatcatcgccaaacacgacatcagaaacccgacgaccgatggcaacctccttcctcccgtcgctttcaacctcatgttccagacctcaattggccccagcagcaacatgccgggttacctgcggcctgaaaccgctcagggtcagttcctgaacttccagaagctgctggagttcaatcaacaatccatgcctttcgcatcggcctccatcggcaagtctttccgcaacgagatttcgcctcgcgcgggactgttgcgcgtccgtgagttcctcatggctgagattgaacattacgtggacccggagggtggcaagaagcatcaccggttcgaggaagttaaggatattgaaatggctttcctcaaccgtaacgttcagctctctggatgcaccaaaactgagaagatgaccattggtaaggcggttgagaccggtatggtcgacaatgagacacttggatacttcattgcccgtatccagctgttccttctcaagctcggcgttgacccgaacaagctccgcttccgccagcacatggctaacgagatggcccactacgccgctgattgttgggatgcggaattgctgaccagctacggatggattgaatgtgttggctgcgctgatcggagcgcctacgacctgacagtgcacaagaacaagaccggtgcacctcttgttgtccgcgagccccgggccgagcctttgaagatcgaggagtggcaggttgatctggacaagaaaaagttcggacctcgtttcaagaaggacggcaaggctgtcgcggctgccgtcgaggccctttctcaggagctccgcgagaagttggccattgatctggagaagaatggcaagattgaggtggatgtcgaaggtgttggctctggtaaggtggagcttgaccaggacatcgtcaagatcgagaaacgcactcgcgtggagaacgttcgcgagtacacaccgaatgttatcgagccttcgtttggcattggtagaatcctgtacagcatgattgagcatgtctactgggctcgtgaagaagatgaagcccgtggtgtacgtatccctatatcctcaaggtgcgttggacaccgctaa

SEQ ID NO: 9602 - DNA, 384 bp, A.fumigatus
gtcctctccttcccgcctgcaatcgctcccaccaaggttctgattgttcctctctcgacacacgcatccttccgccccctcctgcagcagttgatgaccaagttgcggcgcatgggtatctccaaccgtgtcgatgactcctcggccagcatcggtaagcgctatgcgcgtaatgacgaactgggcacacctttcggcatcacggttgactttcagtcggtgaaggacaacaccttcactttgcgtgaccgtgacacaaccaagcaggtccgtgccagcgaggatgagattctacaggcgattaagtccctggtggacggcgagaagacatgggaagatattcgcaaagaacttcctgaatttactggtcaggaggttgattag

SEQ ID NO: 9603 - DNA, 858 bp, A.fumigatus
tgcgaacgacaattgtacactcttcaaagataccaaccttctcaaatgccctcagattgggtgagctccgcgctgttgtgcctttttacaacggaaacgctaacagcccgcccattcagggaggatattacgacgtgccagaagaaaggaaagaccattctgctttctattggcggggccacatacagtgaaggaggattcagttcagaacccgctgcaaaggccggcgccgaattggtctggcagacctttggaccgccctccatcaacgcgacggcccatcggccgttcgggaatgcgtcggtagacggattcgactttgacttcgaggcctccgtcagtaatgttgctcccttcgcgaacaggcttcgtgaattgatggatgccgatcaccgcagagattatttcttgacggctgcaccccaatgtccgtaccctgacgctgccgataaggatatactcaacggtccggtgtccgttgacgctgtgttcgttcagttctacaacaactggtgcggattgaattcttttgaggccggagagagcaagcagaacagcttcaacttcgacgtctgggacaactgggccaagacggtttctctgaacaagaaggccaaggtattcctgggcgtgccggcgaacactggcgctgcaggctcaggctacgtgcctgtagataccctgaagccgatcatcgaatacagcaagaagtttagcagttttggcggcgtgatgatgtgggatgtcacccaggcctacggcaacacgggcttccttgacggtgtcgcccaggcgctgggcaagacggcgtcccacgttcgtcgctcgtgccgctatcgtccttacggctggttttga

SEQ ID NO: 9604 - DNA, 312 bp, A.fumigatus
gtagaagtttcccaggtcgctgttcctcctccatcgcttctctaccgcatcgtcaggatggttcccaagtctcttctgtacaccatcttctcctcccttgccgtcgctctggcggcgtcagtcccccacactgactatgaggtgatgataatcggtggaggcccctctggcctgagcgccgccagtggtttgtcgcgggtgcgccggaagaacatcgtgttcgactcaggcgagtatcgtaatggtccgacaaggaacatgcacgatgtcattggcaacgacggtagctgtccccatttcccagctttctag

SEQ ID NO: 9605 - DNA, 345 bp, A.fumigatus
cggctgtgcaaactaacgtcggtcttcgcaggcgccgtccccagcgacttccgcgcacttgcccgcaaccaaatctccaagtacaaccagacgacctgggtgaacgaaaaagtcgactcggtccgcgtcatcaccgacgaggaagcgaaacacccacctactttccgcggcctgggtagccggggaaaacctaaacaagccggaagggctattccttgggaccgggctggaagggcaatcctgcccggagacaccccggcttggaacaaaacctgggggaaaaggggtggaccgggggcccctgggggcaaagggggggaaaccaccgggaacaagccttttggg

SEQ ID NO: 9606 - DNA, 1455 bp, A.fumigatus
accatggcgtaccttcaggccggtgtgaatacatctcgcggtgaaggtggcaagaccggtcgggatgccaatgctgttgccttggagcagcaggcagatgtggacgaagacaccttgaaggaaatttatggtgagaagaaggagcatgttaacattgttttcattggacatgtcgatgctggaaagtcaaccctcggcggatccatcctctacgttactggcaacgttgatgagcggacactagagaagtacaagagggaagcaaaggaggctggtcgagagacctggtacctttcatgggctctcgatttgaccaacgaagaacgagctaagggaaagactgtcgaggtcggccgtggccacttcaagctcaccgtgcagtctcccgatggtcccattgagagacacttctccatcctcgatgctcctggtcacaaatcctacgtccaccacatgattggtggcgcctcgcaagccgatgtcggtgtgcttgtcatctctgctcgtaggggtgaatacgagactggtttcgagaagggtggccagactcgcgagcacgctctgctggcccggaacactggtgtcaaaaagctcattgttgccgttaacaagatggacgacccgactgtcgaatggagcaaggctcgtttcgatgagtgtacagttaaggtctccaagttcttggaggctctcggctacaagaaggacgatcttaccttcatgcccatatccgcccagcagactacgggtattaaggatcgtgtccccaaggaacttgcaccatggtacaatggaccgtctctcctggagtatcttgctgaaatgaagactcccgaacgtaacattaatgcccccttcatgatgcccgtgagcacgaagtaccgtgatatgggaacgatggttgagggtcgtatcgaagctggtgttatcaagaagaacgccacctgcatcatgatgcctaatcgcaccaaggtcgaaattgctgctctctacggtgagactgaagacgaaattgccactgcaacctgtggtgatcaagtccgtatgcgtctcagaggcgtagaagaagaagacctcctccctggattcgtgctctgctctcccaagcgactagtgcactgcgtctccgcttttgaggctaagatccgtatcctcgagctcaagaacatcctgaccgctggttataactgtgtcatgcacgtccactcggccgttgaagaagtcacgttcgcggcactcctgcataagtgcgagcccggcacaggacgcaggagcaagcgcccaccaccatttgctagcaagggtcagaccattattgctcgtcttgaggttatcagcagcgcaggtgccgtctgtgttgaacgtttcgaggattacaaccagatgggacgtttcactctgagagatcaggtaagcgatgttttatccgtgccatatcttgggtcacatcactaa

SEQ ID NO: 9607 - DNA, 555 bp, A.fumigatus
  unsure (12): Identity of nucleotide sequences at the above locations are unknown.
accaccgcctcntcatacctcgacgtcggcatcaccctcacaatcaacaactggccggcgctgaccatggccgtacaatcgaactggggcggcccaacatcagccgacaagcgcgactggctctgcggcgcgatatcagacatgatcaatgagcgtcccgagacagacgctctggatctggaagacgttctgatccaggtgatgaacgatgagtttgatgttgtggtagatgatgacagcgcggcgcctgttgcggcgcagatcatggcgatccgggagcagacggcgaggggggagttcggctttgtgcaggagctgtgggaggcgtggcagaggaaggctcagcaaaaggggaataatgtggcggcggcgtttaagcaagtgaaggcgttggatgatgaggataccgatgaggaggatgaggttgaggaggacgaggacgaggacgtcgatatggacgaggctcctgctatcgtacgagcgcctagggagagggtcgagcttgaagttgacgaggacgggtttactaaggttgttgggaagaagaggagataa

SEQ ID NO: 9608 - DNA, 816 bp, A.fumigatus
tcgcttgggagagcagagcacgaatccagggaggaggtcttcttcttctacgcctctgagacgcatacggacttgatcaccacaggttgcagtggcaatttcgtcttcagtctcaccgtagagagcagcaatttcgaccttggtgcgattaggcatcatgatgcaggtggcgttcttcttgataacaccagcttcgatacgaccctcaaccatcgttcccatatcacggtacttcgtgctcacgggcatcatgaagggggcattaatgttacgttcgggagtcttcatttcagcaagatactccaggagagacggtccattgtaccatggtgcaagttccttggggacacgatccttaatacccgtagtctgctgggcggatatgggcatgaaggtaagatcgtccttcttgtagccgagagcctccaagaacttggagaccttaactgtacactcatcgaaacgagccttgctccattcgacagtcgggtcgtccatcttgttaacggcaacaatgagctttttgacaccagtgttccgggccagcagagcgtgctcgcgagtctggccacccttctcgaaaccagtctcgtattcacccctacgagcagagatgacaagcacaccgacatcggcttgcgaggcgccaccaatcatgtggtggacgtaggatttgtgaccaggagcatcgaggatggagaagtgtctctcaatgggaccatcgggagactgcacggtgagcttgaagtggccacggccgacctcgacagtctttcccttagctcgttcttcgttggtcaaatcgagagcccatga

SEQ ID NO: 9609 - DNA, 1428 bp, A.fumigatus
  unsure (29): Identity of nucleotide sequences at the above locations are unknown.
atcatcgtgagtctggaccccctggatgntggtgaacccgcaggccactcaaagcgtgcgctcctggaatcagtcgcggccggtctggatgtcgcaatctataccatggatcaggttgaggaactgggcaccgcttcgaatcgtccttgcgttcctccgtctccttcggacatcgtcactatcaactatacctccggtactaccggtcctccaaagggtgtggtcttaacccatgaaaatgccgtagctgctgcctcttcggctctcgtcaacatccggcaggccccgggtgacacgagtttgtcttatctcccgttggcccatatctatgcccgtttagcggagcataccgctttctgggcgggtgcgcgtatcggctacttccacggtaacatcgtcgaattggttgacgatatcaaggcgttgaaacctacggcattcttctctgtgccccgtctttacagtcgctttggcaacgtcattcgtggtgccaccgtggagcaacccggcttcaagggtgctttgtcgaggcacattgttgccgccaaaactgccaatctgaagaatcccgaccctagcaaagccaccgtgaagcatgctctatacgacagaatctgggccaagaaggtctctgcagccattggtttggaacggtgtagattcatggtttctggatcggcgcctctcgacccctccttgcacaacttcctgagagttgcttttggagttgatttcatccagggttacggtctgactgagacgtacgccatcgcaagctcgcagtctgcgaaggatcttaccgccggcaactgtggacgtatcgctccttccaccgaagcctgtctgatgtctctgcctgacatggactattcggtggatgacaagccgttcccgcggggtgagttacttctgcgtggtaccaatatcttcagggaatacttcaaaaacccagaggagacaagcaaagcaatgaccgaggatggctggttccgcactggggatgtttgcacaattgatgaaatgggtcgctttatcatcatcgaccgccggaaaaatgtcctcaagctcgcccagggagagtacatctctcccgaacggcttgagggtgtctacctgtctgagcttagttactttgctcaaggctacgttcatggcgacagcgttcaaactttcctggttggcattttcggtgtccagcccgatacattcgctccatttgctagcaaagttctcggtcggactatcgacgctacagacattgagggactgaagtcggttctgggtgatgacaaggtccgcaaggccgtgctgagggacctcgagaagatcgccaagaagcacaaacttgctggttacgaaagggtcaagaactgtgctttgctcattgagcctttctcggttgaaaataacctgctgactccgacgtaa

SEQ ID NO: 9610 - DNA, 258 bp, A.fumigatus
cggcgcaccctcccccaaagtctggcttttttttttttttttttttttttttggaacgtctctgcacatctacgtagcatatgtcgactttgcgatctcacttggtacgtggcttgtattatctctacgttgggaaagaactggacctgttggctgcttgacaagtgcgagatcatccagaatttcgtctttgtctccaatgctccatattgcatcacatgcaagatgatggaaataccagtccacagcgccgagtag

SEQ ID NO: 9611 - DNA, 1581 bp, A.fumigatus
  unsure (102): Identity of nucleotide sequences at the above locations are unknown.
cctccggcggacactgcatctacctgggggcgaagacgaagctcctgcccacgggacaggacaccaatccgaattgtgtacgcacggttcagcgcaaactcncgggataaagtggacaagactcttctgttctatggccattacgatgttgtgagtgcggatgccaaccgaaccaagtggaataccgatccataccagctggcatccatcgatggctttttgtacggccgcggagtttcgacaacaaaagggcctatcttggcggcattgtatgcggcagcggatctagcacggcaaaaggcgcttccttgtgacgttgttttccttattgagggcgaggaggagtccgggtctcaaggattccacgagaccgtccgacagcacaagccggaaattggatcggttgattggattctactggccaacagttactggctcgacgattacaacccgtgtttgacgtacgggttgcggggggtggtgcatgccaacctgatcgtcaccagcgaccatccggatctgcacagcggtattgacggcagcgcattgctggatgagccgttgaaggatctgtcgatgctgcttgccagcttggtgggtcctaaagggcggatcaatatcccaggcttccatgacctggtccttcccctgacggaagccgaaaagcagcgattcgccgacgtggcaaggattctgctaccgcagcaccctgaaatcaccgaccgtgacgcgctcatcaactcgctgatgcaccggtggcgggagccatctcttaccatccattcggttgaggtgcccggcagcagcaaggccgcaacgaccaccatctcgcgcaaagccaaagccagcctttcgatccgagtcgtccccaatcaagaggcagacgaggtagccgccaacctcaccatgtacgcgcaggagcaattcgacaagctcgagtcacagaacgacctcaccgtcgaaatcaccggcaagtcagacccctggctaggcgatccggacaacgagatcttcgcgaccctctcggaagctatcaccgcggcctggagccgggaccagaccagtcagaaacatcagtatccgccgctgcagcgttttcccaagggcaaggacacgccgggcctcgcgcgcaccgactcctcggacagcctggcctcgcacatcgatcgcatcatcatgtcgaccacgacctcgtccgcgagcaagagcaaggcccgccagcgctccgccctcagcagcacagtacccacctcgtccacgctgacgagcaaatcgggcgtgatcgtttccccagacgccagcggggactcctcggacgagaagcccgcagcccctgcacaggagccggtcgccacccgttccactgtccagccgatcttcatccgcgagggcggctcgatccccacgatccggttcctggaaaaggagttctcagcgccggcggccaatttaccctgtgggcaggcgagcgacaatgcgcatctgtacaatgagcggttgcgggtggagaatctgtacaagagtcgggagatcttccagtatgtattttcgcggttgccgaggcgccaccgtcccagttag

SEQ ID NO: 9612 - DNA, 402 bp, A.fumigatus
ttactgatattccacacccggccagaccagaatgacgaatccctgaaccgctggaaggcctccctcggcctcaacaccggcaaaccgatcggtgatcccaacgaccccagaaaatgcatcatcaggtccctgtccttggaggtcgagggccgccccgacgtggtgattgagctgtccgcgcccggcgccctcgaggcgctcaaggacaagccatttacgatcaaggagggagcgaccttccgcatcaagtgcaagttcgaggtgcaccacgaggtcctgagcggtctcaagtatctgcaggtggtgaagcgcaagggaatcagagtcagcaaggactatgagatgctggtgagtattattgattcaggaagcgtgacctgctgcgtgcgtcgtttaacctag

SEQ ID NO: 9613 - DNA, 414 bp, A.fumigatus
gtcctccgtatactcttgggttccttctcttgcattcttttagatttgtatctcttctctccgacctctgtccggtatacgttgcatatatatatatatatagataccctcccgctcttatccctgcccccttctctggtgccaccatccttggttcaggtaccccgccaaaaaagaagccgtcaacaaacaacagctacactcacaatgactgaacacgacgatgatctcgttgcctcgaagaccgagggcttcaaggtaggagagaagaagacaattgaagaatacacaaaactcggtatgtcgaggctccttagacttccctatgccagtcatgctggcaattcttccctccactcggggttaccagtcagccccttaccgcaagcccgcctactgcaagctgattactga

SEQ ID NO: 9614 - DNA, 210 bp, A.fumigatus
  unsure (180): Identity of nucleotide sequences at the above locations are unknown.
tcgcatctcgatcccccatcacaatggcacaaaacatggttccagagattgtataccttacttgggtcatctcataagtccacttgtctatccctgagtgatgattatgatcttagactagattctagacctcatcctcaccgcccttctcatgatcttgaagcaattggtatttttgcntatgccccccaccagaccgtatcagactaa

SEQ ID NO: 9615 - DNA, 633 bp, A.fumigatus
gatctctcgcacctcgtaccacaacatcgtctggaggatgacaaggtccggaaacagctcgtcaataacagtgccatgtcaggaaatggatccagttcaaacgcagccacttctctcctggccggtggcaatggccgtcgtgctactgctggtaacatcactatgggtcttcccatcgaggagaaggagaagggccctaacaagggtgacatcctgaacggtgccgtgggttggatgcgtgacttgatgtgggctcttcatgttaagctgcagcaggagtctgagctcgcggaattgatcactagtctcggaggcacctggccgtttgaacagacggaggaggagaagcgcatgcggagtgagattctggacgctttggagaagaacgatcctagcaccttcacttacagccgaggacccgggagcggcttgagagtgcccaagcataccaacttagcgggcgagcccatttcccaaaacggggcgctgagcccgcagagtctcagcccgtcctacaacagtggtggcagcagcaacggcgggaactcgggtcaagcacaatattggaacagctccggtcacgcgggaatgagcttcaaggaagaagatgagtacgcaatggagatgcagtaa

SEQ ID NO: 9616 - DNA, 498 bp, A.fumigatus
gctggtcaagatccgtctgcaggatcgcgcttccgcaggcaagtacaacggtatgctggacgttgtgcgcaagatcatcgccacggagggtcctcttgccatgtacaacggcctcgagtcgacgctgtggcgtcacatcctctggaacggcggctacttcggctgcatcttccaagtccgcgcgcagctccccgctgccgaacccggcaacaagtcccagcagacccgcaacgacctgatcgcgggtaccatcggtggtatcgcgggtaccgtcctcaacacccccatggacgtcgtcaagtcgcgcatccaaaactcccccaaggtcgccggtcaggtgcccaagtacaactgggcctggcctgccgttggcaccgtcatgaaggaagaaggcttcggcgccctctacaagggtttcatccccaaggtgctccgtctcggtcccggtggtggtattctgctcgttgttttcacgggtgtcatggactttttccgtaa

SEQ ID NO: 9617 - DNA, 744 bp, A.fumigatus
atgtcagaagctaatcgtgggactctgagcagattctcacgtctataccgcggtatctcggcccccatcctgatggaggctcccaagcgtgcgaccaagttcgccgccaacgacagctggggctccttctaccggggactgttcggcgcgcagaagcagacacagtcgttggccgtgctgacaggtgccaccgcgggcgccaccgaggcctttgtggtcgtgccctttgagctggtcaagatccgtctgcaggatcgcgcttccgcaggcaagtacaacggtatgctggacgttgtgcgcaagatcatcgccacggagggtcctcttgccatgtacaacggcctcgagtcgacgctgtggcgtcacatcctctggaacggcggctacttcggctgcatcttccaagtccgcgcgcagctccccgctgccgaacccggcaacaagtcccagcagacccgcaacgacctgatcgcgggtaccatcggtggtatcgcgggtaccgtcctcaacacccccatggacgtcgtcaagtcgcgcatccaaaactcccccaaggtcgccggtcaggtgcccaagtacaactgggcctggcctgccgttggcaccgtcatgaaggaagaaggcttcggcgccctctacaagggtttcatccccaaggtgctccgtctcggtcccggtggtggtattctgctcgttgttttcacgggtgtcatggactttttccgtaagattcgtggcgagtaa

SEQ ID NO: 9618 - DNA, 1005 bp, A.fumigatus
gtgctcatatctctggcgctcaatattcaacgttacgctcacatccggatcgagagggagtgggagcagagcaagctacaaagggagatacagtggaaacgggccaactcgggccggaatgcagcaggtgcctacggaactactgtagctgaagaggatgacagagaattcagacgagggggacgtctgtttcctcgttatcgagacgagtctccggattccgggccagaactacccgaggactttctaagacggagcgacgagttctcggatggagaatcaggcccgcgtggtcgcctacgcgagtcctttctatcggaccaaactattcgtgctggggataaggattcgcgccatggccggcgcaagtcatacctccgctcgccgtactggtgggcgggcctcgtgctcatgtgtctcggcgagatcggtaatttcatggcatacgggtttgcccctgcatcgattgtgtccccgctaggcgttgtcgcgttgatctcaaactgcgttattgccccaataatgctcaaggagaagtttcgccaacgcgatgcctggggtgtgctcattgcaatcgccggtgctgttgtggtcgtgctcagtgccagttcgtcggaagagaaaatcggtccccatgatatatgggtcatgatcacgcgctgggaattcgagttgtacttgggtctgacagcctgcttgattatcgccctcatgtgggtgagccacaagtatggctctcgaaccatcctgatagatgtcgggctagtcgcgctatttggtaagtctcagtcattattgatgcgtctggttgatcgtgtgatccaagtgctcattcagatatcaaggtggatataccgcattgtcgaccaaaggtgtctcgtcactgctgtcatttacgctatggcatgttattacctttccggtcacctatctactggtgtttgtccttgttttcagcgctctgatgcaaatccggtacatcaaccgggctttgcaacgttttga

SEQ ID NO: 9619 - DNA, 1266 bp, A.fumigatus
tccaagtgctcattcagatatcaaggtggatataccgcattgtcgaccaaaggtgtctcgtcactgctgtcatttacgctatggcatgttattacctttccggtcacctatctactggtgtttgtccttgttttcagcgctctgatgcaaatccggtacatcaaccgggctttgcaacgttttgattccacccaagtcatcccaacccagtttgtactcttcacattgtcggttatcgttggaagtgctgtgttataccgcgactttgagaactacaccgtcgagcgcgcctcaaagtttgtctctggttgcctaatgacattcctaggcgtgtactttatcacgagtggcagactccgtgcagatgacgagtcttctttctccattgatgacgaggaagaagcgattgggcttctgggaggagagcagtatcaggacaactttgacattgcccgtcctgcgcatcaacctaggacagccaaacgcgggcagaggcaatcaatacctgatgagaacgatctacaatccccattaggatcgttcctgggcagtggaattgaagacgttgatgaggaccagctcactcccaagggtgctctgtccgcggctccttcatctcctgtcggctccataaccgcggaatctcctacgcagccatctcccgggcatccgtctttgcactcacactctcactcactgttgacgaacccatgggcggaccacttggaacaacacgttcaggcttccaattccgaacctcagcttcaccgaccagccactcctccggaacagtccgaaacaggaaatgctgattcagcagtcctcttgcagtttcctcctgcccccggtattgaagatcgcggttaccgaccctcgtctccatccaagcccgaccacgtcgaaccggctgaccgagcaagtaccgtcccccagactcctcccgcaaggaacctacgcaattctatatccaagcatttctctcccggcccactcctccctaccctttcagcaggtttcagtgcggtcgttgccgaatcacttcgccgtggcgaaaccagtcccgtgaaagaccgaaagtcgcataagcgatccgctcgaagaaagcagctaagcacaacagtctttgacggttacacgcgcaacagggacagaggcccttcagatgaggtggatgcaggtgtggaccagcatcttccattgcaacttgcgactgctcgactccgttctgtcttcaccacaggggccgaaggatccgcgctatgcgta

SEQ ID NO: 9620 - DNA, 192 bp, A.fumigatus
aagaactctgaccagtttcaacacttatgtaaacttcccttatggagcgataaactacaactctcaagagattgcattgagtttgctattgtcatagatagtccttacatggagaaaggcggaggctggtgtctcaaaaagctcatgaaagcagctgaaactttccctcttgaggccgccaattgtaggtaa

SEQ ID NO: 9621 - DNA, 1305 bp, A.fumigatus
gcttattccccccctccgtcatgctttccgactgtgcttttcgagatactggcttggctcttttttttctgccttgtttacgctaacgacgctttctctatcaaatcctcacagcccgatagacaaatttcccaaatcgagaaaagtgtcacccacctccttgtcgctacaaaacaactactggagaccttgactcaatggtctcgaagacaggcgtctgagaacgaagtctcagacgtctatgtacgactaggttacgaatttaacctagcctgccgcgccttcaacgcgattggtgttgatacctccgacctgggcccagtgcctgacctcctccgcacaatcctggaagatactctgagccaggatgcgtctcctcagagtctcgatcgatatctgcctcgtattcgtgacataattatcaatctcctccatggtctcaagaagaagcaggctcgcttgcgctcacggcagcaaagggaagaaagccgtcccttacctggtcggcaggcaagctcggggagtgccgttacaaaccagatgtatgaggaagccaccgccagttcgccgaaaaggccaggtagtcgtcggcatggaagcaatggctcactcgaagaccagtccagcggggctcattctggttctactgtgcagacttcaaacgacacgaggggtactagctactcggagagggaagcgtcaagacgagaagcgcagcagattctatctcagccatcgcaacctgagaccgcaatttccaatgtagccatgccttcacccgacttctctggttatcctactcctccccctccgccccctccccccaagcaggacgatgctttgggtgccctccaaagaagtggagaactggaaagacgagcctcgcggcggttttctgcctaccagatacagaaacatttgggagcatcaaatggtgtccccgttctgccaacacagaattctcccgtcccaaatcgcggtcgtgatgtccgcgaatctttgaatgcagtacgcttgcgagggtcttatgcacatggtagacaacggtcgacaaatcgtccgcaagatgcggttactccaagcaaaaccgcgaagccattgccatcctctcaccttgcgcaaggaggagagagtgagctcgccaaggctcgcaccgcatctccgacagagtctcaggcaaatgcttccgttacatcccagatacgcccggacaaagtgccactccggtctgaagatggtacgatcgatagccctacagtcgccggaaaacagcccggggcgcctcagtctgctgaggaacgtctt

SEQ ID NO: 9622 - DNA, 234 bp, A.fumigatus
ggcgatgtgaataagctcggattaagctccgtggaaggattaggatggaattgcatggatgctaacagtttggttttctcttttacagctgcccgcatcaagcgcaaccgcgcgacccagcagatcaagttcaaggttagatgccaccgcttcatctacacccttgtcctgaaggactccgacaaggccgacaagctcaagcagagcctgcccccaggtgcgttgccaacctaa

SEQ ID NO: 9623 - DNA, 189 bp, A.fumigatus
  unsure (136): Identity of nucleotide sequences at the above locations are unknown.
atactggactgccgacgagatgcggagatggcttcgcaatgtacgtttcgctcctctcatcagggattcccgcaactaacaggtggcgacctgcagagagccctcctgcccactgagcaggccacacgcgacgatntactcgagcgtgtcagagcggatctgcgcgtaccgccgagatcaacgacctga

SEQ ID NO: 9624 - DNA, 1173 bp, A.fumigatus
ggctatctgcaagcttggcttgaaggccaaggtacgttcgcgtccctgatcctgatctcgacttcgcattcagttctaaagtgtcgttgccacagatcctcacacacatcagatgtcacatggacgacgccagagttgctgtcgagactggtgttgacggagtgtaagtggccctaccaacgttggcaatcacggctggattctgactttttatatagtgacgtcgttattgggacctcgtcctatctccgggagcactctcacggcaaggacatgacctacatcaagaacaccgccattgaagtcatcgaattcgtcaagtccaagggcattgaaatccggttctccagcgaggactccttccgttctgacctcgttgacctgctgtccatttactccgctgtcgacaaggtcggcgttaatcgtgttggtattgctgacactgtcggctgcgcttcgcctcgtcaggtttacgaactcgtccgtgtgttgagaggtgtcgttagctgtgatattgaaactcacttccacaatgacaccgggtgtgccatcgctaacgcttactgcgccctggaggctggtgccactcacatcgatacctctgtccttggtatcggggagcgtaacggcatcactccccttggtggtctcatggcccgtatgatggtcgccgaccctgaatacgtcaagagcaagtacaagctcgagaagctcaaggacattgaggatcttgttgccgctgccgttgaagtcgacattcccttcaacaactacatcactggtttctgcgccttcacccacaaagccggtatccacgccaaggccatcctcaacaaccccagcacatacgagattatcaaccctgccgattttggtatgaccagatacgttcactttgcttcgcgcttgacgggttggaacgctatcaagtctcgtgctcagcagctcaacattgagatgaccgatgctcagtacaaggagtgcactgccaaaatcaaggctcttgctgatatccgtcccattgccgttgacgacgctgacagcattatccgtgcctactaccgcaacctcaagtcaggcgagaacaagcctctccttgacctcacagctgaagagcaagctcaatttgctgccaaggagaaggagcttgctggctcgggtgttattgcttaa

SEQ ID NO: 9625 - DNA, 297 bp, A.fumigatus
tctcccttcttcctagttcctcaccccggcttcactgccgtcgagacccgtcaaaaccctcacccttcggcttctcgtaacccttacggccacaacgtcggtgtgaccgacttcttgagcaatgtctctcgttttaagatcattgagagtacccttcgtgaaggtgaacagtttgccaacgccttcttcgatacggagaagaagattgagattgccaaagctctggatgactttggtgtcgactacgtgagtcatagccagctgctgtcaacatgttactgggaagacgtgcactga

SEQ ID NO: 9626 - DNA, 864 bp, A.fumigatus
cttgaggttgcggtagtaggcacggataatgctgtcagcgtcgtcaacggcaatgggacggatatcagcaagagccttgattttggcagtgcactccttgtactgagcatcggtcatctcaatgttgagctgctgagcacgagacttgatagcgttccaacccgtcaagcgcgaagcaaagtgaacgtatctggtcataccaaaatcggcagggttgataatctcgtatgtgctggggttgttgaggatggccttggcgtggataccggctttgtgggtgaaggcgcagaaaccagtgatgtagttgttgaagggaatgtcgacttcaacggcagcggcaacaagatcctcaatgtccttgagcttctcgagcttgtacttgctcttgacgtattcagggtcggcgaccatcatacgggccatgagaccaccaaggggagtgatgccgttacgctccccgataccaaggacagaggtatcgatgtgagtggcaccagcctccagggcgcagtaagcgttagcgatggcacacccggtgtcattgtggaagtgagtttcaatatcacagctaacgacacctctcaacacacggacgagttcgtaaacctgacgaggcgaagcgcagccgacagtgtcagcaataccaacacgattaacgccgaccttgtcgacagcggagtaaatggacagcaggtcaacgaggtcagaacggaaggagtcctcgctggagaaccggatttcaatgcccttggacttgacgaattcgatgacttcaatggcggtgttcttgatgtaggtcatgtccttgccgtgagagtgctcccggagataggacgaggtcccaataacgacgtcactatataa

SEQ ID NO: 9627 - DNA, 285 bp, A.fumigatus
atacaatacttccatgtctgtctcgatcccagtactcatgaattgatgatgatagtggatgacactctgcaccgctattctttctactcctcttcccccgaaattcattgctccagctcggctggcgccgttcattatgaggctgataaacgcactgggggagaatccatgttcagaaaccatattcccgctatatcaaattatgaccggcctgcaaccagtccccggagtattactggagatatctccggagacaatgtcgagccttcaggtagagattactaa

SEQ ID NO: 9628 - DNA, 186 bp, A.fumigatus
aatttggccgcggctgaaattggaggctattttgaacccctaaaacatgattttattactaaatctagttattcttgcgctacggacattgtaattacctatggcctagaatatgacagtcactgcagcatgggggtgcctattaagggtgttattctgtatctactacctactctggagggatag

SEQ ID NO: 9629 - DNA, 285 bp, A.fumigatus
aagggacccatggttgatgggccccttgaccactactctagtgtggtggacattgacctgaacggtaccttttactgcgccaagtacgccgctgctcactggcggaggcagaaggaagagggaaccgacatctacggcaacaagctttccaacttcacatatgggagctttgtggccactgcctccatgagtggccacattgtgaatttcccgcagatgcaggccgcctacaacgctgccaaggcggctgtgatccatctttgtaagtttggctggctggaatga

SEQ ID NO: 9630 - DNA, 270 bp, A.fumigatus
aaccgttgctcatacagcccaggcaaatctcttgccgtggagtgggtcaagttcgcccgtgccaacaccgtctctcccggctacatcgctacagagatctccaacttcgtgcctcaggagaccaaggacatctggaaggacaagattcctatgggtcgtgaaggtcgtgctgaagagctgaagggtgcctatctctacctggcttcggatgctgccagttacaccaccggtgctgacctcgttgtcgacggtggttactgcgcaccataa

SEQ ID NO: 9631 - DNA, 1005 bp, A.fumigatus
cttcttccaggatgctgctcctgtcaagaaggtgtcgctcttccgcaatggtatctcctccgaagtccccccaaccccaacccccagaccaaacatactgacgagtcagccaccgaggtcgagttcaccggaatcaagcgtcgtctcctcactgaaggcctctctgacgatgccttgaccacgctcgcccccggcgccacctttgaggacgagttcgacgtcgccagcacggctgacctcaccgagggtggcacggtgaccattcgcaccgatgggtttgtccccataaccacagaccgcaaagtctccggctacatcccctaccagtcaaacgagctcgagatcgaggtcgacgccgcaaaggccgccgccgtgccccaggccatcaagctcctcgaccgccgcacaaaggtcgcctcctgctccggcagccgtgcctcggccctctccacggctctgcgcaacgcggcttccctcgccaacgccgctgccagcgctgcctcctccggctcgtctactcgcttccaggagtacttcaagaccacctccagcagcacccgcaacaccgtcgccgcacgcttccgcgccgtcgccagcgaggcctcctcccagtcttccggcaagacgacctactactgcaccgacccctacggctactgcgactccaacaccctcgcctacactctcccctccagcaacctcatcgccaactgcgacatctactactcgtatctcccggcgttgaccagctcctgccacgcccaggaccaggccaccaccaccctgcacgagttcacccacgccccggctgtctactcgcccggtactgacgactatgcctacggatatcgggcctccactgccttgagtgctagccaggcgctgctcaacgcggatacctatgccctgttcgctaacggtaccccccccctccttcccctctccacatccacttccaaatgctcgacactaacaatggttatagccgtgaaccttaactgctag

SEQ ID NO: 9632 - DNA, 519 bp, A.fumigatus
cctcctgttctggtcatatctccgttcgttccaggactcgttcgtgatatctatactgcaatcattagccttgggggggtggtctataaatatggggttgatcccaggtctgccagacgcatcagcaagagcacagcatcagtaaagcagctcagtccaattcaattcattatgaaggtcactattctcgcttctgccattctggccctcatcaatggtgctctggctcttcctgccaacaccccgaccctggatgtcaccctgacccaggtcgacaacactcgcatcaaggctaccgtcaagaacactggcaacgagaaggtcacctttgtgcatcttaacttcttccaggatgctgctcctgtcaagaaggtgtcgctcttccgcaatggtatctcctccgaagtccccccaaccccaacccccagaccaaacatactgacgagtcagccaccgaggtcgagttcaccggaatcaagcgtcgtctcctcactgaaggcctctctgacgatgccttga

SEQ ID NO: 9633 - DNA, 456 bp, A.fumigatus
ccacagaccgcaaagtctccggctacatcccctaccagtcaaacgagctcgagatcgaggtcgacgccgcaaaggccgccgccgtgccccaggccatcaagctcctcgaccgccgcacaaaggtcgcctcctgctccggcagccgtgcctcggccctctccacggctctgcgcaacgcggcttccctcgccaacgccgctgccagcgctgcctcctccggctcgtctactcgcttccaggagtacttcaagaccacctccagcagcacccgcaacaccgtcgccgcacgcttccgcgccgtcgccagcgaggcctcctcccagtcttccggcaagacgacctactactgcaccgacccctacggctactgcgactccaacaccctcgcctacactctcccctccagcaacctcatcgccaactgcgacatctactactcgtatctcccggcgttga

SEQ ID NO: 9634 - DNA, 333 bp, A.fumigatus
accttaactgctagccagtacgagatctacgagaaacgagagaacgaaatagtaacaagcttagttttgcacaacccaatcaattcattatacttccttgcatactatagccatcctttcaaccagagtcataaccgtaactataagcatacccgtacgctgaggcgaggcactgctgttaacccctccggcaaatcccttcgagacatttatttccactatagcaacagtccgcgtcactctcacacagctggaaatcctcggcgcagcccggccacttcggactcgtgggccggcatttcgtcgcggcgcagtagcccgagcagcaggtga

SEQ ID NO: 9635 - DNA, 642 bp, A.fumigatus
tgtcgagcatttggaagtggatgtggagaggggaaggagggggggggtaccgttagcgaacagggcataggtatccgcgttgagcagcgcctggctagcactcaaggcagtggaggcccgatatccgtaggcatagtcgtcagtaccgggcgagtagacagccggggcgtgggtgaactcgtgcagggtggtggtggcctggtcctgggcgtggcaggagctggtcaacgccgggagatacgagtagtagatgtcgcagttggcgatgaggttgctggaggggagagtgtaggcgagggtgttggagtcgcagtagccgtaggggtcggtgcagtagtaggtcgtcttgccggaagactgggaggaggcctcgctggcgacggcgcggaagcgtgcggcgacggtgttgcgggtgctgctggaggtggtcttgaagtactcctggaagcgagtagacgagccggaggaggcagcgctggcagcggcgttggcgagggaagccgcgttgcgcagagccgtggagagggccgaggcacggctgccggagcaggaggcgacctttgtgcggcggtcgaggagcttgatggcctggggcacggcggcggcctttgcggcgtcgacctcgatctcgagctcgtttga

SEQ ID NO: 9636 - DNA, 210 bp, A.fumigatus
ccatatctcacccgatggcagctgactctgcaaatagaaagtgccatgaatgaagataactctagcacgacggatccagcgaagatccaacaggccaacaaaacattttcccgcaatcacgctatgtcgatccatctgaatgcgattgctcttgttgcaaccgtttggtatgggtttacattgtcgtcgagccttctgaatgggttgtaa

SEQ ID NO: 9637 - DNA, 438 bp, A.fumigatus
accaacgccatgtccacacagcacggccccaagtccacccgtacaaacgacctgtacgagctcgccgtcaacatctccagcacggtagaggcctttgtcggaaggctggacgcaatcggcgccgaacgacccaacctagacaatccctttccagagatcatccaagatgaaggcgcgcagctggcccggctaaagattctgcgtctctgcgaacggctgatggctctggtccagggtccggtccaatggctcatgttccagaatatggcgttcctcgatgccgcctgcgtcggggcgattctggacatggggatccacgacatcattgcgcctggacccgaaccaacgtcgctggatcagattgtagaggcgacgggggcctcgaaggatattctaagtacgcgacgccggctatctagtatgcaaagatcgagctga

SEQ ID NO: 9638 - DNA, 429 bp, A.fumigatus
atcctcgcagcaaacaagggtcttttcgactacttctacaccgaggatctcgcccgtggtcagcgtttcgccctcggtatggcaggcagtgagatcatgaagaccctcacggaggacatgttccccttcgagtctctgccgcagggcgcaaaagtggtggacgtcggaggcggccggggccatgtcagcgtacgcatcgcagagaaggttcctggtctgaacttcgtcgtccaagacgatgagtccatgctagaggctggtcaggcagaaggtgtccccaaagcagtcaaagatcggatcgagttcatgccgcatgatttcttcaatgagcagcccgtcaagggggcagatgtgtatctcttgcggttcatcctgcatgatcattcggacaggttagttttgccaacaggaaggaagaagtatggctaa

SEQ ID NO: 9639 - DNA, 333 bp, A.fumigatus
ttttgccaacaggaaggaagaagtatggctaatagtcccagtcgctgtgcgaagattctgtcgaacatcgtcgatgcaatggagccgggaaagtcgcggattctcatcgacgatgcgattgttcccagcttcttgggtccggagagttctcggttctataacttgctggatctctacatgctggctggtttgaatggaaaggagaggactttggagcagtggaactacttgatccagatggttagtcccaagttggtgctggagaaggtttggaaaacgccaaacggcgggcctgaatcggggactatcctggaactgcgactgcaggaatga

SEQ ID NO: 9640 - DNA, 492 bp, A.fumigatus
  unsure (1): Identity of nucleotide sequences at the above locations are unknown.
naccacattcatttccaatacaacggctttctgtacggtattctcgttctatccatcgttctagcgcgcaagccatcgactctactatacagtggcatcctgttcgcggttctgctgtgcttcaagcacatttacctttatctgtcgttagcctactttgtttacctgctgagggcctactgtctcgatccgaagtctgtctttcgaccccggttcggcaataccttgaaactcggtttgagtgtcattggcgtattcggaatcgcttttggcccgttcgctcattggaaccagctgctccaactgaaagacaggctatttccattctcgagaggactgtgccatgcttactgggcgccgaatatctgggcaatgtattccttcgcagatcgcgtgctaattctgcgtgagtacaacaatcttcgcctgcatctgtgcagatttactcaccataacagttgctccgcgcctgggccttccgatcaaccatga

SEQ ID NO: 9641 - DNA, 525 bp, A.fumigatus
cttcctctgataaagctctggcttcatccggattggaacacgtttgttggtgctattactctatgcggttatgcttcattcttgtttggctggcacgttcatgagaaagctgttctcctgatcattgtccctttcagcttgatagcgctcaaggaccgacgctacttcagcgcatttcggcccctcgcggttgcaggccatgtttcactattcccactgcttttcacagcagccgaattcccgctgaagaccgtgtatactgtgtggtggctggtccttttcctgttcgtatttgaccaagtcgccccagtttccgagcggccgcggatgttcgtttttgaccgcctgtccctggtatacctgacagtggctatcccgttgattatatattgctcattggtgcatcagcttattttcggatgggaccggtatgagtttcttccgctgatgttcatgagtagctattctgctctgggggtagtcggcagctgggtcgggttcatggtcgtctatttcaccacatga

SEQ ID NO: 9642 - DNA, 1113 bp, A.fumigatus
ttttattcctttgctcaatacagagacatacaaaccaacatgagtggtgtattcggccttctatttagcaggctgactctcccagctccctcggcaatccaggggaaaactatcctcatcaccggtgcgaacactggcctcggtcgtgaagctgccagacatgcgctcgccctgggcgccggtacggtcattttgggcgttcgaagcctgagcaagggcgaagacgccaaagccaacatcgacgcaagtaccggctgcacagacaagggaaaggtacttgtttggccaatcgacctcgaatcatttgctagcgttcaaggcttcgcagcgcgagttcgcaaatatgtcacggagggcggccgactggacatggccatcatgaatgctggaattgcgtcggtcacgtacgctgttacccgtgatgggtgggagagaggcatccaggtcaatgttctatcgaccgcgctcctcagtctggagctgctgccgctactactgcgaacaaaagagcgagattcatcatcccaaccgcatctgactattgtcacaagcgacatccacaagtcaataaaatttcccgagcggaacgagcagaatattctttccgccttgaatgacgagaagcagtggagggaatcccaggctgtaggcggcgctaccgagcgctatggtgttaccaagctgatggatctcttcatcacctttgaaatagctcaactggtgcctcgtgacaagtccggaaacccccttgtaattgtcaatgccgtggcgccgggattctgcaaatcggatctcctgtctagggagaaggtgccgttgattctgaagctgatccaggctttaattgctatgacggcggaaaaaggcagcaaaacattgctgcatgcagcaagccatggagcggaaactcatgggaagtggttagacaatcagattatcacagagtacgtcgtcactttgattggagatgtgattgttcgcgctgctgatatgtgttttagacctggcaatattatcacaagccctgaggcagtggttttgagaaagaaactatgggcagagattctctcagtcttgcatgatgttaatcctgagatccaaactgagtcctaa

SEQ ID NO: 9643 - DNA, 240 bp, A.fumigatus
ttcgaggtcgattggccaaacaagtacctttcccttgtctgtgcagccggtacttgcgtcgatgttggctttggcgtcttcgcccttgctcaggcttcgaacgcccaaaatgaccgtaccggcgcccagggcgagcgcatgtctggcagcttcacgaccgaggccagtgttcgcaccggtgatgaggatagttttcccctggattgccgagggagctgggagagtcagcctgctaaatag

SEQ ID NO: 9644 - DNA, 432 bp, A.fumigatus
gcgctcttcgaactagtcactggtaatctgtgtacagcaaactattacggttctgcggcggcacggatgatatatatgctgggaggccatacctatcctggccccataaactcattctccgcatctcccgccgagcacctcgagcaaagaaagaaacgtcatctcaggaacctattctggctatgctatacgattgagaaggacgtggctctccgcacaggacaaccacaggtcctctcggacgaaaactgcgacctgaccctcccccccggttatgtagagcacctgtaccgcagcttgggcattcaccaccattcccgagaactgccggaccatccgatgttcccagtcgatctgcgcctgagtatcataaaatctcgagcctatagcgctctatactcgtttcgagggctccaaaaaacagacgcctag

SEQ ID NO: 9645 - DNA, 306 bp, A.fumigatus
tttgctgtacacagattaccagtgactagttcgaagagcgcctatgaatctgtcagctttgttgaagaacgatacagtaaagtcacgcagcttgcacggcaatttgcaagatgccaggcgagcatgacgactcaccataatgataagcgcctgcagaccctccaagcccgcatcctcccggaggacctgcgggatgagacactgagccttgagggcaagtccctcgctgtcgatcggcgggaggctaagcggtctatccttgtattccggaacttggagaatggaactaaaggcaagaaaggatag

SEQ ID NO: 9646 - DNA, 1125 bp, A.fumigatus
aggcgattggactcccttggtgacatgggagggccgacccttcatttgtacctcttgtccgacaatgtaacagaaaaggaggacttttacttcggtatgctccagaaccagactagaatgggcgactcgccaaattgtccgcccaagcatcagcagtttgacgtcaagcatattgtcaccatagtccaacgtatacactcttccgaggagcaactgcagacgcggtggatcaatgccgttctcggcagactgttcttggctttatacaagactccggaggtggaagacttcattcggcagaagatcactaagaagatctcgcgggtcaacaagccaaacttcatcagcaagctctgtttgcagcggatcggcatgggtgaaggtgccccttttatcacaaacccgaggctcaaggacctgacggtcgacggaaactgctgcgtggagactgacatccaatataccggcaactttcggcttgagatttcggccactgttcgcattgacctaagtcctcgtttcaaggcacgagaagtcgacattgtgctcgctgtagttctcaaaaagcttgaaggccatatgttgattcggtttaagcccccgcccagtaacagagtgtgggtttctttcgaaacaatgccaaacatggttatggacatcgaaccgattgtcagctcgaaacagatcacttacggcattatcctgcgaactatcgagagcagaattcgcgaagttgtcgccgagagtgtggttcagccatactgggatgatattcccttcctggacaccgcttcgcagccttaccgcggcggcatctggcaacgagaggtcccaggccaagattcaaaggctgagattcctgatgagtcaatcagtcagccacagactctgactacaaaagactcaactgaggctctgaagacgaaggacgatcgcgcaatgagcatgccagtgcttttggaaaccactgccggattgaaatcacgcaaaagctccaagttggttacaacagactcggaaacgagtatatcatcagccgttgataaaactggcggtttgtgctccgccgcgcgctattcgatctcaaacgttttcgaatgtggccgatcctgtcgtcactgctga

SEQ ID NO: 9647 - DNA, 1161 bp, A.fumigatus
aatcacgcaaaagctccaagttggttacaacagactcggaaacgagtatatcatcagccgttgataaaactggcggtttgtgctccgccgcgcgctattcgatctcaaacgttttcgaatgtggccgatcctgtcgtcactgctgataacgtcaagatcgaaaaagctacgagtgatatcaagggcgaagagaagagcagtgctgccagtgccatgattgagatctcgaaccgttcgcctcctggctcgccgaataagacgccgaatggatcaccgccctcaatcagccagatgaaccctgagaagctatcctccagtcgagggtcatcttttatggagtctattgaaagtgttagcgagttcgccagcagctccccaacgcgccctacatctgcgcacttggctagtgaatcgtcaaacgctctccgaggcgctaatggaagttcgaacgcgtcgatcaatagcgacaggtcgcgcaggcgaagcacgttggaaacagtagggaccctgactaggtccgtcacgtcttcgactgcttccgaagagaagccaaaattatctatctcgctgggtacagcgaccgcggcagcaaaaaaatggagttggagtgtgtttggaaagggagattcaaatagccaggaaatttctcggcctgcaggcactcccgacgagccgatcggacgtggtcaccctcttcctccgccaggcacccccttaccgcgccctgataaattcggtatcaagagtaaccctattcctcgacggaagcctgtgcccccgccactccccgggcgttccaaaggtgacgcgaagcggcccgtcccaaagccgcccctgccaaaacggaagcctccagcgagaccggagggtgacgaaagcagtcccgacgaattgctcgtggttgaggcgccatacgattcgacgcccaatagcccggcgcctgattcctcttctgagataggcatagtactgccgattgcgactcaggcaaatactcgggatctttcccgttctggatcggacgatgtggttgcaagccgccgctgggatgatggtacggagcaaaaatcaagcgagcatgactcgtttggtcatggaatgcccggtgtcaccaagcacggcatggaaatattatctgcaacagatgggatcttaccttag

SEQ ID NO: 9648 - DNA, 210 bp, A.fumigatus
cgttttgggcgtctatcgggaaagttggcgcctgcagttcggccatcgcaagtcttggcaacgcgtagtcctcctgatagcagtatctccttaacggagggcatgaagcccaacattgtgattacatatgtgaagcttctgcctagcgatggatctaaatatgtcatcagtctgagaacccaggtgactgctgtatgctcaatatgctaa

SEQ ID NO: 9649 - DNA, 525 bp, A.fumigatus
atgggaaccatacctggaggtatgactaacggtaccaggaactgggtctttcgcaaagccctctcaccgtcatcagcagcagcatcaacgaatctgccagacccgatcacaccctctggcccagcattctcgaagacttcgacaataggcaacgtccacacacggacaatgaagcaaacggcagtcaccctgttccggttttcagcgctgacgttcaacccacataaaattcattattcacttccttgggctcgcgacgtagagggccacagggacattgttgtccatggcccgctgaacctcatcaacattctggatctgtggcgcgacacgaggacggcaacgctcgccagcgaagctcccgagctcatacttcctcagagtatctcctatcgggcgacgagccccttgtatgctgaagaggaatatcggattatcctagaggatgaggatagtattgccaaggtacaagtcattggtcctgacggaaagacagtggccatgaaagcagatataaagagctag

SEQ ID NO: 9650 - DNA, 618 bp, A.fumigatus
ttcgccgatttggcgctcctcttattgagggactggtcggagaggccgaccgcaaattggtggtcaatatccggaagcagcgcgagcgccgcaagcgcaagaagaaggaaggcgaaggcgctggtgacgaagacgacgaggaggtggtggccgacaacgccggcaaagccgcttacagcaacgctttcgacaaggccgtctacgactcagatttctccgactctgaggacgacgccagtgagatcgaggtcgacgagcaaggcaacacccatgttcgcggccgcaagggcaagaagggcaagcagaacgagcagtacatccgtgagatgtctccggaggacaacccgctggatctcctggctcccgacgcgctggccagcatttctaccaccaagcccagcgtccgcttcctcaataccggcccgggctcccggaaaaagcatgccgccaaattcggcccagatggccgcctcctcatcggcgatgcggagaacgacgacatcgacatgtccggtgcacctggaggcgacgccgacccaggcgagagcggcatcaacgcctacctggccgctgtcagcggaccggacgccatccgccgcggtcaaaagggccgtctga

SEQ ID NO: 9651 - DNA, 786 bp, A.fumigatus
gatgtctccggaggacaacccgctggatctcctggctcccgacgcgctggccagcatttctaccaccaagcccagcgtccgcttcctcaataccggcccgggctcccggaaaaagcatgccgccaaattcggcccagatggccgcctcctcatcggcgatgcggagaacgacgacatcgacatgtccggtgcacctggaggcgacgccgacccaggcgagagcggcatcaacgcctacctggccgctgtcagcggaccggacgccatccgccgcggtcaaaagggccgtctgaagatgtctcaggcccagaagaagaagaacagcggcggcgacggcatggacctcgacgacaacgaggacgacgacgaagccccggcctccgcatccaaccatggcaagggcccacagtccacccgtcgcgggctcggagtgcccaagacacatggccccagcggcaacggcaggatccagaaacggagaaatcctcccaaggggggaagacagagcggacgcggcggcatccgtgttgggaagagacggtgaaggtggagatgaagcgggctgtctgcttcttgcgaggcaactggcagttattttcaatgccgatgtacggcgtatgggcaatgaccacacaatacattgggacctgggacttgaacatgaccatatggcattacagcatcctgcacacagaaaaaatattggcaatcttcttctctgttccttttccgtttctctcccagggcgtacgacctctgcgttatttgcattccatgtttttttga

SEQ ID NO: 9652 - DNA, 1749 bp, A.fumigatus
agacggtctggcgacaagaggcctcccacttctcacactctgatcgacttggtcattgccatgtcgatctatttgccccgttcaagctttgcaagcctgttcgcacttgctgcagctattttgaatggtcaaacgactgatcagcaactgatcaagaaagcatacaaactaattccccgcttggccaccacggagactggccgcactgctctccttgagcgcagtgcagagctgcagtctctcatgctcgcgacggcagacaagacgcccgcctcggcccgtcgggatcgaagcctagctatctacgagctgattacctacctcccaacatctgatctacattttattccttccatcctctcagaggttgttctgggttgcaaagagagtaacgagaaagcccggacagcctcctttgaccttctcatccaccttgctaagaggaccattgattccgaccggaacccgccaggaactaagattcgcaactctctggtgccccatatgcccaacgacgcccccgatgccccggcgacgatcgaggagttttttactatggtctccgctggtttggctggtagctcgccacacatggtcgctgcctccgtcacagccttatcccgccttttcttcgacttccacactcaactcgagccctcggtccgcattgacctggtccagacagtggagttgttccttacaagcaacaaccgggaaatcgttcggtccgtcctcggcttcgtcaaggttgctgttgtcgtcctccccgaagacgctctgcgtccccgcctgaatacgctggtccccaacctcatggtttggaacaaggagcacaagggtcgtgtccgcagtaaggtcaagggtattttggatcgcttgattcgccgatttggcgctcctcttattgagggactggtcggagaggccgaccgcaaattggtggtcaatatccggaagcagcgcgagcgccgcaagcgcaagaagaaggaaggcgaaggcgctggtgacgaagacgacgaggaggtggtggccgacaacgccggcaaagccgcttacagcaacgctttcgacaaggccgtctacgactcagatttctccgactctgaggacgacgccagtgagatcgaggtcgacgagcaaggcaacacccatgttcgcggccgcaagggcaagaagggcaagcagaacgagcagtacatccgtgagatgtctccggaggacaacccgctggatctcctggctcccgacgcgctggccagcatttctaccaccaagcccagcgtccgcttcctcaataccggcccgggctcccggaaaaagcatgccgccaaattcggcccagatggccgcctcctcatcggcgatgcggagaacgacgacatcgacatgtccggtgcacctggaggcgacgccgacccaggcgagagcggcatcaacgcctacctggccgctgtcagcggaccggacgccatccgccgcggtcaaaagggccgtctgaagatgtctcaggcccagaagaagaagaacagcggcggcgacggcatggacctcgacgacaacgaggacgacgacgaagccccggcctccgcatccaaccatggcaagggcccacagtccacccgtcgcgggctcggagtgcccaagacacatggccccagcggcaacggcaggatccagaaacggagaaatcctcccaaggggggaagacagagcggacgcggcggcatccgtgttgggaagagacggtga

SEQ ID NO: 9653 - DNA, 1023 bp, A.fumigatus
gctgtccatacgatgagcccgcttcgtcctctgctccgttcaccgcaaactcctggcaagcgggtagcccagcacatacggcatttccacgccacgcgaccatctcctttcattaatgaagttctggacgtttcgtctggcttcattcatgccgttcattcgataagtggcctcccatgggccttgtccatcccattgactgccttgatcgtccgaactactgttgcgatgccgctgcagatgtacaccaagatccaagcacgcaaggagcgagacctagctccgctacttcactcatggaggaaacattttcaagcgcaaattaaaaagcgtgttgatgccgagaatcacaacccaattctcccgagagaggcaatccgagagttggcgacaaaggtaaaggcgaagcggaaggaactgcacaagcgatggaacgtaccccggttctggaaacctgttagcttcctgcagataccgatatggatttcagttatggagagtctccgagccatgtctggaaacaacaagggtcttgtaccgtacctcctctccctggttgaaccctcctccgttgagccaagcaccgcggtccacctggcggtcgagccgtccctggccactgaaggagccctctggttccccgacctcttggctggagactcgacgggcattcttccagctgcgctcactctttcaatcatactcaatattcgtactgggtggaagtctcctgctctatcggacatggctgacttaccgcggatcgagattgcaaagaacctgactgtgcgtggtatcagggtactgatccaggcgcttgccttgaatatcggcgtttcgtcctatctgtacgaaatgccttctgcgctcatgatctactggataagcagtacgaacattgctactttacaaacttttctactggagaggttcatgttgtcaaagccactccttgagccctggagacagattcatattggctatcctcagaaaggcgaaaagacgcctccatcaaaaaaatga

SEQ ID NO: 9654 - DNA, 1911 bp, A.fumigatus
aagggcacaatcgtaccagccgacggccggatagtgtcggccaaccttattcaggtggaccagtcttcgatcactggtgaatctctggcaattgacaaacacaaaggagatacctgttacgcctcgtctgccgtcaagcgtggtcgagcaataattgttgttacggcgactggtgactataccttcgtcggacaggctgccgcattggtaaatgctgcatcctctggctcaggtcacttcaccgaagtcctcaatggtatcggcgccgttctccttgtgctggtcatcataaccttgcttgttgtgtgggtttcgtccttctaccgctcaaatggcatcaccacgatactcgagttcaccttggccattacgatcatcggtgtacctgtcggtctccctgccgttgtcacaaccacaatggcggtaggtgctgcgtacctagctaagaaacaggccatcgtgcaaagattatcggcgattgagtctttggctggtgttgagatcctgtgctctgacaagaccggcacgctgacaaaaaataagctttcattgtcggagccgtacactgttgctggggttgaaccggacgacctcatgttgactgcttgcttggccgcctcgaggaagaagaagggcatggatgccattgacaaagcatttttcaaggcactccgacattatccacgcgcaaaagcggcgcttacaaaatacaaggtgctggaattccatccatttgatcctgtctcaaagaaagtgacggccgtagtgcagtctccccaaggtcgccgaatgacgtgtgtcaaaggcgcgcctctgttcgttctcaagaccgtcgaggaggaccatcccattccagaagagattgatactgcatacaagaacaaagtcgctgaatttgcaactcgcggtttccgttcacttggagttgctcgcagacgcgatcagggcagttgggagatcctcggtatcatgccatgctccgaccctccacggcacgacactgcgaaaaccattagtgaggcgaagagcctggggctctcgatcaagatgctaaccggtgatgcggtgggaattgctcgggagacttcgcgtcaacttgggctcggcaccaatgtgtataatgcggagcggctcggtcttggaggtggaggaacaatgcctggatcagaggtgtatgactttgtcgaagctgccgacggtttcgcggaggttttcccgcagcataaatacaatgttgtggagattctacagcaacgtggataccttgtcgcaatgacgggagacggcgtcaacgatgctccttcgctcaagagagctgacactggtattgccgttgaaggatcctctgatgcggcgcgctctgctgctgatattgtcttccttgctcccggcctgtctgccataattgatgcactgaaaacttcacgtcagatattccaccgcatgtatgcatatgtggtgtatcggatagccttgtcgttgcacctcgaggtctttctgggcttgtggattgcaatcctgaatgaaagtctcaacctacagctcgttgttttcatcgccatctttgctgacattgccacacttgccattgcctacgataacgccccgtactctaagacccctgtgaagtggaacctccccaagctatggggcatgtctattcttcttggtcttgtacttgccgcagggacgtgggttgcgcttaccactatcatgaacagtggcgaagaaggtggcatcatccagaatttcggagaacgcgacgatgttctgtccctcgagatatcactgaccgagaattggctcattttcatcacccgcgcgaacgggccattctggtcatcaattccttcttggcaattgacaggagccattctagttgtccatcttgtcgctacgtctttctgcata

SEQ ID NO: 9655 - DNA, 270 bp, A.fumigatus
gcacagggtgctgctttcttggccgccgggcttcgagattgggtggatttcggtgtcatatgtgcgcttcttttgctcaacgcatctgtgggctttattcaggaatttcaggccgggtccattgtcgatgagcttaagaaaacactcgctctccaagcaatcgtctgccgcgaaggagagttcaatgaaattgacgcctcggagatcgtgcctggagatatagtcagaatcgaggaggtaacgtaccaccaaagctccaacttcagatga

SEQ ID NO: 9656 - DNA, 912 bp, A.fumigatus
gctgacgataaacctggcaggtacctcgactacaagaacatcaccaaggtcatccaacccggcaagctgatctatgtggacgacggtattctctcatttgaggtgctcgagattgttgacgatcagacccttcgtgtcaggtgcctgaacaatggcaacatctcgtctagaaagggtgtcaacctgcccggcactgacgttgatcttcccgctctttctgaaaaggatatcaacgatctcaagttcggtgttaagaatagggttgacatgatcttcgcctcgtttatccgtcgcggaagcgacattcgtcacattcgtgaagtccttggcgaggagggcaaggagattcaaattattgccaagatcgagaaccagcaaggtgttaacaacttcgatgagattctcgaggagactgacggtgtcatgttcgcccgtggtgacttgggtatcgagatacctgcgcccaaggtcttcttggcccagaagatgatgattgccaagtgtaacatgaagggcaagcccgtcatctgtgccactcagatgctcgagtccatgacatacaacccccgccccacctgtgcggaggtatcggacgttgccaacgctgttctcgacggcgctgactgtgtcatgttgtccggagagactgccaagggcaattaccccaccgaggctgtcaagatgatgtcggagacctgcttgcttgcagaggtcgctattcctcacttccaggtctttgacgaattgcgtaaccttgctccccgccccactgacaccgttgagtctatcgccatggctgccgtcagcgccagtcttgagctcaacgctggagccattgttgtcttgaccactaggtatgtaatatcgctgtcatctgcggtcgaccgaattccgctaacagtagatccttag

SEQ ID NO: 9657 - DNA, 360 bp, A.fumigatus
aactgctcgtcttctttccaagtatcgccctgtctgcccaatcatcatggtcactcgcaaccccatggccgcccgggtaagtttgatctcgtcgtcatcgttggacaaatgagcgtcgctaaccgtgcaatcaagtactcccatctgtatcgtggtgtctggccctccaccttccctgatacaaaacccgacttcaatgtcaagatctggccggaggatgtcgaccgccgcctcaagtggggtatttctcatgctctcaagctcggcctcaccaactatggcgacaacatcctttgttttccatcgctttgccggtggcatgggaacccctacacccgttccgttttggtccctgtctga

SEQ ID NO: 9658 - DNA, 252 bp, A.fumigatus
agcaattctttcttttcatcctttctttcaaatccatcagaggagtcgttcaaaatggccgccagcaattctcttgaccacctgagcaaccgtatgaagctggaatggcacgccaagctgaacacggagatggttcctgcgaagaacttccgtcgcacctccatcatttgcaccatcggtatgtcggagcttctcaatcttattctggaatatccacacccctacgaattgtttggtctcacaagatactga

SEQ ID NO: 9659 - DNA, 777 bp, A.fumigatus
cagcgatattacatacctagtggtcaagacaacaatggctccagcgttgagctcaagactggcgctgacggcagccatggcgatagactcaacggtgtcagtggggcggggagcaaggttacgcaattcgtcaaagacctggaagtgaggaatagcgacctctgcaagcaagcaggtctccgacatcatcttgacagcctcggtggggtaattgcccttggcagtctctccggacaacatgacacagtcagcgccgtcgagaacagcgttggcaacgtccgatacctccgcacaggtggggcgggggttgtatgtcatggactcgagcatctgagtggcacagatgacgggcttgcccttcatgttacacttggcaatcatcatcttctgggccaagaagaccttgggcgcaggtatctcgatacccaagtcaccacgggcgaacatgacaccgtcagtctcctcgagaatctcatcgaagttgttaacaccttgctggttctcgatcttggcaataatttgaatctccttgccctcctcgccaaggacttcacgaatgtgacgaatgtcgcttccgcgacggataaacgaggcgaagatcatgtcaaccctattcttaacaccgaacttgagatcgttgatatccttttcagaaagagcgggaagatcaacgtcagtgccgggcaggttgacaccctttctagacgagatgttgccattgttcaggcacctgacacgaagggtctgatcgtcaacaatctcgagcacctcaaatga

SEQ ID NO: 9660 - DNA, 279 bp, A.fumigatus
tgccccagccccagcccccagccccagcccccagccacctccctcaccggctactggctgcctccggatattgccagcaaaacagatcttgtcgttggaagtggagcggcaaaggccactaagacagacctattggacccttcacgtgtactccgtacctccgtacattcaccaccttccctgacttccacgggtcttccatataaagtcctactctgctttttgactactggtataaacgtcgctgagtggctgtaccgcctttctcctcgctattaa

SEQ ID NO: 9661 - DNA, 195 bp, A.fumigatus
agcgcccgtttggccggcatcaatgtcggcgcaccggcgcgtcctttacctagtgctgatttcggtctcatcggtctggccgttatgggccagaacctgatccttaacgttgctgatcacggtttcacggtctgcgcttacaaccgtacgacctccaaggtcgaccgcttcctagcaaatgaaggccaagggtga

SEQ ID NO: 9662 - DNA, 201 bp, A.fumigatus
ataattactccgtctatcaagattaaggtattactagccgtgattgctaaagcatggctactctgtacatttaatactatctccgagggaacgttcgttggtattctcgtctgtactctgtactctgcatttagtaccttagaccatcctcctccgggcttttgtcgcatttggtctagcactttagtagcagttgcatga

SEQ ID NO: 9663 - DNA, 186 bp, A.fumigatus
ttcaacttcctgaatacatcgggtgacaatggcaggaatgatgctcttttcatgctccatgcgctgttccagatcagtgccaaacagggctgctataaggttagctttattgtcagaggcatatcaaaatgtcgacacataccagtcggagcgagatctgccagagccggaacactatcagtctga

SEQ ID NO: 9664 - DNA, 1128 bp, A.fumigatus
  unsure (9),(10),(11),(12),(13): Identity of nucleotide sequences at the above locations are unknown.
ccctatccnnnnntatctgcccgctttgcctctctagccaccgtggtcgaagacgattcccccgtcaatggaaccacacccgttcccgatgctgggagcccctccggttccccggggccgtcgcactcagatgaagtggcgtggctcacaagcgaattacgcaaagaacgtcaacgtgtcttggataaggaacagaagattgcggaaatggaagctgtcctcaacgcgacggccgatgtcaagcaggtgaacacggagctcaacgagaagcggtccacgatggtggttctggatgcaaaaaaggagattgtcatgcgagaactctccgtcctgaccgatcatttagaagcggagaaacgtggcgccagcgggcctcttgaccttggaaagattaccaacaaggtcctgcgtgactttgtggagtcactccataagctgaaggagtcattcacaccacaaattgaggagctggttcaaaaacgcaacgacgctgcggaagagcttgccaacttgaaccgcatgaaggacaagagctttcaggagttcgagcaactgtcctccaagaatgctcagttggccgaactgaacaatcaactggtgcatcagattcaggagctctacaaggccaattcaaccgaaggcaatcggggtgccaatggccttggcatctattcccacggcaaggaaaagtcactgtcagccattgatgcactgaaggccgccaacaatgacctctctgcttccgtatccgctaccaatctgtctgaggaagccgaaccggccactgtcgttccaggaccacaggtcgttagtatccgcaagggacagcctcgtaagttcaactggaagaagggtggacagaacgtcgccaagggcgttacaaagggtatcaagggcgcctttatgtcaagcgacagcaatgccgctcaagatgccaaccccggtctcccacgctcgcagacacaagatcctagccgtcaaggttttggattctttggaaaccagaaaagcaagcaagctgggactcgaatgcctcagactgatagtgttccggctctggcagatctcgctccgactggtatgtgtcgacattttgatatgcctctgacaataaagctaaccttatag

SEQ ID NO: 9665 - DNA, 513 bp, A.fumigatus
ccacattggataggaatggatatggaaggaatttatcgtaaatcaggcgcaagctcggcagttcagtccattcgagaagggtttgaacggtttcctcaagattacgatatctctgatcccgatctcgatattcatgcagtcacctcggctctcaagcaatacttccggaagctgcccactcctcttatcacttatgaagtctacgaaaaaatcatcgacactggggagattacctcagcggaagctcgtatttcggttctgcagaagagccttgcagagctgccgcgtgttcaccaggacgtcctggagtttctggtgttccacttgaagcgagtagtcgaacgcgagaaggaaaatttgatgacgagccagaatattgccgttgtctttgcacccacgatcatgagaccggagagtttggcccgggaaatgaccgacgtgcagaaaaagaacgaggtattgaaatttttggtggacaactgccaagaagtctttatgggtatgcagagctga

SEQ ID NO: 9666 - DNA, 213 bp, A.fumigatus
tatgcctctgacaataaagctaaccttatagcagccctgtttggcactgatctggaacagcgcatggagcatgaaaagagcatcattcctgccattgtcacccgatgtattcaggaagttgaactacgaggtgagatcttaggcgcctgctgttccgaggttacgaaactaaccacattggataggaatggatatggaaggaatttatcgtaa

SEQ ID NO: 9667 - DNA, 1911 bp, A.fumigatus
aaagcgatcaagtggaggaacaatttacagccagattccaacacacagaggacagggaggaaagcatccacaaaaacccaagtaggagatgcactgtcgcacttcctatattgttggtttggaaaaataataacaaagagtatgaaaatgactgatcgcccctcatcagctggcctggaggaacccgtgaatttggttgctcaaaatggtcaagcagtggacagcgttccatcgcgacggagttcgagtaggtctactgaagctccagaagcctcgctgcctgccccgaccgagtcggcagatgttaagcaggcagtcgccaaacctcccagtgccaaactttccctgcctaacggcgaggtggcggatgctcaaacgtctcttcgtcacacatttccccatttataccattcttccagtgcatcccggtcaccgtggaccggtaattcatccagctcaatacaggcgttgaacgaagacaccgttgttgacgcccggtcggatcacggtttatggacgaaggcatctctcgggcgaaggatgtcccatcggagtgcgaccgacgcgcagcctgccgattaccctgtatatcctgatcaatcgtacgccgtgctccaatcacaaattcaccctacctatcaccctccatttcttcgctcccgcaggtcctacccagcaaggactgagtcgcttggccgactcgtgacacctcgtaccgctcgcactgcgggcaacactcccgtatcaagtcctggattattctccgtcaacagtcccaactcaacgcctcctgccaactccgataacgaaggtcgcattagcagtccatatctccaccctactcatctccagccgccgaaagagacgcatacggcggaggttgatcgagatctcgttactgggaacaaattgatcaatcagtatgagattcttgaagagcttggccggggtgagcatgggaaagtgaaactgggccgccatgtgacaacgcgtcagaaagtggcaatcaaaatcgttcagcgctattcgaaacgacgccgtctgggcaaattgggtaaccccgaagacaaagtcaagaaagaagttgccattctgaagaaagctcggcacccgaatgttgtcagcttactggaagttatcgacgacccgaaccgccagaaggtatatatagtcctagagttcgttgagaacggcgagatcatctggcggaagaaaggattacgcgagattgtacaagtcgacaagcgccggctggaacgtgaaaaggccggtattcccgaaaccccgtcgttctgggaagagtgtcggcaatatgtcaagacggcgcagcgtcttcgtcgccagcgagagaaggcacgtgaacggcgccaaatgaaagcggttcacgcccaacaggcacctattcctgcctggagtttagagcatggagccgagtcggacgaggaagaagaggctgatccagcaatgacccgcaccatcagtcgctccattgccagtcacgacgagacccaagaatccccgagtcactctttggcatccgcacatgactctgcgctggccgcaattgaaggtacaatgtacggaccctatgccgattactcccttgataggcgattcagtaccgcctcgagcagcatgggctacgcaccctccgagccggagtggttctcggacgatgatgacatgtcgtatgttccatgccttaccgtcaacgaagcgcgaaacgcattccgtgattctctactcggtcttgagtatcttcactatcaaggtatcatccatcgcgatatcaaaccggcgaatcttttagtcacaagcaatcatcgcgtgaagatttccgactttggagtctcctatcttggacggccgatggtctcaccacggggctggaaggatccgcggtggcgtcat

SEQ ID NO: 9668 - DNA, 588 bp, A.fumigatus
ttacgcatagcgcggatccttcgacccccgtgggtgaagacaagtctgcaatggagggaacaccaaattaaccgatttaaaccaggcaagtccattgtcggtgctcactccgtcgaggaattctgcgccaagctgaagcgccctcgccgtatcatgctgctggttatggctggcaagcctgtcgacgacttcattgagtctctcctcccccaccttgaggagggtgacatcatcatcgatggtggtaactcccacttccccgacagcaaccgccgcaccaagtacctgaaggagaagggcatccgcttcgtcggcagcggtgtttccggtggtgaggagggtgcccgctacggtccctctctgatgcccggtggcaacgaagaggcctggcccttcatcaaggacatcttccagagcattgccgccaatagcgacggcgaggcttgctgtgactgggtgggtgacgaaggcgctggtcacttcgtcaagatggtccacaacggtatcgagtacggtgacatgcagctgatctgcgaggtaagacgcgttcttgctccgataatctgccgcaacagcccactaacatga

SEQ ID NO: 9669 - DNA, 477 bp, A.fumigatus
caacaggcttatgacatcatgaagcgtggtctgggcatgcccgtcaacgagatcgccgatgtcttcgctaagtggaacaagggtgtgctggactcgttcctgattgagatcactcgtgacgttctctacttcaacgacaacgatggcactcccctcgtcgagaagatccttgacaaggcgggccagaagggtaccggcaagtggaccgccatcaacgctctcgaccttggcatgcccgttaccctgatcggtgaggccgtcttcgcccgttgcctgagcgccatcaaggacgagcgtatccgtgccagcagcctcctcgatggccctactccccagttcaccggggacaagcaggctttcatcgacgacctcgagcaggctctgtatgcctccaagatcatctcctacgctcagggcttcatgctcatccaggaggtaagatgctgctcatctcactcggctgcatgcaatggctga

SEQ ID NO: 9670 - DNA, 312 bp, A.fumigatus
gctgctcgcgagtacggctggaagctgaacaagccgtccattgccctcatgtggcgtggtggctgcattatccgttccgtcttcctcaaggacatcaccaacgcttaccgcaacaacccggacctggagaacctcctgttcgacgacttcttcaaggccgccatccagaaggctcagcagggctggagaaacgtggtcagcaaaggcgccctctggggtatccccactcccgccttcagcactgctctgagcttctacgacggataccgcacccgacacctccctgccaacctgctgcaggctcaggcgtga

SEQ ID NO: 9671 - DNA, 456 bp, A.fumigatus
gcagcatcttacctcctggatgagcatgaagccctgagcgtaggagatgatcttggaggcatacagagcctgctcgaggtcgtcgatgaaagcctgcttgtccccggtgaactggggagtagggccatcgaggaggctgctggcacggatacgctcgtccttgatggcgctcaggcaacgggcgaagacggcctcaccgatcagggtaacgggcatgccaaggtcgagagcgttgatggcggtccacttgccggtacccttctggcccgccttgtcaaggatcttctcgacgaggggagtgccatcgttgtcgttgaagtagagaacgtcacgagtgatctcaatcaggaacgagtccagcacacccttgttccacttagcgaagacatcggcgatctcgttgacgggcatgcccagaccacgcttcatgatgtcataagcctgttgtcatgttag

SEQ ID NO: 9672 - DNA, 579 bp, A.fumigatus
tgggctgttgcggcagattatcggagcaagaacgcgtcttacctcgcagatcagctgcatgtcaccgtactcgataccgttgtggaccatcttgacgaagtgaccagcgccttcgtcacccacccagtcacagcaagcctcgccgtcgctattggcggcaatgctctggaagatgtccttgatgaagggccaggcctcttcgttgccaccgggcatcagagagggaccgtagcgggcaccctcctcaccaccggaaacaccgctgccgacgaagcggatgcccttctccttcaggtacttggtgcggcggttgctgtcggggaagtgggagttaccaccatcgatgatgatgtcaccctcctcaaggtgggggaggagagactcaatgaagtcgtcgacaggcttgccagccataaccagcagcatgatacggcgagggcgcttcagcttggcgcagaattcctcgacggagtgagcaccgacaatggacttgcctggtttaaatcggttaatttggtgttccctccattgcagacttgtcttcacccacgggggtcgaaggatccgcgctatgcgtaa

SEQ ID NO: 9673 - DNA, 759 bp, A.fumigatus
gattgcatttcttctcacggaaaatggtggagtacagaagtgctgacttgtcattcgctcatcagtcgatggtggtcaccgtgccatcaagtactcgagaatcggcggagtcaagaaagaaatctacaacgaaggtaccgatgccattactcatacggcgaaatcatctcacaaagccctttacgtactttaggaacacatttccgaatcccatggattgaaacaccgatcatctacgacgtgcgcgcgaagccacggaacatcgcttccctcacgggtaccaaggacttgcagatggtgaacatcacctgccgtgttctgtcaaggcctcgagtagatgcccttcctcagatctaccgtaccctcggcaccgactttgatgagcgcgtccttccctccatcgttaatgaagttctcaagagcgtggttgcgcaattcaacgcgagccagctaattacacagcgtgagaatgttgcgagacttgttcgggacaaccttgctcgccgggcggcccgctttaacattgctctagacgatgtgtctcttactgtacgcacccttttgactcgtgcatccccaattgttgcttatataactaatctgtttaattgcggctttgtagcacctgactttctcccccgaatttaccgccgctgtcgaagccaagcaagtagctcagcaggaggcccagcgcgctgccttcctcgtcgacaaggcccgccaggagaagcaggccttcattgtccgtgcccagggtga

SEQ ID NO: 9674 - DNA, 327 bp, A.fumigatus
cacctgactttctcccccgaatttaccgccgctgtcgaagccaagcaagtagctcagcaggaggcccagcgcgctgccttcctcgtcgacaaggcccgccaggagaagcaggccttcattgtccgtgcccagggtgaggcccgctctgctgagcttatcggtgacgcaatcaagaacagcaagagctacatcgagctccgtaggatcgaaaacgcgaggcagattgcccagatcctgcacgagagtggcggaaagaacaagctgtatcttgacacccagggtctgggtctcaatgtcaacgcatcacgcggagacgaatcgaagtaa

SEQ ID NO: 9675 - DNA, 894 bp, A.fumigatus
tatgtgcgcgtccattcgcctctgctgtccagtctcgctaacgaattcatttcagaccttacggaggaacaggtcaaagacatcctcagctccgctggcacggttaccaaattccgtcttatgatgaacccggagacggggaaaccaaagggttatggcttcgcagacttcgccgatgcagacgccgccgcctccgcagtccgaaacttgaacgacttcgagatcatgggcaggaagatccgcgtggactggcctcacaacaacgagaaggattcggtcccccctgactactctcagacatctcagatgcctagtcaggatgttcaagccggtcagcagccatctgcgccgctcccccctcttccccccggtgtcgaggtgccgcctcacttggattgtccaaacgctatctctcaaacactttcctccttacccccgaaccagctccttgacgttctttcacaaatgaagtctttggcaatgaccgatccggcccgcgcgacggagctcctgcgacaggccccgcagctggcgtatgccatattccaggctctgttgctcatgaatctcgtcgactacagcactttgggagcagtggtagagcaagcgacccaaccaaccgctgcggccgctccttcggctccccctgcggcacaggcttttcagcccttctcagccgtacctggtcagatctccacgccaccaatggtcaatactccttttgcccctcaacccgcagcacaggcggcaccccaacaacaggttccatcgcaagaagaacttctacaacaggtgctcagtatgccacagtcagctattgatgctttgccaccaatggaacgaaatcaaatcatgcttttgcgtcagcagttgatgcaaggagccatgaggtag

SEQ ID NO: 9676 - DNA, 198 bp, A.fumigatus
cttactatccaaaggctagcaaagatatgttgtataaggaaggaatctaaagggaataatactattatctttacaaagttacaagaatttaatagtgagatgagagctatagctattaaatataagtatctgtttctcccccttctttatatacttatttattatattaataaagctttaaagctattaaacagctag

SEQ ID NO: 9677 - DNA, 1401 bp, A.fumigatus
  unsure (1021),(1036): Identity of nucleotide sequences at the above locations are unknown.
cctgttatgaaaacgcgctataggactctgaagcatgtggcacaatattctccattgctgcccgaaagtgtgaagcgcacgatcgcccagactccccctcagcagtctattaagcaacgattcacccccgatcaactccccctttccgaacttccaatgctgctcgacaagcggctcacactcgatgttcctgtatacaccgtttggggtgcatgtgaggatgtccgggtgctggagaaattccgctccggggagtacaaggtcaacaatctgcacatcattgacgaggctaactcgcggttgcttgatatcggaggcgtgaagcttcgtctgcttggtctgggaggtgcggttgtcatgcacaagctgtttgacaatggcgagggcaagaccacaattgctggtggtcaaggcaccatgtggaccactctgcttcaaatgggcgagctgatcgacacagccaaccgcgtatacgacccatcggagacccgcatttttgtcactcacgcctcgcccgctcgagaggggatgctgaaccagctgtccgtgaccctcaaggctgacttctccatctcagctggtctccatttccgctatggttcttcctacaacgagttctccgtcaatccctctctggaccactaccgcggtaagctcgccgcctccaaggcttctttcaacgatgtttgggagaccgtccgcggtgaggtggaagccgctatctcctccaacgaagctcaaaagaccctcttggacaatgctctcgacgtcgttcagagaatgcctactgtcgccaacggtggaaatccatttggtggccccactgcgcctggcaacgccgctggacaagtcgatgagagcgccttcaagaacatgtggaacttcaaccttgcagatgccgcatttggcttcctcgtccttgagatcgaaggtggtcgcattgcgacagaaatgcgcgctcagggcttcaactttgcccaccgtactggaaagcctcaggttgctgcgggtcagacagtanctggtggccttccancttctccagccactaccgcccgtgtccccaacgctactcctccccagttcggtcaagcccctcctgctcccgctagggctgcgggcaccgcccaacagcaaattcagggcaagggacctgctgcgggttccaactcggcatcccctgttcccgtaattcctaaccctgcaaccccccatgccctctgctgggcgccacacctcaacccaatgctgcttccccggaaaaaggcgggtacgtccaatccaacggaactggccaaccagaaaaacccccggaatcccctttgcccccagggtaaaaaaaacccaaccacggaatggttcctctccaaatttaataaacaaacaggggggtccggaatt

SEQ ID NO: 9678 - DNA, 321 bp, A.fumigatus
  unsure (94): Identity of nucleotide sequences at the above locations are unknown.
ccggggctcgggccgggacttattgtttcccgttggtgtcgggaaacttcctccaagggcatgacgtaccaaaagcgagacattaaggatcctntactttcggcctcatatgtggcacacaccaagaagaagatcggaacaaccgcagctaaagacctgaacaggtttgagacggagtgctgtaacgcagttgccccgccgggatctcaggttactctcagtggtaaacgcaaggatctttccaagccgctttaccgatgcaacaactggctcgacgatgtcatcagcttggcgttccagaagggcatttttgaaccctag

SEQ ID NO: 9679 - DNA, 213 bp, A.fumigatus
gttgaagtgttgaaaagcaagttgaatcacatgatcaaagaggccacgacatctcaagactacgagttcgggccaaacctttccaagaagcctggaactacctctaaaataggtatgaacaacatgttcaatagtacgaaagttttcccactacctagggtgccgatctactacactctggcggctcgtatccttgtacatcccacagcatga

SEQ ID NO: 9680 - DNA, 1320 bp, A.fumigatus
gctgatattccacagaatttagtatggagcggctggggtaattcggggcctgggaatgcccatggcatgcacgtatgcaagtacaagggagcaaaccacctgtgcttcttccaaggaatccagcagaatgggtattgcaggggccatggcgtcattatggacaaccggtatcgcattgtcaagaccgtcacccccgggggagggattgcgtcgagcgatatgcacgagttccgcctggtaaatgacggcaagacggcgctgatgacggtctatcaacagcggcagttcgacatgagcctttggaacctaagaatgggcatgggctggttgatggagagcatcttccaggagatcgacgtggaaacgaatcaggtcctatttgaatggcggtctctggaccacgtcgatccatctgtgagttacacctacccgtcgtccacagacacgtctggtaccgggttcgagccgcggtctccgtgggattatttccatatcaactcagtcgacaagaacaaagatggcgattatctgatttcttcgcgccatacgagttgcatctacaagatctccggcaaggacgggtcgatcctgtggcggttgcacggcgccaatccatctttcaagaacatcaactttagcttctcgcagcaacacgatgcacgctggctcggtgagaatgccacacatacgctcctgtccctgtacaacaacggctacaacggctacaaccaaacgcatccctattcgtccggcatgataattctcatcgaccacgtaaacaacacggcgacacagattcgcgaatacaagccgctgaatgacgacatgctcagctcaagccagggaaatatgcaggtgctgccgaaccgtaatgtgtttatcgggtgggggaacaatgcgtatatctccgagcacgatgagcaaggcaagctggtcttttggggttacattgacaaggacaagatcatgaactaccgggccctgaagttcgagtgggagggtaacccgaccgatgtccccgctctgtggacctatgccaaaaccaacgatggcttctccccgacgaccttttacgtgagctggaatggtgcaactcgcgtgaagcactggcgattctacggcgccgcaaactcgaccggaccctatgagttgctaagccaagtcgccaagcagggaatccaaaccacgtacaccaacgcgaccttttatccctggtcatatgtggaagcagtcgacggtcaaggcacagtcctgggcaagtcccggaaccagtttaccttcacaccgtcgccggaactgccaaggctattgcgcgaatga

SEQ ID NO: 9681 - DNA, 225 bp, A.fumigatus
ttgttgtttgttctctctattccctcttcttctctcccctctcttctgttctcttcctctgctcattctcccccttttttgttctttctttacatcactctctttttcttctcttatttcgctacattccttctccttcctcttgtttctcttctattgcccctccccttctacttctgctttgtgcttactaatctcctctccaagatctctttttcaccttga

SEQ ID NO: 9682 - DNA, 624 bp, A.fumigatus
  unsure (619): Identity of nucleotide sequences at the above locations are unknown.
gttattccaccgcggatctcgtacttggtcctagctaacttgttttgtgctacaggtattgtgggatccgacccctacttggcaccagaggtgtacgacgaaaagaagtatgacccgcgtcctaccgatatatggtcgttggctattatcttctgctgcatgacactgcgtcgatttccgtggaagcaaccccgtgtcagcgacaactcttataggatcttcgtctcaacacccacgccaggaactcctgttccggatgctgatccgaagcgtcaccgcgccattaaatcagcaccagacgtgtcgtcttttgataacgagggcaaaccggcgcaacctgcagaggagaagaacggattaagtgagccttcggcacaatcggactcggaaaagaaacaagccccaaccacctccacgacgagtgacgagaatcgccctcctgagagtcctaaagataaggtcagcggcaacctcagcaaaccgactcgaacaaccagcaaggaagcgccgcctctcccagcttcagcgcagtcatctagccagcgtcaggaggtcatcaagggtcattggaggctcttgcggatccggccgcgcgaagtttttacaaccggccgaagancatga

SEQ ID NO: 9683 - DNA, 951 bp, A.fumigatus
cacctgtggggagagccgaacgacccgtatgcccgcagcaagcgaccgcctcaagctaagaaccttgcccagatcgatcaacgattcatctttggaggccgtgactccaaacgccgaaaccacaccacgccaactttcggtcgtcccggaaccccccgctcctccagtgctggagatttgaaatctagcgacaagcgaggcggtatcttcggcagcaagaaagatctacgacagagcgacagcggtgaaaacaaacatcatcatggccacatggcggagctcaagcgattcttcaagatgggacaccacaaacataagcgaggcgattctccctcatctcttccgaagcggtcgagccgctcgtctggaaagagcacgcagtcggaaaccgttcctttcgccgatgaccatgggctcaacaccaagtacggaaagctcgggaaagttctgggttccggagccggcggttctgttcggttattgaagcgcaacagtgatggagtgactttcgccgtgaaacaattccgagaccggcattcctgggagacaatgaaggaatattccaagaaggtgacggcggagttctgtattgggtcaaccctgcaccacggcaacatcatcgagacgctcgatatcattcaggagggcgatcactggtacgaggttatggaatatgcgccctatgacttgtttgcgatcgtcatgaccgggaaaatgtccaaggacgaaatcgcatgctctttcaagcagatcctgagcggtgtggcctacttgcacggcatgggactggcacatcgggatttgaagttggataacgtagtggttaatgagcacggtatcatgaaactcatcgatttcggcagcgcggttgtcttccgatatccctttgagaatgacattgttcccgcttctggtgagttattccaccgcggatctcgtacttggtcctag

SEQ ID NO: 9684 - DNA, 216 bp, A.fumigatus
tgtatatgtcggaggccggtttctgacggaagcagtggcagacgggatgatcatctcaacgcctacgggcagtacggcttacagcttaagcagtggggggagcattgtccatcccctggtaccagcggtgcttttgacgcctatttgtgcccggagcctcagcttccggcctctggttctgcctgcaagcacgccaataacgcttcgactgagtga

SEQ ID NO: 9685 - DNA, 966 bp, A.fumigatus
tgtaacctaggaagggcctttactaactcaatctctggagagtccagccacacaaggtcgacctatccatcaattgccatcatcctcgaacgaaagactgccgaggaaattcactcttcgcttcctttcccggtctactcaacatttccagataatgacccatccgcattacatgataaagtggacatgacggtcaccctcgggggggatgggacaatcctacgagcatcttccctgttcgccacgtgcgttgatgtacctcccatgttgtcattcagtatgggaacactggggtttctaagcgaatggaaatttgccgaatacaagcgcgcttttcgtgaagtatttatgtctggggcgggtgccggagatcgggcaccgattctagaggaccagatggaagacgggaccgggccaacaggatggtcttcggttcgtggaaaatctatgggttcgtccaggggagctcgaattctgatgcgcaaccgtctaaaggtcgggcttttcacagctgatggcaaaccaattcaagtacgtggaaacatccctgctgcacaggatcagctgggtacgcagggggtgtatgttatgaacgaagtgcttctacatcgcggcaaggagccgcatctagctgtggttgatgtatatgtcggaggccggtttctgacggaagcagtggcagacgggatgatcatctcaacgcctacgggcagtacggcttacagcttaagcagtggggggagcattgtccatcccctggtaccagcggtgcttttgacgcctatttgtgcccggagcctcagcttccggcctctggttctgcctgcaagcacgccaataacgcttcgactgagtgagaaaaatcggggccgggagctagaggtcagcattgacggagtcaatctgggacaggggatgactgtgggcacagaagctcgcgtgtggaatgaggagatgcggtcttaa

SEQ ID NO: 9686 - DNA, 861 bp, A.fumigatus
gtggttgctcggctccgtccggctcgctgtggtgaaagacgtaaatgccgtggatctaatctaccctgctcaaggttcttcgtgaacttgcacacaggcaaatcccagtgggaacgtcccgagggtccagcgcagaaagaggagcagcatgctccgccaagcgggccgccaccgtcatacgatgactctggtcctgcgaatccatctgttcaggctgctgcaactgacgacaagaagacgctggggtcgaacaacccatacaaccaagcagaccccagcaatgataccctggaaagcgatgcccggctcgctgctcagctacaggctgaagaagatgctcgagctcaaagcagaagtcctgttcatcccggcgcggcggcagactactacagcggaagctccaggccgctgtcctcggcgggttatcagccatcacagggtcctgcgccggcccctgaaccgaagcgcagcagaggctttttgagcaagttgatgggtaaaagctcaagcagtagtggtagccctcactttggaagaccgcctattgctcagcagcaatcttacgggtatcagcaaggaggctactatgggggtggctaccccccgcaaccgcatcctgcaggctacggatatcctcagtaccagccacagggcggccactatcctggagcggtgccaccgcggcggggcggcggcatgggcactgcaggcgctgccgctttgggtgtgggaggcggtttgctcggcggtgctctgctcgcagaagcattcgacgatgaccatggggacacgatcatcaataactatggtgataattacagcggtgactttggcggcggcgatgactttggtgacttttga

SEQ ID NO: 9687 - DNA, 474 bp, A.fumigatus
  unsure (23): Identity of nucleotide sequences at the above locations are unknown.
cccaatcgtaacaccttcccagntgggacacatgcgacattgacctcattaccgtcgttgaaggatagggaagacgccagcagtcacgtacttcatcccttgacagccccgttgacccgttcggtttcttttgtcttccggaacctcaaggcgacgaaaccggagtcctatctgctcgagatccgatcagccgagtatgtctttgccccgtaccgggtggatgtctctgccgatggaactgttctgggcgtgtgggagacttaccgaggaaacccatgggacaatcgcggccgggagaagttcgttgtcgatgctgctggtggtaacggtgccaaagccgcagaggtgatggtggaagctaagattttggctagaagaggattctatgaagaacgagctagatgtgagatggaccgaatccaacccccgcgctcccgtggtggagaatgctttacccttgcgcgcttcaaatga

SEQ ID NO: 9688 - DNA, 249 bp, A.fumigatus
tggtggaagctaagattttggctagaagaggattctatgaagaacgagctagatgtgagatggaccgaatccaacccccgcgctcccgtggtggagaatgctttacccttgcgcgcttcaaatgacatgtctactgacaaaatgcgtcgtgccagtctctcctctttcgctcttcaaaaaccctatgatcttgttggcgttggtagccctggccttcacctttgggatgccgaaacttatggagaatag

SEQ ID NO: 9689 - DNA, 288 bp, A.fumigatus
  unsure (10): Identity of nucleotide sequences at the above locations are unknown.
gtcgttttgntactattgattcatgcatatacacgccttccctgcgtgctaacttatttgtcagtggacccggaaatgcgtgctgaattcgagaagcaatcacgcacctccccgatctctggtgctacgcggaacgctatggctggtggcggcgggcccgggaacttcgatctcgccggctggatggccggtgccaccccaaggcaagccactgggacagattctgaggccgcccggggaaccgcaactggtcgggaaactggaggtactacgcgcagacgaggttga

SEQ ID NO: 9690 - DNA, 285 bp, A.fumigatus
tatagaagtctctttagaactaatatacttaataattataacttatttatagtttccttagataactatataaggtctctcactgtattctactatagtaataatcttagatattatatagagccctattataaagctagttttattaaaattctagatattatctttatatatactatgttcttagatagctttatatattgttataaactactatttaataaccttaggatcctcctattttaccctctagtatataattctttaattatatcttatatatag

SEQ ID NO: 9691 - DNA, 255 bp, A.fumigatus
gaacttgtcaatctccttgacccaaaaagagttctgtggattgacttggtgggcagaagtatattcccagtacgatggataccaaccagcagtctcccaatcaataataccaacaatatcgtctccacgaacaagaatgttgagactactaaggtcaccatgcgtaaataccaaaggccaagtcttgctttgctgtttgataaggtcctgaatttcagggtcaagtctcagatcaaattccatgcccctacgtaa

SEQ ID NO: 9692 - DNA, 186 bp, A.fumigatus
ccacccaataatactaaggagactcttaaaaagtttaggtacattagagatttccctgctcttcagaggctgggaatggtgtgcgcactttacttgtacaggcctctttacatcgtcactgccgtcgggggcaataccgcgctccggatcatttatgtgtacgcgacgatggccttacaaagctga

SEQ ID NO: 9693 - DNA, 753 bp, A.fumigatus
cctccctatgtaccggggtggacggtagtatataacttgccatttaccacactccatcgacgtgtttgtcatagcatccccgtcataaccaaatgcctccatcccaccaccatcgcagccatctacaacgaacggagcaccacctacgatgccgccatcttccaccaccgcctcgcagaggagtacatccgcgccgcagccccccagcctggcgctcaggtcctcgatctcgcctgcggcacgggcctagtcaccttcctcgcagaagcgcaggtcggaccgacagggaccgtcgtcggcgtcgatatcagcgaggggatgctggaggttgcgcggggaaaggcacagcggaccggctcgcgggttaccttctaccagcatgatatctccaacttgagtgatttggatctgaatccaaatccgggaggccaagacgacggcgcaggccagttcgatctgatcacttgtgcggctgccctggtgctgctccctgatccgcttggagcgatacggagctgggcggagctgttgaggaacggcggcaagttggttacggatgtggcggctcgggatgtacatgtccctgcgcggatttttgagtggattgggccgcagcttgggctgtcattgcagtgggatcagagctgggtgaagggtgaggagtcgttggctgggttgttgacggagggccgattggaggtcgaaaaggggattgtgacccctgtcttccaggtaaaagagtacagggtttga

SEQ ID NO: 9694 - DNA, 438 bp, A.fumigatus
agaccgaatgctccagctggctcgcctgcagccggagcagaaccgacagcacccctcctcccagcagcggcggcggcggattgccattggcctcgacgtcggtcgcggcacgatcagccagcgtcgtggcatccgattcgggaaccgcgctctccttttcattcgcctctgcggacggtttgcgctgacgcatctcggccagaccaaagccctgcatcagctcctgcgcttccgcagccacggccatgtgcaggctgggctgatccgaaggccccgaatccttgtggtttcggaagaaggccgccaacttctcgtcgtcctgcgagcccagctcttccatcgggaccaacgacgaacccagcccgttcgcatcctgtccctccggccggcctagcctgtccgccagccgcccggtcttctctcggactgatcggctag

SEQ ID NO: 9695 - DNA, 309 bp, A.fumigatus
catccccgtcataaccaaatgcctccatcccaccaccatcgcagccatctacaacgaacggagcaccacctacgatgccgccatcttccaccaccgcctcgcagaggagtacatccgcgccgcagccccccagcctggcgctcaggtcctcgatctcgcctgcggcacgggcctagtcaccttcctcgcagaagcgcaggtcggaccgacagggaccgtcgtcggcgtcgatatcagcgaggggatgctggaggttgcgcggggaaaggcacagcggaccggctcgcgggttaccttctaccagcatga

SEQ ID NO: 9696 - DNA, 276 bp, A.fumigatus
ccgatcagtccgagagaagaccgggcggctggcggacaggctaggccggccggagggacaggatgcgaacgggctgggttcgtcgttggtcccgatggaagagctgggctcgcaggacgacgagaagttggcggccttcttccgaaaccacaaggattcggggccttcggatcagcccagcctgcacatggccgtggctgcggaagcgcaggagctgatgcagggctttggtctggccgagatgcgtcagcgcaaaccgtccgcagaggcgaatga

SEQ ID NO: 9697 - DNA, 468 bp, A.fumigatus
tcgtctcagatgcgtctgtatacggaggtatgtgtcccgagggatccccagccagacagactggctaacggcgaattagaccttctgaagattcccgacgccgacgcgtttgcctaccatcaggagctgaagaagcttgccgcgtctctcggtctcactcatttggaatttgtgcgtccaggcactcttgccggcattgtccccgaggaggccaagacactcgaggagtattccgaccacgtctccaaaactcgcaaccttctcgatggtaccctcgcccaggcggtcgacccaaacgaggatgagaatatgcgagcaaccagcaagcagtacgacacggcgctgcctcaggccgaagatcacgaagccttcaaggctgctatgctcaagcggggaaaggtaggcctggagtcccatacggccgttcgtcacgatgttgctgaccgcttcaggcctatgctaagctga

SEQ ID NO: 9698 - DNA, 240 bp, A.fumigatus
ctgatcctcatcaacaacaacaacaacaacaactactactactactactactactactactactactactactactactactacatctacatcaaggcaaaacatcatattgaaagctgccacgctcaaatagatcaagatgccctacgctggcaaccttcccactccaacggagaacaaggtctcccagatcatctccatcatctcagcctatcgtcaccgctccgccgctgttcctga

SEQ ID NO: 9699 - DNA, 408 bp, A.fumigatus
atcaagatgccctacgctggcaaccttcccactccaacggagaacaaggtctcccagatcatctccatcatctcagcctatcgtcaccgctccgccgctgttcctgatcgcttttccgagttcgccccagctctcgagaagcaactaacggagactgtctccaagggggagccagtgcgattcattcttccatccttccccttcaaggcccccgcggagggagacaagcgcaagactctgggctctctgccagacaaggcagaagagatcgcattgcaaaccctcgatgcatttgccgattccattgcggagatccaccaacccggtgccactgtggtgatcgtctcagatgcgtctgtatacggaggtatgtgtcccgagggatccccagccagacagactggctaa

SEQ ID NO: 9700 - DNA, 1221 bp, A.fumigatus
ccgcttcaggcctatgctaagctgattgcctcatcggccgagtcgacgatccgcctgtccatccacgagtccaacaacgtgggcaaaatcactatgaacctcttccctcctccaacaaacccggacttcatcactccctggcacggcgccgtcgcggtcctcgcagacgccagcgtgcgcattgtcgatgcctccaccgtggacagggaccgatttgaggtcatcacgaaccacgagggtcgcccctggctgctgcgcgagaaatcggatctcttcgactggtttggcatggaactggattttgagcctctcttcccctgcgggatgcaagtccgccccaaggaaggatacggtccgtaccggttcgaggacgtcaatatgaagctcgtgcgccggctcgccttgtcgaccgccccgctccttctgcgcggcttcaccatgcaggtcgagaaggaggtcttccgcagcaaggcgcgcgagctgggcgagatccagatgtggccctttggcgacattctcgaggtccgcgagaacgccgacttcaacatgaacaacgtgctcacccgcgaagccatgcccttccactacgacggcgtcttcaagaccgtccaggacgagaagacgggcgagtggatctccgtgccgcccctcttccagatgttccgcaaccgcgccgcgtcccagtccaagggcgggctgacccttttcgcctcgtcgcgcaacctcatccctctcctcggcccggacagcatcccactcgaggagctccgcaagctccagtgggaaaccttcaccgccgccaatgaggcatttggcggccataagctccagctgccgttcatcatcacccaccccgagtccggcgtcgacactttccggtttcacgagccttggcccgagagcaagtgcgtgcccggaagcagtgagccgaccctcgtgcgggttgtgggctggcccctggcggagagcgatgcgctctgtgagaagctgacccggctcctgtatgaccgccgggttgcctaccgtcaccagtggagggcgggggatttcatcttcaacgacaacgccatgacccaccacactcgcacagccttcgaggacggccaccgcgagcactggcgtgtgcatgtgaataagatggtcctctttttgaagtcaatgcgaatatttccggttagagacaggaatcaaaatgagattggctctatgatagtttgtcta

SEQ ID NO: 9701 - DNA, 576 bp, A.fumigatus
gccaagcggctactttcttgcttctcgaagcttactttcggtgctcaacatgtcccagataaagcgtcaatagtctccaaagcgacaaaaaaggcactggaatggctgtcagctatgtcaaattttgataaggcctcgggaagagcctttcgactttgtgatggattctccaggcgtcttgcaccgcatgtcggtgccgatattgaaaaatttcccgccgcaggcgatactgctagggacgctacacccgatgctcattttgatgatgcagaagatacagctgtgggtaaaacaagtgctgacaatctaaccaccgagctagatgccattgcatgctcacccatgaatgaatcaaactcccctctgcctggacagatcccattcgaactggcctcgtccgatccattcgacttcctgaaaactgataaatcagtctcaggtcacaatacattcgacgaccttttcccatacgatgcagatacaggtcaaatcacaggatctttcttcccccctgaaaacaacattgactttgacttgggatgcttctggggtgacccgatattttggaaagagtag

SEQ ID NO: 9702 - DNA, 219 bp, A.fumigatus
ggtcgtgcatacagctccgctatagcccagaagcctgacagcagcgaagggcagtacaaggccagcggtgacatcgtcggagctaattctttgggccccttcgagggcaagtgcagagattcccatggtggtcgcgcacagccagggtatagcaaaccagcaaagacctcctataacatatcctgggaaagcgtggacaggacttgcggcaatggctga

SEQ ID NO: 9703 - DNA, 429 bp, A.fumigatus
atcgagagggaactagaggctgtcaaacatgtcctcagaggaggtcaagtttgttgcccctctttcgcaagggtttggatatggcatcattattggattgggtttcgcttttgcgttggtgatgatcttcattacctgggctttgaggaggtaagagcttcccatatccgtcctcatcgtgctacaccaaatatcgggtgcaatgcctctaccttgacctgcagccatgctaataaagaatctacttacagatatcagcatgaagtccagacatctgaaatgttctcgaccgccggacggtctgtaaagtcgggtttggtcgccgcagctgttgtcagtagttggacttgggcagctacccttctgcaatcttcagctgtggcttaccagtacggtgtctcggggcccttcttctatgcttcaggttag

SEQ ID NO: 9704 - DNA, 519 bp, A.fumigatus
ttaatttcagccattgccgcaagtcctgtccacgctttcccaggatatgttataggaggtctttgctggtttgctataccctggctgtgcgcgaccaccatgggaatctctgcacttgccctcgaaggggcccaaagaattagctccgacgatgtcaccgctggccttgtactgcccttcgctgctgtcaggcttctgggctatagcggagctgtatgcacgaccctaatggtatttatggcagttacttcggccttctcagcccaattgattgccgtctcctctattgtcacttacgatgtctatcaagcgtacatcaaccctgccgccaagggcaagagattggtgtgggtctctcacatgtcttgtattgtctttgctctcatcatggctgcattcgcgacagggctctactacgccggaattggtatgggctatctgtacttgctcatgggtgtcatcatctcctctgcggtgtttctcggtgctatgactcttgtctggaagcaacaaaactgg

SEQ ID NO: 9705 - DNA, 726 bp, A.fumigatus
ccgggaataggtgcctgcgttcagattatattatttgcgacactcgccatcgagctcaaaagacgagcccccaacgcccataccttcctggaagctctccgcgcgcgatatggaactgcagtgcatctagtgtttattgtattttgcctcatgactaatatcctcgtcactgccatgttactcactggtggttccgccgttttgacttctttgactggggttcacacagctgcagcctgtttcctactgcccataggtgttgtgctctacacacttttcggcggtatcaaagcaacatttatcaccgactacatgcacactgtggtcattatcgttgttattttcatcttcgcgttctccgcctacgcgacgaatgcggaattgggatcccctggcaaagtgtatgatgcactggttgcagcctctgagcttcatccagtggaaggcaacgctcaaggtagttaccttaccatgagatccaaggaaggggggattttctgggtgatcaaccttgtcggtatgtacccccgggctgcccagtacaataacacaagctctgacagatgttttgcaggtaactttgggttagtaacatacataattcggacttcacgtcagattgctgatgactgtaatagcacggtgttccttgacaatggctactacaacaaaggtgcgtctactctattcttgaaagaacaactgggtgaagaggatactaattaa

SEQ ID NO: 9706 - DNA, 306 bp, A.fumigatus
  unsure (52),(115): Identity of nucleotide sequences at the above locations are unknown.
tggcttcgctggaatgtcgtccttcaattatgcttgacctttcttgggtttnttctttttctcgcttaccttttattgggataccccgaggcatatatgggcctgttcgactctngcatgcttcctctgctctacagccaagacaacgtctcttatcacatctcgtacctcttacaaatgaagaaaataaacatctcgtacagctcactcggtgacacacgctctacgttcttgtttataaatagggtagatcgtaaacaaagccttgctggctcgctgccaatgtacgacttcgcttattcttga

SEQ ID NO: 9707 - DNA, 531 bp, A.fumigatus
  unsure (417): Identity of nucleotide sequences at the above locations are unknown.
taccgtgactggatgaagtcgcgggggaaggtcatctggtaccgacgcagtcatacagcttacacctcagccgtacgggatatggggatcccaggtttgactcaatcgttcgttataaatagttttctgaaaccatttaacactgtttcttcttacattgaaattactcctactctggacgaatccatttgcctctcgcaagacttccctactcggaagatggcgttcccatatagccaaagcccaccctatgacgctccagctccagatctgaaccctagtggcgggtcatactatacgccccaggacgccccgcatggttatggggctcagcaaccatatggacagcctggccagcttgaacagtatacgagtgtccacaccacccagcatgatctgagcccacaagcgcaacantatcagccaccgccgcccagggattttctgagcccgtctgatgcgctggggtaccagcatgcgccccgaaactacgaagctagaggtcgccagggcagcaatgctgagtattag

SEQ ID NO: 9708 - DNA, 561 bp, A.fumigatus
gcccgtctgatgcgctggggtaccagcatgcgccccgaaactacgaagctagaggtcgccagggcagcaatgctgagtattagtatgacaccttcctcgagtatctggttccatctccggctaacgccttacagcaaccagcataccgacgagcatagaaatatttcccgatcacggcgcagccgatcccgcgcctccagcagcgcaatgaaagacagatccggatcgcggtctaggtctagatcagggtcatcagggcaggatcgtagccttgcgggaacgttgatgggaggtgcgtctgggtactatctgggacataaacagagtcacggtctccttggtgctttgggtggtgcactactagggaattttctggagcaccaggtggaggaacacaaggagcatggtgaggatcatcacaagcgccatcgccatcgccatcgtcatcaccaccaccaccatcatcataatcatgatcatgggcatctcgatcaacaccaccatgaccatcggcatcatcggagccgttcgagacatagtagacacagtgattattcttga

SEQ ID NO: 9709 - DNA, 237 bp, A.fumigatus
ggaattttctggagcaccaggtggaggaacacaaggagcatggtgaggatcatcacaagcgccatcgccatcgccatcgtcatcaccaccaccaccatcatcataatcatgatcatgggcatctcgatcaacaccaccatgaccatcggcatcatcggagccgttcgagacatagtagacacagtgattattcttgaggtttgggatcgctgtgggatgtgctcagtctggcactag

SEQ ID NO: 9710 - DNA, 609 bp, A.fumigatus
gccagcaagagggcatttgtgaattgcttagattcactcagtatgcctcctccgctattatacaatgtcctaccagccgctcttccagcacattgtgagccctcgtcaccattcctagctgccgtttcgtcccacttgcatatctgccttcctacgcctcttgcgctcttatcttcgattctcggaacgctcagcatcatatcctggctttttgcgcagcttccccaaatatacaagaactaccagttgcaatcaacgtccgggctgtccctgttctttctcgtcgaatggtgtcttggtgatacaggtaaccttgtgggcgctctgtttactcggcaggcagcctggcaagtcatcatagccgcctactacgtcttggtggacgttaccctagtgttccagttcttttggtatacacactacaaaggccgaagggtcgcgtacggtggccactcccactcccaccatggcgaagacgccggatcgttcctggagggagtgccgctatcagaggaggattcgatcactgatatcccaccacgcaagcctgcaacggaaggctcggccagtattgaccacgaggcgccaaaatccgcgtataggttatac

SEQ ID NO: 9711 - DNA, 312 bp, A.fumigatus
agagctgcacacccagtcgtgcctgcttttccctttttttttcccctcccattctcacatttctctcaatttgtcaacatggataacgtcacagagaagcaaacctcagcgttagagctcgaggagcagcccgtctcgaagggcgggcctgtctacgatgtcaacgagaaggtcggcttggacagagcaggtgccatcaatgctgaggatgtcgaacataagatgactgtggtcgaggctgtcaaggcctatcccgcagccagttggtgggcattcgtcatgtcatgcaccattgtaagctcttgcgcatga

SEQ ID NO: 9712 - DNA, 684 bp, A.fumigatus
gagctccagcgacgcagatgttgcagatgttctgggctattgggtcaatcattgttggcggtatcacttaccactaccaatccagggatgaccccacagcgtacaggttcgtccgctcccatatatgccatcgaggagcactgtactaacagtcatgccagaatccccattgcactccaatggatgtttcctactcctctcgctatcctactctacttggcgcctgaatcaccctggtggctcgtacgaaagggccgtctggctgacgcagagaaggctgtcagacgccttggacgcgcgagtgcaaatgatgatcccgctgacgcagtcgcaatgatgcgtcgcacgatcgagcttgagaagaccgagaagaagcccagtcttgttgaactgtggaaaggcaccgatctctatcgcacattgattgtgtgcggtgtgtacgcatctcagaatctgacgggcaatctgattgctaaccaagcggtttactttttcaaacgtgagtccaaccctttcctgcacactcacagcagactaacaccagctcagaggccggtatggcagacaacaccgcatttgcactcggtctcatcacttctgctctccagtggatcatggtcatgctctcttggatcctcaccacatacctcggccgacgcaccatctatgtctatggccaattga

SEQ ID NO: 9713 - DNA, 522 bp, A.fumigatus
atcatggagtcatactgtgttttcttgatggggcagttcatagccacaaagcgattcgccagggactatggtgtatggagcgatgtaaaacaggatttcattattgaagcttcatggcagtccgcattccagtgtagcggaccagtcggtgcttttatcggtgtattcatcgcaggccccattaccagttggattggatatcgatgggcaaccattggcggtctcatgtttctgaacgccttcatcttcatcttctatttcggcaacagccagggcatgtttttagcgtcccagatcctggaaggcatcccgtggggtatttttgtcgccaatgcacccgcctactgttccgaaattgtgcccatgagattgagagctccagcgacgcagatgttgcagatgttctgggctattgggtcaatcattgttggcggtatcacttaccactaccaatccagggatgaccccacagcgtacaggttcgtccgctcccatatatgccatcgaggagcactgtactaa

SEQ ID NO: 9714 - DNA, 297 bp, A.fumigatus
gtccaaccctttcctgcacactcacagcagactaacaccagctcagaggccggtatggcagacaacaccgcatttgcactcggtctcatcacttctgctctccagtggatcatggtcatgctctcttggatcctcaccacatacctcggccgacgcaccatctatgtctatggccaattgatcaactgtgtattcttggtcgcgctaggtattgcggcttcagtcggcgccagtaaggcagctagcaatgcggtcttcaccacggggctggaaggatccgacggggtgtctacaaaa

SEQ ID NO: 9715 - DNA, 234 bp, A.fumigatus
ccaacgtcttattttccattgtcttttagttctattcaagtcatcctctctcctgctgtaacctaccaagttgactgcttgtcaattattgccttttcgtttttgctcttcatccgtttttcaccctcattttgtctcttttccctctgcgtccgtcaagtcacacaccgaaccctgaccgacctagataaaattttctcgcttcgaataatatcagtgcaaatcggttgctaa

SEQ ID NO: 9716 - DNA, 399 bp, A.fumigatus
ccgtatgcacagttccgcaacaagttccttcccaaggatatcaagatcgtcggatatgctcgaacaaagatggaccacgaagaattcttgaagcgagtgcgatcatacattaaggttcccaccaaagaaattgaggagcagctggacagcttctgcggtctctgcacctacatctccggtcaatatgaccaggacgattctttcattaacctgaggaagcacctcgagaaggttgagaagggccacaaggagcaaaacagagtcttttacatggcgctgcctcccagcgtcttcaccactgtgtcagagcaactgaagaggaactgctatcccaagaatggcattgctcggatcatcgtgagtttccctacacaacctgaagagaagagcaacatctga

SEQ ID NO: 9717 - DNA, 327 bp, A.fumigatus
gaagaaactttggcagcttcgtcacacatggtacgcattgggtcgcatcagctccgaatagcaactaacctcgttctagaaacgaagcacttcatctacttgctacctcggacactgcgccatcctcctcttcaagacacaatagaatcatacgttatgttcacttcctactttggggatggagagtcgactttacgaagcccttcggctaaaagtggtaacccggagttgacccttcgagaacagtcacagatggaaggttggtgcgctgctgctggacataacagacatcggttgctgctggacaagtccaatgtgtcttgttga

SEQ ID NO: 9718 - DNA, 927 bp, A.fumigatus
  unsure (917): Identity of nucleotide sequences at the above locations are unknown.
attgaggtttgctcggggactaatatatactgtcagcgtatcgtcggtgttcgccacaagtgtctgacctgccccgactgggactactgctcagagtgtgttggcaacgccgcgcaaacccacccaggccatcgcttcgctcccctctatgaggccatctccgagccaatacagcatcatgaggtccactatggcatctactgcgacggaccattgtgcaaagacaagccgttcccccgctacataactggagtccggtacaagtgctctgtgtgccatgatactgatttctgcgccaaatgtgaagccctaccgaccaacccccataaccgcacccacccattgctgatgctcaagacaccggtacgcggcgttactatcagcaattccgtgactgagaacgggttcggtggccctgtcatccttacaggtgaccaagtcaacagatctacctcggcacaagccaatatcccagccgaagctgagaagtcttcagaggcgccacaccacgaggaagaagcaactgtgaagcaaaaggaagtcgtggaaccatctccaggagcggccgaaaaggcgcaatccaaggtgtatgagatgccaactaccgatccggcttccagctatcaagctttcttcatacgtgacaccgtccatgacggcaccgtcatgctaccgaacaaggtattccagcaaacatggacactctataaccctggaccacttgcatggcccgctggaagtagtgtgcgctttgtgggcggtgattccatgtttaatgtcgataccaatcgccccatgagtcttgatgcagtctccgccgctatggagagcaaccagctgctcgaacctttggagcctggccaaagcgccgatttcactgtgtcttcaccacggggctgcaaggggccgctccagtngctatcaaac

SEQ ID NO: 9719 - DNA, 921 bp, A.fumigatus
ctccgtcaactcattggcgtcccacccgatagtaacatcatctttgaacgctactctgacagcgccggttgctatgtccgcttagacagcgagaatctcgcagtctacaagcaactctaccgtgctgctaaagctaagttgaagctgcgtatcagagcgacattggtcaacgaagtgaacgagcctgttgcgcagcctgctctttccgagaatgctccggaggaacagggcccagcaagatacagctacctggagactgtcctgagttcccccccacctgtgatgggttccgaagtagtaccctctggctcttcggaatcggtgcctggcctgctaggtgccctcgagaaacctgcttcagttggtccccagtctgctcagtggacaaaggacaacacggcacccgctcagcctggctatagagactttgtccttaacacagataacgtcgatgtgcccatcgtctcgcacaggtccccaaccggtgtattctgcattgactgcaacaactgcggacgttctattcgcaatgaacactaccattgcagcatctgtgaagacggtgatttcgatctatgctctcaatgtgtaaactcgggcgtctcgtgtcaatctgaagatcactggttgatcaagcgtattgtcgaagatggcattgtcactaacagcactactgaacgagtggctcctcgcaaggttgaggaaccgagacagtccaagacggggtctgaaactctacctgagctcgctcccgaagaggtccaaaagcctactcctgctcccgaagaggtccaagagcctactccagctacagctgaaaagtacccacttcaacctgcggagcggatctgcaactcttgtctcaagggtgcgttgcctgttgtcacacatgaggtttccgttgttgctcactctcggtag

SEQ ID NO: 9720 - DNA, 192 bp, A.fumigatus
aataaagtaatagaacagattttatggcttaacacgatagagagcttgccaacggtggttggcaaggactccatggtgcttgatggggagtggttcaagctccgaccggagctaactagggtggaataccatcctacttaccttctgaaggaagaacccgagcacccagtttctctcagggggaacctgtga

SEQ ID NO: 9721 - DNA, 1179 bp, A.fumigatus
gctcgtggaatctttcaacccattcaatgctgtctttgcgaaggtgaagacctccagacatcgccaggctttccaataaacaaaaggaaagtcacttggtctggaggtccctgtgcgtccggatcaatcaactgtggatatcttccttttaaggagttgggcggatcgttgttttggccaggaagtagttgctgtccactgctaaccatggcttcgatctctctgcctcttccacctcagtcacctgctgccttgtctcagcatttcgattcgcctagccagtctcccagccgacacagccgtcgtaatttaagcatggccgcgcctcttcccaatccaccattcgtctttccagctcgcgatccagaaccctcgaatatgcggccatccgcgccgcctgagcaaagaagcagaattcctcaccctcttccagctttctccttcaaccctggatcgtcccacaccacgcaatcccccgtatcagcagttcctccggctcgagtgagtggacaccgtcggcgacctagcgaattcattggaggagatcagttagtcaccaagggagtgacagagaccggccagagcaacgatgaaaattcattgccagctcctgctaaactccctactcctggtcctggattcagtgcaggtgggcccggacgacgtcaccatgcccatcgacgatcagcagccgtctctggtgtagatcttgcggaaataactaaagcgcttgcactgaaacccgcagtaagcacaccatcgacaccagcagacccaaaaatcggcgctttcgaggaacaacaccggcccgtctcctactcagcgatatctctgagtcgaccaacacctccagcctctcctcggattccattcgctggaagctcgcctcatcgggctgccactgaatctccagttcaatcacccgctagtggacgaccagttttgccggtcaagcccaatagccctggacccaatggctcccaccagtcacaactgggtgctagaaatagcggaaagtctggtaaagatggttttctcgctgttaatgacgcgacaccctctgctccggaaaaggctttccctatacccaggactgccgatgcgctcttgatgtgtgatcttggtggaaacggggtttctggcgatgtatcgcatatgaagcgaccgtcgtctgctact

SEQ ID NO: 9722 - DNA, 198 bp, A.fumigatus
  unsure (17): Identity of nucleotide sequences at the above locations are unknown.
gtgtctaccaagtgcanagtacgtatattcatgacgacaattgccaagtcacatggcacaaaccaggcggtttcctgttgcttgttcaaccactctggacaacctgaaacaaatacaggaaccgcaaatggtagccctttgtcccaaaatgggtcttttaactacaggacttggaagatctttactttgaaaattaat

SEQ ID NO: 9723 - DNA, 672 bp, A.fumigatus
ctcgcaaagaatgtacttacgttcaacatcctcttcgacggcatccccatcatataccaggggcaggagcagcactttaacggagcatattacgccaacaacagtaaccgagaagccgtctggctgtccggctacaacaccgacgccgagctgtacaagctggctgccaagctcaaccgcctccgcaaacacgtatacaacctcgacaacaactatctcgacatcgagacatacccgatctaccagggctccagcgagctcgcctttcgcaaaggcgtcgagggccgccagaccatcatgcttctctcgacgcagggcgccaaccagaaagagccgtacgacctgtacatgcccgtaagctttaaccccggtgtagtagcgatggacgtcctcaactgtgtcaactataccgtcaaccgggccggtcaactcgtagtccccatggacaagggcgagccccgcgttttcttccccgcgaacctcatgcccggcagcgggctgtgcggcttcagcgacacaaacatcagctatgtcgagctgaagacgggcaagccggcatcatcagggtctgcgaaggtgttctcgatgacgccggcggggataccggtgacgattctgttctctgttttggtgtcattggggtttgggttggggtttgggttggggtgttga

SEQ ID NO: 9724 - DNA, 453 bp, A.fumigatus
  unsure (383): Identity of nucleotide sequences at the above locations are unknown.
attgtatcattgaattgtcaatgtgatctgtcggctaggttgcataatgaaacacgcagggcaaaaagcaaaattaagcattgcatcaattattatggggataggatagatagtgataaggacagacacagtctaatcatgcgaatggcagatcctcatatacatacagagcagtacggagtatacgtccagtacgcggtgggtggttgtcctatctaccagaggagatttccgggtgcgcgaaccggatcattcgtttctgagatgacaaaaggttcacgcttacagagccagggcgaccagaccaagcaggagcgatccagcggggacggtgagcgagccggcaccgttgggggtggtggtgggggagctggtgctggaancggaagcgccgctggtttcgctgccggtggcggaggcagtcttggaagctgcagaggcggagaatattag

SEQ ID NO: 9725 - DNA, 288 bp, A.fumigatus
agacgcaacacgagttccttggcaaacattgtagaagtgatgaagaacagctgtcacgacgtcacatccatgactaccttcacagagagccacgacgtgaaccgtttcgccaacatgacctcagacatggcggtagggaccgaccccttcccccccaccaaggctattccccccccgctccccgctgatacattgaacccctttttagctcgcaaagaatgtacttacgttcaacatcctcttcgacggcatccccatcatataccaggggcaggagcagcactttaa

SEQ ID NO: 9726 - DNA, 303 bp, A.fumigatus
  unsure (61),(132),(150),(245),(263): Identity of nucleotide sequences at the above locations are unknown.
catggcagccagattcttcaacatatacggaactggattagatccgggtacccagatcaanttggttttccagggatccccagaacacgggaatctttggcccagtggcagcagttcaaggtgggttcttcnggctccttgaccacttcngacttgatttctagcgcttctgctactggctccgcgtctacttctttttctagcaccgtacggttctttagcactgcatctgcatatgccaccgnttttgcatctgccaccgntttttccaccttgagcaagtccgcctctggcacaggttag

SEQ ID NO: 9727 - DNA, 285 bp, A.fumigatus
  unsure (24),(42),(185): Identity of nucleotide sequences at the above locations are unknown.
cactgcatctgcatatgccaccgnttttgcatctgccaccgntttttccaccttgagcaagtccgcctctggcacaggttagtcgcctgttctgggttcttcaagagtcgtgtgctaatattctccgcctctgcagcttccaagactgcctccgccaccggcagcgaaaccagcggcgcttccgnttccagcaccagctcccccaccaccacccccaacggtgccggctcgctcaccgtccccgctggatcgctcctgcttggtctggtcgccctggctctgtaa

SEQ ID NO: 9728 - DNA, 462 bp, A.fumigatus
agctactcactaggtcccgatgaatatgtaatggcggtaaagaatatggaccttgaagtttccgaaaacacccacgagcgcaggaatatgattgttgtcggaacggcatttgctcggggcgaggacatcccctctcgcggctgtatttacgtgttcgaagtgatcaaagtggttccggacccggagaaaccagagacggaccgcaaactgaaactaataggcaaggagctggtcaaaggtgccgtgactgcgctatcacagattggcggtcaaggattcctaattgctgcgcaagggcagaaatgcatggttagggggctgaaagaggatggcagtctgctccccgttgctttcatggatatgcagtgttatgtcaacgtgctgaaagagctcaagggtactggaatgtgtataatgggggatgctgtcaaagggctttggttcgcgggctactcggtatga

SEQ ID NO: 9729 - DNA, 492 bp, A.fumigatus
tttcaaatagatccaaaatcatctaacggtgatagattgctggcccgcagcaaatttcacatgggtcactttgccacaacaatgactctgttgccacgtaccatggtctcctcagagaaagcaatggccaacccagattcaatggaaatagattcccaaaccatatcccagcaagtcctcattacctctcagagcggctcagttggcattgtgacgtctgttcctgaagagtcatatcgccggctttcagccttgcagtcccaattagcgaattcgctggagcatccttgcggcctgaaccctcgagcttaccgagccgttgaaagtgacggaacggcagggagaggcatgcttgatggaaatctgctgtatcaatggctggatatgggacaacaccgcaagatggaaattgctgcccgggttggggcacatgagtgggagatcaaggctgacctcgaagctattggtgcagagggactgggatatttgtaa

SEQ ID NO: 9730 - DNA, 357 bp, A.fumigatus
aatttgggacaacgaattaggaggcttctcttgtctttctttaaccttatatctttgattctttcttacttgatttctttctctcgttcaggctttcttcttgtttccttgcgctatcgtgtccagggctcttctaccagcatcgcctcctgcgccttgtcatctattcatctaatgtcctattctctcaaccgagcaccgacctattcctgcccatcacaaggcggtttcactccttaccactttcttaaatgtcttacaatcgagttctccccaaacctcctgctttgctatatgacactcctcaagtccctattccaagacggtcaagtagcctccttgaacacaagatcatga

SEQ ID NO: 9731 - DNA, 210 bp, A.fumigatus
  unsure (137): Identity of nucleotide sequences at the above locations are unknown.
atatttctgtttacttttgcggtccttggtatctcccttcttttggggaaaaccaagtcagattttcgcggatgttatatgatcatacttatgcctatgcataatatagtagaggggcgattggctgctgtcttttntttttttttttcttttctttctgccccctttttctccctttattatatcctttgtcaaatagacagcttctga

SEQ ID NO: 9732 - DNA, 822 bp, A.fumigatus
ctcgaaagaggttatacaatctcgttcgacttccctcagaagttcgcaaacttcctcattggcaagcgaggcgagaacatcaataaacttcgcgaggaattcgatgttgacatcaaggttgacaacggcaaggtcgaagtcaaaggacccaaggctaaagcggatgctgccaaaacccgcatcatcaatctgggaaagaaactggaggatgagacgactcacgttctgaagatccccgcacagtaccaccgcgaacttatcggtcagaagggaagccaggtcaacagactgcaggaccgctactctgtccgcgttcaattcccaagggcggcggttgcaacacctagctttgacgatcaatccgtggcagacacttctagcgaagttggcggctctcgtcccatccgccccaaccaggcccctgatgaagtcattgtcaagggtccgagcaagggtgcggatgccgccagagatgaaattttgagtctgttgcagtgggtcattgaccactctcactcagctacagtatctgttgctcaaagtcaaatcccatctctgatcggccagcgtggccgtgagatggacaagcttcgcgctgatacaggggcgcaaatcgacgttccgggagctaatgacgcgcccgacgcttcgggtcgcgtgcagataaagatcaagggcacaaagcagcaggtcgaggaagcaaagaagattctgctgcagcgttccagcgaatttgacgctattgtcaccaagacgattgatgttgacaagaagtatcataaggctttgatcggcgctggcggtaagtttgtgttgatataa

SEQ ID NO: 9733 - DNA, 1023 bp, A.fumigatus
gtatctcgtccaccttggaagctgactcaatgcccaggtgcgaatattcgcaagatcgtcaccgaagccggtggtcctaccgacggaagtgcctcacgcattgtcagattcccccggcccgatagcagtgaatccactattaagttggaaggaaatggcaaggtcgttgacaatatcattgctgctatcgaagctttcgtaagggaacgcgaagaccaggtgacagtcactgtcgacattcctcctgtacagcataggctgctgatcggccgcggaggcgagacgagacgcggtattgaatcgcagtttaatgtcaccctggacatccctaaacaaggctctggacggaccgatatcaagctgaagggcccaagcaacgccgtcgagagtgcaaaggagcatattcttgccatgctgaaggatcagcagggcgaaacagtagaagttcctcggcatctgcaccatgttgttgcagacaatggcgcctttttccgacgcctccgcaacgactaccgagttaccgttgaccacgctggccagcaagtgccgctcaaaccggcttccgaagagtcccgcgccacgaccaatggggcgtcatcccttccattgatcactgatgagcccagcgactctgtggacgctcactcttggaaggttgtcgatcacagcgatgcctcccaagatgcaacgcaacccgcgaccatcccatgggtgcttattggaagtagcgacaatgtagccagagccaagtcggcattggaaaaagccattgcttctgcatcccagcagacctcgactggctatctgattctgcccgatcccaagacataccgtttcgttattggccagggcgggagccagatcaacactatccgcaaacagacgggatgccggatcaacgtgcccaaggatcaggctcgcggtgaggcgattgaaatcaagggcagtaaagacggactggagaaagcaaaggagatgatccttgacgccgtccgcgccggcctcaacggcggctccagatga

SEQ ID NO: 9734 - DNA, 234 bp, A.fumigatus
gcttctgaagtggtgccaatttctccgtgtcacccggagctcaaccccgataccttgctaacgaactttcaggagctcaagttcggtgtcgaagcccgtgctcagctcctcaagggtgttgacactctggccaaggccgtgacttcgactcttggtcctaagggtcgtaacgtccttatcgagtctccctatggctcccctaagatcaccaagggtacgtttgactcgagttaa

SEQ ID NO: 9735 - DNA, 1557 bp, A.fumigatus
  unsure (145),(861): Identity of nucleotide sequences at the above locations are unknown.
ctaaaaatagatggtgtctctgttgccaaggccatcactctccaagacaagttcgagaacctcggtgctcgcttcctccaggatgtcgcttctaagaccaacgagattgctggtgacggtaccaccaccgttaccgtccttgccngtgccattttttttgagaccgtgaagaatgttgctgctggctgcaaccccatggatctgcgccgcggtatccaggctgctgttgatgctgtcgtcgactacctccagaagaacaagcgtgacatcaccaccggtgaggagatcgctcaggttgctactatctccgctaacggtgacacccacatcggtaagctgatctccaccgccatggagcgtgttggcaaggagggtgtcatcactgtcaaggagggcaagaccattgaggatgagctcgaggtcactgagggtatgcgcttcgaccgtggatacacctccccctacttcatcaccgataccaagtcccagaaggttgagttcgagaagcctctgattctgctgtctgagaagaagatctctgccgttcaggacatcatccccgcccttgaggcctccaccaccctccgccgccccctggttattatcgcagaggacattgagggtgaggctctcgccgtctgcattctgaacaagcttcgtggccagctgcaggtcgctgctgtcaaggctcctggattcggtgacaaccgcaagagcatcctgggcgatcttgccgtccttaccaacggtaccgtcttcactgatgagctcgacatcaaactcgagaagcttacccccgatatgcttggttccaccggcgccatcaccatcaccaaggaggacaccatcatcctgaacggngagggcagcaaggacgccattgcccagcgctgcgagcagattcgcggtgtcatggcggaccccagcacctccgaatacgagaaggagaagctccaggagcgtctagctaagctctctggcggtgttgccgtcatcaaggtcggtggtgcctccgaggttgaggtcggtgagaaaaaagaccgtgttgtcgatgctctcaatgctacccgtgctgctgttgaggagggtatcctccccggtggtggtaccgcccttctcaaggccgccgccaacggccttgacaatgtcaagcccgagaacttcgaccagcaactcggtgtgagcatcatcaagaatgccatcacccgccccgctcgcaccattgttgagaacaccggcctcgagggcagcgtcattgtctgcaagctgaccgacgagttcgccaaggacttcaaccgcggtttcgacagctccaagggcgagtacgtctacatgatctccagcggtatcctcgatcccctcaaggttgttcgcaccgctctgctcgacaccagcggtgtcgcctccctgctcggtaccactgaggtcgctattgttgaggcccctgacgagaaaggccccgctgctcctgcatgggtggtatgggtggtatgggcggcatgggtggcggcatgttctaactggttccattggccttggtaccatagcctttcatga

SEQ ID NO: 9736 - DNA, 588 bp, A.fumigatus
aaggctatggtaccaaggccaatggaaccagttagaacatgccgccacccatgccgcccataccacccataccacccatgcaggagcagcggggcctttctcgtcaggggcctcaacaatagcgacctcagtggtaccgagcagggaggcgacaccgctggtgtcgagcagagcggtgcgaacaaccttgaggggatcgaggataccgctggagatcatgtagacgtactcgcccttggagctgtcgaaaccgcggttgaagtccttggcgaactcgtcggtcagcttgcagacaatgacgctgccctcgaggccggtgttctcaacaatggtgcgagcggggcgggtgatggcattcttgatgatgctcacaccgagttgctggtcgaagttctcgggcttgacattgtcaaggccgttggcggcggccttgagaagggcggtaccaccaccggggaggataccctcctcaacagcagcacgggtagcattgagagcatcgacaacacggtcttttttctcaccgacctcaacctcggaggcaccaccgaccttgatgacggcaacaccgccagagagcttagctag

SEQ ID NO: 9737 - DNA, 963 bp, A.fumigatus
  unsure (103),(819): Identity of nucleotide sequences at the above locations are unknown.
acgctcctggagcttctccttctcgtattcggaggtgctggggtccgccatgacaccgcgaatctgctcgcagcgctgggcaatggcgtccttgctgccctcnccgttcaggatgatggtgtcctccttggtgatggtgatggcgccggtggaaccaagcatatcgggggtaagcttctcgagtttgatgtcgagctcatcagtgaagacggtaccgttggtaaggacggcaagatcgcccaggatgctcttgcggttgtcaccgaatccaggagccttgacagcagcgacctgcagctggccacgaagcttgttcagaatgcagacggcgagagcctcaccctcaatgtcctctgcgataataaccagggggcggcggagggtggtggaggcctcaagggcggggatgatgtcctgaacggcagagatcttcttctcagacagcagaatcagaggcttctcgaactcaaccttctgggacttggtatcggtgatgaagtagggggaggtgtatccacggtcgaagcgcataccctcagtgacctcgagctcatcctcaatggtcttgccctccttgacagtgatgacaccctccttgccaacacgctccatggcggtggagatcagcttaccgatgtgggtgtcaccgttagcggagatagtagcaacctgagcgatctcctcaccggtggtgatgtcacgcttgttcttctggaggtagtcgacgacagcatcaacagcagcctggataccgcggcgcagatccatggggttgcagccagcagcaacattcttcacggtctcaaaaaaaatggcacnggcaaggacggtaacggtggtggtaccgtcaccagcaatctcgttggtcttagaagcgacatcctggaggaagcgagcaccgaggttctcgaacttgtcttggagagtgatggccttggcaacagagacaccatctatttttag

SEQ ID NO: 9738 - DNA, 783 bp, A.fumigatus
  unsure (468): Identity of nucleotide sequences at the above locations are unknown.
acgtactcgcccttggagctgtcgaaaccgcggttgaagtccttggcgaactcgtcggtcagcttgcagacaatgacgctgccctcgaggccggtgttctcaacaatggtgcgagcggggcgggtgatggcattcttgatgatgctcacaccgagttgctggtcgaagttctcgggcttgacattgtcaaggccgttggcggcggccttgagaagggcggtaccaccaccggggaggataccctcctcaacagcagcacgggtagcattgagagcatcgacaacacggtcttttttctcaccgacctcaacctcggaggcaccaccgaccttgatgacggcaacaccgccagagagcttagctagacgctcctggagcttctccttctcgtattcggaggtgctggggtccgccatgacaccgcgaatctgctcgcagcgctgggcaatggcgtccttgctgccctcnccgttcaggatgatggtgtcctccttggtgatggtgatggcgccggtggaaccaagcatatcgggggtaagcttctcgagtttgatgtcgagctcatcagtgaagacggtaccgttggtaaggacggcaagatcgcccaggatgctcttgcggttgtcaccgaatccaggagccttgacagcagcgacctgcagctggccacgaagcttgttcagaatgcagacggcgagagcctcaccctcaatgtcctctgcgataataaccagggggcggcggagggtggtggaggcctcaagggcggggatgatgtcctga

SEQ ID NO: 9739 - DNA, 216 bp, A.fumigatus
ttctgggaggagaaatcagggaaagtgatccatagcccccggatccgcgaagctggctccgctattgtctttatgcccgtcattggcatgtatgtactgaaaaaggtcgtcaaaatacatgctctgctcgcctggggcaatgcccatttgctcactctgctggggattcagatgattcaaggcgttcggaacaaagtcgagctgctcgttctgtga

SEQ ID NO: 9740 - DNA, 414 bp, A.fumigatus
cctgacaaacgtcgtggaatcactaacccggtgatcgcaattgcaggtacgggatggggttcagtttctctgctgaagaaactcgatacagagaactacaatgtcgttgttatctctcctcgaaactacttcctctttactcctctccttccctcttgcaccactggtcaggtcgagcaccgctcgattatggagcctattcgtaacatcctccgccagaagaaggctcacgtgaagttttacgaagccgaggctaccaagatcgactacgagaaacgcgttgtctacatcagtgacgactctgaaatcaagggtgacatctctcacaccgaggtgccttttgacatgcttgtcgttggtgtcggtgctgaaaacgctactttcggtgagtcgcgggctttaagtgcaaattga

SEQ ID NO: 9741 - DNA, 240 bp, A.fumigatus
ctcttctctcccttctcccccttctcccttcgcctaggtgcgatcaagaccttcaatggttggaagttccatgttccgctccaacatggcttccccaactgtcatgcagttaacgtcgctgtcgcgcaggtcgctttcgacgcgatcgccagccctcggtctccggttgtcacgccctctgagatccgctacttcctctcagcagtgtgtccagcgcaccttccgtcgctcctatgctga

SEQ ID NO: 9742 - DNA, 1155 bp, A.fumigatus
gtgcaaattgatcgcaagacaccagttaacggtgtaattacagggatcaagggggtgaaggagcactcctgctttctgaaggaagttggcgacgcacagaagattcgcaagcgcatcatggactgcgtcgagaccgctatgttcaaggaccaacccgaggaggaagtcaagcggcttttgcacatggtggttgttggtggtggccctaccggtgttgaattcgccggtgagctgcaggacttctttaatgaggacctgaaaaaatggattcctgagatcaaggataacttccacgttaccctcgtcgaggctttgcccaacgtccttcccatgttctccaagcaactgatcgactacacggaatcgaccttcaaggaagaagccattaccattcgcactaagactatggtcaagaatgttaccgacaagtatatcgaggccgaagtgaccaagcccgacggaaccaaggaactggagaccattccctatggcctgctggtttgggccactggtaacgctgttcgtaatgttgtccgggacctgatgaaccagatccctgctcagaagaactcacgacgtggtctggccgtgaacgagtacttggttgtcaacggtacagagaacgtctgggccgtcggtgactgtgccgttaccaactatgcacccactgcccaggttgccagtcaggagggtgctttccttgctcgcctttttaacactatggccaagactgaggctatcgaaaaagagctgaagaggctttccgaggctcaggccgtggccaagaatgaggaggagcgcaacaagattttcgacgagatccgcgagcgccagaagcaattgcggagaaccaagcagattggccccttccagtactctcaccagggaagtctggcttacattggaaaggagcgtgcggttgcagacatcagctggctgagcggcaacatcgcgagtggtggaacagtcacctatctcttctggcgcagtgcctacctgagcatgtgcttcagcagtaagtgcctccttcgccctaccaaccacaaaattgtcccttttccgtttctaacaatttcaatagcacgtaaccgtgttctggtcgctgccgactggctcaaggccaagatctttggacgtgacgtctctcgggagtaa

SEQ ID NO: 9743 - DNA, 438 bp, A.fumigatus
gtgcgatcaagaccttcaatggttggaagttccatgttccgctccaacatggcttccccaactgtcatgcagttaacgtcgctgtcgcgcaggtcgctttcgacgcgatcgccagccctcggtctccggttgtcacgccctctgagatccgctacttcctctcagcagtgtgtccagcgcaccttccgtcgctcctatgctgacgcggctcctacccccaaacccaagaagcggttcaggttcctgcgttgggcctggcgtctgacctggctctccggtgtcggtctcaccggcgctctcatctacagtatctatgaacagcgccatcccattgaacagatcgaacccgacccgaccaagaagacccttgtcatcctcggtatgttgggttccttaccttgtctgccgccaattgatcgcgtcgcaaacgtaacctga

SEQ ID NO: 9744 - DNA, 183 bp, A.fumigatus
ttctctgtagataaaactacaaccataaatagggccccaaagtatgaggtctccttagggccttggcgatggcctaattcttcccaaatcttaatgaccttccatattcatcacgaatataacactcaacttactgagactaatatattatttccagatactaatattgactcttttacctag

SEQ ID NO: 9745 - DNA, 384 bp, A.fumigatus
tatcttgttcgaagaatgcctgttttgcgagtcctctgcaaagactaccctcagcgtactctgattttggctactactgacgacgctttggtatttaaagccatcgcaacagaagtggaccacagtacaggaaaaaaagaacgagacaatatccattgcttggttgaattttgcagtttgtcttccgtggacttaacaggttaccgccgtctatgcgatgggcacggtacgcttgggttaatcgctcttgacggagatgtcttcttgtgtgtggtgactggtgcctccaaggccgcaacagttaggcctggcgaagctgtatggcgaattgacaatgtgcactttcgtaatagttcccactccctcgtctatcttatattctga

SEQ ID NO: 9746 - DNA, 240 bp, A.fumigatus
ttcccactccctcgtctatcttatattctgaccgaagcagtttgtctcaatcattcatgcaatgaagatggtcttaattatgagtccgaatccgagtttgccgctgaagaatccaaccggggtgaagataaagaaattgtcactgatcacccattcttagcgttgaaaaagctcctgagtgatggcagtttttactatagcctagatttcgatctcactaatcggctgcagaaccggtaa

SEQ ID NO: 9747 - DNA, 1125 bp, A.fumigatus
  unsure (1079),(1114),(1115),(1116),(1117),(1121): Identity of nucleotide sequences at the above locations are unknown.
catattgtcagctcgaacaaagctgatgcgttcgacatgggctctcttgatgaggacatgctgtggaactcatacatgattaacccccttctttccctcagaagccacttgtctcgccttgggaaactgcacctcgacatgtctcgaatgttgacatatgtaatacgaggattctgtagcactttgaccattcccacttctagaccgatagtccagcaagcaccaacgcgcttgccaccaacattgactgttatatcacgccagtcatctcgacgggcaggtacgagattcaattctaggggcattgacgatgacggaaacgttgcgaattttgtggaaacggaaactgttctctggattcctccctgctttactttctcgtacgtccagattcgtggttctgtgcccgttttttgggaacaagcacctggcttcttccctggccagcagaagattgaggtgatcaggtcatgcgaggcaaccaaacacgccttcgacaagcacttcgaaagtcttgaatcacgatacggcgctgttcatattgttaatctcttgagctctctgaaacccggagaagttgagctttcaacgaggtttaacgaattggttagccgaagtccacttaaccagaaggctaacgctgatgcctcctccaaccatatgttacttgaaatgacggaattcgattttcatgcggaggcccgcggtccgctaggatatggagctagtgatcaaatcaaggacgttattctgcattctgtggatggttttggatacttcttgtcagagagcacttgctatggtaacgaggcaaaaacctcatccgtcgttctgcaacaagaaggcgtttttcggacgaattgtctagattgtcttgacagaaccaatcttgtacagacgatcattagtactatggcccttgaatctttctttcgtcaacagggagctcacattgatcccgaactttggctcaggcactcaaccctttgggccgacaatggggatgctctatcgcgaatctacgctggtactggtgcgctgaaaagctcattctcgcgacatgggagcagtctctcgtnttttccgctagccccgcgaatcaacaagtacgttnnnncccngaat

SEQ ID NO: 9748 - DNA, 1356 bp, A.fumigatus
attgctaaccaccgtggccagtttgctattgcattaggtcctctgttcgtcttgttcttactcgcagcggcctactatagagcttccgcgcggaatctaaagcggcatgattcagtacttcgctcgacggtgttttcacgtttcggcgaggccatcacgggtgtcgcaagcattcaagcgtatagaatggaagggtacttccagcggaatctgcatgaaagcatcgactcaatgaatggtgcatatttcctgacgttctccaaccagagatggctctcgattcgccttgatgctattggcagtctaatgatcctggtggtgggaattctggtcgtcacctctcgtttcaacgttgggccaagtatctccggtttggtactgtcgtacgttttgaacatcactctgagcttgcaattcaccatccggcagttcgctgaagttggaaacaatatgaatgccgctgagcggatccattactacggcaccagcttggaccaggaagcgcccctccaattggccgaggtaccaccgggctggcccgaaaaggggagaattacgttctcagatgtgcaaatgcggtatcgtgatggactgcctctggtgctcaagggactcacgatggacgttcgcggcggggaacgtattggcattgttgggcggaccggtgccggcaaatccagcatcatggccgcgctattccgtctcaccgagctttccgggggaagtatcaagatcgatgacattgatattgcgacagttgggctgcgtgatcttcggactcgtcttgctattatcccgcaggatccgacgctcttccgcggcacaatccgctcgaacctggatcctttcaatgagcatacagatctggaactatgggcagcgttgcgcaaggcacatctcgtcggccaagagctgccagaggacgagtcccaggacggcactctaacgccatcatcgatgaacgaaaagcagcagacggtgcagcgactgcaccttgacaccatcgtcgaagaggagggacacaatttctcacttggccaacggcagctaatggctttggcgcgtgctctcgtccgcgatgcccgcatcatcatttgtgacgaggcaacctcgtccgttgactttgagacggaccagaaagtccaggagacgatggcgcaagggttccaaggcaagacgctactttgcattgctcatcgtctgcggacaatcatcaattatgatcgcatctgtgtgatggatcaagggcagattgccgaattcgacacccctctggcgctctgggagaagccggacggcatcttccgcagtatgtgtgatcagagtggaatcacccgggaggattttgagggttga

SEQ ID NO: 9749 - DNA, 588 bp, A.fumigatus
agatgcgtctctacttactatgaaatccaatggagacgcgtcacaggcagaacctcaacccaacaacaaacagaacgcatccgcgcaactacacccgtctcctcgaattcctggtcctgctgtacctccaccagacacgagcggactccaggaaatgtcacggctcttcaggccgccgtttctaggtggaatattgatatagtccggttactgctcgaatggggcgctgatgtcaatgcaccagcaaacaagcataagcatggaggaaagcctgccctgcaaacagcagcgccagagaaccatcgagtcatgacggacctcctggtgcatcagggggctggtgtcaacggcgtgcccagtccagtgcgtggccggaccgctctccaagaagctgcaagctcgggttatgtgcagctctctgaatatctactggctcatggagccgatgctgatgctctagccagaacatttgggtggtgttacagccttgcaaggggccgcaacacgcggcaacattcgcattgtgatgatgctgcgtccggccggggtagatgtccatggagctgcagcagagaatggcaggcttga

SEQ ID NO: 9750 - DNA, 717 bp, A.fumigatus
gcaatgcaaagtagcgtcttgccttggaacccttgcgccatcgtctcctggactttctggtccgtctcaaagtcaacggacgaggttgcctcgtcacaaatgatgatgcgggcatcgcggacgagagcacgcgccaaagccattagctgccgttggccaagtgagaaattgtgtccctcctcttcgacgatggtgtcaaggtgcagtcgctgcaccgtctgctgcttttcgttcatcgatgatggcgttagagtgccgtcctgggactcgtcctctggcagctcttggccgacgagatgtgccttgcgcaacgctgcccatagttccagatctgtatgctcattgaaaggatccaggttcgagcggattgtgccgcggaagagcgtcggatcctgcgggataatagcaagacgagtccgaagatcacgcagcccaactgtcgcaatatcaatgtcatcgatcttgatacttcccccggaaagctcggtgagacggaatagcgcggccatgatgctggatttgccggcaccggtccgcccaacaatgccaatacgttccccgccgcgaacgtccatcgtgagtcccttgagcaccagaggcagtccatcacgataccgcatttgcacatctgagaacgtaattctccccttttcgggccagcccggtggtacctcggccaattggaggggcgcttcctggtccaagctggtgccgtag

SEQ ID NO: 9751 - DNA, 372 bp, A.fumigatus
agcggcttcatccagcgcgacgagccgctcttgactgttcgacggcgcaagatcgcgctgtatattgcctgtcaggcgctgggcgtcgccgcgacggtggccatctcgcagacgattgcggcgattgggttcccgattctgatcattgccttgattccgttcagagtgtggattatgccgagatggttcagcgtcgaggagctcgatgtcatggatgatctgacggcgaataatagtgcggtcttggccagtcttgggggcccaccgcagttcccgggacagcctgataatgagatgtttgggctggagcggcgctattccgagcaaagatttgggtcgacgaggcagagggcgggaagtatccatcgttag

SEQ ID NO: 9752 - DNA, 246 bp, A.fumigatus
gttcttagcccaaagctttctaggaacttgtcgcgaactcacggcgcgtatgcatatgtggaccacccgcaaccacgcgtctttcgaaaggtcaaatggacctctacggagtacctacatagtgtttcaaattttttcaaaaacaacaacaacaacatcatcatcatcatcgtcatctggataacccatgatcgctctaacccagcatcttgtttaccttttcagagaacccgacttctgtcatga

SEQ ID NO: 9753 - DNA, 1152 bp, A.fumigatus
gcaattactatcacatcggaagtgaaaatggaccgcacaccgcttgctggagacaggtgcctggactctgatctcatcttctcttcgtctccagggtttggcactccggtacgccctttacgaaaatcaaatcttaatgctccggtcgcgaggagctcagtcttgccaattctacttccgccttctacgcttcgacctgtggctttccgtactttcaccaggaagcacaacttaaccatctcgtcctcagcactgcagactttggcttcctttgtggggaaacattgcggctctggatggcgcgaagaaggccttgcggagcgcgtcttggatgaggtagctaaaggctggaaaaaggccgggggtggcgtgatcgttgaggaagggagaggggcctcactgaaggctattttgaaggccttagagggcaacatgagtggaggaagggtagtcgctgcgaaacccagtgcaataagagaaggaccgatagatgtgaatgcccccaattgtgatgccaggcgactgaacccgcacttgtctccagacccagcaatcaacaatgaggaacttgatgatttggacttatcattacacccaagaaattggataaagattgttgaggcattcgacatgccccgcttgacttacaacgtcgacaagaagtacttcgaattaacaaagtcaaaggctacattgttcccgcaggcttcacacaaaactagcatgtttagagaccgttataacatcattcaccagcgtctactccggaatgaaacatttcaatcatcgttgagttatctcacaggccactccatgaagaggtcgtcatcctcattcgctcccactcaatgttataggttgacaccgatcgcaaacttgcttggaagaagtggcacgtcacacctgcttctaggattactctctatatcacccgcaggtgatctatccttggtcgatttgacaggtagcgttgcgctagatttgagtcatgcccggacgataccagacgatggtgcttggtttgctcccggaatggtagtcatcgtcgatggagtctatgaagaggagggaagcgtgagaggatcagtcttaggcggacacagcggagtcggtggcgccgttgggggtcgatttgtgggtgtatcaatttga

SEQ ID NO: 9754 - DNA, 2100 bp, A.fumigatus
  unsure (2067): Identity of nucleotide sequences at the above locations are unknown.
gtcgttttcaaaggagatttgaacgaagatctccgatgcctgcatcgcttcgtaacatctatggataaccgcggttccttctttttcctgctgatcgttttttatcttcttctcagctcgcagtctcgtccaccgttacttgaccaggatcgagagcgtcagcgggaagtagcaagggaacgaggtgcgcttcgtttgttgaatgaatccaaatatggggacttcgacccgccgggtgataagtggcttccttttgcgggaaccaggaagaacgacagttatgcctggggtatactcccggaagctcagggcagagctcgtcaccagctacgatccgccatttcaaacgctgggctggaacctcccaggtctctagaagaccccgacgctttaccttccctgaatcttactcagttgttactcccggtctatcgcaatgcgacagggaaattgcgtggagattgggttcgccgcaagttgaataaagagtatccgaaactcaacactacggctatcgctttggagcatgggtatttcacccacgaattcggattgaacatcacaggtagcagtggaactttctacttggatctcagggaaggtgggggcgaagagcttcgggtagatagcggccaagttcgagagatacgagcgacattggctgtcgaaagcaatgacttctggggaaatacctggtatatctccttattcggtgtccatttcccagagacgggagccatcatccttagttcaaatagcgagaagtttgaggggttgtttgtgctgccgcacctggctttctcctcagatgcgtatgagctttcgcaccagcttctcctcaattcgctttctgataccttatctgagaaagagaatcgccctccgacgcttttcccgtggtcgtccctaatcggatcggagcaggtagaatttcctgcaccgaagtgtgaacatattatctacctgcaacaacatccagtcactattcatgactacctagcggataagccagtggttgaccagatcgaagaggagctaagattccctattggggctccggtaccacctgcgccgttaatggtaatgtccgctgtggtgttctctccggactgtgggtatatcctcgaaaccaaaggaaccccagacttccctccgagcgagggcctctatctcacgggcccgaaaattgaagagtacgacaaatacagtgcgcgtctcgtatttatcatatgcggagtgtttgccgcacaaatcacactacttctgagacagatcaaggaggcatcgacaccttccacccggagccgtattagcttctatacaattgctcttatggcctttggggatgcttttgttcttatctttattctcttggagctgtacccggcggtgtcattcttggtcatggcaacggcggcctttctcacgtttctgtcggtcagctacattggtatgaaattcatgatggagatttgggctgtccaagcgcccgaacgcagggagcaagagcgtcgctcgaatcctccggcttcaactccgcgctcgactggcctacctctcccggcgacatcggccccggtaagagactctggcgcaacacctatcatattgactccagatcaagatcctcctgctgaggaggatgatcaaccaaccaaccgtggcaccacttcagcggcccaagaaactcgcaacgacgttggtgcgatgtacgcacgattctacttcgtcctatttgtgatgctcattatttccatatggtcttttctatggccgaatcgactaggagccctatatgcgcgcgctctcgcctttgtctatttgtcgttctggaccccacagattggccgcaatatcatacgcaactgccgtaaagcgctccgctgggattttgtgatcggacagagtattctgcgtctgtttccgtttgtatatttcctaacggtacgtggcaacgtgctgtatatacaccctgataacacaacagcttttgcgctagcaggctgggtgtggattcaggtctgggtcttggcgactcaagacattctccgaccgcgattcttcgtncctcgaggctgggcaccggccgcatacgactaa

SEQ ID NO: 9755 - DNA, 1017 bp, A.fumigatus
gattttcgggtttcaggaactttttctaatgggttccccggcccggtagagcaaatattggagcatggtagagaaacaatggatgatgagacaaaacgagtggttacgaaactccataccatcttgcgtccttatatcttgcgccgcctcaaagccgacgtcgagaagcagatgccagcaaagtacgagcacgtcgtctattgccgactttcgaaaaggcagagattcttatacgatgggtttatgtccatggcccaaaccaaagaaactcttgcatctggtaattacctttcgattattaactgtttgatgcagctgcgcaaggtttgcaaccacccggatctcttcgagactcggcagatatcgacatcatttgtgatgcatcattccgtagccactgaatatgcaagcaaggaacaactcgttcggcggcggctactatatgaacatcccctcacgaagctggatctggactttctcaatctggttcctatctcgagagaagatatctcacggaggttggcagatgatagtactaggcttatggcttacggacccttcaacatacttcgggaacgtcagtacaagcgcacgaactggcaaatgatgttcgacggttctacggtgcagtccacactagaagcattggagaacgacgccagaaaacgcaggatggcggaattggaacggtgtctctacttcgaatcgaagcgccatggccgtcgaccagtgtatggaacgagtctcgtcgaattcctcactgcggatagcaagcagaaaccaactctgggtggtcgtccccaaacgcagtctctcgcggaatggttgtcgaatcggtcatccattcttgcatcgatgattttgtccatcgaagagcggtcccaagccatggatggttacgtcagacgtttcgcctgtgttacgccggctgcagttgcctctggtatcacagaggcagctttgactccgattgaaacccgttatttaaccgaaaaggagcgtttcccctccttatga

SEQ ID NO: 9756 - DNA, 1056 bp, A.fumigatus
ccgaaaaggagcgtttcccctccttatgatccgttccatgaggcccagatgcgtctttcaatcgcttttccggacaagaggctgctgcaatacgactgtgggaaactgcaaaggcttgataagttgctacgggatcttaaagccggtggtcaccgagccttgatattcacgcaaatgaccaaaatgcttgatattctggagcagttcctcaacatccatgggcaccggtacttgcgactagacggtacaaccaaagtggagcagcgccagattctcaccgaccggttcaataacgacgaccgcatcttggtgtttattctgtccagccgatccggtggcttggggatcaacctgacgggcgctgataccgtgatcttctacgatcttgactggaatccggccatggacaagcaatgccaagatcggtgccatcgtattggacaaacgcgcgacgtccacatctaccggttcgtctcggagcatactattgaatcgaacattctccgcaaggcaaaccagaagagaatgctagatgatgtcgtcatccaggagggtgaattcactacagactacttcaccaagctggacgtccgtgacatgatcggtgaggaagcggaagcacaggatgaagccagcgccgccatggaccgcgtcttatccagccgggttgccacaggtggctctcgggtcttcgagcaggccgaggacaaggaggatatcgatgcggccaagaacgcccagaaggagatggaacaggctgacaacgacgacttcggggatcgcagcatttcgcatacacccggtcaggtgggcacacccttggccactggtccccaagaaggcgagacgcctggggcgcagctcatcacgacaccccagatccatggtgtggatgagacagtagatgtcgagcctcaacccggtcatatcgacgactatctcctgcgtttcatggaatggaacatgaaggatgaaccgcttgttctcccccccgataagacaaagaagaagtccaagaagggcaaagaacatcgccttagcaagaggcgtcgctaa

SEQ ID NO: 9757 - DNA, 3078 bp, A.fumigatus
  unsure (9),(17),(18),(19),(20),(22),(25),(26),(27),(28),(35),(2359),(2369): Identity of nucleotide sequences at the above locations are unknown.
gcgttgaanaccttgannnncnttnnnnattggancgctccttccagccccgtggtgaagacgatgccagcagacgctaatgacatttcatcagaccacctctcccgctgcaaatcggcttcttcccaagtcagtgacagatcgagtgctgatgcagaatccaccgccgcgcagccatgcagattagagcgcactacttcctttaatacaaacacccgcccaccctcacgagaacccgtctctcctgcatctgagaattcaaaagatggccagaacggtggaagccgggctgcgacagggaatgcaagcgtcaaagaagacaaagtggcggagaccaaggctgttgaacagtctcagacaccccagagaagcacaccccgctcgatcacaggaagaaggaattcatggatttctagcataagctccaaattctcgtcagggtctactcctccctcacaagcctccatgaagtcgccaagtcccaaggccacctcacctatgtcgaagctcgatatgcccaacccctttggagcagcgtattcccctaaggacaaggaggaagagaggagggacgaacacacccctcttgtctctacgtcgccaaagggaccttcttttctccatagtgcccttcgaaagttttcctcttctggaaaagtggtaccgaacgggggcatctgtgagcgccgggtgatgaacattgatcatgatagggacaggtgtaagataccggacctcgaccaaaagaaattgcggcgtgttgctttctgtgtagatgtcgagatagctgggatttctcgacgtgaatcagacgaggagagtcccaccggtgcgagcaaccagaaagcgaaaaggtcgaactcaaagtctaaagacagggacgattccaaacgaccacaacccgatattgcggataaagagaaaggacgccaggagaatggtacttctcggcagcatcctaagccgtcggagacgccgtccaacgaagccaaacccaatggtgaaatcaaggagccgacaagaaagcaagagaagaagaagcgctcagaggaggagaggagggaacggaaggaacggaaacgaaggcaggccgaggcaaacgggactatacccctgcagctgcgtgctgaagatcacgaggacgatgctcgaccggctgttcctggaaatcctcgatccagaacacaaagccacccgacaacggaccctgtgcgtatttatcgacgctgttgtcagctgcgtgagactcccgtgcttaagaagatcgtcgatgagatatcctcgccttcgtcaacgctagcggagtcaccaggcactgttgccgtgcttgaccttaccaacttccccatgacctcgcaggacatggccaccttctgcgactggctcgctattgtgcccgtccgaaagcttatccttgaaaaatgtgcactgaacgacgtctcggtcagggctattctggctgctttgctctctaccaagaccatcgagcagatgagacaaaggcgcagaagagctaagaagactgacgcagacccggtaaagaaggaggatagattctgtgtcgtggagaagctgtctttgaaagataaccctaggattggcctggagggttggcgtcatattagcgttttcgtccatctggcaaattcattgaaagctatagacatgtccggcatcccgttccccagaatgcccctttcagcaaatgattttgccacatcgctgtcaacgtctccaaaccccttgaagccagtcaatgacgtcgcgaccatctttgctaattcacttgctcagcgatttggcggagaccatcttgaagagctgttactcagcgagtgtaatccaacaacggaagatgtgggaagaatatgtgaagccgcaacgacgcttggattgagaaggctgggatttgcaaataacaagcttaccagagaggggttggaacatgttgttcggtatctggaagccggcaagtgtgaaggcctcgatctgggtggaaaccctattcgtgatcatttggacttgatcacttccgctcttgaaggagagttcccgctctatgccctcagtctcgcggattgctccttgactccatctgttattcaccctcttcttcagcgcttgacatgtctctataatctccgattcatcgacttctcgcataatcctgatctcttctccagcaagcctgatgcgttggcaactttcaggcggttccttcctaaaatgaaatcactcaaacgcattcatcttgccgatgtcaatctctcagcagatcatgccatcgctcttgcagagatccttcctgaatgccccagtctctgccatctcaacattctggagaacccctgcatcgcanaactagccgntgcgactgaccctgccacccaggaagaggcttgtgccgtttatgcttctttgatggcggcggtgcgcgtatctcgaaccatcattgcagtggatattgaagtaccaagtgcggaaaacaatgaagtcgtcaaggcccttgcctcccagatcgtggcctattgtctccagaatctggaacgaggtgccattgaagaagagctctcagatccagcggatccttcgtccgcccgtgcggctgtccctgtccctgtccctgaaattctacagcacattgtcggccatggtggccttggcgacgacatctgtgaagatgaggatgagcctgctcctgacgaggactatgtgattggaggcacaggtgttgtcaaggccttggaagtctgtttaggcaccctgcaccatcgtgatatgctcggggaccaatccggccccccaagtggtacaactacaccaaggcataggaagtcgaggtcatttgttcctcaaaggccgcgggatatgtccaagaatttgcttgaatcagctcgcaacatccgcacacggatccagtccgctcttgttcgtgaggatcgagccggtaatgacgcgaattaccgtgagtacctcatccgtattgtatttctgttctcacatgatcacatatctaacaaacgatcaactgcagggtcttcaccacggggctggaagggccgcgccaatggaatgtga

SEQ ID NO: 9758 - DNA, 273 bp, A.fumigatus
cgtatgcacaacctattcttccgaagatgccgcgtacaatgcgcgactgatccagtgctgacttttcatagctacaaccgttacctggccgtcgctgcccgcgccgtccgcagatctcttaaggacggccctcgtctcgctgctgagcgccgtggacagtccgaactgcgttttgccaagtgggaggttcgtatatacaccatttttgtgctggattgtggtggtgatgggtacaatgactggctgtattcggctaacgggtttctcgcctga

SEQ ID NO: 9759 - DNA, 267 bp, A.fumigatus
tgggtactaactcgtgttggacatgaagatgaggaaatggcagatgttccagaacctcccatggaggaagaaaaaaccatcgaccagccaccgaccaaggaggaacccagggaagagataacagtgtcaggaggccgccgaagaggtagacgcaaggtcatgaaaaagaagactgtcaaggacgaggaaggctaccttggtgagaacctccgtgcgctgtcttatgacgccctgaaccccgctaacctgccgttttctcgccagtga

SEQ ID NO: 9760 - DNA, 207 bp, A.fumigatus
tacataacagtagttctgggagatgcctctgatgaggaggaacccgaagagctcttccctgactctgggaagtcatcgactgccagctaccgtgagacgagaaaagaacgagaagaaaagctcaggaagatgatggaagatgaggacgacgacggtacgctaattggctctaattttcatacgacactacgatctgatgggtactaa

SEQ ID NO: 9761 - DNA, 387 bp, A.fumigatus
tgtcttgtctttcagaggagaacaggcgtgcggccccctccaccagcgcccacccctgcccaggaagctgcggctccctcgaaacggccatcacaggacgaagcgacacaaaaagtaaagtcggagagcaagaaggccgagcatgcagcaatgacatcacaaacaaaggctgaagagaaaccacctgtcaaacctagtgaaaagactgcgccgttgaagagggagaagagtgacctattcagctcttttgcgaaggcaaaatcaaaacagaagaaagatggatcagcgacccctgctgtttctggtgccgaatcggtcagtgcatcccagcccaacatcgttgctgcaagatctcagctgctgatgaaattaccaggccgagcctag

SEQ ID NO: 9762 - DNA, 1692 bp, A.fumigatus
  unsure (119),(153): Identity of nucleotide sequences at the above locations are unknown.
agagatcggcattgtggggcccgaaagtacgccacttaccgaagcgttaatattcgccaaactccaatccggaagcgcggtttcccggaaagttgttccccaattactttcggagatgnagaagaatgggaaaccctgcagaatctggtaccnttcatgctgcattgcaggtatggcagtctcattacgtctaacggcatgcctctacgaatgcagggtcttttgactaccacagacgatatttataggttctcgctgttcatcttgattatctactgcgtcaagaaatactacgcacccttccgagatcgatggctgccgcttagtcccgctggctggcactacgtggtggccggcctcttgagagaaaaccaattcgaactcgcactggaccatatcgcgcatatggagcgaaaggaaatcatggtcgagaattggctacacagtctgttgatatacaatctctgcgacattggggatttcgacgaagtcctccggcagatgcgcaagcggacaagtcagggtcatgacatgacgacggaattgtggctgtatgtgttggatgtggcagtcgcggcatctcatctcgaaactactcgttacgtatggacgcaaatggtacaactggggtacctccagccttcgagggtcctgtgtagtgacactctgacggtggcggccgaaaagggcgacactaagctcgcttccttagtgatccggtttctttcggaaagtgatatcccgctgatcttgcaggattacgagaagacggtagaggcgcatgtcaagtccggcaagctctcgtcggcttttgaaattctctgtaagatgcacaaagctggtatcaaattggaacacagttcgacgcgggccattttcaactacatggttcagacgaggactagtccacggcaggcatgggctattctcaagaagctgaagtccttgaaatacccggttccgatggaatgcgcgcatgtggtcatcgagctttgtgattatgaatcctttaatgacccgtttgcggttgatgaagggatctcactctaccaggagctctatactttatgtccaggcaaggccgacgtttcgatctacaatacccttttagggatggctcgcagagcgaagaacattcaagccggcatgtttgcagtaaaggagatgtcctcgcttggagtgatcccgaatgacaaaacttttgagcacctcattatgatgtgcttagatgcgggcaattttgaatcggcgtacagatactaccaggatttggtggcacgggggtttcgtcccgatgcatacacgcgccaacagatcaagagcgtatgctccgagtccaacgatgaatttgcgattcaattgagaaacgacccgcagatgcaagatgaccctgcggacgatctcattcagcgcaatgaaggagcttcagaccagtcggcttccatcagaaagatagggtctgaaacacactcaagatacgcaaaacgctccgagcgtcgcatgtgggagccgcctatgaggattctcctctccaaggaagcgcgccgagcggccagcaaggagagacggaagagaaagcgaagacgcttggcgatggccaaggcccaagaagaagagggctggatggactatgagccagggggccttgtgccggaagatcagttgaagcctgatgaaacgcaaaccagctaa

SEQ ID NO: 9763 - DNA, 471 bp, A.fumigatus
atggcctggctaacgatgcgtgcagaaatcctcaactatctcctggcaactctaaccgcgcaatctgctgcgccgctctcggcggagcagatcgcggctgtggttaaccatcggaatcactcgggcaacacgcctctgcactgggctgcgctgaacactcatctaggttgtgtgaaggcacttgtggaggcgggtgcggatatcggtgttaagaatgatgcggggctggatgcgattttcctggcggagaggacggcttggtcgaccgaggaggagggtaaggaggtgcctgctgaggaagaaggtgctgggaagatgtccaagggtcggcaggttgtggagtggttgttgagctcggataaggctggtgacttggaggaagggctcagtgttagcgctggtgttggtgctgaagggtcagcgtcagggtcggggtctggggagacgatggatgtggatgagaagaattga

SEQ ID NO: 9764 - DNA, 327 bp, A.fumigatus
caacatcaggggaatttagttctcaggagttgcagttactccaaaccaagggaagcacagtgcaaaatgtcgacatccacaccagtcaagctctccttcgaggcaatcgacgacctcatctacgacgctcgcgcaggcgacctggaagccctcaaggccgatctcgccacccaaagcaaagagcacaactgccccgaggcctggatcatcgcctccgccattgacgccgagcccgaggccgagggtggcacggggtcctgtctgcttcatttccccgctgcgaatggcaatgccggtacgttgacgcttgactcaactcgactatga

SEQ ID NO: 9765 - DNA, 1560 bp, A.fumigatus
actaatgtgcggtacgtggacagatggaggcatttctcgcgcagacctcggatatcctatgcagcctcatcctccaacgcccctcacgtcaccgtgattcggcccgtcaaaggccttgagccgtatctctacgactgcctggctgcgactttctatcaagactatccccatgacaaactgaccatctacttttgcgtttcgtctcgagcagatcccgcttatccaacgctgcgcaaacttctgtcggattttccgcacgccgacgcgcacatctacgtcgaagaagaggatccgttactccagcctaacaatgcagtcaactacaatctggggccgaatccgaagatccgcaacatgagccgtgcttaccgagaggccaagggggatattgtctggatcctggactgcaacgtgtgggttgggcgaggggtttgtgggcggatggtggacagactatgcgggcttggggacaccccgggcaggaagcacaagttcgtacaccacttgcccattgcggtagatgtgacaggaacgagtgggttgagggaggagcggcaggcccttcttcaagcgtgtgcccaaggcgattctgcttccgcgaggcgcgacgcttttgccatgattgagcaacagcaccgagaagttggctggctagcgactgggggcggccgattagaggagttgtttctggcgtcctcgcacgcgaagatgtataccgccattaacactgttctcattgcgccgtgcattgttgggaaatccaacatgtttcgccggtctcatttggactatttgacgaagccatccccgacggaagcgcagccacgccgccccggtattgattatttctctgacaatatctgcgaggatcatttggtcggtgatcttctttggaaacagcagatacgtgaagagagggaactgggcgaaagctggggcaaacacggcatggtctttggcgacctggcgatccagcctgtggcgagcatgagtgtccggggctatatggcacggcgagttcggtggctgcgcgtacgcaagttcaccgtccttcttgcgactctggttgagccaggcacagaatcaatcctatgttctctgtacggagcatggggtgttaccacatctcttgctcaattcctgcagcgccaaggattcgggttcgcagaccacctgacctcgtggactgcattcttctcgatcttctttctgagcatcgctgcctggatattggtcgactggacattgtacatcaagttacattccgcgaagaccgtcgagctgaacgacgacacgccctgctttgcacaacctcccgaacgccgaaggacgaggcggccgttctcccactggcttgcggcatggttgggccgagagatgctcgctttgcccatctggatttgggccttctacgggggtgtcactgttcaatggcgtgaccgacgattccgggtcgggcttaatatgaaggtccgggaaatcaaggatgggaagggcgtccagatagaaggttcctactccagtccagcctcacgcttatcatccagtgggcaaggctag

SEQ ID NO: 9766 - DNA, 1452 bp, A.fumigatus
acctgggtctgtccgatatgctcgttcactaatccggtgccttctaatttcgacccagcaacggctactgcttctactcccttgtcgccatgcttggcttgtggcataaagccgccatttacgaccgttctgaaggccgcaatcacagctgccgctagtcgcgaagccgcccaagtacatccagcttcacatgagcctggtcaacccgaaagcaatgatgatgaaactgtacgcaagcctaatgcctccacaccatgtcccagatgtacatttgtgaaccatccttatcttctcgagtgtgaaatatgcggggctcccctagcccccgcagtcgcccgaggggcgtctgttgatggctcacgtcgatcagaatccccagcgccggtattcggacaaggaaacatcgccaatactgagacttttgaggtagtcaaattatccttccgcggaggcggtgaaaagactttctatgaaaggttgaaaggcgccttggtccagcgaaagtggctgctctacgatgcgcctcctgttccgcagcagccatcgcaatcgcctgccacgccgaatcttacagcctctggtgctgttgccgccaacgtctccacgccagcccaaccccggtcccccgcagtaggaattgcgggccttgagcagcggggacttgaagctcgtagaaataacgaggtggtaataggcagctcgtttgaagatcttgaagccttgatggcgtctgctaaacggatcatcaatcttgctgaaacgctcgccagggaatcaggcatggccggtgacgagaatactgcagcaaccaacgcagtgctgtcagaatccgctgccgctcttgggatgaccacgaccaaagatatgcttggctctggtgccgagaatttatatctctctgaactctcacgggacttggcggagtacctcaccgacgataacaagggtatcttgcagaaagaaggcggtatcatgagtctggttgatctttgggcgatgttcaatcgctcccgaaatggggtggaactagttagtccttctgacttccagaaagcagcagagctctgggaaaaactgaaactacctgttcggctgcggcgattcaaaagtggtcttcttgttgttcaacgctacgactggaatgatgagaagaccattcggcaactgcaagaatggatggcggaacttcgtcagataccgcccgccgatccagtaccgtgggactggcgtcaatttgggcgtgccgtgacagcacaagaggctgctcaaaggttcaagtggagtgtcggagtcgcagcagaagagctagaaatggctgaggataaaggtgtcctatgtcgcgaggaaggcatcgaagggttaagattctggagcaactacatcacctccgacctttcttcgatgaatagcattgattcgattgatttgagggtgtctagcctggccatatga

SEQ ID NO: 9767 - DNA, 687 bp, A.fumigatus
cgcatctcagtggcgttttatttctctgttcaaccatacttttattcctatctccaggttgtccaaggctacgacgtcgctaccgctggccgggttactcaaacatttgccttcacttcgacaattgccgcctttgcggtttcgatattgatcaaatacacccggcgctatcgagcattcgtcattgctggctgcgtggtctatatcatcgggatggtgctgatgatggtaacccgtcacgaaggaagtacaccagcgcaaatcttagtgactcaggtcgtcgtcggtatcggtggcgggcttctcaatgttccagtacagttgggagtccaagcatctgccagtcaccaggaagttgccgcggccacggccatgtttctgacgtccatggagatgggcggcgcggttggcgctgcactctcgggggctgtttggacccataatatcccccgcaagctccgcctttaccttccggaggagaacaaaggagatgcagacgcaattttcggcaagataacgaaggccctctcgtaccctctcggatcacctgtcagggtcgctattaatcaagcataccaggagacattcaaaaagctcctgattctggctctcattgccataataccattagtacccttgagcttggcgatggaagattacaagcttgataaagtatatgactcatga

SEQ ID NO: 9768 - DNA, 480 bp, A.fumigatus
aaccctagtcctcgctcacgagcgcttgtgtatcgtcggtgtcggttcgtgctcatgccaagcttcccgctttcgaatttgcatgctgaactcacagcagactccggagcgcaacccctcgtcaacgatgatggcaccattgccctggccgtcaacggcgaaatctacaaccaccggatcctgagaaaggggctgaagaagcagtacaacttcaagacacattcagattgtgaagtggtcattcctttggtatgccccaagacatttcacaaaattgccggcttccagaggctaatcagcttcagtatatggaacatggtcttgatgctcctaagcatcttgatggcatgttctcttgggttctctatgacaagaaggaagaccgggtggtcgccgctcgtgaccccatcggtatcaccagtttctatatcggatggtcctctgagacccctggagctgtttacttcgcctccgagttga

SEQ ID NO: 9769 - DNA, 963 bp, A.fumigatus
agtggtcattcctttggtatgccccaagacatttcacaaaattgccggcttccagaggctaatcagcttcagtatatggaacatggtcttgatgctcctaagcatcttgatggcatgttctcttgggttctctatgacaagaaggaagaccgggtggtcgccgctcgtgaccccatcggtatcaccagtttctatatcggatggtcctctgagacccctggagctgtttacttcgcctccgagttgaagtctttgcaccctgtatgcgacaagattgaggctttcccccctggccatgtgtacgactccaagacagaatcgatgacccgctacttccagcccaagtggtgggatcccaccaacgtccccacagctcctgttgactacaaggttatccgtgcaactctggagaagtcggtgcgcaagcgtctgatggcggaggtgccttatggggttcttctgtctggtggtctcgattccagcttagtggcctccatcgcccagcgggagaccctgcgtatgcaagaggcggccaagaacgctcttgtagaccagactggcgcgtctgatttggtcggtattgacgatactaacgagctgtcggtcttcaccactttccagcaattgcactccttctctattggtttacctggcgctcccgacactgaagctgcccttgaggtggccaggttcctcggcaccaagcaccatgccttcaccttcaccattgaggaaggtctcgacgctctctccgatgtcatctaccaccttgagacatacgatgtgacgactatccgcgcttctactcccatgtacctgctcagccgtaagatcaaggctatgggtgtcaagatggtcctcagtggagagggcagtgacgagatcttcggtggttatttgtacttccatgccgctcccaacaaggaggaattcggccttcacgcccggggaggagatacgcgt

SEQ ID NO: 9770 - DNA, 912 bp, A.fumigatus
tttacccctgccgtactaacttccttcaggtatggtgccaagaatgaagacttcgcggaaatcgctcgtatcaaccatgaacactccaagcgcaacccctactcgcaattccaggatgaatacacgctcgagcagatcctcaaggcgcctatgattcatgagcccctcaccaagctgcagtgctgtccaacctcggacgggggtgctgccgctgtgatcgtctcccaggcattcctagacgcccgtccccacctcaaagaccaggcaatcctggtcgcaggtcagcagattgcaacggacacatccactctctacaaccgaagctcaatcgacctgatgggctttgggatgacccgctacgcctgtcgggcggccactgctgaggctggcgtcaacgttaaggacatcaaggtctgcgaactgcacgattgcttctctgccaatgagatgatcacgattgacgcactcgagctctgtgagcctggtaaggcgcacgagatggttcgcaaaggtgatatcacctatggaggcaaaatggtcatcaatccctccggcggtctcatctccaagggtcatcccttgggtgctaccggtcttgcgcagtgttctgaactggtctggcacctgcgcggatgggccaacaaccgattggtccagggaacagatgtggcactgcagcacaaccttggcttgggtggtgcagtcgtcgtgactgtatataagcgtgcggacggaaaggttgcggctgcagttccttcagacgttgtcgcgaagatcactggactgggatacaatccagccgtcgaggcaaagggcttcacagccgagcaagctaaatcggtccttagcaggaagcacaacgaccagtgggcactgggtgacactcaggagagagtgctcgcacgcttctaa

SEQ ID NO: 9771 - DNA, 582 bp, A.fumigatus
tcaatatcctcaaccttttaccttacaaagatacaacacttacacacctctcgggcccaactaatcagcatgggaaagaagcaagtagcgcccgcctatgtcctaggcgtgggcatgaccaagtttatcaagcctcgtgggaaggtcgactaccatgaactcggattcgaggctggtgtcaaggctatgctggacgctcacatcaattacgatgatgtcgaccaaggtattgcatgctacgtgtacggcgatagtacctgcggtcagcgtgtcttctaccaattcggtctgaccaacatccccatctacaatgtcaataacaactgctcgaccggctcaacgggtctggccatggctcgcaccatggtctcccacggcgctgcggactgtgttcttgttattggtttcgagaagatgagccctggaagcttgcagtcggtctacaacgaccgggctaatccgactggtctctttggtatgatgatggccgagacgaggggcatcactaacgcccccggtgctgcacagatgtttggcaatgctggccgggagtacatggagaagtacgttgaaccatgctaa

SEQ ID NO: 9772 - DNA, 1266 bp, A.fumigatus
cgaatgtcgcatatatctaggaagtccacgacgtccacaggcatctacgaaacaaatatggaagtatacaaaactcgtctttctcctcatgtgctcccctcctcaccaatctctactcctttatccatcctagatgccaccgttgcccgatttgctccagctggcgcaatatggctatgggatcggttctccgggaatctccctgaaacggattttatcgactgtcttcaatctttatttgcgcagactctatccgactatccccaatgggctggtcagctgcaatgggccccggttcgagaaggcggcaatcacaccgaacgcttcaaccggcccatgatcgtctacggggcacctgatgaccctggggatgagtggcgtgtcgtcaaacgagacggcatatcggtcgggacgctggtaccttcagccatggaacgaataagcgcgggagcctgggacggggccaatttcccccagagagatttcctgagtgaacccccattggcgttgcatgatctacgtgaataccagggattacccagtatgcaggtgcaaatcacgctattaaagagtggcgcattcgcaattgggatccgaatggcgcatgtcctcgccgatgcccagacgttgatggtgtttgtgcatcagtgggcggctaccagtagagccacgtttggttcacacaactcgaagtcgttgatggacgcaccggtctttaacccagcgctgttagacgcacatgctgccggggatgttgacggcccagcgccggatcgcggactggttgccacagcgcgagagctgccactgcaccgatttgactggtggaagacggacgacccggggtatccgaaagtactggtgcccaacacgctgaactcgatgccttcgtgtgagcagctggacagcgtcgaactctctccgtcgacatctgcaccatggacatcgtgggacctgtccagacggattcgttatacgcagatccattcctcagggaatcaattggcggatctcaaacggacagcgctggcgcagagtcaagaagatatctctcgactagatgcgttactagcccaccttgggatctccatcaaccgcgccaggaatctcaccaattgccccgactccgttttcctggatctctctataggcactagaacacgcctgtctccccctctacccgacacatttctcggatcaccactctttctcactcacgtaagctccgcagcaaaggccctttgcgctgcgttcatcagacaatag

SEQ ID NO: 9773 - DNA, 189 bp, A.fumigatus
tggcgtctcagatggtcggcaaattcaggcacccctggaacggcagaattcggcgaccaaaacagctttgtatactcccagttctatgttgagtcgcctcaaacttccacggactggtttgaccaacttcggggtgacttgctacatgaactcgaccatccaatgtctcagcgcgaccgtaatgcttag

SEQ ID NO: 9774 - DNA, 2430 bp, A.fumigatus
gactcaggacatcagggaaccgccgcggcaacatctcagggtgcagtttctagaggccgtcagagtgaggcaggcgagagttcagtacggatgccgagtccttcagaatttcaaagagcgcctgacacacgaccgaagccgaacaggtattcggcccctgccgaggacctacttgcccaacgcttcgctaaactaagggcatcaccatatcctgtcaatggtcaaaatcatccgaataaaggacaaaatggtgcaactacaacgccttcgccgcctaaatactctaatgactatcctcctcgtccgttctcttacatacagcaaagttcacaatctagcgcaaacttgacctcaccctctaggcgccctctagggccccgtaacatggggaccaaccacgacttaccgaatccgcctccaaagataccgcttaatacctctcttcctcgggcacctgatccagcgtatagtccaatatggacagtgccttctcagcccccatcaaatccgccgagaacatctaccgaaagctcccgccctgtcaatccgcgatactcacaattagccaactctccccgtggcagtcccagtcgtggtggtcttgatgacaatccctatcgatctacgacgccaaatggcgttcaccatgtcaaagaagccaggagtagctccgcagatctaccgcatagcactactatcaccgctcaagctttactggagtaccttcgcaaataccacgttttgttgatcgatgtgcgacctcgcgaggaatttgacggaggtcatatttacgccaaatcaatcatttgcattgaaccggtggcattgaaagagaacgtgtctgcggaggaactggaagagcggctggtggtatcgcctgagcatgaacagtcactgtttgagaggcgcaatgagtttgacctcgttgtgtactatgaccagaaaacagattcggtcagctaccttgcggggtctcctgttgggacaacagctcctcatcttcgagccttgcacgacacactgtatgagtttaatgagtacaagcccttgaaagatgcacggccacctgcgttactattgggcggactcgatgcatggattgacctctttgggcagcagtctttggcaacatcgacgactgctgccgtaatgggatccatacaggccaagaggccggcgatgagaccgggtagacctcttgggagggtaccgactatggcgagtgccaattccagtctggaagtccgaaaaagaagactgcgcgaatataagcctttgaatccggaagaattgaccgcgtggatggagaagtcgaagaatgaggagatcgacacaagcacctatatcgaggaggaagtgctgacagaggaaccggaagatgcttctgaacagcaagagcctccggttacaccttttgtgcatacatacgaggacttcttgcgacgtttccccgaaccgcatgcaattcaggaatcgatgattgtgcctcactctcagccatcgataccttcctcaacaccaaattacgctgctcccgtacccgttgtgccatcacgaccaccccccgccgtaccccgacccagctatagtggcgtctcagatggtcggcaaattcaggcacccctggaacggcagaattcggcgaccaaaacagctttgtatactcccagttctatgttgagtcgcctcaaacttccacggactggtttgaccaacttcggggtgacttgctacatgaactcgaccatccaatgtctcagcgcgaccgtaatgcttagcaagttcttcattgacaaccgattccggttctacgtgcagaagaattggaaaggatcacaaggcatcatgcctgggctatttgcgaatctgattaggtcgctgtggaagaacgatgttgaggtgatcatgccgacatcatttcgcaatttttgcggccgcttgaatcaagagtgggccatcgatcggcaacaggacgccaaggagttttttgactttgtggtggactgtttgcatgaggacctcaacatcaactggcagaggactcctctccggccgctcacattcgaggaagaaatgcagcgggagcggatgcctgtacccaaggtctccaagattgagtgggaccgctactgtcaccgggaagaatccttcatctcctcactgtttgctggccagcatgccagtcgacttcgatgtacgacctgcaagcggacgtcaacaacatatgaggctttctacagtatcagtgttgagattccacacaccggcacgggcgacatctatcaatgcctgcgtagttactgccaggaggaactgctgagtggggatgaagtgtggaagtgtccttattgcaaatgtcagagggtggcaacgaaacagatcatcatcacccgggcgcctgaacatactcgtgtcttctcccacaagcgc

SEQ ID NO: 9775 - DNA, 1257 bp, A.fumigatus
ctcttgcgcacgttatcatatatatatactgaaccagtcacatttcaaggccccatgaacctcacgggggtccactgttctcctccagccgggacgctccagcaggaacgatcccctggcaatttctccaggcttacctttgtgatggaggacggaataaggccagctcgtcatcgcgaatcgcgagtacagacaaaagaggaatcaggcgagagaagagagaaaaataagaggctcaaggaaatgggaggcgtttgcctctggtgttaccgtttgaagaaaacttgcgaaccgcaacttccttgtccgcgttgtcaagacagcaaatctaattgcatcagaagacctgcagagctgtccttgcttccctgtcaggacatgaatcaaggcagtatttcgtttcaaacgaaatctgaagatattctttcgcctctacaaaagatatcccaatgtgcgtcttcgcaggctgttgtcagcttctgccaatgcaacggcgaagtgatagattactgggtcatgcatgcggccaacctcggtgctacaaacatgaacacttccagcgggttgggccaacagctgattcttaagctcctgaagtgcgttcaatctgcagagatggataaatttgagacggaattccctggcagctctcttgtgcagactgctgtgaccatgcacaagctgctctcggcgattctatgcctttccaagacgcaggtatacttgcgagcgagcgatgtagaacaaacaaggatcgtggtgtccttcatgctggctctctgccgacaatgtctctgcgaattgtcagacgacttgggttccgaagcctacagcttaatcaaacagaaatcagactacgacggtgagcctgctggcatgaagaatgactgcagcggtgcaagctgcgtcaacccagtttgggtcgctgtcggcctctaccaccgagtcctggaagccctttctagcttcgaactgccaccgccaatagctgacatatttgataaggttaaaattcgctcaaacatggtgctctccaatatctattgtgtgaaggagaagatcgcgcacgtattcgggtcgaagctggagaaagaaaaactggaggccgaaaaggtgtcctttgagcaatatatcccgccagtctcctgccgtcgatacttcaacgtcgcgatctgtttcggcccttttgatcagagtcagccatccacagccattcacagacagagtcttcacgccggcgctggaaggaaacgaatc

SEQ ID NO: 9776 - DNA, 465 bp, A.fumigatus
ttcccacaccatgggctgcactggcattccacccactggacggatatgtgcagtctctgccataccagtcagtatccctgtccactgtcccctgtcgcagcaatccttagcgccgtccctctaacaatcaacagcgtcttcgtcttcatttgccccatgcagcgacacctgtacatggttctcttcgctgcggtccaaatctggaccattctcattcacgacggcgacatgatttcgggccattggacggagaaaatcatcaacagcccggcgcaccatacattgcaccatatgtacttcaccgtcaactatgggcaatacttcacctgggccgacgcctatttcggttcgcaccgcgcccccgaacccgcgctggatccgctccacgatgccctcaaggtgatgcgggccaagggtcttgtggatgagcacggcaacccgatcaaaaagccaaagggggagtga

SEQ ID NO: 9777 - DNA, 816 bp, A.fumigatus
ctcctgagtaactctggcaattgttttgctccgacatccccccgaagcttgccgcagtcgctcctgtatgtggcgcaacgcccttctccgcgccgtcgtggtcgaccattaacatattcacccgatcagcccgccatggatgtcgctctcgagtttctcgatcctctcattctggacaaggcctatgcctggttgctgccctccgagcctaacgtccccgatccgacctcgcgttgggatcgcgacaacgtctatcgccaagtcatctcgattctggtcctcacgcaactcggcgcgacctccctctacctcttcttcagcgcgctctcctactacttcgtcttcgaccgacggctcgagtaccatccgcgattcttgccgaatcaagtccgccaagagatcaaatcatcgctgtccgccattccgtttatcaatatcctcacgctgccatggttcctggctgaggtccgtggcaaaagcatgctgtaccgctcggtcagcgactatggctggccctggctggtggtctcgtccatcctgtacatggccttcaatgatattggcatctactggatccatcggctagagcatcaccccagcgtgtacaagtacattcacaagccccatcacaaatggatcggttggtctttacagaactcccatgtacctaggtgcatgctgacgagatatagttcccacaccatgggctgcactggcattccacccactggacggatatgtgcagtctctgccataccagtcagtatccctgtccactgtcccctgtcgcagcaatccttagcgccgtccctctaa

SEQ ID NO: 9778 - DNA, 1683 bp, A.fumigatus
  unsure (563),(1495): Identity of nucleotide sequences at the above locations are unknown.
atgtcctggtctttccagcagaggggacccagccctgctcctgacgaggaaccagatgtagagatgcgattcctaactttcttcgtccttgcagcagcagcctgcgctgccgttccatatgaagagtatatcctagcaccagccactcgagatttagtcccagaaagggtgtatcaagtcagcggctccatttcggacccctctgccgtaacccatgcagaaggtgggaaagcgacgttccatggcgtctcatccgtcacttatgactttgggcgcaacatcgccggcattgtctcggtggccgtcagccgggtctcctcgccggatgccttcatcggcgtcacgttctccgaatccagcgcctggatcagccacgaagcgtgtgacgcaactgccgatacaggtcttgactcacccctgtggtttcccgtcggacatgggccgggacgatacaccgcagagaagaaacacaatcgcggagcctttcgatatctaactctcttcaccaacacatctgccactgttgttgttgacagcgtccggttcaatttcacggccgttcngactcagaatctccgcgcgtacaaaggctacttccactgcgacgacgaattgctcaaccgcatctggtacgcaggcgcatacacaaaccagctgtgcaccattgatcatagcatggggaatgcgctgccgttgctaggcaccgtgacctcccgcgacaatatcactctcccggagactgtcccctggtggagcaactataccatcgccaacgggagcagcgtgctcacggacggagcgaagcgggatcgccttgtctggccaggggatatgtctattgcgctggagagcgtcgccgtcagcacatatgacctgtacagtgtgcgcatggcgttggaatcactctttgcaatgcaacaagccgacggccgtcttccatacgccggcaaacccttctatgacaccgtcagctatacctaccatctccacagcctgatcggcgtggcgtactattaccgcttcgccggggacctgaactggcttgccgcacactggacccagtacaaacgcgccttgcaatggtccctgtccagtatcgaccacaccgggctcgccaacgtcaccgccagcgccgactggctgcgtttcggcatgggaggccacgtacgtcccgcaccccacgcccccacaaggatcttgactaaacacaaagcagaacatcgaagcaaactccatcctctacttcgtcctccgggaatccctcctcctggcaacaaccctcaacgacaccgcctcctcctcgtcctggtcccgcatcgcaagcaccctcaaagcctccgccaacgcccgactctgggacccagccgtcggcctctaccgcgacaacgaaaccaccaccctccacccacaggacggcaacgcctgggccctcaaagccaacctcaccttgtccgcaacccaatccgccgccatctccgccgccctctcggcccgntgggggccatacggcgcccccgccccagaggcaggatccaccgtctcccccttctccaccggcttcgagctgcaggcccacttccttgcgggccagccgcagcgcgctctggatttgatgcgccggcagtgggggttcatgctggacgatccgcggatgacccagtcgacgttcatcgaggggtatag

SEQ ID NO: 9779 - DNA, 882 bp, A.fumigatus
  unsure (294): Identity of nucleotide sequences at the above locations are unknown.
ctaaacacaaagcagaacatcgaagcaaactccatcctctacttcgtcctccgggaatccctcctcctggcaacaaccctcaacgacaccgcctcctcctcgtcctggtcccgcatcgcaagcaccctcaaagcctccgccaacgcccgactctgggacccagccgtcggcctctaccgcgacaacgaaaccaccaccctccacccacaggacggcaacgcctgggccctcaaagccaacctcaccttgtccgcaacccaatccgccgccatctccgccgccctctcggcccgntgggggccatacggcgcccccgccccagaggcaggatccaccgtctcccccttctccaccggcttcgagctgcaggcccacttccttgcgggccagccgcagcgcgctctggatttgatgcgccggcagtgggggttcatgctggacgatccgcggatgacccagtcgacgttcatcgaggggtatagtacggatgggtcgctgcactatgcgccgtataggaatgatgcacggatctcgcatgcgcacgggtgggctacgggcccgacggcggcgttgatgttctatgcggccggactgcagattgcgggggcgggtggggagaggtggctgttcgcgcccatgccgggggatttgcaggctgttgaggccgggttcgagacgcgtttggggaggtttgcaacggagttcacgaggggggaggagggatatacgaagctggtgtttacgacgccggaggggacgagtggggaggtgaggctggaggcggagggcgtgctggtctcggggaatgggacgagggttaagcttgttgagggggtttcgacggggttgcatggtgggacttggaggttgacgagggtgtag

SEQ ID NO: 9780 - DNA, 408 bp, A.fumigatus
  unsure (290): Identity of nucleotide sequences at the above locations are unknown.
acacaaagcagaacatcgaagcaaactccatcctctacttcgtcctccgggaatccctcctcctggcaacaaccctcaacgacaccgcctcctcctcgtcctggtcccgcatcgcaagcaccctcaaagcctccgccaacgcccgactctgggacccagccgtcggcctctaccgcgacaacgaaaccaccaccctccacccacaggacggcaacgcctgggccctcaaagccaacctcaccttgtccgcaacccaatccgccgccatctccgccgccctctcggcccgntgggggccatacggcgcccccgccccagaggcaggatccaccgtctcccccttctccaccggcttcgagctgcaggcccacttccttgcgggccagccgcagcgcgctctggatttga

SEQ ID NO: 9781 - DNA, 1053 bp, A.fumigatus
  unsure (760): Identity of nucleotide sequences at the above locations are unknown.
ccacggttggtattgcaagctgtcaagcggagtcgaaagtggaatgcattttttttttcttgctgttggcataagcaccgtacgagcacacacacacacacacactcgactctatccattcctgtccaacacctgtccgattgcatgggatcgaggcacatgaagaatacactacaccctcgtcaacctccaagtcccaccatgcaaccccgtcgaaaccccctcaacaagcttaaccctcgtcccattccccgagaccagcacgccctccgcctccagcctcacctccccactcgtcccctccggcgtcgtaaacaccagcttcgtatatccctcctcccccctcgtgaactccgttgcaaacctccccaaacgcgtctcgaacccggcctcaacagcctgcaaatcccccggcatgggcgcgaacagccacctctccccacccgcccccgcaatctgcagtccggccgcatagaacatcaacgccgccgtcgggcccgtagcccacccgtgcgcatgcgagatccgtgcatcattcctatacggcgcatagtgcagcgacccatccgtactatacccctcgatgaacgtcgactgggtcatccgcggatcgtccagcatgaacccccactgccggcgcatcaaatccagagcgcgctgcggctggcccgcaaggaagtgggcctgcagctcgaagccggtggagaagggggagacggtggatcctgcctctggggcgggggcgccgtatggcccccancgggccgagagggcggcggagatggcggcggattgggttgcggacaaggtgaggttggctttgagggcccaggcgttgccgtcctgtgggtggagggtggtggtttcgttgtcgcggtagaggccgacggctgggtcccagagtcgggcgttggcggaggctttgagggtgcttgcgatgcgggaccaggacgaggaggaggcggtgtcgttgagggttgttgccaggaggagggattcccggaggacgaagtagaggatggagtttgcttcgatgttctgctttgtgtttag

SEQ ID NO: 9782 - DNA, 1776 bp, A.fumigatus
ggacgcatgtctcccgatgaagtttcgttaccgtctccttataaaagtaccgctgcaagtcttgtggacgtcttcaaaacgctaggggtcgcccgttccagatcgcaaaccccactttcgctggaggacgacagcagtcattccttgtcgcatacgacggatgcgcggaggaacaatttcctcgtactcggattcgaatcaatgcatcgtggtagcgtggtatccagttcctcggacactcccagggccccggatttcgaaacatctctcaggaatctatcacagacacagaacctagctcatgccatcgacgaggcggagcatgtctccagatccctgcagtggttcacttcagaccaatccattgcgctatgggaggctggttcctacctcatccacaatccggactcgccggacgcccgacgaagtgggtcaatgttgatagaagctgttgcagcccgtcaggatctatcgccttcaggtcggcgcatcgtttttgaagcgatttcatgctcgtcagagccggatgtaataccggcacgtgtgcaatcgttgatatcgctttcggatcacggcagaaagttggacttcacctcatcgtctatccttcccatcctttcgtcatgcgctgtcccactgtatgagctcatctcgtcgtcccgactgaaagctcgcaaggccaaggttggcaaagtgaacggacttggctatgatgaaacagcattggatgatttgttgcagttcgctgttgatttgatcacgctccaacggaaacgtccaagcgccgaagaggttgagtcgttgctcgatcagattttcacgatttgcaaaaagacgagcgttgccgcggacatcaaaaactcgttagcagtattcgatgccgtcatactctatgcagacgttccggacgggagtttcgttcctatgctagaggttctgtgcagcattcatgcttctgtgaagtccttatctgggcctacatcgagagccgtcagaaaccttgcaaagtcaagatggcaaacagaaatgatcaacacccttgattcatttctgatggattcatctggggaagagagtcgcaatatcaacgttttgcgcggtacagtgtacattttcacagacttggttcgcgctcatggtcaggatggcataccgcagcttcgcttcgagcatctaatggattgtctcgaggtggtgattcgtaaagatgacagtcgcttagaagcagatgtgctagagttgtgtttgaacattttggatggcgatttcgctcacgtggctctggaaagcagctggtccgggtttgtgagggttctcaactcatgttccctcagagctattggtgagtgtgaagagcgcgccgcctcaatttctagttcacagtcgcccttctcaaaaactagcacgtctgaagacgcaaaatcgaatatcctcgccaacgctgttcaaatcgcggccacagtcgaatccctctgggaccgtttgagcagagagcaaaaattggaagctacacgattcctgatgaacctgtgtgagcacattgagccgtcgcaggctgagctcgtcatcaacacgatgagatccgaaaatctttgcctcccttctaggtcagactgggtcaactattgccagagattgattcgctgcttcatccgatctcgcaacaagccatctgatatccgaatttcagccttggatctcctgaaagaggcgttttcaacctacgatgcattagtatttttcaaggggagaagggttgctccaccttatgcttga

SEQ ID NO: 9783 - DNA, 282 bp, A.fumigatus
  unsure (116): Identity of nucleotide sequences at the above locations are unknown.
agtgagagcaggtgtatgattgaaagttcagagtggatggaggagctgatggaggaagtggacagacagtccattatgcaaggtccgatattaggtgtcttcgtctggggtatcanaaacatgccgaaataccggccaaccacggacccaagtcaagcactctttgttctgaccactgtgcagaaaatcccagtggaactttacttcatggaaggcttggaaattggaacaatcgtctatctcgccctttggaggcagtcgactaacagggtattcaaatag

SEQ ID NO: 9784 - DNA, 1854 bp, A.fumigatus
gtcaatacggcatcggtgtcgaaagtatccctgaaaatggaatacttcgatttcgacggagcctctttcggctcccatgccccagacgacgaggtggcttcggacaggtttgagctcgatgagaacgacgcaattgaaaactacgaatcccttctacgtgagcagccattggactttcccaatgatctgccggagcaggatgctctcaacccgcagacggaagccccgtcagtcaatgcgcaatccaataatgctcttccaatccatcgagccaaggagccctgcgacttttgcaggcatatgaacctggactgcttcatttcagacagaggagccttgcagaatggctgcacgtgctgcgtaattttgttccgagagtgcagcttcacgcacgccaagaagcctggcaagtacatggaaactctccagtcgatctcagagaacgcagatatcccaacagttggtccaaagggaaggaagacgctaaaatcacttacggggatgaccatctcggaagatatggaaggccgggggaggaagagcagttctcgtctttcccgcgacgccgtacggatcctcaaaacatggcttctggagcacctggaccatccgtatccgtccgagcaagaaaaagacgaattgaaaaagcgcacgggtctgaagagatcccaaattagcaactggctggccaacgcgaggcggcgtggaaaggcccgacccttgccgcccagcaattcgtcggttccaggtgccataaacattcccgggcagcaacagcagcagcaaccgaacattgcgctcatgacgccccttgagcgatggaagtactctccacctgaaaacgaacctgcttccaccaccgatattcttcgagccctggtgaacaaccctttggattcaacacgacagccaggtcacgtgcgttccctttctaggaagggatccagcaatgactcaagccatgccaactccaatatattcaaggccccatccatcagcagcttgggtgaaagtcggtcagtcagtcgttcatccgtctctgacctgtcctttgcctctgccttctcccatcggtcctccttggagtcctttggctcaatggaaaggaaggaacgtcgtcgtcgtcgcaagccctcgacagccttgaacactttcaatcaacagaaggctcgcaactctcgcatattccaatgcacattctgtactgaaacgtttgctaccaagtatgactggcagcggcacgagaagtcgttgcaccttgccctcgacaagtggacctgctcacctcagggaggtgtggtgtacgtcaacggagccaatcgctgtgtcttttgcatggcgagtgacccagacacagaccatctggaatcccactgttatagtacctgtcaagagaagactctggcggagcgaacattttaccgcaaggaccatctcaaccagcatcttcgactgatgcacaatgtcaagttcaattcatatatgaaccaatggcaaagcacaaccacagaattgaaatcgcgttgcggattctgtggcacaaccctcacgacctggaaagatcgtgtggaacacctggctgcacacttcaaaaacggcgctgatatgacccaatggcaaggggattggggcttcgaaccattcgttcaaggcttagtggaaaatgctatgcctccttaccttattggtcaagatcggaaaacattgaacccttacacaacctccaaatttctcggacagtcgtgttgttcaccaactactgcgtctcctgggctcattgaacctaacgatgtgaattgtttccatcgtctccagcgcgagctcactgcatatatccacaagcaagttgcataa

SEQ ID NO: 9785 - DNA, 894 bp, A.fumigatus
cgagcgcttatcttccagccccggcgggtaagacgtgatgtatatcctagggatggtcaggattcgacggaggcccacattgattcccaaaatccccaagggcccaacggcacggagagttctcaaaaatcgaccggccgcaaatcgaagaaaaagaaagggaaaaaaggacgtaatggttctcacgcgcaaggagacgaaacctcgacccccatgtccaccccttccgtttcgatgtcgcaccctttgccgccacctctctcctcacatctcgcgtctcacaatattttgaagcctgccaaaaaccgcagtatttggaatacatctactcaggaagaacgtgagaacattaagacgttctggctcgagctaggagaagaggagcgacggcagctcgtcaaggtggaaaaggatgctgttctgaaaaagatgaaggagcaacaacgccattcgtgtagttgtacggtatgtggccgaaagcgaacggctatcgaggaggagctcgaggttctctacgatgcctactatgaagaacttgaacagtacgccaatcacaatcaaggatcgtttgaaaaaggctcccctatggtaccgcctccacggttgtaccaacctccactacgatctcccggtcaacatacccgaacccaaggccaattccatccttcacgaggtcgtattcatgaactgacagaagatgatgacttggaggaggactacgatgaggaggaagatgacggggatgagccgtacagtgacgaagaacttgacgaagaagacgaggaaactcgagcagctcgcgcagatttctttgccttcggaaatagcttaactgttaaaggtaaggctgatgtgccgccagctttcgatcattccaacagaatcctgtactga

SEQ ID NO: 9786 - DNA, 1512 bp, A.fumigatus
  unsure (800),(808),(820),(823),(848),(856): Identity of nucleotide sequences at the above locations are unknown.
tcgaagaactcatggaggaggagactcggaacgaacagcgaaatgctaagaaagctcgggaagcgcaaaaacggaaagacaaaaaaagacttcagaaacaggccaaggaagaggaacgcgcgcgtcgggaagcggagaaggctgcagaggaagcagctgccaaggcggaacaggagaagaaacttgaggaacagcgaaagaaacgggaggagcagcggaagaagaaagaagcagaacggaaggcccaagaagaggagcgtgcgcgcaaagaggcggaaaagcttagacgtcagcgtgaggaacgagagcgacaggccgaagcggagcgaaagcagcgcgaggagaagaaacgacgcgaagaggctcggcggaaagaaaaagaagaacgcgaattgcgggaaaagaaggcaaaggaagagcgcgaccgcaaggctcaggagcaacaagccaagaaggatacagcaaaaggcggagaggaagccaaagatcaggagaagcgtgatgatcaagccaaacggtcgtcgcaacaggtacctgtccctattccgacgaatttacatcatcttcagggcctttccccgactgtcgctcattcgccgcacgtcccatccgcaacacctgtgttacctaaagctcctactcctgccaaaccccgtcagccatcccaacaagattctcattcctcctcgccacactcccaagcccctagcaccgaccggttttcagggctaccttttttcttcgttcgatgcccgggtctcagtcatcgggagttgccagtgggaattcgcaacaagggncagggaanttcatgcaatgnttnatcaacctcagctttttacgccctngtcccccntaggcagatccattcctcctggattctcgagcgtcaacggaataccacctaatcccccgggcttgtctggaatggtcgcgcgaccaccagttggacatgacctgcctagttatccgtcgcattcaggacctttcatcagtcctttccgtggctatccagcaccaaccggaatccccgcccccccaggtatcaatggggcacgtccaatgccgcctgggcgcggatttccgcttgagcccgcacaagggtttgcgttccatggccagcagattcctggagctttctcgacgccgcaaggtggattgccccaccgccattccaggcaaccctccggctcacttgagaggtcacctctagagaatcacgcacagcctatgccaatttctcgacctagccctatcaaacgaccatccagcacccaacaggaccagcagaagggtgatgatcgcaccacacaacgggatgtggatgatttgagcgcccatcttggtagcagtgctctccttgatgacagtgatgtttctctctcctcgaatctgtcgcaatcgctaccaggtgctacagtacccggcactttttcaggaccggcgcgggccagtttcggtggaccatctctgtttccggatcccctcagtggtaagtttctccggctataa

SEQ ID NO: 9787 - DNA, 384 bp, A.fumigatus
tgtgccgccagctttcgatcattccaacagaatcctgtactgatttcttcctttttcccctcgctctccgagatagatggtattcttacagttgcagacgatctactgaagaatgatgggaaacacttcatcgacatgatggagcagttggctgagcgtcgaatgcaacgtgaagaagatacgcagtacggcatagctgctgcgcacgaatcccttcatagcggtcacaatcatggtccattcgatgacgaagattacgacgacgaggaggacgaggactatgacagtcaagaggaagaggattacgaggaagatgaaatggtctgccctggagttgttcccccccttcgtggtattcgaccgttatgctttgttcaccgctaa

SEQ ID NO: 9788 - DNA, 1053 bp, A.fumigatus
  unsure (945),(953),(965),(968),(993),(1001): Identity of nucleotide sequences at the above locations are unknown.
cctctaccgcaggatgccatgacagaagaacaacgcatggaagaaggccgacggatgtttcaaatatttgcggcccgaatgttcgagcaacgcgtcctgactgcataccgagaaaaggtcgccgagcaacggcaacagaagttgatcgaagaactcatggaggaggagactcggaacgaacagcgaaatgctaagaaagctcgggaagcgcaaaaacggaaagacaaaaaaagacttcagaaacaggccaaggaagaggaacgcgcgcgtcgggaagcggagaaggctgcagaggaagcagctgccaaggcggaacaggagaagaaacttgaggaacagcgaaagaaacgggaggagcagcggaagaagaaagaagcagaacggaaggcccaagaagaggagcgtgcgcgcaaagaggcggaaaagcttagacgtcagcgtgaggaacgagagcgacaggccgaagcggagcgaaagcagcgcgaggagaagaaacgacgcgaagaggctcggcggaaagaaaaagaagaacgcgaattgcgggaaaagaaggcaaaggaagagcgcgaccgcaaggctcaggagcaacaagccaagaaggatacagcaaaaggcggagaggaagccaaagatcaggagaagcgtgatgatcaagccaaacggtcgtcgcaacaggtacctgtccctattccgacgaatttacatcatcttcagggcctttccccgactgtcgctcattcgccgcacgtcccatccgcaacacctgtgttacctaaagctcctactcctgccaaaccccgtcagccatcccaacaagattctcattcctcctcgccacactcccaagcccctagcaccgaccggttttcagggctaccttttttcttcgttcgatgcccgggtctcagtcatcgggagttgccagtgggaattcgcaacaagggncagggaanttcatgcaatgnttnatcaacctcagctttttacgccctngtcccccntaggcagatccattcctcctggattctcgagcgtcaacggaataccacctaa

SEQ ID NO: 9789 - DNA, 195 bp, A.fumigatus
cgattgcgacagattcgaggagagagaaacatcactgtcatcaaggagagcactgctaccaagatgggcgctcaaatcatccacatcccgttgtgtggtgcgatcatcacccttctgctggtcctgttgggtgctggatggtcgtttgatagggctaggtcgagaaattggcataggctgtgcgtgattctctag

SEQ ID NO: 9790 - DNA, 696 bp, A.fumigatus
attcgtcggaatagggacaggtacctgttgcgacgaccgtttggcttgatcatcacgcttctcctgatctttggcttcctctccgccttttgctgtatccttcttggcttgttgctcctgagccttgcggtcgcgctcttcctttgccttcttttcccgcaattcgcgttcttctttttctttccgccgagcctcttcgcgtcgtttcttctcctcgcgctgctttcgctccgcttcggcctgtcgctctcgttcctcacgctgacgtctaagcttttccgcctctttgcgcgcacgctcctcttcttgggccttccgttctgcttctttcttcttccgctgctcctcccgtttctttcgctgttcctcaagtttcttctcctgttccgccttggcagctgcttcctctgcagccttctccgcttcccgacgcgcgcgttcctcttccttggcctgtttctgaagtctttttttgtctttccgtttttgcgcttcccgagctttcttagcatttcgctgttcgttccgagtctcctcctccatgagttcttcgatcaacttctgttgccgttgctcggcgaccttttctcggtatgcagtcaggacgcgttgctcgaacattcgggccgcaaatatttgaaacatccgtcggccttcttccatgcgttgttcttctgtcatggcatcctgcggtag

SEQ ID NO: 9791 - DNA, 408 bp, A.fumigatus
caatccgcgtattacggccgtaccccaacaacaacaattataattactgctggtgttcagaagtaccgcgcgtcttcacagatagcattctgcatcatgagaccgtctcatttggggctcctggcccgtcgatcgtggatctgcacgcgatgcagagtagccaactactcttccgtcgcgccagcccgcgctggcaagtccaagaagaacctccccgatgcaccggccagaacccggttcgcaccgtcgccgacgggataccttcatcttggatccttgcggaccgcattgttcaactacctcttggcaaaacggacggggggccagttccttctgcgaatcgaggatacagatcaggttcggccttggagcaagcacggaacattggaatgttgtgatcagggctga

SEQ ID NO: 9792 - DNA, 570 bp, A.fumigatus
gacgctctgttgcagtccgaacggacggccatttaccgcgaacatgccaaccaattggtccaaaacggtcacgcataccggtgtttttgctctccagaacggctcgactcgctcgcaagacatcgcagtcaggccggtctccctcctggttacgacagacagtgtgcagacatctccgccgaagaatccgaggatcgagccgcaaagggcgaagcgcatgttgtgcgcttgaaagtagagggctaccccatgttcgatgacctggtctatggcaagaccgggcagaaccgctcgagcagtaagctggacctcattgagcgagtctacgatgaccccatcctgctcaaatctgacggacacccgacgtaccatctggcaaatgtggtggacgatcattgcatgaagatcacccatgtaatcaggggaaccgtcagtatactaccccggaaaaaacagactgcaaatattgactcgtacaggaatggatgccctcgacaccaatgcatgtggccctgtataacgccttcaactggacacctccgcgcttcggtcatgttcccctcctcgtag

SEQ ID NO: 9793 - DNA, 363 bp, A.fumigatus
  unsure (71),(171),(253),(301): Identity of nucleotide sequences at the above locations are unknown.
acccccgggaccatcgctctgctcacagccacccagttcaacctcaaaatcacccgcggcaacaccgtcgntgccttcgaaaagctgtggtttctccaaaaagcccacgcgcagcgattcgccgccaccggcgggcccgtcttcgacgaaatgggtcaccaagtgtctcangccggtgaagagacctacccagcggatcaactgtacgtacataatcccagcacacccctcaggaacaaccaactcacttttncacaatggaaccatccctcgattccccgccccttgaacggattacatncccccccctccttcaaaggcgacgcaaaaatcttcaccaacgcccccggaattcttccaggg

SEQ ID NO: 9794 - DNA, 276 bp, A.fumigatus
ctcgtacaggaatggatgccctcgacaccaatgcatgtggccctgtataacgccttcaactggacacctccgcgcttcggtcatgttcccctcctcgtagacaagtccggccagaagctcagcaaacgaaacgcagacatcgatctcagcttcttcaaggataagcaaggcgtgttcgcagccacgctgattaatttcgccgctcttctgggctggtcgcacacccagaagtccgatgtcttcagccttgacgaactggaactactcgtaggttga

SEQ ID NO: 9795 - DNA, 276 bp, A.fumigatus
tggacaaggtttgaggcacaagtggctccttttcatgaacaccctagactgatttggactacaggattcaagcaaatcttgacgcgaatgggacagttcctgacgccatccaccgtgacctgttcgacctgcaatggccagggcgagtttttcagtcccaaggacaaatgtaagaagtgcaaaggcaacaaaaccgtggaggagaagaaaatgctggagatctacattccacggggagcagtcttcaccacggggctggaaggagccgtgcaaagg

SEQ ID NO: 9796 - DNA, 489 bp, A.fumigatus
caggctgcgctcgcaagtcaccccgataaggtccccgaggccgaacgagaagccgcggaggtacgattcaaagccgtccaagaagcctacgatatcctttacgatgaagataaaagacacctttacgatacccatggcatgtctgctttcaatggctctggcgagcccggcatggcaggaggaccggatctggacgatattctagcgcagatgttcgggatgggtggtgggatgcccggcatgggcggcatgcctggcggacggcctcccaagcctcgacggagcccggacgagaatacaaagtacgaggtgcggttagaggacctatacaagggcaagacggtcaagtttgctagcacgaagaatgtcatttgcagtctgtgtcagggtaaaggtggcaaggaaagagcgacggctaagaagtgctcgacgtgtgatggacaaggtttgaggcacaagtggctccttttcatgaacaccctagactga

SEQ ID NO: 9797 - DNA, 306 bp, A.fumigatus
  unsure (55),(58),(83): Identity of nucleotide sequences at the above locations are unknown.
gaggagcatcaattatgcactcttgagagacttacggatgtgattcgtttcgctntantgatacctgccagtttttcgcttcngtcccggggactttccaattgcgagctgggtctgaccggctgctatcctcttatatacttgcttcaaatccctattaccattgtgtctatctccccaatactcgattccagttggtacaagttcaaagaccctagagacggttcaggtttgcagcctgaaatatacctttacgacgtcaatccacccacaatcgctactagaattattagaagctgtaagtga

SEQ ID NO: 9798 - DNA, 816 bp, A.fumigatus
aacagaggtgctaacaatagatcccaggactactccctccgtgccaaagactacaatgccaaaaaggccaaactcaagcgcctccaggaactcgccgccaaccgcaacccagatgaattcgctttcgggatgatgtccgcgcactcgcagaagaaaggcaaacatggctctgcggcgcgcgactcggccgcaaagcggggactgagccatgaagcgatcaagttgctcaagacgcaggatgcggcgtacctgcggacgacgggggagcggctacggcgggagatcgagaaggtggagcaggaggtgaggttacaggaggggattcaggaggctcttggggagaagaagaaggatgagagcgaatccgacatagaggaggatgatgacgactttgatttcgatttcgggccaaaggagaagcgcgggcagaagaaggcgaggaagttgatctttgcggatgatcggcgggagcagcgcgcgttgaagaaacggaaacttcacgaagatcaagatgaggaggaggacgaggacgaagaacagtcgtttggtgaattgcagaagaagcagctacagaaaaagtcgcagaagcaacttgaggcggagaggctggctctcgtcgaggctcgtcgagtccgcaagatgaagaagagagctgctgaggcccgggagaacaagctcaaagcgcttcggaagcagtacgccgatatcactgccgccgagcgcgagctggactggcagcgagggcggatggataattcggttggggggacgaacaaggatggcatcaagtggaagatccgcgagcgcaagaagtga

SEQ ID NO: 9799 - DNA, 579 bp, A.fumigatus
agatcctcggacaatgtccatccggggcagggcccgggcctgggcatcgacctcgtcctcgatggcctgcagttggctctcgttcaagtcgatggcgatcaggatcacctgcgagtcaacgccgtgctcagcctggctcagcagatccgaagccacgaaggccgggttggcgtccttgtcggcgatgaccaacacctcactaggtccggcgggcatatcgatgctgacaccggccgaggtgtcgttggaaaccagcatcttggctgccgtcacgaactggttaccggggcccaagatcttgtccaccttgctgatactctccgttccgtaagccatggcggccacggcctgcgcaccaccggcgaggacaatgctctcggctcccactttgtgggcgacgtagacaatctcgggggagatgctgccatcggcccgaggaggagaagccaagacaatcttctggcagccggcaaccatggcggggacaccgagcatcatggcggtggacggcagcacggctgtgccaccggggacgtacagaccaacacgctcaatagggcgagaaaagcgcgagcaaac

SEQ ID NO: 9800 - DNA, 417 bp, A.fumigatus
agaatcagatgctccggcgcatattcattgctgagcgccatcgcctcatcaatgtcacgcaccacgaaggtgaccgagtgtgctagagatcctcggacaatgtccatccggggcagggcccgggcctgggcatcgacctcgtcctcgatggcctgcagttggctctcgttcaagtcgatggcgatcaggatcacctgcgagtcaacgccgtgctcagcctggctcagcagatccgaagccacgaaggccgggttggcgtccttgtcggcgatgaccaacacctcactaggtccggcgggcatatcgatgctgacaccggccgaggtgtcgttggaaaccagcatcttggctgccgtcacgaactggttaccggggcccaagatcttgtccaccttgctgatactctccgttccgtaa

SEQ ID NO: 9801 - DNA, 339 bp, A.fumigatus
tggagaaggtcgtcaacgccggcagcgtcttcatcggacagtggacccctgagagtgttggtgattactctgcgggtgtcaaccactctttgcgtaagttttcgtctttcccgtgcaggaatcaagctaacaacaacagcaacctacggctacgccaagcagtactctggagtcaacctgggctcgttcctcaagcacatcaccagctcgaacttgacggcagagggattgctgggattgtctcgcacggtggagcagttggctgccgttgagggattggacgcgcacaagcgggccgtgagcatccgagtcgcggcgatgaagaagaaccaggcgtga

SEQ ID NO: 9802 - DNA, 450 bp, A.fumigatus
gcttgttctcccgggcctcagcagctctcttcttcatcttgcggactcgacgagcctcgacgagagccagcctctccgcctcaagttgcttctgcgactttttctgtagctgcttcttctgcaattcaccaaacgactgttcttcgtcctcgtcctcctcctcatcttgatcttcgtgaagtttccgtttcttcaacgcgcgctgctcccgccgatcatccgcaaagatcaacttcctcgccttcttctgcccgcgcttctcctttggcccgaaatcgaaatcaaagtcgtcatcatcctcctctatgtcggattcgctctcatccttcttcttctccccaagagcctcctgaatcccctcctgtaacctcacctcctgctccaccttctcgatctcccgccgtagccgctcccccgtcgtccgcaggtacgccgcatcctgcgtcttga

SEQ ID NO: 9803 - DNA, 963 bp, A.fumigatus
gtttgctcgcgcttttctcgccctattgagcgtgttggtctgtacgtccccggtggcacagccgtgctgccgtccaccgccatgatgctcggtgtccccgccatggttgccggctgccagaagattgtcttggcttctcctcctcgggccgatggcagcatctcccccgagattgtctacgtcgcccacaaagtgggagccgagagcattgtcctcgccggtggtgcgcaggccgtggccgccatggcttacggaacggagagtatcagcaaggtggacaagatcttgggccccggtaaccagttcgtgacggcagccaagatgctggtttccaacgacacctcggccggtgtcagcatcgatatgcccgccggacctagtgaggtgttggtcatcgccgacaaggacgccaacccggccttcgtggcttcggatctgctgagccaggctgagcacggcgttgactcgcaggtgatcctgatcgccatcgacttgaacgagagccaactgcaggccatcgaggacgaggtcgatgcccaggcccgggccctgccccggatggacattgtccgaggatctctagcacactcggtcaccttcgtggtgcgtgacattgatgaggcgatggcgctcagcaatgaatatgcgccggagcatctgattcttcaggtgaagaacgcggagtcggtagtggagaaggtcgtcaacgccggcagcgtcttcatcggacagtggacccctgagagtgttggtgattactctgcgggtgtcaaccactctttgcgtaagttttcgtctttcccgtgcaggaatcaagctaacaacaacagcaacctacggctacgccaagcagtactctggagtcaacctgggctcgttcctcaagcacatcaccagctcgaacttgacggcagagggattgctgggattgtctcgcacggtggagcagttggctgccgttga

SEQ ID NO: 9804 - DNA, 945 bp, A.fumigatus
caagccatccatcagtatggcctcatttgcgtgcgtcttccgagttcgtatcaagtttggagactcctaacgaccaacaggagcaataccttctcccaccaattatatgcggctttccggccaacatactcaaagcagctctactccgccgtgctcgcatatcatcaaggtccatcatggacagcccttgacttgggaacaggccatggtctagtcgctcgcgaactcagtccacatttccagcgagtcctcgccagcgatccatccgcggggatgatccatgaggcacggcagttatccacaggtttccccaacatgactttctaccaagcaagagcagaagagtgtccttttgctgcagatgcgcaagtagacctcgtaaccgctgcgcagagcgcgcactggttcgactatgccaagttgtggccagaaatgagaagaattgtccgatccggaggcacgcttgctttctggggctacaaggaccatgtgctcgtgtcttaccccagagcaactagtatcatcaacgagtatgcatatgggcaggatccatggctgctgggaagctactggcaacagccaggtcggagcatagtgcagcagaaactgcgagcggtccagccgccagtcgaggactgggaggatgtctctcgtgatgagtatgagcctggagtagagggggggacacggttcatgcatgcgagaatgactttggggtccatggaagaatatgtcagaacatggagctcgtttcacgcttggcagaggaaatggccggataggatccggcgggctcctgggaatacggatcaacgtggtgatgttattgatgaaatgatggacaagattcgggagactgaaccgtcgttccagcgagatgactggaaggatgtagaggtggatgttgaatgggggagtgcgttgattttggcgcggagaaggtag

SEQ ID NO: 9805 - DNA, 333 bp, A.fumigatus
  unsure (301): Identity of nucleotide sequences at the above locations are unknown.
gcacttcacaaactactcagcgtcatcttccaaatgactcggacggcatctgtgccaattaatcatatcacaatccgtacacaccaacctgcagacatagagtggatcatctcccgccatgggaccctctacgctgaggaatacaacttcaacgacaagttcgtcgccctggtgtcgaagatcgcatctgactttcagcaaaaccatgatcctacctctgagcgctgttggatcgcagagcgcactggcaagaccaccaatgagccagtggtttgtataatgcgactcaaggacgttgatnttatagcgaccgctagcagatttagctgtgtt

SEQ ID NO: 9806 - DNA, 183 bp, A.fumigatus
gaagataataaagggtggaataaagtagccatctacactaattacttccataatagttatatattcttaattagtattactaggagagaaagaaggcttcttaaactctctagtaactatctattaatctttactaattctaatctagaagcctgtcttattaaagttgtagaggtcttatag

SEQ ID NO: 9807 - DNA, 234 bp, A.fumigatus
cgtaaagctatgaatacggagttactccgtaccttgcctcttctaaagtacctgacatttccactgaaggctttagatacatctatccctttttctgtaccatcagaagctcaacgtcgcacatttattctctccgccttagccacgacttattcccaactgaaatatggtaccctaccatggcctacctcgagcattccttctgattatctgtatctggctgctttaaaatga

SEQ ID NO: 9808 - DNA, 225 bp, A.fumigatus
tataacagggctctaataaatacaaagctttctacagagcaagaggcggctcttataaagtatattaatatacttattaagctagatattcctctgtggccaaaggtaatcagtaatgtagtaaatttaatatttttttatagatatactaatctaataacccccccccctttaattagcgtgtattggatgaaatacttccttaaatactatctagaatattaa

SEQ ID NO: 9809 - DNA, 939 bp, A.fumigatus
ctagccgacatgctgggtaggcatgaatgcactattagcgagtcagtcagcgctcttgatcctacggctcaagagcctgaatacacccttgtaccctcaacatcaagggaccttgttcgagacatgacactaaacatggaagacgcccaagctcatctaaaagagcatggctgggtcaagatccctgccgttctctccaaagctgaagctgaggatgcactcagccgtctctgggaggcgaaagctgcctcggaggctcgtggcgagtgcactttccagccgatcttggatcccaacccggcgaacgtgcgcgtcttctatctccccgagttggacgcatactggcgcgacatgctggtcaacccgaccgcactagacctggccaagtccctcctgggcgaccagctgctggtcagcaacttctcggccaacattgctcgtcctggcgcggagagcatggccctgcactcggaccagagcatcgttcttccagcgccgtggttggatgtctgggcagtcaacgtgatctggtgcctgacgaggatgaccaaggagaacggtgcgaccttgtatatccccggttcgaacaagtggaccacctgggaggacgtgcccgataacgcaccggatctgctggtcccgtttgaagcggatgcgggcgacattgtcgttattgacgggcgcctgtggcacacctctggttccaacgtgactgaggatgaagatcgagccattctgtttgcctattattcggcgcctcacatgcgacccctgacaaactggtctgcaaagctgccaaaggagcttcaagagacacttagtccgcagttgaaggaactgctcgcactcagccatattggatacgtcgtcaagggcgatctgacgtatatggctcagaaatacccttccgaaaagggtacaactgcggtgagcgcttga

SEQ ID NO: 9810 - DNA, 408 bp, A.fumigatus
ggatgcactcagccgtctctgggaggcgaaagctgcctcggaggctcgtggcgagtgcactttccagccgatcttggatcccaacccggcgaacgtgcgcgtcttctatctccccgagttggacgcatactggcgcgacatgctggtcaacccgaccgcactagacctggccaagtccctcctgggcgaccagctgctggtcagcaacttctcggccaacattgctcgtcctggcgcggagagcatggccctgcactcggaccagagcatcgttcttccagcgccgtggttggatgtctgggcagtcaacgtgatctggtgcctgacgaggatgaccaaggagaacggtgcgaccttgtatatccccggttcgaacaagtggaccacctgggaggacgtgcccgataa

SEQ ID NO: 9811 - DNA, 186 bp, A.fumigatus
ttcggtggacttggtgaccttcagacctcgacctgcataactacagtgaggcctgaggccaaagatcgattctacaataacacgctagaaaagtcacctcaagcagctcctacggatatatccatgggcgaaccgattttaactattccagatcccaacagtgactattacttcaatctgccctag

SEQ ID NO: 9812 - DNA, 984 bp, A.fumigatus
tcagaagcagtacaagagtcctttcatctagcctttatctacaacacaatggcaccagttgcgatgagctccgaacctgcggtgttcaacaccaagcgtgatggacatgctctcgaggacctgtccgacgctatcgacactgtcaacctcctcaagaacgagatgaaaaaagaacgcggattgtatgacgaatcggagttcgataagaacaaggacaagactcaattccgacagtacgaggatgcttgcgaccgcgtgaagaacttctatcgcgaacaacacacaaagcaaacagttgcatacaatctcaaggctcgcaatgacttccactcgaagactcgcgctgagatgtccatctgggaagctatggagaagctgaacactctcatcgacgagtctgatcctgacaccagcctctcgcagatcgagcacctgctacaatccgccgaggccatccgtcgcgatggaaagcccagatggatgcagctgaccggtctcatccacgacctcgggaagctcctctatttcttcgacgcgcaggggcagtgggatgtggtcggagacactttcccagtgggctgcgcattcgacgatcgcatcatctacggaaaagagtctttcaaagagaaccccgactacgagcatgagatctacggcaccaagtacggaatctacacccctgggtgcggtcttgacaacatgatgctctcctggggtcacgacgagtacctctaccacgtggtcaaggaccagtccaccctccccgatgaagcccttgccatgatccgttaccactccttctacccatggcaccaggctggcgcctatcacgagttcatgaacgagaaggatcagaagatgcttcaagccgtcaaggcattcaacccctacgatctgtacagcaagagcgacgatgtcccgtcagttgaagaattgaaggtgagcttcccatcctcccattccacacgcagagtcataagctaa

SEQ ID NO: 9813 - DNA, 324 bp, A.fumigatus
cctttcaaccaccctgatccgagcgaaattgcttttggttacgcccgccgatcttgtgcggctcggtactttgcggacgccagtgtctacatcaccgtggtccagctgctggctgttttcaacgtccgcaaggctcgagatgaccaaggcaacgagatccccgtcactctccaggcgatcccgggcatggtcaatcgccctgctcccttccagttcaaggtcgagcctcgcagtcagcaccacatcgatcttctgcgccgcatcgagtcggagcagatacccgaggtcagccatgcaagccttctcaaaccgagtacagtctag

SEQ ID NO: 9814 - DNA, 1593 bp, A.fumigatus
gttcagtcgggccaggtctttgcttgtgtctttcatctggccattcatccagtagtggacgcgattctcggcatggatcacccgtatctccaggacgaagttctccgtcagagtctgcaaaacccagacgaattctggtcacgccaggccgagcgccttcactggcatagaaaacctgacacggcactccggacaacccagaagagtctgccagatggcaccgcgcacccgatgtgggaatggttccccggcggagaaatctcgacgtgctacaattgcgtagacaggcacgtcgcggcaggaaacggacatgaatcggccatctactacaacagcccggtcacgaatacaaaggagaccatcacgtatcacaccctcctcagggaggtcgagacgctggccggggtcctgagagaggcaggggtcaagaagggtgatgtggtcatgttgtacatgcccatgatcccggctgcgctgattggcatgcttgccgtcaatcgtctgggagctgttcactcggtcgtgttcggcggctttgcgcccaacgctctcgcccagcgagtcgaggcgtgcaaaccggatgtgctgctcactgcatcgtgcgggatcgtggggaataggcccccgattgcgtaccaagcacttgtcgaagaagcaatcaagctttcctatcacaagcctgcacacacaatagtctggcagcgcgaccaattacagtgggacttccaggagtctgcaccgacgtggtggaggaccgtatggcagtggatacaacgcgtcctcttccgtcgcaggataagaactgccaaacaatcatcgtggcagcaactcgtggccagcgccagggcacggggactcaaagccgactgcgtgcccgtgccgagcgatcaaccgatctatatcatgcatacctcgggcacgacgggagcgcccaagggagtcctgcgcagttcaggtggtcacgcggttggcctacaattcaccatccagtacatcttcaacatccacggcccgagagacgtcatgttcgcggcgtcggatatcgggtgggttgtcggtcactcttatatcctctatgcgccgttgctggcgggggcggccaccgttttgtacgaaggcaagccggtaggaacgccggatgcgtctgcgttttggaaagtggtggaggaataccaggtgaacaccatgttcgcgacgccaacagcgctgagggcgatcaagcaagaggacccgagtaataccaagctggccgagattggagcgcgggggggcttgcgatccctgcaagcactgttcctcgctggcgaacggtcagagccaaccttggtctccatgtaccaggagctactggatcagcacggcggaaggaatgctcaggtcatcgataactggtggtcaaccgaggccgggtcccccatcaccggccgcgcgatggcgcctcatttcgggttgacaaccgagctgtcacggagcttcgacattcccattcctccaatcaagccaggaagtgcgggaaagcccatgccaggattcgatgttcgggtcgtggacgagcacggcgaagagtcttcaccacgcggcggagatcaacga

SEQ ID NO: 9815 - DNA, 573 bp, A.fumigatus
ttggtcgcgctgccagactattgtgtgtgcaggcttgtgataggaaagcttgattgcttcttcgacaagtgcttggtacgcaatcgggggcctattccccacgatcccgcacgatgcagtgagcagcacatccggtttgcacgcctcgactcgctgggcgagagcgttgggcgcaaagccgccgaacacgaccgagtgaacagctcccagacgattgacggcaagcatgccaatcagcgcagccgggatcatgggcatgtacaacatgaccacatcacccttcttgacccctgcctctctcaggaccccggccagcgtctcgacctccctgaggagggtgtgatacgtgatggtctcctttgtattcgtgaccgggctgttgtagtagatggccgattcatgtccgtttcctgccgcgacgtgcctgtctacgcaattgtagcacgtcgagatttctccgccggggaaccattcccacatcgggtgcgcggtgccatctggcagactcttctgggttgtccggagtgccgtgtcaggttttctatgccagtgaaggcgctcggcctggcgtga

SEQ ID NO: 9816 - DNA, 279 bp, A.fumigatus
tccagtagctcctggtacatggagaccaaggttggctctgaccgttcgccagcgaggaacagtgcttgcagggatcgcaagcccccccgcgctccaatctcggccagcttggtattactcgggtcctcttgcttgatcgccctcagcgctgttggcgtcgcgaacatggtgttcacctggtattcctccaccactttccaaaacgcagacgcatccggcgttcctaccggcttgccttcgtacaaaacggtggccgcccccgccagcaacggcgcatag

SEQ ID NO: 9817 - DNA, 1833 bp, A.fumigatus
aaccgaaggcaagccaaaaggttggagcaccaaatgcggaatggggcaaatattcaagatgcgtctgaaaatatcgagcaggcacggcctgacaagcctgcgcaagaaccgaccacggttgtttctcaacggaaagagcccgaggcgcaggtgacagcaccggagtcggaagagcccaaagacaatggaaaagcaaagcgatcaccgaaagaggaacagcaagagcaacaaccagatgttcagaccgagcaacgtaagcccgagcctccagcggaaggatcgatgactgatgcaaaggcggcggaacaagcggcggagtcattacagcagacacagcctgaggtttctagcaaggaatctgaagccattcaggttgcagaagcgggaattggcagtgaaggcagtgcgccttcacgcgcgccatcacagcctgaagctgagcaccctgtcgaaccggtcgagcaggctcccggaagcgcagaagcggtgcacggacaggactctaaagaacttccggattctgttgggaaggctgcgactcaagtatctgcagagactaccgggctgtcaacgcccctccccgtggaggagatgatcgaagacacccggaagcggaagcggcgcagtcaaactcccatcccaacaccggaggcggttgcaagcaaaagggccaaggcacaggaggagtcgcccagagttctactacctgaagatcgtgatattatggatgtggaagggagtcctggaaagaaggcggtcgccgtcccggcagagaacgaacaggcccaaaaccaaaatggagatgaccgaaatgatgcaattcgccgtgtatcaataagtgatgatgtgcggacaaggggaactgcgtctatcaagcaagatgctcgtttcaaggatctttttgcaccagcggacagagagcagattcggccccgttcacctccagcagatacgaacatggaagatgccgaggtcgaacccgcgctacatgtcgcaaccgaagcgttatatatcgatggactgatgcgccctcttcaacctgctgcactcaaaaaccatcttgtcagcatcgcaacggcccctggcgcatcacccgatcctgacgtgatcgttgatttttacttggatcccatcaaaacgcactgttttgtaaagttcgcgaatatatcggctgcctctagagcgcggaccgccttgcacggtgttgtctggcccaacgaaagcaacagaaaagctttgtttgttgatttcatcccccagcaaaaactgcagcaatgggttgcaagggaggaagaatcgcgcgggcgcggtggtcccccgcctcgttgggaagtccgctatgatcggaccgacgatggtgtcgaggctgttctgcaggaagtggatctcaagagtaccgcttcgcgtcaggctcccggtcgagcgtcgactgacttctctcgtccccctcccttgggccccagagcaagcatgggtgttaaggacagacgtcctagcggccctccaccccttgagccccgtcctagaccagggcaaggattcaaagcgctggatgatctctttgaatccactacaacgaaaccgaagctgtactacctccgtgtccctcgcgaagtggccgaccgacgtctagatcggttcgatgacctgctgcggaagggatcatttccgcgtcgtgggggcgatgagaataggcgaatcacatttgaagacggtgacttcttcgttgacaacggaccggaatatggccgtggccacggacggcgccgtggccggggtcgtggaggcggcatgggcgactcatggagagatgacagacgaggccgtgactaa

SEQ ID NO: 9818 - DNA, 285 bp, A.fumigatus
ggtaaggtcggactatctcctggtctggcacgtgtagttcctgactttctcaagcttggattctccaatcttcctgagaagaagcccgaaggggaagccctcaatgacgagcagacattgaaggatctgcatcggttgctactcgagacgcatgttattgagggaaagttggtgtgcgggaattgcggtcatgaatatttgatcaaagagggaattgcgaatttccttctgccaagtcacttgggtttgggattacctgaccgcatctatatagtcgcttgctaa

SEQ ID NO: 9819 - DNA, 303 bp, A.fumigatus
agatatgcgattgtatgccttatcttatcgcacttactcaaatttcacttcagcatcatattactctgtgatctagacacaatgaagttagtgacagcgaattttctaacttgcgccgtcaaggggtgtaagacatcatcagcgtcatttcctctccactttcaagacgctgagcttgaactcgaggagcttgacttccaaccggaattcatacgcaatattattcctcgcgttgactgggatggactgcgggtgactgcgaatgaggtaaggtcggactatctcctggtctggcacgtgtag

SEQ ID NO: 9820 - DNA, 504 bp, A.fumigatus
aactcggaaggctttgtttttgcactagataaagagtgcaacgtccaagtcaactgcgaggtatctcgggggaccttaattaaggaaccctttgcaacctgtcgagccgcagaggcagggaattctgtcgtcactgtcccattcccgttcgaatttgtagtcgtaggtcagctcttcatctgcatatatgttagcttatgtccggatgtagagtcagttggcttgtctgtcagaattacctcttccaatgtccctgagagcatatataacaattcttttgctaccatcaaccttgatgatctttgcagtgcaattaggagtacagctatggttgatgaagcgagcgatacctcctctcttggtggcatctataacagtgttctcgtcgattcggaaaaggtagctgctacctatcccgctcttcaagtactgcctctcccgcatgtctgccacttgctgtcgcaccttttcaccaacgtactctatgatcatatcattcgctga

SEQ ID NO: 9821 - DNA, 213 bp, A.fumigatus
atttccaaccttggatctcgactgcccgtccagaacatggcgaaggaagcagagatcctcctcatctttgacgagattctgccagccgtccaaatccaagattatggtttcatcatcaacaactgtcggacgaggttcatcattagacaccccccattcgatctccgtaatcgggtcttcatggctctttgtagtagtggattcgtcaggtaa

SEQ ID NO: 9822 - DNA, 1212 bp, A.fumigatus
atcgcttctgtggagcctggagatatgttctacgaggagtctcagcactcagaatctgctgagcttggcactgtgaagccagaaaacctcgttggcatcgggggtaaatttcttgggcgagtggaagacaggtcaatcaatgaggatggtgagaaagagaatatggaacggctgcatatcgagtctgccatacaaggagcaaatctcggcattcagcagccattacctgacgaatccactactacaaagagccatgaagacccgattacggagatcgaatggggggtgtctaatgatgaacctcgtccgacagttgttgatgatgaaaccataatcttggatttggacggctggcagaatctcgtcaaagatgaggaggatctctgcttccttcgccatgttctggacgggcagtcgagatccaaggttggaaatctatcggcatgggcttggagacagaaagagatcaaagctctcaaccgtgccggtgagagtgggccggtccatcaagaaactagaataccagattactacgtttgcaaccccactggagctgctcggaccgaagggagaaagagaatcttggagtcggagaagtcgaaatacctgcctcaccgtatcaaagttcaaaaggctcgagaagaacgggaggccaacgcaaagagcgatcctcatgcttcttctgctgcagaagccgctaggatatccgcggcgaagacgatatctaaatctacttcgagatcgacaagggttaacaatcgcacgctggttgcagacatcaatgcgcaaaaacaggctctccctatgcaaggtggaggtggtgatgttctccgtttcaaccagttgaagaaacgaaagaagccagtacgctttgctcggtcagccattcacaatgggggtctgtacgcggaagagaacatatcagcgaatgatatgatcatagagtacgttggtgaaaaggtgcgacagcaagtggcagacatgcgggagaggcagtacttgaagagcgggataggtagcagctaccttttccgaatcgacgagaacactgttatagatgccaccaagagaggaggtatcgctcgcttcatcaaccatagctgtactcctaattgcactgcaaagatcatcaaggttgatggtagcaaaagaattgttatatatgctctcagggacattggaagaggtaattctgacagacaagccaactga

SEQ ID NO: 9823 - DNA, 252 bp, A.fumigatus
aatttgagtaagtgcgataagataaggcatacaatcgcatatcttcacaccctacgaaagtgggtaaccaactttatctccgctttcttatcttttattcctttcaaggttctttttcttatgtacatatatatccttagcttgtttcgtgttaattacaaaatacaagatggaaagaggcttttagcagagttcagccccactgtctacaccttctggaatattcaagaaatcgccagttctaatacttga

SEQ ID NO: 9824 - DNA, 405 bp, A.fumigatus
acgcattcgcggatccttccatgtctgtgtgtgaagagccatccacaagctcgtacggcaatctgttcagcagataatattaaaagtagcttttcagcaactagattaataccactaaatctagatcagatgctcagtcagcttaatatccagcttagaacacctacaccaccaggcagccgatcaactaattctgtcccaaaaacaccttacaatctcaagcagctaaagaagcaggaaactacacttaagaagctacttagagagcatacatacagccctcctacccctacaaaggctgtgctaggtcagattattaaggggtgtgagatggcaatgaataacactgcccttcttgcaaaggaaaatcatgatctacatgctgcatatgaaaagcacctttaa

SEQ ID NO: 9825 - DNA, 255 bp, A.fumigatus
ctggaacctccaaggtctcggacaaacgggtcgaagagatcgtctccaaagttctttccttcgctcgctccctcgtcctataacacccagcctgttcgcgtctcgctcgctttcggggcgaaacacaaggagctctggagcattatcatcaaggtcgcggaaccagtcctcacatccatgaaccccgatctctgggcacgatttggcccgatactcgaagctcataaggctgcctatggatcagtatgtcgatga

SEQ ID NO: 9826 - DNA, 321 bp, A.fumigatus
gtactcttctgggaatgtggcgagaccatcaaggagtcgagtgagaaacacaagcatgtcgcgcataagctgggcgagtggagtgatgtctctcaaggcatgcaccagatccttgtctggacagccctggggctcgagggagtcggcgccaacctgcagcacacgaattctattccgcccatcgaggccgctattaagaaatttgcgggtgtccctgaacattatacatggaaggcccacctgaactacggggacaaacaggctgatcacccggagaagcctgcgaaactgcccatgggcgagatactgatgattctctga

SEQ ID NO: 9827 - DNA, 258 bp, A.fumigatus
atatctgtttctcctctaggagccactatagggactgtgcgctttcttaccccactgccggggccatcgtcttttggcctccgacgtcgattctttgcaaaaatggcagtgttagagacgcagcctgctccgcaaaaagcgcccgagagcgcaactgcggagcctcggaagaagctattcggcagagagttttatgagagcttaggaagtcccaagtatattgtggcacctatggtcgacagatcggaatttgtatag

SEQ ID NO: 9828 - DNA, 786 bp, A.fumigatus
gaagtcccaagtatattgtggcacctatggtcgacagatcggaatttgtatagcccatgccactcctatcagcgcatccggactaaccattccatctcccaggcctggcgcatgctgactcgttcgttcatgccacccgatgacccgaaaccaatacttgcctactcccccatgtatcatgcgcgcttgtttcgagagcaagcgaatgttcgctggcaacatttccagcctacccgagccggtctcgacaagaatgacaattccctctaccttgacggcaacccggcttttgacagaccacttattgtacaattctgcgccaatgatcctgatgattttctagaagctgcccgacatgttgcgccctactgcgacgctgttgatctcaatcttggatgcccccaaggtattgcgcggaagggccattacggagcatttctccaagaggactgggacctgatctacaaactgatcaaccgactgcataaggagcttcccattccagttacagccaaattccgcatacaggagtcgaaagagaagacgctggagtatgcgaaaatgatattgtccgccggagctagcataatcacacttcatggacgcacaagggagcaaaagggtcacaacacaggcttggcagactggagctatattcgatatctgcgcgacaatttgccgccagagacggtcatcttcgcaaatgggaacaatctgaaccatgatgatctggaacgttgtcttgaggcaacaggcgcggacggtgtaatgagcgcggaagggtaa

SEQ ID NO: 9829 - DNA, 414 bp, A.fumigatus
  unsure (397): Identity of nucleotide sequences at the above locations are unknown.
tcaaccaccgaaccgccgataccaccgaaccgccgcttcgccgcgaatatcatcgaattcttggagccatctaatcaacacattatttctttaccactattattaaaaatgccactatccaaagagaatcgaatgcagatggccatatcagcatataaaaaggggcaattcaaatcaaaagcagccgctgctaaggtctttggggtgtctagagagacccttcgtgatcggcttcgcggaatcaaaccacgcgcagagacacgcgctaatagccataagttaacagctcttgaagaggaggcccttgctaagcgtctattagatgctgataggcgtggcttttcaattcgaccgcagttcctgcgtggaatggcacatattcctacttattgtttgnccaaccccggggggaaa

SEQ ID NO: 9830 - DNA, 1404 bp, A.fumigatus
cccccattagggtccgcggccgtagaaagaaagcccttgcacagaactctaaccattgcccaagccgtcaaggcaagaccaagcgggcccaagggcggccgtcctttgatgtcccgtgaggccagactcgactcgtctcaggccaggaacaataagagagtccgcctgtgggccgcaaggccatcgaagcgtcgcaaaacattgtctttgcttgagactcttccggtggagttgatcgagaagatcttcttgtactcgttgaatgtcaatctaccccgtgcatcgccctcgctggcggcggcggtgtcgagtgagcgcatctatcgcgtgttgatactgctcggtttctggaatgattccgcatcagaagctgaggatcctgactctgctatctcgaggatactgagaccgttggactatgctcctctgcaggatgatgaccgcgaaaatcttcagacgtccgtcctgcgctgccggtggtgcacgatgccccggttgctcatgcagttgtcggacatgacaaacctaactatccagagacattgggtcaacgctggtattgaaatgactagagaccaacaagaatccttagaccggttcctcgcacgagagaacgacacttctacatacgaaggtaccgacaaagacggcaaccactacactctatccatcactcccttcgtatcaataaacatcgcatgccaggaaaccgacgagcaacaaacccacaagatcctcagcattaaacactttccggagaagctcctccttggcgccagcggagagggcttcagcgacgaccacgcaacgcacctcgagatcatgcgagtcgcctgcgggctcagtcgctccgaccacctagagacagacgtctctgtctcccgcgaatccctacaccaaggcgtccacattgccctcgtggaacacaacacgagagcactcgccaccctcctcaaaatagacgagtacatcttccgcagcaacgcagccgtcgccggcggcttgccatatagcatcccacccgaacatttccgcacagctgtccgagtcgcacggaacgaccccgctctgttccaaacattgcttcgagccagcgcggaatctgtcccggcggatgatcccgatattactgagtgggcgatgaatctcggggacccgtttggccattggttgctggatttaatgttaaggcttccgcagcagatagagactgcgaatgcgaatccggcagagggtgcgctgttctatctggggagagcgaatgggcatattgagctggcgagacggtatttgcgggatgtattgaatgtggacgagctgccgagttggatggaggcgtccgatgacctgtttaggcaatggagggttatcacaactacgacaggaatatacatgttcgtatag

SEQ ID NO: 9831 - DNA, 582 bp, A.fumigatus
  unsure (29): Identity of nucleotide sequences at the above locations are unknown.
atctgcggcggcaagcgctacaatcatcntagacacccctacggccattacttcacgccgaccttcttcgccgacgtgacgccctccatgcgcattgcccagacggaactctttgcccccgtctttgtcctcatgcgcgcggaatcagtgtcccacgctattagcatcgcaaactcaacaatgtacgccctgggagcaagcgtattcgggtataatcagaaagatgtcgcggcgtgcgtatctcaaatcaaagcgggcatggtgtccgtgaacgactttgccagttactacgcggtgcagctgccgtttggcggcgtcaagggttccggatatggccggttcgccggagaagagggtctccggtccgtgagtaacatcaaggcagtttgtgtcgaccgcttccccaggctgatggctacgcggatacccccgagagtggactatccgattcagaagggtgacgatgataagcagaatgggactggagcttgggagctgtgcaagggtgtggttgagacggggtatcagctgacgttggctggcaggttaggggggatcctgcggctcttgaagaatatgtaa

SEQ ID NO: 9832 - DNA, 189 bp, A.fumigatus
atccagggcgtcttccggtccatcggcgcctgcctcatgggcatcgtcaataccatcggcgcggtccttaaagccatcatcaacggtgtcgtcagtctctgcaatatcgtcatttcatgcctcacttgtggctactgcggaaaccggggaaggatgaggtcttcgagacatcgacgatcaagggtctaa

SEQ ID NO: 9833 - DNA, 312 bp, A.fumigatus
aattacgtccttcgtagcacctttttctctccaggtttctattcgtacgcagcctgcccctttcatgatattcagttgtcgcattcctggaatatcccaacctcatacatcattctcagaccttggcgctattgtgacatcgtacctgccatatatagcctcactatccctctcgttcaacccttcacgatgcgtccattttctgatacctctgtccacaccactgcatcttccagtactttgtcaaacacagacaacgcttcctcctctaaaccacaaaccgtgatccacatcaaaacaaagatcctataa

SEQ ID NO: 9834 - DNA, 795 bp, A.fumigatus
gaaaacatcgtcatcgcgaccaaggtgtgggcgcccgtcggtcgcggcaaggagtatccccttttcctgtccaacgaggaacgcgacaatgccggctacgtgaacgagtacgggctcagtcggaagcatatcttcgatagtattgaggcgagcctgaagaggttggatctgccgtatgttgatctgctgcagatccaccggtttgatcccaacacgcctgtgaaggagacgatggaggcgttacatgatgtcgtcaagtcgggtaaggtgcggtatatcggggcgtcgtcgatgtgggcgcaccagctgctggagtatcagtatacggcgcgtatgaacggatggacggagttcatttccatgcagaatttccacaaccctatctaccgggaggaggagcgggagatgttccctgcgtgcgccaagttcgggatgggtgcgataccgtggagtccgcttgcgatgggtttcttgacccggccatggaaagcgtttgaggaaaccacgcgggggaaatcgctgaatggcaaactaatgggccaaccgtttaccgaaacggacaagaagatcagtgagacgatagaggatattgccaataaacgcggtgtgtcgatgaccatagtgagtcttgcctggtcgttatcgaagccattcatcaccgcgccgattgtgggtttgagcaagaaggagagagtcgatgaggcgattcaagcaatcgacttcaagctcaccgaggaggagatcaagagtattgacgatctgtatcaacctaagaaggtcataggccaccactag

SEQ ID NO: 9835 - DNA, 186 bp, A.fumigatus
atgctaacaccaccacctttttcaactactaaaactacctactattcgactacctcagcctctaccgatttcctggacaatttcttcttctttctctcatctattattctccagcggcaccttttctctccacatctcggcgcacattatagcgcgatattcactatctcccgcccgctcatctaa

SEQ ID NO: 9836 - DNA, 201 bp, A.fumigatus
ataactcttaggtccccactgttattcccaaagactggcaggatgatatttctcgccctctccgttcttatcccctcatttctgtctctccttgcgtttatcagtattagggaaaagggaagcctaaacagacagttgaccgattatgttgcgttctacctattaatcagaagtgaacaatattataatcaggattattag

SEQ ID NO: 9837 - DNA, 348 bp, A.fumigatus
atatctcatagccgctataaccacaatctgagctcaacagtctctcttcccataaatatgttcacagcccgtcgactccttaccagcgcccctcgcgccatctcccggagggcgctgtttcacagcactgcgccggccttcgtccaaaagggagacgccattccagacctcgatgtgctggtcgagagttcacctggaaacaaagtcaatcttgcaaaggagctcaagggaaaggggattatcatcggtgtccctgctgctttcagtacgtttgctgccccccgccttgaacccctacatctcctacgcatccaatccgacatgagatcgacaagagggaaaagataa

SEQ ID NO: 9838 - DNA, 561 bp, A.fumigatus
tgcgccactcgtggatccttccagccccgtggtgaagacaagattcttaagtcccccggggctcggaaaattcccatattcgtgaaggatatggaggagaccatcaacaccgcgactcagtttgtcagtcagcgcatttgccccatcttccaggtgtccaatgtcaccggtgaaaatctggagttggtacggacattcctgaacattcttcctcaccggggccaatacaacacagaagcaccctttgaatttctgatcaatgataccttctctgttcctcatgtcggaactgtggtgtctggagtggccaagtccggggtgatccacgctggcgattcggtgctcgtgggccctgattctctcggccagttcaccacgactacaatcaagtcgattgaacgcaagcggatccaagtgaatgcttgctttgcgggacagtctggctcgtttgctctcaagcgtgtgcgcagaaaggaagtccgtaagggaatggtggttctcaagaaattggagcagcctcccaaggtctaccgagaatttgtcgctgaaggtacgttctaa

SEQ ID NO: 9839 - DNA, 291 bp, A.fumigatus
cttgaaccagtgctcattctttcccacgctaccacaattaagccgaggtatcaagcaatgctacatgtgggcgcagtgagtcagacttgctcagtcattgacattgaccgccccttcatccgaaccggtgatcgagctcttgttgctttccggttcatccaacgtccggaattcttggcccctggcgatcgagtcctattccgagagggtaaaaccaagggcttggggattgtcaagagtgttggatacgacccggatcatcccctgaaccctgaagctaagaccaagtga

SEQ ID NO: 9840 - DNA, 1563 bp, A.fumigatus
ttttattcgaacagcttcggttcagcatggcgctccttttggcatacgatgacctcctatgatcgacatgcgtcccacgactcaccatatcggaccggaagacatgtacctttgagtcaaagccgccatgagcccctgacgtctattgcgacgagcgccattgagtctcgaccggatctgactgatacatttgaagatgaccaaccgaaagggtctacaaattccaactctaacgggtggacgggttcccctaccggagttggttctcctaaccgtccctattcccccggactgaggtcgctttcttcccagaagcggcgatcaactgaacgtggcgcagatggtgccccagagattcagatgcaaagctttcatgacggagctccgcctccgcccccggtggcccattcatggcgaaagatcgatcgatggctggaaaataattacgaagagctatacgataatctttgcgaggggtgcactcaaaacgatataaatgagttggagcatgaattggattgcagcctgccattggaggtgcgggagtcccttatgatccacgacggtcaggagcgccctggccttcccacaggcgttatcttcggatgtatgcttctggactgcgaggaaattgttcaagaatggaagaactggaggaccgtcaacgaagagtttctgagcaattccaccatgatgaatcctcccccgaaggccacagcaagctcatcctctgcggtacctcctctgcaaggcgcgaatcccctctggagacaagaacttctggaccgccaggactcacaacctccaggcgccgtacagaaggcatacgcacaccctgcctggatccctcttgctcgtgattggggtggcaacaacattgcgatcgacttggcccctggccctgccgggaaatggggtcaagtcatcattttcggtcgtgactacgactgcaaatacgttgtagctcgctcttgggctgctttccttgctgtgctcgcggatgatatctgcagtggtaaggtcagcgtagatgaggagacaaatgagcttaaattgttggaattcaagggtcagaatgttgagccgccttatttggagattctgcgttggagaacagaccagaaatatggcagaagagcccctcgacgcaaggcgccaaatggactgggactcaacacgaacagccgccccgggaaagaatccccgtatgggagcccaacacctagtgaagaacgtggccggtctcctcaccgatttcccaaccgcggttctactcagagccctaagacacagttcggcgtttcgagtcctctagctcgtgtcacagaagaagcgacaagccctgtgaatacaagcgctgaagttgagatgcccgaagatgctttcaaggagcatagaaaggagcccgaaacagatgatctgatggaggtagttacaccccaaatctctgggaaggaaaatcaggacctcacagacaagcatgacgagtggaagtcacccaaaccagaaaaagtgcagagacgtgagtctagccaagggacaaccgcagtctcggaaacctga

SEQ ID NO: 9841 - DNA, 420 bp, A.fumigatus
  unsure (22): Identity of nucleotide sequences at the above locations are unknown.
ccttcggccccgtctggagaanacgcaacacgggaccatgaggtgcgcttcgcgcgcgtcgatgtgcgcaatacccccttcgtggtgaacaagctgaacatacgagtccttccttgtgtaattgggtttaaggacggaattgttgtcgagcgtgtggtgggatttgaaggtcttggagctggggggcgggacggggctgacagttttgatatcgcgactctagaaaagcggctgctttggaaagggatcctcacccagacgaagttcaaaaataatgaggatgattctgatatatctgagggtggcagtggcgacgaaggttccaacaggagacggccatgtactgggcgacggactattcggagcggaaatggacgacaccatggaggcgatgatgacgatgacgacgactggggctga

SEQ ID NO: 9842 - DNA, 1437 bp, A.fumigatus
gctgctcattatccacttaaggattgtggtcagaccttacagcgtccatttactagcaccatgccccctccgaagctgtcctacgggctcaatttgcccagcaaaaaagctccaatctcgaaactcggaccgccaggttcccagaaacgcaagaagaccatcttcgattccgactctgaaggcgacaaccagaacgatgccggcgacggcggcggtgacggccccatcgagataaccacaattggcggtctcgaagaaccacccagaccgtccaccaacgagcgacaaactacagaaccgcctgcaaaacgaaaaccattggctggtcccccaaccggcaaacccaacatcaaacccctaagcaagaactccatctttgccgacggggaagagacccaagaaccacaggcaatgccgctgggcctcaaccccgcaaaaaacaaatccagcgcgccacccaccgccgagctcacaaacctttccgccctccgcagtagcaagaaacacgccgaggacgcccaacagcttgaccccaccatctactcctacgacgccatctacgacagcctgcataccgccaaatctgacaaagccaaagccgcttccgcggacgccaaaaacgacgggccgcggtacatgacctcgctattgcgcagtgcagagatccgcaagcgggaccagctgcgcgcgcgggacaggctgctcgccaaagagcgtgaggcagagggcgacgagttcgccgacaaggagaagttcgtgacgtccgcgtacaaggcgcagcaggaggagctgcggcggatcgagcaggaagaagcagagcgggaacggcaggaggaggagcggcggaagcagaacggcggggcggggatggtcgggttctaccgggacatgctatcgcgagacgagcagcggcacgaggaagtcgtcaaggctgcagaggaggccgcgcgacgggtgcaggcgggcgagatcccagccgacgaagccgccgcggaggcggaagcaagcaaggaaaagaccgaggcgcagatcgccgcggagctcaacgccaagggcgcgcacatcgccatcaacgacgagggcgaaatcgtcgacaagcggcagctgctgtccgcggggctgaacgtcgcgcccaagcccaagccgtccgcctcggcgagcgccgctgcggctgctgctcgtgcggctgccaacaagccgcgtctcgactcggggcaccacgcggcgcggacgaaccagcgcgcccgtcagacggagatgatcgcgcgacagctagaggagaaggcccgacaggaagccgaggccgaggccgcgcgacagcgggagatcgcggagcgcacgcgtactcgcaaaacggagacggatgtgctgagcgcgaaggagcgatatctggcgagaaagcgggagcgagaagaagcggccaagaaggggtcgtag

SEQ ID NO: 9843 - DNA, 279 bp, A.fumigatus
gcaagaactccatctttgccgacggggaagagacccaagaaccacaggcaatgccgctgggcctcaaccccgcaaaaaacaaatccagcgcgccacccaccgccgagctcacaaacctttccgccctccgcagtagcaagaaacacgccgaggacgcccaacagcttgaccccaccatctactcctacgacgccatctacgacagcctgcataccgccaaatctgacaaagccaaagccgcttccgcggacgccaaaaacgacgggccgcggtacatga

SEQ ID NO: 9844 - DNA, 789 bp, A.fumigatus
ggcagagggcgacgagttcgccgacaaggagaagttcgtgacgtccgcgtacaaggcgcagcaggaggagctgcggcggatcgagcaggaagaagcagagcgggaacggcaggaggaggagcggcggaagcagaacggcggggcggggatggtcgggttctaccgggacatgctatcgcgagacgagcagcggcacgaggaagtcgtcaaggctgcagaggaggccgcgcgacgggtgcaggcgggcgagatcccagccgacgaagccgccgcggaggcggaagcaagcaaggaaaagaccgaggcgcagatcgccgcggagctcaacgccaagggcgcgcacatcgccatcaacgacgagggcgaaatcgtcgacaagcggcagctgctgtccgcggggctgaacgtcgcgcccaagcccaagccgtccgcctcggcgagcgccgctgcggctgctgctcgtgcggctgccaacaagccgcgtctcgactcggggcaccacgcggcgcggacgaaccagcgcgcccgtcagacggagatgatcgcgcgacagctagaggagaaggcccgacaggaagccgaggccgaggccgcgcgacagcgggagatcgcggagcgcacgcgtactcgcaaaacggagacggatgtgctgagcgcgaaggagcgatatctggcgagaaagcgggagcgagaagaagcggccaagaaggggtcgtagccttgcttgtttatttctttgcatccgccttgaccaggtgtcttaaccgccggaaaggaaggaacagcgct

SEQ ID NO: 9845 - DNA, 243 bp, A.fumigatus
ttacctgtcccaaagatgtcgtattatttcactatcctctcccccaccgacgttcccctattcaatatcgccttcggcacctccaaaggcggcggagatggcatcgcccgattccgcttcccagacacagcgcaatacatgaaccaattcatcatccactcgagtctggacattgttgaggaggcccaatggatgaatggcaatatgtacggcccgccatattccaatcttaccgacatttga

SEQ ID NO: 9846 - DNA, 378 bp, A.fumigatus
acaagcaaggctacgaccccttcttggccgcttcttctcgctcccgctttctcgccagatatcgctccttcgcgctcagcacatccgtctccgttttgcgagtacgcgtgcgctccgcgatctcccgctgtcgcgcggcctcggcctcggcttcctgtcgggccttctcctctagctgtcgcgcgatcatctccgtctgacgggcgcgctggttcgtccgcgccgcgtggtgccccgagtcgagacgcggcttgttggcagccgcacgagcagcagccgcagcggcgctcgccgaggcggacggcttgggcttgggcgcgacgttcagccccgcggacagcagctgccgcttgtcgacgatttcgccctcgtcgttga

SEQ ID NO: 9847 - DNA, 456 bp, A.fumigatus
cgacttcctcgtgccgctgctcgtctcgcgatagcatgtcccggtagaacccgaccatccccgccccgccgttctgcttccgccgctcctcctcctgccgttcccgctctgcttcttcctgctcgatccgccgcagctcctcctgctgcgccttgtacgcggacgtcacgaacttctccttgtcggcgaactcgtcgccctctgcctcacgctctttggcgagcagcctgtcccgcgcgcgcagctggtcccgcttgcggatctctgcactgcgcaatagcgaggtcatgtaccgcggcccgtcgtttttggcgtccgcggaagcggctttggctttgtcagatttggcggtatgcaggctgtcgtagatggcgtcgtaggagtagatggtggggtcaagctgttgggcgtcctcggcgtgtttcttgctactgcggagggcggaaaggtttgtga

SEQ ID NO: 9848 - DNA, 255 bp, A.fumigatus
acccgtgtggagtatatggagaaaggtggtgacataggaagaagaggcgagcggaaaaagaatgaaatcccgtatacgctgtcgtacacgcaacaaacgtcgttgtgtctctggcgcggttggaagcgcctgcttgcggatccctcactaccatatatccagcttggaggcaataccatcgtgggtttgtcttgggaggtatcttcttcaatctgcacaatgacccaaacagcttgtacagccgaggagggttga

SEQ ID NO: 9849 - DNA, 195 bp, A.fumigatus
aactgtgaggcaaatgcagaggcgtgtacagtttattataaggccggtaatattcatcataattggagtttaacctttgtgtttagtagtgtaagcggcagcatgttcttacaatttcttgccattggtactccggaccattacagcagtttccttattggacgctgtcgaggtagtcatgggctgtctgtttag

SEQ ID NO: 9850 - DNA, 387 bp, A.fumigatus
gtgatcgtggacgttcaacctcctttctcgtgctatgtctatagaggttactatggcgcggccactggtaaggggagacaggccgcgaaagctgaacttgagaaattggacctagcctccgaaaagttgactttgctcgaggccgtcagagaagccgcccgtatcatatacgtggcccacgaagatagcaaggacaaggagtttgagttggagatgtcttggattagctcattagacggtccgaccaaagggaagcatgaagcggtacctagggaacttcttgaagaggccgaaaaggctgcgaagagagctttggagggggaagatgaggacgaggaagagacaacaaagaatgatggcaatggaggcgagcgaatggaggaatag

SEQ ID NO: 9851 - DNA, 249 bp, A.fumigatus
gtaccatggggatatggtgacttattcaacggtgaccgattttgccagattgcgtgggaaatcaacgttgagtccctctccaacagcaagccaataagcaataagctgcagcggaataacgttgagaagtccctgaaggcagtcaacggtctttgggacctcaatcttttcggtctgggcggaagagaactctgggtcgtcatggttgcaaatcacaatgggacgaccaccgcgagcaatcactggtga

SEQ ID NO: 9852 - DNA, 291 bp, A.fumigatus
ggacccatcccgatctccgccctggccaatcgtcttggcagttatgtccaagcttacactctctattccagtgtacgaccatttggggttacagctattgtcggaggttgggattctgataccgaacttgctgttgatggtcaagtaggaaccggaccggctgcgggttccggcggtaagacttcacatgccaaggttggtgggccgggtctttatatgatcgagcccagtgggttgtactgggtaagtgatcgtggacgttcaacctcctttctcgtgctatgtctatag

SEQ ID NO: 9853 - DNA, 366 bp, A.fumigatus
aggtatttgcctttgctaattgccgtgagactaaacaatttttccttctacccagtctcttctcttcaaaccaagttccacggcggctttaccccaatcctcaccatgattgtgcattcccttcttgccaagaccagctctttccaggccttgttcttccgtcagaacagtgagcactccgaaaattactggcacgccagtatcaagttgaacacgcatcaaaccatgagacaccgcatccgcaatgtactcaaaatgcattgtctctcccttgatgagaacaccgatagcaatgatggcgtcaaaaggcttagctgcagtcgaagttggcgatgtcttactcaggtctgcagtagaggacgataa

SEQ ID NO: 9854 - DNA, 270 bp, A.fumigatus
ctatctctccctcctgccttcattttacatacctctaaccattcaccagtgattgctcgcggtggtcgtcccattgtgatttgcaaccatgacgacccagagttctcttccgcccagaccgaaaagattgaggtcccaaagaccgttgactgccttcagggacttctcaacgttattccgctgcagcttattgcttattggcttgctgttggagagggactcaacgttgatttcccacgcaatctggcaaaatcggtcaccgttgaataa

SEQ ID NO: 9855 - DNA, 426 bp, A.fumigatus
tccgagatctttaccaggatatacacggcctcgcagctccaagctgccaaaggatcatcatccgcaggagggatcagtgcgacggatttattatcgtcctctactgcagacctgagtaagacatcgccaacttcgactgcagctaagccttttgacgccatcattgctatcggtgttctcatcaagggagagacaatgcattttgagtacattgcggatgcggtgtctcatggtttgatgcgtgttcaacttgatactggcgtgccagtaattttcggagtgctcactgttctgacggaagaacaaggcctggaaagagctggtcttggcaagaagggaatgcacaatcatggtgaggattggggtaaagccgccgtggaacttggtttgaagagaagagactgggtagaaggaaaaattgtttag

SEQ ID NO: 9856 - DNA, 255 bp, A.fumigatus
agtcttaccgccggaacccgcagccggtccggttcctacttgaccatcaacagcaagttcggtatcagaatcccaacctccgacaatagctgtaaccccaaatggtcgtacactggaatagagagtgtaagcttggacataactgccaagacgattggccagggcggagatcgggatgggtccttagaatacgcttctccacgaggaagcttcgtctctagctcgcgacacgaagtgacgaccgtctgggactaa

SEQ ID NO: 9857 - DNA, 204 bp, A.fumigatus
cgcgtttgcttatgcttcatctccctctctaaaggctctggacttcgcgttgccatagttcatgccaggtggaacatggcaataatccagcctctcgtggaaggggcaaagaaaagccttttggcggccggagtacttgaagaggatatcacccttgagacagtgcccggcagttacgaattaccctttgctgctcagcggtaa

SEQ ID NO: 9858 - DNA, 1482 bp, A.fumigatus
acgcccaagaagacaagagtattaccttttcgcgatggattcgacgatgatgaaatcatggcgatttcgccgagcaagtccgcaaaatcaaagcggacaacccccacggggcctggaaagaagaaaaggaagctcgattctggcagtcccacacctctgccactatgtcagccagccgagcttgtacctgagccgcctgaggacttattcgacgaggagatgatggatgatgtgatggttgacgagccagtcccccgcagagaggaccggaatgcagaactcatgaaatccattctcaaccacaaaacatatcccaacgaggaatgcgatatagaggtattatcgcaaatggcgtttccctcagaaccgcgacggaagctgtctacgattgtcctggaggaaacagcaaggttgcactcgggcaactatgtggtggaatatgcgcaagtcatcgcatcgctatggtcccgggccctaaaggagaagttcttcaagccggtgccgatgttcatggagattacccaccacctgttagcattggatgcaccgtcgtgcgtcccagacatgatcgaccatcttgtgccagtgctacaagagtcgggagatatcaacgggattcctcgtttcagaaactcgcccgtgtcgcgtcagaacctcggccaggtacggcagacgccgctgtcccaacttgaagtccttgtggattcgaccgaagcgctaagcctgttgtaccgcatggcgtatctctgtatacacatggagcgcacgatggagaggttctggcggcacatgcgctacgactttgtcttgatgatgctgaattgctcacaacccattcgagacatcaccttaatgctgaatctgctttcaacgagcatccgagcggagtcctttggatcggtccaggagacccagcaagatcagcttgccaacgagaattacattgtagaccgtgtggccaacctcttgagtgagacaccacagccggatgaagggcagcctccctatactgcggcggacatctgcagcatgcgcttgcaggcaatgtattttctcacctcggtagcttttaatccagttgcaccggccagtgagcacggaagctccgtcattgcacagcacccaacggtgcttgcgcggatgatacgagccatgcatgacgaactggatgcactctacacgtatccgcccgagcgagatctccacgcgaccatggtcaacggcctcatgcgcttagtctacggagtaatccgtcgtcacaagaacgtggacctgcaatcgaagttatgtcgagtcgctggtgggaagcaaaagtttctagtggtgctgacacggttggcgttcagcgaaggaccgatactcgagggcggcatcgatgacgagacggtggagatggcccatgagatcctcgatgatgccgtcacccctcaggaagcagaagcgctcttagaggcattcccgagtgcaaagcgagacgattga

SEQ ID NO: 9859 - DNA, 522 bp, A.fumigatus
tgggttatggaagacaaggacgatgacttcttctcggatgatggcctcgaggatctgcctcccagtacattattgcagctggagcagaacgcgtatctagctacacaggcgcaaaaaccagcgcaatcagaagcttctattcacactgctcctacttcacatgcgcaagtcgaccgacaatttgcggtcgcagaatcccgatcaatacctatcaatgctacgttgaaaccgcctgcgcgtctacacaccggtctgacgaacgattacgattctctggatgtgggtgaatttgatgcggaagtgctcgatggtgattctggatttcctgttgccctggatcagccgcctgcttcggcaggacaagctgttcctctccgcaatgagtccgccttagagcctatggacattgaagaaggacggggaaacccgtaccaagccaatatctacgaggcttacaatgcgctggaggagaaggtatctgttgtggaagcatatacaacggcaggcttttggctaatgtga

SEQ ID NO: 9860 - DNA, 489 bp, A.fumigatus
tgttatagacgatggtccctcacatactggacctcctccgacgaccgcgtccggggcggttcctcgtattccaccctcaccattctcccaaacaacacagtccaattccacggacatctggacattaccaccctcggccgagcagggtttacctcccagcgcacaacagatgatatgtcctgggacctatccgacgccgacgggctcgagctggacgtcgccggttcggatgggaaagtgtacactctagttgttaaagacagactactaccaacccgggctgatggtcgtgagcagagtacgatcagctgggagtatgatttccagacggtggagagggcaattgtgagagtgagatgggaggatctacgggcgtcgtatcgggggaggaaagttgatgcggagccgttggatttgaggaatgtaaaacggattagtattatggttcgcaggtatgtatttattctgcaaagaaaaagtcgttattga

SEQ ID NO: 9861 - DNA, 279 bp, A.fumigatus
gtcaccttgctcagatctgacatagctaatgttatagacgatggtccctcacatactggacctcctccgacgaccgcgtccggggcggttcctcgtattccaccctcaccattctcccaaacaacacagtccaattccacggacatctggacattaccaccctcggccgagcagggtttacctcccagcgcacaacagatgatatgtcctgggacctatccgacgccgacgggctcgagctggacgtcgccggttcggatgggaaagtgtacactctag

SEQ ID NO: 9862 - DNA, 243 bp, A.fumigatus
tggttgaggacgcttctgattcagatgctgccgtgttacgccaggaagcgctcggtctcgtgcctccgcaagtacacgaagttcatcatgatcatgacttattgtcgaagtacgaatatgttggaccgccggatgatgagttggatttcagctaaggtcattcttttgattctgggttctattggcgtttggagcgtttcgggtggtcaagcttggataggttattacccggtgtggtcatag

SEQ ID NO: 9863 - DNA, 282 bp, A.fumigatus
ctcagcgaatatagtgcgggacgacgatttctctgctgcgttcacatcattccggactccagaatacacggctggtccttgaagtgccgcttcaacaactcgctggacacatcgggtgaaatttattatttttattattattggaaagtcagtacttctataatcggtaatgtgattgccacagctcctcctccagtcgaacttgtctacatgaaaggcagtctgctctatcacaattcccattctatcttattcccttgcagcctgcctctgcaggcctga

SEQ ID NO: 9864 - DNA, 555 bp, A.fumigatus
tctcgtgaccggccgtgcccggccgaggacgccatcatgcctgctattcatggagatttactggccgctgtgataccaaccgatagagacatcccggtcaatatcactccgcggcaggtcactctaagagaccgggtcactgttgcgaccctggtgcctatttcatcagccgatgatgtgcctccctccttgatgcgctatctgtctgatcagttgaataaagaaattgccaagggtgacacctatgccatggttgatcccatcccgctagagcagtttgcgacgtactggttcttcaactttggcgccatcatgctactaggcgacattaagagtgtgtatgagatgaaggccatggaaagggctggcgcggattggaccaagacctgcttgggcagcttcaatatccggccgaattaccccggacgtagtagtcatgtctgtaatggcatgtttcttgtgacagatgcggcgcgcaatcgtggtgttggtcgattgatgggagagggctatcttgaatgggctcctaaactggtcagtatgatctccacttga

SEQ ID NO: 9865 - DNA, 1116 bp, A.fumigatus
cagggttacacatatgccgtcttcaacctggtttacgagagcaacgtggcgtcttgtcgcatttgggatgctcttggctttaagcggatcggtaaggtgccaaatgctggcaaggtgctttccagccccggtgaatatgttgatgcgattatctatgggcgcgacctgagttctgaaggcgatgattcatttacgcaagatcgcttcgacaagatccggtattatctcaagcattctaaataccctagaggtgccgatagagccgagaagagtcggctgagaagtgcagccacccactacaagcttatagaggggaaggacggcgactcagataaactgatgctgaaagacaaagaggtcgtttcagatccccagcagcaatacgaaattgcccgaactattcatctcaagcagcatgcaggcatcaataagacgactgcagccattgcggtgaaatatcactgggtcaggatcaaagagaccgtcagtcgagtcattcgagattgtcctcaatgcaaagagacgctcaaactgccaccgagtaacggtatgctaattcacgacggcgctgtaaccatggagaagttgagcgccaacgagaatgaaacgagcttgtcgacacggagcaccatggagacaccgcagttgatggacaataattcccttgatcctcaccaaagccacaatccgtttgctcaaacgcatccacaggtcattcagggacctgtagattctatcaccgactatacaactctgcccctcgatccgcaaatcattgatatcaaccagcaactttcacgatttcattctcacgatggcatgagtcaccatccccatgacggcttaggtcaccacccccatgatggcatacctgacccatacacgcatggccatcatagcttatcccactcgaactttgaagacgccgtacggcatcacacagcgcatgactaccatatgatggttgaggacgcttctgattcagatgctgccgtgttacgccaggaagcgctcggtctcgtgcctccgcaagtacacgaagttcatcatgatcatgacttattgtcgaagtacgaatatgttggaccgccggatgatgagttggatttcagctaa

SEQ ID NO: 9866 - DNA, 447 bp, A.fumigatus
cgcagtttagccagtcccaatggctggtcatacgatgatcccaacgtatctaccgactctctcaggcgatacacattgcatgatccggggataaccgcatttgctcccccgtacccggagtccgaggccgccgatgtacgcagcgcacggatgtcgggatacagtggaatcgagatggatgcctggcaaagacgacaaggggtgaaaccaagtgcgctacggcgatatggaaccaggaagatcaacctcgtccagggttcggtactcagcgttgactacccggtgccgagtgcgattcagaacgcgatccaggcggagtatcgggatgcggaggaagcgttccatgaagaattcacgcatatgcggtgtaagtactcatgccgaattgcgatcgcatacagtcggctaaggaggtctagatactgccgccacctgcgacccagatga

SEQ ID NO: 9867 - DNA, 417 bp, A.fumigatus
ggaggtctagatactgccgccacctgcgacccagatgaattcactctgcgcaacggctacaacctacgtcccgccatgtataaccgtcatacggaactgctcatcgcgatcacttattataatgaggataaagttctgaccgcccgaactctgcatggagtgatgcaaaacgtccgggacattgtgaacctgaagaagtcagaattttggaacaagggaggaccggcatggcagaagattgtggtgtgtctcgtgtttgatggaattgagccttgcgataagaatactctggatgtcctcgccacgataggtgtgtatcaggatggggtgatgaaaaaagatgtggacgggcgcgagacagtcgcacatattgtgagtgatacaaggcagcgcgttccttttgaaaaacatcactga

SEQ ID NO: 9868 - DNA, 1035 bp, A.fumigatus
ttcgagtatacgacacaattatccgtcaccccgacacagcagctggtcagaccgcagcctaatgatcctagcaatctccccccggtccagatgctattctgcctcaagcagaagaacagcaagaaaatcaattcccaccggtggctgttcaacgcctttagtcgaatcctgaatccggaaatatgcatcctgcttgatgctggcacgaagcccgggagcaaatccttgcttgccctatgggaagcattctataatgacaaaacactgggcggagcatgcggcgaaatccatgccatgctgggcagggggtggcgcaatgtgctgaaccctctagtcgcagcgcagaattttgagtacaaaatttccaatattcttgataaaccgctggaaagcgcctttggctacgtgagtgtgctaccgggtgctttctcggcatatcgctaccgggcgatcatgggccgaccgttggagcaatactttcatggggatcatactttgtccaagcggctgggaaagaagggcattgaggggatgaatatctttaaaaagaacatgtttcttgcagaggatcgcatcctatgctttgaactggtggccaaagctgggtataaatggcatctcacgtatgtgaaagcatccaagggagagacagatgttcccgaggcggcgcccgaatacatcagtcagcggcgacgatggctcaatggctcctttgctgcgagtttgtattccatcatgcacttcggacgcatctataagagtggtcatagcttcgttcgaatgttcttcttgcatattcagatgatttacaactgctgccagctcatcatgacctggttctcgttggcatcctactggctgaccagctcggtcatcatggacctcgtagggacgcccagctcgcataacaagtacaaggcatggccattcggcaacgatgcctcccccattgtcaacttttttgtcaaatatggttatctcttggtgctgatgctccaatttgtgctggctctgggaaaccgccccaaagggtaa

SEQ ID NO: 9869 - DNA, 723 bp, A.fumigatus
gccgacggaatctcgtgtccgagacggaaaactgctgacacaaacagaaccaaattagcctacaccatgtcgttcctctggttttctctggtgcagttctacgtgctgatcctgtccttctacctggtcgctaatgccttcatgggtggcatgatcgactttgatttcgaccaaggcgtgggcaacttcctctcctccttcttcagctcgactggtggagggattgtcctgatcgccttggtgtccacttacggcatttacattgtcgcgagcattctctacatggacccttggcacatcctgaccagttcctgggcatacttcctgggcatgaccacgtcgatcaatattctcatggtgtatgcgttctgcaactggcacgatgtgtcgtggggtacgaaggggtccgataaggcggacgctctgccctcagcgcagacgaaaaaggccgacggcagcaagaacaacttcatcgaggagatcgataaaccgcaggcagacatcgacagccagttcgaggcaacggtcaaacgggcgctggccccgtatcaggagcccaaagaagactcgactatcagcctggatgattcctaccgcaactttcggaccagcctggtgttgctctggatcttgagtaatttgctggtctcgctgctcattacgagcgacggcatcaggaagatgtgtctgacggtacgcctgggatccccgggatgcgcctga

SEQ ID NO: 9870 - DNA, 2085 bp, A.fumigatus
  unsure (1926),(1999),(2031): Identity of nucleotide sequences at the above locations are unknown.
caggtgttggactcagaggacaaagggcagttacaggctattgtacgaaccctaggacttgcacggcggctgtactttgctcccttcgtggagtacttgctaccgctcctgaaccatgccgaccaggaacgggagctccgcgcaatggcgtatacgttccagatggtggtaggatatgccctgccttggacacgagtatcagagttgctcttccgagagctcacaagagacgcgctcattgtcctggggattgacgcactggatgaggaagcgaactttgaggacagtgtcagtgtggataatatggaggtcgaccggcagttctcggtctcctaccaggattggcgggaagaaccgtccgcggaggttcgaatgcagatgatggcagagtacgaggatgtacgagtcgttgcgacgcgcgaacgcctgctgtccctactgagaagcttgcagctcgttggcttaggcggggacaaggcccaaaaggtctttgccagcgtgatggacatgatgttgacggtgtttattgaatccgcatatgccaaccagtgggaggggccgtcgttggtcagccagcacctgcgacagtggattgagaatgtgtttgctcggttggttgtgcaggttctggcgattatcaatcacgacgagactggagcgaatgcctccggacgtctggatgtaagtttggtggatgtggaaaggtggcaagagatgggaatctcgcgcctggggtcactccggacccgcgagctgtttgatatcattgtcgagtggcctgcgagcagcggtgcgattgaggacttgcgacaattttggacacatccgcccgccaggtactgtctgacgcaagcgttcatcaaggtgctcaaccaacggttgttgcatcccggggcgtcaaccattgacatcttacgagtgtatatttctatcatccgcgcgttcaatctcatagatcccaaaggtgtcttgctggaccgagttgctcggcccattcgcaggtacctacgcgatcgcgatgatactgtcaaggttattgtgggtgggcttttggcggatcctgctgacacagacgagtccaatctcccgtctactggagagactctttcagagctgtctgccgagctagccaaggcacatcagaactcgctgcgggccgattctggcgagctggactgggatgatatgaactggatgccggacccggtggacgcggcgccggactacaaaaagtctaagagttccgatgtcattggcagtctgatcagtcttttcgagtccaaggagactttcgtcagagaaatgcagaacatgctggctgagcgtctgctccaaaaacgcgccgaattcgagcaggaaacgtccgttctggaactgctcaaggtgcgcttcggggacaattccctgcaggcatgcgaagtcatgttacgggacatctttgactctcgccgggtcgatgccgtagtccgcaacgaccaagggctcgtccagtcggaagacgacacccggcctgagctgcatgcgaagattctctctcacttcttctggcccgaattcccagcgcagcaattcaaggtgcctccggagattgcggcgctgcaggaacgctacgcgacaggattcggatcgctcaaacagtcccgcaaactcacctggctcaacgggatgggccaggtcaccgtcgagctggatctcgaggaccgagtgtttgtggacgaggtgacgacctggcaggccaccgtgatctacgcctttggctctgaggaaggggccaccaaaaccgtggacggattatcggctgaactgggcatgtcgacagcgctcgtgcgcagtgcctgtctgttctgggtcagtaaacgcatcctgagcgaattgcagcgcaatacctttcgcgtcctggaggtcctgcccaacgacgatgacacnggagccgtcggccccgctggcgtgtcagcaatggagtctggtccggccaacgccgccgccgcagccgattcancggcggcggcggcagccaaggaaaccgcccangcggcggcgatggaaaatatgacctgtactggccattcacccttggcatgttga

SEQ ID NO: 9871 - DNA, 1227 bp, A.fumigatus
  unsure (392): Identity of nucleotide sequences at the above locations are unknown.
ggtctcctgtacctcttatcacctgtgacattcacacttttgacgcggtacccacgcctccaaggctggtgcattccgacagggctctgtatcaccgtgatcggctcgcttctatcgtctatctcgacgcacgtatggcatctcattgcaactcaaggtattatgtgcgccatcggcaatgcgctcatgttcagcccgtcatctctgtatatggaccagtggttcatccacaaaaagggccttgccctcgggatcatgtgggcagccaagagcgtaaccggtgttgtattgccctttgcggcaaatttttgtttgcaccacttcggttctagtacgaccttcagagtgaggactgtcactacggtatggagcccgggttcattgctgcgatntgttgcgaatctatgcagaggaaccaacttgggtggcgtttgtcgctgtccgaatgcatccagtactaacactgaatcacagttgctgactactctaggatctctgccgttcatgaagcctcgaatccctgtctcgccgtccgcatcagcccggcgtctggacctggggttcctccgcctcgccgccttctggacgctccaggcaggcaatatcatccaaagctttggatacttcttgccgtccacatatctgccatcttattcgaccgcaacagttggtctctcaagaacaatgggcacaatgctagtctcgctcttcaacgcgacttctatcgtcggcggtatctgcatgggaatgctctgtgatcgtttcgcagtatcgaatatcctgcttctctcctcgatgggctcagcgctatctgtgtttcttttgtggggcatggcatcatctccggggtccgactcacctcggacgggcattgctttgctcaccctgttctccatcttttacggattcttcgccggtggtttcagttccacttggtcgggtgtcatcaaacaaatcaagcgtgattcttccacctctttggagacagggttagtctttggtttgctggccggagggcggggaattggcaatgtcatcagtggtccgctgagcacggcactgatcaagcagggatcgctgggtggctcgcaaaccagcaacgctgggactggctttagcactcaatatgggactctgattctcttcactggtatcacggcagcgttgggagcttggagctcgatgtggggttatatcagctccagcgtgcgctgtgtgagtcgctag

SEQ ID NO: 9872 - DNA, 204 bp, A.fumigatus
gggctcgtgttcctcatccagcatttgcagagccgcagtaagctcgacctccagagggcaaacccatccgactgtgtagtcctcatgcgtgaacctcttcttctgtatctctgcgctattttgggcctgatcatcagccccttgtctttctacctcactatcctccgcgtggtcgacacgtttgagcatgttgggttttactga

SEQ ID NO: 9873 - DNA, 1833 bp, A.fumigatus
atcataccaagcatgccgtctatatccctgaccgcgaaagatcgcttgcgaagaagccagtccgctcgctccatgcgcagatcgcgtcagtcctccctgccttcggagctgttcgacccgtccattgccagacagcatgcggctgtcgctgccactcgtgccatgctgcgctcctcggacagatcgtctgcagactcaaagcactcgtatgactgtctaggtggcccggaaaacatggcagtcccatcaaaaagactaactcggccgccccgtcacacgcaagccccaaccacggatccttcagtcgaagacgcttcgccttctcgccgatccatagcaagctatatagagaactgcgacgatgaccttactttctcggcggccttgccacccataagtgaatttcgaggcctgaatggtcgtgactcctcgctgccttcctcctatcgccggcttcgtaaagcacgttcgatgttctcgactagacagcgtgcctcgtatatttctcatgaatactcatctgatgtatatgctcggagattcaatgacacagagcaatttgaaacaccccgccgttacaggacgttgagacgctccatgtcttttctaagaagtggtcaatctcctagattcatccgccacgcgcagagtcaagaagcagctatccagctcgcgcgcagtcagttccaggagaacatggtcggacaatgcagtggtcaaaggcaatcgtctatcactatgctcaagccaagacgtgagcataagcccttcagaaagacatttcgcactaacagtggctcgggtatggacacggatgcgtcaacatctgcagggcagtcaaaaagagtttcttctcgtggaaaagcgcgcgctctttcttcatctatcaagagagggctgaagcgagttttgggtctgtcaaagacatcagcggctccgggacaagcggaagcttcacccctctcacttcagcaacacaattacggcccatcgtcgaccatctatgccggcgattctagcgctgaggaacttggccattcccatgagaccatcggccagagtagaccgcccacggtgcggagtgttcaaagcaatgaaagtctttcgacttcccgctctcgtgtaacaagttggactgactcgaccgtcgcaagtacgatcgcaacccgcagagcacccgagcgtgactgtctgtccatcattaacgaacaaggagacttcaacggacgtgccggttccgagctcccaccaagaccaagtgcaatacgaccagacggctccatcgacagtaaacacttgtacgatgcgttgttgagacggataggcagaggagatatgccaagtcccagtgaggaggttgtagtgggccaagtcaaagagcatcgactcataccagcgcgcacgtcttctcttcgccccaggcgcagcaggcagaccatccgccagataccaagtgatgcatcgattgcaacttccaggacatttgccacagcctacgcaggtagttcatctcctcagaagcagacgcagcgccattcccggtcgtccatgccttcgcaaaggaaatcaagtgcgccgaagaaagcgagcacaccactggattttagtgcagtcgataatgcaaaggaacctgccgctgcatgtgctgaagacgccgaggacgattctcgaagcgtgatcgtcgccagtcaagccgacccagagactctctccaattctcccagcatctattctcggaccaccagcgggagctctcctgaaaggaaagatcaggcgatcgatttgtattcgcgtcttcaccacggggctggaaggatccgcgggagcgcattc

SEQ ID NO: 9874 - DNA, 693 bp, A.fumigatus
gcagctatacgatgcactttatcagtgggagagattggggtccctcgccgttacaaatataagcctcgcgttcttccaggacttggtcccatcagctacagttgggacatacgcgaaggacaccatcacatttgcctctatatctgcagctgttcgagattacgcagatcgatttctccgaatcgtggtaggtgttactctctaactttttttttggccagaaccgtgtcaagcactaacatgacctcacagcagaaatacacacccccgaatggcgccctcgcagagcaattctcgcgctatgacggctcccccctctcagcgcaagacctcacttggtcctacacatcctttctcactgcagttcaagcccgaagacatgctcttaatccttccgcatcacacatccaacctctcctctcaaacgcgaccaccgccactgccctcccccaagtctgcaccccttcctccgcacgagggccctaccagcccgttaaacgaatcaagtggcccagaccagagtgtctctcccctcggagtaccgtcgccgttcggttcaatgtcctggcgaccaccgttattggcgaggacatcttcctcgtcgggtccatccccgcgctgggcgaatgggatgcgcggcatcaggctttgaagttggaagcgaatgagtactcgagcatcacgcccttgtga

SEQ ID NO: 9875 - DNA, 507 bp, A.fumigatus
tgtatcatatcctgtatgcagcaagaaggggtctcaggtggttcgtctctttcggtcttggagtgtgaccgctcagcttctcgtttcaattttccttatttccctaccatcatcatcattatcatcatcatcatcactgtgatctattcaaggcagtcatcgataagagcatgtgaaagttgtgcatgcgaggcagtctccatccgccttgatgaaatgaaagatgaaacgccgcgaatgaccgagatgacaaggaagccgttcctgacgatcgccataggcgtcttgaccactgtcagcgctctctcggaccccgctcagattgtgattccagcaacaataacaccccagacgacggaccccttggtgtcatggttagcgcaagaaacttcatacgccctcgatggtgtgttaaacaatgtcggaccgaacggggctaaggcaactggcgctagctctggcatcatcatcgctagtcctagccaaagcaatccggactgtgagtaa

SEQ ID NO: 9876 - DNA, 249 bp, A.fumigatus
  unsure (41),(52),(53),(123): Identity of nucleotide sequences at the above locations are unknown.
tgggcctgcgctgagagcaacaacactgatttcctacgcanacttgatgatnngtatgttttgctcttttcaataaagattgagcttcctaacttcgtgtactctaataggataatggttatntctctaccgttgagtcaagcatctggccaatcatttcagaatgaccttttctatcctacggagttttggaactcttctacttttggtacgtttgtgtgtttctcatacgggaggatcatccagtga

SEQ ID NO: 9877 - DNA, 669 bp, A.fumigatus
ccagatccggtagatctttgggaggaagttcgcggttcctcatttttcaccacggcagtccagcatcaagccctcagaaaaggtgcagcccttgcccagaggcttggtaaaacctgttcaaactgccagtcacaggcaccgcaggttctctgtttcctgcagacttactggactggctcgtccatactggccaatctgtatagtgatcggtccgggaaagatgccaattcaatactaggcatcatccatacttttgaccccaatgcgggctgcgacggacagacgttccaaccgtgttctgatcgggcgcttgcaagccacaaggaagtcgtagactccttccgctcgctgtacccgatcaatgcagacattccccagggccaagctgtagccgtgggtcggtacccagaggatgtctatcaaggtggacacccttggtatctgtgcactttggcagcagctgagcagctatacgatgcactttatcagtgggagagattggggtccctcgccgttacaaatataagcctcgcgttcttccaggacttggtcccatcagctacagttgggacatacgcgaaggacaccatcacatttgcctctatatctgcagctgttcgagattacgcagatcgatttctccgaatcgtggtaggtgttactctctaa

SEQ ID NO: 9878 - DNA, 408 bp, A.fumigatus
cctcacagcagaaatacacacccccgaatggcgccctcgcagagcaattctcgcgctatgacggctcccccctctcagcgcaagacctcacttggtcctacacatcctttctcactgcagttcaagcccgaagacatgctcttaatccttccgcatcacacatccaacctctcctctcaaacgcgaccaccgccactgccctcccccaagtctgcaccccttcctccgcacgagggccctaccagcccgttaaacgaatcaagtggcccagaccagagtgtctctcccctcggagtaccgtcgccgttcggttcaatgtcctggcgaccaccgttattggcgaggacatcttcctcgtcgggtccatccccgcgctgggcgaatgggatgcgcggcatcaggctttga

SEQ ID NO: 9879 - DNA, 183 bp, A.fumigatus
  unsure (87): Identity of nucleotide sequences at the above locations are unknown.
gactactatacctggactcgagacgccgctctcaccgtcaaatacctcgttggttcttttgccgccgatcacgaatcctgcatccanaggatcatagaggattacgtagaatcccaggcgcacttgcagactgtctccaacccttccggaaatctatcaagcggaggcttgggggaaacctaa

SEQ ID NO: 9880 - DNA, 411 bp, A.fumigatus
  unsure (10),(18): Identity of nucleotide sequences at the above locations are unknown.
acgtccactngcagattngcggtgaagaccatgctcacagaggtagccactacccaactgagtgtgtctccacttgagttaacatgcaattctagcctcgccgataaatgggctgcaaacggagcaaccttctacaactgctgcggcccaaccgaggtcaccatcatcaataccatgcatagacaccaattcggccagcaattaaccataggacgacctctcccaaacaccagtgtgtatatactggacgacaagcaacttccagttgtgattggggaggtcgggaccatgtgggctggtggagcagggatcacaagagggtatcttggacagcctgagaagactgctgagcgctatcgctatgatccttttgttgacgatgggtgcgtcccaggcagtctcgctgattga

SEQ ID NO: 9881 - DNA, 288 bp, A.fumigatus
ttggggaggtcgggaccatgtgggctggtggagcagggatcacaagagggtatcttggacagcctgagaagactgctgagcgctatcgctatgatccttttgttgacgatgggtgcgtcccaggcagtctcgctgattgatatgcttactgacagatggatcgcttacagtcactcaatgatgttcaatacgggtgatttagcccgctggcttcctgatgggagcttggaaactctgggacgcaatgatgatcaggtcaaaatcaaggtgggtttgcacctctcttaa

SEQ ID NO: 9882 - DNA, 1326 bp, A.fumigatus
ggcttccgcgttgaactagacggtgtcagcgcgtcattggcgtcgtgcccaggtgtattggaggctgcagccatcatggtggaaggagacgtcgtcgcattcgtcacgcctcaagcactcgatttgcagcaactacaaatgcacttaaaggcgagactaccatactatgctgtcccaacacaagtgcatagggtggatgagtttccactgacgccaaatggcaagatcgacaaacgagcgctcgcccagttatcccgtccccaaaagaagacatcgcagtctgatacggagatgctggacgagaagaagcatgttgttctaaacgcttctcgcgagacagtgtcaacccgatcagattcatccgactcacttcgcaagcccctgccgttggcagagaagaagaaccgcaaggttgtccggggactcagataccgaatctttattgtctaccggaggcttttcacgctcatttggcttgccaatgttgctgcgctcttgtgtattctgttcattcccaagcttgggccccaatggatctcaacaattgccttcatcaacctcacgattgccgtcctcgtccgccaggacgctgtcatcaacgttctctacacaatctgctgctctgtaccaaagtcatggccattggcgatccgccgccggtgcgcaaagatctatcatcttgggggagttcactcgggcgctgcaatggccgctacggcctggtttgccggctccatcgggtataatatctacaaccaggttgacgatgcccgagcgcttgcaaaagcctcacctgcgactctcaccctttccctaatcgtgttactcctgctgttttcaatgatcggcttcgcatatccgacttttagaaagaagcgtcacaacacgttcgagcgaatccatcgcttcgtcggctggacaatcctcggcatcatctggatccaaacaatcctctccatacgtgaccagcgcggcacacaacctttggggcgagccgtcatctcttcacctaatttctggatgctcctcgtcatcaccgccagcattgcaagttcgtgggtcttcctccggaaggttcccgtcgacgccgaggtcctctccaatcatgctgtgcgacttcactttgactacacgatgcccgtcaacgggacctttacgcgactatccgaacggcctttactggagtggcactcgttcgcgactgtcccagctccaaccgccgtgaacggcagaccgaaagggtactccttagtcgtgtctcgcgcaggagactggacaggacggcagatcagcaagccacccacccacctgtgggtccgcggtatc

SEQ ID NO: 9883 - DNA, 366 bp, A.fumigatus
tatccagtgttatctccgcagagtggcttcatttcctctgaagtacatgtgactgaatctattcgattcaccgttgcaagccgtacgtttgaattgttacacaacatgactaacccccaagttacaaatgctacagtcgaatggatagcacgtggtgcggggaacaagttccttttcttactcgatgtacgattcgcgaccaaggcccacacgctgttagggcaaccggaggtgggaatggacctaatgccaggcggcggaggtggtcaatatttgcctcgcttgattggacgcggtcgtgcatggaataatattgagctcgacagacattactacggaggatgcggaggaaatgggtttgattaa

SEQ ID NO: 9884 - DNA, 432 bp, A.fumigatus
tctttgaggcgtattttcagctcctggccgattagtgagataggaattgccgggcgcgccaataacatgtacgactctcgcatcgagaacctcaacatccagaactggcctgtccactgcttcgacatagagcacaccgagaacatgatcatctccggcatcacactggacatttccaccggcgacgcacctcgcagcgccagtggcagcaaaccggccgcccaaccgacggcttcgatctcacctctagcaccaacttcacctgtagaacagctgggtacacagccaggacgactgcgtcgcggtctcaagcggcagccacgtcgtcgtagactacatctacggcggccatgggctaagcatcggctccatcggcagcaagagcgacaacaccgtcgacggggagacctccaactcgcaggccatcgatag

SEQ ID NO: 9885 - DNA, 333 bp, A.fumigatus
aggatcaaattaaactccagaaccaccggtgaggtctccaacacccgctacgagaacgtcaccgtctgcggcatcaccgactatggtatggacacccagcaggattacctgaacgggggtcctaccgacaagcctaccaatggcgtaaagatcgagaacatcacctttgtcgatgtcactggtactatgagagatggtaaggattactacattctctgtggtgatggcagttgctctagcttgtctttgaaaatggcagcatcaccggtggtagtggcgacagctgtaactatcctaccggtacttgtcttgaggcttgattgtaccaaataa

SEQ ID NO: 9886 - DNA, 1368 bp, A.fumigatus
ccacgctgctataatatttccctctttctacattctttggcagttatcctacggttcaaacaaggctcctgcctgcccgtttcctcaatcatggcgtggcagaggcctaattgcatcgttcaggcagtgcagacggtccgagcagctcagttgcagtccatcctgcgaacctccacagtcacttcggggagcttattacaacagcgaaagggtacgcgaagttatgcaactgaggcccaaaccactggtggaaatgctcttcaggtacgagcagcttctgagatcgatttctcccaactcgctacccggcctgctcgggtcattcccgcatccccggcctacttctccggcagtcccaagttcatcgatcatttattgaatctggaacgtgtctgcgccaaatacgcatcgctacctacggtggccccgaacgaagcacctcgaatggcatggctcaaacttgcacagttccgcgactttgtcggcgagcccgtaccgacgaagaaatacaagagcttggtcaagatcctgcagcggctcaatcgcattgagcctgctcttgtcccgggggaagtccgcgacaccttgaagaccttccttcggccgggtaacccgtacggaaataagccggcgccggcaacagtggacgagatgggccgagctcgcggcaagggaaagcgcaagacctcttcggcggtgggttacctagtcgaaggaaagggtgaggtcatggtaaacggcaagacgctggttgaagcttttccccgtcttcacgaccgcgagagcgcaacttggccgctgagatgcacgtcgagactagacaaatataatgtttgggctactgttcgaggggtggtgtcactggcccaggcagaggctattacattagcccttgcacgggcattactggtccatgagccggcgctaaagccgattttgcgaaaaggtacgttgcagatgaggctgtctgagtgggtagtaaagaacattgctgacaatttttctagctggtgtcattaccgtcgatgctcgtcgcgtcgagagaaagaaacccggtcacgtcaaggctcgcaagatgccaacctgggtcaagagatgaaggcatgtttgttctctcttggtcctggcgtgctgtctgctctttactccgtttactgttctcatttccccgacctgtatcattatctcacttgccatcttgattcttcattgaatatgctttctgatcctccgcatcaccgcgcgtgtgtcatgggggtttgtttcaagacaagacacttgcatgggcggtctcggcgacaagcaatgtaccttagtttgactcttatcgggcgttaccctcagatgacaatggaatcgattgattag

SEQ ID NO: 9887 - DNA, 903 bp, A.fumigatus
agtgtccttcgaggacatcctcgcagtcggctcaggatggaggacaggattcagttcgatattaacgagtcactcaaatattatttgagcgacccggcctctgttcccacaaacgatgccgacccggaactgttggattgcgaaagcgacctcgagcatttaacgccagcattgatcgataatgtgctcaatcccattgtagacgctgtggctgagagccccgaagcattggcgagacagtctttttttgactcgctgcaattccttctaaagtgcgcgatggccctttcttcgttctccgagtttcctggccatggtggaaccctttctgaacttctgaattcctgcagatactcgtctttcctccctacgaagtccctcagcaaactcctcgatctgatagtgtccgggctgtctctcgaagcagatattatccatggagacctcgaagctgaggaacaggatgctatccagcaccataaacagctattggagatgtacggcttcttgcttcaatgggctctctctgctgtggaagtcaaagcggcagaaaagcccgcggaggctgcgcctgctcggagaggtgcaggtaaatcgggaaggtccaagaccagcaacagggacggtacatgggactggacagcgcagattcagatatccatggagacgatgtgcaaagtgatgaaacttaaattaagcaggattttcatgaccacatcggaccgcgacactttcatcaacttgttcacccgtgcgatttatctcatcttggagagcgagcaacgggtcaagagcctagcgattcgaatgcatgctttcaaagttctttgcattgctgtgaaacatcatggccatgcatttggtagggtccaagaacataatgagcagtcatgcctgagctaa

SEQ ID NO: 9888 - DNA, 1029 bp, A.fumigatus
ttattgccacagtcatacactcttcgttgcgctgttgttgaggtttgcggcaatctaattgcggaccttagcagacaagaagaacgcagtgagaattacaaaactcaaatcaatgcgttcttcgatgtcttagaagagagatttctcgacgtcaatccctactgccgttgccgcgccattcaggtatatatgaggatctgtgacctcgagcagaagttccccaaaagacgacaggcagttgctgagctggcggcaaggagcttggaagacaaaagcagcaatgtgcgacgcaatgcgatcaagttacttgcgaaattggtttctacgcacccattcagtgtaatgcacggcggacagctttcctacaaagagtgggcagctcgtctcgagaatgtcgatgcggaacttaacgcattacggccacctgagacccccggctttgacggtggcgaggcttcacatgtcgacagcgagctgttagacgacgcgacccagatacctgaagattccccatcgaaggcaccacgcatgaccgatgccgaaaaagctgccgccatccaaagggccgcggaacaggcagcgacttccgaactacttgcacgactacagctgaccagaaagtactacaacgaagccatccgtttcattgaggtacttcactccgcctcagcagttgtctcccagctcctgtcttctcgaaataagagcgaagtcattgaagccatggacttttttgtggtgcttgatgcatataaggtcgagactgcacgcagtggcatcaggcgcatgctgcgactcatctggaccaaagggaacagcgatgaaggcaaaggagtccaaacccatctgattgactgctacaagggtttgttctttgatgcgccggactcgttcggtcccaatgatgccgcaaactacgttgctcggaacattatcagtttgacctttggctcaacacctgcggagttgacatgccttgaacaactgctcagtactatgatgaaagccggtcacatctcggatgtcttc

SEQ ID NO: 9889 - DNA, 369 bp, A.fumigatus
cagcgactcctccagcaccgcctcaattggacgatcgactacaacacaggcgcatacagagcccagttccctactccaaccgggaaccccgccgacccaaccctaacctcccatggcgtccgacaatcgcatgaatttgccgcacacatctcaagcccaaggttccagcccaagccgttccgagtgtactgcagccccttctaccgctgtctacagacgatccagccaaccgtcgaggcgctaaaggcaaagcaacagcagcaacagcagcagcagcacgaggaaagtagcgacatcgacgcctgcgcggactttgacgtcagggtcgagaatgggatagggttggcacctaccttaccacagttatag

SEQ ID NO: 9890 - DNA, 807 bp, A.fumigatus
tccgcttccaaacactgcaacccaacggtcgaaggaagcactcaccagcctctttcagctcccgaactgagaaacccacagtccccattcttcacacagtcccatccacccccgacgcccttcccaccgcgccaatccggcaccttcgtctcagcccgcaggatcttcgtcccgggagccaacgcctccaccccaaccccagcggtgccaaccttgtttcccctcctccgaaacgtactcaaccccgctgtgaaaacaaagaagtcctccgtggaactatcgtccggcatcgcgcccgtcaacgcgcggcccatggcaatcagcggcgccgcatgcgagcagataagcagcgccttgctggtgcgctggtcggggcgctgcgactcctccagggccgcgatctcggcgtccacgtcggcgattatgcctgcgagcgcggtggcgaggcgattgtgcagctgggcgatggtctcgccgcggggcgaggggatgaggtgcggcttgtgctttgaggggtccgacgggaggatgctggggaagtgggtgtggagggttggcggtgtggcgggggagggatgttcgaagaaggaggttgggccgaaccattcccttgtatctctaaatcagcagtgtatcttctataactgtggtaaggtaggtgccaaccctatcccattctcgaccctgacgtcaaagtccgcgcaggcgtcgatgtcgctactttcctcgtgctgctgctgctgttgctgctgttgctttgcctttagcgcctcgacggttggctggatcgtctgtagacagcggtag

SEQ ID NO: 9891 - DNA, 1227 bp, A.fumigatus
caaacaagagtttcattggccaaatgggcctttcaaaccgttccccaaacgtcaaaatttcatcccacggggaccccagcccaggaatccgggggctcgtatagatgtccctacagctcccaagtaaaatatcccgaggaccagcttcaactgggaatcgcacatccggcagaacgaatcattcgtattcgtaatcagctttgcgagatgctagacgatctttatagtgatccacgtgccgcacgcaacggaaacattgaagcgttgcttgctcgtgtctttaatatctacactcgcgctgatcaacttcgcgtcacgcagtctcgattgcaacccactctcgctaccaacgcttctgcaaatgcggaaccggcgcagccgcctctgtaccttctatcgtcaccaggtggatatcaagctctagtcgcgtctccgggcgcgacaaactctattcaggcattggttgcatccttccatgtgtcgcagactcctgagtttacacccatacaggctccagctcaaccagccagattccgagccaatcaggaggctgtggttctggaaaatgttgttcgtcaagctgtgctaaaccagcgagcagtgaacaatggacctgttgatctttccagatatattagacgcatctggctcttcgtccggttgtattttttctgctacatgttcagcgagccaggaacatggttgcgagtcttatatgttacgctagccgtgattgcctctcttctttccgagaccaatattccgcggcagctgttcaatctgacagttgctcctctccagcgctaccttgaggggttgttacatgtagctcctgatgctgctggtaataatggcacccgcgctgctgtgaatggtactggcatgcttaacgacaaccgcgccagcctgcccggtcaacttcgccagggtatccagcgattggaacgatctgcagcgctgtttgttgccagtctggtccccggagttggcgaaagacagattgaggtgcgaaatgcagccgaggcagcccgtaacgcgcagctcgcacgagaagaagaggagcgtcgcagacagcaggagaccgcgggcaacggcgaaaacagtgcagagcggcaagagcctcgtgaggaagcggacggcgcaaatgagcgcgtcgagcctgccgaacagaatatcatgactactaatcaatccgagcctttgataccccttgagcctgacgaatga

SEQ ID NO: 9892 - DNA, 387 bp, A.fumigatus
cctccgtctgaccgatctagatatgacacaggaacaatcagcggcattcttgccatgccctactggcaagagctcttctccaccggctaccgtgaccccaccggacaccccaatattacctcctcgcagtctgccgccatcgtctccatcctctctgctggtaccttcttcggtgctttgggtgctgctcccatgggtgaccggatcggtcgtcgctggggtctgattgcttcggcccaggtgttcaatctgggagtcatcctgcagacggccgccacggggatccccctcttccttgcgggtcgcttctttgccggtctcggggtcggtttgatctctgcgttgagtatgtcttctctctcccacggcattcccggattcgactaa

SEQ ID NO: 9893 - DNA, 486 bp, A.fumigatus
tggacagtccctctgtaccaatctgaaacggcccccaagtggatccgaggcacgatcgtcggtgcctaccagctctccatcaccatcggtctcctgctggcctcgatcgtcaacaactccacgcagaaccgcatggacaccggctgctaccgcatccccatcgcggtccagtttgcctggtcgatcattctcgtcggcggtatgctgatcctccctgacacgccccggtacttgatcaagaggggcaacatcgatggcgccgccagagccctcggccgtctccgccgcctccctgccgatgacccggccgtccgcgaggaactggccgagatccaggccaaccacgagtatgagcttagtcttggcaaatccacctacctcgactgcttcaagggcaacctgctcaagcggctcctgactggctgcggcctgcaggccctgcagcagctcaccgtctacacggccggcggatggaaggtaccgagt

SEQ ID NO: 9894 - DNA, 315 bp, A.fumigatus
attccaactgaagcttcccgtcctcaaaccccttcaacgaaatgctcctcaaattcctccaaaatccaatccggcccgggccccccaaaatggtccgagaattttttttctcctccacgccaaccacctggaaaaccggcgggcctggccccccccggaatacccaagggcgcatcctcctacccccccaaagggaatttaaattgtccccagttcaacccgggaacggggccaacaagtgtgaaacccgggaatatggtttggcccaattccaaacttcctccccggaaacaacaaaaccctggggaaatttga

SEQ ID NO: 9895 - DNA, 258 bp, A.fumigatus
cgtcttcttcctactactagcaaagacacaaaaagggatccctttcccctggtcgctcttggtgtagcattgattatgcgactagtttcaggttacccttcatccgtttctgacttcatttccgatttattgacgatcgacattgcagcttgcgtggaagacgtccctttcaagacccttgtccgcatccggatttcctccttatttgactccttaaaaaaacaacttcacgccctcacaattgcgaaaattaattga

SEQ ID NO: 9896 - DNA, 618 bp, A.fumigatus
gctcctctgctttttggtctggtcaagcttttgtactcatactgcatacaactaggggacaaatccgtcaactactcgctgccagaccagatgctgtcgtatccagctcatcctatctatccgcccatctatagcggcgatgaactcagccaccccccgggggccatgacgccgtcagacgtctcctcgtcgatttcgccgcccaatgggcagctcggcaacatcaaatacagcacacccgtcgccggcgaatccatcgcttccgcattaagccaagaagaagaactgcgccgcgccgccgaagaggaccgccggcgtcgaaacaccgccgccagcgcccggttccgcatgaagaaaaagcagcgcgagcagaccctcgaacgcactgtccgggagacgaccgaaaaaaatgcctcgctcgaggcccgcgtagcgcagctggagatggagaacagatggttgaagaacctcctgaccgagaaacacgaggcctccgctagccgcatggctccgcctccgacagatagcacggccctgaacagcaagactaacgggctggctggaagcgggcaaaaacatatccagccaaaaaagaagggcgtgggaaccgataattaa

SEQ ID NO: 9897 - DNA, 615 bp, A.fumigatus
cgagtcagcagtgccggtgggcttggaggtgacggtgccagtgcccgcggtgccggcctccttcatgagggagctgcaggcaccggtcgccttggtagcggaggtgacagtggccgagccaccaaagttgcaggcggaggaagcagagctctgctcggagtagtacttgttgagcaggaagttgagctgctgcttgggggtgcacatgccataggcgccgtagctgcctgtggtagcgttgcgggcgatgccggtgcagtcagtgtagccgcagataagactgaaaaggtcgccgtactcgtcgctgctgacggagtccttgacgacacaggaggcggcgttgctcatgcaggtgcagagctgctcgttaggggtcgggggcaggggactggcgctggcaagccattggctgttgacggtcgggcagctttgcagagctgtgttggtgggggtgtaggaggctttattggtgccggaggggttggcgttgttgttgatctggctggagtagtacttgaagtcggccatggtgctgacgctggtgctgtcaacagcggagacaagacctggatggatcagttgcggccaatgactggatcaaagagcttaccgtag

SEQ ID NO: 9898 - DNA, 741 bp, A.fumigatus
tccagtcattggccgcaactgatccatccaggtcttgtctccgctgttgacagcaccagcgtcagcaccatggccgacttcaagtactactccagccagatcaacaacaacgccaacccctccggcaccaataaagcctcctacacccccaccaacacagctctgcaaagctgcccgaccgtcaacagccaatggcttgccagcgccagtcccctgcccccgacccctaacgagcagctctgcacctgcatgagcaacgccgcctcctgtgtcgtcaaggactccgtcagcagcgacgagtacggcgaccttttcagtcttatctgcggctacactgactgcaccggcatcgcccgcaacgctaccacaggcagctacggcgcctatggcatgtgcacccccaagcagcagctcaacttcctgctcaacaagtactactccgagcagagctctgcttcctccgcctgcaactttggtggctcggccactgtcacctccgctaccaaggcgaccggtgcctgcagctccctcatgaaggaggccggcaccgcgggcactggcaccgtcacctccaagcccaccggcactgctgactcgtcaggctcgtctgcttcttcgactagctcgtctggtacggccgttgctcttacccgcggctctgcggtgaccgttggctcgttcgagctgggtgtgtatgccatcactgcgcttctgactgcggtcggcatggtcatgctataa

SEQ ID NO: 9899 - DNA, 825 bp, A.fumigatus
atgcgtcacatgagattaacttcaacagaggactattcgagcaatggtaccactgatggcagcagcacctatatcgaccccttgtcggacgccacgctgtgcaagcgtgacgttcccatcttccgggagttaaacaccaacaccatccgtgtttacgccatcgatcccactgctaaccacacagagtgtatgcagatgctggccgatgccggcatctatgtcatctctgatctctctgacccatcccagtcgattgaccgcagtgatccctcctgggagaccaccctctacaaccgctacaccagcgtgatcgacgccctggcaccttacaacaacactctcggcttttttgcgggcaatcaggtttccaacaccgtcggtaccaccgatgccagtgcctttgtcaaggcggcggtgcgggacatgaaggcatacatcaaggagaagggataccgctcaatgggagtcggctacgcgaccaacgatgactcgtccatccgcgtcaacatggctgactacttcaactgcgaagacagtgacgagtcgattgacttctggggatacaacatctactcctggtgtggtgattcgtcctacactgagtctgggtacagtgttcgcacagaagagttccggaactactccgtgcctgtcttctttgccgagtatggttgcaacgaggtcactccccgcaagttcacagaaatcgaagccttgtttggagacaagatgaacgatgtctggtcgggtggtattgtatacatgtatttccaggaggccaacaactacggtaagctctttgatccagtcattggccgcaactga

SEQ ID NO: 9900 - DNA, 306 bp, A.fumigatus
aggcatacatcaaggagaagggataccgctcaatgggagtcggctacgcgaccaacgatgactcgtccatccgcgtcaacatggctgactacttcaactgcgaagacagtgacgagtcgattgacttctggggatacaacatctactcctggtgtggtgattcgtcctacactgagtctgggtacagtgttcgcacagaagagttccggaactactccgtgcctgtcttctttgccgagtatggttgcaacgaggtcactccccgcaagttcacagaaatcgaagccttgtttggagacaagatga

SEQ ID NO: 9901 - DNA, 402 bp, A.fumigatus
atcatcacaatcacgtcaggaattctgcgtgataatgtccctgatggggacatgacgatctcaaacacaggccacgacctgaatcgtatctgtctcgtcctggacgagatcatccccacctggagggcacattcctccatcctgatgacgcatccgtctgcgagtttcgggatgtggccttgcgtgcagtgtaacttggaaaatatccgagtcacgctgcagcagctacggcaagagctggaacctgttgccgagagcgggcagaagaagcgctcactgttcaaggtctacgccaaggcgtggaagttgggcttgcatagtcgcgcaattattgcgtatcgtggccgtctggaaccacaccgtaaggctttgagggttggcgccactatgatgaatatgtag

SEQ ID NO: 9902 - DNA, 483 bp, A.fumigatus
  unsure (306): Identity of nucleotide sequences at the above locations are unknown.
gctatgactgttcggtgcacatgtgtaagtgtgtcttttttttctttttttcgttttactgaaccgaatcaagccgaggagatcaaggatgctgcagagacgctgccgaaagcaatgatgtcagctgttgcggttaatggagttttgggatttgtcatggttgtcactctttgcttcaccctcggcgatgttgacagcatcttgagtactccgactggttttccgttcatccagattttctacaataccaccaacagctacgcggcaacgaacactatgacagcggtcctggtgatcacgctcacngccagcacaatcactgaagtcgcgacggcattcccgcaactatggtcttttgctcgagatcaaggactgccattttcatccttcttcgcttatgtgagtcttacgcccccaatctctgggcggcgttactggtcgcccaaatgcaagtcaactccgggattggatattcccttttaa

SEQ ID NO: 9903 - DNA, 264 bp, A.fumigatus
atgatcaaccaagcctcatctcaccgagatattaagctcaaccgaggggcttgcattgccagggtggtcggtagctgcaatcacggtgtgtgcattgagatgggcctacatgatttgataaagcccagtcactccattgttgagattgtttctgttgctggagtctccatcttactgtgggctgtcgaatactctcttatcgcccttgagcttctaagcaaaaagatggtcggtgtggaccaagggatcactatggccttgtga

SEQ ID NO: 9904 - DNA, 615 bp, A.fumigatus
gagtgtctttccgctttggatcgagctctttttgacgattctagggctccaacctccggaggtcaataccattgggtttccgagtttgctcctcgaagggcccaaaagttcttgagctacattaccggtaggcatcaagacctgggtgtttcgcgggcggaactgacgttgataggatggctcagtgcaaccggatggcagtgcgctatcgtatctattgctttcctcgctggcacgatcatacaagggctggtcgttctaaacgacccaacctatgagtttcagcggtggcacggcaccttgttggtggtggcaataacaaccttttcaatattgtttaacacgttcctagccaaaaacctacccatggtggaaggactcatcctgatcattcatgtggtagggctgttcgccatcattatccccctctgggttcttgctcctcgaaacagtgcgaaagcagtgtttacagagttcaataacgctggaggatgggatagtgacgggactgccactctggtcggtctctccaccactattacagccatgataggctatgactgttcggtgcacatgtgtaagtgtgtcttttttttctttttttcgttttactga

SEQ ID NO: 9905 - DNA, 1428 bp, A.fumigatus
aaccgccttgcgtggaaccggaacccggaaacaccactcggaattagaaccaagcgcatagtgattttcatgagcgatcaattgttccagaagctctttactcgtactgacagctcgcaggagtcatatggaataccttcactgtcccaaggaatggcgggcgtcaagacgtatatcaaaccattcccgaatgcgaatattgactttttcaatgttcaagagacgataatgcacatgcttggttacgcaagaaaggggaaagagttcgaaatcttgaggaattttcgtggagtgctacacccgggagagatggtccttgttctggggcgtccaggatcaggctgcactacattcctgaaaacgatcacaaaccagcgttttggctatactagcatagatggcgatgtcctctatggtattttcgacgctgacaccttcgcaaagaggtttcgcggcgaggctgtctacaatcaagaggatgacgttcatcagcctacgctcacggtcaaacagaccttgggatttgcgctagacacgaagaccccgggaaagagacctctgggggtttctaaggccgagttcagagagaaagtcatcaatatgctactcaaaatgttcaacatcgaacataccgccaataccgtgattggaaaccagttcatccgtggcgtctcaggaggagagagacgtcgagtgagtattgcagagatgatgatcacatcagcaacggttctggcttgggataatagtactcgtgggctggatgcttcgactgctctggactttgccaaatccctgagaatcatgacaaacatctacaagactacgacgttcgtctctctttatcaagcatctgagaatatctacaagcaattcgacaaggtcctggtgattgacagcggtcgtcaagtcttcttcggtcctgcctctgaggcaagatcgtattttgagagtcttggtttcaaggagagacctcggcagaccacgcccgactatttgaccggctgtacagatccatttgaacgggaatttaaggaaggacgaagtgaagacgacgtgccgtccacccctgactcactcgtggaagctttcaatcgatcatcgtacagtgagagactcgcccaggaaatggatgcttatcgaaagaagttggaacaagagaagcatgtgtacgaagacttcgagattgccaatcaggaagcgaagcgcaaatttactcctaaatcttcggtctactcgatacccttccacttgcagatctgggcgctgatgcaacgccagttcctgatcaaatggcaagacaggtttgctcagacagtctcttggattacgtccaccggagttgccatcattctaggtacagtttggctgcgactgcgaaaaactattggcaggagcatttaccaggggtggtttactcttcattag

SEQ ID NO: 9906 - DNA, 1479 bp, A.fumigatus
  unsure (89): Identity of nucleotide sequences at the above locations are unknown.
gtacagtttggctgcgactgcgaaaaactattggcaggagcatttaccaggggtggtttactcttcattagtctgctcttcaacggatntcaggccttttccgaactcgtctcgacgatgatgggtcgctctatcgtcaataaacaccggcaatttaccttctatcggccaagtgctctgtggattgcgcaaattctggttgatacgacgtttgctattgcacgaatcctcgtcttcagcattattgtctattttatgtgcggcctggtcctcgatgcaggcgccttcttcacgttcatcctgattatcgtgctcggatacctctgcatgacttgcttcttccgtgtcattggctgcatgagtcctgactttgactatgccatgaagtttgcgtctgtggtgatcacactgtttgttctgacgtccggctacctcatacaatggtctagcgagcaagagtggctgcgatggctgtactacatcaatccgttcggactggggtttgccgcgctgatggtgaacgagttcaaggatctcaccatgacatgcactgcagactcgttggtaccgagtggccccggctacgacgacatggcaagtcgcgtgtgcacacttgctggtggtgagccaggctcggtcattattccaggtgcgagctatctagcaaagacgttcagctacttcccaggggatctatggcgaaactttggtatcatggttgcactcaccgttggtttcctgaccctgaatctgtacctcggtgaaacactgcagtttggggctggaggcaggaccgttaccttctaccaaaaggagaacaaggagcgcagagcgttgaatggagccctgatggagaagcgaaccaatcgcgagtctaaggatcaatcagctgcgaatctcaaaattacctccaaatcggtcttcacctgggaagacgtttgttatgacgttcctgtgccctcgggtactcgccgcctccttcaatctgtctacgggtacgtgcagccgggcaagctgacggcgcttatgggagcttccggagccggcaaaacgacgttattggatgttctggcctccaggaagaacattggcgtgatcagcggcaatattctggtggatggtgccccccctcccggaagtttcttgcgtactgtgtcttacgcggagcagctggatatccatgagcccatgcaaaccgtacgagaggcattacgcttctcggctgaccttcgccagccttatgaaacaccacaatctgaaaagtacgagtacgtcgagggcatcatccaacttcttgagctcgaggatcttgccgatgcgatcatcggaactccggagaccggcctctcagtcgaggaaagaaaacgcgtcactatcggtgttgagctcgctgccaaacctgaacttcttctttttctggagaacctaccagtggcctcgtcttcaccacagcgggccgaccgatccgagctaagcatt

SEQ ID NO: 9907 - DNA, 687 bp, A.fumigatus
cttcttgacacatacactctcaaaacggccctttcctccctcctcccggcaccagctccagcaagtttcgtaaagcgcgtcaacgccagcttctcaaagatcgaaaccctcctcaagaccctgcaagtccagccctcgccccccgaagccctcgtccaagcatatctcatccatatcgcggaccgcaacaatgcaaatttccgcaagatcctcgaccttaagggcatccgcagccgccaggagcagaatcagctcgtggaactattccaggtccatcgcacctccgatcgctacgcctcgaatcttcagcagagcaaccccgtcctagccgccatgcagaccactcctgccctctcgtcgagttccgtctcccagggtctcggactaggagctgccgcgtccattagcgcctcgaatctacccactcgctttgacccgtccatgctcgggtccgccctcatctcagcggccaaggacggcgttgatcgatttggcacgccgtccagcggcactaatcctagtagcagcaccggcggcgtatccaccccaccccattctggaacgacaggacaggggcagggtcaaggcggggaaatgagctcgaatttgaacgagaatttgaagaatattgggaaattcttcaggagagatctgggagggtttgggggtagatttggcggtagttga

SEQ ID NO: 9908 - DNA, 318 bp, A.fumigatus
ctctttgatgctttcagcagcgccatcaagaccatcaccacggtctccctggcccttaactaccccactctgccctccgtcatgcactctctcatcaacggctacaagaaggtcctcgctgtcgccatcgagaccgactacagctggcccgagattgaggagctcaaggaccgtatcgccaaccctgacgcttacgctgccgctgctcctgtcgccgccgcccctgctgccggcggtgctgctcctgctgcggaagagaagaaggaagaggaggccgaggagtccgacgaggacatgggcttcggcctcttcgactaa

SEQ ID NO: 9909 - DNA, 201 bp, A.fumigatus
ggtcaatatcgggatagtctcaatcaaagccatccagtctccagacaccagtggctcaccaacatggcttctattcagaattttttgctccgacgttcctctgatgacttactgtacatagattacttatggcaagaaatctatcagcctttctctgtgcttcagtctcgtcttcttttcttcaggttgatatcagattga

SEQ ID NO: 9910 - DNA, 1401 bp, A.fumigatus
ctgggccttctaaacgctgacttgttccacacagtatggttcaatggtgggccgggttgttcgtcgctgatagggttgatgacaggcaatgggcctgtcttgctcgatagcaataccacccatgtcatcgagaacccacaatcatggacgaagcttggccacgttctctatgtcgaccagcccgcaggaacggggttctcaacggcaagcaacccatatcccgtccgggacaatgaccgcgtaacctcggatttctacaaatggctgcagtccttcttttcccactttcccaattttcgctccaagcgtgtccacatgataggggaatcgtacgcaggaatttacatcccgtactttgcttatgccatcgccgagaatcaggacaattacccgatagacctccgttccatatctttaggggacggcaccctgggcaatcctgctgccatgacagccgtcacagtcggcacgtttcttaaatccagaaagagtttgctgcagataccaggcgagatcttgtccgcgttcacacaagccgaccagacctgcggtttcacaaccgtcctacaacagggtagccagttccctccgaagggcaagttcgagatcgtaggggacccagaaaacctcaactacaaacaccggcatcgtcgccaccggtttcagcaggaccagcgccgcaatctgcgaaacgtaatgaatgaaacgtgcaacaaccaccctaccaccccagagcaggtcagctcgtccatcctcaactcaacctgttacggctcgtgtgcgacctactccaccgccatgaactacctaaacgccgtctccgctgccggcacagggaagcgctgcttcgacgtctacgacataacgaacgactgtaccatgatagacccactcggtctgatggcctcgtatctcagccgtggcgacgtccaagctgctctgaatctgtccccagcaccagccggcctggcgttcgcaccctgcaacagcaccatcctcgacaccctgctgctagccgttccgcccacgccgccggcgtacaccatccttccttccctcgtgaccgagcacaatatctccgtccatgtttactctggcgacaatgacctgcttctcaaccacctcggcacagaattggtcctgcagaacatgacctggggcggcgcccagggcttctcgcggaaacctagtcgaatcttctatgtagatgacgcagcgccgtccttgcatggtgctgatgcttgtaatgtcagtgtgagccatgattctactgggctgtcggaaggagcacagcgttgtgtcccggcgggcatctgggcctcggaacgtggagtcacctaccatcttttccgaggcgctggacgtcttcaccacggggctggaaggatcagcggtggacaa

SEQ ID NO: 9911 - DNA, 183 bp, A.fumigatus
ccatcatcagcgtgcggtgtgacttttattctcttcctcttggcactccaatctagacaatacaattctcagcttattgagttgtctgtcaacctgtgcaccttacgtaccagcttattgagttattcaagcttaagcgtccatagaaggggtcaaaatgttgtctgtcagcaccatcactga

SEQ ID NO: 9912 - DNA, 207 bp, A.fumigatus
cttcttaacccttccactaccagaagtgcagaagaagctgttagaaataaatattatactctttttccttctcacagctatattattctctgtactttgcctataaagttggatcctaggaaaattatctgctctggaaaaggctttagtaattattctaatagctgtttcaaccgcctcatttatacattcagagtttcacaatag

SEQ ID NO: 9913 - DNA, 357 bp, A.fumigatus
tggcgcctttgctattttatacttttaggcacctctgcaataaaaatcctttccttattcctagactacagaatagagactttctttaattttactgctgcttgcatgggatatagaataattactatgctcctagtggctcacgcaaagttatcaccactggctaatcatacattgctagcgtctacctttatcaaattagtggctatgaatacttgtagggccctgatttacatctttcaagtaccagaaaggctgggggaactagtctccagcaaacttttgctgcactgcatggttgtctattcagtgatggtgctgacagacaacattttgaccccttctatggacgcttaa

SEQ ID NO: 9914 - DNA, 705 bp, A.fumigatus
agcgcgttatccttcttatccccgtcggtgaggcacattggatccgccagcaacagcggccatgccgagctggcccagcgcaaccgcaaacactacaaatggtactactccaccgcttctgcaagcaacgagatgaacctccccccgggtcgactccacgagttcctgcgaggatactttcacctgaagagtggctcgtgcgcgcgcaactgcccgcgtccgttgaagacctggacagcagatgaactattacaactaccattctactatattatgccgctggacgctaccatgcccgaagctatcgcgctggacatggaaaacgagccggagaacgcccagcagctttcgcaggcctggctaccggattccgatctggaggtctatgtggcggagtacgggcggacggggttccagggcgggttgaactggtatcgagtgcggacggcagcggatggccggtttacgcaggatttcgacactttcgcggggaagaagatcgaggtgccttgtgcttttgtgtcgggggagatggactggggcatctaccaggaaccaggggcgttggagaggatggtaaatggggaggtgtgcagcgattttaagttcctgaggttgatcgaaggcgttggacattgggcgccacaggagagcccagaggaggtttccaatgcgattctacgcctagtgcgtagtgtcgaatga

SEQ ID NO: 9915 - DNA, 597 bp, A.fumigatus
gcgtgtacacagctaatgtataatcgtcttatttttgcaggcggaggtatgccgacaaccactaatcgaacgaaatggccggtcggaggcggcgctattgccatccaacctggctggttccagggtcatcaaaccgccttcatctacatcaacctgggcctgggcacaatccctccgaacatgagccatccgatggtccctcccttccagattacaggtccgaccaatgacccttatcctggtactatctgcctgccacaagtcccactgccggcaaacacgagtgtgaagccaggagatcacgctactatccaggttatcgagactgccaagcacggtgcagctttgtacaatgtacgttccccgctctttgccagatggctgaatctgaccatgatgcagtgcgtggacattgaattcgccgagccgtcggaggtagaggaagtgacgcgtgacaactgcttcaactcgagcatcatcagctttggtgaggtcttcacaacaacgtcgctcacatcagcagcggctcccaagtcgtcgctgatgagcgtgctgcctgtttacatggtagcattgctcagttgggcgatgatgtaa

SEQ ID NO: 9916 - DNA, 195 bp, A.fumigatus
cgaacttttcttctccagatatatgcttacgacaaactgattagtcctaaactctattggtatattgtgtataattgctcagcaatcgtacatgaagctagtcatacatggaagccatcgtctagtgctctggacaaggagcaaggttgctcggccgaagccatccaaacccatgcccgagagtcatctctttga

SEQ ID NO: 9917 - DNA, 1065 bp, A.fumigatus
tcttcagtatcatcgctacccggttcgaatgcccgcggagaacccgtcaagctcgtctctcaaacgcttccctacccatactcagcagaaaaacctacaccgcatcgaactcacgagggagtcttctcatccctcgtccaagtaatccaaaaccgcctccgtcaaggacagtcgccttatatcaatgtcacacatgcggtccctgaacagttcagtcttacgaaccttcctacttcaccaccggggtcgccgcgctgtatgcttcccaacaatgactacttcaacgccaccgtattttctagcgctgcggtggtctccgcataccacgacttccgaggccccattcagatgaaagctccgcaacactttccaatgccaattgttccgcctcagtcggtacacatctcagtcctggagcgctacatcccaccttcgtcggcccaggaatacaatgatctcttctccccatcgcgaccatctttcctggtagatcgcctgtcggaactttctccggatggcggttcgctgctgttcatttacccaaccagaaggggtggctcggccttcaaatctcagtatctcggaccgatcctcgatcctctgcttcgacaactcgtcgtggtcaacgaactctctgccgatatcggtcgatacttgggcaagttgtcttctgtctctcatatggaggattttgacactctcaagaacaatctttccatgttatgtcgtgcattgagctcttcttcctctcagttcagcatcgtggatgcccggaagggcagtgcctatctcgatcgggacctctggactgagtggtacatccatcaagagaaggctcgcatgaaagaagtgctcagcctttactgccagaatggtcgtcgcttttcaacacacaaggcgacgtcgtcgagtatcgccaatacgtatatcctggccgcggacaaggaagtgacctcggccatgttactgagcgagattatcgacggcattcgcagacggccctacgagagtgagcctcgagatgggattgaactcggagtatttgtcatccgtcgctcacagtag

SEQ ID NO: 9918 - DNA, 1215 bp, A.fumigatus
gagtattctcctttctcttttgcgtctggggcatgtggatcacttctgaggaaagaaaagccgatctctgcttggactttctgctcgatgaatccttgttttatcactatttcagtcactggagcccaatggtgcgcgcatactttcagcgtctcctatgttggcgggtgtgtaggtttaatggggagccctcgccgcttgactcgtaagtacaagccctctggtatccgtgcgtctgccttgggttcgctgaccattaacatcatctgtagcacaatatacgagacgctctggaaccggctacaacgggtttggtcttactatcgcgactttcaagcaaacgctgaaaggggacttaaacccccgctatcgtctgcaccatgttcgccagcgccggggcgccggatcatcattatacggtgtgataatcacattacgccgccgagtctcttcgtctccttcgaccgcgtcgtgccgcccgctccaaccgaactgacggtaggctccaagggcgacgatttctccgagtctcaggcagctccgaagagaaggtggaatcttctgaaggcgatgtttggcagttcttccagcatcagaaacaatgacgacgcatcgcctccgagcactagttcggaagattcggattcaaggagccacgataccatgaacggtacagagaagaactcggacgaccatttgcgaccgcagaatggcacgggagagagtagccgaccgaagacgccgcatcagccatatactttcaagttctcgctggaatggatggacaggccgcaatggccgagcaagaataagcgtctctacggcccttgccttcctgtaggagcgcagctgcacttgcagctccgaggatacttggacagaccggttgatgatgcgtcggaatatgcctctgcaattgattttgatgaacgcgaaaagactgactgccgtcttgaggatgcagcgtcagacaaagagatacaggggccagcacaggatgctgcggacggtgggaagacccttggtctaagaaatactcggtgccttgcgaaagacggggtcgtggccagcaagtatgcaggccgagccctcgccgaatgggcgcaaattgtcactgagtgtgacagtttctttgccagaagacgcgacgagggtgtcccttgcgaccggatggtggagactccaatgctgggcgttgaaggcttccgcaagtaa

SEQ ID NO: 9919 - DNA, 1287 bp, A.fumigatus
gcgacccatgaatactctcgcgcggcatccttccagccccgtggtgaagactctgactcctcgggctcggatttcctgattgagtcaatccatcacaacatcaggaatatcttcgttcagaatctgctgtctcagatggccttcgtggtggagagaatgtcaatgaggcatgcacctgctagcttggtggcattctgcgggaaggcctgcgcatacgccttcttcttctgccctggcgtcgcagatattctagtgcgcttatggaacacccccgcgagtatttttcgacggatccttgccgattccggcgtagagcgatgcaggaacattcgtgctttcacccaggatctcgggttaaattttcccatcgccctccggacgctatgcttccattctcacacacctctcgttcgatatcttcggcaaaaacccgacgtgcctttgagtacagctcagatacaatggcaaagcccttgggtttcgaggtggtgtggtcgagacacagatcttttctttgtctttgtcaagtatattcacatactctatgcagatgctctgccgacagatattgagaaaccaaaacgtatcctagccccgggtctgttgccaattcacgctcaggtgcttgtagtcatggaggacactctctacaaacaatcaagtccacagatgcctgagagtacgcacaccgccgcagccatcacttttgatgacttcattgagggtgccgatgcaacagtatctgctcttccgttaggctctgctaacagtcaccggtcgatggctgagaatcgcctgatcattcttctgcgtgatttcttgtctgaatcttccctcgagcctcaacgcgcgcggttactgtacgcggagtccttctgcaacatcatgaaggctgccgctcagaagacttctttatttgaccacaatgcatgctttttgctgtgcgacttcgtcgaggaggtccttcccatcctcacacgctactctcaagctgtggatatggaattatttgactggaagttttggctttcggcttgccgccaaatgatgcggagtcacaattctcttaccgaagtaagagtattctcctttctcttttgcgtctggggcatgtggatcacttctgaggaaagaaaagccgatctctgcttggactttctgctcgatgaatccttgttttatcactatttcagtcactggagcccaatggtgcgcgcatactttcagcgtctcctatgttggcgggtgtgtaggtttaatggggagccctcgccgcttgactcgtaa

SEQ ID NO: 9920 - DNA, 696 bp, A.fumigatus
gacaagacatcgaagtcttcctgcgaattcacctccggatacggcgttgcttacaagcccaatgtttttaactggagtccaagccatcccgctcagtcgcctctgttcgacatccctggcattaagctgactcctggccgcgccttcactcccaccactgtgacccgtttagcggatgccaactttgtgcacctcgagcaggaaatccctgcaaatggggcattccgcatcttcatctttgccggtaaacaggcaaacaccaagaaagcgatcaccgactttggagccaaccttgaaaaggagcggtcattcctgtcttcttaccgccgtattgatgagatctccttttttgagcgccatctgccccactccaagctgttctctatctgcctgatctacgctgctcagaagaatgaggttgatgtggaggctatccctcagatcctccgcgattaccaccatcacatctacgccgacgacattccagacgtgcgcgtgcctctcgccaagtttgccgcccatgagaagcttggcttcgaccccgaaaagggaggtgttgtagtcactcgtcccgacagccacgttgcctgcactgtgcaattggtggagggcagcggcactgttgatgctctcaacgcatacttcaactctttctccacaaaaccccttggccaggaccagcaaagccgtctataa

SEQ ID NO: 9921 - DNA, 195 bp, A.fumigatus
gtgtattctcgatcctcaagccaggctagatttctgacgatggatgcgcagggagaatgggaggcaaaaggcattgattcatccacgcctttcactggtatagatttgtccgagggagaatggtatgattatgacgagaaagccggggaggaggtctccatcaaggaaatcaagtgggaggtaggaagaggttga

SEQ ID NO: 9922 - DNA, 237 bp, A.fumigatus
gacgacactgtatccagtagcaataagttcacccatccgattgtcattatccttggtcctcgcggaattgtctcccggtgcttcctgtctattgtggccatcgttgcattcagatctgcgagaggcgtctgtcgcgtctgtcgcgtctccgccatcgataactctcttcctgccgtcagcaacgccgccctcatcccgctgtcgtcaggtgctctctgctttcccccccctgggtga

SEQ ID NO: 9923 - DNA, 273 bp, A.fumigatus
gatgtgctttgtaaacacaatcataactgctgtggttttagttttctcgacgagtcgaaaaataccgatcttatacgatggtccgatgacggaaattcattcatcgtgttggacgaagacgaattcgccaagactttgattcccgaactcttcaagcacaataactatgcttcttttgttcgtcagctgaacatgtacggattccataagaaggtgggcctgtccgacaactcgatgcgagccagcgagcggaagaatcttcccacgggctga

SEQ ID NO: 9924 - DNA, 264 bp, A.fumigatus
tcccggattggccgtcagagtccaaaagctttggtaaatgatgtcgtgagccccacagaagatgcgcaatgggacgtcgaatcgcgtatcagcgagcctgatacggagagtggaactggggagatgaagttgaagatgaagagatacctggagggattccccttcccatactacctggttgttcgtgacgttcgggagttaccggctgtgctggctacggcgttgaaacaatggtttgcagaggttgttgatgtatcatcgtga

SEQ ID NO: 9925 - DNA, 2262 bp, A.fumigatus
  unsure (271): Identity of nucleotide sequences at the above locations are unknown.
gcacaagttcttggtggattcttcagcgtcccaactgacgaaagctcctggtctccgcgtttgaaactgtacttccacgccgtcacgcaatgtcaagcacgaacgaaaaatacacctttgggcactgtcatggtaactgacctgagctcgtttccgtttgcgctgacggtcatcccagtccccgacggtgacatactccgacacaaggaagattttatcgtcaatgagaacctgaaacggttctcctgcgccggccgggccggcctaaagntacaacctccttcacctgcgaccgtggcaaagttttatcaactctatcgaacgagcgagcgagtacctgtgtattctgctgtaatggagctcgtcaaacaatgccagattgcgctgtcaatgtttggtctcttggcacctgaatacgtggatgggctgctctgcgatgttaccgagactgcgatcaatgattggtggaccgagtttgggattgatctatacaacatcgaaccaagtgacggcgtattagggccgacaactgtagcggcgttgctgggcacattcatgggagctcgaaatcggcttcatgccttcggtgccccggtaggaaaagacgccttcgatatacgcagtcttaagagggcaatcgagagctttcaaaagtcacagaagatggaacggacacgcagactggaccgtcaaacgctcgatcggcttcaccgtgtaactgccaaggcggcgaatgcagaaggctggacggatgctgtcaagtcaacgatggctgaattgagcggacatgggggtgagatggtcatgggtatggtacggggacgtgaaaaaggtggcatcgccgatattgagaccctggagctggacgatttcgcatcgctagttacgggtgagagagcaaagtggctgtggagagggaagccacgtaagagtgggcttggtgatggcttcgctcatgatcagcctgctgcggacatgatgttcaacagggatgaacagggcaactatgtttggacaagtaggaaacgccattcatacgaagatctggctggtgaccgatccttgcaaggctcagaccgtccgtggaggcagccagacacgggggcggcaccggacgaaaaggatcagaacctcagtcgcatggttcgaaggggtgttagtggcaaggtgtcggacgcacgaatcggatttggaaggttcaaagaagcagttggactgccaagccttcgatctcagcacaagtcgacgaaagacggggcggagttgatgggtgatgcggcttacatgccagcgattgaaagcgatgcggagatgcctgtgctaaaaacacaggctgatgctcacctgacggatcaggaaagtatttctgagcctcaagaccaggcacggtttcacgcagtaaaggcagagcaaccagcgagtactagtggcccgacagtctccgaattggaacctccgaaaatcactgttgattctccgcgtgataatgagaagactgaatcagcacgaaaaacctcgacaagtcagctggaagaggacgagtctgatctagggcgatccaggacacgatcgaccgatgcatctgttagtcaggacgaactctctcgagtcgatctgatgctattgcgccgaccacagagtttcatagaatcctccacgacagatgactccgaacgtagaagcaatggttggcctcgccacctgtccttcagtattgttgaagacgtcgtacttggctgggagagcctgggcggccgagaagcattgcagcctaagccagatgccactctagagcaagccgttgcgcttgaggatacgctggcctctgatgtacgaatatttagttccaaaattgaggagctgagccatcacacagtcccttgggtggaaaaacaagtgaactcggtggatgaattgaaccggaagctctatgagtcacaggagaacatcaactcgatctacctagaccaggttgagaaataccagcaaatgagggaacgctccagtgagttgctgacggaggagcacaactaccttgttgataccatgaagcgcgtcgagatgatgggagctaagctggattatgagctcgacatcctcgagtcaaaagtcgaggatgtggagagcggcctcggagaattcgagcggcatgtggtggagcttgaaacaagaatgaaaggattgataaagaacgaggaagagaaacaaaacaattcatggttgtcgctgttgggaagatttcttggattgtcttctagatga

SEQ ID NO: 9926 - DNA, 327 bp, A.fumigatus
agacttgatgaaattgtcaatggctctgctgacggatcattcccggggctcattccactcgtggaatcgtacctgaatagtgtcaatgtggacgtggagactcggtgttccttagctacctaccttgacctcatcaggaaacgagcaaacggaaccctctggacaggagctcggtggattcgcgagttcgttgcctctcatccttcgtataaacaggacagcgtggtatctgaagagatctgctacgaccttgtgaaagctgttgaagagatgaccgtaaaggaaggcagggatgggagtgtcggatggcaattactgaggggctaa

SEQ ID NO: 9927 - DNA, 636 bp, A.fumigatus
tggaacagccgggggaatgtcgaccttcgatcaaatgaaggtctttccccggaaccggcagctctttgccattcactggcacaggtgcacacagcgcaggcgcaaaaaagctcttttcgcttctacaccagcacctccaatcaattccacaagtccacaatgtgttggacactaccgaatcaatctcagcgacaatcagatgcctcgacctcgactgcctgcaacctgacagaggaggtcgacgccattgtcacagtgacaaaaggattcctctctgccttggaaacaaagtctcgcgatgacttcgacaagtactgcgtcaaggcaggaggaatggctctctggccaccgccacccagcgtgccacgattctgcaccattggagcctttgttgagcacatttcaaagatcaaggacgatatcgacgagcgcatgtgggaccctgaagtgaaagtgcacgagtcggcgaatctagcggctgtgtgggccccgttcagggcgaagatcaatggggttgtggaccatgtcggtgtcgaactgttcgtcctccacaagattaatgggggatggaaggtgactggcctggccgattcgtgtcgacggcccacggacgacgagaaaatttcactggtctga

SEQ ID NO: 9928 - DNA, 336 bp, A.fumigatus
atacgggctggagcttttctgactcattgcctactcttgcaggataatgttggcctcacggcaaacacgagctcactcgttggtggagtgattcagattatgtttgtcatcggtaggatttatctcgacatattcgtgcacaagacgcaaaacattaatcatatcgctctaggttcattgtatcctacactgtatgcagaccgccttggacgtctaaaccccatgatgtggggatcattcggtctatgttcttgctttttgatgcttgccatcctgtcttcgttcgaacgtatcttcaagtctcctttccgagcacttcagcgctttaacgtttga

SEQ ID NO: 9929 - DNA, 198 bp, A.fumigatus
tcttctaactcgaatagacaatccatcggagtgtccgcaaactggctctggaacttcttcgtggccatgatcactcccatcctccttgagaagctgcgctggaagacctatctcatcttcatgtgtcttaacttctcctttatacccgtaagtggagccgactatcccagtccactgaccctgaccgtcatgtactaa

SEQ ID NO: 9930 - DNA, 183 bp, A.fumigatus
attgaagccatcgcaaatgtcgtcctcgtcttcacggagctcgtcggctcgaagcacgacatcagcgaagatcccattgtgacggtcccatctgaaaccatctaccttggaggaattgacctctatcttacttccaaggacattcttgcggaaccattcttcgagctgatctcgacctcttga

SEQ ID NO: 9931 - DNA, 216 bp, A.fumigatus
aaggatgacaaccctcttgatctgagcgagccgtttcgggaactttgcgaagcgtgtcgcaagggggacctgaaagtctgccaggaaaagatcacggaaggagttaatgttaatgctcgggatccttacgactatactcccttgattgtagtaagtaaactatcccttgaggatcgccggaatgtgaaacccgggagtttgcctttatcattgtga

SEQ ID NO: 9932 - DNA, 966 bp, A.fumigatus
tcatctcggactaatactcgatttcattgcagatgcctatataacgctttgaacgatcgtatacgaaatttactgcttgaatatgattattcgaaatctaccgatccccttcagccccttgccgcccatgtatcgtcgctactcactcgagatcaacccgggacgtctgatattgtggtgacagctggtgatgagtccctgtatttgcacaaatttatacttgctgcacgttctccgtactttcggggtaagttggtagctgaccccaagtctacgacatggaaactgccgagcacgatcccgccgcaagcattcgggacggcaattaagtacctgtactttggagaggctcctcgcgacttgagaagcggacctggtacggggtttacagagtcagaggtcttcgcagggattgacaggatctccaagcacttggagattccgagtctgctggacagcatcctcgacagtggtgacaggaggttagccaggcagcgaaggtcaatggagctttcaagaggtcgagatcagctcgaagaatggttccgcaagaatgtccttggaagtaagatagaggtcaattcctccaaggtagatggtttcagatgggaccgtcacaatgggatcttcgctgatgtcgtgcttcgagccgacgagctccgtgaagacgaggacgacatttgcgatggcttcaatctaaatggaaaacagcaagacaggaaatcagttttgtttccctgccaccgggccatgctgcttcggtccgagttctttcaagctatgttttcgtctaccttccgagaggcacacctgaaggagcacctgaatgtcatacctgtggattgctctcctgaggttctggagattgtgctaatgtttctgtacacggaaagggcggatttcccacttgatatcgctgtcgacgttcttttcgccgctgatatgctgtttatccagaaattataa

SEQ ID NO: 9933 - DNA, 633 bp, A.fumigatus
accaaggcaccggtcgttatcagcacacttggcagcggtgaaatgtctcacgcagaagctgcaatgactcggggtaccaacgaagaatatgacattgatatctacgctaacatccgcgctgcttggttgactcgagtccagcgattggaggagttcgctgcacgttatcttgcgtaccgattggaagctcatattgactcacctgaattcgctgaactgattcaagagtcagcagctcgtatcaaggcaagtcaagaaactgactccattgagctgttggacgacatccggttctacttgggcgagcgcttccgacttagattcgatgatgctggcctggaagagatgatggaagaggaacaacgacaacagctggctgattctagtggcgtcgacaaagacttggtagagattaccgataaagtggacacaatgggcattcaaagtcagactctgcccatcggcgcagaagcagaggtcacgcctggtgaaatgattagagaacaaggccccatcatccggactctggatggagaaattgctggcgatgaattcagcaaggatgcgatcaactaccagatcctcatggagaaactggatctcctcttgaaagagctgaacttggaagcttga

SEQ ID NO: 9934 - DNA, 189 bp, A.fumigatus
gctcagacaaactcaaactacccgtctcacccgccgacccgagccgcagtgataagaagggaacagactattatgttgtctgtgctgaaggctgtcctcatacatgagaaggttacagtcgagcacgaattggaggacaacgctgcatgctctctggctcaaagcatgtgtttgaactccagcaaatga

SEQ ID NO: 9935 - DNA, 327 bp, A.fumigatus
atttcgtgccagttctttttcggggtttttgcataccaatcggagaagatgattttctggcgacaatggttgggccttaagtcggtgtatggctactggtcagcgcccaccacaaatcgcttcctgggagttaaagaggcgtcgcaggctctgataggattatttccgtctcacaccgttatgattttttcacctagcctgatcgacacgctggtgacctcgatcaagggtgcggggatggaaggattgattggtgcgatattctacgagcccaaccggtcgtttgaactgtcaaccttggctgaagctgagcacggcctcttttga

SEQ ID NO: 9936 - DNA, 306 bp, A.fumigatus
agacttcccaggcaaagtaagtattggttgagccctggaattatttcgtatgctaaccaattcctgaggttcgatcttttcgtcaaatatcaaaccaaaatccacaaagaagatgtatccaaatggaaacagaaggatttcaagcgttttctgtgctccggcattaaaaggtcgcccgcagacgctaagtctgcgcaacgaaaattaggatcgtggcatcaatgttaccggcttgacgggaagctcatagcggttgcggttttggacttgatgccaagtggtgtgagctccgtctatatcttgtga

SEQ ID NO: 9937 - DNA, 366 bp, A.fumigatus
gaacgaaatgctaataggatccgagaccccgagagctacacctgggacccgcttgacggggagctaacgatgaagctgaacgaacggcgctacgtgtctctgtcccgcgacagacgattggccgcgcagggccagccagaatctacggagctggattcggcggaggaagagatcaacgacgaggagatgtctctgtttgacctgcacatgcccggagtcatgactctcgatgaggtaaagacgctagatctggaccactcgctcctcctcgtgcagggctcgcttattcatatgatggtgagacgctcttattgccggtgcatccaagctggcctgctaacatggctggactctaggatcttgtag

SEQ ID NO: 9938 - DNA, 846 bp, A.fumigatus
agaccaccacactcccttcctcaatcgccctcattccgcatccaccgtgcctcccgctcctcctcttcatcgcgcccagctctctcactcgacctctccaatcttcctgctctctcacagccaactcctccctcaaacacgctactaataaccgacctccacgacctctacctctttcaaccggcctccctcgcctccatccgctcccagatcgagtccatcgcccccctaaactccttctccccgctcccctccttgcggcgcatcgtctgctcctttcactcagaagacgacgccctccgcgtccgcaaactcctcgacggccaatccctcctcaaccgcaacgtctgcacaaagatctacttcggcgaacccaccccgctcctcgacgagggtcgccccaaactcctcgaggccccccacctcgacaagctcttcttcatcagtccgcccccgagcccgccacacggctgggtcatgcgcaccgaggatccccccaacaaggaggtccacgccagtgatctcgcccaggcgcttgcgcagctcaagacggaacaatctgctccggtctcaggccccgttgaccccgggacgcccatgtcgatgtctgacgagaagcggacggggagctggcccatcgccatgtcagggcagcgcagtcggagtagtacgctgatctacaatcccgaggatcatggtggtagtcccggtttaccggccgtgatggtcgaggatacgacagtcgattccgacgatgaggatatcgagatgatgagtccgattgacatgtcggttagaaagctgccgccgaagacggcacgcccgccggttgagttgatgcattga

SEQ ID NO: 9939 - DNA, 444 bp, A.fumigatus
actccttctccccgctcccctccttgcggcgcatcgtctgctcctttcactcagaagacgacgccctccgcgtccgcaaactcctcgacggccaatccctcctcaaccgcaacgtctgcacaaagatctacttcggcgaacccaccccgctcctcgacgagggtcgccccaaactcctcgaggccccccacctcgacaagctcttcttcatcagtccgcccccgagcccgccacacggctgggtcatgcgcaccgaggatccccccaacaaggaggtccacgccagtgatctcgcccaggcgcttgcgcagctcaagacggaacaatctgctccggtctcaggccccgttgaccccgggacgcccatgtcgatgtctgacgagaagcggacggggagctggcccatcgccatgtcagggcagcgcagtcggagtagtacgctga

SEQ ID NO: 9940 - DNA, 522 bp, A.fumigatus
aagaccaccacactcccttcctcaatcgccctcattccgcatccaccgtgcctcccgctcctcctcttcatcgcgcccagctctctcactcgacctctccaatcttcctgctctctcacagccaactcctccctcaaacacgctactaataaccgacctccacgacctctacctctttcaaccggcctccctcgcctccatccgctcccagatcgagtccatcgcccccctaaactccttctccccgctcccctccttgcggcgcatcgtctgctcctttcactcagaagacgacgccctccgcgtccgcaaactcctcgacggccaatccctcctcaaccgcaacgtctgcacaaagatctacttcggcgaacccaccccgctcctcgacgagggtcgccccaaactcctcgaggccccccacctcgacaagctcttcttcatcagtccgcccccgagcccgccacacggctgggtcatgcgcaccgaggatccccccaacaaggaggtccacgccagtga

SEQ ID NO: 9941 - DNA, 396 bp, A.fumigatus
  unsure (365): Identity of nucleotide sequences at the above locations are unknown.
tcagtctcatcaaagtttttgatcggctacactatgagcgaaaaggctcgcctaaaatgtactgtctatgtggggggtctcgaccaggccgttaccgtgcagacactggccgaggcattcgtcccatttggcgaagtcgttgatattacgctacctaagcctgatgtgcccaactcaggcgatctccatcgcggctttggatatgtggagttcgacttgcctgaggacgctgcagaagcgattgacaatatggatggaagcgagctgtatggccgtacaataaaagtcgccgccgggaagcgcaagaaggaaagcaccgagggactggaaagcaagccagtaattgggagcaaggtagatcactntgatccgatcttacacggacgttgtagctaa

SEQ ID NO: 9942 - DNA, 195 bp, A.fumigatus
atttctttgcctgggcccttcagtggcatgaatgatgtcacgtgcatccgcagatgttttggcgaggtcccgatggagcttagcgtcactcccccggtccccctccagaaggacacttggttgcttgagcccaaggcatcggatcgttcaggtctcgatcacctcttaacctataagctcctttccgtttactga

SEQ ID NO: 9943 - DNA, 978 bp, A.fumigatus
gaagaatcccgagttccaacacaatggggggatttctactggtgggaaaagaggggttccttgggggcctcgccccgattttttctttgggaccaccttttcctttgggaacattcaaacaagtaccctgtatgcttcgggggggcggtgagggcgttaatgccaacaccctttgacaaaggcatccaagtcgacccattggatttcgaaggtgtggcccaggggggccagaccattcctaccgatgatgaggacgctgagggcaatggtcatgggacgcactgctttggaaccattgccggccggaagtatggtgtcgctaagaaggcccacctctacgccgtcaaggtcctcagatcaagtggctctggtaccatgtccgatgttgttgctggcgtcgagtgggctgtcaagtctcatctcaagaaagttaaggatgccaaagacggtaagatcaagggattcaagggcagtgtcgccaacatgagtcttggtggtggcaaatccaggacgcttgaagctgctgtcaatgctggtgttgaagctggtcttcacttcgctgttgctgccggtaacgacaatgccgatgcctgcaactactctccagcagctgccgagaatcccattactgttggtgcctcaacactccaggatgagcgtgcctacttctccaactatggaaagtgcactgatatcttcgctcctggtctcaacatcctctccacttggattggctctaagcacgcagtcaacaccatatctggcacttcgatggcgtctccccacattgccggtctgttggcttactttgtgtctctgcagccttctaaggactctgccttcgctgtagatgatctcactcctaataagctcaagaaagatattatcgctattgctacccagggcgctctcacagacatcccgtctgacactcccaacgtaagttaccacttcggtgattcggcactacttgtttga

SEQ ID NO: 9944 - DNA, 1239 bp, A.fumigatus
ttatgtgagtccctcctgcttatccttcaatgcatgagactaactcttaatgtctcacagtacgccaaccagcagtctcctgacggacctgctatgacgtgggctatatttgcaatcactgcaaatgatgtctcaccatccggctgctctgcctatacctaccatcaggactcttacgacccgtacatgagagctccgttttaccaactgtccgaacagatgatcgatgacgccggtatcaacggtggcactcacccggcttatccctttttgacaggacacggtggtgccaaccaggtcgtcctcatgggatacctgggcctgagactgcttcccgatgatgccattcatatcgaccctaacctgccccctcaggtttccaacttgaagtaccgcacgttctattggcgcggatggcccatttcctcgagctccaaccgcacccatacgactattatccgagcggcaaaccttgcgcctctcgacacggcagactctcgctttgccaacgcctccattcctgtcttggttggcgaccccagcaactcgactgcctaccggcttccagtcacgggccccctggtcgttcccaacagacagatcggattcaacaacaccatccctggaaacatggtgcaatgtcgccccgtgtactcgcccaatgattatgctcccggtcagttccccattgcggccgtcgacggtgcaacttttaccaagtggcggccttccaccgccaacatgagctcgttgaccgtggccctggccgacgtcgagatcaactccaaggtctctggcttccactttaattggtggcaagcccctcccgtcaatgccaccgtcatcttccacgacgagatgcttgaggacccagtggctgcgatgtcttcctcccacgggaactcccgatacagggtcgtcaccacattgacaaacatcgaacaatctcagccttatgacgcccagagcactgacaacaacgaagttgtcttgaacaccggtaatacgaccgatgtgagtttgtcacaaactgtgcacacgtctcgctacgccactctgttgatttcgggtaatcaggccggcggcgaggaaggtgctactgttgctgagtgggctatcctgggtgagagcaagggatcgtcgagtggtcacggcaacaacaagagaaggctggacgtcagggctgctgctgctctgtctgctttgaatgaccgtcggtaccgacagttcaatgcttga

SEQ ID NO: 9945 - DNA, 861 bp, A.fumigatus
agacgcgagtccgtcgtgttgctgaagaacgacaagaatgacagtaccaacagtccaatcctcccgctcgatcgagagaagacgacgcttgtcatcgggccgaacgcagatcttgcggcgtactgtggcggcggctcggcgtcgctgctggcatattacaccgtgactccccggcaggggatcgcggataagtgcggcgccgagcaagtcgtcttttcgcagggctgctacgggcacaaggagctgccgctgctcggggagcatttgaggacgatcgaaactgggcagcccggatatacgttccgggtgtatacggagcctccgcccgcgtcggggagcttcaagggcagcgacagccggacgcccgtggacgagttgcacatgacgaacagttccgcgttcctgatggattacagccccccgcagatttcgggggatacgtactatgccacgctggaggggacatttgagcccccggagagcggcgtgtatgagtttgggctgacggttgccggcacggggctgctgtacatcgacggggtgctggttgtcgacaacaagacggtacagcgcgcgggcacgtccttttttcgggatcgggacggtggaagaacgcggcgagcgttacctcgaggcgggcaagaaacatcatgtctttgtagagttcggcacggcgccgacgtcgaacctgcagcaccaccacggcgtggtctcgtttgggccggggggccttcggctcggtgggtgccggaagctggatacagatacagcgatccagcaggcggtgcagtcagccgcgcaggcggaccaggtcgttgtctgtgtggggttgagcggcgactgggagagcgagggctttga

SEQ ID NO: 9946 - DNA, 474 bp, A.fumigatus
cggttgccggcacggggctgctgtacatcgacggggtgctggttgtcgacaacaagacggtacagcgcgcgggcacgtccttttttcgggatcgggacggtggaagaacgcggcgagcgttacctcgaggcgggcaagaaacatcatgtctttgtagagttcggcacggcgccgacgtcgaacctgcagcaccaccacggcgtggtctcgtttgggccggggggccttcggctcggtgggtgccggaagctggatacagatacagcgatccagcaggcggtgcagtcagccgcgcaggcggaccaggtcgttgtctgtgtggggttgagcggcgactgggagagcgagggctttgaccggccgcacatggaccttccgccgggggaggacgatctcgtcaacgcgggtgcagcggtccaccccaacgccggtgattgtcgtgcagagtggcacccctgtgaagatgccgtgggc

SEQ ID NO: 9947 - DNA, 459 bp, A.fumigatus
cgagatcgtcctcccccggcggaaggtccatgtgcggccggtcaaagccctcgctctcccagtcgccgctcaaccccacacagacaacgacctggtccgcctgcgcggctgactgcaccgcctgctggatcgctgtatctgtatccagcttccggcacccaccgagccgaaggccccccggcccaaacgagaccacgccgtggtggtgctgcaggttcgacgtcggcgccgtgccgaactctacaaagacatgatgtttcttgcccgcctcgaggtaacgctcgccgcgttcttccaccgtcccgatcccgaaaaaaggacgtgcccgcgcgctgtaccgtcttgttgtcgacaaccagcaccccgtcgatgtacagcagccccgtgccggcaaccgtcagcccaaactcatacacgccgctctccgggggctcaaatgtcccctccagcgtggcatag

SEQ ID NO: 9948 - DNA, 330 bp, A.fumigatus
cccacggcatcttcacaggggtgccactctgcacgacaatcaccggcgttggggtggaccgctgcacccgcgttgacgagatcgtcctcccccggcggaaggtccatgtgcggccggtcaaagccctcgctctcccagtcgccgctcaaccccacacagacaacgacctggtccgcctgcgcggctgactgcaccgcctgctggatcgctgtatctgtatccagcttccggcacccaccgagccgaaggccccccggcccaaacgagaccacgccgtggtggtgctgcaggttcgacgtcggcgccgtgccgaactctacaaagacatga

SEQ ID NO: 9949 - DNA, 534 bp, A.fumigatus
caagtctgtttaggtgccctcaaaggaaagctgcaagcgttgaaattcctgtcggactctgacagcttgtacgacactacgcctctggtggacatgggtgtcgacagcctggtagctgtggaagtaaggtcttggttcttgaaggagctcacagttgacgtgccactcatgaagattctgggcggcgcctccatcacggatttggtagaggttgtcgtgcagaaggttccccgggagctattgagtcggcttgatcccgaagggcggcgtcaggacagcaatggcgatgttcctgctactgtgggtgacaatgactctgttgaaacagtgggatcaaagatgaatggcattaacagcgctcatgaaaatggttctagtggtgtcaatggtatcagtggtacttatacacctgatatggatagcactacagaccttaatggtactaatggggctgcagttatcaaggaaatgttagggcataaagccataaagggtgttgttccaatccttctcaatgcacaggaggttgcctaa

SEQ ID NO: 9950 - DNA, 1212 bp, A.fumigatus
acagaagggttccattaccagattctcaccgccaaaatatccgccaaccagaatatgccaatgatcctccaaaaaaaatgtatcttccatctagtatacagagtacagcacaacacaacaacttggaacacttccaagggagcttctcccccatccgggaagggatccgaaggagttccttggcggtggatcaaaatgctccatttacgcatccgtccgctcccccgtctccaaccggcatcatccatccccacccagtctgcccctccttccgacttccacaatgaagacaacagcaacgatgacgactccgctgaggacctcttctctgccttcctccctcatcttttccccgacgacgcgccctccttccatggagaccccggccagcggctcctgtacacctccccgcgctacggcgacctcgagatcatggtgccctcatacccgagccagagcgagcgccgctcggaagagatcgcggctggcctgccgtcagaagatggcagcgtgaatgccgtcgacgagggccgcaagctatttgcgcattttctctggagcgctgcgatggtggtcgccgagggtgtggaaaaggccgacaccctggccacgcgcggtgagctcgacgctgacacagccatgtggatggtgcgcggcgagcgtgtgctggaactcggcgctggcactgcgttgccttctattatatgtgcacgtgcacacgctgctgctgtcaccatcactgatcacccatcgtcgcctgcattaaccggtgctattgactttaacattcgtcgtaatctagcagcgacagaaacagaagtcatgagccagccgcatgaatggggcatgctggaaccagacccgtgggccgttgcgcaccgcggtgccttcacccgcatcatcgcggctgactgctactgggtgcgctcgcagcatgagaacctggtgcgctcgatgaactggttcctggcgccaggtggaaagatctgggttgtggcaggattccacacagggcgcgcgattgtagcatggttctttgagacggccatgcagaatggactggagattgagcgcatctacgagcgggatcttattgccaccagcgaggatgggggcgaggtgcggcgtgagtggatgcctgagcgtgaaggtgaggggccagagaatcggcggagatggtgtgtggttgctcttttacaaaggagagagtaa

SEQ ID NO: 9951 - DNA, 204 bp, A.fumigatus
agggtgttgttccaatccttctcaatgcacaggaggttgcctaagatgaaagattttatacttatgtttgataatattagttctctagatgttctgatctatagactactaaagataatcaaattcctattcttacaagttattataagcctactgctttcaaatttaagacttagaataggtcctttaccctttattcagtga

SEQ ID NO: 9952 - DNA, 210 bp, A.fumigatus
ttacacccaatcgcggatcttccaggccgtggtcaatacgccaaaaagcgcaagaccgacatgctcagcgaagatgaggaggatgaggagaccagagcagcctcagccctgcgcgccaagagggcaaaggtcctggaagagaagctgaagcgggagcgtgtgaggaaccgtgccttggtcggcgttacggctgtctttgcacttgcgtaa

SEQ ID NO: 9953 - DNA, 837 bp, A.fumigatus
ctattggccggcaccgcagagcttttcggcacagaacttgctgcatcgcaaacatataccttctccgggacgaaagcggcgatctacacctggcacggctgcacgctcgaggtcagcgccggcgatacgatatcgacgatagatggactaggatcgggtggtctgaacggcgagggggcgcgtggctatggcgcgggcggctgccagagcgagtatacggccgaggagacgccgatggtcgagtatgcgaatgtgcatttcgcgctggaggcgatgcgccaggaagccaaggcgacgggcaaggacgggccgcgggtgctgattctggggcccgagaacgcggggaagacgagcgtggcgaagattctgacggcatatgcgactaaggtcgggaggcagccgatcgtggtcaatttggatccggcggaggggatgctcagcgtcccagggacgctaacggcgacggcgttccggacgatgatgaatgttgaggaggggtggggaagtagtcccatgtcggggccgagtgcggtgcctgtgaagctgccgttagtttacttctatccgttgcagaatccgcttgaggctgagggtgccgtctatcggcctatagtgtcgcggctggcgctgagtgtgacggggcgaatggctgaggatgaggacacgcgcgagacgggcatcatcgtcgatacgccgggcattttgagcgctggcaagccgggtagtcttgagattatcaaccatatcgtgacggagtttgcaagtaaggctcccttcctgtctgcttcccgtcgctggtcttcaccacgggggccgaaggatccgcgcaaggtctag

SEQ ID NO: 9954 - DNA, 570 bp, A.fumigatus
  unsure (534),(537),(541),(557),(561),(562): Identity of nucleotide sequences at the above locations are unknown.
gcagattgccaaggagcaaagatggctgaacaagctcactcccaaggtcaaggtcagagtcaaggtcaaggtcaaggtcaaggtcaaggtgatgtcgaacgcggcccatcccgtatctctcaacaatcttcaagacgtatctcccgtgtgtcttacaaagaggattgggcgaaccttgacgagtatggcaagcttgtgaagtacgtctcgacctaccgcgagcctggcagggaggagggtgtcgaggaagaaaaagtgaagcgagtgtggtacgctccgtggaagaagcgcaaggtcaaagttaagcatgtagataaagagccgggccaatttccgccagaatggcttattacagacattcgtcaaggcctgcccagctcggaagttcctatcagacgtcgtgtctcaggatggaacgaactcacatctgagaaggaaaacccgatcgccaagatcctgtcctatttcagaggtccaattctctacggtatgacatatgacttcgattcgtcgagctttaaggacagtgacatnatnttcnctacgggcccgggccntaannaagtaaat

SEQ ID NO: 9955 - DNA, 429 bp, A.fumigatus
gcctcattactccatctcggctcgcctggaactgaccactgtcctcagattatcgcggcgagcccatattcgccccccatctatccctataatgactccattcccactgtgtactacgagcagtttgcaaaagaggccgggtgtggccgatcagcatctgccagatccaagcacaagacgacttttgactgcctagttgccgcgcctagtgagacactgcaaactgccagcggggctgtctccgcgtctggaatctttggtaccttcgcctttctccccgttgtggatggtgatatgatccgtgcgcgaccatcggtgcagttactgacaggacaaatcagcggtcggcgtatccttgtcggggtaggtttgtttccttcctttttccggtctgcttcagtctgttgcgaactggttgaccaactgtaa

SEQ ID NO: 9956 - DNA, 762 bp, A.fumigatus
aataacgccaatgatggagtccctctcagcaaccccaacatagtcactcgtgctgcgtttgacgactatatctccaagacattcccccgactgacagcgaagcacgtaacacggctgaacgttctctatggtacggcggactcacaggcaagcgacgacggacctcgctttgataccctaggcacctccggtccgactgcgaataatcagtccgaaatcgctacggggttgcaacagacagtcttcaatatctacggcgaaaccacatttgactgtccggcacagtggctggtcgaggcctttggcggcacttcacgccaggcatggaagtaccagtactcggtcacgccggcatatcatggtgccgatctcaactcctatttcaatatgggggcctcctggcccaatgctggattcaatcacgctttccagaagatgtggggtaacttcatcatgaatgatagtccggtcattcctcttggcgacgcgacggccaacaacagccaagccgtcgttcctgtcggacgagatggtcatctgcactggccgcgttttcgtccaacatctccctggcagatggacctcaacaccacgggaggcagcgtgagtaaggttgtggtcacaccaaacttgacctactacgtccgggagggagacgacatcgtcaatcacttccggttggccaatgcatactcctgggaagggggccgtggacttcgctgcgcattctggagggctgttgcagaccggattgctgtatga

SEQ ID NO: 9957 - DNA, 264 bp, A.fumigatus
ttgggcgcatttgggtttctttcatctgccgaggttcacaaacaaggcgctttcaacgctggccttctcgaccagagatttgccctggaatgggtgcagcgttacatcagcaggtttggtggcgaccccaaacgagtcaccattggcggcgaatcggcgggtgcaggtgcggtaatgctgcagtcactggcgtatggaggagcggaatcgaatctgttccagaatgtaagcctcattactccatctcggctcgcctggaactga

SEQ ID NO: 9958 - DNA, 738 bp, A.fumigatus
cagatcttcaacagctcttgtatagcacaccgcacaactatcctcgcggagcatttatcacccggaacatcctcaactgcagcctcttcgctagcgtccattattctccctaagatcacgcatgacaagcctcagaagctcacttacacacatgagcgtctcttcatccattacatcgcagattcaccctcgggctcttcagacgatgccggtcgtcaggaacccaactcctatgcacctctcagctacatcgtcgtggcgaccgccgaacaaggccgtcgcattccatttgcctttctcctcgagatgaaacgcaagttcctatcgacctaccccccttcgagcactgatttctcttctctccctgcatacggctgcgccgctttcaactcggagcttcgttctcttctccagacatacaataccgccccgccgtcggactcgcttgcttcagcccgacgggagatcgacagcgtccgtgacattatgacagagaatattgagcgggtactggagcgtggtgagcgaattgatttgttggtcgataagactgatcggctcggcggcagcgcgcacgacttccgagtgcgtagtcgcggtctgcggcggcggatgtggtggaagaatatcaagctgatggtgcttctggctgttgtggtggtcttcctcatctatcttttcgtcggtatgggatgcggcttgccagcttgggggaagtgtgttgggcacagtgcgtag

SEQ ID NO: 9959 - DNA, 426 bp, A.fumigatus
ctcaagctccattgtgcgccggaagacggcttcatcatcaaagctgtttcagaaacagccagtcctgagacatcggagacgtacgggctgcattcaatgaccgtcaccggacccggtgcagaaggatacagcaccttcttcgccatcgtctgcgcgaccgcagtgtatcgggataagacatcggtccgcttgcgagctgctagtgaactcagaaggctgctcgctgagatttatcacacgagagtcacaaacggacagtactctcagctccgtggggctgtggctgttggtcaatccgtccagttcttcaactggggcgaggatgggttcctaagggtgtttccctgggcgacacatccgttcgatatcaaaagcgaccattacgctgtccaaggttgtcttgacctcatcgtccaaaatcattga

SEQ ID NO: 9960 - DNA, 1497 bp, A.fumigatus
tctaatcctgttcttcttctctttctcttttttattctgatatactttcttcttcaacaatatttcctacttttcttaacttctgtttttgcttttgtacacgtttctgccatcatgagttctggtatcccaccttggcgtactaccgcatccgcgactgctacgaccgctcactttcctgcacatggtatgtgttttcttactctaatatctttgtatttaatttctaattgtgacctagcaacccctgcatatatccctgttcaagcacgtcgtagctttgctcatacatccaccaccgccatggtacctcagccgcagccaacgacaactcaagcacctcgcaaacgagtagaatggccagccccccttcgatcatatgtacaacgaagcttcgcgcctgagaaccaacttcctggagtcaaccggcaggagatggaggtgaaactgaagggtgttattactgaggcggcggagaagggtcagctggagaagatcaactgggatgcattgcccctaccgcaagtcatgattcaaaacgagcggaaccagattcttaccaacccagctgtctctggttggagtgattcacttttaactgctgctcagaaaccggacaccgttaccgaggacgtttctagaaaaaggaaatcggctgagtacggggacaaagacagctgtccaccatggaggcagactaacaaccatcatgcatttggagatcgaactacttatccctcagcagacaagcgtcagcgtgttgatcataagaaccccagtaagtcaaaagctaatctggaaatgcggaggaaacgtttcgaagaaccgcgggccaggtatggctcttcgccatcctcatctcgtggggaatccccagcgcccagtgccaatcagggacctgttgttggacggtgccaggagctagagaagaactacttccgcttgacttcagcgccaaacccagacaccgttcgaccgctgcatgttttgcacaagaccctggatcttctgaaaaagaaatggaagaaggataacaattatggatatatttgcgaccagttcaagtctctgcgacaagatctgactgtccagcacatcagaaatgagttcactgtcagtgtctatgagattcatgcccgcattgcgctcgagaagggagatcttggtgagtataatcaatgtcagacacagctgcgagctttatatgcccaaaatctcggtgggcaccctacagaatttaaggcgtatcgtattctttacttcatccacacccgcaattggacggctatgaacgatgcgttggccgatctaacagcagcagacaagcgtgatcctgctgtcaaacatgccttggatgttcgctcagcccttgccctgggaaactatcatcgtttcttccagctttacctcgacacccctaacatgggggcttatctgatggacatgtttgtggaccgcgagcgactttccgcacttgcagccatttgtaaagcgtaa

SEQ ID NO: 9961 - DNA, 654 bp, A.fumigatus
gccacattggattcgtcctttatgtcaaagctggacggctatctaaagtcgctagttgctcgtcggtcgctggtcgacaacgtgacatccgggctttctaccgcggttgactccgttggaagcgtcggtaacactgccagcgctgcacagactctgacggacgtggctgggagtgcggcaagtactgtagctagtgtaggggaggatataacgagcgccaccaataagactttggtgaatgctgtagacgctgctctgtccaggacccgcgccgactatccagactttttgattgttggcttgtggagttattgcaacgggagcttcgacggcagtcacaccccgatagtaactaactgctccacgccaagtaccaccttctcgttcaacttttcaggcgcccttggcttagacagctcatgggtagcctctatctttccgtctgctctacaagatgcaattgactattaccacaaattcaccaactggatggtctcggcttggatcatcacagttgtctcgacggtcctcgttttgctcgcgggactcaccgcttttgggtctcggtggggtagtctgattacgagcttctgtgccgtggtaacaactgctcttttccctctgactgaaagcaaacggaggctaacccattaa

SEQ ID NO: 9962 - DNA, 768 bp, A.fumigatus
attaagcagcaaaaggagtccatatgtgcagctggctcgcctcagtacaccggctggctagctgtgggtcacaagcatctgttcttctggtacttcgagagccagaatgatccctcccatgacccattaactttgtggatgagcggaggccccggagtctcgagtatggttggcctgttccaagagattggcccctgtctcgtgaatgaatacggcaacgggacctaccacaacccctgggggtggtcccgctactcatcgctccttttcgttgatcagcctgtcgatgtgggcttctcatacgttgatggaggacatgagctgcctcgtgactcaaaagaggcagcggttgacatgcatcgctttctgcagctgtttgtctctgaggtgtttcctcacctgcaggatcttccggtccatgtttctggggagtcatttgcggtatggaagatgctttcatttccccgtacaaaccatactgacattccagggtcactatattccgtaccttggcgctcagatcatacagcagaacgagctgtagcccagccagccacaggtgcggctcaagtcgtgtttggtgggcaatggcttcatgtccccgagggatacattcttcgggtactgggaaacgctctgcaccacgaatccaggtgtggaaaagcccgtgttcaaccagacgcgctgcgatctcatcgcctcgaacatgcctcggtgcatggaagtcagtgcagtgtgtgtccagaatccagatccggctttgtgtag

SEQ ID NO: 9963 - DNA, 516 bp, A.fumigatus
gcagtacccaattcagtcacggcgccctgtgaaatcgacgacatgtgctacatccaagctgtgcatgttgaacagtatctcaacacgccagcagtctggaacgctctgtcaccccccaaacagatttccgaatacaaaatggtctcggaggcagtcattgacgcctttgcaaaatcttcagacggtatgacatccacttccgatctggttgcctttctcctggcgaaccaggtccattttctggcgtatcagggaaaccttgatctcgcctgcaataccgccgggaacctccgctgggcgcattcactggtctggaagggtcaggctgagtttgcgtcgaagcccctacgtccctggaggtcgcctgttgcagcgacagaccggaatgagacggttggtaccatgaaggaagtttgggttcgtgtgggtaatgcagacaccgagtcacggtttgcacttgtcactgtggatggtgctggtcatctggtgagcacatgtcgagaatacaatccgtag

SEQ ID NO: 9964 - DNA, 276 bp, A.fumigatus
gatgtggtaggctcggtctctcgcagtggtcgctttagtagaactgttaagcgggaggctgatctcattaggcttaccaggtttattgccaccggcgtaacggtaccggggctgtttgtgagagccgcctactggccggaaaaatgggactgggtcaacaatgttcttatgtactggctggtgggcgctttctattgcttggatatagcgtatgggatgtgtttgtggtatttccggaggcttgaaaggatgtcatctcgagtcaagcaagggtag

SEQ ID NO: 9965 - DNA, 531 bp, A.fumigatus
actatcaaaatggatggactcgatttcgacactgctccggtcgagttccaaaaagtgcggtggatagtggagacgccactcattattgccgggatgggatggacgctgaactatttcttcactatccgcaaagcatatcaggaccgcatgtctggtgtctcgctaatagctctatctaacaacctggcttgggaaattgcttttgctcttatcaatccaccacctaatcctctggcgagggtcaactatcctctgtggctgtctgtcaatgcttttgtcctatatgctaccgtcaaatgcgagagagagtctggtctccattcgccgttcatgcggagacacctaccctttattgtcctcatcagcattctaggcctgttgtccgggcatctcgccttctcatcgcatgttggtcccctggcagctctcttctggggcgggatgttttgtcaagtgacgctcagcgcaagtgcattgggtctccttcttcagcgtggccatacgcgaggaatgtcatataagatgtggtag

SEQ ID NO: 9966 - DNA, 306 bp, A.fumigatus
aaagacgaagaggcatcgaaggccatcccatccttgaaacagtcgccatcgctcaaaggcctcaaccaccttgctaccgacggagtgtaccgcagttttagctcgagtggccaggtagtagattataagcaattaagtccagcggatattacaaaggtgctggagttccatgaaaaatatatggactcagagatctttcagaagactaagaagaaatttgacggtgtggatggcagaaatgtgaccgatttggagcaactgcttcatccaggaccggaaagtcgtccagtgagatttagagagtga

SEQ ID NO: 9967 - DNA, 666 bp, A.fumigatus
  unsure (13),(15): Identity of nucleotide sequences at the above locations are unknown.
cgggggggttttntnatagtcgaacgttcgttctcccatccccgtggtgaagacgccattgccctggcgaatacaggtgcaacgctcgccttgatcgacgtcgacgttgaggctctcgaacctaccaaggccgcagctcgcaatgtccaggatcgtcagtcccacgtcgagacctacggattggatatcaccgacccgggcgctgtccagtccacgttcaagtccatcgcggccaccctcggccgcgtggatatcctcgtgaacaacgccgggattactcgcctccacttatttgcggaggaagagggcttcgacgacttctggaggacggtggaagtcaatttcaaggggaccatgctctgcatccacgctgttcttcccggcatggtcgaacagaaatcaggctgtatcatcaatatggcctcgcgggcagcaacggtggatgggccgaagagtgtgggctacaacgcgagcaaagccgcactggtccgcgccactggaagtctccaggaagacctggcgtccatgggcctcggagagcaggtgcacgcttactgtcttcatccggggagcgtgtggggagacattatcactggtaagctcacacacacgaggggtgcttttcctggtatccaggtccaaacacccaagaagtggttcaagtga

SEQ ID NO: 9968 - DNA, 1791 bp, A.fumigatus
tacgttgaccgttatccagttaatggtcgtcttcccgtgaagcctaatatcagggctctatctgagccatgggtgagaagcgcaaacttgagttggatgagcttaccatcccgagcaaatctcggaaacgcccggcgctggatgatgctggtaagatgtttgaactctgggattgaattgactgtggagctgaacatcgctgttgcagatccaatttacgaggaacctcagtcagatgccgattatgtgtcttccgacgaatcgagtgtgaacagcgacagtctccacgagactccagcgacaccaatctctacgacctcagccaaatatccttcagagctgaaaactcaccgctgtcccttcgatggttgcacaaaggcattcaaccggccagcgcgacttcaagaacatctgcgctcccataacaacgagagaatctttaaatgcacattcgaggagtgtgacaagacattcctccgcgcatcgcatctgaatcaccatatcaaaagcgcacacactggggtccgagactacgtatgcgaccgtcctggctgcgggaagagcttcgtgacgggctcccggctccgtcgacatctggctgcccacgatggacgagataagtaccgctgcacggagtacccaccttgcaatgagacgtttcggaaacattccacccttcaaaaacacatcatgaccgcacatctaaagcaaaagcctttccaatgcccccacacggatccgagtaccgggcagaaatgtacgatggcatttgacacagcaggacatctccgagcccacgaaagccgcattcacaccgagaaacggtttagttgcactgaatgctcccagcacgcagagggtgccgaagcaacctttcccacctacgcgctcctacaagctcatatccgatccgttcaccccccgcaatgtcccaactgtgctctgacttgcgcgacgtcccgcgaactccgccgccatctcgaagtcgcccatggcgatgtcagtctcgaggagcgcaagatattcccttgcaccgtacccggctgcgaccgcagcttcaccaagaagggaaatctaaccgtacacatccgcaccgttcatcagggcgagaaacgcttcgtctgcggcgagaccgacctctcgtcctcgaaaaaggtgtccggctggaacaacgacaacggctgcggcaagcggtacgggagcaagctcgcgctggaagaacacatccgcactgcacacctgggctaccaaaacgccaaagccgaacgccggcaacgtctcggcatcacccgcgatcgacagcactctaccgcaacctcacccggtgtgtccgcgctggccgcgctcacgggtgagggctacgccgaggaaacgggccgccacatcgcgtgtctggttgagtcgtgcccgcaccggttccacagagactacgatctctgggtccatatgagcggcaagcatcatttctccgaggaggaaacccgcgatctatttctgcggcgagccctgctcgcgcatgatttcggtgcgtctgcgtctgcttctgcttcctccgaggaactattcgggggtatctacggccttgaattcgataacgatcattcgtcgtatgatccgtatgtgttggacgggtccgagacgatagcgacttctggcgcggccgtgtcgaagccgttgcctgcgcatggcgccgatgtaatgatgcatgacaacagttctacgatacccactcctggtgatgatatggcgctgattgatcctgcactggcttacgatatgatggagtcgtag

SEQ ID NO: 9969 - DNA, 237 bp, A.fumigatus
  unsure (197): Identity of nucleotide sequences at the above locations are unknown.
acataccctgatttgcttgtcttcggctccggtggcaaggtacttgccgtcgggactgaagcagacgctgcgaatatacaggtctccatccttgtctacactttcgtcttgcaaggtagcgacgatctggccagtggtcacgtcgaagatctgagcggagcggttgcagcccgcggcgaggtggtccccgtcgcgantgagtcgggaagtcggccgtacagcgctagtatcaggggt

SEQ ID NO: 9970 - DNA, 252 bp, A.fumigatus
  unsure (41): Identity of nucleotide sequences at the above locations are unknown.
acccctgatactagcgctgtacggccgacttcccgactcantcgcgacggggaccacctcgccgcgggctgcaaccgctccgctcagatcttcgacgtgaccactggccagatcgtcgctaccttgcaagacgaaagtgtagacaaggatggagacctgtatattcgcagcgtctgcttcagtcccgacggcaagtaccttgccaccggagccgaagacaagcaaatcagggtatgttcactgttctcctaa

SEQ ID NO: 9971 - DNA, 543 bp, A.fumigatus
gattttgttctgagcgtgtgtctcacccccgatggacactgggtcatgagcggttccaaggaccggggtgttcaattctgggatcccatcactggaaatgcacagatgatgctccaaggacacaagaattccggtcagcacttcttcccttacttgtcttgccattctctgtggccgatctcgtcagttttccagtgtctaactgggttttacagtcatctcggttgctcccagccctacaggcaatttgttcgccacgggcagtggcgacatgcgggcgagaatctggaggtatgttttggcgttcaattcttattgctgatatggaaactaacaccggggtgtcgctggcagatactccacttataccggacggtaatgggcttgatgatgggaagcttcggcgcaaatgtgacttcttttgtttgtttgatccacaatgtcgtagcctctttgaacatggcctgggtttgtttctgcgttcaacctttgcaagggtctgtcctgtcccatcgcagcttcggattttcgtttcctcggtga

SEQ ID NO: 9972 - DNA, 360 bp, A.fumigatus
gtgtgggacattgcggcgcgtaccattaagcatatcttcaccggtcacgagcaagatatttactcgcttgacttcgctggcaacggtcgatacattgcttccggcagcggagacaagaccgtgcgtctctgggacatcctcgacggtaaactcgtctacactctcagcatcgatgacggcgtcaccactgtagccatgtctcccgacggccactacgttgcggccggctccttggataagagtgtccgtgtttgggacaccactactggatatctcgtggagcgtttggagagtcctgatgggcataaggataccgtttactcagtcgcctttggttcccaatggtcgggatctggttag

SEQ ID NO: 9973 - DNA, 204 bp, A.fumigatus
gggggccacgccaacgttgacactgtggttagcaacattcgtccagccaagacattactgggcgagcttgcgaagaccaaaacaaacactaaacagaaaaatgctcaacagaacccaacaagcgagcgagtcaagcaggaggtcgactcggacctgtccctgaatcatcaggctaaatgcaatctgcagtgctccgcgacctaa

SEQ ID NO: 9974 - DNA, 276 bp, A.fumigatus
gcatttttctgtttagtgtttgttttggtcttcgcaagctcgcccagtaatgtcttggctggacgaatgttgctaaccacagtgtcaacgttggcgtggcccccctacgacacgtggatagatgcatcctgtgataaagacttggatgctgattttatttttttatcattggataaagaagaaaactccaatgccgggagatcagacgtgtccgactccaacgcctacctgcaagtccttgatactttggcttcgtatgatctgtctgctggatag

SEQ ID NO: 9975 - DNA, 228 bp, A.fumigatus
actgatctcgtggctcagattgagcggagactcgcgccgttttggagaggactgaatgatttctcggagtcgtggactgagcatcaattgatggcagcagcgcgtggcctgccaataccaccaccagatgaaattcccccggagctggaatataagaaccctccgaaattgagtggagatgggaaggagcccagcattcagcacagtcttcaccgagggatgcgatag

SEQ ID NO: 9976 - DNA, 942 bp, A.fumigatus
agtctacgaaaagtgagtgcgctcgtctcatccattcccatagtcattgtgcttatggtctctaccagagtcggcatgatattgtctcgctacaagtccggacctcttcccaagcctttcaagattcttccctctgtccccaattggccaactcttctctctatcactcgccccgagtcgtggacagcgaacgctgtttatgccgggactaggattttcatatcatcgaagccagccgttgcacaggagttcatatcgacagttctccttgaccgcgttcgagaggagattcacgaaacaaagaagttaaatgttcatacctacaatgctctgaagaaagcgctgtacaagccagcttgctttttcaaaggcctgctgttcccactggtatcgagtggtacttgcactctacgggaggcgcacatcgtctcttctgtcatcgcacgtgtatctatcccagtattgcactccgcggctgctctacttcgcatgtgcgacctcgccgcagaacagtctctcagatctctcgaaagcacgggtgcggtcaatgtcttcatccgtgtgttcctcgagaagaagtacgcgcttccatataaggtgattgacgctctcgttttccattttctgcgcttccgcgcttgcgacaatgccgaggactcgatgatgaccgatggaccttctggggctgctacgaaagcgtataagcttcctgttctttggcaccagtcattattggtctttgcccaacgttatcgcaacgatatcactgaagatcagcgtgaagctctccttgacctgttgttagttcggggccacaaggatatcggccctgaggtcagacgggaattgttggcaggtagaggacgcggcgtggttgtacctgacccagaaaagcagggcgctctcgacgctggcgatgacacgatggatgtcacgttttag

SEQ ID NO: 9977 - DNA, 186 bp, A.fumigatus
ttgtgtaggaatgtctctgtgctacgcaacggcccgaacacaactcataagaacagtagcttctactccaagtttaacgccaaagatattggacatgtctcaatatctgagagtcctggaaggactgatacataccaaggggtcgcaccacccattctcaggtttcccaacgagtgtcaatggtag

SEQ ID NO: 9978 - DNA, 723 bp, A.fumigatus
ctttgctctgtctcttctgcagcggaggatcgtcgaaatatgcccagtctctgggggttcatcctggcgattttgggaatggtactggttctcagtatcatcatcctactatgttatcaattcgtgcagaagagacgccgactagccctcgaacgtcgtatctctgccggcgagacggatactgaaaattttgggctacatcatatcagggtttcgcgggaagttcttgatcagatccccacatacgtttattccgctgtcaacattccctcaaaagtatctttgagaagcagccctagtcaaacccagatcacactggcaagagccgatgatgcaagctcgatacgatctgttgaccccaaagagcctcgtctagtctacaaggagacagaaatgcaagcaagcagttccaccatcagactaccggaaactgcaattacgtgtcagagcagtcgacctccctccgcgcgagagtgcagcgactctgccagcaggtcacagcccacttgtgcaatctgtcttgatgactttgtctcgggaataacgatcgtacgggaacttccatgcggccatatctttcatccgagttgcatcgacgtttcgcttacgcagataagcagtctttgcccgctgtgtaagaaaagcgttctaccggcagaatactatacaacgcctgcggacgatatgggagtgcatcgggattatgtcgtgactgagcattga

SEQ ID NO: 9979 - DNA, 396 bp, A.fumigatus
atgcaactgttcagtgcgtctcaatcccaaacgcaggctatcgatctcgctagattcttctgccaatctacaaatatcgacatcagcattatccagacccaaaaaaaggaagaggcaagaaacctaccaagcaaacttgtcatgcttccccttaaccctcacatcgagcacctcttcatggaaagttccttccctcctcgccctcttcaacctcttcacctcatgctcctccagccgtctccccacaataccctccaactccttccgactaatcttctccctcgccttggtctccttgttcgctttgatacgcggcttgaatcgcgcctgcatgcgaacccgcagcgtcgtctcaaaaccaagactactcgcgtcgccgcgcacctcgatcacgcg

SEQ ID NO: 9980 - DNA, 189 bp, A.fumigatus
tgcttcatcgctagtcgtaagagagcatacatgcacagagtaacggaaggtattcgaccaatcctgccattggttttcgattcttccgatgacgtccgcatcatcaccttaattagacttaagtctcctagtaccaagtcctatcttagacctagtctctataacttcgtcaggtatcgtgttgcctga

SEQ ID NO: 9981 - DNA, 1518 bp, A.fumigatus
ttgagtgatgctaacacacctccagtgcgagggtcttccccacggagtatattatatctcattcggagcgccacaacttatatcatgtctcaagaatcccagttatcgcagacttcacttgctcctcctctggagctttcagggccagccactccggatcgacggccaagtctctctgcatcgcctgagctggatgaaaaagtccaagtccaggtttcccaagccgatcagcgcaagctcgtctcccccccttcattggcctcctcggacatgaccccacctccatcatcacaagtgcccggtgctcccctgcggcggtcaagatcacgatcgaccacatacctagcatctcctccagatattgaaaagactctgtgcgctgcatacggtgcctctgagaatcttccatctgtcggtgacattgacactgctggcgagcccgagctgcgtataatcgccaaagagctcctcagtgttgcgcaagaagctcgtatgtcggcgctgcatttcaaacttcagaatagccttctgtctttcacaagtaatgaagcaatcaagcgcgccgaagttgaacatcagttagcgaggcgggaggtggagattcttcagagttccgagtaccgaaatagacatggtccgaccgaggtgaaaccactgcaacctatctcgaacgcggagctggaggccgccctcaggcgtaatcaagagttggagagagtcaatgccactctcgatcgcagactgcgtcgcgcgaagaaactcattgagcaggagaaagaaaagtcagagctgctcatggaggagaataatctgctgaagaagcggattagagaaaaccgcgagcatttctctaggatgatcgaacgtggttccatgtcaccgagtcctcagatccaatcgggcacgcctcaaagaaagccagtcccccacttccatgacagccctagtccacacatgagccgaggtgaaagccatccgtttgatgcccttcttgctgcagacagagttctcaacagaggatcttctgatttccaatcatctccacaaaggtttagtcaaagacagcactctaatggccatgtgcggggcacccattcattgtcttcgctccccatgacaccgtcgcagcctcggacgaccccacgagaacatctgttcttcactcctaccaggaatactcagtatgagcagcgtgaccgcgacagcacgatatctgcctcggacatcgaagaagccgagacagaagaagacattccagcctctcaacctgattctcctgcaaccagcatggttcgtcccgaccctgtcatcagtcagcagcagactcgaagtgcggctattgccccgaagacgagcacattattgccaacaaaattgttcggccaggtgaggaatgctggcgtcgaccgtcctccgagtggactaaaacgcatagccagcattgacgaaagtgcggcctcgaagatatccaatgcggctgatggggtgggtcttggtattgaagcgtacacttcttaa

SEQ ID NO: 9982 - DNA, 237 bp, A.fumigatus
ctgatgttcaacttcggcgcgcttgattgcttcattacttgtgaaagacagaaggctattctgaagtttgaaatgcagcgccgacatacgagcttcttgcgcaacactgaggagctctttggcgattatacgcagctcgggctcgccagcagtgtcaatgtcaccgacagatggaagattctcagaggcaccgtatgcagcgcacagagtcttttcaatatctggaggagatgctag

SEQ ID NO: 9983 - DNA, 663 bp, A.fumigatus
tcctctacaagatcctcactgagcctactacagtcaccaaccatgtccgactccaatcctgacgaaacacacaaatgccagagctgcaaaaaggcagaatccaaaagtgttcccttgaggaactgcttccgatgcaaatcggccatttactgctctcgcgactgtcagaaagccgaccggaagactcacaagaaagtctgcgccagcaatgctcaagcaaacactggctccaacaaccagtctgcgagcgacactaacgccacccaatccaccaaagctctggaagttgacgacttcctgaagccgttttatcgcctccacgcaaagacctggctccatgaccacaccgaaaaggaaacctacaagctactaatcgatacctaccgtctccggctcgacgacgactacacgttctcaggggatattcacgaggataacatctatggcggagcaactgatgacggacgcgctggctttcgccggttcctgaagagcgttgaacgcaaaccccatctgctgccgaggtggtggaccccagccaaagcggaggaatgtatccggtacggcaagaattccacaaactggagctatcttgggtacacggtagagaagcacgacgttgtcgagcattacgcaaacaacttgatgccgatacagctgcgc

SEQ ID NO: 9984 - DNA, 351 bp, A.fumigatus
ctcgacagtccctttgaacgttcctggttggatttgccaaacatggaagggaatactgcggcgaatgctcagtcactgagcccggaaccttctgctagaggacctcgacaaaaatcgaccggaaaagcgaagagtgtggatcctgacaatggtccaacgtcaaagagacgctgcgtaagcacagcctgcatcgcttgtcggaggaggaaatcgaaggtaatgagctggcattttcgcttagtgctgtatctccatcatattcttaccaaatttctaccagtgcgatgggaatctgccgagctgtgccgcatgttcatccgtttatcatacaccctgtatggagagccctaa

SEQ ID NO: 9985 - DNA, 549 bp, A.fumigatus
  unsure (393),(395): Identity of nucleotide sequences at the above locations are unknown.
atttggattccaacagcctgggaactcgtaagcttgccgacgaagaattggatgcacgacgaatcacattttggggctgtttcctctttgataagtttgtccccccttttcaaatcacactttttcgggtgtatctctgacgaagacaggtgctggtctaactaccttggccgccagcctcaattattgacctcgcaggtttgcgtgccgaagatcgatatcttgcctaatgaggaggcagagctctggtccccatacacagattctggcccgagccaggacaacacacaaccttcgcggatcaggacagttgctttacagcttgccaagctcagtgagatcagcggcgatttgcttggttacttctatgacccgagcccaacggataggccngncaacaaacaagcggatcttaaaaagctcagcgagatacatactagacttgaagcctggaagaaaggcctacccaaggagttggaaacctcgagaaggccagcttcctcaggttcttgttatgcagtaagcaagcaagcactcagtccacaatga

SEQ ID NO: 9986 - DNA, 273 bp, A.fumigatus
tgtctggacccatcctccacgatcccgcctccactgcgggtcgaaaccccatggtgtgatcacacgctgtttacggagtacattcaattctatccgcaatttgcgatctgtgagtatacccagatgaatatgggcacgaagtttgcgtgtgtaaatctgcaatcgcaatcaaagcgatggagttcaggctccgagtcgcttctaactgctccccgacttaacatgcatgttctgatgtttctccaaccatttcaggttcggtcaacaccttaa

SEQ ID NO: 9987 - DNA, 1215 bp, A.fumigatus
  unsure (1166): Identity of nucleotide sequences at the above locations are unknown.
gcaagcaagcactcagtccacaatgagactctgccactaatgatcgttaatagcatgttttaccaactcctcttcatacacctttaccgcccgttcctgagatacaccaaatcctcctctcctcttcctcagcatgtctctcctcgcagaatatgcacacaagccgcagccaccatatcgaaattgctgcggatgtataaacgcacatatggcttcaaacaaatagttaatgtcgcggtctatattgcacatactgcttgcactatccatcttctcaatttacctgaaaaaaatgcacagagggacttaattcacggcctccgcaacttagacgagatgggcgagagctggctctgtgctcggcgcacgcttcgtattctcgacatatctgccaataactggcagattgagttgcctactgaagcttcgagcgtctttgagcaaacacacgcgaaatggggcccttggggctcatgggatcaagcagtatccccctcgacgtcggaagaatccccaccgaccgtttcggtacagcttccgtcttcagcttcggcttacataccaccagccccaggaggagcatcaataactcaacctggagtttctcctcaaaacctttcaacctcagcttcatatcaaggcaatcaacaatatcgttcagaagtctctttcccaacgtcgttatccgcgatgcgagcagctcatcgctcttttaccgctcagatttcacgagcagatgggcctctaccggagccaacctatcttaggcctgttcctcatagctaccgaccagtgcaggctttcccactaacacagcacgacgcttggtacaacggtcaagtgcgaaccttcagcacggacaagaacaccgcttcggctacagaggcttctccattgactggttttgacgagtcggagaatttagtggaagagagccatgactggtggtcccgcaaccccaatgcactcttaagcatggggacagaaaattgggagcaacgtctgaacccgagcttcaccgggccggcttcaagcatgcgctacgacaccagcgttctcaactccggacagtcatcaggaccggacagcacgccgggagcaccacaggccttcaggtaccccgttggtgtgcctcctaatctgaccgattcggaacaaggtcccancatctctggatataacaatataggtcttccgggcgatttccagcgatga

SEQ ID NO: 9988 - DNA, 1005 bp, A.fumigatus
cctcaaggtgtttacgatccaaattctgatcacagacgcaagggtgtgtacaaaaaggacacagccaacctcaggacgaaaaattcgactttacacactttgatccaggcactgctgaactacgatgaagaagacgcttttgacttagtccggcaaatacgatcctgtgacagtttggaagatgtggctgaatcgatcgtgagccgggacaaagggcccacacctggggaggtcttccccagcggagacgagtcttcgacgcatgaagatcaatttgtatctactttggcaggaagaatgggggagcttatgttggacggttcccgtaagtatattggaggcacgtccaacctcatctttctaccgtcagggtcagacctcaatgagttcgactcgagtctgaaggggcggccgttggaccgcagccatgagtactctgtcagtcggtggacgagagtcaccgatgacgagcaattgataagtcacctcatgacgatgtacttcacctggcattatcctttcttcaccactatccctaaagatctcttttaccgcgactatgtccgtggtgtttccagccaatactgctcgtcattactagtgaatgcgatgcttgctctgggctgtcattttagctcatggaaaggagctcgggcggatccgagcaattctgcgactgcaggagatcatttctttaaggaagccaaaaggttggttcttgagaatgacgagcatgagaatgcaaagctgtgcaccgtccaagcgttggcactcctatcagttagagaagctggttgcggtcgcgagggcaaaggttgggtttacagtggcatgagcttccgtatggcgttcgacctaggtctaaatttggattccaacagcctgggaactcgtaagcttgccgacgaagaattggatgcacgacgaatcacattttggggctgtttcctctttgataagtttgtccccccttttcaaatcacactttttcgggtgtatctctga

SEQ ID NO: 9989 - DNA, 267 bp, A.fumigatus
gcaagattatcatcatcactgcaaggacctacgaataaaaacgtcctcggccaatgggtagtgggtgcttgcgacgcagctcatgtgactggtgcctttgaacattctctcatcttccagcacagtgaactcccgatccagtacaagctccagtctctgctacggagtattagtagttcgattaaatccaacgccgagatagacgcagctaactctcgaggtggactaattctgagtgagtacgtacctaaccatcgcaaggcgtga

SEQ ID NO: 9990 - DNA, 222 bp, A.fumigatus
tccgtagtcaagcgccttaccattgggccagcaggccttgctgatgggaaaatcggtcttctttggcaacctaactctggaaagagagactcacaccggaaccaccgtgccgagtggggcactcgggaggatgaaatcgctcactccggtggaggacattattaccctcccacctcccactcgactgattcgctgattctgaatcacctccgccaattatga

SEQ ID NO: 9991 - DNA, 900 bp, A.fumigatus
ggtatttgtctcatcatcaacctacattcataccacatacctcccacttaccacttaccacaagcttcccggggtcgctgctgtagtgctgttcaccaacgaaccattatcctcaaaagcttcaagatggaaagcaagtggaaagacattgtcgcctcgtatcccccacaggcaatagaatttgtgggcacagttctcgttcaagttatctccttttggcttccatctctctgctacctctccttagacgccttgttcccgtccttctcgcaacggcacaaattgcaaccagcactcagacagcctggccgacgtgatatctggcaatgcttcgtggtagtcgtgcagaactcagtgttgtccatgggcctgcatctcttccagatttttgttctccaacgggggacttcagcgttccgaatccaagcctcgttgccacccctggccgaattccttcgtgacttcatcctgtgtattcttctgagagaggcgctcttctattacagtcaccgttttcttcacagtccattcttttacgccagaatccataagcggcatcataaattcacagcacccatcgcactggccgcgcagtacgcccatcccatcgaacacattgtggccaattcgcttccgattagtctgccaccgcaaatcctaggaagtcatatccttaccttctgggccttcctggcttacgaactcgccaataccgcgacagtacatagtgggtacgattttttcaagaacaaggcgaaaatgcacgacctgcatcatgaaaagttcaacttgaactatgggtctatcggccttttagattggctgcacgggactgataagcttgaaaaaaaacgaaaggatgttttcaccacaggaggcgcaggatcagcgctaaaatat

SEQ ID NO: 9992 - DNA, 1248 bp, A.fumigatus
tcgcgaatttcaatcggggatccggccaggtcggttggtgaaaacgacgatgaccgggaatccgatatcctcaacaactctgagagcctcctccaggttggaagcagacgcagacttggcgcacttctcgttgatggactccatgcttcgagcaaacaactcacggtcctcggtcgtgatgatggtgtcaatgggcgtaccaaggaccttgacaccgagggattcaaactcatccttgagctggataccgacttgaagggcggtctgaccaccaaatgtgacatagatggcatcagggcgctcgtgcttgatgaccttgcgcacgaactcggcgttgaccgggaggaagtaaaccttatccgcaagacccttggaagtctggatagtggcaatattgggattgatgaggatagtgtagattccttcttccttcaaggccttgatagcctggctaccagagtagtcgaattctccagcctgaccaatgctgaggccaccgcttcccaggatcaaaaccttcttgacagagacacgtggcgatgtcttgatgttctctgccttcgttccgccagggaaagagacaggcttctgaagagcatcagaagaggtaagagtgtccttgatagtgttgatgaacacatcgaagaggtactcagtgtcccggggaccaggagtgctttcgggatggaattgtacactgaagaaagggcggctcacatgccggataccctcattgctgccatcgtttgcgttgacgaaaagttcctcccagccctctgggagagtcgaggaatcgacagcgtaaccgtgattctgggaggtgatgtggcacttgcccgacagcatgctggtacaggggatgttgtgaccgcggttaccgaacttcatcttgagcgtctgggcaccaacggaacgagcaatcaactggtggcccaagcaaataccaaagacaggagttctggcctccttcagggtcttggacagattgttcacagtttcagagagcatcgctgggtcaccaggaccgttcgacacaaacagaccgtcgtagtccttgccggcaagcttggggaaatcgtagtcccacggcacaacgagaacctcaacaccacgagcaagcaagcaacgcagctggttgaacttcataccaacgtccaagcaaaggacacgaaccgggcggccagatgggtgtttgagtgcgacattctcggggggtgtgaaaaggcgaggctcacggatcgaaactga

SEQ ID NO: 9993 - DNA, 861 bp, A.fumigatus
agtgaaccccttgccaatttgtccccgagaggacctttccctcccccatcagagaccgcaatgccacagtctgccggtaacgacgaggtcgctctcccctccagccctttgtctggaggggctgtgtcctacaatcagatcaacaaagaactacagccactcccatcaatggattcaggaaatggagccgtgattccgccagcttctgcccgagtaagaggcagcagcggcaagatgttcgccctcgaacttgaggatggcacaatctaccagggctacagctttggtgctgacaagagtgtggcaggagagttggttttccagaccggtatggtgggatacccagagtcgatcactgatccctcctaccgcggtcagattctggtcatcactttccctctggtgggcaactacggtgtgccctcccgtgagaccatggacgagcttctgaagacattgcccaaatattttgagtctacagagatccatgttgcggctctcgttgttgcaacgtacgccggagaggattactctcacttcctcgccgagtcgtccctcgggcagtggctcaaggagcagggcgtccccgccatgcacggagtggacacccgtgctctgactaagcgcatccgtgaaaaggggagcatgctcggccgcatgatgctttcaaagtctgaaatcgccgatggtgtcgtggagatgactccaggtgacaaagacagctggaggtcatccttcgaacaggtcgaatgggtagatcccaacaagaagaacctcgtgagtgaaggtagggtttttaacaccagaaacgcactcttgaagggttcgatatctgacatagtcctcagtttcgatccgtga

SEQ ID NO: 9994 - DNA, 1242 bp, A.fumigatus
tcctcagtttcgatccgtgagcctcgccttttcacaccccccgagaatgtcgcactcaaacacccatctggccgcccggttcgtgtcctttgcttggacgttggtatgaagttcaaccagctgcgttgcttgcttgctcgtggtgttgaggttctcgttgtgccgtgggactacgatttccccaagcttgccggcaaggactacgacggtctgtttgtgtcgaacggtcctggtgacccagcgatgctctctgaaactgtgaacaatctgtccaagaccctgaaggaggccagaactcctgtctttggtatttgcttgggccaccagttgattgctcgttccgttggtgcccagacgctcaagatgaagttcggtaaccgcggtcacaacatcccctgtaccagcatgctgtcgggcaagtgccacatcacctcccagaatcacggttacgctgtcgattcctcgactctcccagagggctgggaggaacttttcgtcaacgcaaacgatggcagcaatgagggtatccggcatgtgagccgccctttcttcagtgtacaattccatcccgaaagcactcctggtccccgggacactgagtacctcttcgatgtgttcatcaacactatcaaggacactcttacctcttctgatgctcttcagaagcctgtctctttccctggcggaacgaaggcagagaacatcaagacatcgccacgtgtctctgtcaagaaggttttgatcctgggaagcggtggcctcagcattggtcaggctggagaattcgactactctggtagccaggctatcaaggccttgaaggaagaaggaatctacactatcctcatcaatcccaatattgccactatccagacttccaagggtcttgcggataaggtttacttcctcccggtcaacgccgagttcgtgcgcaaggtcatcaagcacgagcgccctgatgccatctatgtcacatttggtggtcagaccgcccttcaagtcggtatccagctcaaggatgagtttgaatccctcggtgtcaaggtccttggtacgcccattgacaccatcatcacgaccgaggaccgtgagttgtttgctcgaagcatggagtccatcaacgagaagtgcgccaagtctgcgtctgcttccaacctggaggaggctctcagagttgttgaggatatcggattcccggtcatcgtcgttttcaccaaccgacctggccggatccccgattga

SEQ ID NO: 9995 - DNA, 432 bp, A.fumigatus
aggaagaaggaatctacactatcctcatcaatcccaatattgccactatccagacttccaagggtcttgcggataaggtttacttcctcccggtcaacgccgagttcgtgcgcaaggtcatcaagcacgagcgccctgatgccatctatgtcacatttggtggtcagaccgcccttcaagtcggtatccagctcaaggatgagtttgaatccctcggtgtcaaggtccttggtacgcccattgacaccatcatcacgaccgaggaccgtgagttgtttgctcgaagcatggagtccatcaacgagaagtgcgccaagtctgcgtctgcttccaacctggaggaggctctcagagttgttgaggatatcggattcccggtcatcgtcgttttcaccaaccgacctggccggatccccgattgaaattcgcgaa

SEQ ID NO: 9996 - DNA, 300 bp, A.fumigatus
gtcctggttgacggtccttccaccgaggagaacaagatcgttccccgtcacgctcttcctctcgctcacgccactctcacccccttcgtcattcccaaactcccccgcgctgccggcactggccccgtcaagaagctctgggagaagaacgagatcgatggaaagtgggctaagagcaccattgctcagaagactgagcgcgctgagcggaggaagaaccttaccgacttcgagcgcttcaaggtcctcagactcaagaagcaggtacgttcagtttgcgaaactatgggagaattgtga

SEQ ID NO: 9997 - DNA, 228 bp, A.fumigatus
gaacacggcccatttgcgcgacaaaaacagtccatatatcgggtttctgcaaggcagagcccaaatctgaaagagcaggagctaatacgtcgtctgcagatcctcttcgtcatcaaccagcccgatgtctaccgctctccctccagcaacacctggatgtatgtgccttacggttctttcgatgcggtctatcgtcttcaccaacggggccgccggatcagcgcatag

SEQ ID NO: 9998 - DNA, 477 bp, A.fumigatus
accgcaaaaatggctgatccccgtgttgaagagctccctgacgaggaggttcccaaggccaacgtcgaggatgctggcagcgactctgagtccgaggctggtgaggagtccagcatccccgctggcgccgccgtcaccatccactcccgtaacgagaagaaggccagaaaggctattggcaagcttggcctgaagcacgttcccggcatcactcgtgtcaccctccgcagacccaagaacgtaagaacacggcccatttgcgcgacaaaaacagtccatatatcgggtttctgcaaggcagagcccaaatctgaaagagcaggagctaatacgtcgtctgcagatcctcttcgtcatcaaccagcccgatgtctaccgctctccctccagcaacacctggatgtatgtgccttacggttctttcgatgcggtctatcgtcttcaccaacggggccgccggatcagcgcatagaggta

SEQ ID NO: 9999 - DNA, 789 bp, A.fumigatus
aatcaaagccatcagaaccggttccaacgtgccaacaccttccaatttccatttaagggtgggacgtcctctatcgacggtaatgtgtgcgttgcctctttagtggatacgaaagatgtcattcttcggaactttgggcgacctgtccaagctgtcgcactatcaccagaatacaagaatgatcgaacattcttgtctggagggcgagcgggtgatctgattcttacgactggtggacgagtgggtgtgagcacgaactcaacgacaatgggaggcgccgcagctgcagcgtccagctggcttggatcgattgggctgggagccaataccggcaaggacaccatattacacagcggggagggtgctatcagcacgattaaatggtcattgtcggggaaatacgtcgtttgggtcaatgaagaagggatcaaaattatgcggtcgaacttacatctggactcagctgactctgagcttgcttggaaacgaattagccacattgaccgtccgaacggccctggatgggaagaaatggccagcgtctggagagctcgagctgaatgggtggacgaagattctcttcgctgggaggataatgtgaattcccagcaggacgaacctcatcttaacaccccggccccgccggatatagttgcgatgaaggagaatgtagagaggctcgtcgtgggttggggagggactgtttgggtcattaatgtgtatcccgaccggccaaacaaaaacaataaggacctgaagataggatctgtccaagtctccaccatgtga

SEQ ID NO: 10000 - DNA, 801 bp, A.fumigatus
gaatttgacgaaatctcttctgttattccggcagattttcatccgtccttgtcgcaggacatatatgaagaaatcctgggtcattatgtctctcgagatcggcacagattcagcgaactcttggatacctggcctttcactctgtttgatgttaatagtgtcacaacagctgtcgaggaacagttggatccaaggacggtgtcacctgagacagaggactggcggatactaaccaaatgcctggccaagctctatctggccggaggtcattataacgaagcattgcactgttacattcgactacaggatgcggacactgccatggctttgatcaaggagcaccgtttgctggacgctctttcagatgatatccctgcatttatcatgattcgagtttccaagcaacagatgaaaacagctccactttccgaactggaagagataactgccgagccaatcaagcttctcgtcagcgaagcatatactggaattgtgcgccctgaggtcgtggtcactcagcttaaagatgcaaatcggcttctctttctttatttctacctccgcgctctctggcgaggagaatcgcttccacacagcgctgcaaagccacgcagaggtcacggtgctcgagttcgggacgcagcaagcaaactagcagcagatgaggggaaggcgctagttgataatttcgctgataccgctgttggaacttttggcgactatgaacgtccatggttgatgggattcttggaggtttaccacgcgtactcctttgaacacaccgttgctgttctgcgataa

SEQ ID NO: 10001 - DNA, 195 bp, A.fumigatus
agacgtgagattctcatatcgactaactgtaagcgtatcagcgctgagctcttctttcgtatcaatatcaataatgcgaagctcgggttccaggccccggggacggcggtgtgtgcgaggacgaagaacgccgtgcttcgtccgctcttccgaaacattctcttcctcggcctcaatatatgcaagaacagctaa

SEQ ID NO: 10002 - DNA, 396 bp, A.fumigatus
tcgagacacagagattgcgtgccgctcgtcgaccttctcggaatcatcttccaaatccgcgatgactaccagaacctgcagagcgacttgtatgctaagaacaaagggtttggtgaagacatcaccgagggcaaattctcctaccccattatccacagcattcgcagtgatccgagtaatttccagttgatgaatatcctgaagcaaaagacagaggacgaagatgtcaagcggtacgctgttcgcattatcgagtccacaggaagcttcgatcattgccgcaagaaactggcgaatctgacggcagaggcgagagaaatcctgaaggactttggtgatctaggcaacacagatggcttgaagggtatcctggactttctggagctgaaggggtag

SEQ ID NO: 10003 - DNA, 198 bp, A.fumigatus
gccatgcaacagtcttctgaaagtcgcagccctaacatctgcgactactggactgttaacggagtggggactaaagagttcaggaacagcgccaggacgtatttctacgcattgtctctgaccgaggaggcgcaacaaaagtacgaaacacgagggcagtcgacaacagcatctctgtcttctcaaccatctcgatga

SEQ ID NO: 10004 - DNA, 183 bp, A.fumigatus
acgtgggactctctccattcgccattctacttttttgttgtcgtttctcattcaataggcgcatactctatgagatacccgggaatctgtacttatgaacccctaggaaatgggactttgctgcatgtaatctacatcattgtatttagtgacagcattatcacgaggacagggcccatttaa

SEQ ID NO: 10005 - DNA, 228 bp, A.fumigatus
tcctatgtaattgctgcatttcccttctcccctcatgatccagataataacctccctctcctccgtctccagcccatgagcattcgccgtgtctccacgttcttcgatacttctctctcctgctatctattcttcttcggtcagatcttcgctgcagtttttgccccagcgctatcagtcgctcccctccatttcaattctttgcaaattcgccatgactatcggtga

SEQ ID NO: 10006 - DNA, 534 bp, A.fumigatus
gcattcgccgtgtctccacgttcttcgatacttctctctcctgctatctattcttcttcggtcagatcttcgctgcagtttttgccccagcgctatcagtcgctcccctccatttcaattctttgcaaattcgccatgactatcggtgacattgtctccgatccctcattgctacccgtgttgcgtacttgcgccgagacgcgggaacaatgcgagaagcttttatccttgttagatcccacgacacagtctacttcatccgaccccgaacaggcgcttctagctgcctctaaacagcagaagcagctttttgcccttctagcccagctccgcggtcaaagtcgggatgctattcttcgggttcgccagacaaaacaacttacagcagaagctcggcaagagatcgatcgattgcatctgcaactgcagaatctgtattatgaacagcggcatctgaccggagaaatcgctgcttgtgaatcatatgagtatgtggaccgttgtttgacgttcattcagcccccttgcaattaa

SEQ ID NO: 10007 - DNA, 1398 bp, A.fumigatus
cagcctcgcggcgcagcaaaacaacatgctcgcagagtggctgcgaagctcggtgtctcgtctggtctaatttaccttgttggtcagcctacaattaattggggagattcagatcagccgcgtccgttccgacaaaggcgatacttctactaccttagcggggttgaagaggcggactgctatctgacgtatgatatcaagaatgatctcttgacgctttatgtgcccgatttcgacttgcaccgggccatatggatgggaccgactttgacagtgaaagaagctcgagaacggtacgatgtcgatcaagtgcggtaccatgcgtctctcaagggtgacatccagcgatgggcggataactacaacaagacgagtctcttatatattcttcatgatacccagaagccccaggtgctgtcaaatgaacttcgcttagatgacgaattgctgttaccagccatggatgcagctcggggcatcaaagatgagcatgagattcggatgattcgagaagcgaacagagtatctgctctggcccaccgcaaggtgctcgaaaatgttctccgaatgtcgacagaggcagagatcgaaggtctttttctagacacctgcatctcccatggagcgaaaaaccaagcatatgagatcatcgctgggtcaggggagaatgcggccgttcttcattatgtgaagaataatgaaccgcttcaaggaagacagctggtctgtctggacgcaggtgccgagtggaactgctacgccagtgacgtaacccggacctttcccctggccgctgactggcccacagcgcgggccagggacatttaccagctggtagaagagatgcaagaggaatgcatcaagcgtatacagaaaggtgtgcgatttctagacctacaggtcctggcacacgtgattgcaattgaagggttgatgcgactaggcatcctcaagggcggctcggtagaagaaatccgcgagtccggggcatcgaccgtctttttcccgcacggattgggccatcacgtcggactcgaagtacatgacgtgtctgcgaaacggctcacagctgttgagggggacaaggaatactacagctcgatattggtaccgtctatgagccattgtccctgtacactttccgcaccattattggaggaaggtatggtggttacagtcgagcccggcatctacttttcccggctggctctggcgaatgcacggaagctggcctttgcaaagtatataaactttgacgaggccgagaaatacattccaattggtggtgtgcgcattgaggacgatattttggtgaccagctctgggcacgaaaacctgactacagctcccaaaggggaagaaatgctagagatcatccgtcgggggatcgacagttag

SEQ ID NO: 10008 - DNA, 261 bp, A.fumigatus
  unsure (103),(118),(128),(130),(226): Identity of nucleotide sequences at the above locations are unknown.
tataacctttcatcaaaaatagtcggaccatacggcatgatcacatttgccactctgaatggcattagtattgagaattggcgaaattggacatggcattatntggcgcatttggtancggaattttntnttttgtcttgctccgactttccggaataccccttttttttctgtcggagtcataccactttttttaataaagggggaagaaaaaatgtaattaccnttaaaaccttaaaaaatttcctgtggattggaata

SEQ ID NO: 10009 - DNA, 222 bp, A.fumigatus
ggtgggtggataacgatagcgctgatcttcgcccctggggtgatgaccattgtgtccacgctgcaagcgggctgcttctttggagcccttatcgcttcgcaggtggctgatcgctggggaagaaagcccggtctgatatcggcatcgattatgtcgatcgttggtgtgatcatgcaggttgccgccagtggccacctggaagccatgtacataggacggtga
